United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 62

SEQ ID NO: 2205688 - RNA, 18 nt, Human
gagucccaggcugagccu

SEQ ID NO: 2205689 - RNA, 23 nt, Human
gccugaguguugccuaauuuguu

SEQ ID NO: 2205690 - RNA, 18 nt, Human
ugugaccacugcagaaga

SEQ ID NO: 2205691 - RNA, 18 nt, Human
acaaaugcauuucuaaag

SEQ ID NO: 2205692 - RNA, 17 nt, Human
gcuauugggguuggggg

SEQ ID NO: 2205693 - RNA, 21 nt, Human
cccccucuggcuccagcuggc

SEQ ID NO: 2205694 - RNA, 21 nt, Human
ugcccauccugccccugagcc

SEQ ID NO: 2205695 - RNA, 13 nt, Human
aaaaaugguuuaa

SEQ ID NO: 2205696 - RNA, 21 nt, Human
aagacucgggauuaguacaca

SEQ ID NO: 2205697 - RNA, 15 nt, Human
uuacagagacagaaa

SEQ ID NO: 2205698 - RNA, 19 nt, Human
uaucacuugucaauaaaau

SEQ ID NO: 2205699 - RNA, 12 nt, Human
cauaaaguaugu

SEQ ID NO: 2205700 - RNA, 13 nt, Human
gagcuaggggggu

SEQ ID NO: 2205701 - RNA, 18 nt, Human
acaggauggcaggaggca

SEQ ID NO: 2205702 - RNA, 22 nt, Human
agacucgggauuaguacacacu

SEQ ID NO: 2205703 - RNA, 17 nt, Human
cgcucaucccacccgcc

SEQ ID NO: 2205704 - RNA, 19 nt, Human
ucccagaucaagccugccu

SEQ ID NO: 2205705 - RNA, 21 nt, Human
guauacugugugcuaaaacaa

SEQ ID NO: 2205706 - RNA, 19 nt, Human
auaucaguuauuuuuaaac

SEQ ID NO: 2205707 - RNA, 16 nt, Human
aaaaauuccaagugau

SEQ ID NO: 2205708 - RNA, 20 nt, Human
ucauucacucaacaaacaua

SEQ ID NO: 2205709 - RNA, 19 nt, Human
guacaagagcuuaacagug

SEQ ID NO: 2205710 - RNA, 15 nt, Human
uuuuaggaauacaua

SEQ ID NO: 2205711 - RNA, 16 nt, Human
gcugcugguggcgcug

SEQ ID NO: 2205712 - RNA, 22 nt, Human
aauugacccacaagaaaugaaa

SEQ ID NO: 2205713 - RNA, 13 nt, Human
agccuccagcugc

SEQ ID NO: 2205714 - RNA, 19 nt, Human
auccugugggaccugggcc

SEQ ID NO: 2205715 - RNA, 12 nt, Human
ucuacacuccag

SEQ ID NO: 2205716 - RNA, 22 nt, Human
caguauggcagcuuuccucaaa

SEQ ID NO: 2205717 - RNA, 16 nt, Human
cugcacuccagccuga

SEQ ID NO: 2205718 - RNA, 22 nt, Human
auauaugcuaagucuuauauau

SEQ ID NO: 2205719 - RNA, 18 nt, Human
uaaugaauacuuuauaaa

SEQ ID NO: 2205720 - RNA, 14 nt, Human
caggaggcauccaa

SEQ ID NO: 2205721 - RNA, 12 nt, Human
ccccuugccaua

SEQ ID NO: 2205722 - RNA, 15 nt, Human
ucaaaggacaccauu

SEQ ID NO: 2205723 - RNA, 14 nt, Human
cuaaacauaugaau

SEQ ID NO: 2205724 - RNA, 21 nt, Human
cggcuccggacgcugcugccg

SEQ ID NO: 2205725 - RNA, 20 nt, Human
cucccugccccccagcccuc

SEQ ID NO: 2205726 - RNA, 18 nt, Human
uaucccaaccucucccaa

SEQ ID NO: 2205727 - RNA, 22 nt, Human
agaugaucaguaugaaaauguc

SEQ ID NO: 2205728 - RNA, 12 nt, Human
gaugcugagccc

SEQ ID NO: 2205729 - RNA, 12 nt, Human
acacuuaaaaau

SEQ ID NO: 2205730 - RNA, 21 nt, Human
gcucccaggaggggcuucugg

SEQ ID NO: 2205731 - RNA, 19 nt, Human
ccgcagggugaacugcagc

SEQ ID NO: 2205732 - RNA, 15 nt, Human
uccauccugaggcuc

SEQ ID NO: 2205733 - RNA, 23 nt, Human
ugcauagguuuaauaauuuuuaa

SEQ ID NO: 2205734 - RNA, 20 nt, Human
ggguuccuuccucugagccu

SEQ ID NO: 2205735 - RNA, 16 nt, Human
uauaucaauuuaaaaa

SEQ ID NO: 2205736 - RNA, 22 nt, Human
cuccagccugagcgacagugag

SEQ ID NO: 2205737 - RNA, 16 nt, Human
accuguucgcgcgccu

SEQ ID NO: 2205738 - RNA, 20 nt, Human
cugcacacagcacgggggcc

SEQ ID NO: 2205739 - RNA, 23 nt, Human
agggcgcggggcggggagcgagc

SEQ ID NO: 2205740 - RNA, 20 nt, Human
uaagugaaauaagccagaca

SEQ ID NO: 2205741 - RNA, 17 nt, Human
cagacaucaacagauaa

SEQ ID NO: 2205742 - RNA, 17 nt, Human
auguugacaugggacau

SEQ ID NO: 2205743 - RNA, 17 nt, Human
auguuuacagaucccca

SEQ ID NO: 2205744 - RNA, 19 nt, Human
cgccacgcucugggucgcc

SEQ ID NO: 2205745 - RNA, 15 nt, Human
cagccagcacagccu

SEQ ID NO: 2205746 - RNA, 18 nt, Human
cagaucaagccugccuca

SEQ ID NO: 2205747 - RNA, 21 nt, Human
aaaugucuugcuugauuguau

SEQ ID NO: 2205748 - RNA, 15 nt, Human
ccuguucgcgcgccu

SEQ ID NO: 2205749 - RNA, 17 nt, Human
ccugagcuugcagagau

SEQ ID NO: 2205750 - RNA, 16 nt, Human
agucucuaucauuaaa

SEQ ID NO: 2205751 - RNA, 21 nt, Human
cuccccagcucuaucccaacc

SEQ ID NO: 2205752 - RNA, 14 nt, Human
cgcgcccucuggcu

SEQ ID NO: 2205753 - RNA, 14 nt, Human
ugcucauggaauug

SEQ ID NO: 2205754 - RNA, 19 nt, Human
cagauccccaagccuggca

SEQ ID NO: 2205755 - RNA, 22 nt, Human
gagucccaggcugagccucagu

SEQ ID NO: 2205756 - RNA, 13 nt, Human
auccugaggcucc

SEQ ID NO: 2205757 - RNA, 16 nt, Human
cuagaacucccuuuca

SEQ ID NO: 2205758 - RNA, 22 nt, Human
cagcucuaucccaaccucuccc

SEQ ID NO: 2205759 - RNA, 15 nt, Human
aaugauuaugaauua

SEQ ID NO: 2205760 - RNA, 15 nt, Human
uucccgugugccuga

SEQ ID NO: 2205761 - RNA, 15 nt, Human
gcagcucaggcuggc

SEQ ID NO: 2205762 - RNA, 18 nt, Human
gcuccauuuuuagugaaa

SEQ ID NO: 2205763 - RNA, 16 nt, Human
ugcucgcccacuuccu

SEQ ID NO: 2205764 - RNA, 11 nt, Human
ggguugggggg

SEQ ID NO: 2205765 - RNA, 15 nt, Human
cccccagcccuccuu

SEQ ID NO: 2205766 - RNA, 13 nt, Human
gggcggcggcccu

SEQ ID NO: 2205767 - RNA, 14 nt, Human
acacugaagaagca

SEQ ID NO: 2205768 - RNA, 21 nt, Human
ccucccuuggggccuaugcag

SEQ ID NO: 2205769 - RNA, 15 nt, Human
auuauuuuuuaaaaa

SEQ ID NO: 2205770 - RNA, 15 nt, Human
ccaacuauaaaacua

SEQ ID NO: 2205771 - RNA, 12 nt, Human
acucccugcccc

SEQ ID NO: 2205772 - RNA, 19 nt, Human
gguuuaauaauuuuuaauu

SEQ ID NO: 2205773 - RNA, 22 nt, Human
uauuucuaugaaauauuauguu

SEQ ID NO: 2205774 - RNA, 12 nt, Human
cuaagaagugaa

SEQ ID NO: 2205775 - RNA, 21 nt, Human
auauaugcuaagucuuauaua

SEQ ID NO: 2205776 - RNA, 16 nt, Human
guuuuguuucuuccuu

SEQ ID NO: 2205777 - RNA, 20 nt, Human
cagguaccuucucaccugug

SEQ ID NO: 2205778 - RNA, 18 nt, Human
gaaaauaacaauaaaaga

SEQ ID NO: 2205779 - RNA, 17 nt, Human
acuaguuguaauuuuuu

SEQ ID NO: 2205780 - RNA, 15 nt, Human
auuucauucaauauc

SEQ ID NO: 2205781 - RNA, 17 nt, Human
guauuauuuuuuaaaaa

SEQ ID NO: 2205782 - RNA, 22 nt, Human
cuaagcuucacuguaaaauaau

SEQ ID NO: 2205783 - RNA, 21 nt, Human
uauuacuguaagaaaauauca

SEQ ID NO: 2205784 - RNA, 18 nt, Human
acaagccuccuuuuaaag

SEQ ID NO: 2205785 - RNA, 18 nt, Human
gaugcaguucugaagaag

SEQ ID NO: 2205786 - RNA, 12 nt, Human
uuuuuuuuaaaa

SEQ ID NO: 2205787 - RNA, 15 nt, Human
cagcgaguacuuccc

SEQ ID NO: 2205788 - RNA, 22 nt, Human
caagcucuaucaccaaggagcc

SEQ ID NO: 2205789 - RNA, 13 nt, Human
aucaagccugccu

SEQ ID NO: 2205790 - RNA, 14 nt, Human
guaacuaauuuuaa

SEQ ID NO: 2205791 - RNA, 17 nt, Human
ugaaaaucuuauaauuu

SEQ ID NO: 2205792 - RNA, 15 nt, Human
uuuaugguuguauua

SEQ ID NO: 2205793 - RNA, 23 nt, Human
aauauuuauuuuaauaauguuuc

SEQ ID NO: 2205794 - RNA, 11 nt, Human
cuguuuuauaa

SEQ ID NO: 2205795 - RNA, 12 nt, Human
gcauccuagucu

SEQ ID NO: 2205796 - RNA, 16 nt, Human
aagguccuggcaaaga

SEQ ID NO: 2205797 - RNA, 17 nt, Human
ccuacuuccccuuccua

SEQ ID NO: 2205798 - RNA, 23 nt, Human
gccccugcacuccagccugagcg

SEQ ID NO: 2205799 - RNA, 12 nt, Human
cuacaagacaca

SEQ ID NO: 2205800 - RNA, 13 nt, Human
auaacuggaaacu

SEQ ID NO: 2205801 - RNA, 18 nt, Human
ccacuuggucugugagau

SEQ ID NO: 2205802 - RNA, 14 nt, Human
ccugccccccagcc

SEQ ID NO: 2205803 - RNA, 22 nt, Human
cacuaguauuucuaugaaauau

SEQ ID NO: 2205804 - RNA, 15 nt, Human
cuucaacucccugcc

SEQ ID NO: 2205805 - RNA, 15 nt, Human
ugagcgcccacuaga

SEQ ID NO: 2205806 - RNA, 13 nt, Human
ggcuccugagaca

SEQ ID NO: 2205807 - RNA, 15 nt, Human
caaggaaaaaauaac

SEQ ID NO: 2205808 - RNA, 15 nt, Human
cagaauucauucacu

SEQ ID NO: 2205809 - RNA, 14 nt, Human
ucuaucccaaccuc

SEQ ID NO: 2205810 - RNA, 17 nt, Human
cuacacuccagugagac

SEQ ID NO: 2205811 - RNA, 20 nt, Human
cugcacuccagccugagcga

SEQ ID NO: 2205812 - RNA, 16 nt, Human
uuuauauuugaaauau

SEQ ID NO: 2205813 - RNA, 19 nt, Human
cauccaaaggcuccugaga

SEQ ID NO: 2205814 - RNA, 15 nt, Human
cuaagugcagccccg

SEQ ID NO: 2205815 - RNA, 14 nt, Human
aaugauuaugaauu

SEQ ID NO: 2205816 - RNA, 15 nt, Human
ugcagauaaacagua

SEQ ID NO: 2205817 - RNA, 22 nt, Human
cccccugcaaagcccagcuuga

SEQ ID NO: 2205818 - RNA, 15 nt, Human
cuuccucccggccgc

SEQ ID NO: 2205819 - RNA, 19 nt, Human
aggucuaccaaaaaucuca

SEQ ID NO: 2205820 - RNA, 18 nt, Human
gcacuccagccugagcga

SEQ ID NO: 2205821 - RNA, 18 nt, Human
acugugugcuaaaacaag

SEQ ID NO: 2205822 - RNA, 23 nt, Human
ccccucuggcuccagcuggccgg

SEQ ID NO: 2205823 - RNA, 20 nt, Human
ugagagugaacaaauuuaca

SEQ ID NO: 2205824 - RNA, 20 nt, Human
uguaagaaaauaucacuugu

SEQ ID NO: 2205825 - RNA, 19 nt, Human
uaucucauuuccaagcaag

SEQ ID NO: 2205826 - RNA, 17 nt, Human
gcucggccugcucgccc

SEQ ID NO: 2205827 - RNA, 23 nt, Human
aauaauccucaguuuuugugaaa

SEQ ID NO: 2205828 - RNA, 16 nt, Human
ccuaugcagaggucca

SEQ ID NO: 2205829 - RNA, 19 nt, Human
aauguuuacagauccccaa

SEQ ID NO: 2205830 - RNA, 21 nt, Human
auccugugggaccugggccau

SEQ ID NO: 2205831 - RNA, 22 nt, Human
aguauguuagugcaaauuguca

SEQ ID NO: 2205832 - RNA, 21 nt, Human
ccugaucaccugcccugcuga

SEQ ID NO: 2205833 - RNA, 17 nt, Human
auaauuuaaauauaugc

SEQ ID NO: 2205834 - RNA, 20 nt, Human
augguuuagaaagcuugccc

SEQ ID NO: 2205835 - RNA, 21 nt, Human
aggcauccaaaggcuccugag

SEQ ID NO: 2205836 - RNA, 20 nt, Human
uagucucuaucauuaaaguu

SEQ ID NO: 2205837 - RNA, 19 nt, Human
gcuguuccucgccacgcuc

SEQ ID NO: 2205838 - RNA, 18 nt, Human
acggcuccggacgcugcu

SEQ ID NO: 2205839 - RNA, 22 nt, Human
uucauucacucaacaaacauaa

SEQ ID NO: 2205840 - RNA, 15 nt, Human
cacaggacagcccuu

SEQ ID NO: 2205841 - RNA, 23 nt, Human
auguuaaaacugggacaggggag

SEQ ID NO: 2205842 - RNA, 17 nt, Human
acuaggugcugcagccc

SEQ ID NO: 2205843 - RNA, 17 nt, Human
ccugcucgcccacuucc

SEQ ID NO: 2205844 - RNA, 22 nt, Human
cucuggccuucggccuccaucc

SEQ ID NO: 2205845 - RNA, 14 nt, Human
acaaauccaaugaa

SEQ ID NO: 2205846 - RNA, 18 nt, Human
ugcugcagccccugggac

SEQ ID NO: 2205847 - RNA, 21 nt, Human
uuccuaauuccacagcugcuc

SEQ ID NO: 2205848 - RNA, 12 nt, Human
uccaaagggcau

SEQ ID NO: 2205849 - RNA, 21 nt, Human
ucagccagcccucuucugaca

SEQ ID NO: 2205850 - RNA, 17 nt, Human
caaacauauauaacaau

SEQ ID NO: 2205851 - RNA, 15 nt, Human
uuauuuuuaaacugu

SEQ ID NO: 2205852 - RNA, 23 nt, Human
uccaaacugacucuuaagaagac

SEQ ID NO: 2205853 - RNA, 24 nt, Human
gucgcaggaccaucccggccggcg

SEQ ID NO: 2205854 - RNA, 16 nt, Human
uacaaaugggaaacaa

SEQ ID NO: 2205855 - RNA, 20 nt, Human
aaaaaccugagccccaaaag

SEQ ID NO: 2205856 - RNA, 21 nt, Human
gaaaacaauaacgauaaaaga

SEQ ID NO: 2205857 - RNA, 23 nt, Human
cacagauuugagcucagcccugg

SEQ ID NO: 2205858 - RNA, 13 nt, Human
uaauuuuuauauu

SEQ ID NO: 2205859 - RNA, 13 nt, Human
uuuagugaaauau

SEQ ID NO: 2205860 - RNA, 15 nt, Human
gccuaauuuguuuuc

SEQ ID NO: 2205861 - RNA, 14 nt, Human
ucccaacuauaaaa

SEQ ID NO: 2205862 - RNA, 12 nt, Human
gcucagcccugg

SEQ ID NO: 2205863 - RNA, 13 nt, Human
aucucaauauuuc

SEQ ID NO: 2205864 - RNA, 22 nt, Human
caccucccccaucucuucuggg

SEQ ID NO: 2205865 - RNA, 12 nt, Human
gaagaccucauu

SEQ ID NO: 2205866 - RNA, 19 nt, Human
agagccggagccuccagcu

SEQ ID NO: 2205867 - RNA, 18 nt, Human
agugucaaugcagccccc

SEQ ID NO: 2205868 - RNA, 19 nt, Human
aauaaaacuuuuccaauga

SEQ ID NO: 2205869 - RNA, 22 nt, Human
agacccacuggacucaccuccc

SEQ ID NO: 2205870 - RNA, 12 nt, Human
gaaucuuguaaa

SEQ ID NO: 2205871 - RNA, 22 nt, Human
uugagaaggagcucccaggagg

SEQ ID NO: 2205872 - RNA, 22 nt, Human
aucucuucuggguuccuuccuc

SEQ ID NO: 2205873 - RNA, 14 nt, Human
ugugaaaagcucca

SEQ ID NO: 2205874 - RNA, 17 nt, Human
gaagcaccaaucaugaa

SEQ ID NO: 2205875 - RNA, 15 nt, Human
uauuuauuuuaauaa

SEQ ID NO: 2205876 - RNA, 15 nt, Human
cgcgcuccgcgcagc

SEQ ID NO: 2205877 - RNA, 13 nt, Human
ccucuggcuccag

SEQ ID NO: 2205878 - RNA, 23 nt, Human
cccggccggcgcgcucaucccac

SEQ ID NO: 2205879 - RNA, 22 nt, Human
aaacaccucagcugccucccca

SEQ ID NO: 2205880 - RNA, 15 nt, Human
guucugcagauaaac

SEQ ID NO: 2205881 - RNA, 14 nt, Human
ugagacucugucuc

SEQ ID NO: 2205882 - RNA, 21 nt, Human
gacagucaccucauggaauug

SEQ ID NO: 2205883 - RNA, 17 nt, Human
aggguguguaaguagau

SEQ ID NO: 2205884 - RNA, 16 nt, Human
uguaguccuguaaugg

SEQ ID NO: 2205885 - RNA, 18 nt, Human
aaaaguucugcagauaaa

SEQ ID NO: 2205886 - RNA, 15 nt, Human
auaauccuaaacaua

SEQ ID NO: 2205887 - RNA, 19 nt, Human
uugugccccugcacuccag

SEQ ID NO: 2205888 - RNA, 16 nt, Human
auuuuuagugaaauau

SEQ ID NO: 2205889 - RNA, 16 nt, Human
gacaaggaaaaaauaa

SEQ ID NO: 2205890 - RNA, 23 nt, Human
auuuuauagcuacuaauuuuaaa

SEQ ID NO: 2205891 - RNA, 20 nt, Human
cagccugagcgacagugaga

SEQ ID NO: 2205892 - RNA, 14 nt, Human
gggaccugggccau

SEQ ID NO: 2205893 - RNA, 15 nt, Human
augguuguauuauuu

SEQ ID NO: 2205894 - RNA, 21 nt, Human
ucacaugaacuuguaaaggaa

SEQ ID NO: 2205895 - RNA, 13 nt, Human
cugagagugaaca

SEQ ID NO: 2205896 - RNA, 18 nt, Human
auccuucagccugaaaga

SEQ ID NO: 2205897 - RNA, 14 nt, Human
cgagcgcgcgcgcc

SEQ ID NO: 2205898 - RNA, 13 nt, Human
uaagugcagcccc

SEQ ID NO: 2205899 - RNA, 16 nt, Human
cuguacgcgagcgcgc

SEQ ID NO: 2205900 - RNA, 16 nt, Human
aaaaugugauauguac

SEQ ID NO: 2205901 - RNA, 24 nt, Human
uaauuuaaaauaugcucuaaacau

SEQ ID NO: 2205902 - RNA, 19 nt, Human
ggccugcucgcccacuucc

SEQ ID NO: 2205903 - RNA, 23 nt, Human
uuguaaagguccuggcaaagaug

SEQ ID NO: 2205904 - RNA, 23 nt, Human
auucugagguaaccucauuauca

SEQ ID NO: 2205905 - RNA, 19 nt, Human
cagcuacuugggaggcuga

SEQ ID NO: 2205906 - RNA, 14 nt, Human
ucaaugcagccccc

SEQ ID NO: 2205907 - RNA, 15 nt, Human
gaaaugaaagcaggg

SEQ ID NO: 2205908 - RNA, 21 nt, Human
cucuucuggguuccuuccucu

SEQ ID NO: 2205909 - RNA, 14 nt, Human
cccggccggcgcgc

SEQ ID NO: 2205910 - RNA, 19 nt, Human
aaauaugccccauucaaca

SEQ ID NO: 2205911 - RNA, 14 nt, Human
ggagccuccagcug

SEQ ID NO: 2205912 - RNA, 20 nt, Human
uaaaagacagugaaagaaaa

SEQ ID NO: 2205913 - RNA, 20 nt, Human
uauuuauuacuguaagaaaa

SEQ ID NO: 2205914 - RNA, 22 nt, Human
gcuaaaacaagcacuaaacaaa

SEQ ID NO: 2205915 - RNA, 14 nt, Human
accugggccauagu

SEQ ID NO: 2205916 - RNA, 12 nt, Human
gaaggggcggcg

SEQ ID NO: 2205917 - RNA, 20 nt, Human
auauauuuuuuuuuuuaaaa

SEQ ID NO: 2205918 - RNA, 12 nt, Human
uauuauuuuuua

SEQ ID NO: 2205919 - RNA, 18 nt, Human
gagcgacagugagacucu

SEQ ID NO: 2205920 - RNA, 23 nt, Human
ccagaucaagccugccucaauca

SEQ ID NO: 2205921 - RNA, 15 nt, Human
cccaaccucucccaa

SEQ ID NO: 2205922 - RNA, 16 nt, Human
ugagaugcuagaacuc

SEQ ID NO: 2205923 - RNA, 18 nt, Human
aaauggaaguaaauguug

SEQ ID NO: 2205924 - RNA, 15 nt, Human
uaaaagacaaggaaa

SEQ ID NO: 2205925 - RNA, 22 nt, Human
auagccagguaccuucucaccu

SEQ ID NO: 2205926 - RNA, 21 nt, Human
gccucagggugcacacaggau

SEQ ID NO: 2205927 - RNA, 19 nt, Human
uauauuuuuuguuaaauga

SEQ ID NO: 2205928 - RNA, 22 nt, Human
caagcacuaaacaaagagugaa

SEQ ID NO: 2205929 - RNA, 14 nt, Human
ccucagcugccucc

SEQ ID NO: 2205930 - RNA, 11 nt, Human
caacucccugc

SEQ ID NO: 2205931 - RNA, 21 nt, Human
uacauaaaguaugugcauauu

SEQ ID NO: 2205932 - RNA, 22 nt, Human
cuucagccugaaagaggaauga

SEQ ID NO: 2205933 - RNA, 13 nt, Human
caauccaagaacu

SEQ ID NO: 2205934 - RNA, 19 nt, Human
uccagaaagugacaagcuc

SEQ ID NO: 2205935 - RNA, 19 nt, Human
gucaaauugugugaaaggu

SEQ ID NO: 2205936 - RNA, 14 nt, Human
cggacggcuccgga

SEQ ID NO: 2205937 - RNA, 21 nt, Human
cccuauccuacuuccccuucc

SEQ ID NO: 2205938 - RNA, 13 nt, Human
aggaaaaaauaac

SEQ ID NO: 2205939 - RNA, 19 nt, Human
ccuucccagcuagaauuca

SEQ ID NO: 2205940 - RNA, 21 nt, Human
caauuuuguuauguauauuuu

SEQ ID NO: 2205941 - RNA, 15 nt, Human
ucaguauucauauuu

SEQ ID NO: 2205942 - RNA, 20 nt, Human
ccuccugccuaagugcagcc

SEQ ID NO: 2205943 - RNA, 16 nt, Human
cccccagcccuccuua

SEQ ID NO: 2205944 - RNA, 16 nt, Human
ccugagaccaaggccc

SEQ ID NO: 2205945 - RNA, 21 nt, Human
cuaccaaaaaucucaauauuu

SEQ ID NO: 2205946 - RNA, 23 nt, Human
agcaugucgucaaagcugaaaug

SEQ ID NO: 2205947 - RNA, 21 nt, Human
uuuauagccagguaccuucuc

SEQ ID NO: 2205948 - RNA, 22 nt, Human
uguugcccacagcuguaugauu

SEQ ID NO: 2205949 - RNA, 13 nt, Human
caugggccccaga

SEQ ID NO: 2205950 - RNA, 16 nt, Human
gagcucgugggacagu

SEQ ID NO: 2205951 - RNA, 21 nt, Human
gaaaaaaagcuuuuuuugaau

SEQ ID NO: 2205952 - RNA, 19 nt, Human
ggaaaaaauaacaaugaaa

SEQ ID NO: 2205953 - RNA, 23 nt, Human
cgagccccaggcggguccggguc

SEQ ID NO: 2205954 - RNA, 18 nt, Human
agccgggaaagaagagcc

SEQ ID NO: 2205955 - RNA, 18 nt, Human
cuuucacauuuaaauaaa

SEQ ID NO: 2205956 - RNA, 16 nt, Human
ugacuuaaugccacua

SEQ ID NO: 2205957 - RNA, 12 nt, Human
accuucucaccu

SEQ ID NO: 2205958 - RNA, 15 nt, Human
uguuaaaugauuuca

SEQ ID NO: 2205959 - RNA, 13 nt, Human
gcagaacagugau

SEQ ID NO: 2205960 - RNA, 20 nt, Human
cacuagacccacuggacuca

SEQ ID NO: 2205961 - RNA, 19 nt, Human
cucuguucugcacacagca

SEQ ID NO: 2205962 - RNA, 20 nt, Human
aaucuuucacaggggacagg

SEQ ID NO: 2205963 - RNA, 20 nt, Human
gaaacgaggauugggaaaaa

SEQ ID NO: 2205964 - RNA, 11 nt, Human
auaauuuaaau

SEQ ID NO: 2205965 - RNA, 18 nt, Human
uaguaucaaaagaaagaa

SEQ ID NO: 2205966 - RNA, 14 nt, Human
gcgcgcuccgcgca

SEQ ID NO: 2205967 - RNA, 20 nt, Human
uaaaacaagcacuaaacaaa

SEQ ID NO: 2205968 - RNA, 16 nt, Human
cugagcauuuaauaug

SEQ ID NO: 2205969 - RNA, 15 nt, Human
aguucuucaaagaua

SEQ ID NO: 2205970 - RNA, 14 nt, Human
cugaaagucccaga

SEQ ID NO: 2205971 - RNA, 17 nt, Human
agaaaugaaagcaggga

SEQ ID NO: 2205972 - RNA, 17 nt, Human
uccauccugaggcucca

SEQ ID NO: 2205973 - RNA, 16 nt, Human
cucucccaacuauaaa

SEQ ID NO: 2205974 - RNA, 10 nt, Human
acuuccuccc

SEQ ID NO: 2205975 - RNA, 14 nt, Human
cggggagcgagccc

SEQ ID NO: 2205976 - RNA, 20 nt, Human
agcuacuaauuuuaaaaugu

SEQ ID NO: 2205977 - RNA, 21 nt, Human
ccgacggagccgggaaagaag

SEQ ID NO: 2205978 - RNA, 16 nt, Human
gccuaagugcagcccc

SEQ ID NO: 2205979 - RNA, 17 nt, Human
caagaaaugaaagcagg

SEQ ID NO: 2205980 - RNA, 15 nt, Human
gaagauguagaggag

SEQ ID NO: 2205981 - RNA, 15 nt, Human
agccccugggaccag

SEQ ID NO: 2205982 - RNA, 22 nt, Human
gugugaccacugcagaagacag

SEQ ID NO: 2205983 - RNA, 16 nt, Human
uuccgcauccuagucu

SEQ ID NO: 2205984 - RNA, 22 nt, Human
cgcgcagcucaggcuggcaccg

SEQ ID NO: 2205985 - RNA, 15 nt, Human
gaaagaaaauaacga

SEQ ID NO: 2205986 - RNA, 14 nt, Human
gagguaccagccuu

SEQ ID NO: 2205987 - RNA, 23 nt, Human
cucagcccuggugggcagagagg

SEQ ID NO: 2205988 - RNA, 15 nt, Human
ccuggugggcagaga

SEQ ID NO: 2205989 - RNA, 24 nt, Human
aacuauaaaacuaggugcugcagc

SEQ ID NO: 2205990 - RNA, 15 nt, Human
aagccuggcaaggga

SEQ ID NO: 2205991 - RNA, 18 nt, Human
uucucuaggaaauauuua

SEQ ID NO: 2205992 - RNA, 18 nt, Human
aucuuauaauuuaaaaua

SEQ ID NO: 2205993 - RNA, 14 nt, Human
cuacaagacacagu

SEQ ID NO: 2205994 - RNA, 20 nt, Human
guuccuuccucugagccuug

SEQ ID NO: 2205995 - RNA, 14 nt, Human
agguugcagugagc

SEQ ID NO: 2205996 - RNA, 14 nt, Human
gcgcugcgcgccgc

SEQ ID NO: 2205997 - RNA, 16 nt, Human
gccgcgcugcgcgccg

SEQ ID NO: 2205998 - RNA, 16 nt, Human
uugccauaauuacuau

SEQ ID NO: 2205999 - RNA, 22 nt, Human
guggcgcuggcugcgcucggcc

SEQ ID NO: 2206000 - RNA, 21 nt, Human
ccuuuuuuugaaaaaaagcuu

SEQ ID NO: 2206001 - RNA, 14 nt, Human
ucuuuuuuuuaaua

SEQ ID NO: 2206002 - RNA, 12 nt, Human
cucccugccccc

SEQ ID NO: 2206003 - RNA, 17 nt, Human
cugagcgacagugagac

SEQ ID NO: 2206004 - RNA, 16 nt, Human
ucccugccccccagcc

SEQ ID NO: 2206005 - RNA, 17 nt, Human
ccugagcggaccuuccc

SEQ ID NO: 2206006 - RNA, 17 nt, Human
cugaucaccugcccugc

SEQ ID NO: 2206007 - RNA, 21 nt, Human
ccugagcggaccuucccagcu

SEQ ID NO: 2206008 - RNA, 13 nt, Human
aacaagccuccuu

SEQ ID NO: 2206009 - RNA, 17 nt, Human
accugagccccaaaagg

SEQ ID NO: 2206010 - RNA, 14 nt, Human
ccacuggacucacc

SEQ ID NO: 2206011 - RNA, 14 nt, Human
ucugggcagacucu

SEQ ID NO: 2206012 - RNA, 13 nt, Human
uccugugggaccu

SEQ ID NO: 2206013 - RNA, 17 nt, Human
augcagagguccacaac

SEQ ID NO: 2206014 - RNA, 13 nt, Human
auauauauuuuuu

SEQ ID NO: 2206015 - RNA, 16 nt, Human
cugcgcgccgcgcucc

SEQ ID NO: 2206016 - RNA, 18 nt, Human
aagucuuucacauuuaaa

SEQ ID NO: 2206017 - RNA, 18 nt, Human
agguccacaacacacaga

SEQ ID NO: 2206018 - RNA, 13 nt, Human
agcccagcuugaa

SEQ ID NO: 2206019 - RNA, 19 nt, Human
agacagugaaagaaaauaa

SEQ ID NO: 2206020 - RNA, 14 nt, Human
agcccucuucugac

SEQ ID NO: 2206021 - RNA, 19 nt, Human
agauaccaugaugcugagc

SEQ ID NO: 2206022 - RNA, 19 nt, Human
ucagugucaaugcagcccc

SEQ ID NO: 2206023 - RNA, 24 nt, Human
ccagguaccuucucaccugugaga

SEQ ID NO: 2206024 - RNA, 20 nt, Human
cccuuccuaauuccacagcu

SEQ ID NO: 2206025 - RNA, 19 nt, Human
cuccagcuggccgggagcc

SEQ ID NO: 2206026 - RNA, 15 nt, Human
gcccacuagacccac

SEQ ID NO: 2206027 - RNA, 20 nt, Human
gaccauacuaauuauacccc

SEQ ID NO: 2206028 - RNA, 14 nt, Human
agcggaccuuccca

SEQ ID NO: 2206029 - RNA, 14 nt, Human
cuccagugagacag

SEQ ID NO: 2206030 - RNA, 14 nt, Human
gaaaaaauaacaau

SEQ ID NO: 2206031 - RNA, 14 nt, Human
cggggaggggcgcu

SEQ ID NO: 2206032 - RNA, 16 nt, Human
gaccaaggcccccggg

SEQ ID NO: 2206033 - RNA, 12 nt, Human
cagaacagugau

SEQ ID NO: 2206034 - RNA, 14 nt, Human
caugaacuuguaaa

SEQ ID NO: 2206035 - RNA, 18 nt, Human
cuccagccugagcgacag

SEQ ID NO: 2206036 - RNA, 14 nt, Human
ccaaugaaaugagu

SEQ ID NO: 2206037 - RNA, 20 nt, Human
ccagcuggccgggagccuga

SEQ ID NO: 2206038 - RNA, 14 nt, Human
uuuuuguuuuguuu

SEQ ID NO: 2206039 - RNA, 20 nt, Human
caggcugagccucagucucc

SEQ ID NO: 2206040 - RNA, 22 nt, Human
ccgggagccugaucaccugccc

SEQ ID NO: 2206041 - RNA, 14 nt, Human
cagagguugcagug

SEQ ID NO: 2206042 - RNA, 20 nt, Human
ccccuauccuacuuccccuu

SEQ ID NO: 2206043 - RNA, 19 nt, Human
aaaguaugugcauauuuua

SEQ ID NO: 2206044 - RNA, 15 nt, Human
cgcucggccugcucg

SEQ ID NO: 2206045 - RNA, 18 nt, Human
gaagcaccaaucaugaau

SEQ ID NO: 2206046 - RNA, 17 nt, Human
uuucacauuuaaauaaa

SEQ ID NO: 2206047 - RNA, 20 nt, Human
gcgcugcgcgccgcgcuccu

SEQ ID NO: 2206048 - RNA, 15 nt, Human
cuucucuucacaguc

SEQ ID NO: 2206049 - RNA, 21 nt, Human
uucccgcuguuccucgccacg

SEQ ID NO: 2206050 - RNA, 18 nt, Human
agucauucugccugcccu

SEQ ID NO: 2206051 - RNA, 14 nt, Human
gcuggcaccgcugu

SEQ ID NO: 2206052 - RNA, 17 nt, Human
aguuauuuuuaaacugu

SEQ ID NO: 2206053 - RNA, 13 nt, Human
augauuccaccua

SEQ ID NO: 2206054 - RNA, 17 nt, Human
ucccagaucaagccugc

SEQ ID NO: 2206055 - RNA, 14 nt, Human
ccugagaccaaggc

SEQ ID NO: 2206056 - RNA, 19 nt, Human
uggauacuccauggggugg

SEQ ID NO: 2206057 - RNA, 23 nt, Human
gaaaaaguucugcagauaaacag

SEQ ID NO: 2206058 - RNA, 19 nt, Human
aaaguucuagugaccgaga

SEQ ID NO: 2206059 - RNA, 13 nt, Human
gagccuccagcug

SEQ ID NO: 2206060 - RNA, 20 nt, Human
auaauccuaaacauaugaau

SEQ ID NO: 2206061 - RNA, 23 nt, Human
cccacuggacucaccucccccau

SEQ ID NO: 2206062 - RNA, 22 nt, Human
aacucccugccccccagcccuc

SEQ ID NO: 2206063 - RNA, 15 nt, Human
gcucgcuuccgcauc

SEQ ID NO: 2206064 - RNA, 22 nt, Human
uggaaaguuuaugguuguauua

SEQ ID NO: 2206065 - RNA, 22 nt, Human
uauagccagguaccuucucacc

SEQ ID NO: 2206066 - RNA, 16 nt, Human
cuggcugcgcucggcc

SEQ ID NO: 2206067 - RNA, 18 nt, Human
uacauuuguauaaaauaa

SEQ ID NO: 2206068 - RNA, 19 nt, Human
gcacacagcacgggggcca

SEQ ID NO: 2206069 - RNA, 15 nt, Human
acauccuacaagaca

SEQ ID NO: 2206070 - RNA, 19 nt, Human
guaguccuguaauggaagc

SEQ ID NO: 2206071 - RNA, 13 nt, Human
cgcgcugcgcgcc

SEQ ID NO: 2206072 - RNA, 15 nt, Human
aagccuccuuuuaaa

SEQ ID NO: 2206073 - RNA, 22 nt, Human
uuuuauagcuacuaauuuuaaa

SEQ ID NO: 2206074 - RNA, 23 nt, Human
gggaaagaagagccggagccucc

SEQ ID NO: 2206075 - RNA, 22 nt, Human
agcgcgcgcgcccucuggcugc

SEQ ID NO: 2206076 - RNA, 18 nt, Human
cugagaccaaggcccccg

SEQ ID NO: 2206077 - RNA, 15 nt, Human
guuuuauuauauaua

SEQ ID NO: 2206078 - RNA, 11 nt, Human
gcauccuaguc

SEQ ID NO: 2206079 - RNA, 18 nt, Human
gacccacuggacucaccu

SEQ ID NO: 2206080 - RNA, 20 nt, Human
agcuucacuguaaaauaaua

SEQ ID NO: 2206081 - RNA, 15 nt, Human
aucaguaugaaaaug

SEQ ID NO: 2206082 - RNA, 22 nt, Human
uuccccuuccuaauuccacagc

SEQ ID NO: 2206083 - RNA, 18 nt, Human
uuuuaaaaaagaaacauu

SEQ ID NO: 2206084 - RNA, 14 nt, Human
cucgcccacuuccu

SEQ ID NO: 2206085 - RNA, 13 nt, Human
cccugcacuccag

SEQ ID NO: 2206086 - RNA, 19 nt, Human
ggagggcgcggggcgggga

SEQ ID NO: 2206087 - RNA, 14 nt, Human
accauuuuuacuug

SEQ ID NO: 2206088 - RNA, 15 nt, Human
gccagcccucuucug

SEQ ID NO: 2206089 - RNA, 14 nt, Human
ugaggcuuuaaaac

SEQ ID NO: 2206090 - RNA, 18 nt, Human
uucugauauuggacagua

SEQ ID NO: 2206091 - RNA, 14 nt, Human
cuagaauucacucc

SEQ ID NO: 2206092 - RNA, 22 nt, Human
cggagccgggaaagaagagccg

SEQ ID NO: 2206093 - RNA, 19 nt, Human
acuaucucauuuccaagca

SEQ ID NO: 2206094 - RNA, 14 nt, Human
gcgcccucuggcug

SEQ ID NO: 2206095 - RNA, 14 nt, Human
agagacagaaagca

SEQ ID NO: 2206096 - RNA, 15 nt, Human
gggucagccagcccu

SEQ ID NO: 2206097 - RNA, 13 nt, Human
augacauuuuguu

SEQ ID NO: 2206098 - RNA, 18 nt, Human
uaaaagacaaggaaaaaa

SEQ ID NO: 2206099 - RNA, 21 nt, Human
uauacugugugcuaaaacaag

SEQ ID NO: 2206100 - RNA, 11 nt, Human
gcaugguuuag

SEQ ID NO: 2206101 - RNA, 13 nt, Human
ccacaacacacag

SEQ ID NO: 2206102 - RNA, 21 nt, Human
aaugaauggcuaagcaaaaug

SEQ ID NO: 2206103 - RNA, 19 nt, Human
auuggagcucgugggacag

SEQ ID NO: 2206104 - RNA, 13 nt, Human
cacaggauggcag

SEQ ID NO: 2206105 - RNA, 16 nt, Human
auaaugaauacuuuau

SEQ ID NO: 2206106 - RNA, 13 nt, Human
acaauaaaagaca

SEQ ID NO: 2206107 - RNA, 17 nt, Human
gccaugggacagggagg

SEQ ID NO: 2206108 - RNA, 16 nt, Human
ggaggggcgcucgcuu

SEQ ID NO: 2206109 - RNA, 21 nt, Human
cucagugucaaugcagccccc

SEQ ID NO: 2206110 - RNA, 20 nt, Human
gggagccccaauucgauccc

SEQ ID NO: 2206111 - RNA, 23 nt, Human
caaagcugaaauggacuuuugua

SEQ ID NO: 2206112 - RNA, 14 nt, Human
uccacaacacacag

SEQ ID NO: 2206113 - RNA, 20 nt, Human
gcucgcccacuuccucccgg

SEQ ID NO: 2206114 - RNA, 15 nt, Human
ccccugagcuugcag

SEQ ID NO: 2206115 - RNA, 19 nt, Human
gaaaauaacgauaaaagac

SEQ ID NO: 2206116 - RNA, 17 nt, Human
auaaguacaugauaagc

SEQ ID NO: 2206117 - RNA, 19 nt, Human
aauauuauguuaaaacugg

SEQ ID NO: 2206118 - RNA, 16 nt, Human
gaaagaagagccggag

SEQ ID NO: 2206119 - RNA, 16 nt, Human
uuacccccugggagcc

SEQ ID NO: 2206120 - RNA, 16 nt, Human
ccagggcuacgcgcgc

SEQ ID NO: 2206121 - RNA, 14 nt, Human
aaaagaaagaaaau

SEQ ID NO: 2206122 - RNA, 23 nt, Human
ugaauuacauuuguauaaaauaa

SEQ ID NO: 2206123 - RNA, 15 nt, Human
caggcacccccagaa

SEQ ID NO: 2206124 - RNA, 18 nt, Human
ugggcacaggguuuaugu

SEQ ID NO: 2206125 - RNA, 22 nt, Human
accaaucaugaauuaguuuuau

SEQ ID NO: 2206126 - RNA, 13 nt, Human
cucaccuccccca

SEQ ID NO: 2206127 - RNA, 13 nt, Human
ucuuauaauuuaa

SEQ ID NO: 2206128 - RNA, 13 nt, Human
aacacaacuauau

SEQ ID NO: 2206129 - RNA, 23 nt, Human
gggccuaugcagagguccacaac

SEQ ID NO: 2206130 - RNA, 18 nt, Human
auaaaguguuugaaagcu

SEQ ID NO: 2206131 - RNA, 12 nt, Human
accccugagcuu

SEQ ID NO: 2206132 - RNA, 12 nt, Human
agggauggggcu

SEQ ID NO: 2206133 - RNA, 21 nt, Human
uuauagcuacuaauuuuaaaa

SEQ ID NO: 2206134 - RNA, 17 nt, Human
gugccuguaaucacagc

SEQ ID NO: 2206135 - RNA, 19 nt, Human
acuucagcgguuuauauaa

SEQ ID NO: 2206136 - RNA, 15 nt, Human
aauaacgauaaaaga

SEQ ID NO: 2206137 - RNA, 14 nt, Human
ugacacuaaaacac

SEQ ID NO: 2206138 - RNA, 13 nt, Human
ucacuguaaaaua

SEQ ID NO: 2206139 - RNA, 17 nt, Human
acaagaaaugaaagcag

SEQ ID NO: 2206140 - RNA, 20 nt, Human
agagccggagccuccagcug

SEQ ID NO: 2206141 - RNA, 14 nt, Human
auuuaaauauaugc

SEQ ID NO: 2206142 - RNA, 20 nt, Human
caagcucuaucaccaaggag

SEQ ID NO: 2206143 - RNA, 18 nt, Human
gccuuggauacuccaugg

SEQ ID NO: 2206144 - RNA, 12 nt, Human
uaguacacacuu

SEQ ID NO: 2206145 - RNA, 23 nt, Human
caucaacagauaaauaguuuaug

SEQ ID NO: 2206146 - RNA, 22 nt, Human
ucuagcaugucgucaaagcuga

SEQ ID NO: 2206147 - RNA, 18 nt, Human
ugagcucagcccuggugg

SEQ ID NO: 2206148 - RNA, 18 nt, Human
aaggagcucccaggaggg

SEQ ID NO: 2206149 - RNA, 21 nt, Human
cgagccccaggcggguccggg

SEQ ID NO: 2206150 - RNA, 11 nt, Human
ucaccugcccu

SEQ ID NO: 2206151 - RNA, 20 nt, Human
guucugcagauaaacaguag

SEQ ID NO: 2206152 - RNA, 23 nt, Human
agaaugauuaugaauuacauuug

SEQ ID NO: 2206153 - RNA, 17 nt, Human
uuauaaucuuucacagg

SEQ ID NO: 2206154 - RNA, 13 nt, Human
gcuacgcgcgcuc

SEQ ID NO: 2206155 - RNA, 21 nt, Human
ucccagaucaagccugccuca

SEQ ID NO: 2206156 - RNA, 17 nt, Human
agggcauagaaguaaaa

SEQ ID NO: 2206157 - RNA, 14 nt, Human
acccaaaaggcaga

SEQ ID NO: 2206158 - RNA, 22 nt, Human
gugaacaaauuuacagagacag

SEQ ID NO: 2206159 - RNA, 19 nt, Human
ugggccccagauaccauga

SEQ ID NO: 2206160 - RNA, 15 nt, Human
ucugcagauaaacag

SEQ ID NO: 2206161 - RNA, 16 nt, Human
auuuuaauaauguuuc

SEQ ID NO: 2206162 - RNA, 17 nt, Human
uaaaagacagugaaaga

SEQ ID NO: 2206163 - RNA, 19 nt, Human
auuuucuauaauuuaaaua

SEQ ID NO: 2206164 - RNA, 19 nt, Human
ugaucaccugcccugcuga

SEQ ID NO: 2206165 - RNA, 18 nt, Human
gccugagcgacagugaga

SEQ ID NO: 2206166 - RNA, 19 nt, Human
augaauuacauuuguauaa

SEQ ID NO: 2206167 - RNA, 20 nt, Human
ccugagcggaccuucccagc

SEQ ID NO: 2206168 - RNA, 18 nt, Human
auuauuuuuuaaaaaaau

SEQ ID NO: 2206169 - RNA, 19 nt, Human
auccuacaagacacaguga

SEQ ID NO: 2206170 - RNA, 17 nt, Human
uuacagagacagaaagc

SEQ ID NO: 2206171 - RNA, 21 nt, Human
uuauuuucuauaauuuaaaua

SEQ ID NO: 2206172 - RNA, 17 nt, Human
ucucuggccuucggccu

SEQ ID NO: 2206173 - RNA, 15 nt, Human
aucuuauaauuuaaa

SEQ ID NO: 2206174 - RNA, 23 nt, Human
aguaauuggaaaggcagcucuaa

SEQ ID NO: 2206175 - RNA, 16 nt, Human
ccuacaugagguacug

SEQ ID NO: 2206176 - RNA, 19 nt, Human
cagguaccuucucaccugu

SEQ ID NO: 2206177 - RNA, 16 nt, Human
ugaaguacucauacau

SEQ ID NO: 2206178 - RNA, 19 nt, Human
guaaagcuuugugcagauu

SEQ ID NO: 2206179 - RNA, 15 nt, Human
ccgucccccucuggc

SEQ ID NO: 2206180 - RNA, 16 nt, Human
cacgggggccaaggau

SEQ ID NO: 2206181 - RNA, 22 nt, Human
augguuguauuauuuuuuaaaa

SEQ ID NO: 2206182 - RNA, 17 nt, Human
cccggccggcgcgcuca

SEQ ID NO: 2206183 - RNA, 16 nt, Human
agaugcuagaacuccc

SEQ ID NO: 2206184 - RNA, 13 nt, Human
gauggcaggaggc

SEQ ID NO: 2206185 - RNA, 18 nt, Human
uauauuuuuuuuuuuaaa

SEQ ID NO: 2206186 - RNA, 22 nt, Human
gaggcggauugagaaggagcuc

SEQ ID NO: 2206187 - RNA, 13 nt, Human
acaagaaaugaaa

SEQ ID NO: 2206188 - RNA, 23 nt, Human
gaaaaugucauuguucuugugaa

SEQ ID NO: 2206189 - RNA, 22 nt, Human
cccaggcggguccgggucgcag

SEQ ID NO: 2206190 - RNA, 18 nt, Human
gccccgucccccucuggc

SEQ ID NO: 2206191 - RNA, 17 nt, Human
ggcuccggacgcugcug

SEQ ID NO: 2206192 - RNA, 19 nt, Human
ggcgggagggcgcggggcg

SEQ ID NO: 2206193 - RNA, 19 nt, Human
augaguaacugauuuguaa

SEQ ID NO: 2206194 - RNA, 17 nt, Human
cugagaugggagaauca

SEQ ID NO: 2206195 - RNA, 22 nt, Human
aaugggcacaggguuuauguuu

SEQ ID NO: 2206196 - RNA, 19 nt, Human
aggggggucagccagcccu

SEQ ID NO: 2206197 - RNA, 22 nt, Human
aauuacauuuguauaaaauaau

SEQ ID NO: 2206198 - RNA, 20 nt, Human
uugauaaguacaugauaagc

SEQ ID NO: 2206199 - RNA, 17 nt, Human
aaauaacaauaaaagac

SEQ ID NO: 2206200 - RNA, 14 nt, Human
uugccaugugcuag

SEQ ID NO: 2206201 - RNA, 17 nt, Human
gaagaccucauuuugaa

SEQ ID NO: 2206202 - RNA, 14 nt, Human
ucucuaucauuaaa

SEQ ID NO: 2206203 - RNA, 13 nt, Human
aaaaauccuacuu

SEQ ID NO: 2206204 - RNA, 16 nt, Human
agugaaagaaaauaac

SEQ ID NO: 2206205 - RNA, 17 nt, Human
cuaccuguucgcgcgcc

SEQ ID NO: 2206206 - RNA, 13 nt, Human
ugggaggcugaga

SEQ ID NO: 2206207 - RNA, 16 nt, Human
cacuuaaaaaugguuu

SEQ ID NO: 2206208 - RNA, 18 nt, Human
ugcucgcccacuuccucc

SEQ ID NO: 2206209 - RNA, 12 nt, Human
gcugaugcaguu

SEQ ID NO: 2206210 - RNA, 18 nt, Human
accaccugccuauauuuu

SEQ ID NO: 2206211 - RNA, 11 nt, Human
ggucacaggaa

SEQ ID NO: 2206212 - RNA, 21 nt, Human
ugggaggcugagaugggagaa

SEQ ID NO: 2206213 - RNA, 16 nt, Human
agauagggagggaagg

SEQ ID NO: 2206214 - RNA, 21 nt, Human
aaacaauaacgauaaaagaca

SEQ ID NO: 2206215 - RNA, 12 nt, Human
gcgagccccagg

SEQ ID NO: 2206216 - RNA, 14 nt, Human
acgcgcgcuccgcg

SEQ ID NO: 2206217 - RNA, 23 nt, Human
ccucuucugacacuaaaacaccu

SEQ ID NO: 2206218 - RNA, 13 nt, Human
ccagcacagccuc

SEQ ID NO: 2206219 - RNA, 13 nt, Human
uuuauuauauaua

SEQ ID NO: 2206220 - RNA, 13 nt, Human
uuauguuuaauuc

SEQ ID NO: 2206221 - RNA, 20 nt, Human
accuacacgagauacagaau

SEQ ID NO: 2206222 - RNA, 22 nt, Human
uuaccucugccucagaaaacaa

SEQ ID NO: 2206223 - RNA, 15 nt, Human
uagauaggccauggg

SEQ ID NO: 2206224 - RNA, 19 nt, Human
gcuuguauuccuuuuucuc

SEQ ID NO: 2206225 - RNA, 12 nt, Human
aagaaaauaaca

SEQ ID NO: 2206226 - RNA, 16 nt, Human
cucaauaaaguacaag

SEQ ID NO: 2206227 - RNA, 15 nt, Human
aguaaauguuguuuu

SEQ ID NO: 2206228 - RNA, 19 nt, Human
cccacuggacucaccuccc

SEQ ID NO: 2206229 - RNA, 13 nt, Human
ccuucucaccugu

SEQ ID NO: 2206230 - RNA, 17 nt, Human
cuuccuaauuccacagc

SEQ ID NO: 2206231 - RNA, 19 nt, Human
aagucuuucacauuuaaau

SEQ ID NO: 2206232 - RNA, 22 nt, Human
caucgcaauguaagacucggga

SEQ ID NO: 2206233 - RNA, 19 nt, Human
gaaaaugucauuguucuug

SEQ ID NO: 2206234 - RNA, 18 nt, Human
uaagcuucacuguaaaau

SEQ ID NO: 2206235 - RNA, 15 nt, Human
gccgacggagccggg

SEQ ID NO: 2206236 - RNA, 18 nt, Human
aaagaaaaucaggcuggc

SEQ ID NO: 2206237 - RNA, 16 nt, Human
uuaaauuguaauaggc

SEQ ID NO: 2206238 - RNA, 13 nt, Human
caguuauuauauu

SEQ ID NO: 2206239 - RNA, 17 nt, Human
uccacaacacacagauu

SEQ ID NO: 2206240 - RNA, 20 nt, Human
gauugagaaggagcucccag

SEQ ID NO: 2206241 - RNA, 12 nt, Human
guagacacacau

SEQ ID NO: 2206242 - RNA, 18 nt, Human
ucuaugaaauauuauguu

SEQ ID NO: 2206243 - RNA, 12 nt, Human
cuuccucugagc

SEQ ID NO: 2206244 - RNA, 20 nt, Human
ggaggcauccaaaggcuccu

SEQ ID NO: 2206245 - RNA, 17 nt, Human
uccuacaagacacagug

SEQ ID NO: 2206246 - RNA, 21 nt, Human
ccaaauauaaauaaaaauaau

SEQ ID NO: 2206247 - RNA, 20 nt, Human
cuuuuuuaguucuucaaaga

SEQ ID NO: 2206248 - RNA, 20 nt, Human
cgcauccuagucucuaucau

SEQ ID NO: 2206249 - RNA, 19 nt, Human
cagauucuuuacccccugg

SEQ ID NO: 2206250 - RNA, 16 nt, Human
ccugagcuugcagaga

SEQ ID NO: 2206251 - RNA, 15 nt, Human
cuaggugcugcagcc

SEQ ID NO: 2206252 - RNA, 22 nt, Human
ugccugagcggaccuucccagc

SEQ ID NO: 2206253 - RNA, 21 nt, Human
cugauauuggacaguaaaauc

SEQ ID NO: 2206254 - RNA, 13 nt, Human
aauuuuuauauuu

SEQ ID NO: 2206255 - RNA, 16 nt, Human
ggccuccauccugagg

SEQ ID NO: 2206256 - RNA, 16 nt, Human
cgcccacuuccucccg

SEQ ID NO: 2206257 - RNA, 14 nt, Human
ccccagaaugaccu

SEQ ID NO: 2206258 - RNA, 20 nt, Human
caagagccuuuuuuugaaaa

SEQ ID NO: 2206259 - RNA, 12 nt, Human
aacuuauuugua

SEQ ID NO: 2206260 - RNA, 22 nt, Human
agaagcaccaaucaugaauuag

SEQ ID NO: 2206261 - RNA, 17 nt, Human
guugcugggggggauug

SEQ ID NO: 2206262 - RNA, 18 nt, Human
auagaauuaacacaugau

SEQ ID NO: 2206263 - RNA, 17 nt, Human
aauaaaguguuugaaag

SEQ ID NO: 2206264 - RNA, 17 nt, Human
uugugaagcaaaauuuu

SEQ ID NO: 2206265 - RNA, 18 nt, Human
gcgcuggcugcgcucggc

SEQ ID NO: 2206266 - RNA, 22 nt, Human
aggaugccccgucccccucugg

SEQ ID NO: 2206267 - RNA, 16 nt, Human
cugagccucagucucc

SEQ ID NO: 2206268 - RNA, 22 nt, Human
acaggauggcaggaggcaucca

SEQ ID NO: 2206269 - RNA, 16 nt, Human
agugaaauauuauuuu

SEQ ID NO: 2206270 - RNA, 23 nt, Human
auucaauaucuuuuuuuuaauaa

SEQ ID NO: 2206271 - RNA, 16 nt, Human
uggauacuccaugggg

SEQ ID NO: 2206272 - RNA, 20 nt, Human
cugagccucagucucccucc

SEQ ID NO: 2206273 - RNA, 14 nt, Human
auugucuagugaaa

SEQ ID NO: 2206274 - RNA, 21 nt, Human
cuauaaaacuaggugcugcag

SEQ ID NO: 2206275 - RNA, 14 nt, Human
aauauaaauaaaaa

SEQ ID NO: 2206276 - RNA, 20 nt, Human
agcucaggcuggcaccgcug

SEQ ID NO: 2206277 - RNA, 13 nt, Human
ccugagcuugcag

SEQ ID NO: 2206278 - RNA, 15 nt, Human
ccagcacagccucuu

SEQ ID NO: 2206279 - RNA, 20 nt, Human
ggcuccggacgcugcugccg

SEQ ID NO: 2206280 - RNA, 22 nt, Human
accucagcugccuccccagcuc

SEQ ID NO: 2206281 - RNA, 23 nt, Human
aacuuuuccaaugacauuuuguu

SEQ ID NO: 2206282 - RNA, 20 nt, Human
gcggggcggggagcgagccc

SEQ ID NO: 2206283 - RNA, 16 nt, Human
cuacacuccagugaga

SEQ ID NO: 2206284 - RNA, 13 nt, Human
uaacgauaaaaga

SEQ ID NO: 2206285 - RNA, 21 nt, Human
cugagccucagucucccuccc

SEQ ID NO: 2206286 - RNA, 17 nt, Human
caauucgauccccuguc

SEQ ID NO: 2206287 - RNA, 22 nt, Human
uuuauugaggcuuuaaaacuua

SEQ ID NO: 2206288 - RNA, 15 nt, Human
ggccugagaccaagg

SEQ ID NO: 2206289 - RNA, 16 nt, Human
gaaaaaauaacaauga

SEQ ID NO: 2206290 - RNA, 19 nt, Human
caacucccugccccccagc

SEQ ID NO: 2206291 - RNA, 19 nt, Human
uggugagugccuguaauca

SEQ ID NO: 2206292 - RNA, 19 nt, Human
aauuuuguuauguauauuu

SEQ ID NO: 2206293 - RNA, 22 nt, Human
gccccggggaggggcgcucgcu

SEQ ID NO: 2206294 - RNA, 14 nt, Human
auccuugaagauuu

SEQ ID NO: 2206295 - RNA, 23 nt, Human
ggaggcagagguugcagugagcc

SEQ ID NO: 2206296 - RNA, 23 nt, Human
uacuuccagggcuacgcgcgcuc

SEQ ID NO: 2206297 - RNA, 20 nt, Human
ggccaugggacagggaggac

SEQ ID NO: 2206298 - RNA, 17 nt, Human
gccgcgcugcgcgccgc

SEQ ID NO: 2206299 - RNA, 20 nt, Human
aacaaugcuguauuuuaaaa

SEQ ID NO: 2206300 - RNA, 12 nt, Human
cagccccuggga

SEQ ID NO: 2206301 - RNA, 15 nt, Human
aaauauuuauuuuaa

SEQ ID NO: 2206302 - RNA, 21 nt, Human
uuacauuuguauaaaauaauu

SEQ ID NO: 2206303 - RNA, 17 nt, Human
gacagucaccucaugga

SEQ ID NO: 2206304 - RNA, 17 nt, Human
ucauauuuauagccagg

SEQ ID NO: 2206305 - RNA, 20 nt, Human
aauaucuuuuuuuuaauaaa

SEQ ID NO: 2206306 - RNA, 15 nt, Human
ugagcucagcccugg

SEQ ID NO: 2206307 - RNA, 23 nt, Human
uguucuugugaacccaaagugug

SEQ ID NO: 2206308 - RNA, 22 nt, Human
aggcccccgggccgacggagcc

SEQ ID NO: 2206309 - RNA, 22 nt, Human
gaugcaguucugaagaagaugg

SEQ ID NO: 2206310 - RNA, 17 nt, Human
auaucaauuuaaaaaaa

SEQ ID NO: 2206311 - RNA, 19 nt, Human
ugaaauuguauuacaaauc

SEQ ID NO: 2206312 - RNA, 19 nt, Human
uuaaauggaaguaaauguu

SEQ ID NO: 2206313 - RNA, 22 nt, Human
guauucauauuuauagccaggu

SEQ ID NO: 2206314 - RNA, 17 nt, Human
augaucaguaugaaaau

SEQ ID NO: 2206315 - RNA, 13 nt, Human
ucaucccacccgc

SEQ ID NO: 2206316 - RNA, 16 nt, Human
auuuguauaaaauaau

SEQ ID NO: 2206317 - RNA, 17 nt, Human
cuuauuuguacauuuuu

SEQ ID NO: 2206318 - RNA, 12 nt, Human
aauacuuuauaa

SEQ ID NO: 2206319 - RNA, 15 nt, Human
cuuuaaaacuuaucc

SEQ ID NO: 2206320 - RNA, 23 nt, Human
auaucuuuuuuuuaauaaaccau

SEQ ID NO: 2206321 - RNA, 12 nt, Human
ggggcggcggcc

SEQ ID NO: 2206322 - RNA, 21 nt, Human
acucauuaaauggaaguaaau

SEQ ID NO: 2206323 - RNA, 22 nt, Human
ucuacuaaaaauacaaaaaaaa

SEQ ID NO: 2206324 - RNA, 14 nt, Human
gcugauuaaaccaa

SEQ ID NO: 2206325 - RNA, 14 nt, Human
uugacccacaagaa

SEQ ID NO: 2206326 - RNA, 17 nt, Human
ccagggcuacgcgcgcu

SEQ ID NO: 2206327 - RNA, 21 nt, Human
ggcaccgcuguacgcgagcgc

SEQ ID NO: 2206328 - RNA, 16 nt, Human
ugcaaauugucacagg

SEQ ID NO: 2206329 - RNA, 19 nt, Human
aaaacuaggugcugcagcc

SEQ ID NO: 2206330 - RNA, 16 nt, Human
gcccugaaagucccag

SEQ ID NO: 2206331 - RNA, 23 nt, Human
aagucccagaucaagccugccuc

SEQ ID NO: 2206332 - RNA, 21 nt, Human
auacauaaaguaugugcauau

SEQ ID NO: 2206333 - RNA, 13 nt, Human
gggggaggugagg

SEQ ID NO: 2206334 - RNA, 18 nt, Human
ccaggaggggcuucuggg

SEQ ID NO: 2206335 - RNA, 17 nt, Human
cuucacuguaaaauaau

SEQ ID NO: 2206336 - RNA, 23 nt, Human
ggucucagugucaaugcagcccc

SEQ ID NO: 2206337 - RNA, 16 nt, Human
ccaaauugagcuaggg

SEQ ID NO: 2206338 - RNA, 16 nt, Human
cccaaccucucccaac

SEQ ID NO: 2206339 - RNA, 19 nt, Human
ugggacaggggagaaccua

SEQ ID NO: 2206340 - RNA, 18 nt, Human
ucaaggguacacugccuu

SEQ ID NO: 2206341 - RNA, 15 nt, Human
augauaacuggaaac

SEQ ID NO: 2206342 - RNA, 16 nt, Human
gauggcaggaggcauc

SEQ ID NO: 2206343 - RNA, 16 nt, Human
auuauacccccugcaa

SEQ ID NO: 2206344 - RNA, 21 nt, Human
agucacuaguuguaauuuuuu

SEQ ID NO: 2206345 - RNA, 20 nt, Human
gcuugcagagaugaggccgc

SEQ ID NO: 2206346 - RNA, 21 nt, Human
uauuauuuuauagcuacuaau

SEQ ID NO: 2206347 - RNA, 13 nt, Human
ccaggcugagccu

SEQ ID NO: 2206348 - RNA, 14 nt, Human
cugcugguggcgcu

SEQ ID NO: 2206349 - RNA, 14 nt, Human
uucuggaauaaucc

SEQ ID NO: 2206350 - RNA, 13 nt, Human
guaacuaauuuua

SEQ ID NO: 2206351 - RNA, 14 nt, Human
cgcuccgcgcagcu

SEQ ID NO: 2206352 - RNA, 17 nt, Human
aguugauaaguacauga

SEQ ID NO: 2206353 - RNA, 16 nt, Human
cuccaugggguggggg

SEQ ID NO: 2206354 - RNA, 21 nt, Human
cccccucuccucucuuccucc

SEQ ID NO: 2206355 - RNA, 14 nt, Human
ucuauaauuuaaau

SEQ ID NO: 2206356 - RNA, 15 nt, Human
auauuuuuuguuaaa

SEQ ID NO: 2206357 - RNA, 18 nt, Human
acaaauccaaugaaauga

SEQ ID NO: 2206358 - RNA, 20 nt, Human
aaaacuuauccuccaugaau

SEQ ID NO: 2206359 - RNA, 22 nt, Human
ggguuccuuccucugagccuug

SEQ ID NO: 2206360 - RNA, 22 nt, Human
caaugcuguauuuuaaaagaau

SEQ ID NO: 2206361 - RNA, 14 nt, Human
cugcugagucccag

SEQ ID NO: 2206362 - RNA, 11 nt, Human
gggaaagaaga

SEQ ID NO: 2206363 - RNA, 15 nt, Human
ucuaugaaauauuau

SEQ ID NO: 2206364 - RNA, 22 nt, Human
uuuauggcacuaguauuucuau

SEQ ID NO: 2206365 - RNA, 15 nt, Human
gucaaugcagccccc

SEQ ID NO: 2206366 - RNA, 12 nt, Human
aaaauaacaaua

SEQ ID NO: 2206367 - RNA, 17 nt, Human
cuuccucugagccuugg

SEQ ID NO: 2206368 - RNA, 20 nt, Human
gagccugaucaccugcccug

SEQ ID NO: 2206369 - RNA, 20 nt, Human
caaauguucaucaaugaaug

SEQ ID NO: 2206370 - RNA, 13 nt, Human
gguccacaacaca

SEQ ID NO: 2206371 - RNA, 18 nt, Human
ccaaccuggaguugaaaa

SEQ ID NO: 2206372 - RNA, 15 nt, Human
gacagggaggacgcu

SEQ ID NO: 2206373 - RNA, 22 nt, Human
auuacuguaagaaaauaucacu

SEQ ID NO: 2206374 - RNA, 13 nt, Human
aaagaagagccgg

SEQ ID NO: 2206375 - RNA, 19 nt, Human
cuucuuacaaugcauucug

SEQ ID NO: 2206376 - RNA, 23 nt, Human
ucccgcuguuccucgccacgcuc

SEQ ID NO: 2206377 - RNA, 23 nt, Human
cauuguggucacaggaaguagag

SEQ ID NO: 2206378 - RNA, 15 nt, Human
gacucaccuccccca

SEQ ID NO: 2206379 - RNA, 18 nt, Human
auagcuacuaauuuuaaa

SEQ ID NO: 2206380 - RNA, 16 nt, Human
auccuugaagauuuac

SEQ ID NO: 2206381 - RNA, 18 nt, Human
cuuuccacagaagcucca

SEQ ID NO: 2206382 - RNA, 15 nt, Human
aaaaaauaacaauga

SEQ ID NO: 2206383 - RNA, 14 nt, Human
ggaaguagaggagg

SEQ ID NO: 2206384 - RNA, 13 nt, Human
uuuaaaaaagaaa

SEQ ID NO: 2206385 - RNA, 23 nt, Human
gauagauaggucagugcaaauac

SEQ ID NO: 2206386 - RNA, 20 nt, Human
ucaaaacuucagacauagaa

SEQ ID NO: 2206387 - RNA, 16 nt, Human
cacuggacucaccucc

SEQ ID NO: 2206388 - RNA, 22 nt, Human
gaugguucccuugaugaagaag

SEQ ID NO: 2206389 - RNA, 22 nt, Human
uaaaacaagcacuaaacaaaga

SEQ ID NO: 2206390 - RNA, 16 nt, Human
gccaugugcuaguaau

SEQ ID NO: 2206391 - RNA, 22 nt, Human
gaagugaaaaucuacacuccag

SEQ ID NO: 2206392 - RNA, 15 nt, Human
gauccugcaauucca

SEQ ID NO: 2206393 - RNA, 22 nt, Human
aucaccaaggcugauuaaacca

SEQ ID NO: 2206394 - RNA, 10 nt, Human
aauaaaacuu

SEQ ID NO: 2206395 - RNA, 16 nt, Human
uggcaagcucuaucac

SEQ ID NO: 2206396 - RNA, 16 nt, Human
cagggacuugaaccca

SEQ ID NO: 2206397 - RNA, 16 nt, Human
gggccgacggagccgg

SEQ ID NO: 2206398 - RNA, 18 nt, Human
agggugcacacaggaugg

SEQ ID NO: 2206399 - RNA, 14 nt, Human
cagauccuggaaau

SEQ ID NO: 2206400 - RNA, 12 nt, Human
aauaauuuuuaa

SEQ ID NO: 2206401 - RNA, 14 nt, Human
uuuuaaaaaagaaa

SEQ ID NO: 2206402 - RNA, 22 nt, Human
cuccugccuaagugcagccccg

SEQ ID NO: 2206403 - RNA, 14 nt, Human
ugaucaccugcccu

SEQ ID NO: 2206404 - RNA, 14 nt, Human
ggccuucggccucc

SEQ ID NO: 2206405 - RNA, 15 nt, Human
uucggccuccauccu

SEQ ID NO: 2206406 - RNA, 22 nt, Human
gucacaggaaguagaggaggcc

SEQ ID NO: 2206407 - RNA, 16 nt, Human
ccucauuaucagucca

SEQ ID NO: 2206408 - RNA, 23 nt, Human
cacaagaaaugaaagcagggacu

SEQ ID NO: 2206409 - RNA, 16 nt, Human
aauuucuucaacuccc

SEQ ID NO: 2206410 - RNA, 23 nt, Human
ucuagcaugucgucaaagcugaa

SEQ ID NO: 2206411 - RNA, 13 nt, Human
cugccuucucaac

SEQ ID NO: 2206412 - RNA, 17 nt, Human
cauccugugggaccugg

SEQ ID NO: 2206413 - RNA, 15 nt, Human
ucccccaucucuucu

SEQ ID NO: 2206414 - RNA, 19 nt, Human
cacaggaaccacaagacug

SEQ ID NO: 2206415 - RNA, 14 nt, Human
uaaaguaugugcau

SEQ ID NO: 2206416 - RNA, 17 nt, Human
cucccuggaaucuugua

SEQ ID NO: 2206417 - RNA, 14 nt, Human
cuuucauaauaagu

SEQ ID NO: 2206418 - RNA, 17 nt, Human
aaucuuauaauuuaaaa

SEQ ID NO: 2206419 - RNA, 15 nt, Human
uguauuuuaaaagaa

SEQ ID NO: 2206420 - RNA, 12 nt, Human
aguguuugaaag

SEQ ID NO: 2206421 - RNA, 20 nt, Human
uagaugcaguucugaagaag

SEQ ID NO: 2206422 - RNA, 19 nt, Human
uauauuuuugugauuuugu

SEQ ID NO: 2206423 - RNA, 19 nt, Human
ccaaggcccccgggccgac

SEQ ID NO: 2206424 - RNA, 14 nt, Human
acauauauaacaau

SEQ ID NO: 2206425 - RNA, 17 nt, Human
cauccuagucucuauca

SEQ ID NO: 2206426 - RNA, 12 nt, Human
uaagaagacugc

SEQ ID NO: 2206427 - RNA, 18 nt, Human
uuguaaaggaauuuaaaa

SEQ ID NO: 2206428 - RNA, 13 nt, Human
augcuagaacucc

SEQ ID NO: 2206429 - RNA, 21 nt, Human
auuauauuuauuacuguaaga

SEQ ID NO: 2206430 - RNA, 19 nt, Human
cuuccagauccuggaaauc

SEQ ID NO: 2206431 - RNA, 15 nt, Human
cgcauccuagucucu

SEQ ID NO: 2206432 - RNA, 20 nt, Human
uuaaauggucaauuuuguua

SEQ ID NO: 2206433 - RNA, 14 nt, Human
gagagugaacaaau

SEQ ID NO: 2206434 - RNA, 19 nt, Human
cuuggacaugggccccaga

SEQ ID NO: 2206435 - RNA, 16 nt, Human
ccuaagugcagccccg

SEQ ID NO: 2206436 - RNA, 14 nt, Human
auccaaugaaauga

SEQ ID NO: 2206437 - RNA, 13 nt, Human
aagaaaauaacga

SEQ ID NO: 2206438 - RNA, 20 nt, Human
agccuaguugaucagcuuau

SEQ ID NO: 2206439 - RNA, 15 nt, Human
guaaggggaauugag

SEQ ID NO: 2206440 - RNA, 21 nt, Human
gaaaugaguuuuucuuuucau

SEQ ID NO: 2206441 - RNA, 15 nt, Human
ugagcggaccuuccc

SEQ ID NO: 2206442 - RNA, 12 nt, Human
uuauuauaguca

SEQ ID NO: 2206443 - RNA, 21 nt, Human
aauuuacagagacagaaagca

SEQ ID NO: 2206444 - RNA, 14 nt, Human
cucugccucagaaa

SEQ ID NO: 2206445 - RNA, 15 nt, Human
aaauauaaauaaaaa

SEQ ID NO: 2206446 - RNA, 12 nt, Human
gaaagucccaga

SEQ ID NO: 2206447 - RNA, 13 nt, Human
cacuguaaaauaa

SEQ ID NO: 2206448 - RNA, 16 nt, Human
ccucaaucaguauuca

SEQ ID NO: 2206449 - RNA, 18 nt, Human
aauaucaguuauuuuuaa

SEQ ID NO: 2206450 - RNA, 19 nt, Human
ccucagcugccuccccagc

SEQ ID NO: 2206451 - RNA, 17 nt, Human
uaucaauuuaaaaaaaa

SEQ ID NO: 2206452 - RNA, 15 nt, Human
aaggcuccugagaca

SEQ ID NO: 2206453 - RNA, 18 nt, Human
ccauccugccccugagcc

SEQ ID NO: 2206454 - RNA, 17 nt, Human
caaauauaaauaaaaau

SEQ ID NO: 2206455 - RNA, 15 nt, Human
aagaagugaaaaucu

SEQ ID NO: 2206456 - RNA, 16 nt, Human
ugagcucagcccuggu

SEQ ID NO: 2206457 - RNA, 13 nt, Human
gcuguacgcgagc

SEQ ID NO: 2206458 - RNA, 16 nt, Human
auuugaugcuacagga

SEQ ID NO: 2206459 - RNA, 15 nt, Human
agacaaggaaaaaau

SEQ ID NO: 2206460 - RNA, 14 nt, Human
aaagaggaaugaag

SEQ ID NO: 2206461 - RNA, 17 nt, Human
aagacaaggaaaaaaua

SEQ ID NO: 2206462 - RNA, 14 nt, Human
acuaauuuuaaaau

SEQ ID NO: 2206463 - RNA, 13 nt, Human
uaacaauaaaaga

SEQ ID NO: 2206464 - RNA, 19 nt, Human
agaaaauaacaauaaaaga

SEQ ID NO: 2206465 - RNA, 17 nt, Human
cuaagcuucacuguaaa

SEQ ID NO: 2206466 - RNA, 21 nt, Human
gauaaaagacagugaaagaaa

SEQ ID NO: 2206467 - RNA, 23 nt, Human
cugggccauagucauucugccug

SEQ ID NO: 2206468 - RNA, 15 nt, Human
ccugaaagucccaga

SEQ ID NO: 2206469 - RNA, 13 nt, Human
cgcgcccucuggc

SEQ ID NO: 2206470 - RNA, 18 nt, Human
ccucagcugccuccccag

SEQ ID NO: 2206471 - RNA, 21 nt, Human
ccuagucucuaucauuaaagu

SEQ ID NO: 2206472 - RNA, 13 nt, Human
gauuguaaaaugg

SEQ ID NO: 2206473 - RNA, 21 nt, Human
cucuaucccaaccucucccaa

SEQ ID NO: 2206474 - RNA, 20 nt, Human
auuacauuuguauaaaauaa

SEQ ID NO: 2206475 - RNA, 14 nt, Human
gcucgcccacuucc

SEQ ID NO: 2206476 - RNA, 15 nt, Human
cagugaaagaaaaua

SEQ ID NO: 2206477 - RNA, 18 nt, Human
ggcccugugcggccuggu

SEQ ID NO: 2206478 - RNA, 16 nt, Human
aucaaaagaaagaaaa

SEQ ID NO: 2206479 - RNA, 14 nt, Human
ccacauccuguggg

SEQ ID NO: 2206480 - RNA, 15 nt, Human
ggcaagcucuaucac

SEQ ID NO: 2206481 - RNA, 14 nt, Human
uucacauuuaaaua

SEQ ID NO: 2206482 - RNA, 22 nt, Human
aggcuccugagacacaugggug

SEQ ID NO: 2206483 - RNA, 14 nt, Human
auaaaauaauuuuu

SEQ ID NO: 2206484 - RNA, 15 nt, Human
aauauaaauaaaaau

SEQ ID NO: 2206485 - RNA, 15 nt, Human
uauaaauaaaaauaa

SEQ ID NO: 2206486 - RNA, 16 nt, Human
cugagcgacagugaga

SEQ ID NO: 2206487 - RNA, 13 nt, Human
cccagauaccaug

SEQ ID NO: 2206488 - RNA, 20 nt, Human
cgcucggccugcucgcccac

SEQ ID NO: 2206489 - RNA, 20 nt, Human
cagugaaagaaaauaacgau

SEQ ID NO: 2206490 - RNA, 17 nt, Human
uaauuuuuauauuugaa

SEQ ID NO: 2206491 - RNA, 16 nt, Human
ugcuaagucuuauaua

SEQ ID NO: 2206492 - RNA, 12 nt, Human
cacaacacacag

SEQ ID NO: 2206493 - RNA, 16 nt, Human
uggucugugagaugcu

SEQ ID NO: 2206494 - RNA, 23 nt, Human
ugaaaaucuuauaauuuaaaaua

SEQ ID NO: 2206495 - RNA, 19 nt, Human
uggaaauguuuacagaucc

SEQ ID NO: 2206496 - RNA, 20 nt, Human
gcgcggggcggggagcgagc

SEQ ID NO: 2206497 - RNA, 22 nt, Human
uccgcauccuagucucuaucau

SEQ ID NO: 2206498 - RNA, 17 nt, Human
cugagcggaccuuccca

SEQ ID NO: 2206499 - RNA, 13 nt, Human
aaacauccuacaa

SEQ ID NO: 2206500 - RNA, 21 nt, Human
aaagcugaaauggacuuuugu

SEQ ID NO: 2206501 - RNA, 18 nt, Human
uuacuguaagaaaauauc

SEQ ID NO: 2206502 - RNA, 22 nt, Human
gcauccuagucucuaucauuaa

SEQ ID NO: 2206503 - RNA, 22 nt, Human
gcggguccgggucgcaggacca

SEQ ID NO: 2206504 - RNA, 17 nt, Human
auuauuuuuuaaaaaaa

SEQ ID NO: 2206505 - RNA, 14 nt, Human
agauguagaggaga

SEQ ID NO: 2206506 - RNA, 20 nt, Human
cugccgugggccugagacca

SEQ ID NO: 2206507 - RNA, 21 nt, Human
gagcuaggggggucagccagc

SEQ ID NO: 2206508 - RNA, 20 nt, Human
aaaaucuuauaauuuaaaau

SEQ ID NO: 2206509 - RNA, 19 nt, Human
cuaccuguucgcgcgccuc

SEQ ID NO: 2206510 - RNA, 11 nt, Human
gccuccagcug

SEQ ID NO: 2206511 - RNA, 19 nt, Human
gaggcauccaaaggcuccu

SEQ ID NO: 2206512 - RNA, 18 nt, Human
cccgggccgacggagccg

SEQ ID NO: 2206513 - RNA, 19 nt, Human
aguuguaauuuuuuugugg

SEQ ID NO: 2206514 - RNA, 13 nt, Human
acagcccuucuuu

SEQ ID NO: 2206515 - RNA, 19 nt, Human
ucucuaucauuaaaguucu

SEQ ID NO: 2206516 - RNA, 15 nt, Human
cucguggaacaguua

SEQ ID NO: 2206517 - RNA, 13 nt, Human
caucccacccgcc

SEQ ID NO: 2206518 - RNA, 15 nt, Human
auagaaguaaaaaca

SEQ ID NO: 2206519 - RNA, 23 nt, Human
caauaacgauaaaagacagugaa

SEQ ID NO: 2206520 - RNA, 23 nt, Human
aaagcccagcuugaaaccuucac

SEQ ID NO: 2206521 - RNA, 19 nt, Human
agccuccagcugccccggg

SEQ ID NO: 2206522 - RNA, 18 nt, Human
auggaaguaaauguuguu

SEQ ID NO: 2206523 - RNA, 13 nt, Human
ucuauaauuuaaa

SEQ ID NO: 2206524 - RNA, 23 nt, Human
gaaaacaauaacgauaaaagaca

SEQ ID NO: 2206525 - RNA, 21 nt, Human
cuuuuccaaugacauuuuguu

SEQ ID NO: 2206526 - RNA, 16 nt, Human
gaaucacuugaacccg

SEQ ID NO: 2206527 - RNA, 14 nt, Human
cagugaaagaaaau

SEQ ID NO: 2206528 - RNA, 18 nt, Human
ccugaaagaggaaugaag

SEQ ID NO: 2206529 - RNA, 16 nt, Human
cucucuuccucccugg

SEQ ID NO: 2206530 - RNA, 17 nt, Human
aaccuagggugauauua

SEQ ID NO: 2206531 - RNA, 14 nt, Human
ccagcuggccggga

SEQ ID NO: 2206532 - RNA, 15 nt, Human
cgcccacuuccuccc

SEQ ID NO: 2206533 - RNA, 17 nt, Human
aaagacaaggaaaaaau

SEQ ID NO: 2206534 - RNA, 13 nt, Human
cggccggcgcgcu

SEQ ID NO: 2206535 - RNA, 13 nt, Human
cacacugaagaag

SEQ ID NO: 2206536 - RNA, 23 nt, Human
cuaguaauuggaaaggcagcucu

SEQ ID NO: 2206537 - RNA, 19 nt, Human
ugagguaaccucauuauca

SEQ ID NO: 2206538 - RNA, 12 nt, Human
gggaaagaagag

SEQ ID NO: 2206539 - RNA, 21 nt, Human
uuauguuuaauucugaaagca

SEQ ID NO: 2206540 - RNA, 12 nt, Human
ccuucagccuga

SEQ ID NO: 2206541 - RNA, 21 nt, Human
cccugggaccaggcaccccca

SEQ ID NO: 2206542 - RNA, 12 nt, Human
acugaaaucaua

SEQ ID NO: 2206543 - RNA, 23 nt, Human
ccccggggaggggcgcucgcuuc

SEQ ID NO: 2206544 - RNA, 13 nt, Human
agaaaugaaagca

SEQ ID NO: 2206545 - RNA, 22 nt, Human
uauuucagauaaucacaauaca

SEQ ID NO: 2206546 - RNA, 14 nt, Human
aagagugaaggauu

SEQ ID NO: 2206547 - RNA, 15 nt, Human
gaccacugcagaaga

SEQ ID NO: 2206548 - RNA, 18 nt, Human
ugugcauauuuuauuaua

SEQ ID NO: 2206549 - RNA, 16 nt, Human
cuagaauucacuccac

SEQ ID NO: 2206550 - RNA, 16 nt, Human
cgcgcgcuccgcgcag

SEQ ID NO: 2206551 - RNA, 13 nt, Human
aagugcagccccg

SEQ ID NO: 2206552 - RNA, 22 nt, Human
ucuuccuuuuuuaguucuucaa

SEQ ID NO: 2206553 - RNA, 18 nt, Human
ucuucaacucccugcccc

SEQ ID NO: 2206554 - RNA, 20 nt, Human
agaugcaguucugaagaaga

SEQ ID NO: 2206555 - RNA, 13 nt, Human
agacacagugacc

SEQ ID NO: 2206556 - RNA, 17 nt, Human
cccacuagacccacugg

SEQ ID NO: 2206557 - RNA, 21 nt, Human
auuuguauaaaauaauuuuua

SEQ ID NO: 2206558 - RNA, 18 nt, Human
gcaaagcccagcuugaaa

SEQ ID NO: 2206559 - RNA, 16 nt, Human
aaauaacaaugaaagu

SEQ ID NO: 2206560 - RNA, 15 nt, Human
cugcagauaaacagu

SEQ ID NO: 2206561 - RNA, 19 nt, Human
gccccccagcccuccuuau

SEQ ID NO: 2206562 - RNA, 13 nt, Human
caacucccugccc

SEQ ID NO: 2206563 - RNA, 22 nt, Human
cgggucgcaggaccaucccggc

SEQ ID NO: 2206564 - RNA, 21 nt, Human
gagaaggagcucccaggaggg

SEQ ID NO: 2206565 - RNA, 15 nt, Human
uucacuguaaaauaa

SEQ ID NO: 2206566 - RNA, 14 nt, Human
ggcaauagucaaau

SEQ ID NO: 2206567 - RNA, 20 nt, Human
aaagacaaggaaaaaauaac

SEQ ID NO: 2206568 - RNA, 13 nt, Human
uuuucuuuucauu

SEQ ID NO: 2206569 - RNA, 21 nt, Human
gcucggccugcucgcccacuu

SEQ ID NO: 2206570 - RNA, 14 nt, Human
ccagcuagaauuca

SEQ ID NO: 2206571 - RNA, 17 nt, Human
cuggacucaccuccccc

SEQ ID NO: 2206572 - RNA, 14 nt, Human
gcaaagcccagcuu

SEQ ID NO: 2206573 - RNA, 18 nt, Human
uaucaaaagaaagaaaau

SEQ ID NO: 2206574 - RNA, 19 nt, Human
uuauauauauauauuuuuu

SEQ ID NO: 2206575 - RNA, 21 nt, Human
auaguuguaccgcaaugugac

SEQ ID NO: 2206576 - RNA, 18 nt, Human
uuuuauaucaauuuaaaa

SEQ ID NO: 2206577 - RNA, 22 nt, Human
agaaaacaauaacgauaaaaga

SEQ ID NO: 2206578 - RNA, 11 nt, Human
aauuccacagc

SEQ ID NO: 2206579 - RNA, 14 nt, Human
agaaaugaaagcag

SEQ ID NO: 2206580 - RNA, 16 nt, Human
uugucaauaaaaucca

SEQ ID NO: 2206581 - RNA, 11 nt, Human
accauuuuuac

SEQ ID NO: 2206582 - RNA, 16 nt, Human
auuuuuuuuuuuaaaa

SEQ ID NO: 2206583 - RNA, 20 nt, Human
uuccacagaagcuccaggua

SEQ ID NO: 2206584 - RNA, 12 nt, Human
ggugcugcagcc

SEQ ID NO: 2206585 - RNA, 22 nt, Human
caauaaaagacaaggaaaaaau

SEQ ID NO: 2206586 - RNA, 22 nt, Human
uaaacuguaaagcuuugugcag

SEQ ID NO: 2206587 - RNA, 20 nt, Human
ugguuguauuauuuuuuaaa

SEQ ID NO: 2206588 - RNA, 20 nt, Human
accugauuucugagcauuua

SEQ ID NO: 2206589 - RNA, 21 nt, Human
gcaaaauuuuuucucuaggaa

SEQ ID NO: 2206590 - RNA, 12 nt, Human
agaucaagccug

SEQ ID NO: 2206591 - RNA, 21 nt, Human
aagcuccauuuuuagugaaau

SEQ ID NO: 2206592 - RNA, 13 nt, Human
cugugcggccugg

SEQ ID NO: 2206593 - RNA, 16 nt, Human
aacuugguuuuaauua

SEQ ID NO: 2206594 - RNA, 13 nt, Human
caacaucuaguga

SEQ ID NO: 2206595 - RNA, 22 nt, Human
agagccggagccuccagcugcc

SEQ ID NO: 2206596 - RNA, 13 nt, Human
aagacagugaaag

SEQ ID NO: 2206597 - RNA, 23 nt, Human
cuacacgagauacagaauuuuau

SEQ ID NO: 2206598 - RNA, 16 nt, Human
guuuuuuuuuaaaaaa

SEQ ID NO: 2206599 - RNA, 19 nt, Human
ucccgcuguuccucgccac

SEQ ID NO: 2206600 - RNA, 13 nt, Human
agccucagucucc

SEQ ID NO: 2206601 - RNA, 13 nt, Human
cacaacacacaga

SEQ ID NO: 2206602 - RNA, 11 nt, Human
ccggccgcgcu

SEQ ID NO: 2206603 - RNA, 16 nt, Human
ugaaauuguauuacaa

SEQ ID NO: 2206604 - RNA, 15 nt, Human
uauaauuuaaauaua

SEQ ID NO: 2206605 - RNA, 16 nt, Human
uucaguuauuauauuu

SEQ ID NO: 2206606 - RNA, 18 nt, Human
ccaaaggcuccugagaca

SEQ ID NO: 2206607 - RNA, 12 nt, Human
ucaccccuugcc

SEQ ID NO: 2206608 - RNA, 16 nt, Human
aucaguuauuuuuaaa

SEQ ID NO: 2206609 - RNA, 21 nt, Human
auggcagcuuuccucaaaacu

SEQ ID NO: 2206610 - RNA, 16 nt, Human
uaucaaaagaaagaaa

SEQ ID NO: 2206611 - RNA, 22 nt, Human
aaacaaggaugaauuaaguuuu

SEQ ID NO: 2206612 - RNA, 15 nt, Human
acaaaugggaaacaa

SEQ ID NO: 2206613 - RNA, 13 nt, Human
gccuccagcugcc

SEQ ID NO: 2206614 - RNA, 20 nt, Human
caggaggggcuucugggcag

SEQ ID NO: 2206615 - RNA, 16 nt, Human
ucgcuuccgcauccua

SEQ ID NO: 2206616 - RNA, 16 nt, Human
cagcucuaucccaacc

SEQ ID NO: 2206617 - RNA, 19 nt, Human
acuuauuuguacauuuuuu

SEQ ID NO: 2206618 - RNA, 19 nt, Human
uucccuugaugaagaaguu

SEQ ID NO: 2206619 - RNA, 16 nt, Human
acagagacagaaagca

SEQ ID NO: 2206620 - RNA, 11 nt, Human
uuauauuuauu

SEQ ID NO: 2206621 - RNA, 17 nt, Human
ugaaauaagccagacau

SEQ ID NO: 2206622 - RNA, 13 nt, Human
ccaaccucuccca

SEQ ID NO: 2206623 - RNA, 13 nt, Human
ggaccuucccagc

SEQ ID NO: 2206624 - RNA, 21 nt, Human
gaggugagguaccagccuugg

SEQ ID NO: 2206625 - RNA, 17 nt, Human
ggaaauauuuauuuuaa

SEQ ID NO: 2206626 - RNA, 16 nt, Human
cuggccuucggccucc

SEQ ID NO: 2206627 - RNA, 18 nt, Human
uccagcuggccgggagcc

SEQ ID NO: 2206628 - RNA, 22 nt, Human
cauaaauguugacaugggacau

SEQ ID NO: 2206629 - RNA, 19 nt, Human
cggggcggggagcgagccc

SEQ ID NO: 2206630 - RNA, 17 nt, Human
cucaggcuggcaccgcu

SEQ ID NO: 2206631 - RNA, 21 nt, Human
aaaagguauuuuaaucaccaa

SEQ ID NO: 2206632 - RNA, 17 nt, Human
ccucagcugccucccca

SEQ ID NO: 2206633 - RNA, 14 nt, Human
gcuggagcucugcc

SEQ ID NO: 2206634 - RNA, 21 nt, Human
aaucaccaaggcugauuaaac

SEQ ID NO: 2206635 - RNA, 15 nt, Human
cucaacaaacauaau

SEQ ID NO: 2206636 - RNA, 22 nt, Human
cuaucaauccaagaacuuauuu

SEQ ID NO: 2206637 - RNA, 17 nt, Human
ggagggcgcggggcggg

SEQ ID NO: 2206638 - RNA, 18 nt, Human
gaaaauaacgauaaaaga

SEQ ID NO: 2206639 - RNA, 19 nt, Human
augaaagcagggacuugaa

SEQ ID NO: 2206640 - RNA, 18 nt, Human
ccuuccuaauuccacagc

SEQ ID NO: 2206641 - RNA, 11 nt, Human
cauaugaaaag

SEQ ID NO: 2206642 - RNA, 14 nt, Human
aaacuuuuccaaug

SEQ ID NO: 2206643 - RNA, 21 nt, Human
aaacgaggauugggaaaaagu

SEQ ID NO: 2206644 - RNA, 13 nt, Human
aaaauaacaauga

SEQ ID NO: 2206645 - RNA, 20 nt, Human
auauuuuauaucaauuuaaa

SEQ ID NO: 2206646 - RNA, 20 nt, Human
uccacuuggacaugggcccc

SEQ ID NO: 2206647 - RNA, 23 nt, Human
ccugggaccaggcacccccagaa

SEQ ID NO: 2206648 - RNA, 15 nt, Human
uggacucaccucccc

SEQ ID NO: 2206649 - RNA, 14 nt, Human
gagcccauggcacu

SEQ ID NO: 2206650 - RNA, 21 nt, Human
ucgcccacuuccucccggccg

SEQ ID NO: 2206651 - RNA, 20 nt, Human
aauuaaguuuuuuuuuaaaa

SEQ ID NO: 2206652 - RNA, 12 nt, Human
acacugaagaag

SEQ ID NO: 2206653 - RNA, 19 nt, Human
uccacauccugugggaccu

SEQ ID NO: 2206654 - RNA, 13 nt, Human
accuggccgcagu

SEQ ID NO: 2206655 - RNA, 14 nt, Human
ugcuucuguuuuau

SEQ ID NO: 2206656 - RNA, 15 nt, Human
gugggccugagacca

SEQ ID NO: 2206657 - RNA, 13 nt, Human
cgcugcgcgccgc

SEQ ID NO: 2206658 - RNA, 20 nt, Human
ccuucucaccugugagacca

SEQ ID NO: 2206659 - RNA, 16 nt, Human
aggccaugggacaggg

SEQ ID NO: 2206660 - RNA, 16 nt, Human
ucuuauaauuuaaaau

SEQ ID NO: 2206661 - RNA, 15 nt, Human
ugccgugggccugag

SEQ ID NO: 2206662 - RNA, 15 nt, Human
aaggguacacugccu

SEQ ID NO: 2206663 - RNA, 21 nt, Human
ugaaauggacuuuuguacaua

SEQ ID NO: 2206664 - RNA, 20 nt, Human
uaugcuucuguuuuauaauu

SEQ ID NO: 2206665 - RNA, 12 nt, Human
gccccugagccc

SEQ ID NO: 2206666 - RNA, 20 nt, Human
uuaaugccacuaaauugaca

SEQ ID NO: 2206667 - RNA, 21 nt, Human
caucuagcaugucgucaaagc

SEQ ID NO: 2206668 - RNA, 22 nt, Human
ggccauagucauucugccugcc

SEQ ID NO: 2206669 - RNA, 18 nt, Human
auccccaagccuggcaag

SEQ ID NO: 2206670 - RNA, 12 nt, Human
uucagccugaaa

SEQ ID NO: 2206671 - RNA, 13 nt, Human
guuauuuuuaaac

SEQ ID NO: 2206672 - RNA, 16 nt, Human
acaaggaugaauuaag

SEQ ID NO: 2206673 - RNA, 20 nt, Human
uuucuucaacucccugcccc

SEQ ID NO: 2206674 - RNA, 13 nt, Human
cagcugccucccc

SEQ ID NO: 2206675 - RNA, 15 nt, Human
gaaaacaaggaugaa

SEQ ID NO: 2206676 - RNA, 13 nt, Human
gcucucuggccuu

SEQ ID NO: 2206677 - RNA, 19 nt, Human
auuauuuuuuaaaaaaauu

SEQ ID NO: 2206678 - RNA, 19 nt, Human
aguuauuuuuaaacuguaa

SEQ ID NO: 2206679 - RNA, 23 nt, Human
acuaguuguaauuuuuuuguggg

SEQ ID NO: 2206680 - RNA, 14 nt, Human
agaauucauucacu

SEQ ID NO: 2206681 - RNA, 21 nt, Human
gaaaaguauguuagugcaaau

SEQ ID NO: 2206682 - RNA, 17 nt, Human
auuuuaauaauguuuca

SEQ ID NO: 2206683 - RNA, 15 nt, Human
agcucuaucaccaag

SEQ ID NO: 2206684 - RNA, 18 nt, Human
uccucgccacgcucuggg

SEQ ID NO: 2206685 - RNA, 22 nt, Human
caccagucugacuguuuccauc

SEQ ID NO: 2206686 - RNA, 14 nt, Human
ccggggaggggcgc

SEQ ID NO: 2206687 - RNA, 15 nt, Human
ccucauguccacugg

SEQ ID NO: 2206688 - RNA, 18 nt, Human
aaaguaacccuacaaaac

SEQ ID NO: 2206689 - RNA, 19 nt, Human
ggugcugcagccccuggga

SEQ ID NO: 2206690 - RNA, 16 nt, Human
cgcuguuccucgccac

SEQ ID NO: 2206691 - RNA, 20 nt, Human
uaugaaaaggcuaagcuuca

SEQ ID NO: 2206692 - RNA, 19 nt, Human
ugagcgcccacuagaccca

SEQ ID NO: 2206693 - RNA, 19 nt, Human
ccaccugccuauauuuuuu

SEQ ID NO: 2206694 - RNA, 21 nt, Human
aaaauaugccccauucaacau

SEQ ID NO: 2206695 - RNA, 17 nt, Human
gcgcccucuggcugcug

SEQ ID NO: 2206696 - RNA, 12 nt, Human
ucagcugccucc

SEQ ID NO: 2206697 - RNA, 18 nt, Human
cauccaaaggcuccugag

SEQ ID NO: 2206698 - RNA, 18 nt, Human
auuuauuacuguaagaaa

SEQ ID NO: 2206699 - RNA, 20 nt, Human
augucgucaaagcugaaaug

SEQ ID NO: 2206700 - RNA, 14 nt, Human
uauaauuuaaauau

SEQ ID NO: 2206701 - RNA, 21 nt, Human
aaguuuaugguuguauuauuu

SEQ ID NO: 2206702 - RNA, 23 nt, Human
uagauguauagguugaugguggu

SEQ ID NO: 2206703 - RNA, 20 nt, Human
gcacccccagaaugaccugg

SEQ ID NO: 2206704 - RNA, 13 nt, Human
ugcauuucuaaag

SEQ ID NO: 2206705 - RNA, 12 nt, Human
gccggcgcgcuc

SEQ ID NO: 2206706 - RNA, 12 nt, Human
acaugagguacu

SEQ ID NO: 2206707 - RNA, 18 nt, Human
cacuccagugagacagcu

SEQ ID NO: 2206708 - RNA, 19 nt, Human
auguuuacagauccccaag

SEQ ID NO: 2206709 - RNA, 19 nt, Human
ccaggcacccccagaauga

SEQ ID NO: 2206710 - RNA, 16 nt, Human
ucaucaaugaaugaau

SEQ ID NO: 2206711 - RNA, 16 nt, Human
ugacaagcucacagac

SEQ ID NO: 2206712 - RNA, 23 nt, Human
agaguuuagcuggaaaaguaugu

SEQ ID NO: 2206713 - RNA, 13 nt, Human
ugaaauuguauua

SEQ ID NO: 2206714 - RNA, 23 nt, Human
ugccccggggaggggcgcucgcu

SEQ ID NO: 2206715 - RNA, 17 nt, Human
gucaaagcugaaaugga

SEQ ID NO: 2206716 - RNA, 19 nt, Human
cccugccccccagcccucc

SEQ ID NO: 2206717 - RNA, 23 nt, Human
uccaacuaucucauuuccaagca

SEQ ID NO: 2206718 - RNA, 20 nt, Human
aaaacaagcacuaaacaaag

SEQ ID NO: 2206719 - RNA, 15 nt, Human
gugaccacugcagaa

SEQ ID NO: 2206720 - RNA, 14 nt, Human
acccgggaggcaga

SEQ ID NO: 2206721 - RNA, 22 nt, Human
uaaaauaauuuuuauauuugaa

SEQ ID NO: 2206722 - RNA, 23 nt, Human
gaaugagagacacacugaagaag

SEQ ID NO: 2206723 - RNA, 17 nt, Human
accucagcugccucccc

SEQ ID NO: 2206724 - RNA, 21 nt, Human
aaugucauuguucuugugaac

SEQ ID NO: 2206725 - RNA, 17 nt, Human
agguccacaacacacag

SEQ ID NO: 2206726 - RNA, 16 nt, Human
uuaauaauuuuuaauu

SEQ ID NO: 2206727 - RNA, 19 nt, Human
auugaggacacugauaugg

SEQ ID NO: 2206728 - RNA, 13 nt, Human
uuauucacaagac

SEQ ID NO: 2206729 - RNA, 14 nt, Human
auauuuauuuuaau

SEQ ID NO: 2206730 - RNA, 20 nt, Human
uaauaaguugcauagguuua

SEQ ID NO: 2206731 - RNA, 18 nt, Human
auguuaaaacugggacag

SEQ ID NO: 2206732 - RNA, 21 nt, Human
cugagcccggaaacuccacau

SEQ ID NO: 2206733 - RNA, 19 nt, Human
gccgcgcugcgcgccgcgc

SEQ ID NO: 2206734 - RNA, 23 nt, Human
gccugagcggaccuucccagcua

SEQ ID NO: 2206735 - RNA, 17 nt, Human
gacgagaaaacaauaac

SEQ ID NO: 2206736 - RNA, 14 nt, Human
cucaacaaacauaa

SEQ ID NO: 2206737 - RNA, 19 nt, Human
acggagccgggaaagaaga

SEQ ID NO: 2206738 - RNA, 20 nt, Human
cgcgcucaucccacccgccc

SEQ ID NO: 2206739 - RNA, 17 nt, Human
auaaaguaugugcauau

SEQ ID NO: 2206740 - RNA, 15 nt, Human
ugcuucuguuuuaua

SEQ ID NO: 2206741 - RNA, 17 nt, Human
ggagcucguggaacagu

SEQ ID NO: 2206742 - RNA, 17 nt, Human
gccccccagcccuccuu

SEQ ID NO: 2206743 - RNA, 14 nt, Human
uaaauaaaaauaau

SEQ ID NO: 2206744 - RNA, 16 nt, Human
uauaugucacuuugcu

SEQ ID NO: 2206745 - RNA, 17 nt, Human
agacagugaaagaaaau

SEQ ID NO: 2206746 - RNA, 14 nt, Human
cagauccccaagcc

SEQ ID NO: 2206747 - RNA, 17 nt, Human
aucaaggguacacugcc

SEQ ID NO: 2206748 - RNA, 16 nt, Human
cgcucaucccacccgc

SEQ ID NO: 2206749 - RNA, 14 nt, Human
agccuccagcugcc

SEQ ID NO: 2206750 - RNA, 20 nt, Human
ugagcgcccacuagacccac

SEQ ID NO: 2206751 - RNA, 16 nt, Human
ccugccccccagcccu

SEQ ID NO: 2206752 - RNA, 18 nt, Human
cccucuucugacacuaaa

SEQ ID NO: 2206753 - RNA, 15 nt, Human
gcugcgcucggccug

SEQ ID NO: 2206754 - RNA, 20 nt, Human
aauuuugugaagcaaaauuu

SEQ ID NO: 2206755 - RNA, 23 nt, Human
uuagaugcaguucugaagaagau

SEQ ID NO: 2206756 - RNA, 19 nt, Human
cucugccucagaaaacaag

SEQ ID NO: 2206757 - RNA, 21 nt, Human
ucuuaggguuaugauuaagua

SEQ ID NO: 2206758 - RNA, 20 nt, Human
cugguggcgcuggcugcgcu

SEQ ID NO: 2206759 - RNA, 19 nt, Human
aagguccuggcaaagauga

SEQ ID NO: 2206760 - RNA, 22 nt, Human
agugagcagucaggaaagagaa

SEQ ID NO: 2206761 - RNA, 22 nt, Human
uguauacugugugcuaaaacaa

SEQ ID NO: 2206762 - RNA, 14 nt, Human
caacuauaaaacua

SEQ ID NO: 2206763 - RNA, 14 nt, Human
ggggcggggagcga

SEQ ID NO: 2206764 - RNA, 23 nt, Human
aaaaacagaccgggguucccgug

SEQ ID NO: 2206765 - RNA, 20 nt, Human
gaauucauucacucaacaaa

SEQ ID NO: 2206766 - RNA, 16 nt, Human
uucacauuuaaauaaa

SEQ ID NO: 2206767 - RNA, 16 nt, Human
aauuacauuuguauaa

SEQ ID NO: 2206768 - RNA, 22 nt, Human
cgcccacuuccucccggccgcg

SEQ ID NO: 2206769 - RNA, 18 nt, Human
aaagagugaaggauuuau

SEQ ID NO: 2206770 - RNA, 12 nt, Human
caacccaaaugu

SEQ ID NO: 2206771 - RNA, 19 nt, Human
ggcaccgcuguacgcgagc

SEQ ID NO: 2206772 - RNA, 18 nt, Human
uauuuucuauaauuuaaa

SEQ ID NO: 2206773 - RNA, 18 nt, Human
uccuaauuccacagcugc

SEQ ID NO: 2206774 - RNA, 23 nt, Human
ucugacacuaaaacaccucagcu

SEQ ID NO: 2206775 - RNA, 23 nt, Human
uagucauucugccugcccugaaa

SEQ ID NO: 2206776 - RNA, 16 nt, Human
gaagauguagaggaga

SEQ ID NO: 2206777 - RNA, 20 nt, Human
ccuguucgcgcgccuccgcu

SEQ ID NO: 2206778 - RNA, 19 nt, Human
agccugaucaccugcccug

SEQ ID NO: 2206779 - RNA, 22 nt, Human
aauaugccccauucaacaucua

SEQ ID NO: 2206780 - RNA, 21 nt, Human
agcccuucuuuccacagaagc

SEQ ID NO: 2206781 - RNA, 21 nt, Human
aacuuauccuccaugaauauc

SEQ ID NO: 2206782 - RNA, 20 nt, Human
agaagaacugaaaucauacu

SEQ ID NO: 2206783 - RNA, 12 nt, Human
caggacagcccu

SEQ ID NO: 2206784 - RNA, 17 nt, Human
ugguucccuugaugaag

SEQ ID NO: 2206785 - RNA, 16 nt, Human
cucagcccuggugggc

SEQ ID NO: 2206786 - RNA, 22 nt, Human
cggccugcucgcccacuuccuc

SEQ ID NO: 2206787 - RNA, 14 nt, Human
ggccgcagugaggc

SEQ ID NO: 2206788 - RNA, 13 nt, Human
ugaaagaaaauaa

SEQ ID NO: 2206789 - RNA, 15 nt, Human
ccccagaaugaccug

SEQ ID NO: 2206790 - RNA, 14 nt, Human
uggcuugaguuuaa

SEQ ID NO: 2206791 - RNA, 16 nt, Human
cuucugggcagacucu

SEQ ID NO: 2206792 - RNA, 20 nt, Human
uaaaagacaaggaaaaaaua

SEQ ID NO: 2206793 - RNA, 15 nt, Human
cuagaauucacucca

SEQ ID NO: 2206794 - RNA, 23 nt, Human
aggcacccccagaaugaccuggc

SEQ ID NO: 2206795 - RNA, 12 nt, Human
aauuuuaaaaug

SEQ ID NO: 2206796 - RNA, 21 nt, Human
ucccaggaggggcuucugggc

SEQ ID NO: 2206797 - RNA, 20 nt, Human
uuaaguuuuuuuuuaaaaaa

SEQ ID NO: 2206798 - RNA, 19 nt, Human
acauuuguauaaaauaauu

SEQ ID NO: 2206799 - RNA, 14 nt, Human
aagugugacucauu

SEQ ID NO: 2206800 - RNA, 23 nt, Human
ggccuccauccugaggcuccacu

SEQ ID NO: 2206801 - RNA, 21 nt, Human
guccccuauccuacuuccccu

SEQ ID NO: 2206802 - RNA, 23 nt, Human
gggaaacaaaaggauaaugaaua

SEQ ID NO: 2206803 - RNA, 22 nt, Human
aagagccuuuuuuugaaaaaaa

SEQ ID NO: 2206804 - RNA, 13 nt, Human
acuaauuuuaaaa

SEQ ID NO: 2206805 - RNA, 20 nt, Human
aguuguuucuacuacaugga

SEQ ID NO: 2206806 - RNA, 18 nt, Human
cuuugagcgcccacuaga

SEQ ID NO: 2206807 - RNA, 15 nt, Human
gccccugggaccagg

SEQ ID NO: 2206808 - RNA, 21 nt, Human
gcgccgcgcuccucggacggc

SEQ ID NO: 2206809 - RNA, 13 nt, Human
uaaacauguuuau

SEQ ID NO: 2206810 - RNA, 22 nt, Human
aaagcuuugugcagauucuuua

SEQ ID NO: 2206811 - RNA, 18 nt, Human
gaagcaaaauuuuuucuc

SEQ ID NO: 2206812 - RNA, 20 nt, Human
gaacguaaucguguccccua

SEQ ID NO: 2206813 - RNA, 24 nt, Human
uggccgggagccugaucaccugcc

SEQ ID NO: 2206814 - RNA, 17 nt, Human
ucuauaauuuaaauaua

SEQ ID NO: 2206815 - RNA, 17 nt, Human
aguauuucuaugaaaua

SEQ ID NO: 2206816 - RNA, 19 nt, Human
aaucuacacuccagugaga

SEQ ID NO: 2206817 - RNA, 13 nt, Human
aucaggcuggcca

SEQ ID NO: 2206818 - RNA, 20 nt, Human
gcgcgcucaucccacccgcc

SEQ ID NO: 2206819 - RNA, 22 nt, Human
uuugaugcuacaggauuugaaa

SEQ ID NO: 2206820 - RNA, 20 nt, Human
acggcuccggacgcugcugc

SEQ ID NO: 2206821 - RNA, 22 nt, Human
agcccuccuuaucaaaggacac

SEQ ID NO: 2206822 - RNA, 15 nt, Human
cuugaaaacuuuaug

SEQ ID NO: 2206823 - RNA, 18 nt, Human
gaccccugagcuugcaga

SEQ ID NO: 2206824 - RNA, 19 nt, Human
cccugcaaagcccagcuug

SEQ ID NO: 2206825 - RNA, 13 nt, Human
acuauaaaacuag

SEQ ID NO: 2206826 - RNA, 17 nt, Human
gccugagcgacagugag

SEQ ID NO: 2206827 - RNA, 20 nt, Human
uguaauaggcguaacuaauu

SEQ ID NO: 2206828 - RNA, 20 nt, Human
cccggccgcgcugcgcgccg

SEQ ID NO: 2206829 - RNA, 13 nt, Human
agccgggaaagaa

SEQ ID NO: 2206830 - RNA, 18 nt, Human
cuaucccaaccucuccca

SEQ ID NO: 2206831 - RNA, 20 nt, Human
aaauaauuuuuauauuugaa

SEQ ID NO: 2206832 - RNA, 19 nt, Human
uggugaacuugguuuuaau

SEQ ID NO: 2206833 - RNA, 13 nt, Human
cacauccuguggg

SEQ ID NO: 2206834 - RNA, 22 nt, Human
gcggggagcgagccccaggcgg

SEQ ID NO: 2206835 - RNA, 15 nt, Human
uacaggauuugaaau

SEQ ID NO: 2206836 - RNA, 13 nt, Human
agguaccagccuu

SEQ ID NO: 2206837 - RNA, 14 nt, Human
aauuguauuacaaa

SEQ ID NO: 2206838 - RNA, 16 nt, Human
aagcauuuagauguau

SEQ ID NO: 2206839 - RNA, 13 nt, Human
uuaaaaaagaaac

SEQ ID NO: 2206840 - RNA, 22 nt, Human
gagccucagucucccucccuug

SEQ ID NO: 2206841 - RNA, 22 nt, Human
ccacuuggacaugggccccaga

SEQ ID NO: 2206842 - RNA, 16 nt, Human
cauuucuaaagccauu

SEQ ID NO: 2206843 - RNA, 16 nt, Human
cagcuuuccucaaaac

SEQ ID NO: 2206844 - RNA, 22 nt, Human
cauuuaaauaaaguguuugaaa

SEQ ID NO: 2206845 - RNA, 13 nt, Human
uuuuaaaaaagaa

SEQ ID NO: 2206846 - RNA, 17 nt, Human
cuccuuaucaaaggaca

SEQ ID NO: 2206847 - RNA, 13 nt, Human
cacauuuaaauaa

SEQ ID NO: 2206848 - RNA, 16 nt, Human
ugaaguccaagcauuu

SEQ ID NO: 2206849 - RNA, 19 nt, Human
gcagggugaacugcagcga

SEQ ID NO: 2206850 - RNA, 22 nt, Human
agcagcauaaauguugacaugg

SEQ ID NO: 2206851 - RNA, 12 nt, Human
cauuauauuuau

SEQ ID NO: 2206852 - RNA, 14 nt, Human
auuuguauaaaaua

SEQ ID NO: 2206853 - RNA, 20 nt, Human
uguaaaggaauuuaaaaauc

SEQ ID NO: 2206854 - RNA, 16 nt, Human
gggucagccagcccuc

SEQ ID NO: 2206855 - RNA, 20 nt, Human
agagacacacugaagaagca

SEQ ID NO: 2206856 - RNA, 23 nt, Human
uaaaagacagugaaagaaaauaa

SEQ ID NO: 2206857 - RNA, 14 nt, Human
cagauuugagcuca

SEQ ID NO: 2206858 - RNA, 21 nt, Human
cuuguuggacgagaaaacaau

SEQ ID NO: 2206859 - RNA, 21 nt, Human
ccuaauuuguuuucccuucuu

SEQ ID NO: 2206860 - RNA, 17 nt, Human
cugccucagaaaacaag

SEQ ID NO: 2206861 - RNA, 12 nt, Human
gacagugaaaga

SEQ ID NO: 2206862 - RNA, 20 nt, Human
ccagcuugaaaccuucacuu

SEQ ID NO: 2206863 - RNA, 15 nt, Human
uccaaugacauuuug

SEQ ID NO: 2206864 - RNA, 18 nt, Human
ucccaacuauaaaacuag

SEQ ID NO: 2206865 - RNA, 13 nt, Human
uaugaaauauuau

SEQ ID NO: 2206866 - RNA, 13 nt, Human
gcgcgccuccgcu

SEQ ID NO: 2206867 - RNA, 19 nt, Human
acuucccgcuguuccucgc

SEQ ID NO: 2206868 - RNA, 18 nt, Human
uuuuagugaaauauuauu

SEQ ID NO: 2206869 - RNA, 16 nt, Human
uauguucuaagaagug

SEQ ID NO: 2206870 - RNA, 15 nt, Human
cccucuucugacacu

SEQ ID NO: 2206871 - RNA, 19 nt, Human
agacucgggauuaguacac

SEQ ID NO: 2206872 - RNA, 13 nt, Human
gugcugcagcccc

SEQ ID NO: 2206873 - RNA, 10 nt, Human
caacucccug

SEQ ID NO: 2206874 - RNA, 16 nt, Human
cacgugugggcaaugu

SEQ ID NO: 2206875 - RNA, 14 nt, Human
ccucagucucccuc

SEQ ID NO: 2206876 - RNA, 18 nt, Human
agcugcucaauaaaguac

SEQ ID NO: 2206877 - RNA, 20 nt, Human
gccagcccucuucugacacu

SEQ ID NO: 2206878 - RNA, 21 nt, Human
auuauauggcuugaguuuaaa

SEQ ID NO: 2206879 - RNA, 21 nt, Human
cuggccuucggccuccauccu

SEQ ID NO: 2206880 - RNA, 19 nt, Human
cacauccugugggaccugg

SEQ ID NO: 2206881 - RNA, 13 nt, Human
uuuugaaucauca

SEQ ID NO: 2206882 - RNA, 18 nt, Human
auuuuaacucuauaaugu

SEQ ID NO: 2206883 - RNA, 13 nt, Human
uuuuuuuuuucaa

SEQ ID NO: 2206884 - RNA, 20 nt, Human
caauaaaacuuuuccaauga

SEQ ID NO: 2206885 - RNA, 18 nt, Human
ccugcaaagcccagcuug

SEQ ID NO: 2206886 - RNA, 22 nt, Human
ccggcgcgcucaucccacccgc

SEQ ID NO: 2206887 - RNA, 15 nt, Human
cagucucccucccuu

SEQ ID NO: 2206888 - RNA, 18 nt, Human
uaaaagacagugaaagaa

SEQ ID NO: 2206889 - RNA, 20 nt, Human
accaggcacccccagaauga

SEQ ID NO: 2206890 - RNA, 12 nt, Human
gcaaagcccagc

SEQ ID NO: 2206891 - RNA, 18 nt, Human
uagugaaauauuauuuua

SEQ ID NO: 2206892 - RNA, 19 nt, Human
uacuucuuaggguuaugau

SEQ ID NO: 2206893 - RNA, 19 nt, Human
cauggaauuggagcucgug

SEQ ID NO: 2206894 - RNA, 20 nt, Human
agaggagaaacuggaacucu

SEQ ID NO: 2206895 - RNA, 22 nt, Human
ccauacuaauuauacccccugc

SEQ ID NO: 2206896 - RNA, 19 nt, Human
ucgcccacuuccucccggc

SEQ ID NO: 2206897 - RNA, 16 nt, Human
cugagcuugcagagau

SEQ ID NO: 2206898 - RNA, 19 nt, Human
gguuccuuccucugagccu

SEQ ID NO: 2206899 - RNA, 19 nt, Human
aaaagacagugaaagaaaa

SEQ ID NO: 2206900 - RNA, 20 nt, Human
uuauugaggcuuuaaaacuu

SEQ ID NO: 2206901 - RNA, 19 nt, Human
acuggacucaccuccccca

SEQ ID NO: 2206902 - RNA, 19 nt, Human
cggccugcucgcccacuuc

SEQ ID NO: 2206903 - RNA, 23 nt, Human
uuauagcuacuaauuuuaaaaug

SEQ ID NO: 2206904 - RNA, 17 nt, Human
aaauaacgauaaaagac

SEQ ID NO: 2206905 - RNA, 16 nt, Human
ugacacuuaaaaaugg

SEQ ID NO: 2206906 - RNA, 15 nt, Human
ccugagcggaccuuc

SEQ ID NO: 2206907 - RNA, 20 nt, Human
cuuauucacaagacccaaaa

SEQ ID NO: 2206908 - RNA, 13 nt, Human
uccagcugccccg

SEQ ID NO: 2206909 - RNA, 13 nt, Human
aucaaugaaugaa

SEQ ID NO: 2206910 - RNA, 14 nt, Human
ccaugggacaggga

SEQ ID NO: 2206911 - RNA, 22 nt, Human
cacuuccaagagccuuuuuuug

SEQ ID NO: 2206912 - RNA, 22 nt, Human
cgcgcgccuccgcuacuuccag

SEQ ID NO: 2206913 - RNA, 17 nt, Human
gccccagauaccaugau

SEQ ID NO: 2206914 - RNA, 18 nt, Human
aagggaauuucuucaacu

SEQ ID NO: 2206915 - RNA, 17 nt, Human
ccugugggaccugggcc

SEQ ID NO: 2206916 - RNA, 15 nt, Human
uuagugaaauauuau

SEQ ID NO: 2206917 - RNA, 17 nt, Human
gaaugagagacacacug

SEQ ID NO: 2206918 - RNA, 17 nt, Human
cgcgagcgcgcgcgccc

SEQ ID NO: 2206919 - RNA, 22 nt, Human
auauaaauaaaaauaauccuca

SEQ ID NO: 2206920 - RNA, 23 nt, Human
auuauauggcuugaguuuaaauu

SEQ ID NO: 2206921 - RNA, 16 nt, Human
cccuauccuacuuccc

SEQ ID NO: 2206922 - RNA, 15 nt, Human
cuuaagaagacugca

SEQ ID NO: 2206923 - RNA, 16 nt, Human
ugcaugguuuagaaag

SEQ ID NO: 2206924 - RNA, 14 nt, Human
cuucugacacuaaa

SEQ ID NO: 2206925 - RNA, 17 nt, Human
uucugagcauuuaauau

SEQ ID NO: 2206926 - RNA, 12 nt, Human
aauaaaguacaa

SEQ ID NO: 2206927 - RNA, 16 nt, Human
ggcugagccucagucu

SEQ ID NO: 2206928 - RNA, 14 nt, Human
cucaccccuugcca

SEQ ID NO: 2206929 - RNA, 18 nt, Human
cugagccuugggaccccu

SEQ ID NO: 2206930 - RNA, 19 nt, Human
agcucugcccauccugccc

SEQ ID NO: 2206931 - RNA, 19 nt, Human
cucugcauacucauuagga

SEQ ID NO: 2206932 - RNA, 20 nt, Human
ccagggcuacgcgcgcuccg

SEQ ID NO: 2206933 - RNA, 17 nt, Human
uuccaagccucaugucc

SEQ ID NO: 2206934 - RNA, 20 nt, Human
aagggcuguuauaaucuuuc

SEQ ID NO: 2206935 - RNA, 20 nt, Human
acggagccgggaaagaagag

SEQ ID NO: 2206936 - RNA, 20 nt, Human
auacugugugcuaaaacaag

SEQ ID NO: 2206937 - RNA, 22 nt, Human
uuuccaagcaaguauuagaaua

SEQ ID NO: 2206938 - RNA, 23 nt, Human
aucauuaaaguucuagugaccga

SEQ ID NO: 2206939 - RNA, 18 nt, Human
cugcucaauaaaguacaa

SEQ ID NO: 2206940 - RNA, 14 nt, Human
uugaaauuguauua

SEQ ID NO: 2206941 - RNA, 18 nt, Human
acagagacagaaagcaga

SEQ ID NO: 2206942 - RNA, 13 nt, Human
gggaaagaagagc

SEQ ID NO: 2206943 - RNA, 17 nt, Human
aaaguacaagagcuuaa

SEQ ID NO: 2206944 - RNA, 11 nt, Human
gccaugggaca

SEQ ID NO: 2206945 - RNA, 17 nt, Human
ggccaugggacagggag

SEQ ID NO: 2206946 - RNA, 19 nt, Human
gcggcccugugcggccugg

SEQ ID NO: 2206947 - RNA, 15 nt, Human
cuacaagacacagug

SEQ ID NO: 2206948 - RNA, 12 nt, Human
uuuuauauuuga

SEQ ID NO: 2206949 - RNA, 15 nt, Human
uccagauccuggaaa

SEQ ID NO: 2206950 - RNA, 17 nt, Human
auauuuuuuuuuuuaaa

SEQ ID NO: 2206951 - RNA, 18 nt, Human
uggucaauuuuguuaugu

SEQ ID NO: 2206952 - RNA, 14 nt, Human
ugcuaagucuuaua

SEQ ID NO: 2206953 - RNA, 16 nt, Human
auccuccaugaauauc

SEQ ID NO: 2206954 - RNA, 21 nt, Human
cugcgcucggccugcucgccc

SEQ ID NO: 2206955 - RNA, 17 nt, Human
caccucccccaucucuu

SEQ ID NO: 2206956 - RNA, 18 nt, Human
cccagaaugaccuggccg

SEQ ID NO: 2206957 - RNA, 16 nt, Human
acauuugcucauggaa

SEQ ID NO: 2206958 - RNA, 13 nt, Human
cgcuuccgcaucc

SEQ ID NO: 2206959 - RNA, 15 nt, Human
ugccccccagcccuc

SEQ ID NO: 2206960 - RNA, 18 nt, Human
aauaaaacuuuuccaaug

SEQ ID NO: 2206961 - RNA, 21 nt, Human
gcugagucccaggcugagccu

SEQ ID NO: 2206962 - RNA, 18 nt, Human
uccugugggaccugggcc

SEQ ID NO: 2206963 - RNA, 17 nt, Human
uaacugauuuguaacaa

SEQ ID NO: 2206964 - RNA, 17 nt, Human
aaaacaccucagcugcc

SEQ ID NO: 2206965 - RNA, 20 nt, Human
aagcuucacuguaaaauaau

SEQ ID NO: 2206966 - RNA, 13 nt, Human
cgcccucuggcug

SEQ ID NO: 2206967 - RNA, 21 nt, Human
acgcucucuggccuucggccu

SEQ ID NO: 2206968 - RNA, 19 nt, Human
uuguggggaugaacuuuuu

SEQ ID NO: 2206969 - RNA, 19 nt, Human
auucccagccagcacagcc

SEQ ID NO: 2206970 - RNA, 16 nt, Human
gccaaggaugccccgu

SEQ ID NO: 2206971 - RNA, 20 nt, Human
gacggcuccggacgcugcug

SEQ ID NO: 2206972 - RNA, 15 nt, Human
gcagagguugcagug

SEQ ID NO: 2206973 - RNA, 19 nt, Human
ugggccauagucauucugc

SEQ ID NO: 2206974 - RNA, 17 nt, Human
gacucaccucccccauc

SEQ ID NO: 2206975 - RNA, 20 nt, Human
ugaggcuccacuuggucugu

SEQ ID NO: 2206976 - RNA, 23 nt, Human
gccgggaaagaagagccggagcc

SEQ ID NO: 2206977 - RNA, 13 nt, Human
uuaaauuguaaua

SEQ ID NO: 2206978 - RNA, 21 nt, Human
ugagcuaggggggucagccag

SEQ ID NO: 2206979 - RNA, 11 nt, Human
caauaaaagac

SEQ ID NO: 2206980 - RNA, 17 nt, Human
cuggagggaagccuugg

SEQ ID NO: 2206981 - RNA, 14 nt, Human
uuaugauuaaguaa

SEQ ID NO: 2206982 - RNA, 15 nt, Human
acucaacaaacauaa

SEQ ID NO: 2206983 - RNA, 23 nt, Human
cagcugccccggggaggggcgcu

SEQ ID NO: 2206984 - RNA, 14 nt, Human
agcucguggaacag

SEQ ID NO: 2206985 - RNA, 18 nt, Human
cuuuucccaacuccagaa

SEQ ID NO: 2206986 - RNA, 17 nt, Human
uuaaauggucaauuuug

SEQ ID NO: 2206987 - RNA, 18 nt, Human
ccuugggaccccugagcu

SEQ ID NO: 2206988 - RNA, 21 nt, Human
accaaggagccaaacauccua

SEQ ID NO: 2206989 - RNA, 18 nt, Human
cagaaagcagaacaguga

SEQ ID NO: 2206990 - RNA, 16 nt, Human
ccccugcacuccagcc

SEQ ID NO: 2206991 - RNA, 13 nt, Human
acaaggaaaaaau

SEQ ID NO: 2206992 - RNA, 14 nt, Human
ggaaacuccacauc

SEQ ID NO: 2206993 - RNA, 21 nt, Human
uacuucccgcuguuccucgcc

SEQ ID NO: 2206994 - RNA, 20 nt, Human
acaagacccaaaaggcagaa

SEQ ID NO: 2206995 - RNA, 23 nt, Human
aggaugguucccuugaugaagaa

SEQ ID NO: 2206996 - RNA, 22 nt, Human
aaaucaggguuaguauugucca

SEQ ID NO: 2206997 - RNA, 23 nt, Human
agucccagaucaagccugccuca

SEQ ID NO: 2206998 - RNA, 11 nt, Human
gcgcuggcugc

SEQ ID NO: 2206999 - RNA, 21 nt, Human
aaugugacuuaaugccacuaa

SEQ ID NO: 2207000 - RNA, 18 nt, Human
ccuguucgcgcgccuccg

SEQ ID NO: 2207001 - RNA, 16 nt, Human
ccaggcugagccucag

SEQ ID NO: 2207002 - RNA, 18 nt, Human
cagagacagaaagcagaa

SEQ ID NO: 2207003 - RNA, 12 nt, Human
uguuugaaagcu

SEQ ID NO: 2207004 - RNA, 15 nt, Human
acaagacccaaaagg

SEQ ID NO: 2207005 - RNA, 18 nt, Human
gagccgggaaagaagagc

SEQ ID NO: 2207006 - RNA, 22 nt, Human
cucugagccuugggaccccuga

SEQ ID NO: 2207007 - RNA, 19 nt, Human
caucaaggguacacugccu

SEQ ID NO: 2207008 - RNA, 20 nt, Human
acuccacuuggacaugggcc

SEQ ID NO: 2207009 - RNA, 14 nt, Human
gugagcuacaaaug

SEQ ID NO: 2207010 - RNA, 23 nt, Human
uccagguagaggguguguaagua

SEQ ID NO: 2207011 - RNA, 19 nt, Human
auacuaauuauacccccug

SEQ ID NO: 2207012 - RNA, 20 nt, Human
uuugcaagccagauuuuccu

SEQ ID NO: 2207013 - RNA, 11 nt, Human
acugggacagg

SEQ ID NO: 2207014 - RNA, 21 nt, Human
gagccggagccuccagcugcc

SEQ ID NO: 2207015 - RNA, 22 nt, Human
agaauuuuaugcggcauuuucu

SEQ ID NO: 2207016 - RNA, 15 nt, Human
uugccuaauuuguuu

SEQ ID NO: 2207017 - RNA, 13 nt, Human
agagguccacaac

SEQ ID NO: 2207018 - RNA, 17 nt, Human
cucguggaacaguuacc

SEQ ID NO: 2207019 - RNA, 15 nt, Human
aaugaauggcuaagc

SEQ ID NO: 2207020 - RNA, 23 nt, Human
gucucccucccuuggggccuaug

SEQ ID NO: 2207021 - RNA, 21 nt, Human
uccauccugaggcuccacuug

SEQ ID NO: 2207022 - RNA, 14 nt, Human
agucucccucccuu

SEQ ID NO: 2207023 - RNA, 13 nt, Human
cccaaaaggcaga

SEQ ID NO: 2207024 - RNA, 18 nt, Human
cccucuggcuccagcugg

SEQ ID NO: 2207025 - RNA, 23 nt, Human
gcuuuggucuaucuuugagcgcc

SEQ ID NO: 2207026 - RNA, 14 nt, Human
ccaucccggccggc

SEQ ID NO: 2207027 - RNA, 15 nt, Human
cagccccugggacca

SEQ ID NO: 2207028 - RNA, 14 nt, Human
gucauucugccugc

SEQ ID NO: 2207029 - RNA, 13 nt, Human
ccaaggaugcccc

SEQ ID NO: 2207030 - RNA, 18 nt, Human
ggagccgggaaagaagag

SEQ ID NO: 2207031 - RNA, 18 nt, Human
ccugagcggaccuuccca

SEQ ID NO: 2207032 - RNA, 14 nt, Human
uauuuauuuuaaua

SEQ ID NO: 2207033 - RNA, 15 nt, Human
cuuuucccaacucca

SEQ ID NO: 2207034 - RNA, 13 nt, Human
aguuaccucugcc

SEQ ID NO: 2207035 - RNA, 20 nt, Human
acagcccuucuuuccacaga

SEQ ID NO: 2207036 - RNA, 15 nt, Human
uagggugauauuaac

SEQ ID NO: 2207037 - RNA, 20 nt, Human
gaaaauaacgauaaaagaca

SEQ ID NO: 2207038 - RNA, 23 nt, Human
gagcucccaggaggggcuucugg

SEQ ID NO: 2207039 - RNA, 16 nt, Human
cauagucauucugccu

SEQ ID NO: 2207040 - RNA, 15 nt, Human
caccucagcugccuc

SEQ ID NO: 2207041 - RNA, 16 nt, Human
aaagacaaggaaaaaa

SEQ ID NO: 2207042 - RNA, 14 nt, Human
uaugaauuacauuu

SEQ ID NO: 2207043 - RNA, 13 nt, Human
cucugagccuugg

SEQ ID NO: 2207044 - RNA, 18 nt, Human
uauuuucaguuauuauau

SEQ ID NO: 2207045 - RNA, 20 nt, Human
uccaagccucauguccacug

SEQ ID NO: 2207046 - RNA, 21 nt, Human
uuuucaggcuagauguaugua

SEQ ID NO: 2207047 - RNA, 23 nt, Human
auauaacaaugcuguauuuuaaa

SEQ ID NO: 2207048 - RNA, 16 nt, Human
ucauucugccugcccu

SEQ ID NO: 2207049 - RNA, 12 nt, Human
auauaaauaaaa

SEQ ID NO: 2207050 - RNA, 16 nt, Human
uaggugcugcagcccc

SEQ ID NO: 2207051 - RNA, 18 nt, Human
gggggucagccagcccuc

SEQ ID NO: 2207052 - RNA, 16 nt, Human
gacaagcucacagacc

SEQ ID NO: 2207053 - RNA, 22 nt, Human
uugaaaaucuuauaauuuaaaa

SEQ ID NO: 2207054 - RNA, 11 nt, Human
aaccugagccc

SEQ ID NO: 2207055 - RNA, 15 nt, Human
uaucaguccaaaggg

SEQ ID NO: 2207056 - RNA, 12 nt, Human
aaugcagccccc

SEQ ID NO: 2207057 - RNA, 22 nt, Human
cacagauuugagcucagcccug

SEQ ID NO: 2207058 - RNA, 18 nt, Human
ugagcuaggggggucagc

SEQ ID NO: 2207059 - RNA, 16 nt, Human
accagccuuggauacu

SEQ ID NO: 2207060 - RNA, 13 nt, Human
auaacgauaaaag

SEQ ID NO: 2207061 - RNA, 17 nt, Human
ucauacuucuuaggguu

SEQ ID NO: 2207062 - RNA, 19 nt, Human
aaacaauaacgauaaaaga

SEQ ID NO: 2207063 - RNA, 17 nt, Human
uuccaagugauugaaac

SEQ ID NO: 2207064 - RNA, 21 nt, Human
auaauuuuuauauuugaaaua

SEQ ID NO: 2207065 - RNA, 12 nt, Human
auucugaaagca

SEQ ID NO: 2207066 - RNA, 21 nt, Human
gccugaucaccugcccugcug

SEQ ID NO: 2207067 - RNA, 16 nt, Human
uauccuacuuccccuu

SEQ ID NO: 2207068 - RNA, 23 nt, Human
acguaaucguguccccuauccua

SEQ ID NO: 2207069 - RNA, 13 nt, Human
ccaccugccuaua

SEQ ID NO: 2207070 - RNA, 16 nt, Human
aaaguguuugaaagcu

SEQ ID NO: 2207071 - RNA, 19 nt, Human
ccuccauccugaggcucca

SEQ ID NO: 2207072 - RNA, 17 nt, Human
ucugugagaugcuagaa

SEQ ID NO: 2207073 - RNA, 14 nt, Human
agaucaagccugcc

SEQ ID NO: 2207074 - RNA, 16 nt, Human
ccccaucucuucuggg

SEQ ID NO: 2207075 - RNA, 15 nt, Human
aaaaauaacaaugaa

SEQ ID NO: 2207076 - RNA, 17 nt, Human
ccacuggacucaccucc

SEQ ID NO: 2207077 - RNA, 15 nt, Human
gccucagucucccuc

SEQ ID NO: 2207078 - RNA, 16 nt, Human
uaaugaauacuuuaua

SEQ ID NO: 2207079 - RNA, 17 nt, Human
agggaagggggaacaug

SEQ ID NO: 2207080 - RNA, 17 nt, Human
ugaccacugcagaagac

SEQ ID NO: 2207081 - RNA, 10 nt, Human
accugagccc

SEQ ID NO: 2207082 - RNA, 12 nt, Human
cauucugccugc

SEQ ID NO: 2207083 - RNA, 21 nt, Human
accaccugccuauauuuuuug

SEQ ID NO: 2207084 - RNA, 18 nt, Human
cuuccucugagccuuggg

SEQ ID NO: 2207085 - RNA, 19 nt, Human
cgcccacuagacccacugg

SEQ ID NO: 2207086 - RNA, 17 nt, Human
gcgccuccgcuacuucc

SEQ ID NO: 2207087 - RNA, 19 nt, Human
gaaagaaaauaacaauaaa

SEQ ID NO: 2207088 - RNA, 17 nt, Human
uaacgauaaaagacagu

SEQ ID NO: 2207089 - RNA, 21 nt, Human
cuaagcuucacuguaaaauaa

SEQ ID NO: 2207090 - RNA, 13 nt, Human
uauauauuuuuuu

SEQ ID NO: 2207091 - RNA, 21 nt, Human
acacuaaaacaccucagcugc

SEQ ID NO: 2207092 - RNA, 15 nt, Human
aaaauaacaaugaaa

SEQ ID NO: 2207093 - RNA, 20 nt, Human
guaucaaaagaaagaaaauc

SEQ ID NO: 2207094 - RNA, 15 nt, Human
agggcucacagaauu

SEQ ID NO: 2207095 - RNA, 18 nt, Human
cagguaccuucucaccug

SEQ ID NO: 2207096 - RNA, 22 nt, Human
cagcacgggggccaaggaugcc

SEQ ID NO: 2207097 - RNA, 13 nt, Human
gaaccuaggguga

SEQ ID NO: 2207098 - RNA, 14 nt, Human
gucccaggcugagc

SEQ ID NO: 2207099 - RNA, 18 nt, Human
gaaguaaauguuguuuua

SEQ ID NO: 2207100 - RNA, 21 nt, Human
aagucuuucacauuuaaauaa

SEQ ID NO: 2207101 - RNA, 14 nt, Human
cggccggcgcgcuc

SEQ ID NO: 2207102 - RNA, 14 nt, Human
aaaauacaaaaaaa

SEQ ID NO: 2207103 - RNA, 20 nt, Human
cccugccccccagcccuccu

SEQ ID NO: 2207104 - RNA, 15 nt, Human
ccggagccuccagcu

SEQ ID NO: 2207105 - RNA, 22 nt, Human
ucuggguuccuuccucugagcc

SEQ ID NO: 2207106 - RNA, 15 nt, Human
cugcacuccagccug

SEQ ID NO: 2207107 - RNA, 16 nt, Human
auccuacaagacacag

SEQ ID NO: 2207108 - RNA, 14 nt, Human
aagcaacccaaaug

SEQ ID NO: 2207109 - RNA, 18 nt, Human
cagcuuauugucuaguga

SEQ ID NO: 2207110 - RNA, 19 nt, Human
cugagccucagucucccuc

SEQ ID NO: 2207111 - RNA, 18 nt, Human
aacaaugcuguauuuuaa

SEQ ID NO: 2207112 - RNA, 17 nt, Human
gcgcucaucccacccgc

SEQ ID NO: 2207113 - RNA, 19 nt, Human
gcucauggaauuggagcuc

SEQ ID NO: 2207114 - RNA, 12 nt, Human
cuccagcugccc

SEQ ID NO: 2207115 - RNA, 12 nt, Human
uucucuaggaaa

SEQ ID NO: 2207116 - RNA, 17 nt, Human
ccagaucaagccugccu

SEQ ID NO: 2207117 - RNA, 16 nt, Human
auaucaauuuaaaaaa

SEQ ID NO: 2207118 - RNA, 17 nt, Human
cucgugggacagucacc

SEQ ID NO: 2207119 - RNA, 22 nt, Human
cuggguuccuuccucugagccu

SEQ ID NO: 2207120 - RNA, 23 nt, Human
gaggcauccaaaggcuccugaga

SEQ ID NO: 2207121 - RNA, 15 nt, Human
cugacucuuaagaag

SEQ ID NO: 2207122 - RNA, 12 nt, Human
uauucacaagac

SEQ ID NO: 2207123 - RNA, 13 nt, Human
ugagcggaccuuc

SEQ ID NO: 2207124 - RNA, 22 nt, Human
ugaauggcuaagcaaaauguga

SEQ ID NO: 2207125 - RNA, 18 nt, Human
auccugugggaccugggc

SEQ ID NO: 2207126 - RNA, 15 nt, Human
aagaaaauaacaaua

SEQ ID NO: 2207127 - RNA, 14 nt, Human
ugcugcagccccug

SEQ ID NO: 2207128 - RNA, 15 nt, Human
ugaaacccugucucu

SEQ ID NO: 2207129 - RNA, 23 nt, Human
gcugccccggggaggggcgcucg

SEQ ID NO: 2207130 - RNA, 14 nt, Human
gauugagaaggagc

SEQ ID NO: 2207131 - RNA, 12 nt, Human
cccccagcccuc

SEQ ID NO: 2207132 - RNA, 14 nt, Human
cugggucgccggca

SEQ ID NO: 2207133 - RNA, 14 nt, Human
cgcgcugcgcgccg

SEQ ID NO: 2207134 - RNA, 14 nt, Human
gagcucagcccugg

SEQ ID NO: 2207135 - RNA, 16 nt, Human
auaucaguuauuuuua

SEQ ID NO: 2207136 - RNA, 15 nt, Human
ggauacuccaugggg

SEQ ID NO: 2207137 - RNA, 15 nt, Human
uuaauucugaaagca

SEQ ID NO: 2207138 - RNA, 14 nt, Human
guauuuuaaaagaa

SEQ ID NO: 2207139 - RNA, 18 nt, Human
cagggaggacgcucucug

SEQ ID NO: 2207140 - RNA, 22 nt, Human
acauccuacaagacacagugac

SEQ ID NO: 2207141 - RNA, 17 nt, Human
ccagguaccuucucacc

SEQ ID NO: 2207142 - RNA, 18 nt, Human
gaaggagcucccaggagg

SEQ ID NO: 2207143 - RNA, 22 nt, Human
aggacaccauuuuggcaagcuc

SEQ ID NO: 2207144 - RNA, 12 nt, Human
aauuuaaauaua

SEQ ID NO: 2207145 - RNA, 14 nt, Human
aacgauaaaagaca

SEQ ID NO: 2207146 - RNA, 22 nt, Human
cccagcccuccuuaucaaagga

SEQ ID NO: 2207147 - RNA, 16 nt, Human
caggaggcauccaaag

SEQ ID NO: 2207148 - RNA, 23 nt, Human
ucuccauguacuggcaagaccug

SEQ ID NO: 2207149 - RNA, 20 nt, Human
auaagccagacaucaacaga

SEQ ID NO: 2207150 - RNA, 13 nt, Human
cuucuuucaugaa

SEQ ID NO: 2207151 - RNA, 13 nt, Human
gagacagcucugc

SEQ ID NO: 2207152 - RNA, 23 nt, Human
cagccagcccucuucugacacua

SEQ ID NO: 2207153 - RNA, 20 nt, Human
agcccuggugggcagagagg

SEQ ID NO: 2207154 - RNA, 16 nt, Human
uuuucucuaggaaaua

SEQ ID NO: 2207155 - RNA, 14 nt, Human
ugagaugcuagaac

SEQ ID NO: 2207156 - RNA, 14 nt, Human
caaggcuagaacca

SEQ ID NO: 2207157 - RNA, 22 nt, Human
gcuccgcgcagcucaggcuggc

SEQ ID NO: 2207158 - RNA, 22 nt, Human
ugaguuuuucuuuucauuuacc

SEQ ID NO: 2207159 - RNA, 20 nt, Human
uguuggugaacuugguuuua

SEQ ID NO: 2207160 - RNA, 17 nt, Human
agcuucacuguaaaaua

SEQ ID NO: 2207161 - RNA, 23 nt, Human
gguggcgcuggcugcgcucggcc

SEQ ID NO: 2207162 - RNA, 19 nt, Human
uuuauaucaauuuaaaaaa

SEQ ID NO: 2207163 - RNA, 15 nt, Human
ucacaggacagcccu

SEQ ID NO: 2207164 - RNA, 18 nt, Human
uaauaauguuucaaacau

SEQ ID NO: 2207165 - RNA, 22 nt, Human
cuagucucuaucauuaaaguuc

SEQ ID NO: 2207166 - RNA, 21 nt, Human
aauaauccucaguuuuuguga

SEQ ID NO: 2207167 - RNA, 14 nt, Human
aaccugagccccaa

SEQ ID NO: 2207168 - RNA, 13 nt, Human
uuuaaaaaaaaac

SEQ ID NO: 2207169 - RNA, 22 nt, Human
aagacccaaaaggcagaagcaa

SEQ ID NO: 2207170 - RNA, 15 nt, Human
gcuguauuuuaaaag

SEQ ID NO: 2207171 - RNA, 17 nt, Human
gccuccuuuuaaaguaa

SEQ ID NO: 2207172 - RNA, 14 nt, Human
aucaccaaggcuga

SEQ ID NO: 2207173 - RNA, 19 nt, Human
ggagccuccagcugccccg

SEQ ID NO: 2207174 - RNA, 16 nt, Human
ccgcauccuagucucu

SEQ ID NO: 2207175 - RNA, 23 nt, Human
cacuggacucaccucccccaucu

SEQ ID NO: 2207176 - RNA, 18 nt, Human
aucuacacuccagugaga

SEQ ID NO: 2207177 - RNA, 20 nt, Human
gaagagccggagccuccagc

SEQ ID NO: 2207178 - RNA, 19 nt, Human
gcuguacgcgagcgcgcgc

SEQ ID NO: 2207179 - RNA, 17 nt, Human
ugcagcgaguacuuccc

SEQ ID NO: 2207180 - RNA, 16 nt, Human
uauuuuugugauuuug

SEQ ID NO: 2207181 - RNA, 13 nt, Human
agcgacagugaga

SEQ ID NO: 2207182 - RNA, 13 nt, Human
ugugcggccuggu

SEQ ID NO: 2207183 - RNA, 20 nt, Human
aaagagugaaggauuuaugu

SEQ ID NO: 2207184 - RNA, 14 nt, Human
uucagccugaaaga

SEQ ID NO: 2207185 - RNA, 14 nt, Human
aucaguuauuuuua

SEQ ID NO: 2207186 - RNA, 19 nt, Human
ugcuauugggguugggggg

SEQ ID NO: 2207187 - RNA, 14 nt, Human
gaaaacaauaacga

SEQ ID NO: 2207188 - RNA, 14 nt, Human
aauggcuaagcaaa

SEQ ID NO: 2207189 - RNA, 17 nt, Human
acucuggucaagaagca

SEQ ID NO: 2207190 - RNA, 16 nt, Human
cauagaaguaaaaaca

SEQ ID NO: 2207191 - RNA, 18 nt, Human
uuuucaauaaaacuuuuc

SEQ ID NO: 2207192 - RNA, 16 nt, Human
aaacuuuuccaaugac

SEQ ID NO: 2207193 - RNA, 17 nt, Human
gggagcgagccccaggc

SEQ ID NO: 2207194 - RNA, 18 nt, Human
uuauuacuguaagaaaau

SEQ ID NO: 2207195 - RNA, 13 nt, Human
auauuuuauuaua

SEQ ID NO: 2207196 - RNA, 20 nt, Human
agcuuauugucuagugaaac

SEQ ID NO: 2207197 - RNA, 18 nt, Human
accauuuuugaaaccaaa

SEQ ID NO: 2207198 - RNA, 14 nt, Human
ugcuguauuuuaaa

SEQ ID NO: 2207199 - RNA, 20 nt, Human
acggacgaaccuugaaaacu

SEQ ID NO: 2207200 - RNA, 17 nt, Human
cauuaaaguucuaguga

SEQ ID NO: 2207201 - RNA, 22 nt, Human
gagcuaggggggucagccagcc

SEQ ID NO: 2207202 - RNA, 21 nt, Human
aagaagagccggagccuccag

SEQ ID NO: 2207203 - RNA, 20 nt, Human
uacaucccuuaccugggaaa

SEQ ID NO: 2207204 - RNA, 20 nt, Human
aucccggccggcgcgcucau

SEQ ID NO: 2207205 - RNA, 13 nt, Human
auuuuaaaagaau

SEQ ID NO: 2207206 - RNA, 16 nt, Human
aaaauaauccucaguu

SEQ ID NO: 2207207 - RNA, 20 nt, Human
agccuuuuuuugaaaaaaag

SEQ ID NO: 2207208 - RNA, 19 nt, Human
acaauaacgauaaaagaca

SEQ ID NO: 2207209 - RNA, 18 nt, Human
aaaagacaaggaaaaaau

SEQ ID NO: 2207210 - RNA, 14 nt, Human
uauguauauuuuau

SEQ ID NO: 2207211 - RNA, 17 nt, Human
aaagaaacauuugguaa

SEQ ID NO: 2207212 - RNA, 20 nt, Human
aaggagccaaacauccuaca

SEQ ID NO: 2207213 - RNA, 14 nt, Human
ugagcucagcccug

SEQ ID NO: 2207214 - RNA, 17 nt, Human
cucagucucccucccuu

SEQ ID NO: 2207215 - RNA, 19 nt, Human
auaaaagacaaggaaaaaa

SEQ ID NO: 2207216 - RNA, 21 nt, Human
augucauuugcuggagcucug

SEQ ID NO: 2207217 - RNA, 15 nt, Human
uuaauuuguaguguu

SEQ ID NO: 2207218 - RNA, 17 nt, Human
cugugcggccuggucua

SEQ ID NO: 2207219 - RNA, 12 nt, Human
gaauuggagcuc

SEQ ID NO: 2207220 - RNA, 18 nt, Human
gccuccagcugccccggg

SEQ ID NO: 2207221 - RNA, 14 nt, Human
uaauccuaaacaua

SEQ ID NO: 2207222 - RNA, 23 nt, Human
ggaugguucccuugaugaagaag

SEQ ID NO: 2207223 - RNA, 14 nt, Human
agucugacuguuuc

SEQ ID NO: 2207224 - RNA, 22 nt, Human
ugggccccagauaccaugaugc

SEQ ID NO: 2207225 - RNA, 17 nt, Human
aauaacgauaaaagaca

SEQ ID NO: 2207226 - RNA, 16 nt, Human
auuccaccuacaugag

SEQ ID NO: 2207227 - RNA, 18 nt, Human
agaucaagccugccucaa

SEQ ID NO: 2207228 - RNA, 22 nt, Human
cccagaaugaccuggccgcagu

SEQ ID NO: 2207229 - RNA, 21 nt, Human
ccccugcaaagcccagcuuga

SEQ ID NO: 2207230 - RNA, 19 nt, Human
gagccucagucucccuccc

SEQ ID NO: 2207231 - RNA, 19 nt, Human
ggagccugaucaccugccc

SEQ ID NO: 2207232 - RNA, 17 nt, Human
ucuggcguuguggggau

SEQ ID NO: 2207233 - RNA, 23 nt, Human
gcagacucuggucaagaagcauc

SEQ ID NO: 2207234 - RNA, 22 nt, Human
caaggaugccccgucccccucu

SEQ ID NO: 2207235 - RNA, 23 nt, Human
cuugauaaauggcuuccuggcaa

SEQ ID NO: 2207236 - RNA, 15 nt, Human
auaauuuugugaagc

SEQ ID NO: 2207237 - RNA, 18 nt, Human
caguuguugcccacagcu

SEQ ID NO: 2207238 - RNA, 17 nt, Human
ccauagucauucugccu

SEQ ID NO: 2207239 - RNA, 16 nt, Human
uguccccuauccuacu

SEQ ID NO: 2207240 - RNA, 20 nt, Human
auuuugugauugauuauaug

SEQ ID NO: 2207241 - RNA, 21 nt, Human
gcggcgggagggcgcggggcg

SEQ ID NO: 2207242 - RNA, 20 nt, Human
uccuccaugaauaucaguua

SEQ ID NO: 2207243 - RNA, 18 nt, Human
aaauauuuauuuuaauaa

SEQ ID NO: 2207244 - RNA, 23 nt, Human
caccaaggagccaaacauccuac

SEQ ID NO: 2207245 - RNA, 12 nt, Human
ucuuucaugaag

SEQ ID NO: 2207246 - RNA, 17 nt, Human
aaacauccuacaagaca

SEQ ID NO: 2207247 - RNA, 21 nt, Human
uaguauuucuaugaaauauua

SEQ ID NO: 2207248 - RNA, 21 nt, Human
acaugggugcuauugggguug

SEQ ID NO: 2207249 - RNA, 16 nt, Human
cuccauccugaggcuc

SEQ ID NO: 2207250 - RNA, 17 nt, Human
ccccaguuguuucuacu

SEQ ID NO: 2207251 - RNA, 23 nt, Human
ggcuaagcuucacuguaaaauaa

SEQ ID NO: 2207252 - RNA, 14 nt, Human
ugacacuuaaaaau

SEQ ID NO: 2207253 - RNA, 23 nt, Human
cuucaacucccugccccccagcc

SEQ ID NO: 2207254 - RNA, 13 nt, Human
gggcggggagcga

SEQ ID NO: 2207255 - RNA, 22 nt, Human
ugguuguauuauuuuuuaaaaa

SEQ ID NO: 2207256 - RNA, 16 nt, Human
agaucaagccugccuc

SEQ ID NO: 2207257 - RNA, 14 nt, Human
uaaaggaauuuaaa

SEQ ID NO: 2207258 - RNA, 14 nt, Human
uaacuaauuuuaac

SEQ ID NO: 2207259 - RNA, 18 nt, Human
agcuagaauucacuccac

SEQ ID NO: 2207260 - RNA, 21 nt, Human
uccuacaagacacagugacca

SEQ ID NO: 2207261 - RNA, 17 nt, Human
gcuguacgcgagcgcgc

SEQ ID NO: 2207262 - RNA, 22 nt, Human
ggcuaagcuucacuguaaaaua

SEQ ID NO: 2207263 - RNA, 14 nt, Human
aaauauaaauaaaa

SEQ ID NO: 2207264 - RNA, 14 nt, Human
auaaauaaaaauaa

SEQ ID NO: 2207265 - RNA, 15 nt, Human
acgagauacagaauu

SEQ ID NO: 2207266 - RNA, 20 nt, Human
uccaaaggcuccugagacac

SEQ ID NO: 2207267 - RNA, 22 nt, Human
cuuccuaauuccacagcugcuc

SEQ ID NO: 2207268 - RNA, 20 nt, Human
cucggacggcuccggacgcu

SEQ ID NO: 2207269 - RNA, 22 nt, Human
ggacaguaaaauccacagacca

SEQ ID NO: 2207270 - RNA, 17 nt, Human
cucuuuugggauuuuug

SEQ ID NO: 2207271 - RNA, 19 nt, Human
agguaaccucauuaucagu

SEQ ID NO: 2207272 - RNA, 21 nt, Human
cacuugaacccgggaggcaga

SEQ ID NO: 2207273 - RNA, 17 nt, Human
gacaaggaaaaaauaac

SEQ ID NO: 2207274 - RNA, 21 nt, Human
aacuuguaaaggaauuuaaaa

SEQ ID NO: 2207275 - RNA, 15 nt, Human
aacgauaaaagacag

SEQ ID NO: 2207276 - RNA, 21 nt, Human
auguuuaauucugaaagcaac

SEQ ID NO: 2207277 - RNA, 21 nt, Human
gaagagccggagccuccagcu

SEQ ID NO: 2207278 - RNA, 15 nt, Human
auaucaauuuaaaaa

SEQ ID NO: 2207279 - RNA, 16 nt, Human
uaaaauccauacauuu

SEQ ID NO: 2207280 - RNA, 19 nt, Human
auuguaguccuguaaugga

SEQ ID NO: 2207281 - RNA, 16 nt, Human
agugaaggauuuaugu

SEQ ID NO: 2207282 - RNA, 22 nt, Human
gcuugcagagaugaggccgcca

SEQ ID NO: 2207283 - RNA, 21 nt, Human
ugaaacgaggauugggaaaaa

SEQ ID NO: 2207284 - RNA, 22 nt, Human
agaaugagagacacacugaaga

SEQ ID NO: 2207285 - RNA, 15 nt, Human
uccgcauccuagucu

SEQ ID NO: 2207286 - RNA, 16 nt, Human
cugcucucaguucacu

SEQ ID NO: 2207287 - RNA, 23 nt, Human
cgcaggaccaucccggccggcgc

SEQ ID NO: 2207288 - RNA, 19 nt, Human
cuaguaucaaaagaaagaa

SEQ ID NO: 2207289 - RNA, 20 nt, Human
accuucccagcuagaauuca

SEQ ID NO: 2207290 - RNA, 15 nt, Human
ccgugggccugagac

SEQ ID NO: 2207291 - RNA, 19 nt, Human
augcagagguccacaacac

SEQ ID NO: 2207292 - RNA, 16 nt, Human
gcgcagcucaggcugg

SEQ ID NO: 2207293 - RNA, 15 nt, Human
cuaguaauuggaaag

SEQ ID NO: 2207294 - RNA, 20 nt, Human
ucuucuggguuccuuccucu

SEQ ID NO: 2207295 - RNA, 16 nt, Human
uauugggguugggggg

SEQ ID NO: 2207296 - RNA, 22 nt, Human
uuguucuugugaacccaaagug

SEQ ID NO: 2207297 - RNA, 19 nt, Human
ggaauuucuucaacucccu

SEQ ID NO: 2207298 - RNA, 15 nt, Human
ccugcaaagcccagc

SEQ ID NO: 2207299 - RNA, 14 nt, Human
ugaagauguagagg

SEQ ID NO: 2207300 - RNA, 17 nt, Human
cagugaaagaaaauaac

SEQ ID NO: 2207301 - RNA, 21 nt, Human
augaauacuuuauaaaggauu

SEQ ID NO: 2207302 - RNA, 22 nt, Human
aauaauccuaaacauaugaauu

SEQ ID NO: 2207303 - RNA, 17 nt, Human
uugccaaauauaaauaa

SEQ ID NO: 2207304 - RNA, 14 nt, Human
cuggccgggagccu

SEQ ID NO: 2207305 - RNA, 17 nt, Human
agucugacuguuuccau

SEQ ID NO: 2207306 - RNA, 17 nt, Human
agccuuggauacuccau

SEQ ID NO: 2207307 - RNA, 14 nt, Human
ggcuccagcuggcc

SEQ ID NO: 2207308 - RNA, 17 nt, Human
ucaauccaagaacuuau

SEQ ID NO: 2207309 - RNA, 20 nt, Human
cugucacgugugggcaaugu

SEQ ID NO: 2207310 - RNA, 12 nt, Human
cuucaacucccu

SEQ ID NO: 2207311 - RNA, 14 nt, Human
caccucagcugccu

SEQ ID NO: 2207312 - RNA, 20 nt, Human
auagucauucugccugcccu

SEQ ID NO: 2207313 - RNA, 17 nt, Human
ggugcugcagccccugg

SEQ ID NO: 2207314 - RNA, 19 nt, Human
ucuugugaacccaaagugu

SEQ ID NO: 2207315 - RNA, 15 nt, Human
gggaaagaagagccg

SEQ ID NO: 2207316 - RNA, 16 nt, Human
uagcuacuaauuuuaa

SEQ ID NO: 2207317 - RNA, 14 nt, Human
ccuugaugaagaag

SEQ ID NO: 2207318 - RNA, 15 nt, Human
uauauauauauauuu

SEQ ID NO: 2207319 - RNA, 21 nt, Human
ggucaagaagcaucgugucug

SEQ ID NO: 2207320 - RNA, 15 nt, Human
ggcaauagucaaauu

SEQ ID NO: 2207321 - RNA, 18 nt, Human
aauccacacugagcugag

SEQ ID NO: 2207322 - RNA, 15 nt, Human
accaaggcugauuaa

SEQ ID NO: 2207323 - RNA, 12 nt, Human
ccaggcugagcc

SEQ ID NO: 2207324 - RNA, 18 nt, Human
gcccuggugggcagagag

SEQ ID NO: 2207325 - RNA, 15 nt, Human
guuucuuccuuuuuu

SEQ ID NO: 2207326 - RNA, 13 nt, Human
aaauccuugaaga

SEQ ID NO: 2207327 - RNA, 16 nt, Human
aaauaguuuaugauuc

SEQ ID NO: 2207328 - RNA, 12 nt, Human
gguuuauauaag

SEQ ID NO: 2207329 - RNA, 18 nt, Human
ccugcucgcccacuuccu

SEQ ID NO: 2207330 - RNA, 12 nt, Human
aggggcgcucgc

SEQ ID NO: 2207331 - RNA, 20 nt, Human
ucacaugaacuuguaaagga

SEQ ID NO: 2207332 - RNA, 18 nt, Human
uauagcuacuaauuuuaa

SEQ ID NO: 2207333 - RNA, 16 nt, Human
cuucggccuccauccu

SEQ ID NO: 2207334 - RNA, 13 nt, Human
guggaaaaacaga

SEQ ID NO: 2207335 - RNA, 15 nt, Human
cuguaaaauaauaac

SEQ ID NO: 2207336 - RNA, 22 nt, Human
ggcagcuuuccucaaaacuuca

SEQ ID NO: 2207337 - RNA, 16 nt, Human
ccuccuuaucaaagga

SEQ ID NO: 2207338 - RNA, 18 nt, Human
cccaggcugagccucagu

SEQ ID NO: 2207339 - RNA, 22 nt, Human
uggguuccuuccucugagccuu

SEQ ID NO: 2207340 - RNA, 16 nt, Human
ggaugccccguccccc

SEQ ID NO: 2207341 - RNA, 15 nt, Human
cugaaagaggaauga

SEQ ID NO: 2207342 - RNA, 12 nt, Human
ggaggcugagau

SEQ ID NO: 2207343 - RNA, 23 nt, Human
gaggcauuuaggccaugggacag

SEQ ID NO: 2207344 - RNA, 14 nt, Human
agcucuaucaccaa

SEQ ID NO: 2207345 - RNA, 19 nt, Human
cccagcuagaauucacucc

SEQ ID NO: 2207346 - RNA, 14 nt, Human
cugagucccaggcu

SEQ ID NO: 2207347 - RNA, 19 nt, Human
guuguauuauuuuuuaaaa

SEQ ID NO: 2207348 - RNA, 12 nt, Human
cucuaucauuaa

SEQ ID NO: 2207349 - RNA, 15 nt, Human
ucccacccgcccacc

SEQ ID NO: 2207350 - RNA, 17 nt, Human
uggccgcagugaggcgg

SEQ ID NO: 2207351 - RNA, 20 nt, Human
agugaggcggauugagaagg

SEQ ID NO: 2207352 - RNA, 13 nt, Human
aacuauaaaacua

SEQ ID NO: 2207353 - RNA, 14 nt, Human
gaucaagccugccu

SEQ ID NO: 2207354 - RNA, 14 nt, Human
ggaaucuuguaaag

SEQ ID NO: 2207355 - RNA, 14 nt, Human
gccgcgcuccucgg

SEQ ID NO: 2207356 - RNA, 15 nt, Human
aucaaaggacaccau

SEQ ID NO: 2207357 - RNA, 14 nt, Human
ugaaagucccagau

SEQ ID NO: 2207358 - RNA, 15 nt, Human
ugcuguauuuuaaaa

SEQ ID NO: 2207359 - RNA, 17 nt, Human
ccaaggaugccccgucc

SEQ ID NO: 2207360 - RNA, 19 nt, Human
ucugagcauuuaauaugga

SEQ ID NO: 2207361 - RNA, 13 nt, Human
cugcacuccagcc

SEQ ID NO: 2207362 - RNA, 16 nt, Human
aggguguguaaguaga

SEQ ID NO: 2207363 - RNA, 19 nt, Human
auucuuuacccccugggag

SEQ ID NO: 2207364 - RNA, 20 nt, Human
acuccagugagacagcucug

SEQ ID NO: 2207365 - RNA, 20 nt, Human
aguuuuuuuuuaaaaaagaa

SEQ ID NO: 2207366 - RNA, 19 nt, Human
uuccucccuucucuucaca

SEQ ID NO: 2207367 - RNA, 14 nt, Human
cuucucuucacagu

SEQ ID NO: 2207368 - RNA, 16 nt, Human
cuuauaauuuaaaaua

SEQ ID NO: 2207369 - RNA, 19 nt, Human
cuccucggacggcuccgga

SEQ ID NO: 2207370 - RNA, 19 nt, Human
uccccuauccuacuucccc

SEQ ID NO: 2207371 - RNA, 21 nt, Human
cagcucuaucccaaccucucc

SEQ ID NO: 2207372 - RNA, 17 nt, Human
uacaaaugcauuucuaa

SEQ ID NO: 2207373 - RNA, 12 nt, Human
ccccugggacca

SEQ ID NO: 2207374 - RNA, 18 nt, Human
gagccucagucucccucc

SEQ ID NO: 2207375 - RNA, 12 nt, Human
aagagcuuaaca

SEQ ID NO: 2207376 - RNA, 19 nt, Human
accauuuuggcaagcucua

SEQ ID NO: 2207377 - RNA, 17 nt, Human
agaugggagaaucacuu

SEQ ID NO: 2207378 - RNA, 23 nt, Human
augaauuaaguuuuuuuuuaaaa

SEQ ID NO: 2207379 - RNA, 16 nt, Human
cauuuguauaaaauaa

SEQ ID NO: 2207380 - RNA, 13 nt, Human
cuucucaacucca

SEQ ID NO: 2207381 - RNA, 17 nt, Human
agagacagaaagcagaa

SEQ ID NO: 2207382 - RNA, 18 nt, Human
ccaagccuggcaagggaa

SEQ ID NO: 2207383 - RNA, 12 nt, Human
auaacuggaaac

SEQ ID NO: 2207384 - RNA, 14 nt, Human
ucagucucccuccc

SEQ ID NO: 2207385 - RNA, 15 nt, Human
acaucaacagauaaa

SEQ ID NO: 2207386 - RNA, 12 nt, Human
ucccccucuggc

SEQ ID NO: 2207387 - RNA, 21 nt, Human
cucccaggaggggcuucuggg

SEQ ID NO: 2207388 - RNA, 20 nt, Human
ucgcaggaccaucccggccg

SEQ ID NO: 2207389 - RNA, 14 nt, Human
aaucucaauauuuc

SEQ ID NO: 2207390 - RNA, 20 nt, Human
uuuccaaugacauuuuguug

SEQ ID NO: 2207391 - RNA, 18 nt, Human
uuuucucuccucucccca

SEQ ID NO: 2207392 - RNA, 24 nt, Human
gcuucugggcagacucuggucaag

SEQ ID NO: 2207393 - RNA, 23 nt, Human
ggccugcucgcccacuuccuccc

SEQ ID NO: 2207394 - RNA, 13 nt, Human
cucgccacgcucu

SEQ ID NO: 2207395 - RNA, 19 nt, Human
auaauuuuuauauuugaaa

SEQ ID NO: 2207396 - RNA, 15 nt, Human
auuugguaaggggaa

SEQ ID NO: 2207397 - RNA, 22 nt, Human
guguccccuauccuacuucccc

SEQ ID NO: 2207398 - RNA, 19 nt, Human
uagugagcagucaggaaag

SEQ ID NO: 2207399 - RNA, 13 nt, Human
uccucccggccgc

SEQ ID NO: 2207400 - RNA, 15 nt, Human
accuucccagcuaga

SEQ ID NO: 2207401 - RNA, 17 nt, Human
ucuuucacauuuaaaua

SEQ ID NO: 2207402 - RNA, 19 nt, Human
gcccacuuccucccggccg

SEQ ID NO: 2207403 - RNA, 14 nt, Human
cagccccugggacc

SEQ ID NO: 2207404 - RNA, 18 nt, Human
ugaaaaaguucugcagau

SEQ ID NO: 2207405 - RNA, 13 nt, Human
auccuagucucua

SEQ ID NO: 2207406 - RNA, 14 nt, Human
cagucucccucccu

SEQ ID NO: 2207407 - RNA, 18 nt, Human
agcaaaauuuuuucucua

SEQ ID NO: 2207408 - RNA, 23 nt, Human
ccacuuggacaugggccccagau

SEQ ID NO: 2207409 - RNA, 18 nt, Human
acugccuucucaacucca

SEQ ID NO: 2207410 - RNA, 17 nt, Human
aaauguucaucaaugaa

SEQ ID NO: 2207411 - RNA, 21 nt, Human
cagccccugggaccaggcacc

SEQ ID NO: 2207412 - RNA, 23 nt, Human
ggacggcuccggacgcugcugcc

SEQ ID NO: 2207413 - RNA, 21 nt, Human
gaaauguuuacagauccccaa

SEQ ID NO: 2207414 - RNA, 14 nt, Human
cuggagcucugccc

SEQ ID NO: 2207415 - RNA, 20 nt, Human
caaacauccuacaagacaca

SEQ ID NO: 2207416 - RNA, 15 nt, Human
ggagccuccagcugc

SEQ ID NO: 2207417 - RNA, 21 nt, Human
aggauggcaggaggcauccaa

SEQ ID NO: 2207418 - RNA, 12 nt, Human
uuaauaaaccau

SEQ ID NO: 2207419 - RNA, 15 nt, Human
gucccaggcugagcc

SEQ ID NO: 2207420 - RNA, 20 nt, Human
gauaccaugaugcugagccc

SEQ ID NO: 2207421 - RNA, 16 nt, Human
uaaaggaauuuaaaaa

SEQ ID NO: 2207422 - RNA, 20 nt, Human
aauuuuuucucuaggaaaua

SEQ ID NO: 2207423 - RNA, 15 nt, Human
augggacagggagga

SEQ ID NO: 2207424 - RNA, 20 nt, Human
cagcuggccgggagccugau

SEQ ID NO: 2207425 - RNA, 16 nt, Human
ccaggcacccccagaa

SEQ ID NO: 2207426 - RNA, 22 nt, Human
gaauuucuucaacucccugccc

SEQ ID NO: 2207427 - RNA, 24 nt, Human
gccugcccugaaagucccagauca

SEQ ID NO: 2207428 - RNA, 21 nt, Human
aauucauucacucaacaaaca

SEQ ID NO: 2207429 - RNA, 17 nt, Human
gcgcgcuccgcgcagcu

SEQ ID NO: 2207430 - RNA, 14 nt, Human
cuggaaaucagggu

SEQ ID NO: 2207431 - RNA, 21 nt, Human
acagugaaagaaaauaacaau

SEQ ID NO: 2207432 - RNA, 18 nt, Human
uuauuauagucacuaguu

SEQ ID NO: 2207433 - RNA, 23 nt, Human
guuguaauuuuuuugugggaaau

SEQ ID NO: 2207434 - RNA, 20 nt, Human
aaaagacagugaaagaaaau

SEQ ID NO: 2207435 - RNA, 17 nt, Human
ugcacaucaaaauaugc

SEQ ID NO: 2207436 - RNA, 22 nt, Human
accccugagcuugcagagauga

SEQ ID NO: 2207437 - RNA, 21 nt, Human
aggcucuuuugggauuuuuga

SEQ ID NO: 2207438 - RNA, 19 nt, Human
aaacaaaaggauaaugaau

SEQ ID NO: 2207439 - RNA, 20 nt, Human
aaagacagugaaagaaaaua

SEQ ID NO: 2207440 - RNA, 16 nt, Human
uucucaccugugagac

SEQ ID NO: 2207441 - RNA, 22 nt, Human
auucugagguaaccucauuauc

SEQ ID NO: 2207442 - RNA, 16 nt, Human
augcuaagugaaauaa

SEQ ID NO: 2207443 - RNA, 19 nt, Human
agcuacuaauuuuaaaaug

SEQ ID NO: 2207444 - RNA, 14 nt, Human
ccggagccuccagc

SEQ ID NO: 2207445 - RNA, 15 nt, Human
aaggaaaaaauaaca

SEQ ID NO: 2207446 - RNA, 10 nt, Human
auguuuucag

SEQ ID NO: 2207447 - RNA, 19 nt, Human
aaaauaacaauaaaagaca

SEQ ID NO: 2207448 - RNA, 21 nt, Human
ugagcucagcccuggugggca

SEQ ID NO: 2207449 - RNA, 21 nt, Human
gcgcucggccugcucgcccac

SEQ ID NO: 2207450 - RNA, 23 nt, Human
cagagguugcagugagccgagau

SEQ ID NO: 2207451 - RNA, 19 nt, Human
agauuugagcucagcccug

SEQ ID NO: 2207452 - RNA, 17 nt, Human
cgauaaaagacagugaa

SEQ ID NO: 2207453 - RNA, 15 nt, Human
acugaagaagcacca

SEQ ID NO: 2207454 - RNA, 12 nt, Human
cauagaaguaaa

SEQ ID NO: 2207455 - RNA, 21 nt, Human
guggggaugaacuuuuuguuu

SEQ ID NO: 2207456 - RNA, 11 nt, Human
ccgugugccug

SEQ ID NO: 2207457 - RNA, 18 nt, Human
aaggaugccccguccccc

SEQ ID NO: 2207458 - RNA, 21 nt, Human
ugaccauacuaauuauacccc

SEQ ID NO: 2207459 - RNA, 22 nt, Human
aggauggcuaguaucaaaagaa

SEQ ID NO: 2207460 - RNA, 18 nt, Human
aaaaucuuauaauuuaaa

SEQ ID NO: 2207461 - RNA, 18 nt, Human
cugcugguggcgcuggcu

SEQ ID NO: 2207462 - RNA, 21 nt, Human
uuuauauaagcuuguauuccu

SEQ ID NO: 2207463 - RNA, 21 nt, Human
caccucagcugccuccccagc

SEQ ID NO: 2207464 - RNA, 15 nt, Human
uacaaaugcauuucu

SEQ ID NO: 2207465 - RNA, 14 nt, Human
cuaagucuuauaua

SEQ ID NO: 2207466 - RNA, 17 nt, Human
uccaaaggcuccugaga

SEQ ID NO: 2207467 - RNA, 16 nt, Human
cagggcuacgcgcgcu

SEQ ID NO: 2207468 - RNA, 20 nt, Human
caagccuccuuuuaaaguaa

SEQ ID NO: 2207469 - RNA, 21 nt, Human
augcuacaggauuugaaauug

SEQ ID NO: 2207470 - RNA, 21 nt, Human
cuccagcuggccgggagccug

SEQ ID NO: 2207471 - RNA, 18 nt, Human
ucucuaggaaauauuuau

SEQ ID NO: 2207472 - RNA, 15 nt, Human
aagccagauuuuccu

SEQ ID NO: 2207473 - RNA, 12 nt, Human
gcccccgggccg

SEQ ID NO: 2207474 - RNA, 16 nt, Human
auccaaugaaaugagu

SEQ ID NO: 2207475 - RNA, 20 nt, Human
ccugccuaagugcagccccg

SEQ ID NO: 2207476 - RNA, 16 nt, Human
ggugcugcagccccug

SEQ ID NO: 2207477 - RNA, 23 nt, Human
uuguaacaagccuccuuuuaaag

SEQ ID NO: 2207478 - RNA, 15 nt, Human
gcugguggcgcuggc

SEQ ID NO: 2207479 - RNA, 14 nt, Human
acgagaaaacaaua

SEQ ID NO: 2207480 - RNA, 15 nt, Human
ggacucaccuccccc

SEQ ID NO: 2207481 - RNA, 22 nt, Human
uggcgcuggcugcgcucggccu

SEQ ID NO: 2207482 - RNA, 17 nt, Human
guuuuaggaauacauaa

SEQ ID NO: 2207483 - RNA, 22 nt, Human
uguucugauauuggacaguaaa

SEQ ID NO: 2207484 - RNA, 20 nt, Human
ccagugagacagcucugcau

SEQ ID NO: 2207485 - RNA, 23 nt, Human
ccgcagggugaacugcagcgagu

SEQ ID NO: 2207486 - RNA, 17 nt, Human
ucagacauagaauuaac

SEQ ID NO: 2207487 - RNA, 21 nt, Human
ugccugagcggaccuucccag

SEQ ID NO: 2207488 - RNA, 18 nt, Human
ggcgcuggcugcgcucgg

SEQ ID NO: 2207489 - RNA, 23 nt, Human
uguagguagaucuggucuuuaga

SEQ ID NO: 2207490 - RNA, 17 nt, Human
auggcuaguaucaaaag

SEQ ID NO: 2207491 - RNA, 13 nt, Human
ggaaguagaggag

SEQ ID NO: 2207492 - RNA, 22 nt, Human
agaaagugacaagcucacagac

SEQ ID NO: 2207493 - RNA, 14 nt, Human
uuauuauauuuaca

SEQ ID NO: 2207494 - RNA, 22 nt, Human
gauaaaagacagugaaagaaaa

SEQ ID NO: 2207495 - RNA, 14 nt, Human
uauuugaaauauug

SEQ ID NO: 2207496 - RNA, 15 nt, Human
ccagauccuggaaau

SEQ ID NO: 2207497 - RNA, 14 nt, Human
agacaucaacagau

SEQ ID NO: 2207498 - RNA, 21 nt, Human
gccuuuucccaacuccagaaa

SEQ ID NO: 2207499 - RNA, 19 nt, Human
aagugugacucauuaaaug

SEQ ID NO: 2207500 - RNA, 14 nt, Human
auauuugaaauauu

SEQ ID NO: 2207501 - RNA, 19 nt, Human
ggacucaccucccccaucu

SEQ ID NO: 2207502 - RNA, 22 nt, Human
aaccuacacgagauacagaauu

SEQ ID NO: 2207503 - RNA, 16 nt, Human
uuguaaaggaauuuaa

SEQ ID NO: 2207504 - RNA, 20 nt, Human
cuacuuccccuuccuaauuc

SEQ ID NO: 2207505 - RNA, 23 nt, Human
gcugccuccccagcucuauccca

SEQ ID NO: 2207506 - RNA, 16 nt, Human
ucuucugacacuaaaa

SEQ ID NO: 2207507 - RNA, 16 nt, Human
cggagccuccagcugc

SEQ ID NO: 2207508 - RNA, 14 nt, Human
ggacucaccucccc

SEQ ID NO: 2207509 - RNA, 14 nt, Human
cgagccccaggcgg

SEQ ID NO: 2207510 - RNA, 15 nt, Human
uccgcuacuuccagg

SEQ ID NO: 2207511 - RNA, 15 nt, Human
accucccccaucucu

SEQ ID NO: 2207512 - RNA, 16 nt, Human
gagaaacuggaacucu

SEQ ID NO: 2207513 - RNA, 15 nt, Human
aggagcucccaggag

SEQ ID NO: 2207514 - RNA, 22 nt, Human
auggaaauguuuacagaucccc

SEQ ID NO: 2207515 - RNA, 18 nt, Human
ucuucuggguuccuuccu

SEQ ID NO: 2207516 - RNA, 14 nt, Human
uccagauccuggaa

SEQ ID NO: 2207517 - RNA, 21 nt, Human
auauuuuuuuuuuuaaaaaaa

SEQ ID NO: 2207518 - RNA, 15 nt, Human
cuaagcaaaauguga

SEQ ID NO: 2207519 - RNA, 19 nt, Human
auagugaggagcuuugaaa

SEQ ID NO: 2207520 - RNA, 16 nt, Human
cucgccacgcucuggg

SEQ ID NO: 2207521 - RNA, 14 nt, Human
aaccagagccugag

SEQ ID NO: 2207522 - RNA, 18 nt, Human
ccugucacgugugggcaa

SEQ ID NO: 2207523 - RNA, 19 nt, Human
ucaguuauuauauuuacaa

SEQ ID NO: 2207524 - RNA, 17 nt, Human
aaauccuacuuucauaa

SEQ ID NO: 2207525 - RNA, 22 nt, Human
cuuuuccaaugacauuuuguug

SEQ ID NO: 2207526 - RNA, 17 nt, Human
ccuauccuacuuccccu

SEQ ID NO: 2207527 - RNA, 15 nt, Human
ccagaaugaccuggc

SEQ ID NO: 2207528 - RNA, 12 nt, Human
gggggucagcca

SEQ ID NO: 2207529 - RNA, 16 nt, Human
caauccaagaacuuau

SEQ ID NO: 2207530 - RNA, 22 nt, Human
uauuccuuuuucucuccucucc

SEQ ID NO: 2207531 - RNA, 23 nt, Human
cucagucucccucccuuggggcc

SEQ ID NO: 2207532 - RNA, 22 nt, Human
uucccagcuagaauucacucca

SEQ ID NO: 2207533 - RNA, 15 nt, Human
uggacgagaaaacaa

SEQ ID NO: 2207534 - RNA, 19 nt, Human
aaugaauggcuaagcaaaa

SEQ ID NO: 2207535 - RNA, 21 nt, Human
cccacuggacucaccuccccc

SEQ ID NO: 2207536 - RNA, 20 nt, Human
auaaauggcuuccuggcaau

SEQ ID NO: 2207537 - RNA, 21 nt, Human
ccauccugccccugagcccau

SEQ ID NO: 2207538 - RNA, 14 nt, Human
cucccggccgcgcu

SEQ ID NO: 2207539 - RNA, 16 nt, Human
uucucuaggaaauauu

SEQ ID NO: 2207540 - RNA, 16 nt, Human
gucuaucuuugagcgc

SEQ ID NO: 2207541 - RNA, 22 nt, Human
agccaaacauccuacaagacac

SEQ ID NO: 2207542 - RNA, 18 nt, Human
auucacuccacuuggaca

SEQ ID NO: 2207543 - RNA, 21 nt, Human
agccuuggauacuccaugggg

SEQ ID NO: 2207544 - RNA, 19 nt, Human
gcugcugguggcgcuggcu

SEQ ID NO: 2207545 - RNA, 20 nt, Human
cucuguucugcacacagcac

SEQ ID NO: 2207546 - RNA, 18 nt, Human
agauccccaagccuggca

SEQ ID NO: 2207547 - RNA, 12 nt, Human
ggaggggcuucu

SEQ ID NO: 2207548 - RNA, 19 nt, Human
uguaaagguccuggcaaag

SEQ ID NO: 2207549 - RNA, 18 nt, Human
ccgcuacuuccagggcua

SEQ ID NO: 2207550 - RNA, 18 nt, Human
ugccuaauuuguuuuccc

SEQ ID NO: 2207551 - RNA, 21 nt, Human
auaugcucuaaacauguuuau

SEQ ID NO: 2207552 - RNA, 13 nt, Human
uuccucugagccu

SEQ ID NO: 2207553 - RNA, 14 nt, Human
accacaagacugca

SEQ ID NO: 2207554 - RNA, 22 nt, Human
gcagagagguagggauggggcu

SEQ ID NO: 2207555 - RNA, 16 nt, Human
cauggguuuuauuaua

SEQ ID NO: 2207556 - RNA, 19 nt, Human
ucaccaaggcugauuaaac

SEQ ID NO: 2207557 - RNA, 18 nt, Human
uggagggaagccuugggg

SEQ ID NO: 2207558 - RNA, 19 nt, Human
uaggggggucagccagccc

SEQ ID NO: 2207559 - RNA, 20 nt, Human
accucauggaauuggagcuc

SEQ ID NO: 2207560 - RNA, 15 nt, Human
ccaggcggguccggg

SEQ ID NO: 2207561 - RNA, 18 nt, Human
ugagaaggagcucccagg

SEQ ID NO: 2207562 - RNA, 15 nt, Human
aauugacccacaaga

SEQ ID NO: 2207563 - RNA, 16 nt, Human
agagguccacaacaca

SEQ ID NO: 2207564 - RNA, 21 nt, Human
aauuaaguuuuuuuuuaaaaa

SEQ ID NO: 2207565 - RNA, 12 nt, Human
ucccaaccucuc

SEQ ID NO: 2207566 - RNA, 19 nt, Human
acaaauuuacagagacaga

SEQ ID NO: 2207567 - RNA, 20 nt, Human
cuggccuucggccuccaucc

SEQ ID NO: 2207568 - RNA, 17 nt, Human
caagacccaaaaggcag

SEQ ID NO: 2207569 - RNA, 16 nt, Human
gcuucacuguaaaaua

SEQ ID NO: 2207570 - RNA, 22 nt, Human
cuuguaaaggaauuuaaaaauc

SEQ ID NO: 2207571 - RNA, 23 nt, Human
cccagcccuccuuaucaaaggac

SEQ ID NO: 2207572 - RNA, 21 nt, Human
gcccugcugagucccaggcug

SEQ ID NO: 2207573 - RNA, 15 nt, Human
uccuacaagacacag

SEQ ID NO: 2207574 - RNA, 21 nt, Human
ucaagucuuucacauuuaaau

SEQ ID NO: 2207575 - RNA, 19 nt, Human
aagcauuccaacuaucuca

SEQ ID NO: 2207576 - RNA, 18 nt, Human
gaugccccgucccccucu

SEQ ID NO: 2207577 - RNA, 17 nt, Human
aaaaauccuacuuucau

SEQ ID NO: 2207578 - RNA, 21 nt, Human
auuccuuuuucucuccucucc

SEQ ID NO: 2207579 - RNA, 20 nt, Human
auaacaaugcuguauuuuaa

SEQ ID NO: 2207580 - RNA, 13 nt, Human
gcggccuggucua

SEQ ID NO: 2207581 - RNA, 15 nt, Human
uuuuuaguucuucaa

SEQ ID NO: 2207582 - RNA, 21 nt, Human
auguuuacagauccccaagcc

SEQ ID NO: 2207583 - RNA, 12 nt, Human
auccugugggac

SEQ ID NO: 2207584 - RNA, 23 nt, Human
cuggccgggagccugaucaccug

SEQ ID NO: 2207585 - RNA, 13 nt, Human
aaauaaaaauaau

SEQ ID NO: 2207586 - RNA, 23 nt, Human
ucaauaucuuuuuuuuaauaaac

SEQ ID NO: 2207587 - RNA, 18 nt, Human
auagucaaauugugugaa

SEQ ID NO: 2207588 - RNA, 14 nt, Human
acuauaaaacuagg

SEQ ID NO: 2207589 - RNA, 16 nt, Human
cccugaaagucccaga

SEQ ID NO: 2207590 - RNA, 20 nt, Human
ccugagcggaccuucccagc

SEQ ID NO: 2207591 - RNA, 18 nt, Human
cagcuagaauucacucca

SEQ ID NO: 2207592 - RNA, 14 nt, Human
caggaggcauccaa

SEQ ID NO: 2207593 - RNA, 19 nt, Human
cagacucuggucaagaagc

SEQ ID NO: 2207594 - RNA, 22 nt, Human
gcugcagccccugggaccaggc

SEQ ID NO: 2207595 - RNA, 18 nt, Human
gccauagucauucugccu

SEQ ID NO: 2207596 - RNA, 13 nt, Human
cugccucaaucag

SEQ ID NO: 2207597 - RNA, 16 nt, Human
uguugcuaucaaucca

SEQ ID NO: 2207598 - RNA, 20 nt, Human
gccucagggugcacacagga

SEQ ID NO: 2207599 - RNA, 13 nt, Human
gcuaucaauccaa

SEQ ID NO: 2207600 - RNA, 18 nt, Human
uagccagguaccuucuca

SEQ ID NO: 2207601 - RNA, 21 nt, Human
ugacacuaaaacaccucagcu

SEQ ID NO: 2207602 - RNA, 19 nt, Human
ugagcggaccuucccagcu

SEQ ID NO: 2207603 - RNA, 22 nt, Human
caagaacuuauuuguacauuuu

SEQ ID NO: 2207604 - RNA, 22 nt, Human
guacauuuuuuuuuucaauaaa

SEQ ID NO: 2207605 - RNA, 18 nt, Human
gccagcccucuucugaca

SEQ ID NO: 2207606 - RNA, 21 nt, Human
aaacuuuuccaaugacauuuu

SEQ ID NO: 2207607 - RNA, 17 nt, Human
aguucuucaaagauagg

SEQ ID NO: 2207608 - RNA, 16 nt, Human
accaaauugagcuagg

SEQ ID NO: 2207609 - RNA, 14 nt, Human
ucaagccugccuca

SEQ ID NO: 2207610 - RNA, 17 nt, Human
gauacuccauggggugg

SEQ ID NO: 2207611 - RNA, 15 nt, Human
ccugagcggaccuuc

SEQ ID NO: 2207612 - RNA, 17 nt, Human
ccugugggaccugggcc

SEQ ID NO: 2207613 - RNA, 13 nt, Human
ucagccagcccuc

SEQ ID NO: 2207614 - RNA, 20 nt, Human
ccugagcggaccuucccagc

SEQ ID NO: 2207615 - RNA, 18 nt, Human
cuaucccaaccucuccca

SEQ ID NO: 2207616 - RNA, 14 nt, Human
ggaaacuccacauc

SEQ ID NO: 2207617 - RNA, 16 nt, Human
ggugcugcagccccug

SEQ ID NO: 2207618 - RNA, 21 nt, Human
acaugggugcuauugggguug

SEQ ID NO: 2207619 - RNA, 12 nt, Human
cagccccuggga

SEQ ID NO: 2207620 - RNA, 23 nt, Human
ccacuuggacaugggccccagau

SEQ ID NO: 2207621 - RNA, 21 nt, Human
cuccccagcucuaucccaacc

SEQ ID NO: 2207622 - RNA, 17 nt, Human
ccugagcggaccuuccc

SEQ ID NO: 2207623 - RNA, 22 nt, Human
ccugggaccaggcacccccaga

SEQ ID NO: 2207624 - RNA, 23 nt, Human
ucugacacuaaaacaccucagcu

SEQ ID NO: 2207625 - RNA, 11 nt, Human
ggguugggggg

SEQ ID NO: 2207626 - RNA, 19 nt, Human
aaacaccucagcugccucc

SEQ ID NO: 2207627 - RNA, 15 nt, Human
gacaugggccccaga

SEQ ID NO: 2207628 - RNA, 15 nt, Human
ccaacuauaaaacua

SEQ ID NO: 2207629 - RNA, 14 nt, Human
ggccgcagugaggc

SEQ ID NO: 2207630 - RNA, 20 nt, Human
ggaggcauccaaaggcuccu

SEQ ID NO: 2207631 - RNA, 15 nt, Human
caggcacccccagaa

SEQ ID NO: 2207632 - RNA, 21 nt, Human
acacuaaaacaccucagcugc

SEQ ID NO: 2207633 - RNA, 17 nt, Human
cuuauuuguacauuuuu

SEQ ID NO: 2207634 - RNA, 21 nt, Human
cugggaccaggcacccccaga

SEQ ID NO: 2207635 - RNA, 15 nt, Human
cccucuucugacacu

SEQ ID NO: 2207636 - RNA, 21 nt, Human
gccucagggugcacacaggau

SEQ ID NO: 2207637 - RNA, 12 nt, Human
auccugugggac

SEQ ID NO: 2207638 - RNA, 17 nt, Human
gacacaugggugcuauu

SEQ ID NO: 2207639 - RNA, 14 nt, Human
gaucaagccugccu

SEQ ID NO: 2207640 - RNA, 16 nt, Human
uggauacuccaugggg

SEQ ID NO: 2207641 - RNA, 15 nt, Human
agccccugggaccag

SEQ ID NO: 2207642 - RNA, 14 nt, Human
gagguaccagccuu

SEQ ID NO: 2207643 - RNA, 16 nt, Human
ccaaauugagcuaggg

SEQ ID NO: 2207644 - RNA, 16 nt, Human
caauccaagaacuuau

SEQ ID NO: 2207645 - RNA, 12 nt, Human
cauucugccugc

SEQ ID NO: 2207646 - RNA, 12 nt, Human
gggggucagcca

SEQ ID NO: 2207647 - RNA, 13 nt, Human
uccugugggaccu

SEQ ID NO: 2207648 - RNA, 17 nt, Human
ccccagaaugaccuggc

SEQ ID NO: 2207649 - RNA, 19 nt, Human
gccauagucauucugccug

SEQ ID NO: 2207650 - RNA, 16 nt, Human
uucugacacuaaaaca

SEQ ID NO: 2207651 - RNA, 16 nt, Human
cucucccaacuauaaa

SEQ ID NO: 2207652 - RNA, 16 nt, Human
aaacuuuuccaaugac

SEQ ID NO: 2207653 - RNA, 15 nt, Human
ucaguauucauauuu

SEQ ID NO: 2207654 - RNA, 14 nt, Human
ugagcuaggggggu

SEQ ID NO: 2207655 - RNA, 23 nt, Human
gcugccuccccagcucuauccca

SEQ ID NO: 2207656 - RNA, 20 nt, Human
cccagcuagaauucacucca

SEQ ID NO: 2207657 - RNA, 22 nt, Human
gagcuaggggggucagccagcc

SEQ ID NO: 2207658 - RNA, 23 nt, Human
cauuuuuuuuuucaauaaaacuu

SEQ ID NO: 2207659 - RNA, 21 nt, Human
cagccccugggaccaggcacc

SEQ ID NO: 2207660 - RNA, 13 nt, Human
agguaccuucuca

SEQ ID NO: 2207661 - RNA, 19 nt, Human
cacauccugugggaccugg

SEQ ID NO: 2207662 - RNA, 18 nt, Human
cauccaaaggcuccugag

SEQ ID NO: 2207663 - RNA, 18 nt, Human
cagaucaagccugccuca

SEQ ID NO: 2207664 - RNA, 19 nt, Human
ccacuuggacaugggcccc

SEQ ID NO: 2207665 - RNA, 18 nt, Human
ccugcccugaaaguccca

SEQ ID NO: 2207666 - RNA, 20 nt, Human
cuuuuuuaguucuucaaaga

SEQ ID NO: 2207667 - RNA, 17 nt, Human
auccugugggaccuggg

SEQ ID NO: 2207668 - RNA, 21 nt, Human
cacuaaaacaccucagcugcc

SEQ ID NO: 2207669 - RNA, 21 nt, Human
auccugugggaccugggccau

SEQ ID NO: 2207670 - RNA, 21 nt, Human
gcucccaggaggggcuucugg

SEQ ID NO: 2207671 - RNA, 19 nt, Human
gaaggagcucccaggaggg

SEQ ID NO: 2207672 - RNA, 23 nt, Human
ccccugggaccaggcacccccag

SEQ ID NO: 2207673 - RNA, 18 nt, Human
gccuuggauacuccaugg

SEQ ID NO: 2207674 - RNA, 21 nt, Human
gagaaggagcucccaggaggg

SEQ ID NO: 2207675 - RNA, 13 nt, Human
cacaggauggcag

SEQ ID NO: 2207676 - RNA, 14 nt, Human
ugcagccccuggga

SEQ ID NO: 2207677 - RNA, 20 nt, Human
cugacacuaaaacaccucag

SEQ ID NO: 2207678 - RNA, 18 nt, Human
aaggagcucccaggaggg

SEQ ID NO: 2207679 - RNA, 14 nt, Human
ccacauccuguggg

SEQ ID NO: 2207680 - RNA, 22 nt, Human
gaaugaccuggccgcagugagg

SEQ ID NO: 2207681 - RNA, 20 nt, Human
caggaggggcuucugggcag

SEQ ID NO: 2207682 - RNA, 17 nt, Human
gcuauugggguuggggg

SEQ ID NO: 2207683 - RNA, 14 nt, Human
cuagaauucacucc

SEQ ID NO: 2207684 - RNA, 13 nt, Human
ggaccuucccagc

SEQ ID NO: 2207685 - RNA, 17 nt, Human
uugggguugggggggag

SEQ ID NO: 2207686 - RNA, 20 nt, Human
uccacuuggacaugggcccc

SEQ ID NO: 2207687 - RNA, 11 nt, Human
gggaccugggc

SEQ ID NO: 2207688 - RNA, 20 nt, Human
ugggccccagauaccaugau

SEQ ID NO: 2207689 - RNA, 21 nt, Human
gcaucgugucuggcguugugg

SEQ ID NO: 2207690 - RNA, 13 nt, Human
ggcacccccagaa

SEQ ID NO: 2207691 - RNA, 18 nt, Human
gaggcggauugagaagga

SEQ ID NO: 2207692 - RNA, 21 nt, Human
uuuauagccagguaccuucuc

SEQ ID NO: 2207693 - RNA, 21 nt, Human
ugccugagcggaccuucccag

SEQ ID NO: 2207694 - RNA, 13 nt, Human
cugccuccccagc

SEQ ID NO: 2207695 - RNA, 22 nt, Human
gccauagucauucugccugccc

SEQ ID NO: 2207696 - RNA, 12 nt, Human
acuauaaaacua

SEQ ID NO: 2207697 - RNA, 12 nt, Human
acacuaaaacac

SEQ ID NO: 2207698 - RNA, 22 nt, Human
uauagccagguaccuucucacc

SEQ ID NO: 2207699 - RNA, 17 nt, Human
ucauauuuauagccagg

SEQ ID NO: 2207700 - RNA, 22 nt, Human
uucccagcuagaauucacucca

SEQ ID NO: 2207701 - RNA, 13 nt, Human
guggaaaaacaga

SEQ ID NO: 2207702 - RNA, 21 nt, Human
acuuuuccaaugacauuuugu

SEQ ID NO: 2207703 - RNA, 21 nt, Human
ucccagaucaagccugccuca

SEQ ID NO: 2207704 - RNA, 22 nt, Human
gucaagaagcaucgugucuggc

SEQ ID NO: 2207705 - RNA, 21 nt, Human
cuccacuuggacaugggcccc

SEQ ID NO: 2207706 - RNA, 15 nt, Human
cugggaccaggcacc

SEQ ID NO: 2207707 - RNA, 22 nt, Human
cacuuggacaugggccccagau

SEQ ID NO: 2207708 - RNA, 16 nt, Human
cagcucuaucccaacc

SEQ ID NO: 2207709 - RNA, 15 nt, Human
gccagcccucuucug

SEQ ID NO: 2207710 - RNA, 14 nt, Human
auucugccugcccu

SEQ ID NO: 2207711 - RNA, 13 nt, Human
accuggccgcagu

SEQ ID NO: 2207712 - RNA, 11 nt, Human
uuuuuuuucaa

SEQ ID NO: 2207713 - RNA, 19 nt, Human
auagucauucugccugccc

SEQ ID NO: 2207714 - RNA, 13 nt, Human
cacauccuguggg

SEQ ID NO: 2207715 - RNA, 10 nt, Human
aauaaaacuu

SEQ ID NO: 2207716 - RNA, 14 nt, Human
uuucaauaaaacuu

SEQ ID NO: 2207717 - RNA, 22 nt, Human
aggcuccugagacacaugggug

SEQ ID NO: 2207718 - RNA, 16 nt, Human
cagccagcccucuucu

SEQ ID NO: 2207719 - RNA, 14 nt, Human
ccucuucugacacu

SEQ ID NO: 2207720 - RNA, 18 nt, Human
ccucagcugccuccccag

SEQ ID NO: 2207721 - RNA, 18 nt, Human
ccugagcggaccuuccca

SEQ ID NO: 2207722 - RNA, 15 nt, Human
cuaggugcugcagcc

SEQ ID NO: 2207723 - RNA, 22 nt, Human
agcucuaucccaaccucuccca

SEQ ID NO: 2207724 - RNA, 23 nt, Human
ccucagcugccuccccagcucua

SEQ ID NO: 2207725 - RNA, 15 nt, Human
aaggcuccugagaca

SEQ ID NO: 2207726 - RNA, 14 nt, Human
ugacacuaaaacac

SEQ ID NO: 2207727 - RNA, 14 nt, Human
aaacuuuuccaaug

SEQ ID NO: 2207728 - RNA, 23 nt, Human
cugggccauagucauucugccug

SEQ ID NO: 2207729 - RNA, 15 nt, Human
ccugaaagucccaga

SEQ ID NO: 2207730 - RNA, 17 nt, Human
ggauacuccauggggug

SEQ ID NO: 2207731 - RNA, 22 nt, Human
acaggauggcaggaggcaucca

SEQ ID NO: 2207732 - RNA, 21 nt, Human
cuucucaccugugagaccaaa

SEQ ID NO: 2207733 - RNA, 20 nt, Human
gauugagaaggagcucccag

SEQ ID NO: 2207734 - RNA, 18 nt, Human
acaccucagcugccuccc

SEQ ID NO: 2207735 - RNA, 15 nt, Human
caccucagcugccuc

SEQ ID NO: 2207736 - RNA, 22 nt, Human
ugugccugagcggaccuuccca

SEQ ID NO: 2207737 - RNA, 23 nt, Human
caauccaagaacuuauuuguaca

SEQ ID NO: 2207738 - RNA, 15 nt, Human
cuccacauccugugg

SEQ ID NO: 2207739 - RNA, 22 nt, Human
agccugccucaaucaguauuca

SEQ ID NO: 2207740 - RNA, 18 nt, Human
agcugccuccccagcucu

SEQ ID NO: 2207741 - RNA, 16 nt, Human
acaggauggcaggagg

SEQ ID NO: 2207742 - RNA, 22 nt, Human
ggguggaaaaacagaccggggu

SEQ ID NO: 2207743 - RNA, 17 nt, Human
cugggaccaggcacccc

SEQ ID NO: 2207744 - RNA, 22 nt, Human
cuaucaauccaagaacuuauuu

SEQ ID NO: 2207745 - RNA, 14 nt, Human
ggugcugcagcccc

SEQ ID NO: 2207746 - RNA, 16 nt, Human
cccaaccucucccaac

SEQ ID NO: 2207747 - RNA, 12 nt, Human
accaggcacccc

SEQ ID NO: 2207748 - RNA, 13 nt, Human
ccaaccucuccca

SEQ ID NO: 2207749 - RNA, 21 nt, Human
cucuaucccaaccucucccaa

SEQ ID NO: 2207750 - RNA, 14 nt, Human
caugggccccagau

SEQ ID NO: 2207751 - RNA, 16 nt, Human
uaggugcugcagcccc

SEQ ID NO: 2207752 - RNA, 16 nt, Human
cagaucaagccugccu

SEQ ID NO: 2207753 - RNA, 15 nt, Human
cauucugccugcccu

SEQ ID NO: 2207754 - RNA, 16 nt, Human
gcccugaaagucccag

SEQ ID NO: 2207755 - RNA, 15 nt, Human
caggauggcaggagg

SEQ ID NO: 2207756 - RNA, 22 nt, Human
ucuuccuuuuuuaguucuucaa

SEQ ID NO: 2207757 - RNA, 12 nt, Human
ucaauaaaacuu

SEQ ID NO: 2207758 - RNA, 18 nt, Human
auugagaaggagcuccca

SEQ ID NO: 2207759 - RNA, 20 nt, Human
cugagcggaccuucccagcu

SEQ ID NO: 2207760 - RNA, 16 nt, Human
uauugggguugggggg

SEQ ID NO: 2207761 - RNA, 17 nt, Human
agcucuaucccaaccuc

SEQ ID NO: 2207762 - RNA, 15 nt, Human
ggauacuccaugggg

SEQ ID NO: 2207763 - RNA, 14 nt, Human
ucaagccugccuca

SEQ ID NO: 2207764 - RNA, 12 nt, Human
ggggugggggug

SEQ ID NO: 2207765 - RNA, 18 nt, Human
aauaaaacuuuuccaaug

SEQ ID NO: 2207766 - RNA, 16 nt, Human
uggggaugaacuuuuu

SEQ ID NO: 2207767 - RNA, 14 nt, Human
ucuaucccaaccuc

SEQ ID NO: 2207768 - RNA, 19 nt, Human
acuuauuuguacauuuuuu

SEQ ID NO: 2207769 - RNA, 23 nt, Human
ccuuuguugcuaucaauccaaga

SEQ ID NO: 2207770 - RNA, 21 nt, Human
ugagcuaggggggucagccag

SEQ ID NO: 2207771 - RNA, 12 nt, Human
gaaagucccaga

SEQ ID NO: 2207772 - RNA, 15 nt, Human
ggugcugcagccccu

SEQ ID NO: 2207773 - RNA, 14 nt, Human
cuccugagacacau

SEQ ID NO: 2207774 - RNA, 16 nt, Human
cuucugggcagacucu

SEQ ID NO: 2207775 - RNA, 14 nt, Human
auggcaggaggcau

SEQ ID NO: 2207776 - RNA, 13 nt, Human
uuuuuuuuuucaa

SEQ ID NO: 2207777 - RNA, 22 nt, Human
cccagaaugaccuggccgcagu

SEQ ID NO: 2207778 - RNA, 17 nt, Human
cauccugugggaccugg

SEQ ID NO: 2207779 - RNA, 13 nt, Human
acuauaaaacuag

SEQ ID NO: 2207780 - RNA, 21 nt, Human
aggcauccaaaggcuccugag

SEQ ID NO: 2207781 - RNA, 19 nt, Human
ccaggcacccccagaauga

SEQ ID NO: 2207782 - RNA, 14 nt, Human
cagaccgggguucc

SEQ ID NO: 2207783 - RNA, 16 nt, Human
acuaggugcugcagcc

SEQ ID NO: 2207784 - RNA, 14 nt, Human
augaacuuuuuguu

SEQ ID NO: 2207785 - RNA, 14 nt, Human
cagaaugaccuggc

SEQ ID NO: 2207786 - RNA, 15 nt, Human
uaaaacuuuuccaau

SEQ ID NO: 2207787 - RNA, 22 nt, Human
cugagcggaccuucccagcuag

SEQ ID NO: 2207788 - RNA, 14 nt, Human
cagccccugggacc

SEQ ID NO: 2207789 - RNA, 17 nt, Human
ucaauccaagaacuuau

SEQ ID NO: 2207790 - RNA, 23 nt, Human
gagcucccaggaggggcuucugg

SEQ ID NO: 2207791 - RNA, 18 nt, Human
aggcggauugagaaggag

SEQ ID NO: 2207792 - RNA, 16 nt, Human
uucaauaaaacuuuuc

SEQ ID NO: 2207793 - RNA, 15 nt, Human
ugagaaggagcuccc

SEQ ID NO: 2207794 - RNA, 18 nt, Human
ugagcuaggggggucagc

SEQ ID NO: 2207795 - RNA, 19 nt, Human
gaggcauccaaaggcuccu

SEQ ID NO: 2207796 - RNA, 17 nt, Human
ccagguaccuucucacc

SEQ ID NO: 2207797 - RNA, 18 nt, Human
gcuaucaauccaagaacu

SEQ ID NO: 2207798 - RNA, 20 nt, Human
augggccccagauaccauga

SEQ ID NO: 2207799 - RNA, 14 nt, Human
gauugagaaggagc

SEQ ID NO: 2207800 - RNA, 13 nt, Human
aacuauaaaacua

SEQ ID NO: 2207801 - RNA, 22 nt, Human
augcugagcccggaaacuccac

SEQ ID NO: 2207802 - RNA, 18 nt, Human
gaaggagcucccaggagg

SEQ ID NO: 2207803 - RNA, 17 nt, Human
ccagaucaagccugccu

SEQ ID NO: 2207804 - RNA, 23 nt, Human
ccagaucaagccugccucaauca

SEQ ID NO: 2207805 - RNA, 13 nt, Human
ugagcggaccuuc

SEQ ID NO: 2207806 - RNA, 20 nt, Human
ccaaccucucccaacuauaa

SEQ ID NO: 2207807 - RNA, 17 nt, Human
cauauuuauagccaggu

SEQ ID NO: 2207808 - RNA, 12 nt, Human
caagccugccuc

SEQ ID NO: 2207809 - RNA, 18 nt, Human
auccugugggaccugggc

SEQ ID NO: 2207810 - RNA, 24 nt, Human
gccugcccugaaagucccagauca

SEQ ID NO: 2207811 - RNA, 15 nt, Human
ccgugugccugagcg

SEQ ID NO: 2207812 - RNA, 14 nt, Human
ugcugcagccccug

SEQ ID NO: 2207813 - RNA, 23 nt, Human
gaggcauccaaaggcuccugaga

SEQ ID NO: 2207814 - RNA, 12 nt, Human
gugggaccuggg

SEQ ID NO: 2207815 - RNA, 13 nt, Human
ucauucugccugc

SEQ ID NO: 2207816 - RNA, 21 nt, Human
ucccaggaggggcuucugggc

SEQ ID NO: 2207817 - RNA, 15 nt, Human
gccccugggaccagg

SEQ ID NO: 2207818 - RNA, 18 nt, Human
gggggucagccagcccuc

SEQ ID NO: 2207819 - RNA, 23 nt, Human
gccagguaccuucucaccuguga

SEQ ID NO: 2207820 - RNA, 18 nt, Human
ucccaacuauaaaacuag

SEQ ID NO: 2207821 - RNA, 17 nt, Human
cacuuggacaugggccc

SEQ ID NO: 2207822 - RNA, 15 nt, Human
aguucuucaaagaua

SEQ ID NO: 2207823 - RNA, 18 nt, Human
gcugagcccggaaacucc

SEQ ID NO: 2207824 - RNA, 16 nt, Human
aucaagccugccucaa

SEQ ID NO: 2207825 - RNA, 22 nt, Human
cagcuagaauucacuccacuug

SEQ ID NO: 2207826 - RNA, 15 nt, Human
guuucuuccuuuuuu

SEQ ID NO: 2207827 - RNA, 20 nt, Human
uccaaaggcuccugagacac

SEQ ID NO: 2207828 - RNA, 14 nt, Human
ugaaagucccagau

SEQ ID NO: 2207829 - RNA, 16 nt, Human
guuuuguuucuuccuu

SEQ ID NO: 2207830 - RNA, 19 nt, Human
aggggggucagccagcccu

SEQ ID NO: 2207831 - RNA, 21 nt, Human
cagcucuaucccaaccucucc

SEQ ID NO: 2207832 - RNA, 13 nt, Human
gugcugcagcccc

SEQ ID NO: 2207833 - RNA, 12 nt, Human
ucaagaagcauc

SEQ ID NO: 2207834 - RNA, 21 nt, Human
ccacauccugugggaccuggg

SEQ ID NO: 2207835 - RNA, 20 nt, Human
ccacuuggacaugggcccca

SEQ ID NO: 2207836 - RNA, 14 nt, Human
accugugagaccaa

SEQ ID NO: 2207837 - RNA, 19 nt, Human
accucagcugccuccccag

SEQ ID NO: 2207838 - RNA, 19 nt, Human
ugggccccagauaccauga

SEQ ID NO: 2207839 - RNA, 17 nt, Human
agccuuggauacuccau

SEQ ID NO: 2207840 - RNA, 19 nt, Human
cagguaccuucucaccugu

SEQ ID NO: 2207841 - RNA, 23 nt, Human
ccucuucugacacuaaaacaccu

SEQ ID NO: 2207842 - RNA, 18 nt, Human
uuuucaauaaaacuuuuc

SEQ ID NO: 2207843 - RNA, 14 nt, Human
caccucagcugccu

SEQ ID NO: 2207844 - RNA, 23 nt, Human
aaaaacagaccgggguucccgug

SEQ ID NO: 2207845 - RNA, 15 nt, Human
cuagaauucacucca

SEQ ID NO: 2207846 - RNA, 14 nt, Human
ggggaacaugagcc

SEQ ID NO: 2207847 - RNA, 18 nt, Human
uaucccaaccucucccaa

SEQ ID NO: 2207848 - RNA, 18 nt, Human
agaucaagccugccucaa

SEQ ID NO: 2207849 - RNA, 13 nt, Human
ccaaauugagcua

SEQ ID NO: 2207850 - RNA, 21 nt, Human
guggggaugaacuuuuuguuu

SEQ ID NO: 2207851 - RNA, 16 nt, Human
accagccuuggauacu

SEQ ID NO: 2207852 - RNA, 16 nt, Human
agaucaagccugccuc

SEQ ID NO: 2207853 - RNA, 16 nt, Human
ccagaucaagccugcc

SEQ ID NO: 2207854 - RNA, 20 nt, Human
agugaggcggauugagaagg

SEQ ID NO: 2207855 - RNA, 19 nt, Human
auccugugggaccugggcc

SEQ ID NO: 2207856 - RNA, 20 nt, Human
cagguaccuucucaccugug

SEQ ID NO: 2207857 - RNA, 22 nt, Human
cagcucuaucccaaccucuccc

SEQ ID NO: 2207858 - RNA, 19 nt, Human
ucccagaucaagccugccu

SEQ ID NO: 2207859 - RNA, 13 nt, Human
agggagggaaggg

SEQ ID NO: 2207860 - RNA, 24 nt, Human
gcuucugggcagacucuggucaag

SEQ ID NO: 2207861 - RNA, 20 nt, Human
uuuccaaugacauuuuguug

SEQ ID NO: 2207862 - RNA, 15 nt, Human
cccaaccucucccaa

SEQ ID NO: 2207863 - RNA, 16 nt, Human
aaacuaggugcugcag

SEQ ID NO: 2207864 - RNA, 13 nt, Human
ggcuccugagaca

SEQ ID NO: 2207865 - RNA, 17 nt, Human
ggugcugcagccccugg

SEQ ID NO: 2207866 - RNA, 14 nt, Human
ucccaacuauaaaa

SEQ ID NO: 2207867 - RNA, 14 nt, Human
agaucaagccugcc

SEQ ID NO: 2207868 - RNA, 14 nt, Human
auaccaugaugcug

SEQ ID NO: 2207869 - RNA, 16 nt, Human
ccaggcacccccagaa

SEQ ID NO: 2207870 - RNA, 23 nt, Human
cagccagcccucuucugacacua

SEQ ID NO: 2207871 - RNA, 12 nt, Human
ggaggggcuucu

SEQ ID NO: 2207872 - RNA, 14 nt, Human
cuaucaauccaaga

SEQ ID NO: 2207873 - RNA, 17 nt, Human
uauuuguacauuuuuuu

SEQ ID NO: 2207874 - RNA, 18 nt, Human
ugagaaggagcucccagg

SEQ ID NO: 2207875 - RNA, 15 nt, Human
auagucauucugccu

SEQ ID NO: 2207876 - RNA, 22 nt, Human
aaacaccucagcugccucccca

SEQ ID NO: 2207877 - RNA, 16 nt, Human
ccucaaucaguauuca

SEQ ID NO: 2207878 - RNA, 19 nt, Human
uccugugggaccugggcca

SEQ ID NO: 2207879 - RNA, 15 nt, Human
accuucccagcuaga

SEQ ID NO: 2207880 - RNA, 22 nt, Human
guauucauauuuauagccaggu

SEQ ID NO: 2207881 - RNA, 18 nt, Human
auucacuccacuuggaca

SEQ ID NO: 2207882 - RNA, 17 nt, Human
acucuggucaagaagca

SEQ ID NO: 2207883 - RNA, 22 nt, Human
cucuggucaagaagcaucgugu

SEQ ID NO: 2207884 - RNA, 13 nt, Human
gagcuaggggggu

SEQ ID NO: 2207885 - RNA, 19 nt, Human
uaggggggucagccagccc

SEQ ID NO: 2207886 - RNA, 15 nt, Human
ggggcuucugggcag

SEQ ID NO: 2207887 - RNA, 20 nt, Human
gauaccaugaugcugagccc

SEQ ID NO: 2207888 - RNA, 19 nt, Human
aauaaaacuuuuccaauga

SEQ ID NO: 2207889 - RNA, 19 nt, Human
ugcuauugggguugggggg

SEQ ID NO: 2207890 - RNA, 20 nt, Human
gccagcccucuucugacacu

SEQ ID NO: 2207891 - RNA, 23 nt, Human
aagucccagaucaagccugccuc

SEQ ID NO: 2207892 - RNA, 18 nt, Human
acaggauggcaggaggca

SEQ ID NO: 2207893 - RNA, 16 nt, Human
agauagggagggaagg

SEQ ID NO: 2207894 - RNA, 12 nt, Human
ccccugggacca

SEQ ID NO: 2207895 - RNA, 18 nt, Human
ugcugcagccccugggac

SEQ ID NO: 2207896 - RNA, 16 nt, Human
gcugcagccccuggga

SEQ ID NO: 2207897 - RNA, 16 nt, Human
cauagucauucugccu

SEQ ID NO: 2207898 - RNA, 19 nt, Human
cccagcuagaauucacucc

SEQ ID NO: 2207899 - RNA, 20 nt, Human
ccagaaugaccuggccgcag

SEQ ID NO: 2207900 - RNA, 13 nt, Human
caauccaagaacu

SEQ ID NO: 2207901 - RNA, 16 nt, Human
auagucauucugccug

SEQ ID NO: 2207902 - RNA, 12 nt, Human
ggugcugcagcc

SEQ ID NO: 2207903 - RNA, 16 nt, Human
cuagaauucacuccac

SEQ ID NO: 2207904 - RNA, 16 nt, Human
agcggaccuucccagc

SEQ ID NO: 2207905 - RNA, 14 nt, Human
ccagcuagaauuca

SEQ ID NO: 2207906 - RNA, 13 nt, Human
uccccagcucuau

SEQ ID NO: 2207907 - RNA, 20 nt, Human
accuucccagcuagaauuca

SEQ ID NO: 2207908 - RNA, 18 nt, Human
ccaaaggcuccugagaca

SEQ ID NO: 2207909 - RNA, 11 nt, Human
agccagguacc

SEQ ID NO: 2207910 - RNA, 13 nt, Human
aucaagccugccu

SEQ ID NO: 2207911 - RNA, 21 nt, Human
ugcccugaaagucccagauca

SEQ ID NO: 2207912 - RNA, 18 nt, Human
agggugcacacaggaugg

SEQ ID NO: 2207913 - RNA, 15 nt, Human
ugagcggaccuuccc

SEQ ID NO: 2207914 - RNA, 13 nt, Human
gauggcaggaggc

SEQ ID NO: 2207915 - RNA, 15 nt, Human
aggauggcaggaggc

SEQ ID NO: 2207916 - RNA, 22 nt, Human
gaggcggauugagaaggagcuc

SEQ ID NO: 2207917 - RNA, 17 nt, Human
acuaggugcugcagccc

SEQ ID NO: 2207918 - RNA, 13 nt, Human
ccuucucaccugu

SEQ ID NO: 2207919 - RNA, 16 nt, Human
ucccagaucaagccug

SEQ ID NO: 2207920 - RNA, 19 nt, Human
uccacauccugugggaccu

SEQ ID NO: 2207921 - RNA, 20 nt, Human
agcccucuucugacacuaaa

SEQ ID NO: 2207922 - RNA, 21 nt, Human
agccuuggauacuccaugggg

SEQ ID NO: 2207923 - RNA, 24 nt, Human
aacuauaaaacuaggugcugcagc

SEQ ID NO: 2207924 - RNA, 18 nt, Human
ccaggaggggcuucuggg

SEQ ID NO: 2207925 - RNA, 15 nt, Human
caaauugagcuaggg

SEQ ID NO: 2207926 - RNA, 16 nt, Human
cuccaugggguggggg

SEQ ID NO: 2207927 - RNA, 16 nt, Human
gugcugcagccccugg

SEQ ID NO: 2207928 - RNA, 15 nt, Human
uuuuuaguucuucaa

SEQ ID NO: 2207929 - RNA, 19 nt, Human
agauaccaugaugcugagc

SEQ ID NO: 2207930 - RNA, 17 nt, Human
ccauagucauucugccu

SEQ ID NO: 2207931 - RNA, 12 nt, Human
ucccaaccucuc

SEQ ID NO: 2207932 - RNA, 16 nt, Human
cucagcugccucccca

SEQ ID NO: 2207933 - RNA, 13 nt, Human
cuccccagcucua

SEQ ID NO: 2207934 - RNA, 19 nt, Human
aaaacuaggugcugcagcc

SEQ ID NO: 2207935 - RNA, 18 nt, Human
ggggucagccagcccucu

SEQ ID NO: 2207936 - RNA, 12 nt, Human
accuucucaccu

SEQ ID NO: 2207937 - RNA, 15 nt, Human
ccagaaugaccuggc

SEQ ID NO: 2207938 - RNA, 22 nt, Human
auagccagguaccuucucaccu

SEQ ID NO: 2207939 - RNA, 14 nt, Human
uuuuuguuuuguuu

SEQ ID NO: 2207940 - RNA, 15 nt, Human
ccaugaugcugagcc

SEQ ID NO: 2207941 - RNA, 19 nt, Human
ggugcugcagccccuggga

SEQ ID NO: 2207942 - RNA, 22 nt, Human
ccauagucauucugccugcccu

SEQ ID NO: 2207943 - RNA, 17 nt, Human
uggccgcagugaggcgg

SEQ ID NO: 2207944 - RNA, 19 nt, Human
cugagcccggaaacuccac

SEQ ID NO: 2207945 - RNA, 22 nt, Human
accucagcugccuccccagcuc

SEQ ID NO: 2207946 - RNA, 21 nt, Human
ccugagcggaccuucccagcu

SEQ ID NO: 2207947 - RNA, 23 nt, Human
gaacaugagccuuuguugcuauc

SEQ ID NO: 2207948 - RNA, 21 nt, Human
gaccaggcacccccagaauga

SEQ ID NO: 2207949 - RNA, 13 nt, Human
augacauuuuguu

SEQ ID NO: 2207950 - RNA, 14 nt, Human
ucugggcagacucu

SEQ ID NO: 2207951 - RNA, 19 nt, Human
uggauacuccauggggugg

SEQ ID NO: 2207952 - RNA, 22 nt, Human
ugccugagcggaccuucccagc

SEQ ID NO: 2207953 - RNA, 17 nt, Human
uccaaaggcuccugaga

SEQ ID NO: 2207954 - RNA, 17 nt, Human
ucccagaucaagccugc

SEQ ID NO: 2207955 - RNA, 21 nt, Human
acaggauggcaggaggcaucc

SEQ ID NO: 2207956 - RNA, 17 nt, Human
ugagcggaccuucccag

SEQ ID NO: 2207957 - RNA, 17 nt, Human
cucuggucaagaagcau

SEQ ID NO: 2207958 - RNA, 18 nt, Human
agucauucugccugcccu

SEQ ID NO: 2207959 - RNA, 22 nt, Human
uugagaaggagcucccaggagg

SEQ ID NO: 2207960 - RNA, 19 nt, Human
ccuucccagcuagaauuca

SEQ ID NO: 2207961 - RNA, 23 nt, Human
ccagguaccuucucaccugugag

SEQ ID NO: 2207962 - RNA, 13 nt, Human
cagcugccucccc

SEQ ID NO: 2207963 - RNA, 15 nt, Human
ccucuucugacacua

SEQ ID NO: 2207964 - RNA, 23 nt, Human
aggcacccccagaaugaccuggc

SEQ ID NO: 2207965 - RNA, 24 nt, Human
ccagguaccuucucaccugugaga

SEQ ID NO: 2207966 - RNA, 22 nt, Human
cuuuuccaaugacauuuuguug

SEQ ID NO: 2207967 - RNA, 17 nt, Human
uucugacacuaaaacac

SEQ ID NO: 2207968 - RNA, 13 nt, Human
gccuccccagcuc

SEQ ID NO: 2207969 - RNA, 17 nt, Human
ucuggcguuguggggau

SEQ ID NO: 2207970 - RNA, 14 nt, Human
agcggaccuuccca

SEQ ID NO: 2207971 - RNA, 20 nt, Human
cucuucugacacuaaaacac

SEQ ID NO: 2207972 - RNA, 19 nt, Human
uugagaaggagcucccagg

SEQ ID NO: 2207973 - RNA, 22 nt, Human
ccacuuggacaugggccccaga

SEQ ID NO: 2207974 - RNA, 19 nt, Human
ccugagcggaccuucccag

SEQ ID NO: 2207975 - RNA, 19 nt, Human
cuuggacaugggccccaga

SEQ ID NO: 2207976 - RNA, 20 nt, Human
acuccacuuggacaugggcc

SEQ ID NO: 2207977 - RNA, 22 nt, Human
ggccauagucauucugccugcc

SEQ ID NO: 2207978 - RNA, 23 nt, Human
ccugggaccaggcacccccagaa

SEQ ID NO: 2207979 - RNA, 13 nt, Human
cccagauaccaug

SEQ ID NO: 2207980 - RNA, 12 nt, Human
agaucaagccug

SEQ ID NO: 2207981 - RNA, 17 nt, Human
ccucagcugccucccca

SEQ ID NO: 2207982 - RNA, 19 nt, Human
uuguggggaugaacuuuuu

SEQ ID NO: 2207983 - RNA, 18 nt, Human
caaucaguauucauauuu

SEQ ID NO: 2207984 - RNA, 23 nt, Human
agcuaggggggucagccagcccu

SEQ ID NO: 2207985 - RNA, 23 nt, Human
aacuuuuccaaugacauuuuguu

SEQ ID NO: 2207986 - RNA, 16 nt, Human
agggagggaaggggga

SEQ ID NO: 2207987 - RNA, 20 nt, Human
cacccccagaaugaccuggc

SEQ ID NO: 2207988 - RNA, 21 nt, Human
cuuuuccaaugacauuuuguu

SEQ ID NO: 2207989 - RNA, 23 nt, Human
cagaccgggguucccgugugccu

SEQ ID NO: 2207990 - RNA, 22 nt, Human
agaccaaauugagcuagggggg

SEQ ID NO: 2207991 - RNA, 20 nt, Human
acuaaaacaccucagcugcc

SEQ ID NO: 2207992 - RNA, 21 nt, Human
gagcuaggggggucagccagc

SEQ ID NO: 2207993 - RNA, 16 nt, Human
gauggcaggaggcauc

SEQ ID NO: 2207994 - RNA, 14 nt, Human
cauccugugggacc

SEQ ID NO: 2207995 - RNA, 17 nt, Human
ugcccugaaagucccag

SEQ ID NO: 2207996 - RNA, 13 nt, Human
aggagcucccagg

SEQ ID NO: 2207997 - RNA, 17 nt, Human
caggaggggcuucuggg

SEQ ID NO: 2207998 - RNA, 14 nt, Human
gacaugggccccag

SEQ ID NO: 2207999 - RNA, 14 nt, Human
aacaccucagcugc

SEQ ID NO: 2208000 - RNA, 17 nt, Human
aaacaccucagcugccu

SEQ ID NO: 2208001 - RNA, 22 nt, Human
ugggccccagauaccaugaugc

SEQ ID NO: 2208002 - RNA, 23 nt, Human
aucgugucuggcguuguggggau

SEQ ID NO: 2208003 - RNA, 20 nt, Human
ccuucucaccugugagacca

SEQ ID NO: 2208004 - RNA, 18 nt, Human
auagggagggaaggggga

SEQ ID NO: 2208005 - RNA, 15 nt, Human
gggucagccagcccu

SEQ ID NO: 2208006 - RNA, 14 nt, Human
cacuuggacauggg

SEQ ID NO: 2208007 - RNA, 13 nt, Human
cggauugagaagg

SEQ ID NO: 2208008 - RNA, 17 nt, Human
cugagcggaccuuccca

SEQ ID NO: 2208009 - RNA, 12 nt, Human
aaacuccacauc

SEQ ID NO: 2208010 - RNA, 14 nt, Human
caggaggcauccaa

SEQ ID NO: 2208011 - RNA, 12 nt, Human
gaugcugagccc

SEQ ID NO: 2208012 - RNA, 21 nt, Human
cuauaaaacuaggugcugcag

SEQ ID NO: 2208013 - RNA, 21 nt, Human
gaggugagguaccagccuugg

SEQ ID NO: 2208014 - RNA, 22 nt, Human
ccaaaggcuccugagacacaug

SEQ ID NO: 2208015 - RNA, 13 nt, Human
cugagacacaugg

SEQ ID NO: 2208016 - RNA, 12 nt, Human
aacuuauuugua

SEQ ID NO: 2208017 - RNA, 13 nt, Human
agggggaacauga

SEQ ID NO: 2208018 - RNA, 22 nt, Human
gugucuggcguuguggggauga

SEQ ID NO: 2208019 - RNA, 13 nt, Human
caagccugccuca

SEQ ID NO: 2208020 - RNA, 19 nt, Human
ccucagcugccuccccagc

SEQ ID NO: 2208021 - RNA, 21 nt, Human
gugccugagcggaccuuccca

SEQ ID NO: 2208022 - RNA, 21 nt, Human
cccugggaccaggcaccccca

SEQ ID NO: 2208023 - RNA, 20 nt, Human
ucgugucuggcguugugggg

SEQ ID NO: 2208024 - RNA, 18 nt, Human
uccugugggaccugggcc

SEQ ID NO: 2208025 - RNA, 18 nt, Human
cccagaaugaccuggccg

SEQ ID NO: 2208026 - RNA, 12 nt, Human
gagcucccagga

SEQ ID NO: 2208027 - RNA, 14 nt, Human
ccccagaaugaccu

SEQ ID NO: 2208028 - RNA, 19 nt, Human
cauccaaaggcuccugaga

SEQ ID NO: 2208029 - RNA, 17 nt, Human
gccccagauaccaugau

SEQ ID NO: 2208030 - RNA, 23 nt, Human
agucccagaucaagccugccuca

SEQ ID NO: 2208031 - RNA, 20 nt, Human
caauaaaacuuuuccaauga

SEQ ID NO: 2208032 - RNA, 17 nt, Human
agccagguaccuucuca

SEQ ID NO: 2208033 - RNA, 23 nt, Human
agggaagggggaacaugagccuu

SEQ ID NO: 2208034 - RNA, 18 nt, Human
cccucuucugacacuaaa

SEQ ID NO: 2208035 - RNA, 22 nt, Human
cugccuccccagcucuauccca

SEQ ID NO: 2208036 - RNA, 18 nt, Human
cugcagccccugggacca

SEQ ID NO: 2208037 - RNA, 19 nt, Human
ugcccugaaagucccagau

SEQ ID NO: 2208038 - RNA, 14 nt, Human
cuucugacacuaaa

SEQ ID NO: 2208039 - RNA, 15 nt, Human
uccaaugacauuuug

SEQ ID NO: 2208040 - RNA, 16 nt, Human
ucauucugccugcccu

SEQ ID NO: 2208041 - RNA, 19 nt, Human
ugggccauagucauucugc

SEQ ID NO: 2208042 - RNA, 14 nt, Human
agcccucuucugac

SEQ ID NO: 2208043 - RNA, 20 nt, Human
gccugagcggaccuucccag

SEQ ID NO: 2208044 - RNA, 15 nt, Human
ccccagaaugaccug

SEQ ID NO: 2208045 - RNA, 12 nt, Human
ucagcugccucc

SEQ ID NO: 2208046 - RNA, 23 nt, Human
gcagacucuggucaagaagcauc

SEQ ID NO: 2208047 - RNA, 15 nt, Human
cagccccugggacca

SEQ ID NO: 2208048 - RNA, 15 nt, Human
uucccgugugccuga

SEQ ID NO: 2208049 - RNA, 14 nt, Human
gggaccugggccau

SEQ ID NO: 2208050 - RNA, 21 nt, Human
aggauggcaggaggcauccaa

SEQ ID NO: 2208051 - RNA, 22 nt, Human
gcucuaucccaaccucucccaa

SEQ ID NO: 2208052 - RNA, 14 nt, Human
gucauucugccugc

SEQ ID NO: 2208053 - RNA, 16 nt, Human
cuccacauccuguggg

SEQ ID NO: 2208054 - RNA, 21 nt, Human
ggucaagaagcaucgugucug

SEQ ID NO: 2208055 - RNA, 13 nt, Human
agguaccagccuu

SEQ ID NO: 2208056 - RNA, 14 nt, Human
accugggccauagu

SEQ ID NO: 2208057 - RNA, 14 nt, Human
cugaaagucccaga

SEQ ID NO: 2208058 - RNA, 17 nt, Human
uuauuuguacauuuuuu

SEQ ID NO: 2208059 - RNA, 16 nt, Human
gucccagaucaagccu

SEQ ID NO: 2208060 - RNA, 13 nt, Human
caugggccccaga

SEQ ID NO: 2208061 - RNA, 17 nt, Human
ccaugaugcugagcccg

SEQ ID NO: 2208062 - RNA, 15 nt, Human
acuuuuccaaugaca

SEQ ID NO: 2208063 - RNA, 17 nt, Human
aaaacaccucagcugcc

SEQ ID NO: 2208064 - RNA, 21 nt, Human
cugagcccggaaacuccacau

SEQ ID NO: 2208065 - RNA, 17 nt, Human
agcucccaggaggggcu

SEQ ID NO: 2208066 - RNA, 16 nt, Human
ggggcuucugggcaga

SEQ ID NO: 2208067 - RNA, 17 nt, Human
agggaagggggaacaug

SEQ ID NO: 2208068 - RNA, 15 nt, Human
aggagcucccaggag

SEQ ID NO: 2208069 - RNA, 20 nt, Human
caccucagcugccuccccag

SEQ ID NO: 2208070 - RNA, 21 nt, Human
ucagccagcccucuucugaca

SEQ ID NO: 2208071 - RNA, 14 nt, Human
cucagcugccuccc

SEQ ID NO: 2208072 - RNA, 14 nt, Human
ucugccugcccuga

SEQ ID NO: 2208073 - RNA, 16 nt, Human
caggaggcauccaaag

SEQ ID NO: 2208074 - RNA, 13 nt, Human
ccagaucaagccu

SEQ ID NO: 2208075 - RNA, 13 nt, Human
gggggaggugagg

SEQ ID NO: 2208076 - RNA, 21 nt, Human
ggguucccgugugccugagcg

SEQ ID NO: 2208077 - RNA, 18 nt, Human
cagguaccuucucaccug

SEQ ID NO: 2208078 - RNA, 18 nt, Human
agcuagaauucacuccac

SEQ ID NO: 2208079 - RNA, 20 nt, Human
cuaggggggucagccagccc

SEQ ID NO: 2208080 - RNA, 11 nt, Human
ccgugugccug

SEQ ID NO: 2208081 - RNA, 17 nt, Human
accucagcugccucccc

SEQ ID NO: 2208082 - RNA, 21 nt, Human
caccucagcugccuccccagc

SEQ ID NO: 2208083 - RNA, 16 nt, Human
uucucaccugugagac

SEQ ID NO: 2208084 - RNA, 14 nt, Human
ccucagcugccucc

SEQ ID NO: 2208085 - RNA, 21 nt, Human
ccaggaggggcuucugggcag

SEQ ID NO: 2208086 - RNA, 23 nt, Human
gagguaccagccuuggauacucc

SEQ ID NO: 2208087 - RNA, 14 nt, Human
caggaggggcuucu

SEQ ID NO: 2208088 - RNA, 20 nt, Human
auagucauucugccugcccu

SEQ ID NO: 2208089 - RNA, 16 nt, Human
ucuucugacacuaaaa

SEQ ID NO: 2208090 - RNA, 21 nt, Human
cucccaggaggggcuucuggg

SEQ ID NO: 2208091 - RNA, 23 nt, Human
gccugagcggaccuucccagcua

SEQ ID NO: 2208092 - RNA, 20 nt, Human
gcacccccagaaugaccugg

SEQ ID NO: 2208093 - RNA, 20 nt, Human
accaggcacccccagaauga

SEQ ID NO: 2208094 - RNA, 23 nt, Human
uagucauucugccugcccugaaa

SEQ ID NO: 2208095 - RNA, 14 nt, Human
caacuauaaaacua

SEQ ID NO: 2208096 - RNA, 16 nt, Human
gggucagccagcccuc

SEQ ID NO: 2208097 - RNA, 14 nt, Streptococcus pyogenes M1 GAS
uuuucuuuucuuca

SEQ ID NO: 2208098 - RNA, 12 nt, Streptococcus pyogenes M1 GAS
uuuucucaaaaa

SEQ ID NO: 2208099 - RNA, 19 nt, Streptococcus pyogenes M1 GAS
uuuuaugauuugucaaaaa

SEQ ID NO: 2208100 - RNA, 20 nt, Streptococcus pyogenes M1 GAS
uuuuauacgguaaaaacuca

SEQ ID NO: 2208101 - RNA, 21 nt, Streptococcus pyogenes M1 GAS
uuugguuucgccuaggaauaa

SEQ ID NO: 2208102 - RNA, 23 nt, Streptococcus pyogenes M1 GAS
uuugccguguucuagcuuuguca

SEQ ID NO: 2208103 - RNA, 20 nt, Streptococcus pyogenes M1 GAS
uuugcacugcuauuucagcu

SEQ ID NO: 2208104 - RNA, 21 nt, Streptococcus pyogenes M1 GAS
uuugcaaauaguagcaaauaa

SEQ ID NO: 2208105 - RNA, 13 nt, Streptococcus pyogenes M1 GAS
uuuaaagacauca

SEQ ID NO: 2208106 - RNA, 22 nt, Streptococcus pyogenes M1 GAS
uugugacaugaguauaaauuug

SEQ ID NO: 2208107 - RNA, 13 nt, Streptococcus pyogenes M1 GAS
uugucguuuuuug

SEQ ID NO: 2208108 - RNA, 15 nt, Streptococcus pyogenes M1 GAS
uuguccauuuuuuau

SEQ ID NO: 2208109 - RNA, 19 nt, Streptococcus pyogenes M1 GAS
uuguccauuuuuuauaaug

SEQ ID NO: 2208110 - RNA, 13 nt, Streptococcus pyogenes M1 GAS
uuggugucagcau

SEQ ID NO: 2208111 - RNA, 16 nt, Streptococcus pyogenes M1 GAS
uuucauuauagacuau

SEQ ID NO: 2208112 - RNA, 15 nt, Streptococcus pyogenes M1 GAS
uugaccaauauagca

SEQ ID NO: 2208113 - RNA, 23 nt, Streptococcus pyogenes M1 GAS
uugauaugguggguaaaaccaac

SEQ ID NO: 2208114 - RNA, 21 nt, Streptococcus pyogenes M1 GAS
uugcaauaaucgaugauaaua

SEQ ID NO: 2208115 - RNA, 17 nt, Streptococcus pyogenes M1 GAS
uugcuuuuuaauuguug

SEQ ID NO: 2208116 - RNA, 12 nt, Streptococcus pyogenes M1 GAS
uugcuucuuuua

SEQ ID NO: 2208117 - RNA, 18 nt, Streptococcus pyogenes M1 GAS
uuggaacaccguuuuuug

SEQ ID NO: 2208118 - RNA, 17 nt, Streptococcus pyogenes M1 GAS
uuggccccuuuuuugac

SEQ ID NO: 2208119 - RNA, 13 nt, Streptococcus pyogenes M1 GAS
uuaugcugauuuu

SEQ ID NO: 2208120 - RNA, 15 nt, Streptococcus pyogenes M1 GAS
uuauggaguucuuga

SEQ ID NO: 2208121 - RNA, 23 nt, Streptococcus pyogenes M1 GAS
uuaagauaccaaaucaaaaagcu

SEQ ID NO: 2208122 - RNA, 16 nt, Streptococcus pyogenes M1 GAS
uuaucauauuccauau

SEQ ID NO: 2208123 - RNA, 12 nt, Streptococcus pyogenes M1 GAS
uuagguucuuug

SEQ ID NO: 2208124 - RNA, 19 nt, Streptococcus pyogenes M1 GAS
uguagaauuucaaguucuc

SEQ ID NO: 2208125 - RNA, 16 nt, Streptococcus pyogenes M1 GAS
ugguaaaguauuuuau

SEQ ID NO: 2208126 - RNA, 19 nt, Streptococcus pyogenes M1 GAS
uguucucauaaacaaugag

SEQ ID NO: 2208127 - RNA, 20 nt, Streptococcus pyogenes M1 GAS
uguggcuaguaaguuuuuuu

SEQ ID NO: 2208128 - RNA, 23 nt, Streptococcus pyogenes M1 GAS
uguguaauuucuugugcuaaucu

SEQ ID NO: 2208129 - RNA, 15 nt, Streptococcus pyogenes M1 GAS
ugugauuaguuuuua

SEQ ID NO: 2208130 - RNA, 22 nt, Streptococcus pyogenes M1 GAS
uggauccuuuaucuuauuuuaa

SEQ ID NO: 2208131 - RNA, 22 nt, Streptococcus pyogenes M1 GAS
uggaaggcacagaaaaaagaua

SEQ ID NO: 2208132 - RNA, 23 nt, Streptococcus pyogenes M1 GAS
uaaacuuaugauuauccucuuau

SEQ ID NO: 2208133 - RNA, 23 nt, Streptococcus pyogenes M1 GAS
uaaagucacgaguguuaaaacga

SEQ ID NO: 2208134 - RNA, 21 nt, Streptococcus pyogenes M1 GAS
uaaaauagcaccuacgauaaa

SEQ ID NO: 2208135 - RNA, 16 nt, Streptococcus pyogenes M1 GAS
uaaacauauuauagua

SEQ ID NO: 2208136 - RNA, 20 nt, Streptococcus pyogenes M1 GAS
guuucacgauaagaagcuaa

SEQ ID NO: 2208137 - RNA, 15 nt, Streptococcus pyogenes M1 GAS
uaaccauugccauua

SEQ ID NO: 2208138 - RNA, 15 nt, Streptococcus pyogenes M1 GAS
uaagucaguuuuuuc

SEQ ID NO: 2208139 - RNA, 19 nt, Streptococcus pyogenes M1 GAS
uaauuauuuuaauuuuucc

SEQ ID NO: 2208140 - RNA, 22 nt, Streptococcus pyogenes M1 GAS
uaauuuggaggugaaaauaucu

SEQ ID NO: 2208141 - RNA, 12 nt, Streptococcus pyogenes M1 GAS
uagaaaaagcaa

SEQ ID NO: 2208142 - RNA, 17 nt, Streptococcus pyogenes M1 GAS
uacuagaaaaagcaaug

SEQ ID NO: 2208143 - RNA, 21 nt, Streptococcus pyogenes M1 GAS
uacuauggcuucuaaaaaagu

SEQ ID NO: 2208144 - RNA, 15 nt, Streptococcus pyogenes M1 GAS
uacaucaaaaaaagc

SEQ ID NO: 2208145 - RNA, 12 nt, Streptococcus pyogenes M1 GAS
uacaucaacuau

SEQ ID NO: 2208146 - RNA, 20 nt, Streptococcus pyogenes M1 GAS
uaccauuucuuugcaaaaga

SEQ ID NO: 2208147 - RNA, 12 nt, Streptococcus pyogenes M1 GAS
guuauuuuugag

SEQ ID NO: 2208148 - RNA, 18 nt, Streptococcus pyogenes M1 GAS
guguacucaucuaaaaaa

SEQ ID NO: 2208149 - RNA, 20 nt, Streptococcus pyogenes M1 GAS
guucuuuauuuugauauuuu

SEQ ID NO: 2208150 - RNA, 16 nt, Streptococcus pyogenes M1 GAS
uccaucacuuccauau

SEQ ID NO: 2208151 - RNA, 15 nt, Streptococcus pyogenes M1 GAS
ucaucuugccaucag

SEQ ID NO: 2208152 - RNA, 13 nt, Streptococcus pyogenes M1 GAS
ucaguaaucuaaa

SEQ ID NO: 2208153 - RNA, 14 nt, Streptococcus pyogenes M1 GAS
ucaauuuuugauuu

SEQ ID NO: 2208154 - RNA, 20 nt, Streptococcus pyogenes M1 GAS
ucaauuauuucgucuaaaaa

SEQ ID NO: 2208155 - RNA, 16 nt, Streptococcus pyogenes M1 GAS
ucagacuuaauugaaa

SEQ ID NO: 2208156 - RNA, 21 nt, Streptococcus pyogenes M1 GAS
ucagauaagaccuucaaaaaa

SEQ ID NO: 2208157 - RNA, 13 nt, Streptococcus pyogenes M1 GAS
ucagaauaagaaa

SEQ ID NO: 2208158 - RNA, 19 nt, Streptococcus pyogenes M1 GAS
ucaagagucauuugacuac

SEQ ID NO: 2208159 - RNA, 21 nt, Streptococcus pyogenes M1 GAS
uauuuccuuuuaaagacauca

SEQ ID NO: 2208160 - RNA, 18 nt, Streptococcus pyogenes M1 GAS
ucaaaaaauuaagaagga

SEQ ID NO: 2208161 - RNA, 21 nt, Streptococcus pyogenes M1 GAS
uauuuuuucucaaaaauauau

SEQ ID NO: 2208162 - RNA, 23 nt, Streptococcus pyogenes M1 GAS
uauuuuuucucaaaaauauauuc

SEQ ID NO: 2208163 - RNA, 14 nt, Streptococcus pyogenes M1 GAS
ucaaaagcuaaacu

SEQ ID NO: 2208164 - RNA, 20 nt, Streptococcus pyogenes M1 GAS
ucaaaagaccauaaaaaacc

SEQ ID NO: 2208165 - RNA, 23 nt, Streptococcus pyogenes M1 GAS
ucaaaaucaccguaacuugcuuu

SEQ ID NO: 2208166 - RNA, 16 nt, Streptococcus pyogenes M1 GAS
uaugcuaacugauaaa

SEQ ID NO: 2208167 - RNA, 19 nt, Streptococcus pyogenes M1 GAS
uaucuuucaguuguuuuaa

SEQ ID NO: 2208168 - RNA, 21 nt, Streptococcus pyogenes M1 GAS
ugaagugucuugauaucauaa

SEQ ID NO: 2208169 - RNA, 15 nt, Streptococcus pyogenes M1 GAS
ugacaguuaaaaaua

SEQ ID NO: 2208170 - RNA, 13 nt, Streptococcus pyogenes M1 GAS
ugacuucaaaaau

SEQ ID NO: 2208171 - RNA, 23 nt, Streptococcus pyogenes M1 GAS
ugacuucaaaaauacuaccuuua

SEQ ID NO: 2208172 - RNA, 22 nt, Streptococcus pyogenes M1 GAS
ugagguaaucguaaugucuugu

SEQ ID NO: 2208173 - RNA, 16 nt, Streptococcus pyogenes M1 GAS
ugauuuguuuucuuua

SEQ ID NO: 2208174 - RNA, 13 nt, Streptococcus pyogenes M1 GAS
ugauuauucuuua

SEQ ID NO: 2208175 - RNA, 12 nt, Streptococcus pyogenes M1 GAS
ugauaaaaaaca

SEQ ID NO: 2208176 - RNA, 23 nt, Streptococcus pyogenes M1 GAS
ugauaaaggccuguauuucuuua

SEQ ID NO: 2208177 - RNA, 15 nt, Streptococcus pyogenes M1 GAS
ugaucuuacaaagga

SEQ ID NO: 2208178 - RNA, 20 nt, Streptococcus pyogenes M1 GAS
ugccauuuccuacaaaauaa

SEQ ID NO: 2208179 - RNA, 21 nt, Streptococcus pyogenes M1 GAS
ucgauaaaaacgaucaaaaau

SEQ ID NO: 2208180 - RNA, 21 nt, Streptococcus pyogenes M1 GAS
gcuaagaauaacuaacagcaa

SEQ ID NO: 2208181 - RNA, 23 nt, Streptococcus pyogenes M1 GAS
ggaaaucaauccuguaacuguag

SEQ ID NO: 2208182 - RNA, 16 nt, Streptococcus pyogenes M1 GAS
gcuuuaggaauaucau

SEQ ID NO: 2208183 - RNA, 14 nt, Streptococcus pyogenes M1 GAS
gcuuuuaagcugag

SEQ ID NO: 2208184 - RNA, 14 nt, Streptococcus pyogenes M1 GAS
gcucuaaaauauau

SEQ ID NO: 2208185 - RNA, 17 nt, Streptococcus pyogenes M1 GAS
guccuaaccuuuuggcu

SEQ ID NO: 2208186 - RNA, 18 nt, Streptococcus pyogenes M1 GAS
gugagaaacuaaaggcaa

SEQ ID NO: 2208187 - RNA, 13 nt, Streptococcus pyogenes M1 GAS
gucuucuuuuuau

SEQ ID NO: 2208188 - RNA, 15 nt, Streptococcus pyogenes M1 GAS
guaacguaauagaau

SEQ ID NO: 2208189 - RNA, 12 nt, Streptococcus pyogenes M1 GAS
guacaagagcuu

SEQ ID NO: 2208190 - RNA, 20 nt, Streptococcus pyogenes M1 GAS
guacaguauguaaauauaaa

SEQ ID NO: 2208191 - RNA, 15 nt, Streptococcus pyogenes M1 GAS
guaccaauuuaaggu

SEQ ID NO: 2208192 - RNA, 18 nt, Streptococcus pyogenes M1 GAS
ggauguuuauuccaaaca

SEQ ID NO: 2208193 - RNA, 16 nt, Streptococcus pyogenes M1 GAS
ggcuuuuuugcuuuuu

SEQ ID NO: 2208194 - RNA, 15 nt, Streptococcus pyogenes M1 GAS
ggcuaguaaguuuuu

SEQ ID NO: 2208195 - RNA, 20 nt, Streptococcus pyogenes M1 GAS
cugauaaaacucaaaaagca

SEQ ID NO: 2208196 - RNA, 22 nt, Streptococcus pyogenes M1 GAS
cugagcaaaacaauaacacaga

SEQ ID NO: 2208197 - RNA, 13 nt, Streptococcus pyogenes M1 GAS
cucgacaaaggcu

SEQ ID NO: 2208198 - RNA, 23 nt, Streptococcus pyogenes M1 GAS
cucauaaaauuccccacaaaaga

SEQ ID NO: 2208199 - RNA, 16 nt, Streptococcus pyogenes M1 GAS
cucauaacaaauuuau

SEQ ID NO: 2208200 - RNA, 20 nt, Streptococcus pyogenes M1 GAS
cucaaaccaaacaagcgggu

SEQ ID NO: 2208201 - RNA, 20 nt, Streptococcus pyogenes M1 GAS
cuauucaauauuuuauuaau

SEQ ID NO: 2208202 - RNA, 18 nt, Streptococcus pyogenes M1 GAS
cuaauuagcauauuuuga

SEQ ID NO: 2208203 - RNA, 21 nt, Streptococcus pyogenes M1 GAS
cuaaaugacaguauacaucaa

SEQ ID NO: 2208204 - RNA, 14 nt, Streptococcus pyogenes M1 GAS
cuaacaauuuuuca

SEQ ID NO: 2208205 - RNA, 22 nt, Streptococcus pyogenes M1 GAS
cuaacauggauaccauuucuuu

SEQ ID NO: 2208206 - RNA, 14 nt, Streptococcus pyogenes M1 GAS
cuaaacguuuuugg

SEQ ID NO: 2208207 - RNA, 20 nt, Streptococcus pyogenes M1 GAS
cguaaaaagaucuuucuuuu

SEQ ID NO: 2208208 - RNA, 13 nt, Streptococcus pyogenes M1 GAS
cuguauacaaaaa

SEQ ID NO: 2208209 - RNA, 23 nt, Streptococcus pyogenes M1 GAS
cugugaccaacucuauccauuau

SEQ ID NO: 2208210 - RNA, 16 nt, Streptococcus pyogenes M1 GAS
cuuaaucuaaaagcac

SEQ ID NO: 2208211 - RNA, 20 nt, Streptococcus pyogenes M1 GAS
cuuaacgaucuauugacuug

SEQ ID NO: 2208212 - RNA, 16 nt, Streptococcus pyogenes M1 GAS
cuucuagcucuuuauc

SEQ ID NO: 2208213 - RNA, 13 nt, Streptococcus pyogenes M1 GAS
gaaaagcuaagua

SEQ ID NO: 2208214 - RNA, 18 nt, Streptococcus pyogenes M1 GAS
cuuucauuagcuuuuuuu

SEQ ID NO: 2208215 - RNA, 17 nt, Streptococcus pyogenes M1 GAS
cuugaggugauucuuuu

SEQ ID NO: 2208216 - RNA, 23 nt, Streptococcus pyogenes M1 GAS
cuugauaugguggguaaaaccaa

SEQ ID NO: 2208217 - RNA, 15 nt, Streptococcus pyogenes M1 GAS
cugcuugaaaagaug

SEQ ID NO: 2208218 - RNA, 19 nt, Streptococcus pyogenes M1 GAS
cugcugcuccuaucauagg

SEQ ID NO: 2208219 - RNA, 21 nt, Streptococcus pyogenes M1 GAS
cugcugucccagcagcaaagg

SEQ ID NO: 2208220 - RNA, 15 nt, Streptococcus pyogenes M1 GAS
gaauugcagcuaaaa

SEQ ID NO: 2208221 - RNA, 22 nt, Streptococcus pyogenes M1 GAS
gacaaauccaaugacuaaggua

SEQ ID NO: 2208222 - RNA, 21 nt, Streptococcus pyogenes M1 GAS
gaauugcuggugacuaucauu

SEQ ID NO: 2208223 - RNA, 22 nt, Streptococcus pyogenes M1 GAS
gcaauggcuaaaaagagagcuu

SEQ ID NO: 2208224 - RNA, 15 nt, Streptococcus pyogenes M1 GAS
gauuugucaaaaagu

SEQ ID NO: 2208225 - RNA, 14 nt, Streptococcus pyogenes M1 GAS
gauuacauuaggau

SEQ ID NO: 2208226 - RNA, 23 nt, Streptococcus pyogenes M1 GAS
gagcgcacuuuauuauaccaaau

SEQ ID NO: 2208227 - RNA, 21 nt, Streptococcus pyogenes M1 GAS
gagcuuuaguugcuucuuuua

SEQ ID NO: 2208228 - RNA, 14 nt, Streptococcus pyogenes M1 GAS
gaggcuuuuuugag

SEQ ID NO: 2208229 - RNA, 21 nt, Streptococcus pyogenes M1 GAS
gauaucccaucuuuguuuuuu

SEQ ID NO: 2208230 - RNA, 21 nt, Streptococcus pyogenes M1 GAS
gauaagauacugcccuugaug

SEQ ID NO: 2208231 - RNA, 15 nt, Streptococcus pyogenes M1 GAS
gauaagugccaucag

SEQ ID NO: 2208232 - RNA, 19 nt, Streptococcus pyogenes M1 GAS
gccaauuguucauuaaagc

SEQ ID NO: 2208233 - RNA, 18 nt, Streptococcus pyogenes M1 GAS
gccgaagcggaaaaggaa

SEQ ID NO: 2208234 - RNA, 14 nt, Streptococcus pyogenes M1 GAS
ccucugaaaaguug

SEQ ID NO: 2208235 - RNA, 23 nt, Streptococcus pyogenes M1 GAS
cagaugcuugcucaauuuuugau

SEQ ID NO: 2208236 - RNA, 15 nt, Streptococcus pyogenes M1 GAS
cagcaccuucuuuua

SEQ ID NO: 2208237 - RNA, 21 nt, Streptococcus pyogenes M1 GAS
cagcuuacagcugguuuuuua

SEQ ID NO: 2208238 - RNA, 21 nt, Streptococcus pyogenes M1 GAS
cauaugauggaucguuuugca

SEQ ID NO: 2208239 - RNA, 15 nt, Streptococcus pyogenes M1 GAS
cauuuuauuugaaga

SEQ ID NO: 2208240 - RNA, 14 nt, Streptococcus pyogenes M1 GAS
cauugucaaauaaa

SEQ ID NO: 2208241 - RNA, 22 nt, Streptococcus pyogenes M1 GAS
cauugcuuuuuaugauuuguca

SEQ ID NO: 2208242 - RNA, 22 nt, Streptococcus pyogenes M1 GAS
ccaauaaugccaucaaaaaaag

SEQ ID NO: 2208243 - RNA, 13 nt, Streptococcus pyogenes M1 GAS
ccaauaaaaaaga

SEQ ID NO: 2208244 - RNA, 17 nt, Streptococcus pyogenes M1 GAS
ccauuuccuacaaaaua

SEQ ID NO: 2208245 - RNA, 16 nt, Streptococcus pyogenes M1 GAS
augauuuaguuuuuaa

SEQ ID NO: 2208246 - RNA, 17 nt, Streptococcus pyogenes M1 GAS
augauuugucaaaaagu

SEQ ID NO: 2208247 - RNA, 12 nt, Streptococcus pyogenes M1 GAS
augccucuuguc

SEQ ID NO: 2208248 - RNA, 20 nt, Streptococcus pyogenes M1 GAS
auuaauagcgccagcaauuu

SEQ ID NO: 2208249 - RNA, 14 nt, Streptococcus pyogenes M1 GAS
auuaauaaauuuuu

SEQ ID NO: 2208250 - RNA, 14 nt, Streptococcus pyogenes M1 GAS
auuaagguuuuuuu

SEQ ID NO: 2208251 - RNA, 20 nt, Streptococcus pyogenes M1 GAS
auuacaagcauuuugcaagu

SEQ ID NO: 2208252 - RNA, 15 nt, Streptococcus pyogenes M1 GAS
auuauuuuaauuuuu

SEQ ID NO: 2208253 - RNA, 14 nt, Streptococcus pyogenes M1 GAS
auucauuuucuucu

SEQ ID NO: 2208254 - RNA, 20 nt, Streptococcus pyogenes M1 GAS
auggcuaaaaagagagcuua

SEQ ID NO: 2208255 - RNA, 23 nt, Streptococcus pyogenes M1 GAS
aucguuauuaauuguuuuaguaa

SEQ ID NO: 2208256 - RNA, 19 nt, Streptococcus pyogenes M1 GAS
aucucuauaucuaugauuu

SEQ ID NO: 2208257 - RNA, 23 nt, Streptococcus pyogenes M1 GAS
aucgcuuugaauacguaaaaaga

SEQ ID NO: 2208258 - RNA, 20 nt, Streptococcus pyogenes M1 GAS
aucaggaggguuuuucuuuu

SEQ ID NO: 2208259 - RNA, 22 nt, Streptococcus pyogenes M1 GAS
aucauaacuugucaagccauag

SEQ ID NO: 2208260 - RNA, 15 nt, Streptococcus pyogenes M1 GAS
auuuauaauuucuuu

SEQ ID NO: 2208261 - RNA, 24 nt, Streptococcus pyogenes M1 GAS
auuuagccuauuaucugauaaggu

SEQ ID NO: 2208262 - RNA, 16 nt, Streptococcus pyogenes M1 GAS
auuuacuaauccuuuu

SEQ ID NO: 2208263 - RNA, 12 nt, Streptococcus pyogenes M1 GAS
auuuccuaaugu

SEQ ID NO: 2208264 - RNA, 13 nt, Streptococcus pyogenes M1 GAS
auuuugguugaua

SEQ ID NO: 2208265 - RNA, 16 nt, Streptococcus pyogenes M1 GAS
caaaaagagaccgaag

SEQ ID NO: 2208266 - RNA, 15 nt, Streptococcus pyogenes M1 GAS
caaaaaucuuuuucu

SEQ ID NO: 2208267 - RNA, 12 nt, Streptococcus pyogenes M1 GAS
caaaaaaagcaa

SEQ ID NO: 2208268 - RNA, 21 nt, Streptococcus pyogenes M1 GAS
caagauaccggguuguuuuuu

SEQ ID NO: 2208269 - RNA, 16 nt, Streptococcus pyogenes M1 GAS
caagaacuccuggauu

SEQ ID NO: 2208270 - RNA, 19 nt, Streptococcus pyogenes M1 GAS
caaggugcuuuuuuugucg

SEQ ID NO: 2208271 - RNA, 18 nt, Streptococcus pyogenes M1 GAS
caauuuuugccaaaaucu

SEQ ID NO: 2208272 - RNA, 18 nt, Streptococcus pyogenes M1 GAS
cacaaacugcccuugaaa

SEQ ID NO: 2208273 - RNA, 13 nt, Streptococcus pyogenes M1 GAS
cacagaaaaaaga

SEQ ID NO: 2208274 - RNA, 22 nt, Streptococcus pyogenes M1 GAS
agcugucgcguuucgaaaaagg

SEQ ID NO: 2208275 - RNA, 19 nt, Streptococcus pyogenes M1 GAS
aggcuucaucaaugauagc

SEQ ID NO: 2208276 - RNA, 19 nt, Streptococcus pyogenes M1 GAS
auaggcagagaugauaggu

SEQ ID NO: 2208277 - RNA, 17 nt, Streptococcus pyogenes M1 GAS
auagcuuucaauugauu

SEQ ID NO: 2208278 - RNA, 16 nt, Streptococcus pyogenes M1 GAS
auaggaaaaagccaga

SEQ ID NO: 2208279 - RNA, 16 nt, Streptococcus pyogenes M1 GAS
auaacuguuuuucuua

SEQ ID NO: 2208280 - RNA, 20 nt, Streptococcus pyogenes M1 GAS
auacauuguuuuucuuuguc

SEQ ID NO: 2208281 - RNA, 22 nt, Streptococcus pyogenes M1 GAS
auaauaucagcuacacuugauu

SEQ ID NO: 2208282 - RNA, 14 nt, Streptococcus pyogenes M1 GAS
auacaacugacuag

SEQ ID NO: 2208283 - RNA, 14 nt, Streptococcus pyogenes M1 GAS
aguugcuucuuuua

SEQ ID NO: 2208284 - RNA, 19 nt, Streptococcus pyogenes M1 GAS
aguuauaaagaaacaaaaa

SEQ ID NO: 2208285 - RNA, 13 nt, Streptococcus pyogenes M1 GAS
agaauaacuaaca

SEQ ID NO: 2208286 - RNA, 17 nt, Streptococcus pyogenes M1 GAS
agaauaaagaaaaaguc

SEQ ID NO: 2208287 - RNA, 23 nt, Streptococcus pyogenes M1 GAS
agaaucaaagggauuacgauuaa

SEQ ID NO: 2208288 - RNA, 16 nt, Streptococcus pyogenes M1 GAS
agaauuauacuaacua

SEQ ID NO: 2208289 - RNA, 14 nt, Streptococcus pyogenes M1 GAS
agacaauuauuuug

SEQ ID NO: 2208290 - RNA, 16 nt, Streptococcus pyogenes M1 GAS
agaauuuuuauaacaa

SEQ ID NO: 2208291 - RNA, 19 nt, Streptococcus pyogenes M1 GAS
agauaccaaaucaaaaagc

SEQ ID NO: 2208292 - RNA, 20 nt, Streptococcus pyogenes M1 GAS
agauaccaaaucaaaaagcu

SEQ ID NO: 2208293 - RNA, 13 nt, Streptococcus pyogenes M1 GAS
agacggcuaauaa

SEQ ID NO: 2208294 - RNA, 15 nt, Streptococcus pyogenes M1 GAS
agacuuaaggauuua

SEQ ID NO: 2208295 - RNA, 20 nt, Streptococcus pyogenes M1 GAS
agaccucucaugggcaaaua

SEQ ID NO: 2208296 - RNA, 15 nt, Streptococcus pyogenes M1 GAS
agcauuaaggauuau

SEQ ID NO: 2208297 - RNA, 15 nt, Streptococcus pyogenes M1 GAS
agcaucguuaagugg

SEQ ID NO: 2208298 - RNA, 21 nt, Streptococcus pyogenes M1 GAS
agauuuuaagacaacauacuu

SEQ ID NO: 2208299 - RNA, 14 nt, Streptococcus pyogenes M1 GAS
agcaauaacaucuu

SEQ ID NO: 2208300 - RNA, 13 nt, Streptococcus pyogenes M1 GAS
agccuuuuuugau

SEQ ID NO: 2208301 - RNA, 18 nt, Streptococcus pyogenes M1 GAS
uaaaagucaacugauaua

SEQ ID NO: 2208302 - RNA, 16 nt, Streptococcus pyogenes M1 GAS
guuucccauguuuuau

SEQ ID NO: 2208303 - RNA, 19 nt, Streptococcus pyogenes M1 GAS
uaaacacuaccuuaaaugu

SEQ ID NO: 2208304 - RNA, 17 nt, Streptococcus pyogenes M1 GAS
uaaacuuacaaaaagcc

SEQ ID NO: 2208305 - RNA, 12 nt, Streptococcus pyogenes M1 GAS
uaaagcaaucau

SEQ ID NO: 2208306 - RNA, 23 nt, Streptococcus pyogenes M1 GAS
uaacaaugagaucuucuuuuggu

SEQ ID NO: 2208307 - RNA, 22 nt, Streptococcus pyogenes M1 GAS
uaacacagaagccucuucugau

SEQ ID NO: 2208308 - RNA, 19 nt, Streptococcus pyogenes M1 GAS
uaaauugauuauucuuuau

SEQ ID NO: 2208309 - RNA, 20 nt, Streptococcus pyogenes M1 GAS
uaacaacaacaacccuugau

SEQ ID NO: 2208310 - RNA, 15 nt, Streptococcus pyogenes M1 GAS
uaaugaccuuugaua

SEQ ID NO: 2208311 - RNA, 19 nt, Streptococcus pyogenes M1 GAS
uaauaagauucaauaugaa

SEQ ID NO: 2208312 - RNA, 17 nt, Streptococcus pyogenes M1 GAS
uaacuuucuauuaccua

SEQ ID NO: 2208313 - RNA, 18 nt, Streptococcus pyogenes M1 GAS
uaagauacugcccuugau

SEQ ID NO: 2208314 - RNA, 20 nt, Streptococcus pyogenes M1 GAS
aaguuaucacuaaggcugau

SEQ ID NO: 2208315 - RNA, 14 nt, Streptococcus pyogenes M1 GAS
guuacaaaaaacaa

SEQ ID NO: 2208316 - RNA, 17 nt, Streptococcus pyogenes M1 GAS
guguucuagcuuuguca

SEQ ID NO: 2208317 - RNA, 13 nt, Streptococcus pyogenes M1 GAS
guuaaaauagaag

SEQ ID NO: 2208318 - RNA, 17 nt, Streptococcus pyogenes M1 GAS
gugucuuuucuuuuugg

SEQ ID NO: 2208319 - RNA, 15 nt, Streptococcus pyogenes M1 GAS
ucauggauauuacaa

SEQ ID NO: 2208320 - RNA, 20 nt, Streptococcus pyogenes M1 GAS
uagcauuaaggauuaugaaa

SEQ ID NO: 2208321 - RNA, 18 nt, Streptococcus pyogenes M1 GAS
uagauugcuuccaacucc

SEQ ID NO: 2208322 - RNA, 15 nt, Streptococcus pyogenes M1 GAS
uagauguuguucuaa

SEQ ID NO: 2208323 - RNA, 20 nt, Streptococcus pyogenes M1 GAS
uagcauaaaagauauuuuaa

SEQ ID NO: 2208324 - RNA, 14 nt, Streptococcus pyogenes M1 GAS
uagacuauaaaagu

SEQ ID NO: 2208325 - RNA, 19 nt, Streptococcus pyogenes M1 GAS
uagaauccuccucuuuuuu

SEQ ID NO: 2208326 - RNA, 20 nt, Streptococcus pyogenes M1 GAS
uacucaauauaauaaaaagc

SEQ ID NO: 2208327 - RNA, 20 nt, Streptococcus pyogenes M1 GAS
uaucauuggggaaacuagca

SEQ ID NO: 2208328 - RNA, 15 nt, Streptococcus pyogenes M1 GAS
uagcugguugaccaa

SEQ ID NO: 2208329 - RNA, 15 nt, Streptococcus pyogenes M1 GAS
uaggugaguuuuuuc

SEQ ID NO: 2208330 - RNA, 13 nt, Streptococcus pyogenes M1 GAS
uaguuuaucacuc

SEQ ID NO: 2208331 - RNA, 15 nt, Streptococcus pyogenes M1 GAS
ucaacaaauccuuuu

SEQ ID NO: 2208332 - RNA, 17 nt, Streptococcus pyogenes M1 GAS
ucaaaaaguaaaaagca

SEQ ID NO: 2208333 - RNA, 18 nt, Streptococcus pyogenes M1 GAS
uauuucgucuaaaaagcc

SEQ ID NO: 2208334 - RNA, 12 nt, Streptococcus pyogenes M1 GAS
uauggacuaucu

SEQ ID NO: 2208335 - RNA, 18 nt, Streptococcus pyogenes M1 GAS
uaucgccaauaaaaaaga

SEQ ID NO: 2208336 - RNA, 23 nt, Streptococcus pyogenes M1 GAS
ugauaagauauuguuaauauagu

SEQ ID NO: 2208337 - RNA, 20 nt, Streptococcus pyogenes M1 GAS
ugaugaguaggcgaacuuua

SEQ ID NO: 2208338 - RNA, 20 nt, Streptococcus pyogenes M1 GAS
ugauguacuuuguccuugag

SEQ ID NO: 2208339 - RNA, 13 nt, Streptococcus pyogenes M1 GAS
ucugcaacaucaa

SEQ ID NO: 2208340 - RNA, 16 nt, Streptococcus pyogenes M1 GAS
ucugcauuaucaucug

SEQ ID NO: 2208341 - RNA, 20 nt, Streptococcus pyogenes M1 GAS
ucuuucauuagcuuuuuuua

SEQ ID NO: 2208342 - RNA, 14 nt, Streptococcus pyogenes M1 GAS
ucgucgugacaaug

SEQ ID NO: 2208343 - RNA, 12 nt, Streptococcus pyogenes M1 GAS
uccuuuugcuuc

SEQ ID NO: 2208344 - RNA, 19 nt, Streptococcus pyogenes M1 GAS
ucccauguuuuauuaccag

SEQ ID NO: 2208345 - RNA, 15 nt, Streptococcus pyogenes M1 GAS
ucggacuguuuuuua

SEQ ID NO: 2208346 - RNA, 19 nt, Streptococcus pyogenes M1 GAS
acauacuuuauuaaucaaa

SEQ ID NO: 2208347 - RNA, 12 nt, Streptococcus pyogenes M1 GAS
accaaaaaaagc

SEQ ID NO: 2208348 - RNA, 13 nt, Streptococcus pyogenes M1 GAS
accaaaaaaagca

SEQ ID NO: 2208349 - RNA, 18 nt, Streptococcus pyogenes M1 GAS
acaagucuaucugcagau

SEQ ID NO: 2208350 - RNA, 16 nt, Streptococcus pyogenes M1 GAS
acaauuuuucaaaaaa

SEQ ID NO: 2208351 - RNA, 15 nt, Streptococcus pyogenes M1 GAS
aaugugggauauuua

SEQ ID NO: 2208352 - RNA, 15 nt, Streptococcus pyogenes M1 GAS
acaaaucuucuagaa

SEQ ID NO: 2208353 - RNA, 20 nt, Streptococcus pyogenes M1 GAS
accuucaaccgcuuccuuug

SEQ ID NO: 2208354 - RNA, 14 nt, Streptococcus pyogenes M1 GAS
accuucaaaaaagg

SEQ ID NO: 2208355 - RNA, 13 nt, Streptococcus pyogenes M1 GAS
acuagugacauuu

SEQ ID NO: 2208356 - RNA, 21 nt, Streptococcus pyogenes M1 GAS
acuaggcuuucauuauagacu

SEQ ID NO: 2208357 - RNA, 20 nt, Streptococcus pyogenes M1 GAS
acuccagcuggaguuuuuuu

SEQ ID NO: 2208358 - RNA, 18 nt, Streptococcus pyogenes M1 GAS
acugccauggguaaaaug

SEQ ID NO: 2208359 - RNA, 18 nt, Streptococcus pyogenes M1 GAS
acguuccaugauugauuu

SEQ ID NO: 2208360 - RNA, 12 nt, Streptococcus pyogenes M1 GAS
uugguccucuga

SEQ ID NO: 2208361 - RNA, 12 nt, Streptococcus pyogenes M1 GAS
uuguauuagcaa

SEQ ID NO: 2208362 - RNA, 24 nt, Streptococcus pyogenes M1 GAS
uugucaacucgauaaaaacgauca

SEQ ID NO: 2208363 - RNA, 21 nt, Streptococcus pyogenes M1 GAS
uugguuuaauacguuuauuua

SEQ ID NO: 2208364 - RNA, 16 nt, Streptococcus pyogenes M1 GAS
uuguguugaagaaggu

SEQ ID NO: 2208365 - RNA, 15 nt, Streptococcus pyogenes M1 GAS
uugaugauugaguaa

SEQ ID NO: 2208366 - RNA, 23 nt, Streptococcus pyogenes M1 GAS
aaucuuugugguuacagacuuuu

SEQ ID NO: 2208367 - RNA, 21 nt, Streptococcus pyogenes M1 GAS
uuuuauaacaauuacaaccca

SEQ ID NO: 2208368 - RNA, 20 nt, Streptococcus pyogenes M1 GAS
aaugacuauagaaaguaaaa

SEQ ID NO: 2208369 - RNA, 13 nt, Streptococcus pyogenes M1 GAS
uuuaaagcgauaa

SEQ ID NO: 2208370 - RNA, 14 nt, Streptococcus pyogenes M1 GAS
uuugacuucaaaaa

SEQ ID NO: 2208371 - RNA, 22 nt, Streptococcus pyogenes M1 GAS
uuugaugcagcuaaaagcauaa

SEQ ID NO: 2208372 - RNA, 17 nt, Streptococcus pyogenes M1 GAS
uuugcaaauaguagcaa

SEQ ID NO: 2208373 - RNA, 14 nt, Streptococcus pyogenes M1 GAS
uuuuacaucaaaaa

SEQ ID NO: 2208374 - RNA, 15 nt, Streptococcus pyogenes M1 GAS
uucaucuugccauca

SEQ ID NO: 2208375 - RNA, 18 nt, Streptococcus pyogenes M1 GAS
uuauccccuauucaauau

SEQ ID NO: 2208376 - RNA, 20 nt, Streptococcus pyogenes M1 GAS
uuaucccuggaccauuauca

SEQ ID NO: 2208377 - RNA, 16 nt, Streptococcus pyogenes M1 GAS
uuaacaggugacauag

SEQ ID NO: 2208378 - RNA, 18 nt, Streptococcus pyogenes M1 GAS
uuagcaauccaacuuuga

SEQ ID NO: 2208379 - RNA, 23 nt, Streptococcus pyogenes M1 GAS
uuagacuaugauacauugaauaa

SEQ ID NO: 2208380 - RNA, 13 nt, Streptococcus pyogenes M1 GAS
uuagcaauuguuu

SEQ ID NO: 2208381 - RNA, 14 nt, Streptococcus pyogenes M1 GAS
uuagcuaagaauaa

SEQ ID NO: 2208382 - RNA, 14 nt, Streptococcus pyogenes M1 GAS
uguuacaaaaaaca

SEQ ID NO: 2208383 - RNA, 16 nt, Streptococcus pyogenes M1 GAS
ugucuucuucuuuuca

SEQ ID NO: 2208384 - RNA, 20 nt, Streptococcus pyogenes M1 GAS
ugucaacucgauaaaaacga

SEQ ID NO: 2208385 - RNA, 13 nt, Streptococcus pyogenes M1 GAS
ugcuccuaucaua

SEQ ID NO: 2208386 - RNA, 16 nt, Streptococcus pyogenes M1 GAS
aauauagcaaucuuca

SEQ ID NO: 2208387 - RNA, 15 nt, Streptococcus pyogenes M1 GAS
aauauaauaaaaagc

SEQ ID NO: 2208388 - RNA, 13 nt, Streptococcus pyogenes M1 GAS
aauagcgccagca

SEQ ID NO: 2208389 - RNA, 19 nt, Streptococcus pyogenes M1 GAS
aaucaccguaacuugcuuu

SEQ ID NO: 2208390 - RNA, 12 nt, Streptococcus pyogenes M1 GAS
aaaucaaaaagc

SEQ ID NO: 2208391 - RNA, 13 nt, Streptococcus pyogenes M1 GAS
aaaucuucuauug

SEQ ID NO: 2208392 - RNA, 15 nt, Streptococcus pyogenes M1 GAS
aaaucuucuagaauc

SEQ ID NO: 2208393 - RNA, 18 nt, Streptococcus pyogenes M1 GAS
aaaucuggcuuagcagca

SEQ ID NO: 2208394 - RNA, 13 nt, Streptococcus pyogenes M1 GAS
aacagaaagcgga

SEQ ID NO: 2208395 - RNA, 22 nt, Streptococcus pyogenes M1 GAS
aacagauaagugccaucaggcu

SEQ ID NO: 2208396 - RNA, 21 nt, Streptococcus pyogenes M1 GAS
aacaauaucgagcugauugac

SEQ ID NO: 2208397 - RNA, 14 nt, Streptococcus pyogenes M1 GAS
aacaacccuugauu

SEQ ID NO: 2208398 - RNA, 21 nt, Streptococcus pyogenes M1 GAS
aaauaguucagauauucuuug

SEQ ID NO: 2208399 - RNA, 16 nt, Streptococcus pyogenes M1 GAS
aaauacuagaaaaagc

SEQ ID NO: 2208400 - RNA, 20 nt, Streptococcus pyogenes M1 GAS
aaauacuagaaaaagcaaug

SEQ ID NO: 2208401 - RNA, 13 nt, Streptococcus pyogenes M1 GAS
aaacucaaaaagc

SEQ ID NO: 2208402 - RNA, 11 nt, Streptococcus pyogenes M1 GAS
aaaaaguaaaa

SEQ ID NO: 2208403 - RNA, 14 nt, Streptococcus pyogenes M1 GAS
aaagcaaauugaaa

SEQ ID NO: 2208404 - RNA, 20 nt, Streptococcus pyogenes M1 GAS
aaacgaaaauccuugcguag

SEQ ID NO: 2208405 - RNA, 23 nt, Streptococcus pyogenes M1 GAS
aacauccauaccaucaaugacuu

SEQ ID NO: 2208406 - RNA, 17 nt, Streptococcus pyogenes M1 GAS
aaccauuauaaaagagu

SEQ ID NO: 2208407 - RNA, 20 nt, Streptococcus pyogenes M1 GAS
aaucauuuuggagagauuuu

SEQ ID NO: 2208408 - RNA, 14 nt, Streptococcus pyogenes M1 GAS
aauaguuuaucacu

SEQ ID NO: 2208409 - RNA, 14 nt, Streptococcus pyogenes M1 GAS
aauagcgccagcaa

SEQ ID NO: 2208410 - RNA, 20 nt, Streptococcus pyogenes M1 GAS
aaucuaucucguaauccuug

SEQ ID NO: 2208411 - RNA, 18 nt, Streptococcus pyogenes M1 GAS
aaucuaucucguaauccu

SEQ ID NO: 2208412 - RNA, 14 nt, Streptococcus pyogenes M1 GAS
aauccuuuuucaca

SEQ ID NO: 2208413 - RNA, 15 nt, Streptococcus pyogenes M1 GAS
aauugaccaaaagaa

SEQ ID NO: 2208414 - RNA, 16 nt, Streptococcus pyogenes M1 GAS
aauuaguauauuguaa

SEQ ID NO: 2208415 - RNA, 17 nt, Streptococcus pyogenes M1 GAS
aaugugacaauugguga

SEQ ID NO: 2208416 - RNA, 20 nt, Streptococcus pyogenes M1 GAS
aaucuucaacaccuucguau

SEQ ID NO: 2208417 - RNA, 21 nt, Streptococcus pyogenes M1 GAS
aaugauuguuauuuguuaaca

SEQ ID NO: 2208418 - RNA, 16 nt, Streptococcus pyogenes M1 GAS
aauaaaauagcaccua

SEQ ID NO: 2208419 - RNA, 15 nt, Streptococcus pyogenes M1 GAS
aauaaagaaaaaguc

SEQ ID NO: 2208420 - RNA, 14 nt, Streptococcus pyogenes M1 GAS
aauaacgccagcua

SEQ ID NO: 2208421 - RNA, 13 nt, Streptococcus pyogenes M1 GAS
aaguaaggguuaa

SEQ ID NO: 2208422 - RNA, 22 nt, Streptococcus pyogenes M1 GAS
aagguuuuuuuaagcaugauuu

SEQ ID NO: 2208423 - RNA, 18 nt, Streptococcus pyogenes M1 GAS
aagauacugcccuugaug

SEQ ID NO: 2208424 - RNA, 18 nt, Streptococcus pyogenes M1 GAS
aagcaaugacuauagaaa

SEQ ID NO: 2208425 - RNA, 20 nt, Streptococcus pyogenes M1 GAS
aagauggugcuuuaaaaagu

SEQ ID NO: 2208426 - RNA, 15 nt, Streptococcus pyogenes M1 GAS
aagauccuacaagag

SEQ ID NO: 2208427 - RNA, 19 nt, Streptococcus pyogenes M1 GAS
accagcauuugccauggca

SEQ ID NO: 2208428 - RNA, 20 nt, Streptococcus pyogenes M1 GAS
accaauaaugagcaaggcaa

SEQ ID NO: 2208429 - RNA, 15 nt, Streptococcus pyogenes M1 GAS
acauugaauaaagug

SEQ ID NO: 2208430 - RNA, 13 nt, Streptococcus pyogenes M1 GAS
acaguauacauca

SEQ ID NO: 2208431 - RNA, 21 nt, Streptococcus pyogenes M1 GAS
acaucaaaggcuuuuuguuuu

SEQ ID NO: 2208432 - RNA, 12 nt, Streptococcus pyogenes M1 GAS
aaaaugcauuac

SEQ ID NO: 2208433 - RNA, 23 nt, Streptococcus pyogenes M1 GAS
accuucaaaaaagggaagaagau

SEQ ID NO: 2208434 - RNA, 22 nt, Streptococcus pyogenes M1 GAS
accuguagcccuuuuugccuuu

SEQ ID NO: 2208435 - RNA, 14 nt, Streptococcus pyogenes M1 GAS
acuugauuucauuu

SEQ ID NO: 2208436 - RNA, 13 nt, Streptococcus pyogenes M1 GAS
acuuguuacaaaa

SEQ ID NO: 2208437 - RNA, 16 nt, Streptococcus pyogenes M1 GAS
acucuauuuuaaguaa

SEQ ID NO: 2208438 - RNA, 18 nt, Streptococcus pyogenes M1 GAS
acucaugauaucccaucu

SEQ ID NO: 2208439 - RNA, 22 nt, Streptococcus pyogenes M1 GAS
acucgauaaaaacgaucaaaaa

SEQ ID NO: 2208440 - RNA, 13 nt, Streptococcus pyogenes M1 GAS
acucguaaaaaga

SEQ ID NO: 2208441 - RNA, 13 nt, Streptococcus pyogenes M1 GAS
acucgucuuuauc

SEQ ID NO: 2208442 - RNA, 19 nt, Streptococcus pyogenes M1 GAS
agcagcacuggcuuuuuug

SEQ ID NO: 2208443 - RNA, 20 nt, Streptococcus pyogenes M1 GAS
agcaucaggauugccaucaa

SEQ ID NO: 2208444 - RNA, 14 nt, Streptococcus pyogenes M1 GAS
agcucuuuaucacc

SEQ ID NO: 2208445 - RNA, 21 nt, Streptococcus pyogenes M1 GAS
aucacguaaccaauuguugaa

SEQ ID NO: 2208446 - RNA, 16 nt, Streptococcus pyogenes M1 GAS
aucaaagggauuacga

SEQ ID NO: 2208447 - RNA, 19 nt, Streptococcus pyogenes M1 GAS
auauuauaguaaccauugc

SEQ ID NO: 2208448 - RNA, 21 nt, Streptococcus pyogenes M1 GAS
auaguucagauauucuuuggc

SEQ ID NO: 2208449 - RNA, 12 nt, Streptococcus pyogenes M1 GAS
auagcuuuugua

SEQ ID NO: 2208450 - RNA, 23 nt, Streptococcus pyogenes M1 GAS
auacugguacguugauugccauu

SEQ ID NO: 2208451 - RNA, 21 nt, Streptococcus pyogenes M1 GAS
auacuaccuuuaggaucauua

SEQ ID NO: 2208452 - RNA, 16 nt, Streptococcus pyogenes M1 GAS
auacuagaaaaagcaa

SEQ ID NO: 2208453 - RNA, 19 nt, Streptococcus pyogenes M1 GAS
auagcacguuggaaaagga

SEQ ID NO: 2208454 - RNA, 16 nt, Streptococcus pyogenes M1 GAS
aguuugacuucaaaaa

SEQ ID NO: 2208455 - RNA, 20 nt, Streptococcus pyogenes M1 GAS
auaacuguucauuuaguggu

SEQ ID NO: 2208456 - RNA, 20 nt, Streptococcus pyogenes M1 GAS
agucagacuuaauugaaaga

SEQ ID NO: 2208457 - RNA, 14 nt, Streptococcus pyogenes M1 GAS
agucuugauaacaa

SEQ ID NO: 2208458 - RNA, 20 nt, Streptococcus pyogenes M1 GAS
aggcagacaauuauuuugca

SEQ ID NO: 2208459 - RNA, 16 nt, Streptococcus pyogenes M1 GAS
aguaaccauugccauu

SEQ ID NO: 2208460 - RNA, 15 nt, Streptococcus pyogenes M1 GAS
aguagcaaauaacau

SEQ ID NO: 2208461 - RNA, 12 nt, Streptococcus pyogenes M1 GAS
aguaaaaagcaa

SEQ ID NO: 2208462 - RNA, 17 nt, Streptococcus pyogenes M1 GAS
aggugccuguuuuugcu

SEQ ID NO: 2208463 - RNA, 13 nt, Streptococcus pyogenes M1 GAS
augaugguuucac

SEQ ID NO: 2208464 - RNA, 17 nt, Streptococcus pyogenes M1 GAS
auguuuuuacauuuuua

SEQ ID NO: 2208465 - RNA, 19 nt, Streptococcus pyogenes M1 GAS
auuaguccaaaauacaucc

SEQ ID NO: 2208466 - RNA, 19 nt, Streptococcus pyogenes M1 GAS
auuagucuuuaaaaaacgc

SEQ ID NO: 2208467 - RNA, 14 nt, Streptococcus pyogenes M1 GAS
auuaaggauuauga

SEQ ID NO: 2208468 - RNA, 18 nt, Streptococcus pyogenes M1 GAS
auuaacguuccaaaaaga

SEQ ID NO: 2208469 - RNA, 23 nt, Streptococcus pyogenes M1 GAS
auuauaguaaccauugccauuaa

SEQ ID NO: 2208470 - RNA, 14 nt, Streptococcus pyogenes M1 GAS
auucuuauccauua

SEQ ID NO: 2208471 - RNA, 20 nt, Streptococcus pyogenes M1 GAS
auuguugacuuugcaaaaga

SEQ ID NO: 2208472 - RNA, 16 nt, Streptococcus pyogenes M1 GAS
auugaugagacuaacc

SEQ ID NO: 2208473 - RNA, 17 nt, Streptococcus pyogenes M1 GAS
auugcuggugacuauca

SEQ ID NO: 2208474 - RNA, 12 nt, Streptococcus pyogenes M1 GAS
aucuuucauuag

SEQ ID NO: 2208475 - RNA, 14 nt, Streptococcus pyogenes M1 GAS
augacuugaccaaa

SEQ ID NO: 2208476 - RNA, 23 nt, Streptococcus pyogenes M1 GAS
augacuauagaaaguaaaaauac

SEQ ID NO: 2208477 - RNA, 13 nt, Streptococcus pyogenes M1 GAS
aucuaaaaaagca

SEQ ID NO: 2208478 - RNA, 23 nt, Streptococcus pyogenes M1 GAS
aucgaccaaaaucuucuauuguc

SEQ ID NO: 2208479 - RNA, 13 nt, Streptococcus pyogenes M1 GAS
aucgaugauaaua

SEQ ID NO: 2208480 - RNA, 17 nt, Streptococcus pyogenes M1 GAS
aucgcucagaauaaaga

SEQ ID NO: 2208481 - RNA, 23 nt, Streptococcus pyogenes M1 GAS
aucgcucagaauaaagaaaaagu

SEQ ID NO: 2208482 - RNA, 13 nt, Streptococcus pyogenes M1 GAS
caccaaaaaaagc

SEQ ID NO: 2208483 - RNA, 16 nt, Streptococcus pyogenes M1 GAS
auuuaguuauuuuuga

SEQ ID NO: 2208484 - RNA, 23 nt, Streptococcus pyogenes M1 GAS
caaagcaucaggauugccaucaa

SEQ ID NO: 2208485 - RNA, 14 nt, Streptococcus pyogenes M1 GAS
caaaucuucuagaa

SEQ ID NO: 2208486 - RNA, 10 nt, Streptococcus pyogenes M1 GAS
caaccugaaa

SEQ ID NO: 2208487 - RNA, 14 nt, Streptococcus pyogenes M1 GAS
caaugcuuuuugua

SEQ ID NO: 2208488 - RNA, 19 nt, Streptococcus pyogenes M1 GAS
ccauggguaaaaugacuga

SEQ ID NO: 2208489 - RNA, 15 nt, Streptococcus pyogenes M1 GAS
ccauacgcuccaacg

SEQ ID NO: 2208490 - RNA, 12 nt, Streptococcus pyogenes M1 GAS
aaauaucuagaa

SEQ ID NO: 2208491 - RNA, 20 nt, Streptococcus pyogenes M1 GAS
ccaauaaugccaucaaaaaa

SEQ ID NO: 2208492 - RNA, 21 nt, Streptococcus pyogenes M1 GAS
ccaauaaugccaucaaaaaaa

SEQ ID NO: 2208493 - RNA, 17 nt, Streptococcus pyogenes M1 GAS
cauuuuuacaauacgau

SEQ ID NO: 2208494 - RNA, 18 nt, Streptococcus pyogenes M1 GAS
ccaaaaguuggcuacucu

SEQ ID NO: 2208495 - RNA, 21 nt, Streptococcus pyogenes M1 GAS
cauuuugcaagucucuugcaa

SEQ ID NO: 2208496 - RNA, 15 nt, Streptococcus pyogenes M1 GAS
cauuacauuuaaagg

SEQ ID NO: 2208497 - RNA, 12 nt, Streptococcus pyogenes M1 GAS
aaagccaagcuu

SEQ ID NO: 2208498 - RNA, 13 nt, Streptococcus pyogenes M1 GAS
aaagcaagcaaca

SEQ ID NO: 2208499 - RNA, 20 nt, Streptococcus pyogenes M1 GAS
cagcuacacuugauuucauu

SEQ ID NO: 2208500 - RNA, 22 nt, Streptococcus pyogenes M1 GAS
cagagacaauaaggucaucaga

SEQ ID NO: 2208501 - RNA, 17 nt, Streptococcus pyogenes M1 GAS
cagauaagaccuucaaa

SEQ ID NO: 2208502 - RNA, 14 nt, Streptococcus pyogenes M1 GAS
cagagaugcuucuu

SEQ ID NO: 2208503 - RNA, 20 nt, Streptococcus pyogenes M1 GAS
cacuacaagcaucuuugcag

SEQ ID NO: 2208504 - RNA, 22 nt, Streptococcus pyogenes M1 GAS
aaauuacgauggacacuacuau

SEQ ID NO: 2208505 - RNA, 13 nt, Streptococcus pyogenes M1 GAS
ccuauagaaaguu

SEQ ID NO: 2208506 - RNA, 16 nt, Streptococcus pyogenes M1 GAS
aaauugaaaaaaucgc

SEQ ID NO: 2208507 - RNA, 17 nt, Streptococcus pyogenes M1 GAS
cgaaaugauagcaccua

SEQ ID NO: 2208508 - RNA, 20 nt, Streptococcus pyogenes M1 GAS
cggaguuccucgguuuuuuu

SEQ ID NO: 2208509 - RNA, 14 nt, Streptococcus pyogenes M1 GAS
aacagauugaagac

SEQ ID NO: 2208510 - RNA, 16 nt, Streptococcus pyogenes M1 GAS
aagcagugcuuuaaca

SEQ ID NO: 2208511 - RNA, 12 nt, Streptococcus pyogenes M1 GAS
aagcaucuuugc

SEQ ID NO: 2208512 - RNA, 19 nt, Streptococcus pyogenes M1 GAS
aagcauuuguuuugauaaa

SEQ ID NO: 2208513 - RNA, 13 nt, Streptococcus pyogenes M1 GAS
gcuaaugucuugg

SEQ ID NO: 2208514 - RNA, 18 nt, Streptococcus pyogenes M1 GAS
gcuagggcaacugcaaua

SEQ ID NO: 2208515 - RNA, 12 nt, Streptococcus pyogenes M1 GAS
gcuaagagaaua

SEQ ID NO: 2208516 - RNA, 15 nt, Streptococcus pyogenes M1 GAS
aagcugagcaaaaca

SEQ ID NO: 2208517 - RNA, 18 nt, Streptococcus pyogenes M1 GAS
guccaucauugaugagac

SEQ ID NO: 2208518 - RNA, 19 nt, Streptococcus pyogenes M1 GAS
gucaaaaaguaaaaagcaa

SEQ ID NO: 2208519 - RNA, 13 nt, Streptococcus pyogenes M1 GAS
guaacuugcuuug

SEQ ID NO: 2208520 - RNA, 19 nt, Streptococcus pyogenes M1 GAS
guaaaaucuuauuuuuuac

SEQ ID NO: 2208521 - RNA, 18 nt, Streptococcus pyogenes M1 GAS
guaaaaagcaaauugaaa

SEQ ID NO: 2208522 - RNA, 19 nt, Streptococcus pyogenes M1 GAS
aaguccuuuuaguuuuauu

SEQ ID NO: 2208523 - RNA, 14 nt, Streptococcus pyogenes M1 GAS
aaguaaaggauuua

SEQ ID NO: 2208524 - RNA, 11 nt, Streptococcus pyogenes M1 GAS
aaguaaaaagc

SEQ ID NO: 2208525 - RNA, 18 nt, Streptococcus pyogenes M1 GAS
aagguuguggcugauaaa

SEQ ID NO: 2208526 - RNA, 13 nt, Streptococcus pyogenes M1 GAS
aaggcuucaucaa

SEQ ID NO: 2208527 - RNA, 15 nt, Streptococcus pyogenes M1 GAS
ggccccuuuuuugac

SEQ ID NO: 2208528 - RNA, 16 nt, Streptococcus pyogenes M1 GAS
aaggugccuguuuuug

SEQ ID NO: 2208529 - RNA, 21 nt, Streptococcus pyogenes M1 GAS
aagguuacccuugacgaugcu

SEQ ID NO: 2208530 - RNA, 15 nt, Streptococcus pyogenes M1 GAS
aaggaugaaaugauu

SEQ ID NO: 2208531 - RNA, 15 nt, Streptococcus pyogenes M1 GAS
ggauacaguccaaac

SEQ ID NO: 2208532 - RNA, 17 nt, Streptococcus pyogenes M1 GAS
gauuauucuuagucuag

SEQ ID NO: 2208533 - RNA, 12 nt, Streptococcus pyogenes M1 GAS
gauaaaaaacaa

SEQ ID NO: 2208534 - RNA, 14 nt, Streptococcus pyogenes M1 GAS
gauaagaccuucaa

SEQ ID NO: 2208535 - RNA, 15 nt, Streptococcus pyogenes M1 GAS
gaguuccucgguuuu

SEQ ID NO: 2208536 - RNA, 14 nt, Streptococcus pyogenes M1 GAS
aacucaaaaaauac

SEQ ID NO: 2208537 - RNA, 19 nt, Streptococcus pyogenes M1 GAS
aacucaaaaaauacaauaa

SEQ ID NO: 2208538 - RNA, 23 nt, Streptococcus pyogenes M1 GAS
aacuaucgcucagaauaaagaaa

SEQ ID NO: 2208539 - RNA, 20 nt, Streptococcus pyogenes M1 GAS
gagaaugauaguaaacgaaa

SEQ ID NO: 2208540 - RNA, 13 nt, Streptococcus pyogenes M1 GAS
aacuccugauaau

SEQ ID NO: 2208541 - RNA, 14 nt, Streptococcus pyogenes M1 GAS
gccccuuuuuugac

SEQ ID NO: 2208542 - RNA, 23 nt, Streptococcus pyogenes M1 GAS
aagacggaguauuuuuuaguaga

SEQ ID NO: 2208543 - RNA, 20 nt, Streptococcus pyogenes M1 GAS
gcauaccugagccuccaaca

SEQ ID NO: 2208544 - RNA, 16 nt, Streptococcus pyogenes M1 GAS
gcauuaucaucugguc

SEQ ID NO: 2208545 - RNA, 22 nt, Streptococcus pyogenes M1 GAS
gaagccgugaggacuuauuuuu

SEQ ID NO: 2208546 - RNA, 16 nt, Streptococcus pyogenes M1 GAS
gaaggcuuguucuuua

SEQ ID NO: 2208547 - RNA, 17 nt, Streptococcus pyogenes M1 GAS
gaaggcuuguucuuuau

SEQ ID NO: 2208548 - RNA, 13 nt, Streptococcus pyogenes M1 GAS
gaagucucuuuug

SEQ ID NO: 2208549 - RNA, 14 nt, Streptococcus pyogenes M1 GAS
cuugugcuaaucua

SEQ ID NO: 2208550 - RNA, 17 nt, Streptococcus pyogenes M1 GAS
gaaacuggucaaaagcu

SEQ ID NO: 2208551 - RNA, 13 nt, Streptococcus pyogenes M1 GAS
gaacucgucuuua

SEQ ID NO: 2208552 - RNA, 15 nt, Streptococcus pyogenes M1 GAS
gacauuaguccaaaa

SEQ ID NO: 2208553 - RNA, 22 nt, Streptococcus pyogenes M1 GAS
aacgguaucacucguaaaaaga

SEQ ID NO: 2208554 - RNA, 19 nt, Streptococcus pyogenes M1 GAS
cuugcaaggugcuuuuuuu

SEQ ID NO: 2208555 - RNA, 15 nt, Streptococcus pyogenes M1 GAS
cuugcauuaccuuau

SEQ ID NO: 2208556 - RNA, 15 nt, Streptococcus pyogenes M1 GAS
cuugcagaauagaaa

SEQ ID NO: 2208557 - RNA, 18 nt, Streptococcus pyogenes M1 GAS
cuugguucugaaaauaaa

SEQ ID NO: 2208558 - RNA, 13 nt, Streptococcus pyogenes M1 GAS
cuucuuggaaaac

SEQ ID NO: 2208559 - RNA, 22 nt, Streptococcus pyogenes M1 GAS
cuugaauaucgccaauaaaaaa

SEQ ID NO: 2208560 - RNA, 20 nt, Streptococcus pyogenes M1 GAS
cuucugcagucuuuuucauu

SEQ ID NO: 2208561 - RNA, 16 nt, Streptococcus pyogenes M1 GAS
cuguaaauagauaaug

SEQ ID NO: 2208562 - RNA, 18 nt, Streptococcus pyogenes M1 GAS
cugguugaccaauauagc

SEQ ID NO: 2208563 - RNA, 16 nt, Streptococcus pyogenes M1 GAS
cugguaaaguauuuua

SEQ ID NO: 2208564 - RNA, 14 nt, Streptococcus pyogenes M1 GAS
cugguacguugauu

SEQ ID NO: 2208565 - RNA, 22 nt, Streptococcus pyogenes M1 GAS
aacccgucuuacaauuaauaga

SEQ ID NO: 2208566 - RNA, 14 nt, Streptococcus pyogenes M1 GAS
cuaacaaaaucaca

SEQ ID NO: 2208567 - RNA, 15 nt, Streptococcus pyogenes M1 GAS
cuaacuauuuuuacc

SEQ ID NO: 2208568 - RNA, 15 nt, Streptococcus pyogenes M1 GAS
cuaaaaugaugagau

SEQ ID NO: 2208569 - RNA, 22 nt, Streptococcus pyogenes M1 GAS
cuaggacuaaccccuaaucaga

SEQ ID NO: 2208570 - RNA, 13 nt, Streptococcus pyogenes M1 GAS
cuagaaaaagcaa

SEQ ID NO: 2208571 - RNA, 14 nt, Streptococcus pyogenes M1 GAS
cuagaacagauuga

SEQ ID NO: 2208572 - RNA, 16 nt, Streptococcus pyogenes M1 GAS
cuaauccuuuuucaca

SEQ ID NO: 2208573 - RNA, 20 nt, Streptococcus pyogenes M1 GAS
cuccgacaaucgaaaugaua

SEQ ID NO: 2208574 - RNA, 14 nt, Streptococcus pyogenes M1 GAS
cucgcuaucaaagc

SEQ ID NO: 2208575 - RNA, 13 nt, Streptococcus pyogenes M1 GAS
uuuuuacaauacg

SEQ ID NO: 2208576 - RNA, 22 nt, Streptococcus pyogenes M1 GAS
uuuggcaagauaauauugauau

SEQ ID NO: 2208577 - RNA, 13 nt, Streptococcus pyogenes M1 GAS
uuuuaaagcuaag

SEQ ID NO: 2208578 - RNA, 18 nt, Streptococcus pyogenes M1 GAS
uuucucagagacaauaag

SEQ ID NO: 2208579 - RNA, 13 nt, Streptococcus pyogenes M1 GAS
uuguaauucagca

SEQ ID NO: 2208580 - RNA, 23 nt, Streptococcus pyogenes M1 GAS
uuggcuaccguuaguauuagcac

SEQ ID NO: 2208581 - RNA, 15 nt, Streptococcus pyogenes M1 GAS
uucugguuuaucauu

SEQ ID NO: 2208582 - RNA, 22 nt, Streptococcus pyogenes M1 GAS
uucuuauccauuauaaaucuua

SEQ ID NO: 2208583 - RNA, 14 nt, Streptococcus pyogenes M1 GAS
uuacuaugaaaaaa

SEQ ID NO: 2208584 - RNA, 12 nt, Streptococcus pyogenes M1 GAS
uuaauaaauuuu

SEQ ID NO: 2208585 - RNA, 15 nt, Streptococcus pyogenes M1 GAS
uuaauagcgccagca

SEQ ID NO: 2208586 - RNA, 16 nt, Streptococcus pyogenes M1 GAS
uuaaagcgauaaucuu

SEQ ID NO: 2208587 - RNA, 21 nt, Streptococcus pyogenes M1 GAS
uguuuacgcuuuacauuuuau

SEQ ID NO: 2208588 - RNA, 15 nt, Streptococcus pyogenes M1 GAS
uguugucaaacauaa

SEQ ID NO: 2208589 - RNA, 15 nt, Streptococcus pyogenes M1 GAS
uuauucuuuauuuuu

SEQ ID NO: 2208590 - RNA, 17 nt, Streptococcus pyogenes M1 GAS
ugucuaagauguuuacg

SEQ ID NO: 2208591 - RNA, 18 nt, Streptococcus pyogenes M1 GAS
uguccguuguuuucacua

SEQ ID NO: 2208592 - RNA, 21 nt, Streptococcus pyogenes M1 GAS
uggucccacaccuacuaacaa

SEQ ID NO: 2208593 - RNA, 15 nt, Streptococcus pyogenes M1 GAS
ugguauucuuuuucc

SEQ ID NO: 2208594 - RNA, 21 nt, Streptococcus pyogenes M1 GAS
uggcuguauuuacugggucaa

SEQ ID NO: 2208595 - RNA, 18 nt, Streptococcus pyogenes M1 GAS
uggguaguugguacuuga

SEQ ID NO: 2208596 - RNA, 19 nt, Streptococcus pyogenes M1 GAS
ugggcuuuuuuguguucag

SEQ ID NO: 2208597 - RNA, 20 nt, Streptococcus pyogenes M1 GAS
ugcuuuugccacgcuucuua

SEQ ID NO: 2208598 - RNA, 20 nt, Streptococcus pyogenes M1 GAS
uggaaaaggaauaucaggca

SEQ ID NO: 2208599 - RNA, 21 nt, Streptococcus pyogenes M1 GAS
uaaaagauauuuuaaaauagu

SEQ ID NO: 2208600 - RNA, 16 nt, Streptococcus pyogenes M1 GAS
uaaaaugacugacaaa

SEQ ID NO: 2208601 - RNA, 16 nt, Streptococcus pyogenes M1 GAS
uaaaaugacuucaaaa

SEQ ID NO: 2208602 - RNA, 17 nt, Streptococcus pyogenes M1 GAS
uaacguuccaaaaagaa

SEQ ID NO: 2208603 - RNA, 18 nt, Streptococcus pyogenes M1 GAS
uaacccgucuuacaauua

SEQ ID NO: 2208604 - RNA, 16 nt, Streptococcus pyogenes M1 GAS
uacagcugguuuuuua

SEQ ID NO: 2208605 - RNA, 18 nt, Streptococcus pyogenes M1 GAS
uaagaccuucaaaaaagg

SEQ ID NO: 2208606 - RNA, 15 nt, Streptococcus pyogenes M1 GAS
uaagauggugcuuua

SEQ ID NO: 2208607 - RNA, 13 nt, Streptococcus pyogenes M1 GAS
uaagcuauagaaa

SEQ ID NO: 2208608 - RNA, 21 nt, Streptococcus pyogenes M1 GAS
uaagcuauagaaacuuuuuau

SEQ ID NO: 2208609 - RNA, 14 nt, Streptococcus pyogenes M1 GAS
uaaucaaaaaacug

SEQ ID NO: 2208610 - RNA, 11 nt, Streptococcus pyogenes M1 GAS
guuuucuuuag

SEQ ID NO: 2208611 - RNA, 19 nt, Streptococcus pyogenes M1 GAS
uaguacaguauguaaauau

SEQ ID NO: 2208612 - RNA, 20 nt, Streptococcus pyogenes M1 GAS
uagguucuuugguuugauga

SEQ ID NO: 2208613 - RNA, 21 nt, Streptococcus pyogenes M1 GAS
uagguaaaguuaggaaagaua

SEQ ID NO: 2208614 - RNA, 20 nt, Streptococcus pyogenes M1 GAS
uaggguagcugguuugauua

SEQ ID NO: 2208615 - RNA, 17 nt, Streptococcus pyogenes M1 GAS
uauagcaaucuucaaca

SEQ ID NO: 2208616 - RNA, 20 nt, Streptococcus pyogenes M1 GAS
uauauuuauggaguucuuga

SEQ ID NO: 2208617 - RNA, 13 nt, Streptococcus pyogenes M1 GAS
uauccucuuuuag

SEQ ID NO: 2208618 - RNA, 18 nt, Streptococcus pyogenes M1 GAS
uaucuuuuuuacuuuuaa

SEQ ID NO: 2208619 - RNA, 13 nt, Streptococcus pyogenes M1 GAS
uaucauucuaaca

SEQ ID NO: 2208620 - RNA, 16 nt, Streptococcus pyogenes M1 GAS
uauccauucuuuauaa

SEQ ID NO: 2208621 - RNA, 20 nt, Streptococcus pyogenes M1 GAS
uauuaaccggcucuaaaaua

SEQ ID NO: 2208622 - RNA, 19 nt, Streptococcus pyogenes M1 GAS
uauuaagauaccaaaucaa

SEQ ID NO: 2208623 - RNA, 21 nt, Streptococcus pyogenes M1 GAS
uauucuaaaauccucuuuuaa

SEQ ID NO: 2208624 - RNA, 20 nt, Streptococcus pyogenes M1 GAS
uagcuuuuuacaucaaaaaa

SEQ ID NO: 2208625 - RNA, 20 nt, Streptococcus pyogenes M1 GAS
uacgguaaaaacucaaaaaa

SEQ ID NO: 2208626 - RNA, 17 nt, Streptococcus pyogenes M1 GAS
uacucaucuaaaaaagc

SEQ ID NO: 2208627 - RNA, 18 nt, Streptococcus pyogenes M1 GAS
uacucaucuaaaaaagca

SEQ ID NO: 2208628 - RNA, 16 nt, Streptococcus pyogenes M1 GAS
uaccaaaucaaaaagc

SEQ ID NO: 2208629 - RNA, 18 nt, Streptococcus pyogenes M1 GAS
uaccuauugagucuuuuc

SEQ ID NO: 2208630 - RNA, 22 nt, Streptococcus pyogenes M1 GAS
uccuuagcaguuauaauuagua

SEQ ID NO: 2208631 - RNA, 15 nt, Streptococcus pyogenes M1 GAS
ugccaucagcaucug

SEQ ID NO: 2208632 - RNA, 16 nt, Streptococcus pyogenes M1 GAS
ugagcaaaacaauaac

SEQ ID NO: 2208633 - RNA, 17 nt, Streptococcus pyogenes M1 GAS
ugagauuaacugacaaa

SEQ ID NO: 2208634 - RNA, 13 nt, Streptococcus pyogenes M1 GAS
ugauauuucaucu

SEQ ID NO: 2208635 - RNA, 20 nt, Streptococcus pyogenes M1 GAS
ugauaugguggguaaaacca

SEQ ID NO: 2208636 - RNA, 15 nt, Streptococcus pyogenes M1 GAS
ugauuugucaaaaag

SEQ ID NO: 2208637 - RNA, 20 nt, Streptococcus pyogenes M1 GAS
ugcagagaugcuucuuucaa

SEQ ID NO: 2208638 - RNA, 22 nt, Streptococcus pyogenes M1 GAS
ucuuuauccauucuuuauaaug

SEQ ID NO: 2208639 - RNA, 12 nt, Streptococcus pyogenes M1 GAS
ugaaaaauuaug

SEQ ID NO: 2208640 - RNA, 21 nt, Streptococcus pyogenes M1 GAS
ucuuccuuguacaagagcuua

SEQ ID NO: 2208641 - RNA, 18 nt, Streptococcus pyogenes M1 GAS
ucuugaggugauucuuuu

SEQ ID NO: 2208642 - RNA, 13 nt, Streptococcus pyogenes M1 GAS
ucuugcuaaaauu

SEQ ID NO: 2208643 - RNA, 20 nt, Streptococcus pyogenes M1 GAS
ucuucuuguccgaucuuuug

SEQ ID NO: 2208644 - RNA, 21 nt, Streptococcus pyogenes M1 GAS
ucuguuucuaagcaaauagca

SEQ ID NO: 2208645 - RNA, 17 nt, Streptococcus pyogenes M1 GAS
ucugauaagguuuuuuu

SEQ ID NO: 2208646 - RNA, 17 nt, Streptococcus pyogenes M1 GAS
ucucuuuggagaaauuc

SEQ ID NO: 2208647 - RNA, 17 nt, Streptococcus pyogenes M1 GAS
ucucuuugggaaaaaca

SEQ ID NO: 2208648 - RNA, 22 nt, Streptococcus pyogenes M1 GAS
ucgcuuugaauacguaaaaaga

SEQ ID NO: 2208649 - RNA, 21 nt, Streptococcus pyogenes M1 GAS
ucggcaauacagugaauaaug

SEQ ID NO: 2208650 - RNA, 13 nt, Streptococcus pyogenes M1 GAS
gcuuuuuaauugu

SEQ ID NO: 2208651 - RNA, 15 nt, Streptococcus pyogenes M1 GAS
gcuuuuuuguguuca

SEQ ID NO: 2208652 - RNA, 18 nt, Streptococcus pyogenes M1 GAS
ggaggguuuuucuuuuga

SEQ ID NO: 2208653 - RNA, 21 nt, Streptococcus pyogenes M1 GAS
gcuaugcuuguaggacacuuu

SEQ ID NO: 2208654 - RNA, 23 nt, Streptococcus pyogenes M1 GAS
gcuaguaaguuuuuuuguaauug

SEQ ID NO: 2208655 - RNA, 16 nt, Streptococcus pyogenes M1 GAS
gcgaggcuuuuuugag

SEQ ID NO: 2208656 - RNA, 17 nt, Streptococcus pyogenes M1 GAS
guaaccauugccauuaa

SEQ ID NO: 2208657 - RNA, 16 nt, Streptococcus pyogenes M1 GAS
guaaaaauacuagaaa

SEQ ID NO: 2208658 - RNA, 17 nt, Streptococcus pyogenes M1 GAS
guaauagcguaaagcaa

SEQ ID NO: 2208659 - RNA, 13 nt, Streptococcus pyogenes M1 GAS
guaauccaacaac

SEQ ID NO: 2208660 - RNA, 12 nt, Streptococcus pyogenes M1 GAS
guauuucuuuag

SEQ ID NO: 2208661 - RNA, 20 nt, Streptococcus pyogenes M1 GAS
gucauggcgccguuuuucaa

SEQ ID NO: 2208662 - RNA, 23 nt, Streptococcus pyogenes M1 GAS
gucugauauugaucucugcaaca

SEQ ID NO: 2208663 - RNA, 20 nt, Streptococcus pyogenes M1 GAS
cggcuucuacacaaaagcuu

SEQ ID NO: 2208664 - RNA, 16 nt, Streptococcus pyogenes M1 GAS
ccuaacaauuuuucaa

SEQ ID NO: 2208665 - RNA, 13 nt, Streptococcus pyogenes M1 GAS
ccuaacaaaauca

SEQ ID NO: 2208666 - RNA, 17 nt, Streptococcus pyogenes M1 GAS
ccucuaacauguccaaa

SEQ ID NO: 2208667 - RNA, 19 nt, Streptococcus pyogenes M1 GAS
ccggcucuaaaauauauug

SEQ ID NO: 2208668 - RNA, 16 nt, Streptococcus pyogenes M1 GAS
cgaagucucuuuugug

SEQ ID NO: 2208669 - RNA, 18 nt, Streptococcus pyogenes M1 GAS
cuuuaucuuauuuuaaga

SEQ ID NO: 2208670 - RNA, 13 nt, Streptococcus pyogenes M1 GAS
cuuuugaaaaauu

SEQ ID NO: 2208671 - RNA, 22 nt, Streptococcus pyogenes M1 GAS
cuuuuuaaagagccucaggaca

SEQ ID NO: 2208672 - RNA, 23 nt, Streptococcus pyogenes M1 GAS
cuuuugcuucuagcucuuuauca

SEQ ID NO: 2208673 - RNA, 17 nt, Streptococcus pyogenes M1 GAS
cuuuuuuacuuuuaaaa

SEQ ID NO: 2208674 - RNA, 20 nt, Streptococcus pyogenes M1 GAS
cuuuuuuacuuuuaaaaucu

SEQ ID NO: 2208675 - RNA, 21 nt, Streptococcus pyogenes M1 GAS
cuuuuucguauacuuuaaaca

SEQ ID NO: 2208676 - RNA, 18 nt, Streptococcus pyogenes M1 GAS
gaaaguaaggguuaacaa

SEQ ID NO: 2208677 - RNA, 21 nt, Streptococcus pyogenes M1 GAS
cuuuacaucaaaggcuuuuug

SEQ ID NO: 2208678 - RNA, 14 nt, Streptococcus pyogenes M1 GAS
cuuguuuugguuga

SEQ ID NO: 2208679 - RNA, 15 nt, Streptococcus pyogenes M1 GAS
gaaauuaauaaauuu

SEQ ID NO: 2208680 - RNA, 19 nt, Streptococcus pyogenes M1 GAS
cuggcuuuuuugcuuuuua

SEQ ID NO: 2208681 - RNA, 17 nt, Streptococcus pyogenes M1 GAS
cuggcuuagcagcacca

SEQ ID NO: 2208682 - RNA, 20 nt, Streptococcus pyogenes M1 GAS
cuuauagcacguuggaaaag

SEQ ID NO: 2208683 - RNA, 16 nt, Streptococcus pyogenes M1 GAS
cuuauaguuugacuuc

SEQ ID NO: 2208684 - RNA, 11 nt, Streptococcus pyogenes M1 GAS
cuguucucuuu

SEQ ID NO: 2208685 - RNA, 23 nt, Streptococcus pyogenes M1 GAS
cuguucucuuuggagaaauucaa

SEQ ID NO: 2208686 - RNA, 14 nt, Streptococcus pyogenes M1 GAS
gagaucuucuuuug

SEQ ID NO: 2208687 - RNA, 15 nt, Streptococcus pyogenes M1 GAS
gaauuuuuauaacaa

SEQ ID NO: 2208688 - RNA, 13 nt, Streptococcus pyogenes M1 GAS
cuacuaaaaaagg

SEQ ID NO: 2208689 - RNA, 16 nt, Streptococcus pyogenes M1 GAS
cuacagacaagucuug

SEQ ID NO: 2208690 - RNA, 13 nt, Streptococcus pyogenes M1 GAS
cuauauuguuagu

SEQ ID NO: 2208691 - RNA, 16 nt, Streptococcus pyogenes M1 GAS
cucaauuuuugauuuu

SEQ ID NO: 2208692 - RNA, 15 nt, Streptococcus pyogenes M1 GAS
cugaugacuuguaaa

SEQ ID NO: 2208693 - RNA, 14 nt, Streptococcus pyogenes M1 GAS
cguaacuugcuuug

SEQ ID NO: 2208694 - RNA, 16 nt, Streptococcus pyogenes M1 GAS
cguaacguaauagaau

SEQ ID NO: 2208695 - RNA, 18 nt, Streptococcus pyogenes M1 GAS
cguuauuaaagacaaaaa

SEQ ID NO: 2208696 - RNA, 14 nt, Streptococcus pyogenes M1 GAS
cguguaccaagcuu

SEQ ID NO: 2208697 - RNA, 12 nt, Streptococcus pyogenes M1 GAS
cgucuaaaaagc

SEQ ID NO: 2208698 - RNA, 14 nt, Streptococcus pyogenes M1 GAS
gccaaaucuggcuu

SEQ ID NO: 2208699 - RNA, 13 nt, Streptococcus pyogenes M1 GAS
gcauuuguuuuga

SEQ ID NO: 2208700 - RNA, 15 nt, Streptococcus pyogenes M1 GAS
gcaauccaaaucaac

SEQ ID NO: 2208701 - RNA, 17 nt, Streptococcus pyogenes M1 GAS
gcaauaacaucuugauu

SEQ ID NO: 2208702 - RNA, 16 nt, Streptococcus pyogenes M1 GAS
gcaauuaaguaauugg

SEQ ID NO: 2208703 - RNA, 17 nt, Streptococcus pyogenes M1 GAS
gcaaaaugcuguuuguc

SEQ ID NO: 2208704 - RNA, 18 nt, Streptococcus pyogenes M1 GAS
gcaaaauuauuauuuugc

SEQ ID NO: 2208705 - RNA, 17 nt, Streptococcus pyogenes M1 GAS
gauuauucuuuauuuuu

SEQ ID NO: 2208706 - RNA, 19 nt, Streptococcus pyogenes M1 GAS
gauaaaacucaaaaagcau

SEQ ID NO: 2208707 - RNA, 16 nt, Streptococcus pyogenes M1 GAS
gaguggauacaagguu

SEQ ID NO: 2208708 - RNA, 19 nt, Streptococcus pyogenes M1 GAS
gauccuuuaucuuauuuua

SEQ ID NO: 2208709 - RNA, 21 nt, Streptococcus pyogenes M1 GAS
cagaggcuugcauuuuuugua

SEQ ID NO: 2208710 - RNA, 20 nt, Streptococcus pyogenes M1 GAS
cagcauaaccuuugccauuu

SEQ ID NO: 2208711 - RNA, 14 nt, Streptococcus pyogenes M1 GAS
cauagcuaauccaa

SEQ ID NO: 2208712 - RNA, 15 nt, Streptococcus pyogenes M1 GAS
caucaauguuuugcu

SEQ ID NO: 2208713 - RNA, 17 nt, Streptococcus pyogenes M1 GAS
caguccuccucuuuaga

SEQ ID NO: 2208714 - RNA, 23 nt, Streptococcus pyogenes M1 GAS
caggauugccaucaauguuuugc

SEQ ID NO: 2208715 - RNA, 21 nt, Streptococcus pyogenes M1 GAS
cagcugacagccucuuggaaa

SEQ ID NO: 2208716 - RNA, 22 nt, Streptococcus pyogenes M1 GAS
cagcuaaaagcauaaaaauauu

SEQ ID NO: 2208717 - RNA, 21 nt, Streptococcus pyogenes M1 GAS
ccaauauagcaaucuucaaca

SEQ ID NO: 2208718 - RNA, 20 nt, Streptococcus pyogenes M1 GAS
ccaagggcaauaauuuucaa

SEQ ID NO: 2208719 - RNA, 19 nt, Streptococcus pyogenes M1 GAS
cauuuaugcugauuuugga

SEQ ID NO: 2208720 - RNA, 18 nt, Streptococcus pyogenes M1 GAS
cauuuagcugauaaucuu

SEQ ID NO: 2208721 - RNA, 13 nt, Streptococcus pyogenes M1 GAS
ccaaaaagaaagg

SEQ ID NO: 2208722 - RNA, 16 nt, Streptococcus pyogenes M1 GAS
cauuucuucagguuuc

SEQ ID NO: 2208723 - RNA, 21 nt, Streptococcus pyogenes M1 GAS
cauuauugacaaauccaauga

SEQ ID NO: 2208724 - RNA, 15 nt, Streptococcus pyogenes M1 GAS
cauuaaagcuaucau

SEQ ID NO: 2208725 - RNA, 14 nt, Streptococcus pyogenes M1 GAS
caugggaaaagcua

SEQ ID NO: 2208726 - RNA, 16 nt, Streptococcus pyogenes M1 GAS
auaucccaucuuuguu

SEQ ID NO: 2208727 - RNA, 21 nt, Streptococcus pyogenes M1 GAS
aucaauaacagaaauuaauaa

SEQ ID NO: 2208728 - RNA, 12 nt, Streptococcus pyogenes M1 GAS
aucaaaaaaaga

SEQ ID NO: 2208729 - RNA, 13 nt, Streptococcus pyogenes M1 GAS
aucaaaaaaagca

SEQ ID NO: 2208730 - RNA, 21 nt, Streptococcus pyogenes M1 GAS
aucaaccucucagcugucgcg

SEQ ID NO: 2208731 - RNA, 22 nt, Streptococcus pyogenes M1 GAS
auacguuuauuuaguuauuuuu

SEQ ID NO: 2208732 - RNA, 13 nt, Streptococcus pyogenes M1 GAS
auaauuucaauaa

SEQ ID NO: 2208733 - RNA, 18 nt, Streptococcus pyogenes M1 GAS
auaaucccuugcuuugau

SEQ ID NO: 2208734 - RNA, 22 nt, Streptococcus pyogenes M1 GAS
auaaaaucguuauuaauuguuu

SEQ ID NO: 2208735 - RNA, 14 nt, Streptococcus pyogenes M1 GAS
auaaacuugaauau

SEQ ID NO: 2208736 - RNA, 15 nt, Streptococcus pyogenes M1 GAS
aguuccucgguuuuu

SEQ ID NO: 2208737 - RNA, 23 nt, Streptococcus pyogenes M1 GAS
aguuccucgguuuuuuuaaguaa

SEQ ID NO: 2208738 - RNA, 13 nt, Streptococcus pyogenes M1 GAS
agugguauagaca

SEQ ID NO: 2208739 - RNA, 20 nt, Streptococcus pyogenes M1 GAS
aggucuaauuagcauauuuu

SEQ ID NO: 2208740 - RNA, 18 nt, Streptococcus pyogenes M1 GAS
agggucaaacugaugguu

SEQ ID NO: 2208741 - RNA, 15 nt, Streptococcus pyogenes M1 GAS
agguuaaaauagaag

SEQ ID NO: 2208742 - RNA, 19 nt, Streptococcus pyogenes M1 GAS
aguauacaucaacuaucaa

SEQ ID NO: 2208743 - RNA, 21 nt, Streptococcus pyogenes M1 GAS
aguccuuuuaguuuuauuuug

SEQ ID NO: 2208744 - RNA, 18 nt, Streptococcus pyogenes M1 GAS
agcaauggcuaaaaagag

SEQ ID NO: 2208745 - RNA, 16 nt, Streptococcus pyogenes M1 GAS
agauuaaacuuacaaa

SEQ ID NO: 2208746 - RNA, 16 nt, Streptococcus pyogenes M1 GAS
agcaaauuguuugauu

SEQ ID NO: 2208747 - RNA, 18 nt, Streptococcus pyogenes M1 GAS
agagauuucguugacaaa

SEQ ID NO: 2208748 - RNA, 13 nt, Streptococcus pyogenes M1 GAS
agagcuuuuuuug

SEQ ID NO: 2208749 - RNA, 21 nt, Streptococcus pyogenes M1 GAS
agagcuuuuuuuguuuuggcc

SEQ ID NO: 2208750 - RNA, 18 nt, Streptococcus pyogenes M1 GAS
agagagcuuaucaagguu

SEQ ID NO: 2208751 - RNA, 15 nt, Streptococcus pyogenes M1 GAS
agauauucuuuggca

SEQ ID NO: 2208752 - RNA, 20 nt, Streptococcus pyogenes M1 GAS
agcaugacuguauguaucaa

SEQ ID NO: 2208753 - RNA, 22 nt, Streptococcus pyogenes M1 GAS
agcguguaccaagcuugaucuu

SEQ ID NO: 2208754 - RNA, 13 nt, Streptococcus pyogenes M1 GAS
aucuuauuuuuua

SEQ ID NO: 2208755 - RNA, 23 nt, Streptococcus pyogenes M1 GAS
aucuaggagggacugucaaaaaa

SEQ ID NO: 2208756 - RNA, 15 nt, Streptococcus pyogenes M1 GAS
aucuaagcuuggauu

SEQ ID NO: 2208757 - RNA, 24 nt, Streptococcus pyogenes M1 GAS
augauaaaggccuguauuucuuua

SEQ ID NO: 2208758 - RNA, 13 nt, Streptococcus pyogenes M1 GAS
aucuuugacaaug

SEQ ID NO: 2208759 - RNA, 17 nt, Streptococcus pyogenes M1 GAS
auugcagcuaaaaacaa

SEQ ID NO: 2208760 - RNA, 19 nt, Streptococcus pyogenes M1 GAS
auugagaauuuuuauaaca

SEQ ID NO: 2208761 - RNA, 17 nt, Streptococcus pyogenes M1 GAS
auuguagggauuuuuua

SEQ ID NO: 2208762 - RNA, 22 nt, Streptococcus pyogenes M1 GAS
auuggccuucuuggaaaacaga

SEQ ID NO: 2208763 - RNA, 23 nt, Streptococcus pyogenes M1 GAS
auugcuuccaacuccugauaaug

SEQ ID NO: 2208764 - RNA, 21 nt, Streptococcus pyogenes M1 GAS
auuauuaguaaccauagaagc

SEQ ID NO: 2208765 - RNA, 13 nt, Streptococcus pyogenes M1 GAS
auuaugaaaaaga

SEQ ID NO: 2208766 - RNA, 18 nt, Streptococcus pyogenes M1 GAS
caaaaugcuguuugucau

SEQ ID NO: 2208767 - RNA, 19 nt, Streptococcus pyogenes M1 GAS
caaauaguagcaaauaaca

SEQ ID NO: 2208768 - RNA, 15 nt, Streptococcus pyogenes M1 GAS
caacaacccuugauu

SEQ ID NO: 2208769 - RNA, 16 nt, Streptococcus pyogenes M1 GAS
caaauugaaaaaaucg

SEQ ID NO: 2208770 - RNA, 20 nt, Streptococcus pyogenes M1 GAS
caauauaauaaaaagcaguu

SEQ ID NO: 2208771 - RNA, 19 nt, Streptococcus pyogenes M1 GAS
cacaauuagccaaagaagg

SEQ ID NO: 2208772 - RNA, 16 nt, Streptococcus pyogenes M1 GAS
acccuugauuaauagc

SEQ ID NO: 2208773 - RNA, 17 nt, Streptococcus pyogenes M1 GAS
accauuauaaaagagug

SEQ ID NO: 2208774 - RNA, 19 nt, Streptococcus pyogenes M1 GAS
accaauuguugaauaagug

SEQ ID NO: 2208775 - RNA, 14 nt, Streptococcus pyogenes M1 GAS
acaucaaaaaaagc

SEQ ID NO: 2208776 - RNA, 18 nt, Streptococcus pyogenes M1 GAS
acaucaaaaaaagcaaug

SEQ ID NO: 2208777 - RNA, 14 nt, Streptococcus pyogenes M1 GAS
acuuugcaaaagaa

SEQ ID NO: 2208778 - RNA, 17 nt, Streptococcus pyogenes M1 GAS
acuuuauuaaucaaaaa

SEQ ID NO: 2208779 - RNA, 23 nt, Streptococcus pyogenes M1 GAS
acuuucguaaggguuauuauuua

SEQ ID NO: 2208780 - RNA, 20 nt, Streptococcus pyogenes M1 GAS
acuuaccagcaccuucuuuu

SEQ ID NO: 2208781 - RNA, 12 nt, Streptococcus pyogenes M1 GAS
acuuauuuuuuu

SEQ ID NO: 2208782 - RNA, 13 nt, Streptococcus pyogenes M1 GAS
acuucaaaaauac

SEQ ID NO: 2208783 - RNA, 12 nt, Streptococcus pyogenes M1 GAS
acuucaaaauca

SEQ ID NO: 2208784 - RNA, 14 nt, Streptococcus pyogenes M1 GAS
acuucacauuguau

SEQ ID NO: 2208785 - RNA, 22 nt, Streptococcus pyogenes M1 GAS
acugucaaaaaauuaagaagga

SEQ ID NO: 2208786 - RNA, 17 nt, Streptococcus pyogenes M1 GAS
acucaaaccaaacaagc

SEQ ID NO: 2208787 - RNA, 23 nt, Streptococcus pyogenes M1 GAS
acucuagcauaaaagauauuuua

SEQ ID NO: 2208788 - RNA, 17 nt, Streptococcus pyogenes M1 GAS
acuguaauauuuccuuu

SEQ ID NO: 2208789 - RNA, 21 nt, Streptococcus pyogenes M1 GAS
acuaucugaguccgagaaaga

SEQ ID NO: 2208790 - RNA, 20 nt, Streptococcus pyogenes M1 GAS
acuauggcuucuaaaaaagu

SEQ ID NO: 2208791 - RNA, 20 nt, Streptococcus pyogenes M1 GAS
acuaaggcugaugacuugua

SEQ ID NO: 2208792 - RNA, 15 nt, Streptococcus pyogenes M1 GAS
acuaagguuacccuu

SEQ ID NO: 2208793 - RNA, 15 nt, Streptococcus pyogenes M1 GAS
uuaaguggaauguuu

SEQ ID NO: 2208794 - RNA, 12 nt, Streptococcus pyogenes M1 GAS
uuacaaaaaaca

SEQ ID NO: 2208795 - RNA, 19 nt, Streptococcus pyogenes M1 GAS
uguuuacaguugugugacu

SEQ ID NO: 2208796 - RNA, 24 nt, Streptococcus pyogenes M1 GAS
uguuuaacccccuaaacuaauaag

SEQ ID NO: 2208797 - RNA, 18 nt, Streptococcus pyogenes M1 GAS
uguuguucuaaguuuuua

SEQ ID NO: 2208798 - RNA, 22 nt, Streptococcus pyogenes M1 GAS
uguguuguauagguagaugauu

SEQ ID NO: 2208799 - RNA, 22 nt, Streptococcus pyogenes M1 GAS
uuauaccaaauuucagauaaga

SEQ ID NO: 2208800 - RNA, 22 nt, Streptococcus pyogenes M1 GAS
uuauacgguaaaaacucaaaaa

SEQ ID NO: 2208801 - RNA, 19 nt, Streptococcus pyogenes M1 GAS
uuauuaauaaguauucuaa

SEQ ID NO: 2208802 - RNA, 14 nt, Streptococcus pyogenes M1 GAS
uuaugagauuagca

SEQ ID NO: 2208803 - RNA, 22 nt, Streptococcus pyogenes M1 GAS
uucaagaacuccuggauuaaau

SEQ ID NO: 2208804 - RNA, 20 nt, Streptococcus pyogenes M1 GAS
uugaaccaacuuggacgaag

SEQ ID NO: 2208805 - RNA, 22 nt, Streptococcus pyogenes M1 GAS
uugagacuaaaggucugcuucu

SEQ ID NO: 2208806 - RNA, 21 nt, Streptococcus pyogenes M1 GAS
uucuuucaaacggaguuccuc

SEQ ID NO: 2208807 - RNA, 23 nt, Streptococcus pyogenes M1 GAS
uucuaguucguucauaaauucua

SEQ ID NO: 2208808 - RNA, 20 nt, Streptococcus pyogenes M1 GAS
uuuagugguauagacaaaca

SEQ ID NO: 2208809 - RNA, 20 nt, Streptococcus pyogenes M1 GAS
uuuauuuugauauuuuuucu

SEQ ID NO: 2208810 - RNA, 14 nt, Streptococcus pyogenes M1 GAS
uuucagugguaaug

SEQ ID NO: 2208811 - RNA, 15 nt, Streptococcus pyogenes M1 GAS
uuguaucucauaaca

SEQ ID NO: 2208812 - RNA, 17 nt, Streptococcus pyogenes M1 GAS
uuguucuaaguuuuuau

SEQ ID NO: 2208813 - RNA, 23 nt, Streptococcus pyogenes M1 GAS
uuuagcuuauaguuugacuucaa

SEQ ID NO: 2208814 - RNA, 15 nt, Streptococcus pyogenes M1 GAS
uugggagaguuccug

SEQ ID NO: 2208815 - RNA, 18 nt, Streptococcus pyogenes M1 GAS
uugcugagcuaaagccaa

SEQ ID NO: 2208816 - RNA, 15 nt, Streptococcus pyogenes M1 GAS
uugcuaagagaauaa

SEQ ID NO: 2208817 - RNA, 22 nt, Streptococcus pyogenes M1 GAS
aauuucagauaagaccuucaaa

SEQ ID NO: 2208818 - RNA, 13 nt, Streptococcus pyogenes M1 GAS
aauuuaagguauu

SEQ ID NO: 2208819 - RNA, 15 nt, Streptococcus pyogenes M1 GAS
aauucagcaucguua

SEQ ID NO: 2208820 - RNA, 22 nt, Streptococcus pyogenes M1 GAS
aauuaagaaggaacucuccaaa

SEQ ID NO: 2208821 - RNA, 20 nt, Streptococcus pyogenes M1 GAS
aauuagcauauuuugauuac

SEQ ID NO: 2208822 - RNA, 22 nt, Streptococcus pyogenes M1 GAS
aauuagccaaagaaggccagca

SEQ ID NO: 2208823 - RNA, 15 nt, Streptococcus pyogenes M1 GAS
uuuugggguuauccu

SEQ ID NO: 2208824 - RNA, 23 nt, Streptococcus pyogenes M1 GAS
uuuuucucaaaaauauauucuaa

SEQ ID NO: 2208825 - RNA, 22 nt, Streptococcus pyogenes M1 GAS
aaucuucaacaccuucguauug

SEQ ID NO: 2208826 - RNA, 13 nt, Streptococcus pyogenes M1 GAS
uuuucauuuuuau

SEQ ID NO: 2208827 - RNA, 20 nt, Streptococcus pyogenes M1 GAS
uuuucacaauuagccaaaga

SEQ ID NO: 2208828 - RNA, 18 nt, Streptococcus pyogenes M1 GAS
uuuugccuuuaacaugau

SEQ ID NO: 2208829 - RNA, 16 nt, Streptococcus pyogenes M1 GAS
uuuucuaguucguuca

SEQ ID NO: 2208830 - RNA, 17 nt, Streptococcus pyogenes M1 GAS
uuuuauccccuauucaa

SEQ ID NO: 2208831 - RNA, 17 nt, Streptococcus pyogenes M1 GAS
uuuuaucuguauauuua

SEQ ID NO: 2208832 - RNA, 18 nt, Streptococcus pyogenes M1 GAS
uuuuauaaugguuuuuuu

SEQ ID NO: 2208833 - RNA, 22 nt, Streptococcus pyogenes M1 GAS
uuuuaagggcaaugccaucugc

SEQ ID NO: 2208834 - RNA, 16 nt, Streptococcus pyogenes M1 GAS
ugcucuuguuuucuca

SEQ ID NO: 2208835 - RNA, 20 nt, Streptococcus pyogenes M1 GAS
aauaucagcuacacuugauu

SEQ ID NO: 2208836 - RNA, 15 nt, Streptococcus pyogenes M1 GAS
uggacuaucugaguc

SEQ ID NO: 2208837 - RNA, 16 nt, Streptococcus pyogenes M1 GAS
uggaccauuaucaaua

SEQ ID NO: 2208838 - RNA, 20 nt, Streptococcus pyogenes M1 GAS
ugucauggcccgguucguua

SEQ ID NO: 2208839 - RNA, 12 nt, Streptococcus pyogenes M1 GAS
aaucaaaaaacu

SEQ ID NO: 2208840 - RNA, 17 nt, Streptococcus pyogenes M1 GAS
uggcuacucuauuuuaa

SEQ ID NO: 2208841 - RNA, 16 nt, Streptococcus pyogenes M1 GAS
guucauauaagcaauc

SEQ ID NO: 2208842 - RNA, 14 nt, Streptococcus pyogenes M1 GAS
guuagucugaauug

SEQ ID NO: 2208843 - RNA, 17 nt, Streptococcus pyogenes M1 GAS
guuauagcuccuaaaac

SEQ ID NO: 2208844 - RNA, 20 nt, Streptococcus pyogenes M1 GAS
guggguuucguugacaacaa

SEQ ID NO: 2208845 - RNA, 21 nt, Streptococcus pyogenes M1 GAS
guugcaagugacaaccuuaaa

SEQ ID NO: 2208846 - RNA, 21 nt, Streptococcus pyogenes M1 GAS
guuucuugccuuuauauuuau

SEQ ID NO: 2208847 - RNA, 13 nt, Streptococcus pyogenes M1 GAS
guuuugguugaua

SEQ ID NO: 2208848 - RNA, 21 nt, Streptococcus pyogenes M1 GAS
uaaaaugacuucaaaaucacc

SEQ ID NO: 2208849 - RNA, 22 nt, Streptococcus pyogenes M1 GAS
uacaaucaggacagucuuuuuu

SEQ ID NO: 2208850 - RNA, 18 nt, Streptococcus pyogenes M1 GAS
uacacgugauaaaugccg

SEQ ID NO: 2208851 - RNA, 20 nt, Streptococcus pyogenes M1 GAS
uaauuucaauaauaccauuu

SEQ ID NO: 2208852 - RNA, 16 nt, Streptococcus pyogenes M1 GAS
uacaucaaaaaaagca

SEQ ID NO: 2208853 - RNA, 19 nt, Streptococcus pyogenes M1 GAS
uacaucaaaaaaagcaaug

SEQ ID NO: 2208854 - RNA, 22 nt, Streptococcus pyogenes M1 GAS
uacaugaccuuccccaucaaga

SEQ ID NO: 2208855 - RNA, 13 nt, Streptococcus pyogenes M1 GAS
uaaucaaaaaacu

SEQ ID NO: 2208856 - RNA, 20 nt, Streptococcus pyogenes M1 GAS
uaacugguccaucauugaug

SEQ ID NO: 2208857 - RNA, 18 nt, Streptococcus pyogenes M1 GAS
ucauuuuuauuuaagcaa

SEQ ID NO: 2208858 - RNA, 21 nt, Streptococcus pyogenes M1 GAS
uccaaaaagaaaggaauugaa

SEQ ID NO: 2208859 - RNA, 14 nt, Streptococcus pyogenes M1 GAS
ucauuauugucacu

SEQ ID NO: 2208860 - RNA, 20 nt, Streptococcus pyogenes M1 GAS
ucaucauuuagcugauaauc

SEQ ID NO: 2208861 - RNA, 14 nt, Streptococcus pyogenes M1 GAS
ucagcaucugaaaa

SEQ ID NO: 2208862 - RNA, 20 nt, Streptococcus pyogenes M1 GAS
ucagaagcuuuaucauacuc

SEQ ID NO: 2208863 - RNA, 19 nt, Streptococcus pyogenes M1 GAS
aauaagcccuuaaucuaaa

SEQ ID NO: 2208864 - RNA, 19 nt, Streptococcus pyogenes M1 GAS
ucacuauaauuucaauaau

SEQ ID NO: 2208865 - RNA, 21 nt, Streptococcus pyogenes M1 GAS
uaucugauaagguuuuuuuaa

SEQ ID NO: 2208866 - RNA, 19 nt, Streptococcus pyogenes M1 GAS
uauuagucuuuaaaaaacg

SEQ ID NO: 2208867 - RNA, 23 nt, Streptococcus pyogenes M1 GAS
uauuaagauaccaaaucaaaaag

SEQ ID NO: 2208868 - RNA, 16 nt, Streptococcus pyogenes M1 GAS
uauacgguaaaaacuc

SEQ ID NO: 2208869 - RNA, 13 nt, Streptococcus pyogenes M1 GAS
uauaucuaugauu

SEQ ID NO: 2208870 - RNA, 12 nt, Streptococcus pyogenes M1 GAS
uaucauacucuu

SEQ ID NO: 2208871 - RNA, 16 nt, Streptococcus pyogenes M1 GAS
uaucccuggaccauua

SEQ ID NO: 2208872 - RNA, 18 nt, Streptococcus pyogenes M1 GAS
ucaauauaauaaaaagca

SEQ ID NO: 2208873 - RNA, 21 nt, Streptococcus pyogenes M1 GAS
ucaaagggauuacgauuaaaa

SEQ ID NO: 2208874 - RNA, 13 nt, Streptococcus pyogenes M1 GAS
uacuagaaaaagc

SEQ ID NO: 2208875 - RNA, 14 nt, Streptococcus pyogenes M1 GAS
uacuagaaaaagca

SEQ ID NO: 2208876 - RNA, 19 nt, Streptococcus pyogenes M1 GAS
uagcaaaaugcuguuuguc

SEQ ID NO: 2208877 - RNA, 19 nt, Streptococcus pyogenes M1 GAS
uacuuuauuaaucaaaaaa

SEQ ID NO: 2208878 - RNA, 15 nt, Streptococcus pyogenes M1 GAS
uaccagauaaauagu

SEQ ID NO: 2208879 - RNA, 20 nt, Streptococcus pyogenes M1 GAS
uagcaauuguuuuuucaaca

SEQ ID NO: 2208880 - RNA, 21 nt, Streptococcus pyogenes M1 GAS
uagccuuuuuuugucugacuu

SEQ ID NO: 2208881 - RNA, 18 nt, Streptococcus pyogenes M1 GAS
aaguugccuuaucucagu

SEQ ID NO: 2208882 - RNA, 16 nt, Streptococcus pyogenes M1 GAS
aauaaagaaaaagucu

SEQ ID NO: 2208883 - RNA, 18 nt, Streptococcus pyogenes M1 GAS
ucggaaaacuuuugacuu

SEQ ID NO: 2208884 - RNA, 21 nt, Streptococcus pyogenes M1 GAS
ucggaacagcugaaacaccug

SEQ ID NO: 2208885 - RNA, 15 nt, Streptococcus pyogenes M1 GAS
ugcaaaagaauugaa

SEQ ID NO: 2208886 - RNA, 16 nt, Streptococcus pyogenes M1 GAS
ugauuuuaauuuuucu

SEQ ID NO: 2208887 - RNA, 16 nt, Streptococcus pyogenes M1 GAS
ugacuuguaaaaugau

SEQ ID NO: 2208888 - RNA, 21 nt, Streptococcus pyogenes M1 GAS
ugcaguguacucaucuaaaaa

SEQ ID NO: 2208889 - RNA, 19 nt, Streptococcus pyogenes M1 GAS
ucuauugucguugaugcaa

SEQ ID NO: 2208890 - RNA, 14 nt, Streptococcus pyogenes M1 GAS
ucuacuugucauga

SEQ ID NO: 2208891 - RNA, 16 nt, Streptococcus pyogenes M1 GAS
ucuugcagaauagaaa

SEQ ID NO: 2208892 - RNA, 21 nt, Streptococcus pyogenes M1 GAS
ugaaaagaugcacacaaaucu

SEQ ID NO: 2208893 - RNA, 16 nt, Streptococcus pyogenes M1 GAS
ucuuuuggaccacucg

SEQ ID NO: 2208894 - RNA, 14 nt, Streptococcus pyogenes M1 GAS
ugaauucuaaaaua

SEQ ID NO: 2208895 - RNA, 17 nt, Streptococcus pyogenes M1 GAS
ugaacuauucuagacuc

SEQ ID NO: 2208896 - RNA, 21 nt, Streptococcus pyogenes M1 GAS
agcuccaacgaccuccagcug

SEQ ID NO: 2208897 - RNA, 20 nt, Streptococcus pyogenes M1 GAS
agcuacacuugauuucauuu

SEQ ID NO: 2208898 - RNA, 23 nt, Streptococcus pyogenes M1 GAS
agcuagauugcuuccaacuccug

SEQ ID NO: 2208899 - RNA, 13 nt, Streptococcus pyogenes M1 GAS
aggagaacgguau

SEQ ID NO: 2208900 - RNA, 14 nt, Streptococcus pyogenes M1 GAS
agauuaacugacaa

SEQ ID NO: 2208901 - RNA, 14 nt, Streptococcus pyogenes M1 GAS
agauuucguugaca

SEQ ID NO: 2208902 - RNA, 14 nt, Streptococcus pyogenes M1 GAS
agcauauuuugauu

SEQ ID NO: 2208903 - RNA, 14 nt, Streptococcus pyogenes M1 GAS
aucauuuugguuga

SEQ ID NO: 2208904 - RNA, 15 nt, Streptococcus pyogenes M1 GAS
aucauuauugacaaa

SEQ ID NO: 2208905 - RNA, 17 nt, Streptococcus pyogenes M1 GAS
auccauucuuuauaaug

SEQ ID NO: 2208906 - RNA, 22 nt, Streptococcus pyogenes M1 GAS
auauuuccuuuuaaagacauca

SEQ ID NO: 2208907 - RNA, 20 nt, Streptococcus pyogenes M1 GAS
aucaaaaaucuuuuucuuuu

SEQ ID NO: 2208908 - RNA, 14 nt, Streptococcus pyogenes M1 GAS
aucaaaaaaagcaa

SEQ ID NO: 2208909 - RNA, 14 nt, Streptococcus pyogenes M1 GAS
aucaacgauuacaa

SEQ ID NO: 2208910 - RNA, 18 nt, Streptococcus pyogenes M1 GAS
auauucuuuggcaagaua

SEQ ID NO: 2208911 - RNA, 20 nt, Streptococcus pyogenes M1 GAS
auaccauuucuuugcaaaag

SEQ ID NO: 2208912 - RNA, 20 nt, Streptococcus pyogenes M1 GAS
auaaucuucaauuuuugcca

SEQ ID NO: 2208913 - RNA, 14 nt, Streptococcus pyogenes M1 GAS
aguuauucccauau

SEQ ID NO: 2208914 - RNA, 18 nt, Streptococcus pyogenes M1 GAS
aguugguacuugauaauc

SEQ ID NO: 2208915 - RNA, 18 nt, Streptococcus pyogenes M1 GAS
aguugugucuuuucuuuu

SEQ ID NO: 2208916 - RNA, 23 nt, Streptococcus pyogenes M1 GAS
aguugugucuuuucuuuuuggcu

SEQ ID NO: 2208917 - RNA, 13 nt, Streptococcus pyogenes M1 GAS
auaaaccaagcua

SEQ ID NO: 2208918 - RNA, 21 nt, Streptococcus pyogenes M1 GAS
auaaaggccuguauuucuuua

SEQ ID NO: 2208919 - RNA, 13 nt, Streptococcus pyogenes M1 GAS
auaaagaaaaagu

SEQ ID NO: 2208920 - RNA, 14 nt, Streptococcus pyogenes M1 GAS
agucauuucuucag

SEQ ID NO: 2208921 - RNA, 18 nt, Streptococcus pyogenes M1 GAS
auuaauuuacuaauccuu

SEQ ID NO: 2208922 - RNA, 22 nt, Streptococcus pyogenes M1 GAS
auuagaauccuccucuuuuuuu

SEQ ID NO: 2208923 - RNA, 13 nt, Streptococcus pyogenes M1 GAS
auuauucuuuauu

SEQ ID NO: 2208924 - RNA, 21 nt, Streptococcus pyogenes M1 GAS
aaacuaggccaauccuaacaa

SEQ ID NO: 2208925 - RNA, 15 nt, Streptococcus pyogenes M1 GAS
aaacuacaccauuua

SEQ ID NO: 2208926 - RNA, 22 nt, Streptococcus pyogenes M1 GAS
auuucaaguucucuacuuguca

SEQ ID NO: 2208927 - RNA, 18 nt, Streptococcus pyogenes M1 GAS
auuuaauaggcuuuuuuu

SEQ ID NO: 2208928 - RNA, 18 nt, Streptococcus pyogenes M1 GAS
auugccaucgacgaugug

SEQ ID NO: 2208929 - RNA, 19 nt, Streptococcus pyogenes M1 GAS
auugucguugaugcaaaua

SEQ ID NO: 2208930 - RNA, 14 nt, Streptococcus pyogenes M1 GAS
auuuuauuaauaag

SEQ ID NO: 2208931 - RNA, 22 nt, Streptococcus pyogenes M1 GAS
auuuuauuaauaaguauucuaa

SEQ ID NO: 2208932 - RNA, 14 nt, Streptococcus pyogenes M1 GAS
auuucuuucauguu

SEQ ID NO: 2208933 - RNA, 22 nt, Streptococcus pyogenes M1 GAS
auuugucaaaaaguaaaaagca

SEQ ID NO: 2208934 - RNA, 15 nt, Streptococcus pyogenes M1 GAS
caaauuucagauaag

SEQ ID NO: 2208935 - RNA, 14 nt, Streptococcus pyogenes M1 GAS
caaauccuuuugcu

SEQ ID NO: 2208936 - RNA, 21 nt, Streptococcus pyogenes M1 GAS
caaacaagcgggucucuuugg

SEQ ID NO: 2208937 - RNA, 22 nt, Streptococcus pyogenes M1 GAS
augacuuguaaaaugauacuuu

SEQ ID NO: 2208938 - RNA, 19 nt, Streptococcus pyogenes M1 GAS
aucgacaacauccauacca

SEQ ID NO: 2208939 - RNA, 20 nt, Streptococcus pyogenes M1 GAS
augggcuaaguagauacuuu

SEQ ID NO: 2208940 - RNA, 19 nt, Streptococcus pyogenes M1 GAS
augccauuuaaaagggcaa

SEQ ID NO: 2208941 - RNA, 15 nt, Streptococcus pyogenes M1 GAS
augccaaucuuugug

SEQ ID NO: 2208942 - RNA, 18 nt, Streptococcus pyogenes M1 GAS
augcgaggcuuuuuugag

SEQ ID NO: 2208943 - RNA, 21 nt, Streptococcus pyogenes M1 GAS
caauaaggucaucagaauaag

SEQ ID NO: 2208944 - RNA, 17 nt, Streptococcus pyogenes M1 GAS
caacuuaccagcaccuu

SEQ ID NO: 2208945 - RNA, 13 nt, Streptococcus pyogenes M1 GAS
caagcauuuugca

SEQ ID NO: 2208946 - RNA, 18 nt, Streptococcus pyogenes M1 GAS
caagcaacacgcuaucaa

SEQ ID NO: 2208947 - RNA, 17 nt, Streptococcus pyogenes M1 GAS
caagaauagcuuuugua

SEQ ID NO: 2208948 - RNA, 17 nt, Streptococcus pyogenes M1 GAS
caaugagaucuucuuuu

SEQ ID NO: 2208949 - RNA, 21 nt, Streptococcus pyogenes M1 GAS
cagaaauuaauaaauuuuugu

SEQ ID NO: 2208950 - RNA, 23 nt, Streptococcus pyogenes M1 GAS
cagauugaagacaaacaucgauu

SEQ ID NO: 2208951 - RNA, 15 nt, Streptococcus pyogenes M1 GAS
caucuacagcaccuu

SEQ ID NO: 2208952 - RNA, 16 nt, Streptococcus pyogenes M1 GAS
cauaaccuuugccauu

SEQ ID NO: 2208953 - RNA, 17 nt, Streptococcus pyogenes M1 GAS
cauacacaaaaaaccgc

SEQ ID NO: 2208954 - RNA, 12 nt, Streptococcus pyogenes M1 GAS
cauauuguuaau

SEQ ID NO: 2208955 - RNA, 13 nt, Streptococcus pyogenes M1 GAS
aaagaugucgcaa

SEQ ID NO: 2208956 - RNA, 12 nt, Streptococcus pyogenes M1 GAS
ccauucuugcag

SEQ ID NO: 2208957 - RNA, 17 nt, Streptococcus pyogenes M1 GAS
ccauuucggacuguuuu

SEQ ID NO: 2208958 - RNA, 19 nt, Streptococcus pyogenes M1 GAS
aaaguaaaaucuuauuuuu

SEQ ID NO: 2208959 - RNA, 21 nt, Streptococcus pyogenes M1 GAS
aaaguagcaccuuuuuuauug

SEQ ID NO: 2208960 - RNA, 21 nt, Streptococcus pyogenes M1 GAS
aaagccuuauccauucuuaac

SEQ ID NO: 2208961 - RNA, 16 nt, Streptococcus pyogenes M1 GAS
aaaggauuuaguuuug

SEQ ID NO: 2208962 - RNA, 16 nt, Streptococcus pyogenes M1 GAS
aaaggcaguugcagag

SEQ ID NO: 2208963 - RNA, 20 nt, Streptococcus pyogenes M1 GAS
aacagcauuuucaucaucaa

SEQ ID NO: 2208964 - RNA, 14 nt, Streptococcus pyogenes M1 GAS
gugacaaugugaca

SEQ ID NO: 2208965 - RNA, 21 nt, Streptococcus pyogenes M1 GAS
gugaggacuuauuuuuuuaag

SEQ ID NO: 2208966 - RNA, 22 nt, Streptococcus pyogenes M1 GAS
gggugaaucguuacuccuuuga

SEQ ID NO: 2208967 - RNA, 19 nt, Streptococcus pyogenes M1 GAS
guaaagcaagggaaacacc

SEQ ID NO: 2208968 - RNA, 18 nt, Streptococcus pyogenes M1 GAS
guaaugucuuguucuggu

SEQ ID NO: 2208969 - RNA, 11 nt, Streptococcus pyogenes M1 GAS
gguguuuuuua

SEQ ID NO: 2208970 - RNA, 14 nt, Streptococcus pyogenes M1 GAS
ggugcuuuuuuugu

SEQ ID NO: 2208971 - RNA, 18 nt, Streptococcus pyogenes M1 GAS
gcuugaucuuacaaagga

SEQ ID NO: 2208972 - RNA, 17 nt, Streptococcus pyogenes M1 GAS
gcuuugauuuuucuugu

SEQ ID NO: 2208973 - RNA, 14 nt, Streptococcus pyogenes M1 GAS
gaacacucaucaua

SEQ ID NO: 2208974 - RNA, 18 nt, Streptococcus pyogenes M1 GAS
gaaaauacauuguuuuuc

SEQ ID NO: 2208975 - RNA, 17 nt, Streptococcus pyogenes M1 GAS
cuuuugaaaaauuauga

SEQ ID NO: 2208976 - RNA, 19 nt, Streptococcus pyogenes M1 GAS
cuuuuaauuuuauuuuuua

SEQ ID NO: 2208977 - RNA, 14 nt, Streptococcus pyogenes M1 GAS
cuuuuuugacacag

SEQ ID NO: 2208978 - RNA, 16 nt, Streptococcus pyogenes M1 GAS
cuuuuuugagcaucag

SEQ ID NO: 2208979 - RNA, 20 nt, Streptococcus pyogenes M1 GAS
cuuuuugaauugaaaaaaga

SEQ ID NO: 2208980 - RNA, 15 nt, Streptococcus pyogenes M1 GAS
gaaaaauucugauuc

SEQ ID NO: 2208981 - RNA, 15 nt, Streptococcus pyogenes M1 GAS
cuuugguauucuuuu

SEQ ID NO: 2208982 - RNA, 17 nt, Streptococcus pyogenes M1 GAS
cuuuggagaaauucaaa

SEQ ID NO: 2208983 - RNA, 14 nt, Streptococcus pyogenes M1 GAS
cuuugccuuuagca

SEQ ID NO: 2208984 - RNA, 20 nt, Streptococcus pyogenes M1 GAS
cuuuauuuugauauuuuuuc

SEQ ID NO: 2208985 - RNA, 16 nt, Streptococcus pyogenes M1 GAS
cuuuagcaauuguuuu

SEQ ID NO: 2208986 - RNA, 19 nt, Streptococcus pyogenes M1 GAS
cuuuagcaauuguuuuuuc

SEQ ID NO: 2208987 - RNA, 14 nt, Streptococcus pyogenes M1 GAS
cuggucaaaagcua

SEQ ID NO: 2208988 - RNA, 23 nt, Streptococcus pyogenes M1 GAS
cuguuugucauacucaauagcug

SEQ ID NO: 2208989 - RNA, 20 nt, Streptococcus pyogenes M1 GAS
cugugaugaaucauuuugga

SEQ ID NO: 2208990 - RNA, 20 nt, Streptococcus pyogenes M1 GAS
cuuaugcagguguuuaaaga

SEQ ID NO: 2208991 - RNA, 14 nt, Streptococcus pyogenes M1 GAS
cuucagguuucuuu

SEQ ID NO: 2208992 - RNA, 20 nt, Streptococcus pyogenes M1 GAS
gaauaaggcucgacaaaggc

SEQ ID NO: 2208993 - RNA, 21 nt, Streptococcus pyogenes M1 GAS
gacauaguguuuugaauguug

SEQ ID NO: 2208994 - RNA, 20 nt, Streptococcus pyogenes M1 GAS
gacagacaccaaaaaaagca

SEQ ID NO: 2208995 - RNA, 19 nt, Streptococcus pyogenes M1 GAS
aacgcuauaccuaaaaaau

SEQ ID NO: 2208996 - RNA, 18 nt, Streptococcus pyogenes M1 GAS
cuccuggauuaaaugccc

SEQ ID NO: 2208997 - RNA, 20 nt, Streptococcus pyogenes M1 GAS
cuauagaaaguaaaaauacu

SEQ ID NO: 2208998 - RNA, 22 nt, Streptococcus pyogenes M1 GAS
cuaucauaggguucacuuuguu

SEQ ID NO: 2208999 - RNA, 13 nt, Streptococcus pyogenes M1 GAS
cuaguuaagcuug

SEQ ID NO: 2209000 - RNA, 17 nt, Streptococcus pyogenes M1 GAS
cuauuucacuuaucauu

SEQ ID NO: 2209001 - RNA, 23 nt, Streptococcus pyogenes M1 GAS
cucacuaggccuagcuuuuuaca

SEQ ID NO: 2209002 - RNA, 16 nt, Streptococcus pyogenes M1 GAS
cucugcaacaucaagg

SEQ ID NO: 2209003 - RNA, 15 nt, Streptococcus pyogenes M1 GAS
cucuagcauaaaaga

SEQ ID NO: 2209004 - RNA, 14 nt, Streptococcus pyogenes M1 GAS
cucuuuaccauuua

SEQ ID NO: 2209005 - RNA, 20 nt, Streptococcus pyogenes M1 GAS
cugacaaaacuucaaauuuc

SEQ ID NO: 2209006 - RNA, 20 nt, Streptococcus pyogenes M1 GAS
cugauauaguccguacaauc

SEQ ID NO: 2209007 - RNA, 16 nt, Streptococcus pyogenes M1 GAS
cugcauaucugcccca

SEQ ID NO: 2209008 - RNA, 17 nt, Streptococcus pyogenes M1 GAS
cgucauugcuuuuuaug

SEQ ID NO: 2209009 - RNA, 15 nt, Streptococcus pyogenes M1 GAS
cguaacguaauagaa

SEQ ID NO: 2209010 - RNA, 18 nt, Streptococcus pyogenes M1 GAS
cguagcccucgcuaucaa

SEQ ID NO: 2209011 - RNA, 12 nt, Streptococcus pyogenes M1 GAS
cguuauuaauug

SEQ ID NO: 2209012 - RNA, 20 nt, Streptococcus pyogenes M1 GAS
gauuaaacuuacaaaaagcc

SEQ ID NO: 2209013 - RNA, 15 nt, Streptococcus pyogenes M1 GAS
gauuuuaaauaucuu

SEQ ID NO: 2209014 - RNA, 15 nt, Streptococcus pyogenes M1 GAS
gcaacacgcuaucaa

SEQ ID NO: 2209015 - RNA, 15 nt, Streptococcus pyogenes M1 GAS
gaguccuuuuuuugu

SEQ ID NO: 2209016 - RNA, 22 nt, Streptococcus pyogenes M1 GAS
gauagugugugugauguaauug

SEQ ID NO: 2209017 - RNA, 22 nt, Streptococcus pyogenes M1 GAS
aagaaggccagcaaggcaccug

SEQ ID NO: 2209018 - RNA, 14 nt, Streptococcus pyogenes M1 GAS
gcagcuaaaagcau

SEQ ID NO: 2209019 - RNA, 13 nt, Streptococcus pyogenes M1 GAS
aacuuuuaucacu

SEQ ID NO: 2209020 - RNA, 17 nt, Streptococcus pyogenes M1 GAS
aacuugcuuugacaaag

SEQ ID NO: 2209021 - RNA, 20 nt, Streptococcus pyogenes M1 GAS
gcaacaucaaaaagaggauu

SEQ ID NO: 2209022 - RNA, 18 nt, Streptococcus pyogenes M1 GAS
aagauuaaacuuacaaaa

SEQ ID NO: 2209023 - RNA, 22 nt, Streptococcus pyogenes M1 GAS
aagauggugacucuguuccuau

SEQ ID NO: 2209024 - RNA, 13 nt, Streptococcus pyogenes M1 GAS
aagcaaauugaaa

SEQ ID NO: 2209025 - RNA, 21 nt, Streptococcus pyogenes M1 GAS
aagcaaaauaaacuuucaguu

SEQ ID NO: 2209026 - RNA, 16 nt, Streptococcus pyogenes M1 GAS
aagagagguugguaaa

SEQ ID NO: 2209027 - RNA, 19 nt, Streptococcus pyogenes M1 GAS
acuguggguuaagagaggu

SEQ ID NO: 2209028 - RNA, 13 nt, Streptococcus pyogenes M1 GAS
acugaacuugucc

SEQ ID NO: 2209029 - RNA, 15 nt, Streptococcus pyogenes M1 GAS
acugaacuuguccug

SEQ ID NO: 2209030 - RNA, 21 nt, Streptococcus pyogenes M1 GAS
agaagcaaaauuauuauuuug

SEQ ID NO: 2209031 - RNA, 13 nt, Streptococcus pyogenes M1 GAS
agaauaacgguau

SEQ ID NO: 2209032 - RNA, 14 nt, Streptococcus pyogenes M1 GAS
agaauagaaauagu

SEQ ID NO: 2209033 - RNA, 17 nt, Streptococcus pyogenes M1 GAS
agaauuauacuaacuau

SEQ ID NO: 2209034 - RNA, 16 nt, Streptococcus pyogenes M1 GAS
agaaaguaaaaauacu

SEQ ID NO: 2209035 - RNA, 21 nt, Streptococcus pyogenes M1 GAS
agaacagcugcuugaaaagau

SEQ ID NO: 2209036 - RNA, 18 nt, Streptococcus pyogenes M1 GAS
agauguuuacgcuuuaca

SEQ ID NO: 2209037 - RNA, 23 nt, Streptococcus pyogenes M1 GAS
agaguacuucugcagucuuuuuc

SEQ ID NO: 2209038 - RNA, 18 nt, Streptococcus pyogenes M1 GAS
agaggcuugcauuuuuug

SEQ ID NO: 2209039 - RNA, 12 nt, Streptococcus pyogenes M1 GAS
agacaaaaaacu

SEQ ID NO: 2209040 - RNA, 16 nt, Streptococcus pyogenes M1 GAS
agaccauaaaaaaccu

SEQ ID NO: 2209041 - RNA, 15 nt, Streptococcus pyogenes M1 GAS
acggaguauuuuuua

SEQ ID NO: 2209042 - RNA, 12 nt, Streptococcus pyogenes M1 GAS
acuaaaaucaug

SEQ ID NO: 2209043 - RNA, 13 nt, Streptococcus pyogenes M1 GAS
acuagaaaaagca

SEQ ID NO: 2209044 - RNA, 17 nt, Streptococcus pyogenes M1 GAS
acuagcacaaaaucauu

SEQ ID NO: 2209045 - RNA, 23 nt, Streptococcus pyogenes M1 GAS
acuagcacaaaaucauuucguuu

SEQ ID NO: 2209046 - RNA, 13 nt, Streptococcus pyogenes M1 GAS
aaaauaucuagaa

SEQ ID NO: 2209047 - RNA, 18 nt, Streptococcus pyogenes M1 GAS
acaguuuauguuuaaugg

SEQ ID NO: 2209048 - RNA, 21 nt, Streptococcus pyogenes M1 GAS
aaaauuuaauaguuuuccaua

SEQ ID NO: 2209049 - RNA, 13 nt, Streptococcus pyogenes M1 GAS
accucuaucccuu

SEQ ID NO: 2209050 - RNA, 17 nt, Streptococcus pyogenes M1 GAS
accuaucacgccaguaa

SEQ ID NO: 2209051 - RNA, 23 nt, Streptococcus pyogenes M1 GAS
accuuugccauuuccuacaaaau

SEQ ID NO: 2209052 - RNA, 18 nt, Streptococcus pyogenes M1 GAS
acgauaagaagcuaaugu

SEQ ID NO: 2209053 - RNA, 18 nt, Streptococcus pyogenes M1 GAS
aacuggcacaaacucugc

SEQ ID NO: 2209054 - RNA, 22 nt, Streptococcus pyogenes M1 GAS
aacuucuauauguguaauuucu

SEQ ID NO: 2209055 - RNA, 14 nt, Streptococcus pyogenes M1 GAS
aagaacuccuggau

SEQ ID NO: 2209056 - RNA, 13 nt, Streptococcus pyogenes M1 GAS
aagaacagcauuu

SEQ ID NO: 2209057 - RNA, 20 nt, Streptococcus pyogenes M1 GAS
aacugacuagccaaaucugg

SEQ ID NO: 2209058 - RNA, 22 nt, Streptococcus pyogenes M1 GAS
aacugacaaaaaaagcaagcaa

SEQ ID NO: 2209059 - RNA, 22 nt, Streptococcus pyogenes M1 GAS
aacucuuguagaauuucaaguu

SEQ ID NO: 2209060 - RNA, 15 nt, Streptococcus pyogenes M1 GAS
aaccugcauaucugc

SEQ ID NO: 2209061 - RNA, 16 nt, Streptococcus pyogenes M1 GAS
aaggcugcgaugauuu

SEQ ID NO: 2209062 - RNA, 16 nt, Streptococcus pyogenes M1 GAS
aagguaucuaagcuau

SEQ ID NO: 2209063 - RNA, 14 nt, Streptococcus pyogenes M1 GAS
aagagagaagcugu

SEQ ID NO: 2209064 - RNA, 23 nt, Streptococcus pyogenes M1 GAS
aagacuucuuccuuguacaagag

SEQ ID NO: 2209065 - RNA, 13 nt, Streptococcus pyogenes M1 GAS
aagccaaauccac

SEQ ID NO: 2209066 - RNA, 23 nt, Streptococcus pyogenes M1 GAS
aauaucaugaaguauaguuaugu

SEQ ID NO: 2209067 - RNA, 23 nt, Streptococcus pyogenes M1 GAS
aauaaugccaucaaaaaaagaca

SEQ ID NO: 2209068 - RNA, 14 nt, Streptococcus pyogenes M1 GAS
aauaacaucuugau

SEQ ID NO: 2209069 - RNA, 18 nt, Streptococcus pyogenes M1 GAS
aauaacagaaauuaauaa

SEQ ID NO: 2209070 - RNA, 15 nt, Streptococcus pyogenes M1 GAS
aagucuaucugcaga

SEQ ID NO: 2209071 - RNA, 14 nt, Streptococcus pyogenes M1 GAS
aagugucuugauau

SEQ ID NO: 2209072 - RNA, 18 nt, Streptococcus pyogenes M1 GAS
acagauaagugccaucag

SEQ ID NO: 2209073 - RNA, 18 nt, Streptococcus pyogenes M1 GAS
aaaauaacuuucuauuac

SEQ ID NO: 2209074 - RNA, 21 nt, Streptococcus pyogenes M1 GAS
acaccguucauauaagcaauc

SEQ ID NO: 2209075 - RNA, 14 nt, Streptococcus pyogenes M1 GAS
acaccuacuaacaa

SEQ ID NO: 2209076 - RNA, 16 nt, Streptococcus pyogenes M1 GAS
acaccuacuaacaaca

SEQ ID NO: 2209077 - RNA, 18 nt, Streptococcus pyogenes M1 GAS
aauuccccacaaaagaca

SEQ ID NO: 2209078 - RNA, 16 nt, Streptococcus pyogenes M1 GAS
aaugacuauagaaagu

SEQ ID NO: 2209079 - RNA, 11 nt, Streptococcus pyogenes M1 GAS
aaucuuugaca

SEQ ID NO: 2209080 - RNA, 16 nt, Streptococcus pyogenes M1 GAS
aaugccaucaaaaaaa

SEQ ID NO: 2209081 - RNA, 14 nt, Streptococcus pyogenes M1 GAS
acaaugugacaauu

SEQ ID NO: 2209082 - RNA, 21 nt, Streptococcus pyogenes M1 GAS
acaaguugccuuaucucaguu

SEQ ID NO: 2209083 - RNA, 13 nt, Streptococcus pyogenes M1 GAS
aauuucuuucaug

SEQ ID NO: 2209084 - RNA, 14 nt, Streptococcus pyogenes M1 GAS
acaaauuuauccug

SEQ ID NO: 2209085 - RNA, 15 nt, Streptococcus pyogenes M1 GAS
acaacacaauucaag

SEQ ID NO: 2209086 - RNA, 19 nt, Streptococcus pyogenes M1 GAS
aaaaccauuauaaaagagu

SEQ ID NO: 2209087 - RNA, 23 nt, Streptococcus pyogenes M1 GAS
aaaacccuuucguaagaaagacu

SEQ ID NO: 2209088 - RNA, 17 nt, Streptococcus pyogenes M1 GAS
aaauaaaccaagcuaaa

SEQ ID NO: 2209089 - RNA, 18 nt, Streptococcus pyogenes M1 GAS
aaauccuuuugaaaaauu

SEQ ID NO: 2209090 - RNA, 14 nt, Streptococcus pyogenes M1 GAS
aaaacugucuggaa

SEQ ID NO: 2209091 - RNA, 13 nt, Streptococcus pyogenes M1 GAS
aaagcaucagcau

SEQ ID NO: 2209092 - RNA, 14 nt, Streptococcus pyogenes M1 GAS
aaaaauacuagaaa

SEQ ID NO: 2209093 - RNA, 12 nt, Streptococcus pyogenes M1 GAS
aaaaagcaagca

SEQ ID NO: 2209094 - RNA, 19 nt, Streptococcus pyogenes M1 GAS
aaaaagaaaggaauugaac

SEQ ID NO: 2209095 - RNA, 21 nt, Streptococcus pyogenes M1 GAS
aaaacuucacauuguauuagc

SEQ ID NO: 2209096 - RNA, 22 nt, Streptococcus pyogenes M1 GAS
aaaaccauuauaaaagagugca

SEQ ID NO: 2209097 - RNA, 17 nt, Streptococcus pyogenes M1 GAS
aaaaagccagagcaguu

SEQ ID NO: 2209098 - RNA, 20 nt, Streptococcus pyogenes M1 GAS
aaaaugcgcauguugacuau

SEQ ID NO: 2209099 - RNA, 19 nt, Streptococcus pyogenes M1 GAS
aaaaugaugagauuaacug

SEQ ID NO: 2209100 - RNA, 23 nt, Streptococcus pyogenes M1 GAS
aaaaucuuuuucuuuucuucauc

SEQ ID NO: 2209101 - RNA, 18 nt, Streptococcus pyogenes M1 GAS
uuuucaaagggagauucu

SEQ ID NO: 2209102 - RNA, 21 nt, Streptococcus pyogenes M1 GAS
uuuucaacaaauccuuuugcu

SEQ ID NO: 2209103 - RNA, 12 nt, Streptococcus pyogenes M1 GAS
uuuuuaucugua

SEQ ID NO: 2209104 - RNA, 16 nt, Streptococcus pyogenes M1 GAS
uuuugguugauauaaa

SEQ ID NO: 2209105 - RNA, 11 nt, Streptococcus pyogenes M1 GAS
uuuuguuuuau

SEQ ID NO: 2209106 - RNA, 13 nt, Streptococcus pyogenes M1 GAS
uuuuguuguaaaa

SEQ ID NO: 2209107 - RNA, 18 nt, Streptococcus pyogenes M1 GAS
uuuuguuguauuaugagg

SEQ ID NO: 2209108 - RNA, 17 nt, Streptococcus pyogenes M1 GAS
uuuugucguuuuuugcu

SEQ ID NO: 2209109 - RNA, 17 nt, Streptococcus pyogenes M1 GAS
uuuugucugacuuaaau

SEQ ID NO: 2209110 - RNA, 16 nt, Streptococcus pyogenes M1 GAS
uuuuguaucucauaac

SEQ ID NO: 2209111 - RNA, 13 nt, Streptococcus pyogenes M1 GAS
uucguucuaguuu

SEQ ID NO: 2209112 - RNA, 12 nt, Streptococcus pyogenes M1 GAS
uucguuauaaac

SEQ ID NO: 2209113 - RNA, 19 nt, Streptococcus pyogenes M1 GAS
uucuaacauggauaccauu

SEQ ID NO: 2209114 - RNA, 19 nt, Streptococcus pyogenes M1 GAS
uucuaaaugacaguauaca

SEQ ID NO: 2209115 - RNA, 14 nt, Streptococcus pyogenes M1 GAS
uucgucuaaaaagc

SEQ ID NO: 2209116 - RNA, 19 nt, Streptococcus pyogenes M1 GAS
uucguaaggguuauuauuu

SEQ ID NO: 2209117 - RNA, 19 nt, Streptococcus pyogenes M1 GAS
uucuagguuaaaauagaag

SEQ ID NO: 2209118 - RNA, 23 nt, Streptococcus pyogenes M1 GAS
uucuagacucuagcauaaaagau

SEQ ID NO: 2209119 - RNA, 13 nt, Streptococcus pyogenes M1 GAS
uucucauaaacaa

SEQ ID NO: 2209120 - RNA, 18 nt, Streptococcus pyogenes M1 GAS
uucuaguuucauagaaga

SEQ ID NO: 2209121 - RNA, 18 nt, Streptococcus pyogenes M1 GAS
uucuaguucguucauaaa

SEQ ID NO: 2209122 - RNA, 23 nt, Streptococcus pyogenes M1 GAS
uucuaguuuaggauauaagaagg

SEQ ID NO: 2209123 - RNA, 16 nt, Streptococcus pyogenes M1 GAS
uucuuacuaugaaaaa

SEQ ID NO: 2209124 - RNA, 21 nt, Streptococcus pyogenes M1 GAS
uucuuacuaugaaaaaagaac

SEQ ID NO: 2209125 - RNA, 16 nt, Streptococcus pyogenes M1 GAS
uucuugaggugauucu

SEQ ID NO: 2209126 - RNA, 20 nt, Streptococcus pyogenes M1 GAS
uucuugaggugauucuuuuu

SEQ ID NO: 2209127 - RNA, 23 nt, Streptococcus pyogenes M1 GAS
uucugaaaauaaaauauuuuucc

SEQ ID NO: 2209128 - RNA, 14 nt, Streptococcus pyogenes M1 GAS
uucuggugcaaggc

SEQ ID NO: 2209129 - RNA, 24 nt, Streptococcus pyogenes M1 GAS
uucugauuccauaggugauguagg

SEQ ID NO: 2209130 - RNA, 17 nt, Streptococcus pyogenes M1 GAS
uucugauaggagugauu

SEQ ID NO: 2209131 - RNA, 13 nt, Streptococcus pyogenes M1 GAS
uugauuugccgcu

SEQ ID NO: 2209132 - RNA, 15 nt, Streptococcus pyogenes M1 GAS
uugauuucauuuucu

SEQ ID NO: 2209133 - RNA, 17 nt, Streptococcus pyogenes M1 GAS
uugcagcuaaaaacaau

SEQ ID NO: 2209134 - RNA, 21 nt, Streptococcus pyogenes M1 GAS
uugaugauugaguaagcagca

SEQ ID NO: 2209135 - RNA, 14 nt, Streptococcus pyogenes M1 GAS
uugaugaaccucag

SEQ ID NO: 2209136 - RNA, 13 nt, Streptococcus pyogenes M1 GAS
uugagucuuuucc

SEQ ID NO: 2209137 - RNA, 15 nt, Streptococcus pyogenes M1 GAS
uugauauuuuuucuc

SEQ ID NO: 2209138 - RNA, 23 nt, Streptococcus pyogenes M1 GAS
uugauauuuuuucucaaaaauau

SEQ ID NO: 2209139 - RNA, 22 nt, Streptococcus pyogenes M1 GAS
uugauauuuuuucucaaaaaua

SEQ ID NO: 2209140 - RNA, 12 nt, Streptococcus pyogenes M1 GAS
uugauaaaaaac

SEQ ID NO: 2209141 - RNA, 19 nt, Streptococcus pyogenes M1 GAS
uugauaugguggguaaaac

SEQ ID NO: 2209142 - RNA, 17 nt, Streptococcus pyogenes M1 GAS
uucuuggaaaacagaaa

SEQ ID NO: 2209143 - RNA, 14 nt, Streptococcus pyogenes M1 GAS
uucuuugguuugau

SEQ ID NO: 2209144 - RNA, 19 nt, Streptococcus pyogenes M1 GAS
uucuuugguuugaugaacc

SEQ ID NO: 2209145 - RNA, 19 nt, Streptococcus pyogenes M1 GAS
uucuugugcuaaucuaucu

SEQ ID NO: 2209146 - RNA, 12 nt, Streptococcus pyogenes M1 GAS
uucuuuuuuacc

SEQ ID NO: 2209147 - RNA, 18 nt, Streptococcus pyogenes M1 GAS
uugaaagaggugcaacug

SEQ ID NO: 2209148 - RNA, 15 nt, Streptococcus pyogenes M1 GAS
uugacgcaucuccuu

SEQ ID NO: 2209149 - RNA, 18 nt, Streptococcus pyogenes M1 GAS
uugacuuguuacaaaaaa

SEQ ID NO: 2209150 - RNA, 21 nt, Streptococcus pyogenes M1 GAS
uugacuugguucugaaaauaa

SEQ ID NO: 2209151 - RNA, 20 nt, Streptococcus pyogenes M1 GAS
uugaccuacuagcacaaaau

SEQ ID NO: 2209152 - RNA, 14 nt, Streptococcus pyogenes M1 GAS
uugaauguuguauu

SEQ ID NO: 2209153 - RNA, 21 nt, Streptococcus pyogenes M1 GAS
uugaaugaguuagucugaauu

SEQ ID NO: 2209154 - RNA, 14 nt, Streptococcus pyogenes M1 GAS
uugugauauaaaau

SEQ ID NO: 2209155 - RNA, 19 nt, Streptococcus pyogenes M1 GAS
uuguuaguuuuauccccua

SEQ ID NO: 2209156 - RNA, 22 nt, Streptococcus pyogenes M1 GAS
uuguuaggguagcugguuugau

SEQ ID NO: 2209157 - RNA, 20 nt, Streptococcus pyogenes M1 GAS
uugucaaaaaguaaaaagca

SEQ ID NO: 2209158 - RNA, 19 nt, Streptococcus pyogenes M1 GAS
uuguagggauuuuuuaacu

SEQ ID NO: 2209159 - RNA, 14 nt, Streptococcus pyogenes M1 GAS
uuuacauuuuauuu

SEQ ID NO: 2209160 - RNA, 14 nt, Streptococcus pyogenes M1 GAS
uuuaauuuuuccuu

SEQ ID NO: 2209161 - RNA, 22 nt, Streptococcus pyogenes M1 GAS
uuuaauagcauugucaaauaaa

SEQ ID NO: 2209162 - RNA, 17 nt, Streptococcus pyogenes M1 GAS
uuuaagcugagcaaaac

SEQ ID NO: 2209163 - RNA, 19 nt, Streptococcus pyogenes M1 GAS
uuuaaacacuaccuuaaau

SEQ ID NO: 2209164 - RNA, 22 nt, Streptococcus pyogenes M1 GAS
uuuaaaaaacgcgguaaacaua

SEQ ID NO: 2209165 - RNA, 16 nt, Streptococcus pyogenes M1 GAS
uuuaaaaacaaauugu

SEQ ID NO: 2209166 - RNA, 14 nt, Streptococcus pyogenes M1 GAS
uuuaagacaacaua

SEQ ID NO: 2209167 - RNA, 14 nt, Streptococcus pyogenes M1 GAS
uugguaaaaaggca

SEQ ID NO: 2209168 - RNA, 22 nt, Streptococcus pyogenes M1 GAS
uugggguuauccucuuuuaguu

SEQ ID NO: 2209169 - RNA, 21 nt, Streptococcus pyogenes M1 GAS
uuggaacaccguuuuuuguug

SEQ ID NO: 2209170 - RNA, 18 nt, Streptococcus pyogenes M1 GAS
uugcuuccaacuccugau

SEQ ID NO: 2209171 - RNA, 12 nt, Streptococcus pyogenes M1 GAS
uuggauccuuua

SEQ ID NO: 2209172 - RNA, 20 nt, Streptococcus pyogenes M1 GAS
uugccaucgacgaugugacu

SEQ ID NO: 2209173 - RNA, 22 nt, Streptococcus pyogenes M1 GAS
uugccaucaauguuuugcucga

SEQ ID NO: 2209174 - RNA, 20 nt, Streptococcus pyogenes M1 GAS
uugccaucagcaucugaaaa

SEQ ID NO: 2209175 - RNA, 13 nt, Streptococcus pyogenes M1 GAS
uugccauuuaauu

SEQ ID NO: 2209176 - RNA, 13 nt, Streptococcus pyogenes M1 GAS
uuccuacaaaaua

SEQ ID NO: 2209177 - RNA, 14 nt, Streptococcus pyogenes M1 GAS
uuccuacaaaauaa

SEQ ID NO: 2209178 - RNA, 19 nt, Streptococcus pyogenes M1 GAS
uuccuaacaaaaucacacc

SEQ ID NO: 2209179 - RNA, 16 nt, Streptococcus pyogenes M1 GAS
uuccuuguacaagagc

SEQ ID NO: 2209180 - RNA, 24 nt, Streptococcus pyogenes M1 GAS
uuccuuaacggcaucuacagcacc

SEQ ID NO: 2209181 - RNA, 23 nt, Streptococcus pyogenes M1 GAS
uuccuuagcaaaggcuucaucaa

SEQ ID NO: 2209182 - RNA, 18 nt, Streptococcus pyogenes M1 GAS
uucgccuaggaauaaaau

SEQ ID NO: 2209183 - RNA, 20 nt, Streptococcus pyogenes M1 GAS
uucgccuaggaauaaaaugc

SEQ ID NO: 2209184 - RNA, 21 nt, Streptococcus pyogenes M1 GAS
uucgccuaggaauaaaaugcc

SEQ ID NO: 2209185 - RNA, 18 nt, Streptococcus pyogenes M1 GAS
uucccuuaauaaacugua

SEQ ID NO: 2209186 - RNA, 14 nt, Streptococcus pyogenes M1 GAS
uucccauguuuuau

SEQ ID NO: 2209187 - RNA, 13 nt, Streptococcus pyogenes M1 GAS
uuccccacaaaag

SEQ ID NO: 2209188 - RNA, 12 nt, Streptococcus pyogenes M1 GAS
uuccauaauauc

SEQ ID NO: 2209189 - RNA, 15 nt, Streptococcus pyogenes M1 GAS
uuccaaaaagaaagg

SEQ ID NO: 2209190 - RNA, 13 nt, Streptococcus pyogenes M1 GAS
uuccaaaaagaaa

SEQ ID NO: 2209191 - RNA, 21 nt, Streptococcus pyogenes M1 GAS
uuccagaacaugggagcgcac

SEQ ID NO: 2209192 - RNA, 23 nt, Streptococcus pyogenes M1 GAS
uucacgauaagaagcuaaugucu

SEQ ID NO: 2209193 - RNA, 23 nt, Streptococcus pyogenes M1 GAS
uucagagcacguuuucugguuuu

SEQ ID NO: 2209194 - RNA, 16 nt, Streptococcus pyogenes M1 GAS
uucagagaugcuucuu

SEQ ID NO: 2209195 - RNA, 15 nt, Streptococcus pyogenes M1 GAS
uucacuuuguuacca

SEQ ID NO: 2209196 - RNA, 19 nt, Streptococcus pyogenes M1 GAS
uucagcagcacuggcuuuu

SEQ ID NO: 2209197 - RNA, 23 nt, Streptococcus pyogenes M1 GAS
uucagauaagaccuucaaaaaag

SEQ ID NO: 2209198 - RNA, 20 nt, Streptococcus pyogenes M1 GAS
uucaauuauuucgucuaaaa

SEQ ID NO: 2209199 - RNA, 18 nt, Streptococcus pyogenes M1 GAS
uucaauaugaaaacgugu

SEQ ID NO: 2209200 - RNA, 21 nt, Streptococcus pyogenes M1 GAS
uucaauauuuuauuaauaagu

SEQ ID NO: 2209201 - RNA, 15 nt, Streptococcus pyogenes M1 GAS
uucaaguucucuacu

SEQ ID NO: 2209202 - RNA, 13 nt, Streptococcus pyogenes M1 GAS
uucauuuucuucu

SEQ ID NO: 2209203 - RNA, 21 nt, Streptococcus pyogenes M1 GAS
uucaucaucaagaauagcuuu

SEQ ID NO: 2209204 - RNA, 14 nt, Streptococcus pyogenes M1 GAS
uucaguuaaacuga

SEQ ID NO: 2209205 - RNA, 19 nt, Streptococcus pyogenes M1 GAS
uucauauaagcaaucauca

SEQ ID NO: 2209206 - RNA, 18 nt, Streptococcus pyogenes M1 GAS
uucaucaaugauagcuuu

SEQ ID NO: 2209207 - RNA, 12 nt, Streptococcus pyogenes M1 GAS
uucauagaagac

SEQ ID NO: 2209208 - RNA, 14 nt, Streptococcus pyogenes M1 GAS
uggcuaaaaagaga

SEQ ID NO: 2209209 - RNA, 20 nt, Streptococcus pyogenes M1 GAS
uggcuacucuauuuuaagua

SEQ ID NO: 2209210 - RNA, 21 nt, Streptococcus pyogenes M1 GAS
uggcgggccuucuaucaaaac

SEQ ID NO: 2209211 - RNA, 18 nt, Streptococcus pyogenes M1 GAS
ugguuacagacuuuuaau

SEQ ID NO: 2209212 - RNA, 18 nt, Streptococcus pyogenes M1 GAS
ugguugccugaaauauaa

SEQ ID NO: 2209213 - RNA, 22 nt, Streptococcus pyogenes M1 GAS
ugguuucacgauaagaagcuaa

SEQ ID NO: 2209214 - RNA, 13 nt, Streptococcus pyogenes M1 GAS
ugguuuuuuaauu

SEQ ID NO: 2209215 - RNA, 14 nt, Streptococcus pyogenes M1 GAS
ugguuuuuuugucu

SEQ ID NO: 2209216 - RNA, 15 nt, Streptococcus pyogenes M1 GAS
uguaauucagcaucg

SEQ ID NO: 2209217 - RNA, 14 nt, Streptococcus pyogenes M1 GAS
uggguaaaaugacu

SEQ ID NO: 2209218 - RNA, 19 nt, Streptococcus pyogenes M1 GAS
ugguccaucauugaugaga

SEQ ID NO: 2209219 - RNA, 13 nt, Streptococcus pyogenes M1 GAS
ugguauucuuuuu

SEQ ID NO: 2209220 - RNA, 16 nt, Streptococcus pyogenes M1 GAS
uggugcuacugaugua

SEQ ID NO: 2209221 - RNA, 18 nt, Streptococcus pyogenes M1 GAS
uguucugguuuaucauuu

SEQ ID NO: 2209222 - RNA, 24 nt, Streptococcus pyogenes M1 GAS
uguucauuuagugguauagacaaa

SEQ ID NO: 2209223 - RNA, 16 nt, Streptococcus pyogenes M1 GAS
uguucuuuauuuugau

SEQ ID NO: 2209224 - RNA, 22 nt, Streptococcus pyogenes M1 GAS
uguggagcuuuuuuugguccug

SEQ ID NO: 2209225 - RNA, 18 nt, Streptococcus pyogenes M1 GAS
ugugauuauuauucuaaa

SEQ ID NO: 2209226 - RNA, 21 nt, Streptococcus pyogenes M1 GAS
ugugauuaguuuuuagcagca

SEQ ID NO: 2209227 - RNA, 19 nt, Streptococcus pyogenes M1 GAS
ugugacaauuggugauuaa

SEQ ID NO: 2209228 - RNA, 14 nt, Streptococcus pyogenes M1 GAS
ugucuucuucuuuu

SEQ ID NO: 2209229 - RNA, 19 nt, Streptococcus pyogenes M1 GAS
ugucuucuccgacugcagu

SEQ ID NO: 2209230 - RNA, 17 nt, Streptococcus pyogenes M1 GAS
ugucuugcuaaaauuuc

SEQ ID NO: 2209231 - RNA, 23 nt, Streptococcus pyogenes M1 GAS
ugucguugaugcaaauaguucag

SEQ ID NO: 2209232 - RNA, 17 nt, Streptococcus pyogenes M1 GAS
ugucgugcucauaaaac

SEQ ID NO: 2209233 - RNA, 17 nt, Streptococcus pyogenes M1 GAS
ugucgcuuuuuuuauuu

SEQ ID NO: 2209234 - RNA, 17 nt, Streptococcus pyogenes M1 GAS
uguccuaaccuuuuggc

SEQ ID NO: 2209235 - RNA, 15 nt, Streptococcus pyogenes M1 GAS
uguccauuuuuuaua

SEQ ID NO: 2209236 - RNA, 16 nt, Streptococcus pyogenes M1 GAS
ugucaugaugguuuca

SEQ ID NO: 2209237 - RNA, 13 nt, Streptococcus pyogenes M1 GAS
uguccaauaccua

SEQ ID NO: 2209238 - RNA, 14 nt, Streptococcus pyogenes M1 GAS
uguauucuuaaaaa

SEQ ID NO: 2209239 - RNA, 15 nt, Streptococcus pyogenes M1 GAS
uguauucuuaaaaaa

SEQ ID NO: 2209240 - RNA, 17 nt, Streptococcus pyogenes M1 GAS
ugucauacucaauagcu

SEQ ID NO: 2209241 - RNA, 23 nt, Streptococcus pyogenes M1 GAS
ugucaagccauagccagauggug

SEQ ID NO: 2209242 - RNA, 18 nt, Streptococcus pyogenes M1 GAS
uuauaaagaaacaaaaau

SEQ ID NO: 2209243 - RNA, 23 nt, Streptococcus pyogenes M1 GAS
uuauaaaguuuucucagagacaa

SEQ ID NO: 2209244 - RNA, 20 nt, Streptococcus pyogenes M1 GAS
uuaucagucuguccaauacc

SEQ ID NO: 2209245 - RNA, 13 nt, Streptococcus pyogenes M1 GAS
uuauccauucuua

SEQ ID NO: 2209246 - RNA, 16 nt, Streptococcus pyogenes M1 GAS
uuaugcugauuuugga

SEQ ID NO: 2209247 - RNA, 17 nt, Streptococcus pyogenes M1 GAS
uuauccuccuaaauaua

SEQ ID NO: 2209248 - RNA, 15 nt, Streptococcus pyogenes M1 GAS
uuauccuuuacugua

SEQ ID NO: 2209249 - RNA, 17 nt, Streptococcus pyogenes M1 GAS
uucaaaaaaacuucaca

SEQ ID NO: 2209250 - RNA, 19 nt, Streptococcus pyogenes M1 GAS
uucaaaaaaacuucacauu

SEQ ID NO: 2209251 - RNA, 20 nt, Streptococcus pyogenes M1 GAS
uuauuuucuagguuaaaaua

SEQ ID NO: 2209252 - RNA, 21 nt, Streptococcus pyogenes M1 GAS
uuauuuugcagguaauuaucu

SEQ ID NO: 2209253 - RNA, 23 nt, Streptococcus pyogenes M1 GAS
uuauuccacggacacuaaaacca

SEQ ID NO: 2209254 - RNA, 18 nt, Streptococcus pyogenes M1 GAS
uuauuaacguuaacaaaa

SEQ ID NO: 2209255 - RNA, 20 nt, Streptococcus pyogenes M1 GAS
uuauuaacguuaacaaaaau

SEQ ID NO: 2209256 - RNA, 17 nt, Streptococcus pyogenes M1 GAS
uuauuaagauaccaaau

SEQ ID NO: 2209257 - RNA, 19 nt, Streptococcus pyogenes M1 GAS
uuauuagucuuuaaaaaac

SEQ ID NO: 2209258 - RNA, 19 nt, Streptococcus pyogenes M1 GAS
uuaacaauagugaguauaa

SEQ ID NO: 2209259 - RNA, 17 nt, Streptococcus pyogenes M1 GAS
uuaacaaugaaacguua

SEQ ID NO: 2209260 - RNA, 16 nt, Streptococcus pyogenes M1 GAS
uuaaccauaucacaaa

SEQ ID NO: 2209261 - RNA, 18 nt, Streptococcus pyogenes M1 GAS
uuaaccauaucacaaaac

SEQ ID NO: 2209262 - RNA, 21 nt, Streptococcus pyogenes M1 GAS
uuaagauuaaacuuacaaaaa

SEQ ID NO: 2209263 - RNA, 20 nt, Streptococcus pyogenes M1 GAS
uuaauaaacuguauacaaaa

SEQ ID NO: 2209264 - RNA, 19 nt, Streptococcus pyogenes M1 GAS
uuaaauguccgaaaaaaac

SEQ ID NO: 2209265 - RNA, 13 nt, Streptococcus pyogenes M1 GAS
uuaacaaaaauaa

SEQ ID NO: 2209266 - RNA, 21 nt, Streptococcus pyogenes M1 GAS
uuaaauuuggagagauaaaaa

SEQ ID NO: 2209267 - RNA, 14 nt, Streptococcus pyogenes M1 GAS
uuaaagacaaaaaa

SEQ ID NO: 2209268 - RNA, 18 nt, Streptococcus pyogenes M1 GAS
uuaaagacaaaaaacuag

SEQ ID NO: 2209269 - RNA, 22 nt, Streptococcus pyogenes M1 GAS
uuaaagcuaaguugaaugaguu

SEQ ID NO: 2209270 - RNA, 17 nt, Streptococcus pyogenes M1 GAS
uuacgcuuuacauuuua

SEQ ID NO: 2209271 - RNA, 14 nt, Streptococcus pyogenes M1 GAS
uuacuaugaaaaaa

SEQ ID NO: 2209272 - RNA, 17 nt, Streptococcus pyogenes M1 GAS
uuacuaugaaaaaagaa

SEQ ID NO: 2209273 - RNA, 23 nt, Streptococcus pyogenes M1 GAS
uuaaugagaaaccuauaaggaga

SEQ ID NO: 2209274 - RNA, 18 nt, Streptococcus pyogenes M1 GAS
uuacaucaaaaaaagcaa

SEQ ID NO: 2209275 - RNA, 12 nt, Streptococcus pyogenes M1 GAS
uuacaucaaaaa

SEQ ID NO: 2209276 - RNA, 19 nt, Streptococcus pyogenes M1 GAS
ugccauggguaaaaugacu

SEQ ID NO: 2209277 - RNA, 16 nt, Streptococcus pyogenes M1 GAS
ugccauggguaaaaug

SEQ ID NO: 2209278 - RNA, 12 nt, Streptococcus pyogenes M1 GAS
ugccauuaauaa

SEQ ID NO: 2209279 - RNA, 16 nt, Streptococcus pyogenes M1 GAS
ugccauuaauaauauu

SEQ ID NO: 2209280 - RNA, 18 nt, Streptococcus pyogenes M1 GAS
ugccauuuccuacaaaau

SEQ ID NO: 2209281 - RNA, 16 nt, Streptococcus pyogenes M1 GAS
ugccauuuaaaagggc

SEQ ID NO: 2209282 - RNA, 22 nt, Streptococcus pyogenes M1 GAS
ugccaucaggcuuaaacauauu

SEQ ID NO: 2209283 - RNA, 23 nt, Streptococcus pyogenes M1 GAS
ugccaucgacgaugugacuagau

SEQ ID NO: 2209284 - RNA, 22 nt, Streptococcus pyogenes M1 GAS
ugccaguaaggaaaucaauccu

SEQ ID NO: 2209285 - RNA, 14 nt, Streptococcus pyogenes M1 GAS
ugcauuuuuuguaa

SEQ ID NO: 2209286 - RNA, 17 nt, Streptococcus pyogenes M1 GAS
ugccaauuguucauuaa

SEQ ID NO: 2209287 - RNA, 13 nt, Streptococcus pyogenes M1 GAS
ugcauuaucaucu

SEQ ID NO: 2209288 - RNA, 13 nt, Streptococcus pyogenes M1 GAS
ugcauuacauuua

SEQ ID NO: 2209289 - RNA, 14 nt, Streptococcus pyogenes M1 GAS
ugcauuaccuuauu

SEQ ID NO: 2209290 - RNA, 19 nt, Streptococcus pyogenes M1 GAS
ugcgcuauggacuaucuga

SEQ ID NO: 2209291 - RNA, 18 nt, Streptococcus pyogenes M1 GAS
ugcgcgacuaaaaucaug

SEQ ID NO: 2209292 - RNA, 13 nt, Streptococcus pyogenes M1 GAS
ugcuuuaaaaagu

SEQ ID NO: 2209293 - RNA, 23 nt, Streptococcus pyogenes M1 GAS
ugcuuuuuuugucguuuuuugcu

SEQ ID NO: 2209294 - RNA, 13 nt, Streptococcus pyogenes M1 GAS
ugcuuuuuuuguc

SEQ ID NO: 2209295 - RNA, 19 nt, Streptococcus pyogenes M1 GAS
ugcuguuggauacagucca

SEQ ID NO: 2209296 - RNA, 13 nt, Streptococcus pyogenes M1 GAS
ugcguuuauaaag

SEQ ID NO: 2209297 - RNA, 20 nt, Streptococcus pyogenes M1 GAS
ugcugauuuuggaugaaagu

SEQ ID NO: 2209298 - RNA, 17 nt, Streptococcus pyogenes M1 GAS
ugaauacguaaaaagag

SEQ ID NO: 2209299 - RNA, 20 nt, Streptococcus pyogenes M1 GAS
ugaauacguaaaaagagaag

SEQ ID NO: 2209300 - RNA, 14 nt, Streptococcus pyogenes M1 GAS
ugaaucauuuugga

SEQ ID NO: 2209301 - RNA, 14 nt, Streptococcus pyogenes M1 GAS
ugaagcaaaauaaa

SEQ ID NO: 2209302 - RNA, 20 nt, Streptococcus pyogenes M1 GAS
ugaaggacagguagauguug

SEQ ID NO: 2209303 - RNA, 15 nt, Streptococcus pyogenes M1 GAS
ugaagacaaacaucg

SEQ ID NO: 2209304 - RNA, 11 nt, Streptococcus pyogenes M1 GAS
ugacaauguga

SEQ ID NO: 2209305 - RNA, 17 nt, Streptococcus pyogenes M1 GAS
ugacaauuggugauuaa

SEQ ID NO: 2209306 - RNA, 19 nt, Streptococcus pyogenes M1 GAS
ugacauuaguccaaaauac

SEQ ID NO: 2209307 - RNA, 18 nt, Streptococcus pyogenes M1 GAS
ugacaugaguauaaauuu

SEQ ID NO: 2209308 - RNA, 12 nt, Streptococcus pyogenes M1 GAS
ugagacuaaccu

SEQ ID NO: 2209309 - RNA, 15 nt, Streptococcus pyogenes M1 GAS
ugagacaaguugccu

SEQ ID NO: 2209310 - RNA, 14 nt, Streptococcus pyogenes M1 GAS
ugagaauuuuuaua

SEQ ID NO: 2209311 - RNA, 12 nt, Streptococcus pyogenes M1 GAS
ugacuucaaaaa

SEQ ID NO: 2209312 - RNA, 23 nt, Streptococcus pyogenes M1 GAS
ugacuaucauuggggaaacuagc

SEQ ID NO: 2209313 - RNA, 14 nt, Streptococcus pyogenes M1 GAS
ugacuagccaaauc

SEQ ID NO: 2209314 - RNA, 15 nt, Streptococcus pyogenes M1 GAS
ugacuagccaaaucu

SEQ ID NO: 2209315 - RNA, 20 nt, Streptococcus pyogenes M1 GAS
ugacucugauccgaguuuug

SEQ ID NO: 2209316 - RNA, 22 nt, Streptococcus pyogenes M1 GAS
ugacucugauccgaguuuugcu

SEQ ID NO: 2209317 - RNA, 19 nt, Streptococcus pyogenes M1 GAS
ugcaacaucaaggguaaag

SEQ ID NO: 2209318 - RNA, 14 nt, Streptococcus pyogenes M1 GAS
ugauuaccuguggu

SEQ ID NO: 2209319 - RNA, 23 nt, Streptococcus pyogenes M1 GAS
ugauuaccuguggucaaaagucc

SEQ ID NO: 2209320 - RNA, 12 nt, Streptococcus pyogenes M1 GAS
ugauucuuuuuu

SEQ ID NO: 2209321 - RNA, 17 nt, Streptococcus pyogenes M1 GAS
ugauugauuugucuucu

SEQ ID NO: 2209322 - RNA, 18 nt, Streptococcus pyogenes M1 GAS
ugauugaguaagcagcau

SEQ ID NO: 2209323 - RNA, 19 nt, Streptococcus pyogenes M1 GAS
ugcaaauaguagcaaauaa

SEQ ID NO: 2209324 - RNA, 13 nt, Streptococcus pyogenes M1 GAS
ugcaaauaguuca

SEQ ID NO: 2209325 - RNA, 15 nt, Streptococcus pyogenes M1 GAS
ugcaaaagaauugaa

SEQ ID NO: 2209326 - RNA, 18 nt, Streptococcus pyogenes M1 GAS
ugaucuguuuaaaaacaa

SEQ ID NO: 2209327 - RNA, 16 nt, Streptococcus pyogenes M1 GAS
ugaucuguuuaaaaac

SEQ ID NO: 2209328 - RNA, 12 nt, Streptococcus pyogenes M1 GAS
ugaugauggagu

SEQ ID NO: 2209329 - RNA, 21 nt, Streptococcus pyogenes M1 GAS
ugaugaguaggcgaacuuuau

SEQ ID NO: 2209330 - RNA, 21 nt, Streptococcus pyogenes M1 GAS
ugaugauaaaggccuguauuu

SEQ ID NO: 2209331 - RNA, 18 nt, Streptococcus pyogenes M1 GAS
ugauagugaaguuaacaa

SEQ ID NO: 2209332 - RNA, 13 nt, Streptococcus pyogenes M1 GAS
ugauauaaaauug

SEQ ID NO: 2209333 - RNA, 14 nt, Streptococcus pyogenes M1 GAS
ugauauaaaaaugg

SEQ ID NO: 2209334 - RNA, 18 nt, Streptococcus pyogenes M1 GAS
ugauaggaaaaagccaga

SEQ ID NO: 2209335 - RNA, 21 nt, Streptococcus pyogenes M1 GAS
ugauaugguggguaaaaccaa

SEQ ID NO: 2209336 - RNA, 14 nt, Streptococcus pyogenes M1 GAS
ugauauaaaauugg

SEQ ID NO: 2209337 - RNA, 20 nt, Streptococcus pyogenes M1 GAS
ugaguuuuuucuaaaagaga

SEQ ID NO: 2209338 - RNA, 11 nt, Streptococcus pyogenes M1 GAS
ugauaaaaaga

SEQ ID NO: 2209339 - RNA, 12 nt, Streptococcus pyogenes M1 GAS
ugauaaaaaaca

SEQ ID NO: 2209340 - RNA, 19 nt, Streptococcus pyogenes M1 GAS
ugauaaaugccguuguaag

SEQ ID NO: 2209341 - RNA, 15 nt, Streptococcus pyogenes M1 GAS
ugaguuuauguaugc

SEQ ID NO: 2209342 - RNA, 13 nt, Streptococcus pyogenes M1 GAS
ugaguugauuuau

SEQ ID NO: 2209343 - RNA, 17 nt, Streptococcus pyogenes M1 GAS
ugaguccgagaaagauu

SEQ ID NO: 2209344 - RNA, 18 nt, Streptococcus pyogenes M1 GAS
ugauaagguuuuuuuaag

SEQ ID NO: 2209345 - RNA, 20 nt, Streptococcus pyogenes M1 GAS
ucgagcuuucuacuaaaaaa

SEQ ID NO: 2209346 - RNA, 14 nt, Streptococcus pyogenes M1 GAS
uccuuuuaaagaca

SEQ ID NO: 2209347 - RNA, 13 nt, Streptococcus pyogenes M1 GAS
uccuuugaccaca

SEQ ID NO: 2209348 - RNA, 16 nt, Streptococcus pyogenes M1 GAS
uccuuggccuucuagu

SEQ ID NO: 2209349 - RNA, 17 nt, Streptococcus pyogenes M1 GAS
uccuuuuuuugugaggc

SEQ ID NO: 2209350 - RNA, 13 nt, Streptococcus pyogenes M1 GAS
uccuuuugcuucu

SEQ ID NO: 2209351 - RNA, 18 nt, Streptococcus pyogenes M1 GAS
ucgaaauugguccucuga

SEQ ID NO: 2209352 - RNA, 17 nt, Streptococcus pyogenes M1 GAS
uccuggauuaaaugccc

SEQ ID NO: 2209353 - RNA, 19 nt, Streptococcus pyogenes M1 GAS
ucguuuuuugcuuuugaua

SEQ ID NO: 2209354 - RNA, 18 nt, Streptococcus pyogenes M1 GAS
ucgugaauaaucuucaga

SEQ ID NO: 2209355 - RNA, 20 nt, Streptococcus pyogenes M1 GAS
ucguuauaaacaaagccagu

SEQ ID NO: 2209356 - RNA, 14 nt, Streptococcus pyogenes M1 GAS
ucuaauuugugaaa

SEQ ID NO: 2209357 - RNA, 19 nt, Streptococcus pyogenes M1 GAS
ucuaagcuauagaaacuuu

SEQ ID NO: 2209358 - RNA, 17 nt, Streptococcus pyogenes M1 GAS
ucuaacucuuguagaau

SEQ ID NO: 2209359 - RNA, 20 nt, Streptococcus pyogenes M1 GAS
ucuaaaaaagcaauguauga

SEQ ID NO: 2209360 - RNA, 15 nt, Streptococcus pyogenes M1 GAS
ucguauacuuuaaac

SEQ ID NO: 2209361 - RNA, 12 nt, Streptococcus pyogenes M1 GAS
ucguaaaaagau

SEQ ID NO: 2209362 - RNA, 18 nt, Streptococcus pyogenes M1 GAS
ucgguuuuuuuaaguaag

SEQ ID NO: 2209363 - RNA, 19 nt, Streptococcus pyogenes M1 GAS
ucgguuuuagcuucuaaau

SEQ ID NO: 2209364 - RNA, 22 nt, Streptococcus pyogenes M1 GAS
ucgcuuugaauacguaaaaaga

SEQ ID NO: 2209365 - RNA, 20 nt, Streptococcus pyogenes M1 GAS
ucuuuuucguauacuuuaaa

SEQ ID NO: 2209366 - RNA, 18 nt, Streptococcus pyogenes M1 GAS
ugaaaaaaucgcccugga

SEQ ID NO: 2209367 - RNA, 13 nt, Streptococcus pyogenes M1 GAS
ucuuuuuggcuga

SEQ ID NO: 2209368 - RNA, 19 nt, Streptococcus pyogenes M1 GAS
ucuuuguccauuuuuuaua

SEQ ID NO: 2209369 - RNA, 20 nt, Streptococcus pyogenes M1 GAS
ucuuuuaaccauaucacaaa

SEQ ID NO: 2209370 - RNA, 20 nt, Streptococcus pyogenes M1 GAS
ucuuugcaggguaucugcuc

SEQ ID NO: 2209371 - RNA, 18 nt, Streptococcus pyogenes M1 GAS
ucuuuggagaaauucaaa

SEQ ID NO: 2209372 - RNA, 19 nt, Streptococcus pyogenes M1 GAS
ucuuugguuugaugaaccu

SEQ ID NO: 2209373 - RNA, 21 nt, Streptococcus pyogenes M1 GAS
ucuuugguuugaugaaccuca

SEQ ID NO: 2209374 - RNA, 15 nt, Streptococcus pyogenes M1 GAS
ucuuugacaauguca

SEQ ID NO: 2209375 - RNA, 13 nt, Streptococcus pyogenes M1 GAS
ucuuuauccauuc

SEQ ID NO: 2209376 - RNA, 16 nt, Streptococcus pyogenes M1 GAS
ucuuuauccauucuuu

SEQ ID NO: 2209377 - RNA, 19 nt, Streptococcus pyogenes M1 GAS
ucuuucaguuguuuuaacu

SEQ ID NO: 2209378 - RNA, 14 nt, Streptococcus pyogenes M1 GAS
ucuuucauguuuac

SEQ ID NO: 2209379 - RNA, 23 nt, Streptococcus pyogenes M1 GAS
ucuuggauagacugguucaucuu

SEQ ID NO: 2209380 - RNA, 23 nt, Streptococcus pyogenes M1 GAS
ucuuguuuugguugauauaaaau

SEQ ID NO: 2209381 - RNA, 12 nt, Streptococcus pyogenes M1 GAS
ugaaaugauugu

SEQ ID NO: 2209382 - RNA, 17 nt, Streptococcus pyogenes M1 GAS
ugaaaacguguauucuu

SEQ ID NO: 2209383 - RNA, 22 nt, Streptococcus pyogenes M1 GAS
ugaaaagaugcacacaaaucuu

SEQ ID NO: 2209384 - RNA, 23 nt, Streptococcus pyogenes M1 GAS
ugaaaagaugcacacaaaucuuc

SEQ ID NO: 2209385 - RNA, 16 nt, Streptococcus pyogenes M1 GAS
ugaaaaagccuuuaca

SEQ ID NO: 2209386 - RNA, 14 nt, Streptococcus pyogenes M1 GAS
ugaaaauaucuuuu

SEQ ID NO: 2209387 - RNA, 15 nt, Streptococcus pyogenes M1 GAS
ugaaacaccugcugc

SEQ ID NO: 2209388 - RNA, 17 nt, Streptococcus pyogenes M1 GAS
ugaaacaccugcugcuc

SEQ ID NO: 2209389 - RNA, 18 nt, Streptococcus pyogenes M1 GAS
ugaaacaccugcugcucc

SEQ ID NO: 2209390 - RNA, 15 nt, Streptococcus pyogenes M1 GAS
ugaaaguaucuagga

SEQ ID NO: 2209391 - RNA, 20 nt, Streptococcus pyogenes M1 GAS
ugaaacguuauuaaagacaa

SEQ ID NO: 2209392 - RNA, 19 nt, Streptococcus pyogenes M1 GAS
ucuucaauuuuugccaaaa

SEQ ID NO: 2209393 - RNA, 14 nt, Streptococcus pyogenes M1 GAS
ucuuauagcacguu

SEQ ID NO: 2209394 - RNA, 20 nt, Streptococcus pyogenes M1 GAS
ucuuauagcacguuggaaaa

SEQ ID NO: 2209395 - RNA, 14 nt, Streptococcus pyogenes M1 GAS
ucuuacuaugaaaa

SEQ ID NO: 2209396 - RNA, 15 nt, Streptococcus pyogenes M1 GAS
ucuuacuaugaaaaa

SEQ ID NO: 2209397 - RNA, 19 nt, Streptococcus pyogenes M1 GAS
ucugcaaguucuuugccuu

SEQ ID NO: 2209398 - RNA, 18 nt, Streptococcus pyogenes M1 GAS
ucugcagauuuuaagaca

SEQ ID NO: 2209399 - RNA, 14 nt, Streptococcus pyogenes M1 GAS
ucugguuuaucauu

SEQ ID NO: 2209400 - RNA, 19 nt, Streptococcus pyogenes M1 GAS
ucucuacgauagugucaga

SEQ ID NO: 2209401 - RNA, 18 nt, Streptococcus pyogenes M1 GAS
ucucuauaucuaugauuu

SEQ ID NO: 2209402 - RNA, 22 nt, Streptococcus pyogenes M1 GAS
ucucuacuugucaugaugguuu

SEQ ID NO: 2209403 - RNA, 15 nt, Streptococcus pyogenes M1 GAS
ucucuagaacagauu

SEQ ID NO: 2209404 - RNA, 19 nt, Streptococcus pyogenes M1 GAS
ucugaaaauaaaauauuuu

SEQ ID NO: 2209405 - RNA, 14 nt, Streptococcus pyogenes M1 GAS
ucucuuuggagaaa

SEQ ID NO: 2209406 - RNA, 13 nt, Streptococcus pyogenes M1 GAS
ucugauauuucau

SEQ ID NO: 2209407 - RNA, 14 nt, Streptococcus pyogenes M1 GAS
ucugauauuucauc

SEQ ID NO: 2209408 - RNA, 13 nt, Streptococcus pyogenes M1 GAS
ucugagauauuca

SEQ ID NO: 2209409 - RNA, 16 nt, Streptococcus pyogenes M1 GAS
ucugacguaagcauca

SEQ ID NO: 2209410 - RNA, 13 nt, Streptococcus pyogenes M1 GAS
ucugcaacaucaa

SEQ ID NO: 2209411 - RNA, 16 nt, Streptococcus pyogenes M1 GAS
gguuaaguaaaaggga

SEQ ID NO: 2209412 - RNA, 11 nt, Streptococcus pyogenes M1 GAS
guaaaaacuca

SEQ ID NO: 2209413 - RNA, 19 nt, Streptococcus pyogenes M1 GAS
guaaaaagagaagaugagc

SEQ ID NO: 2209414 - RNA, 13 nt, Streptococcus pyogenes M1 GAS
guaaaaagcaaau

SEQ ID NO: 2209415 - RNA, 20 nt, Streptococcus pyogenes M1 GAS
gguuucgccuaggaauaaaa

SEQ ID NO: 2209416 - RNA, 16 nt, Streptococcus pyogenes M1 GAS
gguuucacgauaagaa

SEQ ID NO: 2209417 - RNA, 18 nt, Streptococcus pyogenes M1 GAS
ggucauuauugucacuga

SEQ ID NO: 2209418 - RNA, 15 nt, Streptococcus pyogenes M1 GAS
gguaucacucguaaa

SEQ ID NO: 2209419 - RNA, 14 nt, Streptococcus pyogenes M1 GAS
ggucaacuccaauc

SEQ ID NO: 2209420 - RNA, 13 nt, Streptococcus pyogenes M1 GAS
ggguaaaaaaggg

SEQ ID NO: 2209421 - RNA, 17 nt, Streptococcus pyogenes M1 GAS
ggcuuuccauucuugca

SEQ ID NO: 2209422 - RNA, 15 nt, Streptococcus pyogenes M1 GAS
ggcugucgugcucau

SEQ ID NO: 2209423 - RNA, 12 nt, Streptococcus pyogenes M1 GAS
gggcaaugccau

SEQ ID NO: 2209424 - RNA, 21 nt, Streptococcus pyogenes M1 GAS
gucggcaauacagugaauaau

SEQ ID NO: 2209425 - RNA, 21 nt, Streptococcus pyogenes M1 GAS
gucgcuuuuuuuauuucacua

SEQ ID NO: 2209426 - RNA, 14 nt, Streptococcus pyogenes M1 GAS
gucuaccgcuagga

SEQ ID NO: 2209427 - RNA, 14 nt, Streptococcus pyogenes M1 GAS
gucguuuuuugcuu

SEQ ID NO: 2209428 - RNA, 21 nt, Streptococcus pyogenes M1 GAS
gucguuuuuugcuuuugauac

SEQ ID NO: 2209429 - RNA, 18 nt, Streptococcus pyogenes M1 GAS
gucuaucugcagauuuua

SEQ ID NO: 2209430 - RNA, 13 nt, Streptococcus pyogenes M1 GAS
guccgaaaaaaac

SEQ ID NO: 2209431 - RNA, 19 nt, Streptococcus pyogenes M1 GAS
gucccacaccuacuaacaa

SEQ ID NO: 2209432 - RNA, 21 nt, Streptococcus pyogenes M1 GAS
guccgagaaagauucuugcuu

SEQ ID NO: 2209433 - RNA, 14 nt, Streptococcus pyogenes M1 GAS
guccuccucuuuag

SEQ ID NO: 2209434 - RNA, 22 nt, Streptococcus pyogenes M1 GAS
gucaucaaaagaccauaaaaaa

SEQ ID NO: 2209435 - RNA, 20 nt, Streptococcus pyogenes M1 GAS
guauuguagaggacuaaguc

SEQ ID NO: 2209436 - RNA, 23 nt, Streptococcus pyogenes M1 GAS
guauucuuuuuccguuugagaua

SEQ ID NO: 2209437 - RNA, 22 nt, Streptococcus pyogenes M1 GAS
guauucuaaaauccucuuuuaa

SEQ ID NO: 2209438 - RNA, 16 nt, Streptococcus pyogenes M1 GAS
guauuagcaccagcau

SEQ ID NO: 2209439 - RNA, 19 nt, Streptococcus pyogenes M1 GAS
gucacgaucaagaaacuca

SEQ ID NO: 2209440 - RNA, 16 nt, Streptococcus pyogenes M1 GAS
guaucuaagcuauaga

SEQ ID NO: 2209441 - RNA, 21 nt, Streptococcus pyogenes M1 GAS
guauagacaaacagaaauacu

SEQ ID NO: 2209442 - RNA, 14 nt, Streptococcus pyogenes M1 GAS
guagcguacaugga

SEQ ID NO: 2209443 - RNA, 15 nt, Streptococcus pyogenes M1 GAS
guagauguuguucua

SEQ ID NO: 2209444 - RNA, 21 nt, Streptococcus pyogenes M1 GAS
guagaacgagucaauuuagcc

SEQ ID NO: 2209445 - RNA, 14 nt, Streptococcus pyogenes M1 GAS
guacagaaaugaaa

SEQ ID NO: 2209446 - RNA, 19 nt, Streptococcus pyogenes M1 GAS
guaauuugguggaagagua

SEQ ID NO: 2209447 - RNA, 16 nt, Streptococcus pyogenes M1 GAS
guaauucagcaucguu

SEQ ID NO: 2209448 - RNA, 14 nt, Streptococcus pyogenes M1 GAS
guaauagaauaaaa

SEQ ID NO: 2209449 - RNA, 16 nt, Streptococcus pyogenes M1 GAS
gugggauauuuagaug

SEQ ID NO: 2209450 - RNA, 21 nt, Streptococcus pyogenes M1 GAS
guggauacaagguuaaguaaa

SEQ ID NO: 2209451 - RNA, 15 nt, Streptococcus pyogenes M1 GAS
guuaagcuugcuaag

SEQ ID NO: 2209452 - RNA, 12 nt, Streptococcus pyogenes M1 GAS
guuaacagguga

SEQ ID NO: 2209453 - RNA, 18 nt, Streptococcus pyogenes M1 GAS
guguauucuuaaaaaaau

SEQ ID NO: 2209454 - RNA, 22 nt, Streptococcus pyogenes M1 GAS
guucugagauauucauuuucuu

SEQ ID NO: 2209455 - RNA, 21 nt, Streptococcus pyogenes M1 GAS
guuccuuagcaguuauaauua

SEQ ID NO: 2209456 - RNA, 21 nt, Streptococcus pyogenes M1 GAS
guucuaguuuaggauauaaga

SEQ ID NO: 2209457 - RNA, 13 nt, Streptococcus pyogenes M1 GAS
guuaccagauaaa

SEQ ID NO: 2209458 - RNA, 15 nt, Streptococcus pyogenes M1 GAS
guuacccuugacgau

SEQ ID NO: 2209459 - RNA, 22 nt, Streptococcus pyogenes M1 GAS
guuaguuuuauccccuauucaa

SEQ ID NO: 2209460 - RNA, 19 nt, Streptococcus pyogenes M1 GAS
guuauuaaagacaaaaaac

SEQ ID NO: 2209461 - RNA, 20 nt, Streptococcus pyogenes M1 GAS
guuauuuaugucuugcuaaa

SEQ ID NO: 2209462 - RNA, 20 nt, Streptococcus pyogenes M1 GAS
gugccaguaaggaaaucaau

SEQ ID NO: 2209463 - RNA, 15 nt, Streptococcus pyogenes M1 GAS
gugcaccgacauaca

SEQ ID NO: 2209464 - RNA, 16 nt, Streptococcus pyogenes M1 GAS
gugcaccgacauacaa

SEQ ID NO: 2209465 - RNA, 18 nt, Streptococcus pyogenes M1 GAS
gugacuagauucccagag

SEQ ID NO: 2209466 - RNA, 12 nt, Streptococcus pyogenes M1 GAS
gugaguauaaug

SEQ ID NO: 2209467 - RNA, 14 nt, Streptococcus pyogenes M1 GAS
gugaauaaucuuca

SEQ ID NO: 2209468 - RNA, 22 nt, Streptococcus pyogenes M1 GAS
gugaaaguaucuaggagggacu

SEQ ID NO: 2209469 - RNA, 16 nt, Streptococcus pyogenes M1 GAS
gucuucuucuuuucag

SEQ ID NO: 2209470 - RNA, 16 nt, Streptococcus pyogenes M1 GAS
gucuugauaacaauau

SEQ ID NO: 2209471 - RNA, 18 nt, Streptococcus pyogenes M1 GAS
gucuucuccgacugcagu

SEQ ID NO: 2209472 - RNA, 12 nt, Streptococcus pyogenes M1 GAS
gucuuuaaaaaa

SEQ ID NO: 2209473 - RNA, 13 nt, Streptococcus pyogenes M1 GAS
gucugugaugaau

SEQ ID NO: 2209474 - RNA, 11 nt, Streptococcus pyogenes M1 GAS
gucugcugcua

SEQ ID NO: 2209475 - RNA, 17 nt, Streptococcus pyogenes M1 GAS
gucugcaaguucuuugc

SEQ ID NO: 2209476 - RNA, 17 nt, Streptococcus pyogenes M1 GAS
gucugcaugaagugguu

SEQ ID NO: 2209477 - RNA, 18 nt, Streptococcus pyogenes M1 GAS
gucugcgcgacuaaaauc

SEQ ID NO: 2209478 - RNA, 14 nt, Streptococcus pyogenes M1 GAS
uaaaugacaugaaa

SEQ ID NO: 2209479 - RNA, 18 nt, Streptococcus pyogenes M1 GAS
uaaaggugccuguuuuug

SEQ ID NO: 2209480 - RNA, 20 nt, Streptococcus pyogenes M1 GAS
uaaaggugccuguuuuugcu

SEQ ID NO: 2209481 - RNA, 16 nt, Streptococcus pyogenes M1 GAS
uaaagacaaaaaacua

SEQ ID NO: 2209482 - RNA, 21 nt, Streptococcus pyogenes M1 GAS
uaaagacaaaaaacuagaaac

SEQ ID NO: 2209483 - RNA, 16 nt, Streptococcus pyogenes M1 GAS
uaaagccuuauccauu

SEQ ID NO: 2209484 - RNA, 23 nt, Streptococcus pyogenes M1 GAS
uaaagcguugacaguuaaaaaua

SEQ ID NO: 2209485 - RNA, 15 nt, Streptococcus pyogenes M1 GAS
uaaagagccucagga

SEQ ID NO: 2209486 - RNA, 15 nt, Streptococcus pyogenes M1 GAS
uaaacuacaccauuu

SEQ ID NO: 2209487 - RNA, 18 nt, Streptococcus pyogenes M1 GAS
uaaacgugcuuuaaucuc

SEQ ID NO: 2209488 - RNA, 21 nt, Streptococcus pyogenes M1 GAS
uaaauuuggagagauaaaaag

SEQ ID NO: 2209489 - RNA, 23 nt, Streptococcus pyogenes M1 GAS
uaaauuuggagagauaaaaagua

SEQ ID NO: 2209490 - RNA, 12 nt, Streptococcus pyogenes M1 GAS
uaacaaauuuau

SEQ ID NO: 2209491 - RNA, 22 nt, Streptococcus pyogenes M1 GAS
uaaauuauuaacguuaacaaaa

SEQ ID NO: 2209492 - RNA, 22 nt, Streptococcus pyogenes M1 GAS
uaaauugcgacacagauaagau

SEQ ID NO: 2209493 - RNA, 18 nt, Streptococcus pyogenes M1 GAS
uaacgcuuguuuaugaaa

SEQ ID NO: 2209494 - RNA, 17 nt, Streptococcus pyogenes M1 GAS
uaaccuuuuggcuguau

SEQ ID NO: 2209495 - RNA, 14 nt, Streptococcus pyogenes M1 GAS
uaaccuuugccauu

SEQ ID NO: 2209496 - RNA, 16 nt, Streptococcus pyogenes M1 GAS
uaacaucuugauugua

SEQ ID NO: 2209497 - RNA, 17 nt, Streptococcus pyogenes M1 GAS
uaaccauaucacaaaac

SEQ ID NO: 2209498 - RNA, 22 nt, Streptococcus pyogenes M1 GAS
uaacccgucuuacaauuaauag

SEQ ID NO: 2209499 - RNA, 14 nt, Streptococcus pyogenes M1 GAS
uaaccauugccauu

SEQ ID NO: 2209500 - RNA, 18 nt, Streptococcus pyogenes M1 GAS
uaaccauagaagccaauu

SEQ ID NO: 2209501 - RNA, 15 nt, Streptococcus pyogenes M1 GAS
guuuuuagauaaaaa

SEQ ID NO: 2209502 - RNA, 13 nt, Streptococcus pyogenes M1 GAS
guuuugcaauuaa

SEQ ID NO: 2209503 - RNA, 22 nt, Streptococcus pyogenes M1 GAS
guuuugcacugcuauuucagcu

SEQ ID NO: 2209504 - RNA, 18 nt, Streptococcus pyogenes M1 GAS
uaaaaaaccuuaucaaac

SEQ ID NO: 2209505 - RNA, 17 nt, Streptococcus pyogenes M1 GAS
uaaaaaaguuaucacua

SEQ ID NO: 2209506 - RNA, 21 nt, Streptococcus pyogenes M1 GAS
guuuuuuugucuucuucuuug

SEQ ID NO: 2209507 - RNA, 13 nt, Streptococcus pyogenes M1 GAS
uaaaaaaaucccu

SEQ ID NO: 2209508 - RNA, 15 nt, Streptococcus pyogenes M1 GAS
guuuuuugucuucuu

SEQ ID NO: 2209509 - RNA, 21 nt, Streptococcus pyogenes M1 GAS
guuuuuuuagugaauucuaaa

SEQ ID NO: 2209510 - RNA, 18 nt, Streptococcus pyogenes M1 GAS
uaaaaguuagccaagcaa

SEQ ID NO: 2209511 - RNA, 19 nt, Streptococcus pyogenes M1 GAS
uaaaaguuagccaagcaau

SEQ ID NO: 2209512 - RNA, 13 nt, Streptococcus pyogenes M1 GAS
uaaaauagcaccu

SEQ ID NO: 2209513 - RNA, 12 nt, Streptococcus pyogenes M1 GAS
uaaaaacaaugc

SEQ ID NO: 2209514 - RNA, 14 nt, Streptococcus pyogenes M1 GAS
uaaaaaauuuaaua

SEQ ID NO: 2209515 - RNA, 16 nt, Streptococcus pyogenes M1 GAS
uaaaagaaaaucuaau

SEQ ID NO: 2209516 - RNA, 15 nt, Streptococcus pyogenes M1 GAS
guuuuagcuucuaaa

SEQ ID NO: 2209517 - RNA, 16 nt, Streptococcus pyogenes M1 GAS
guuuuagcuucuaaau

SEQ ID NO: 2209518 - RNA, 22 nt, Streptococcus pyogenes M1 GAS
guuuuagcgucugcauguccua

SEQ ID NO: 2209519 - RNA, 18 nt, Streptococcus pyogenes M1 GAS
guuuucucagagacaaua

SEQ ID NO: 2209520 - RNA, 23 nt, Streptococcus pyogenes M1 GAS
guuuauuuguugaagugucuuga

SEQ ID NO: 2209521 - RNA, 12 nt, Streptococcus pyogenes M1 GAS
guuuauuuaguu

SEQ ID NO: 2209522 - RNA, 16 nt, Streptococcus pyogenes M1 GAS
guuucauagaagacgg

SEQ ID NO: 2209523 - RNA, 16 nt, Streptococcus pyogenes M1 GAS
ucaaaaaauuaagaag

SEQ ID NO: 2209524 - RNA, 15 nt, Streptococcus pyogenes M1 GAS
ucaaaaauauauucu

SEQ ID NO: 2209525 - RNA, 17 nt, Streptococcus pyogenes M1 GAS
ucaaaaaaagacacaca

SEQ ID NO: 2209526 - RNA, 16 nt, Streptococcus pyogenes M1 GAS
ucaaaaaaacuucaca

SEQ ID NO: 2209527 - RNA, 12 nt, Streptococcus pyogenes M1 GAS
ucaaaaaaagac

SEQ ID NO: 2209528 - RNA, 13 nt, Streptococcus pyogenes M1 GAS
ucaaaaaaagaca

SEQ ID NO: 2209529 - RNA, 15 nt, Streptococcus pyogenes M1 GAS
ucaaaaaaaaggaca

SEQ ID NO: 2209530 - RNA, 20 nt, Streptococcus pyogenes M1 GAS
ucaaaagaccauaaaaaacc

SEQ ID NO: 2209531 - RNA, 15 nt, Streptococcus pyogenes M1 GAS
ucaaaaaucuuuuuc

SEQ ID NO: 2209532 - RNA, 14 nt, Streptococcus pyogenes M1 GAS
uauuuuucgcacag

SEQ ID NO: 2209533 - RNA, 11 nt, Streptococcus pyogenes M1 GAS
uauuuuuuagu

SEQ ID NO: 2209534 - RNA, 16 nt, Streptococcus pyogenes M1 GAS
uauuuuuuaaagcuac

SEQ ID NO: 2209535 - RNA, 19 nt, Streptococcus pyogenes M1 GAS
uauuuugauauuuuuucuc

SEQ ID NO: 2209536 - RNA, 13 nt, Streptococcus pyogenes M1 GAS
uauuuugcuucua

SEQ ID NO: 2209537 - RNA, 22 nt, Streptococcus pyogenes M1 GAS
ucaaauaaaaucguuauuaauu

SEQ ID NO: 2209538 - RNA, 21 nt, Streptococcus pyogenes M1 GAS
ucaaaggguguuuuuuauaug

SEQ ID NO: 2209539 - RNA, 21 nt, Streptococcus pyogenes M1 GAS
ucaacaguugcuugcuuuuuu

SEQ ID NO: 2209540 - RNA, 16 nt, Streptococcus pyogenes M1 GAS
ucaacaguauaacugu

SEQ ID NO: 2209541 - RNA, 21 nt, Streptococcus pyogenes M1 GAS
ucaacaguauaacuguuuuuc

SEQ ID NO: 2209542 - RNA, 15 nt, Streptococcus pyogenes M1 GAS
ucaacaguugcuugc

SEQ ID NO: 2209543 - RNA, 18 nt, Streptococcus pyogenes M1 GAS
ucaacaguugcuugcuuu

SEQ ID NO: 2209544 - RNA, 21 nt, Streptococcus pyogenes M1 GAS
ucaacagauagucaaaaagac

SEQ ID NO: 2209545 - RNA, 19 nt, Streptococcus pyogenes M1 GAS
ucaacaaauccuuuugcuu

SEQ ID NO: 2209546 - RNA, 18 nt, Streptococcus pyogenes M1 GAS
ucaacuggcacaaacucu

SEQ ID NO: 2209547 - RNA, 17 nt, Streptococcus pyogenes M1 GAS
ucaacuuaccagcaccu

SEQ ID NO: 2209548 - RNA, 16 nt, Streptococcus pyogenes M1 GAS
uauugagucuuuuccu

SEQ ID NO: 2209549 - RNA, 21 nt, Streptococcus pyogenes M1 GAS
uauugguugccugaaauauaa

SEQ ID NO: 2209550 - RNA, 22 nt, Streptococcus pyogenes M1 GAS
uauuggccuucuuggaaaacag

SEQ ID NO: 2209551 - RNA, 22 nt, Streptococcus pyogenes M1 GAS
uauuguggcgggccuucuauca

SEQ ID NO: 2209552 - RNA, 14 nt, Streptococcus pyogenes M1 GAS
uauuuaauagcauu

SEQ ID NO: 2209553 - RNA, 23 nt, Streptococcus pyogenes M1 GAS
uauuuaauagcauugucaaauaa

SEQ ID NO: 2209554 - RNA, 17 nt, Streptococcus pyogenes M1 GAS
uauuuuaaguaaaggau

SEQ ID NO: 2209555 - RNA, 17 nt, Streptococcus pyogenes M1 GAS
uauuucgucuaaaaagc

SEQ ID NO: 2209556 - RNA, 16 nt, Streptococcus pyogenes M1 GAS
uauuuauaauuucuuu

SEQ ID NO: 2209557 - RNA, 18 nt, Streptococcus pyogenes M1 GAS
uauuagucuuuaaaaaac

SEQ ID NO: 2209558 - RNA, 19 nt, Streptococcus pyogenes M1 GAS
uauuagucuuuaaaaaacg

SEQ ID NO: 2209559 - RNA, 15 nt, Streptococcus pyogenes M1 GAS
uauuagcaaaaugcu

SEQ ID NO: 2209560 - RNA, 15 nt, Streptococcus pyogenes M1 GAS
uauuaaucaaaaaac

SEQ ID NO: 2209561 - RNA, 21 nt, Streptococcus pyogenes M1 GAS
uauuaagauaccaaaucaaaa

SEQ ID NO: 2209562 - RNA, 22 nt, Streptococcus pyogenes M1 GAS
uauuaaccggcucuaaaauaua

SEQ ID NO: 2209563 - RNA, 20 nt, Streptococcus pyogenes M1 GAS
uauuaaccggcucuaaaaua

SEQ ID NO: 2209564 - RNA, 11 nt, Streptococcus pyogenes M1 GAS
uauucucugcu

SEQ ID NO: 2209565 - RNA, 22 nt, Streptococcus pyogenes M1 GAS
uauucuaaaauccucuuuuaau

SEQ ID NO: 2209566 - RNA, 12 nt, Streptococcus pyogenes M1 GAS
uauuauuuugcu

SEQ ID NO: 2209567 - RNA, 16 nt, Streptococcus pyogenes M1 GAS
uauucauuuucuucuu

SEQ ID NO: 2209568 - RNA, 14 nt, Streptococcus pyogenes M1 GAS
ucacaacuucuaua

SEQ ID NO: 2209569 - RNA, 13 nt, Streptococcus pyogenes M1 GAS
ucaauguuuugcu

SEQ ID NO: 2209570 - RNA, 16 nt, Streptococcus pyogenes M1 GAS
ucaauguuuugcucga

SEQ ID NO: 2209571 - RNA, 13 nt, Streptococcus pyogenes M1 GAS
ucaauuccaucac

SEQ ID NO: 2209572 - RNA, 20 nt, Streptococcus pyogenes M1 GAS
ucaauuccaucacuuccaua

SEQ ID NO: 2209573 - RNA, 18 nt, Streptococcus pyogenes M1 GAS
ucaauuuuguugaguguu

SEQ ID NO: 2209574 - RNA, 18 nt, Streptococcus pyogenes M1 GAS
ucaauuuuugccaaaauc

SEQ ID NO: 2209575 - RNA, 20 nt, Streptococcus pyogenes M1 GAS
ucaauuuuugauuuuaauuu

SEQ ID NO: 2209576 - RNA, 14 nt, Streptococcus pyogenes M1 GAS
ucaaugaaaaguua

SEQ ID NO: 2209577 - RNA, 20 nt, Streptococcus pyogenes M1 GAS
ucaauggaaauuuuaaauga

SEQ ID NO: 2209578 - RNA, 17 nt, Streptococcus pyogenes M1 GAS
ucaauaacagaaauuaa

SEQ ID NO: 2209579 - RNA, 23 nt, Streptococcus pyogenes M1 GAS
ucaaggaaggcuuguucuuuauu

SEQ ID NO: 2209580 - RNA, 23 nt, Streptococcus pyogenes M1 GAS
ucaaggaauugcagcuaaaaaca

SEQ ID NO: 2209581 - RNA, 20 nt, Streptococcus pyogenes M1 GAS
ucaagcuaucgcuaacauuu

SEQ ID NO: 2209582 - RNA, 20 nt, Streptococcus pyogenes M1 GAS
ucaauaacagaaauuaauaa

SEQ ID NO: 2209583 - RNA, 13 nt, Streptococcus pyogenes M1 GAS
ucaauagcugcug

SEQ ID NO: 2209584 - RNA, 21 nt, Streptococcus pyogenes M1 GAS
ucaauauuuuauuaauaagua

SEQ ID NO: 2209585 - RNA, 15 nt, Streptococcus pyogenes M1 GAS
ucacucguaaaaaga

SEQ ID NO: 2209586 - RNA, 15 nt, Streptococcus pyogenes M1 GAS
ucacuauaauuucaa

SEQ ID NO: 2209587 - RNA, 23 nt, Streptococcus pyogenes M1 GAS
ucacuauaauuucaauaauacca

SEQ ID NO: 2209588 - RNA, 19 nt, Streptococcus pyogenes M1 GAS
ucacgaucaagaaacucau

SEQ ID NO: 2209589 - RNA, 14 nt, Streptococcus pyogenes M1 GAS
ucacgauaagaagc

SEQ ID NO: 2209590 - RNA, 22 nt, Streptococcus pyogenes M1 GAS
ucaccuugcuuguagauaccua

SEQ ID NO: 2209591 - RNA, 18 nt, Streptococcus pyogenes M1 GAS
ucaccuuucuauauaacu

SEQ ID NO: 2209592 - RNA, 21 nt, Streptococcus pyogenes M1 GAS
ucaccuuaggcagacaauuau

SEQ ID NO: 2209593 - RNA, 19 nt, Streptococcus pyogenes M1 GAS
ucagaauaagaaaaccuua

SEQ ID NO: 2209594 - RNA, 15 nt, Streptococcus pyogenes M1 GAS
ucagaauaaagaaaa

SEQ ID NO: 2209595 - RNA, 17 nt, Streptococcus pyogenes M1 GAS
ucagaauaaagaaaaag

SEQ ID NO: 2209596 - RNA, 15 nt, Streptococcus pyogenes M1 GAS
ucagaauaagaaaac

SEQ ID NO: 2209597 - RNA, 14 nt, Streptococcus pyogenes M1 GAS
ucagaaagaagaaa

SEQ ID NO: 2209598 - RNA, 19 nt, Streptococcus pyogenes M1 GAS
ucagaucauuaaauugauu

SEQ ID NO: 2209599 - RNA, 19 nt, Streptococcus pyogenes M1 GAS
ucagauaagaccuucaaaa

SEQ ID NO: 2209600 - RNA, 21 nt, Streptococcus pyogenes M1 GAS
ucagauauucuuuggcaagau

SEQ ID NO: 2209601 - RNA, 13 nt, Streptococcus pyogenes M1 GAS
ucagagaugcuuc

SEQ ID NO: 2209602 - RNA, 13 nt, Streptococcus pyogenes M1 GAS
ucagagcuuuuuu

SEQ ID NO: 2209603 - RNA, 19 nt, Streptococcus pyogenes M1 GAS
ucagcaucguuaaguggaa

SEQ ID NO: 2209604 - RNA, 20 nt, Streptococcus pyogenes M1 GAS
ucagcauaaccuuugccauu

SEQ ID NO: 2209605 - RNA, 13 nt, Streptococcus pyogenes M1 GAS
uagcccaagggca

SEQ ID NO: 2209606 - RNA, 20 nt, Streptococcus pyogenes M1 GAS
uagcauugucaaauaaaauc

SEQ ID NO: 2209607 - RNA, 18 nt, Streptococcus pyogenes M1 GAS
uagcaaaggcuucaucaa

SEQ ID NO: 2209608 - RNA, 20 nt, Streptococcus pyogenes M1 GAS
uaggacuaaccccuaaucag

SEQ ID NO: 2209609 - RNA, 16 nt, Streptococcus pyogenes M1 GAS
uaggcagacaauuauu

SEQ ID NO: 2209610 - RNA, 17 nt, Streptococcus pyogenes M1 GAS
uagcguaaagcaaggga

SEQ ID NO: 2209611 - RNA, 17 nt, Streptococcus pyogenes M1 GAS
uaguaaagccuuaucca

SEQ ID NO: 2209612 - RNA, 17 nt, Streptococcus pyogenes M1 GAS
uaguaaccauugccauu

SEQ ID NO: 2209613 - RNA, 20 nt, Streptococcus pyogenes M1 GAS
uaggcuuuuuuuguaucuca

SEQ ID NO: 2209614 - RNA, 18 nt, Streptococcus pyogenes M1 GAS
uaggugauguagggcugu

SEQ ID NO: 2209615 - RNA, 12 nt, Streptococcus pyogenes M1 GAS
uauaagcaauca

SEQ ID NO: 2209616 - RNA, 15 nt, Streptococcus pyogenes M1 GAS
uauaacuguuuuucu

SEQ ID NO: 2209617 - RNA, 20 nt, Streptococcus pyogenes M1 GAS
uauaaccucuagcuugugag

SEQ ID NO: 2209618 - RNA, 17 nt, Streptococcus pyogenes M1 GAS
uauaaagaaacaaaaau

SEQ ID NO: 2209619 - RNA, 20 nt, Streptococcus pyogenes M1 GAS
uauaaacuuguugacucuga

SEQ ID NO: 2209620 - RNA, 23 nt, Streptococcus pyogenes M1 GAS
uauaaaagagugcaguguacuca

SEQ ID NO: 2209621 - RNA, 17 nt, Streptococcus pyogenes M1 GAS
uaguugugucuuuucuu

SEQ ID NO: 2209622 - RNA, 16 nt, Streptococcus pyogenes M1 GAS
uaguugugauauaaaa

SEQ ID NO: 2209623 - RNA, 18 nt, Streptococcus pyogenes M1 GAS
uaguugguauauagcuca

SEQ ID NO: 2209624 - RNA, 14 nt, Streptococcus pyogenes M1 GAS
uaguuuauuacaaa

SEQ ID NO: 2209625 - RNA, 15 nt, Streptococcus pyogenes M1 GAS
uaguugcuucuuuua

SEQ ID NO: 2209626 - RNA, 17 nt, Streptococcus pyogenes M1 GAS
uaguuggauccuuuauc

SEQ ID NO: 2209627 - RNA, 21 nt, Streptococcus pyogenes M1 GAS
uaguucguucauaaauucuaa

SEQ ID NO: 2209628 - RNA, 14 nt, Streptococcus pyogenes M1 GAS
uauccuccuaaaua

SEQ ID NO: 2209629 - RNA, 19 nt, Streptococcus pyogenes M1 GAS
uauccuccuaaauauaaau

SEQ ID NO: 2209630 - RNA, 16 nt, Streptococcus pyogenes M1 GAS
uaucgccaauaaaaaa

SEQ ID NO: 2209631 - RNA, 17 nt, Streptococcus pyogenes M1 GAS
uauccucuuuuaguuca

SEQ ID NO: 2209632 - RNA, 21 nt, Streptococcus pyogenes M1 GAS
uauccuggaacuccuaaaaca

SEQ ID NO: 2209633 - RNA, 22 nt, Streptococcus pyogenes M1 GAS
uauccuggaacuccuaaaacau

SEQ ID NO: 2209634 - RNA, 18 nt, Streptococcus pyogenes M1 GAS
uaucucauaacaaauuua

SEQ ID NO: 2209635 - RNA, 18 nt, Streptococcus pyogenes M1 GAS
uauccaaugaaaacucca

SEQ ID NO: 2209636 - RNA, 15 nt, Streptococcus pyogenes M1 GAS
uauccauuauaaauc

SEQ ID NO: 2209637 - RNA, 16 nt, Streptococcus pyogenes M1 GAS
uauauguguaauuucu

SEQ ID NO: 2209638 - RNA, 21 nt, Streptococcus pyogenes M1 GAS
uauaugucaucaaaagaccau

SEQ ID NO: 2209639 - RNA, 14 nt, Streptococcus pyogenes M1 GAS
uaugcuguccauga

SEQ ID NO: 2209640 - RNA, 18 nt, Streptococcus pyogenes M1 GAS
uauggcuucuaaaaaagu

SEQ ID NO: 2209641 - RNA, 16 nt, Streptococcus pyogenes M1 GAS
uauguuauaagagaag

SEQ ID NO: 2209642 - RNA, 18 nt, Streptococcus pyogenes M1 GAS
uaugugauuauuauucua

SEQ ID NO: 2209643 - RNA, 16 nt, Streptococcus pyogenes M1 GAS
uauguaaauauaaagu

SEQ ID NO: 2209644 - RNA, 22 nt, Streptococcus pyogenes M1 GAS
uauguaacgcuuguuuaugaaa

SEQ ID NO: 2209645 - RNA, 17 nt, Streptococcus pyogenes M1 GAS
uaugauacauugaauaa

SEQ ID NO: 2209646 - RNA, 14 nt, Streptococcus pyogenes M1 GAS
uaugauauaaaaau

SEQ ID NO: 2209647 - RNA, 13 nt, Streptococcus pyogenes M1 GAS
uaugauauaaaaa

SEQ ID NO: 2209648 - RNA, 16 nt, Streptococcus pyogenes M1 GAS
uaugacaaauucuuuu

SEQ ID NO: 2209649 - RNA, 17 nt, Streptococcus pyogenes M1 GAS
uaugacauugacugaca

SEQ ID NO: 2209650 - RNA, 23 nt, Streptococcus pyogenes M1 GAS
uaugauuugucaaaaaguaaaaa

SEQ ID NO: 2209651 - RNA, 18 nt, Streptococcus pyogenes M1 GAS
uacuggucaauggaaauu

SEQ ID NO: 2209652 - RNA, 20 nt, Streptococcus pyogenes M1 GAS
uacuguaauauuuccuuuua

SEQ ID NO: 2209653 - RNA, 20 nt, Streptococcus pyogenes M1 GAS
uacugggucaacuccaaucu

SEQ ID NO: 2209654 - RNA, 14 nt, Streptococcus pyogenes M1 GAS
uacuguauaaacuu

SEQ ID NO: 2209655 - RNA, 14 nt, Streptococcus pyogenes M1 GAS
uacuucaaggaagg

SEQ ID NO: 2209656 - RNA, 12 nt, Streptococcus pyogenes M1 GAS
uacuuuuaaaau

SEQ ID NO: 2209657 - RNA, 16 nt, Streptococcus pyogenes M1 GAS
uacuuugguauucuuu

SEQ ID NO: 2209658 - RNA, 19 nt, Streptococcus pyogenes M1 GAS
uacuuugguauucuuuuuc

SEQ ID NO: 2209659 - RNA, 15 nt, Streptococcus pyogenes M1 GAS
uagaaaaagcaauga

SEQ ID NO: 2209660 - RNA, 21 nt, Streptococcus pyogenes M1 GAS
uacuucugcagucuuuuucau

SEQ ID NO: 2209661 - RNA, 18 nt, Streptococcus pyogenes M1 GAS
uacucuauuuuaaguaaa

SEQ ID NO: 2209662 - RNA, 14 nt, Streptococcus pyogenes M1 GAS
uacucaucuaaaaa

SEQ ID NO: 2209663 - RNA, 17 nt, Streptococcus pyogenes M1 GAS
uacuccguuucuaguuu

SEQ ID NO: 2209664 - RNA, 15 nt, Streptococcus pyogenes M1 GAS
uacuaaaaaaggagc

SEQ ID NO: 2209665 - RNA, 14 nt, Streptococcus pyogenes M1 GAS
uacguuuauuuagu

SEQ ID NO: 2209666 - RNA, 17 nt, Streptococcus pyogenes M1 GAS
uacucaauauaauaaaa

SEQ ID NO: 2209667 - RNA, 17 nt, Streptococcus pyogenes M1 GAS
uaccauuuuuaucugua

SEQ ID NO: 2209668 - RNA, 17 nt, Streptococcus pyogenes M1 GAS
uaccagcaccuucuuuu

SEQ ID NO: 2209669 - RNA, 16 nt, Streptococcus pyogenes M1 GAS
uacgggauuuaguucu

SEQ ID NO: 2209670 - RNA, 17 nt, Streptococcus pyogenes M1 GAS
uaccuuauuuucuaggu

SEQ ID NO: 2209671 - RNA, 21 nt, Streptococcus pyogenes M1 GAS
uaccuauagaaaguuauaaag

SEQ ID NO: 2209672 - RNA, 16 nt, Streptococcus pyogenes M1 GAS
uaauuuuauuuuuuaa

SEQ ID NO: 2209673 - RNA, 19 nt, Streptococcus pyogenes M1 GAS
uacaaaaaaccuuccugua

SEQ ID NO: 2209674 - RNA, 14 nt, Streptococcus pyogenes M1 GAS
uaauuucuugugcu

SEQ ID NO: 2209675 - RNA, 19 nt, Streptococcus pyogenes M1 GAS
uaauuuagucauuucuuca

SEQ ID NO: 2209676 - RNA, 16 nt, Streptococcus pyogenes M1 GAS
uacaccauuuauuaag

SEQ ID NO: 2209677 - RNA, 15 nt, Streptococcus pyogenes M1 GAS
uacaagcauuuugca

SEQ ID NO: 2209678 - RNA, 16 nt, Streptococcus pyogenes M1 GAS
uacaagagcuuaaaag

SEQ ID NO: 2209679 - RNA, 15 nt, Streptococcus pyogenes M1 GAS
uacaagagcuuaaaa

SEQ ID NO: 2209680 - RNA, 16 nt, Streptococcus pyogenes M1 GAS
uaauccaacaacgcua

SEQ ID NO: 2209681 - RNA, 16 nt, Streptococcus pyogenes M1 GAS
uaacguuccaaaaaga

SEQ ID NO: 2209682 - RNA, 11 nt, Streptococcus pyogenes M1 GAS
uaauaguuuuc

SEQ ID NO: 2209683 - RNA, 23 nt, Streptococcus pyogenes M1 GAS
uaauuauuuuaauuuuuccuuaa

SEQ ID NO: 2209684 - RNA, 19 nt, Streptococcus pyogenes M1 GAS
uaauuauuuuaauuuuucc

SEQ ID NO: 2209685 - RNA, 22 nt, Streptococcus pyogenes M1 GAS
uaauggugucgcuuuuuuuauu

SEQ ID NO: 2209686 - RNA, 17 nt, Streptococcus pyogenes M1 GAS
uaaugccaucaaaaaaa

SEQ ID NO: 2209687 - RNA, 15 nt, Streptococcus pyogenes M1 GAS
uaaugccaucaaaaa

SEQ ID NO: 2209688 - RNA, 15 nt, Streptococcus pyogenes M1 GAS
uaaugaccuuugaua

SEQ ID NO: 2209689 - RNA, 15 nt, Streptococcus pyogenes M1 GAS
uaaugauaaggcugc

SEQ ID NO: 2209690 - RNA, 16 nt, Streptococcus pyogenes M1 GAS
ggcacagaaaaaagau

SEQ ID NO: 2209691 - RNA, 15 nt, Streptococcus pyogenes M1 GAS
ggagcuuuaccuccu

SEQ ID NO: 2209692 - RNA, 18 nt, Streptococcus pyogenes M1 GAS
ggagcuuuuuuugguccu

SEQ ID NO: 2209693 - RNA, 19 nt, Streptococcus pyogenes M1 GAS
ggagggacugucaaaaaau

SEQ ID NO: 2209694 - RNA, 13 nt, Streptococcus pyogenes M1 GAS
ggaagaagauccu

SEQ ID NO: 2209695 - RNA, 19 nt, Streptococcus pyogenes M1 GAS
ggaagaucuccaagaucug

SEQ ID NO: 2209696 - RNA, 15 nt, Streptococcus pyogenes M1 GAS
ggaacacucaucaua

SEQ ID NO: 2209697 - RNA, 16 nt, Streptococcus pyogenes M1 GAS
ggaaauugaccaaaag

SEQ ID NO: 2209698 - RNA, 17 nt, Streptococcus pyogenes M1 GAS
ggaaauuuuaaaugaca

SEQ ID NO: 2209699 - RNA, 15 nt, Streptococcus pyogenes M1 GAS
ggaaaacagaaagcg

SEQ ID NO: 2209700 - RNA, 13 nt, Streptococcus pyogenes M1 GAS
ggaaaacagaaag

SEQ ID NO: 2209701 - RNA, 18 nt, Streptococcus pyogenes M1 GAS
gcuuugauuuuucuuguu

SEQ ID NO: 2209702 - RNA, 14 nt, Streptococcus pyogenes M1 GAS
gcuuguucuuuauu

SEQ ID NO: 2209703 - RNA, 22 nt, Streptococcus pyogenes M1 GAS
gcuugucuuuuuuuggccucaa

SEQ ID NO: 2209704 - RNA, 18 nt, Streptococcus pyogenes M1 GAS
gcuuggauuuccucuaac

SEQ ID NO: 2209705 - RNA, 21 nt, Streptococcus pyogenes M1 GAS
gcuugcuuuuuucuaaccucu

SEQ ID NO: 2209706 - RNA, 15 nt, Streptococcus pyogenes M1 GAS
gcuugcuaagagaau

SEQ ID NO: 2209707 - RNA, 13 nt, Streptococcus pyogenes M1 GAS
gcuuccuuugcau

SEQ ID NO: 2209708 - RNA, 22 nt, Streptococcus pyogenes M1 GAS
gcuucuuacuaugaaaaaagaa

SEQ ID NO: 2209709 - RNA, 14 nt, Streptococcus pyogenes M1 GAS
gcuuccaacuccug

SEQ ID NO: 2209710 - RNA, 14 nt, Streptococcus pyogenes M1 GAS
gcugucccagcagc

SEQ ID NO: 2209711 - RNA, 13 nt, Streptococcus pyogenes M1 GAS
gcuguuggauaca

SEQ ID NO: 2209712 - RNA, 20 nt, Streptococcus pyogenes M1 GAS
gcugccuuggccccuuuuuu

SEQ ID NO: 2209713 - RNA, 16 nt, Streptococcus pyogenes M1 GAS
gcugcuaaagcaauca

SEQ ID NO: 2209714 - RNA, 19 nt, Streptococcus pyogenes M1 GAS
gcggaagaacagcauuuuc

SEQ ID NO: 2209715 - RNA, 20 nt, Streptococcus pyogenes M1 GAS
gcucuaauuuagucauuucu

SEQ ID NO: 2209716 - RNA, 22 nt, Streptococcus pyogenes M1 GAS
gcucuaauuuagucauuucuuc

SEQ ID NO: 2209717 - RNA, 13 nt, Streptococcus pyogenes M1 GAS
gcucuuuaucacc

SEQ ID NO: 2209718 - RNA, 16 nt, Streptococcus pyogenes M1 GAS
gcucuuguuuucucaa

SEQ ID NO: 2209719 - RNA, 15 nt, Streptococcus pyogenes M1 GAS
gcucuuuaucaccug

SEQ ID NO: 2209720 - RNA, 13 nt, Streptococcus pyogenes M1 GAS
gcugaaacaccug

SEQ ID NO: 2209721 - RNA, 18 nt, Streptococcus pyogenes M1 GAS
gcucuuaacucucauaaa

SEQ ID NO: 2209722 - RNA, 16 nt, Streptococcus pyogenes M1 GAS
gcugaauaaacaaaau

SEQ ID NO: 2209723 - RNA, 15 nt, Streptococcus pyogenes M1 GAS
gcugagcaaaacaau

SEQ ID NO: 2209724 - RNA, 17 nt, Streptococcus pyogenes M1 GAS
gcugaugacuuguaaaa

SEQ ID NO: 2209725 - RNA, 23 nt, Streptococcus pyogenes M1 GAS
gcuauuauccaacuuuuaucacu

SEQ ID NO: 2209726 - RNA, 18 nt, Streptococcus pyogenes M1 GAS
gcuaugcgaggcuuuuuu

SEQ ID NO: 2209727 - RNA, 17 nt, Streptococcus pyogenes M1 GAS
gcuauuucagcuagacu

SEQ ID NO: 2209728 - RNA, 18 nt, Streptococcus pyogenes M1 GAS
gcuaucaaagcugacagu

SEQ ID NO: 2209729 - RNA, 24 nt, Streptococcus pyogenes M1 GAS
gcuagauugcuuccaacuccugau

SEQ ID NO: 2209730 - RNA, 15 nt, Streptococcus pyogenes M1 GAS
gcuauaacaguucca

SEQ ID NO: 2209731 - RNA, 16 nt, Streptococcus pyogenes M1 GAS
gccaucagcaucugaa

SEQ ID NO: 2209732 - RNA, 14 nt, Streptococcus pyogenes M1 GAS
gccaucaaaaaaag

SEQ ID NO: 2209733 - RNA, 20 nt, Streptococcus pyogenes M1 GAS
gccaucugcuuggauuuccu

SEQ ID NO: 2209734 - RNA, 21 nt, Streptococcus pyogenes M1 GAS
gccagagcaguucagcagcac

SEQ ID NO: 2209735 - RNA, 22 nt, Streptococcus pyogenes M1 GAS
gccagcuacauugggccccaug

SEQ ID NO: 2209736 - RNA, 17 nt, Streptococcus pyogenes M1 GAS
gccaauuguucauuaaa

SEQ ID NO: 2209737 - RNA, 16 nt, Streptococcus pyogenes M1 GAS
gcauuuucaucaucaa

SEQ ID NO: 2209738 - RNA, 17 nt, Streptococcus pyogenes M1 GAS
gcauuuugcaagucucu

SEQ ID NO: 2209739 - RNA, 15 nt, Streptococcus pyogenes M1 GAS
gcauugucaaauaaa

SEQ ID NO: 2209740 - RNA, 15 nt, Streptococcus pyogenes M1 GAS
gcaucuuugcagggu

SEQ ID NO: 2209741 - RNA, 23 nt, Streptococcus pyogenes M1 GAS
gcaucuuugcaggguaucugcuc

SEQ ID NO: 2209742 - RNA, 17 nt, Streptococcus pyogenes M1 GAS
gcaucuacagcaccuuc

SEQ ID NO: 2209743 - RNA, 21 nt, Streptococcus pyogenes M1 GAS
gcaucuacagcaccuucaacc

SEQ ID NO: 2209744 - RNA, 17 nt, Streptococcus pyogenes M1 GAS
gcaucgcaaacagaugc

SEQ ID NO: 2209745 - RNA, 20 nt, Streptococcus pyogenes M1 GAS
gccccuuuuuugacacagau

SEQ ID NO: 2209746 - RNA, 23 nt, Streptococcus pyogenes M1 GAS
gccccuuuuuugacacagaugcg

SEQ ID NO: 2209747 - RNA, 14 nt, Streptococcus pyogenes M1 GAS
gcccuggagcuguu

SEQ ID NO: 2209748 - RNA, 14 nt, Streptococcus pyogenes M1 GAS
gccguccuuaaaag

SEQ ID NO: 2209749 - RNA, 13 nt, Streptococcus pyogenes M1 GAS
gcaccuucaaccg

SEQ ID NO: 2209750 - RNA, 13 nt, Streptococcus pyogenes M1 GAS
gcaccuucuuuua

SEQ ID NO: 2209751 - RNA, 14 nt, Streptococcus pyogenes M1 GAS
gcaaucuucaacac

SEQ ID NO: 2209752 - RNA, 15 nt, Streptococcus pyogenes M1 GAS
gcaauagagccaaga

SEQ ID NO: 2209753 - RNA, 18 nt, Streptococcus pyogenes M1 GAS
gcaaauucuuccuuagca

SEQ ID NO: 2209754 - RNA, 15 nt, Streptococcus pyogenes M1 GAS
gcaaauugaaaaaau

SEQ ID NO: 2209755 - RNA, 16 nt, Streptococcus pyogenes M1 GAS
gcaaauucuuccuuag

SEQ ID NO: 2209756 - RNA, 19 nt, Streptococcus pyogenes M1 GAS
gcaauuguuuuuucaacaa

SEQ ID NO: 2209757 - RNA, 16 nt, Streptococcus pyogenes M1 GAS
gcaauggcuaaaaaga

SEQ ID NO: 2209758 - RNA, 16 nt, Streptococcus pyogenes M1 GAS
gcacagaaaaaagaua

SEQ ID NO: 2209759 - RNA, 17 nt, Streptococcus pyogenes M1 GAS
gcaucacguacagaaau

SEQ ID NO: 2209760 - RNA, 22 nt, Streptococcus pyogenes M1 GAS
gcauaaaagauauuuuaaaaua

SEQ ID NO: 2209761 - RNA, 14 nt, Streptococcus pyogenes M1 GAS
gcagcaaaggcgau

SEQ ID NO: 2209762 - RNA, 14 nt, Streptococcus pyogenes M1 GAS
gcagcaccaguaaa

SEQ ID NO: 2209763 - RNA, 20 nt, Streptococcus pyogenes M1 GAS
gcaaaggcgauuagcccaag

SEQ ID NO: 2209764 - RNA, 12 nt, Streptococcus pyogenes M1 GAS
gcaaaggcuuca

SEQ ID NO: 2209765 - RNA, 21 nt, Streptococcus pyogenes M1 GAS
gcaaaggcuucaucaaugaua

SEQ ID NO: 2209766 - RNA, 17 nt, Streptococcus pyogenes M1 GAS
gauuuuggaugaaagua

SEQ ID NO: 2209767 - RNA, 22 nt, Streptococcus pyogenes M1 GAS
gauuugaccacaccuaauaaaa

SEQ ID NO: 2209768 - RNA, 18 nt, Streptococcus pyogenes M1 GAS
gauuugccgcuacaccac

SEQ ID NO: 2209769 - RNA, 15 nt, Streptococcus pyogenes M1 GAS
gauuauuauucuaaa

SEQ ID NO: 2209770 - RNA, 19 nt, Streptococcus pyogenes M1 GAS
gauuauccucuuauagcac

SEQ ID NO: 2209771 - RNA, 20 nt, Streptococcus pyogenes M1 GAS
gauuaccuguggucaaaagu

SEQ ID NO: 2209772 - RNA, 15 nt, Streptococcus pyogenes M1 GAS
gauuacgauuaaaag

SEQ ID NO: 2209773 - RNA, 21 nt, Streptococcus pyogenes M1 GAS
gauguuuuuacauuuuuacaa

SEQ ID NO: 2209774 - RNA, 15 nt, Streptococcus pyogenes M1 GAS
gaugucauggauauu

SEQ ID NO: 2209775 - RNA, 20 nt, Streptococcus pyogenes M1 GAS
gauguaccaauuuaagguau

SEQ ID NO: 2209776 - RNA, 14 nt, Streptococcus pyogenes M1 GAS
gaugcuucuuucaa

SEQ ID NO: 2209777 - RNA, 22 nt, Streptococcus pyogenes M1 GAS
gaugagauuaacugacaaaaaa

SEQ ID NO: 2209778 - RNA, 16 nt, Streptococcus pyogenes M1 GAS
gaugaaucauuuugga

SEQ ID NO: 2209779 - RNA, 23 nt, Streptococcus pyogenes M1 GAS
gaugacuuguaaaaugauacuuu

SEQ ID NO: 2209780 - RNA, 23 nt, Streptococcus pyogenes M1 GAS
gaugagaaagccaagcuuuaaaa

SEQ ID NO: 2209781 - RNA, 13 nt, Streptococcus pyogenes M1 GAS
gauagcaccuaau

SEQ ID NO: 2209782 - RNA, 15 nt, Streptococcus pyogenes M1 GAS
gauaauauugauauu

SEQ ID NO: 2209783 - RNA, 18 nt, Streptococcus pyogenes M1 GAS
gauaaugauuuauuaaga

SEQ ID NO: 2209784 - RNA, 20 nt, Streptococcus pyogenes M1 GAS
gauacuuugguauucuuuuu

SEQ ID NO: 2209785 - RNA, 12 nt, Streptococcus pyogenes M1 GAS
gauaaaggccug

SEQ ID NO: 2209786 - RNA, 19 nt, Streptococcus pyogenes M1 GAS
gauaaaggccuguauuucu

SEQ ID NO: 2209787 - RNA, 12 nt, Streptococcus pyogenes M1 GAS
gauaaaaaguaa

SEQ ID NO: 2209788 - RNA, 14 nt, Streptococcus pyogenes M1 GAS
gauaaaacaaauaa

SEQ ID NO: 2209789 - RNA, 13 nt, Streptococcus pyogenes M1 GAS
gagugauugaugc

SEQ ID NO: 2209790 - RNA, 14 nt, Streptococcus pyogenes M1 GAS
gagucucuagucuu

SEQ ID NO: 2209791 - RNA, 14 nt, Streptococcus pyogenes M1 GAS
gaauuuccuaaugu

SEQ ID NO: 2209792 - RNA, 12 nt, Streptococcus pyogenes M1 GAS
cuuuuaucacua

SEQ ID NO: 2209793 - RNA, 13 nt, Streptococcus pyogenes M1 GAS
cuuuguugcauug

SEQ ID NO: 2209794 - RNA, 12 nt, Streptococcus pyogenes M1 GAS
cuuuuaaaaucu

SEQ ID NO: 2209795 - RNA, 15 nt, Streptococcus pyogenes M1 GAS
cuuuguccauuuuuu

SEQ ID NO: 2209796 - RNA, 11 nt, Streptococcus pyogenes M1 GAS
cuuuugccacg

SEQ ID NO: 2209797 - RNA, 22 nt, Streptococcus pyogenes M1 GAS
cuuuuuacaucaaaaaaagcaa

SEQ ID NO: 2209798 - RNA, 13 nt, Streptococcus pyogenes M1 GAS
cuuuuucuuuucu

SEQ ID NO: 2209799 - RNA, 18 nt, Streptococcus pyogenes M1 GAS
cuuuuugccuuuaacaug

SEQ ID NO: 2209800 - RNA, 17 nt, Streptococcus pyogenes M1 GAS
gaaaacguguauucuua

SEQ ID NO: 2209801 - RNA, 16 nt, Streptococcus pyogenes M1 GAS
gaaaaguugauauccc

SEQ ID NO: 2209802 - RNA, 15 nt, Streptococcus pyogenes M1 GAS
gaaaaugcauuacau

SEQ ID NO: 2209803 - RNA, 18 nt, Streptococcus pyogenes M1 GAS
gaaaaugcauuacauuua

SEQ ID NO: 2209804 - RNA, 12 nt, Streptococcus pyogenes M1 GAS
gaaaauuaguuu

SEQ ID NO: 2209805 - RNA, 19 nt, Streptococcus pyogenes M1 GAS
cuuuuuuugucguuuuuug

SEQ ID NO: 2209806 - RNA, 20 nt, Streptococcus pyogenes M1 GAS
cuuuuuuugucugacuuaaa

SEQ ID NO: 2209807 - RNA, 16 nt, Streptococcus pyogenes M1 GAS
cuuuuuugacacagau

SEQ ID NO: 2209808 - RNA, 14 nt, Streptococcus pyogenes M1 GAS
cuuuuuucuaaccu

SEQ ID NO: 2209809 - RNA, 14 nt, Streptococcus pyogenes M1 GAS
gaaacaccugcugc

SEQ ID NO: 2209810 - RNA, 18 nt, Streptococcus pyogenes M1 GAS
gaaagaggugcaacugcu

SEQ ID NO: 2209811 - RNA, 17 nt, Streptococcus pyogenes M1 GAS
gaaacuggucaaaagcu

SEQ ID NO: 2209812 - RNA, 16 nt, Streptococcus pyogenes M1 GAS
gaaacugcacugagcc

SEQ ID NO: 2209813 - RNA, 20 nt, Streptococcus pyogenes M1 GAS
gaaacguuauuaaagacaaa

SEQ ID NO: 2209814 - RNA, 15 nt, Streptococcus pyogenes M1 GAS
gaaagcggaagaaca

SEQ ID NO: 2209815 - RNA, 24 nt, Streptococcus pyogenes M1 GAS
gaaauacuccguuucuaguuucau

SEQ ID NO: 2209816 - RNA, 19 nt, Streptococcus pyogenes M1 GAS
gaaccaacuuggacgaagg

SEQ ID NO: 2209817 - RNA, 12 nt, Streptococcus pyogenes M1 GAS
gaacagcugcuu

SEQ ID NO: 2209818 - RNA, 23 nt, Streptococcus pyogenes M1 GAS
gaacaccguuuuuuguuguaaaa

SEQ ID NO: 2209819 - RNA, 16 nt, Streptococcus pyogenes M1 GAS
gaaauuuuaaaugaca

SEQ ID NO: 2209820 - RNA, 16 nt, Streptococcus pyogenes M1 GAS
gaaaugauagcaccua

SEQ ID NO: 2209821 - RNA, 12 nt, Streptococcus pyogenes M1 GAS
gaacuuguccug

SEQ ID NO: 2209822 - RNA, 22 nt, Streptococcus pyogenes M1 GAS
gaagccgcucuaauuuagucau

SEQ ID NO: 2209823 - RNA, 15 nt, Streptococcus pyogenes M1 GAS
gaagcuguucucuuu

SEQ ID NO: 2209824 - RNA, 17 nt, Streptococcus pyogenes M1 GAS
gaacuccuaaaacaugu

SEQ ID NO: 2209825 - RNA, 19 nt, Streptococcus pyogenes M1 GAS
gaacuccuggauuaaaugc

SEQ ID NO: 2209826 - RNA, 14 nt, Streptococcus pyogenes M1 GAS
gaacucgucuuuau

SEQ ID NO: 2209827 - RNA, 17 nt, Streptococcus pyogenes M1 GAS
gaauuauuaguaaccau

SEQ ID NO: 2209828 - RNA, 13 nt, Streptococcus pyogenes M1 GAS
gaauucuaaaaua

SEQ ID NO: 2209829 - RNA, 23 nt, Streptococcus pyogenes M1 GAS
gaaucgcuuuaggaauaucauga

SEQ ID NO: 2209830 - RNA, 16 nt, Streptococcus pyogenes M1 GAS
gaauaaagaaaaaguc

SEQ ID NO: 2209831 - RNA, 13 nt, Streptococcus pyogenes M1 GAS
gaauaaaaugccu

SEQ ID NO: 2209832 - RNA, 15 nt, Streptococcus pyogenes M1 GAS
gaaggcuuguucuuu

SEQ ID NO: 2209833 - RNA, 16 nt, Streptococcus pyogenes M1 GAS
gaaggcucuuaucuuu

SEQ ID NO: 2209834 - RNA, 17 nt, Streptococcus pyogenes M1 GAS
gaauacguaaaaagaga

SEQ ID NO: 2209835 - RNA, 19 nt, Streptococcus pyogenes M1 GAS
gaauaugauauaaaaaugg

SEQ ID NO: 2209836 - RNA, 16 nt, Streptococcus pyogenes M1 GAS
cugucgugcucauaaa

SEQ ID NO: 2209837 - RNA, 21 nt, Streptococcus pyogenes M1 GAS
cuguuggauacaguccaaacu

SEQ ID NO: 2209838 - RNA, 13 nt, Streptococcus pyogenes M1 GAS
cuuacaaaaagcc

SEQ ID NO: 2209839 - RNA, 18 nt, Streptococcus pyogenes M1 GAS
cuuaucaagguugcaagu

SEQ ID NO: 2209840 - RNA, 14 nt, Streptococcus pyogenes M1 GAS
cuuacuaugaaaaa

SEQ ID NO: 2209841 - RNA, 16 nt, Streptococcus pyogenes M1 GAS
cuucaauuuuugccaa

SEQ ID NO: 2209842 - RNA, 21 nt, Streptococcus pyogenes M1 GAS
cuuaucucggagcuuuaccuc

SEQ ID NO: 2209843 - RNA, 17 nt, Streptococcus pyogenes M1 GAS
cuucagguuucuuuugg

SEQ ID NO: 2209844 - RNA, 16 nt, Streptococcus pyogenes M1 GAS
cuuuauccauucuuua

SEQ ID NO: 2209845 - RNA, 14 nt, Streptococcus pyogenes M1 GAS
cuuucaguuguuuu

SEQ ID NO: 2209846 - RNA, 22 nt, Streptococcus pyogenes M1 GAS
cuuguccacgccgaagauguca

SEQ ID NO: 2209847 - RNA, 19 nt, Streptococcus pyogenes M1 GAS
cuuguaaaaugauacuuuc

SEQ ID NO: 2209848 - RNA, 13 nt, Streptococcus pyogenes M1 GAS
cuuggaaaacaga

SEQ ID NO: 2209849 - RNA, 19 nt, Streptococcus pyogenes M1 GAS
cuugucuuuuuuuggccuc

SEQ ID NO: 2209850 - RNA, 14 nt, Streptococcus pyogenes M1 GAS
cuuguuacaaaaaa

SEQ ID NO: 2209851 - RNA, 14 nt, Streptococcus pyogenes M1 GAS
cuuguuuugguuga

SEQ ID NO: 2209852 - RNA, 21 nt, Streptococcus pyogenes M1 GAS
cuuguuuugguugauauaaaa

SEQ ID NO: 2209853 - RNA, 22 nt, Streptococcus pyogenes M1 GAS
cuuuaaaaaguuucugaguuga

SEQ ID NO: 2209854 - RNA, 15 nt, Streptococcus pyogenes M1 GAS
cuuuaacaugaugua

SEQ ID NO: 2209855 - RNA, 14 nt, Streptococcus pyogenes M1 GAS
cuugcuaagagaau

SEQ ID NO: 2209856 - RNA, 16 nt, Streptococcus pyogenes M1 GAS
cuugcuaaaauuucug

SEQ ID NO: 2209857 - RNA, 17 nt, Streptococcus pyogenes M1 GAS
cuugcuaaaauuucuga

SEQ ID NO: 2209858 - RNA, 21 nt, Streptococcus pyogenes M1 GAS
cuugcuaaaauuucugauagg

SEQ ID NO: 2209859 - RNA, 19 nt, Streptococcus pyogenes M1 GAS
cuugcguagacagcaagga

SEQ ID NO: 2209860 - RNA, 15 nt, Streptococcus pyogenes M1 GAS
cuugcucuuguuuuc

SEQ ID NO: 2209861 - RNA, 14 nt, Streptococcus pyogenes M1 GAS
cuugcagaauagaa

SEQ ID NO: 2209862 - RNA, 20 nt, Streptococcus pyogenes M1 GAS
cuugaugucuuggauagacu

SEQ ID NO: 2209863 - RNA, 17 nt, Streptococcus pyogenes M1 GAS
cuugaggugauucuuuu

SEQ ID NO: 2209864 - RNA, 14 nt, Streptococcus pyogenes M1 GAS
cuugauaacaauau

SEQ ID NO: 2209865 - RNA, 13 nt, Streptococcus pyogenes M1 GAS
cuucugacaugau

SEQ ID NO: 2209866 - RNA, 19 nt, Streptococcus pyogenes M1 GAS
cuucuuggaaaacagaaag

SEQ ID NO: 2209867 - RNA, 13 nt, Streptococcus pyogenes M1 GAS
cuucuucuuuuca

SEQ ID NO: 2209868 - RNA, 15 nt, Streptococcus pyogenes M1 GAS
cuucuuacuaugaaa

SEQ ID NO: 2209869 - RNA, 16 nt, Streptococcus pyogenes M1 GAS
cuucuuacuaugaaaa

SEQ ID NO: 2209870 - RNA, 14 nt, Streptococcus pyogenes M1 GAS
cuggcacaaacucu

SEQ ID NO: 2209871 - RNA, 14 nt, Streptococcus pyogenes M1 GAS
cuggagaugagaaa

SEQ ID NO: 2209872 - RNA, 22 nt, Streptococcus pyogenes M1 GAS
cuggagaugagaaagccaagcu

SEQ ID NO: 2209873 - RNA, 23 nt, Streptococcus pyogenes M1 GAS
cuggaaggcacagaaaaaagaua

SEQ ID NO: 2209874 - RNA, 14 nt, Streptococcus pyogenes M1 GAS
cugcuaugcgaggc

SEQ ID NO: 2209875 - RNA, 19 nt, Streptococcus pyogenes M1 GAS
cugcuaugcgaggcuuuuu

SEQ ID NO: 2209876 - RNA, 19 nt, Streptococcus pyogenes M1 GAS
cugucaaaaaauuaagaag

SEQ ID NO: 2209877 - RNA, 20 nt, Streptococcus pyogenes M1 GAS
cugucaacuuaccagcaccu

SEQ ID NO: 2209878 - RNA, 21 nt, Streptococcus pyogenes M1 GAS
cugucaaaaaauuaagaagga

SEQ ID NO: 2209879 - RNA, 15 nt, Streptococcus pyogenes M1 GAS
cuguaaauagauaau

SEQ ID NO: 2209880 - RNA, 23 nt, Streptococcus pyogenes M1 GAS
cuguaaauagauaauguuguuuu

SEQ ID NO: 2209881 - RNA, 16 nt, Streptococcus pyogenes M1 GAS
cugccccaaaaacgcc

SEQ ID NO: 2209882 - RNA, 20 nt, Streptococcus pyogenes M1 GAS
cugccaucggaacagcugaa

SEQ ID NO: 2209883 - RNA, 17 nt, Streptococcus pyogenes M1 GAS
cugcaguagcaugacug

SEQ ID NO: 2209884 - RNA, 14 nt, Streptococcus pyogenes M1 GAS
cugaguucuuuuuc

SEQ ID NO: 2209885 - RNA, 18 nt, Streptococcus pyogenes M1 GAS
cugagucggcaauacagu

SEQ ID NO: 2209886 - RNA, 18 nt, Streptococcus pyogenes M1 GAS
cugaucccuucauuuuac

SEQ ID NO: 2209887 - RNA, 16 nt, Streptococcus pyogenes M1 GAS
cugaucccuucauuuu

SEQ ID NO: 2209888 - RNA, 19 nt, Streptococcus pyogenes M1 GAS
cugauaagguuuuuuuaag

SEQ ID NO: 2209889 - RNA, 13 nt, Streptococcus pyogenes M1 GAS
cugauaaaacuca

SEQ ID NO: 2209890 - RNA, 14 nt, Streptococcus pyogenes M1 GAS
cugauaaaacucaa

SEQ ID NO: 2209891 - RNA, 14 nt, Streptococcus pyogenes M1 GAS
cuaggaauaaaaug

SEQ ID NO: 2209892 - RNA, 14 nt, Streptococcus pyogenes M1 GAS
cuauaacaguucca

SEQ ID NO: 2209893 - RNA, 18 nt, Streptococcus pyogenes M1 GAS
cuauagaaaguaaaaaua

SEQ ID NO: 2209894 - RNA, 21 nt, Streptococcus pyogenes M1 GAS
cuauagaaaguuauaaagaaa

SEQ ID NO: 2209895 - RNA, 14 nt, Streptococcus pyogenes M1 GAS
cuauaccuaaaaaa

SEQ ID NO: 2209896 - RNA, 15 nt, Streptococcus pyogenes M1 GAS
cuauaccuaaaaaau

SEQ ID NO: 2209897 - RNA, 22 nt, Streptococcus pyogenes M1 GAS
cuauaaggagauaggaaacuca

SEQ ID NO: 2209898 - RNA, 15 nt, Streptococcus pyogenes M1 GAS
cuauaauuucaauaa

SEQ ID NO: 2209899 - RNA, 22 nt, Streptococcus pyogenes M1 GAS
cuaugcuaacugauaaaacuca

SEQ ID NO: 2209900 - RNA, 17 nt, Streptococcus pyogenes M1 GAS
cuauggcuucuaaaaaa

SEQ ID NO: 2209901 - RNA, 15 nt, Streptococcus pyogenes M1 GAS
cuaugaaaaaagaac

SEQ ID NO: 2209902 - RNA, 19 nt, Streptococcus pyogenes M1 GAS
cuaucucguaauccuugau

SEQ ID NO: 2209903 - RNA, 18 nt, Streptococcus pyogenes M1 GAS
cuacgguuauuaccuauu

SEQ ID NO: 2209904 - RNA, 13 nt, Streptococcus pyogenes M1 GAS
cucaucuaaaaaa

SEQ ID NO: 2209905 - RNA, 14 nt, Streptococcus pyogenes M1 GAS
cucaucuaaaaaag

SEQ ID NO: 2209906 - RNA, 17 nt, Streptococcus pyogenes M1 GAS
cucaugggcaaauaaac

SEQ ID NO: 2209907 - RNA, 19 nt, Streptococcus pyogenes M1 GAS
cucaucuggguagagauag

SEQ ID NO: 2209908 - RNA, 15 nt, Streptococcus pyogenes M1 GAS
cucagaauaaagaaa

SEQ ID NO: 2209909 - RNA, 17 nt, Streptococcus pyogenes M1 GAS
cucagaauaaagaaaaa

SEQ ID NO: 2209910 - RNA, 21 nt, Streptococcus pyogenes M1 GAS
cucagaauaaagaaaaagucu

SEQ ID NO: 2209911 - RNA, 22 nt, Streptococcus pyogenes M1 GAS
cucagagcuuuuuuuguuuugg

SEQ ID NO: 2209912 - RNA, 16 nt, Streptococcus pyogenes M1 GAS
cucaaucaucaggguu

SEQ ID NO: 2209913 - RNA, 22 nt, Streptococcus pyogenes M1 GAS
cucaaccucugaaggcacagcc

SEQ ID NO: 2209914 - RNA, 21 nt, Streptococcus pyogenes M1 GAS
cuauuuaauaggcuuuuuuug

SEQ ID NO: 2209915 - RNA, 16 nt, Streptococcus pyogenes M1 GAS
cuauuaccuauagaaa

SEQ ID NO: 2209916 - RNA, 16 nt, Streptococcus pyogenes M1 GAS
cuauuucacuuaucau

SEQ ID NO: 2209917 - RNA, 22 nt, Streptococcus pyogenes M1 GAS
cuauuucagcuagacuauaaaa

SEQ ID NO: 2209918 - RNA, 12 nt, Streptococcus pyogenes M1 GAS
cucaaaaaauac

SEQ ID NO: 2209919 - RNA, 17 nt, Streptococcus pyogenes M1 GAS
cucgguuuuuuuaagua

SEQ ID NO: 2209920 - RNA, 20 nt, Streptococcus pyogenes M1 GAS
cuccuagacugugaaaguau

SEQ ID NO: 2209921 - RNA, 22 nt, Streptococcus pyogenes M1 GAS
cuccuaaggaguaguugcuggu

SEQ ID NO: 2209922 - RNA, 12 nt, Streptococcus pyogenes M1 GAS
cguuagcuuuuu

SEQ ID NO: 2209923 - RNA, 21 nt, Streptococcus pyogenes M1 GAS
cguuuaaauguccgaaaaaaa

SEQ ID NO: 2209924 - RNA, 22 nt, Streptococcus pyogenes M1 GAS
cguuuaaauguccgaaaaaaac

SEQ ID NO: 2209925 - RNA, 21 nt, Streptococcus pyogenes M1 GAS
cguuuuacggcuucuacacaa

SEQ ID NO: 2209926 - RNA, 12 nt, Streptococcus pyogenes M1 GAS
cuaaaaaauaac

SEQ ID NO: 2209927 - RNA, 18 nt, Streptococcus pyogenes M1 GAS
cuaaaaaaggagcuagau

SEQ ID NO: 2209928 - RNA, 16 nt, Streptococcus pyogenes M1 GAS
cuaaaagcauaaaaau

SEQ ID NO: 2209929 - RNA, 18 nt, Streptococcus pyogenes M1 GAS
cuaaaagcauaaaaauau

SEQ ID NO: 2209930 - RNA, 23 nt, Streptococcus pyogenes M1 GAS
cuaaaaccauuauaaaagagugc

SEQ ID NO: 2209931 - RNA, 12 nt, Streptococcus pyogenes M1 GAS
cuaacaacaaca

SEQ ID NO: 2209932 - RNA, 21 nt, Streptococcus pyogenes M1 GAS
cuaaagcaucagcauaaccuu

SEQ ID NO: 2209933 - RNA, 17 nt, Streptococcus pyogenes M1 GAS
cuaaguccuuuuaguuu

SEQ ID NO: 2209934 - RNA, 17 nt, Streptococcus pyogenes M1 GAS
cgucuuuauccauucuu

SEQ ID NO: 2209935 - RNA, 15 nt, Streptococcus pyogenes M1 GAS
cgugacaaugugaca

SEQ ID NO: 2209936 - RNA, 14 nt, Streptococcus pyogenes M1 GAS
cgcuauaacaguuc

SEQ ID NO: 2209937 - RNA, 21 nt, Streptococcus pyogenes M1 GAS
cgcuucuauguggagcuuuuu

SEQ ID NO: 2209938 - RNA, 19 nt, Streptococcus pyogenes M1 GAS
cggaaauugaccaaaagaa

SEQ ID NO: 2209939 - RNA, 14 nt, Streptococcus pyogenes M1 GAS
cggaguauuuuuua

SEQ ID NO: 2209940 - RNA, 13 nt, Streptococcus pyogenes M1 GAS
cggcaucuacagc

SEQ ID NO: 2209941 - RNA, 14 nt, Streptococcus pyogenes M1 GAS
cguaaaaagagaag

SEQ ID NO: 2209942 - RNA, 15 nt, Streptococcus pyogenes M1 GAS
cguaauaaaauaaca

SEQ ID NO: 2209943 - RNA, 12 nt, Streptococcus pyogenes M1 GAS
cguaagccaaau

SEQ ID NO: 2209944 - RNA, 16 nt, Streptococcus pyogenes M1 GAS
cgguauccuggaacuc

SEQ ID NO: 2209945 - RNA, 18 nt, Streptococcus pyogenes M1 GAS
cccuugaaauacgcuucu

SEQ ID NO: 2209946 - RNA, 18 nt, Streptococcus pyogenes M1 GAS
cccuuuuuugacacagau

SEQ ID NO: 2209947 - RNA, 21 nt, Streptococcus pyogenes M1 GAS
cccuuuuuugacacagaugcg

SEQ ID NO: 2209948 - RNA, 13 nt, Streptococcus pyogenes M1 GAS
ccgaguuuugcug

SEQ ID NO: 2209949 - RNA, 11 nt, Streptococcus pyogenes M1 GAS
ccugcauaucu

SEQ ID NO: 2209950 - RNA, 22 nt, Streptococcus pyogenes M1 GAS
ccuguagcccuuuuugccuuua

SEQ ID NO: 2209951 - RNA, 18 nt, Streptococcus pyogenes M1 GAS
ccucuuuuuuuuaucauu

SEQ ID NO: 2209952 - RNA, 19 nt, Streptococcus pyogenes M1 GAS
ccucuuggaaacaagagcu

SEQ ID NO: 2209953 - RNA, 13 nt, Streptococcus pyogenes M1 GAS
ccuccaccaaaac

SEQ ID NO: 2209954 - RNA, 19 nt, Streptococcus pyogenes M1 GAS
ccuacgauaaaacaaauaa

SEQ ID NO: 2209955 - RNA, 20 nt, Streptococcus pyogenes M1 GAS
ccuacgauaaaacaaauaau

SEQ ID NO: 2209956 - RNA, 15 nt, Streptococcus pyogenes M1 GAS
ccguaacuugcuuug

SEQ ID NO: 2209957 - RNA, 21 nt, Streptococcus pyogenes M1 GAS
ccuaacaauuuuucaaaaaaa

SEQ ID NO: 2209958 - RNA, 11 nt, Streptococcus pyogenes M1 GAS
ccuaauguaac

SEQ ID NO: 2209959 - RNA, 21 nt, Streptococcus pyogenes M1 GAS
ccguuugagauaacucuucgg

SEQ ID NO: 2209960 - RNA, 19 nt, Streptococcus pyogenes M1 GAS
cgaggcuuuuuugagcauc

SEQ ID NO: 2209961 - RNA, 17 nt, Streptococcus pyogenes M1 GAS
cgauaaucuuugacaau

SEQ ID NO: 2209962 - RNA, 21 nt, Streptococcus pyogenes M1 GAS
cgcauacuggguaucaguccu

SEQ ID NO: 2209963 - RNA, 16 nt, Streptococcus pyogenes M1 GAS
cgauggacacuacuau

SEQ ID NO: 2209964 - RNA, 22 nt, Streptococcus pyogenes M1 GAS
cgauuugguguuugucuuuuuu

SEQ ID NO: 2209965 - RNA, 12 nt, Streptococcus pyogenes M1 GAS
cgauuaaaagau

SEQ ID NO: 2209966 - RNA, 18 nt, Streptococcus pyogenes M1 GAS
ccuuuuuuauugaugauu

SEQ ID NO: 2209967 - RNA, 12 nt, Streptococcus pyogenes M1 GAS
cgaaaaaaacuu

SEQ ID NO: 2209968 - RNA, 18 nt, Streptococcus pyogenes M1 GAS
ccuuuuuggugucagcau

SEQ ID NO: 2209969 - RNA, 17 nt, Streptococcus pyogenes M1 GAS
ccuuucuauauaacugu

SEQ ID NO: 2209970 - RNA, 17 nt, Streptococcus pyogenes M1 GAS
ccuuugaccacacgauu

SEQ ID NO: 2209971 - RNA, 12 nt, Streptococcus pyogenes M1 GAS
ccuuucaagaca

SEQ ID NO: 2209972 - RNA, 20 nt, Streptococcus pyogenes M1 GAS
ccuuucaagacaagcaagca

SEQ ID NO: 2209973 - RNA, 21 nt, Streptococcus pyogenes M1 GAS
ccuuucaagacaagcaagcau

SEQ ID NO: 2209974 - RNA, 21 nt, Streptococcus pyogenes M1 GAS
ccuugcaauagagccaagauu

SEQ ID NO: 2209975 - RNA, 13 nt, Streptococcus pyogenes M1 GAS
ccuuccccaucaa

SEQ ID NO: 2209976 - RNA, 13 nt, Streptococcus pyogenes M1 GAS
ccuucuuggaaaa

SEQ ID NO: 2209977 - RNA, 20 nt, Streptococcus pyogenes M1 GAS
ccuucguauuggccuucuug

SEQ ID NO: 2209978 - RNA, 13 nt, Streptococcus pyogenes M1 GAS
cgaagucucuuuu

SEQ ID NO: 2209979 - RNA, 15 nt, Streptococcus pyogenes M1 GAS
cgaccuuuaacuguu

SEQ ID NO: 2209980 - RNA, 16 nt, Streptococcus pyogenes M1 GAS
cgaccuuucaagacaa

SEQ ID NO: 2209981 - RNA, 18 nt, Streptococcus pyogenes M1 GAS
cgaccuuucaagacaagc

SEQ ID NO: 2209982 - RNA, 15 nt, Streptococcus pyogenes M1 GAS
ccauuaauaauauua

SEQ ID NO: 2209983 - RNA, 16 nt, Streptococcus pyogenes M1 GAS
ccauuauaaaucuuac

SEQ ID NO: 2209984 - RNA, 13 nt, Streptococcus pyogenes M1 GAS
ccauuauaaaaga

SEQ ID NO: 2209985 - RNA, 18 nt, Streptococcus pyogenes M1 GAS
ccccuauucaauauuuua

SEQ ID NO: 2209986 - RNA, 11 nt, Streptococcus pyogenes M1 GAS
ccaugauuuuc

SEQ ID NO: 2209987 - RNA, 18 nt, Streptococcus pyogenes M1 GAS
ccaugauugauuuuagcg

SEQ ID NO: 2209988 - RNA, 23 nt, Streptococcus pyogenes M1 GAS
ccaucggaacagcugaaacaccu

SEQ ID NO: 2209989 - RNA, 13 nt, Streptococcus pyogenes M1 GAS
ccaucaaaaaaag

SEQ ID NO: 2209990 - RNA, 15 nt, Streptococcus pyogenes M1 GAS
ccagcugacagccuc

SEQ ID NO: 2209991 - RNA, 18 nt, Streptococcus pyogenes M1 GAS
ccagcugacagccucuug

SEQ ID NO: 2209992 - RNA, 12 nt, Streptococcus pyogenes M1 GAS
ccagcuuacagc

SEQ ID NO: 2209993 - RNA, 13 nt, Streptococcus pyogenes M1 GAS
ccagcaaggcacc

SEQ ID NO: 2209994 - RNA, 23 nt, Streptococcus pyogenes M1 GAS
ccaccuucaggcugcuaaggaca

SEQ ID NO: 2209995 - RNA, 19 nt, Streptococcus pyogenes M1 GAS
ccacaccuacuaacaacaa

SEQ ID NO: 2209996 - RNA, 15 nt, Streptococcus pyogenes M1 GAS
ccacaccuaauaaaa

SEQ ID NO: 2209997 - RNA, 15 nt, Streptococcus pyogenes M1 GAS
ccaauuguugaauaa

SEQ ID NO: 2209998 - RNA, 12 nt, Streptococcus pyogenes M1 GAS
ccaauccuaaca

SEQ ID NO: 2209999 - RNA, 20 nt, Streptococcus pyogenes M1 GAS
ccaauccuaacaauuuuuca

SEQ ID NO: 2210000 - RNA, 22 nt, Streptococcus pyogenes M1 GAS
ccaaucaccuuucuauauaacu

SEQ ID NO: 2210001 - RNA, 13 nt, Streptococcus pyogenes M1 GAS
ccaaugacuaagg

SEQ ID NO: 2210002 - RNA, 20 nt, Streptococcus pyogenes M1 GAS
ccaaggucugcgcgacuaaa

SEQ ID NO: 2210003 - RNA, 22 nt, Streptococcus pyogenes M1 GAS
ccaaggucugcgcgacuaaaau

SEQ ID NO: 2210004 - RNA, 19 nt, Streptococcus pyogenes M1 GAS
ccaaauuucagauaagacc

SEQ ID NO: 2210005 - RNA, 15 nt, Streptococcus pyogenes M1 GAS
ccaaacucaaaccaa

SEQ ID NO: 2210006 - RNA, 11 nt, Streptococcus pyogenes M1 GAS
ccaaaaagaaa

SEQ ID NO: 2210007 - RNA, 23 nt, Streptococcus pyogenes M1 GAS
caguuucccauguuuuauuacca

SEQ ID NO: 2210008 - RNA, 18 nt, Streptococcus pyogenes M1 GAS
cauaaaagauauuuuaaa

SEQ ID NO: 2210009 - RNA, 16 nt, Streptococcus pyogenes M1 GAS
caguccuccucuuuag

SEQ ID NO: 2210010 - RNA, 14 nt, Streptococcus pyogenes M1 GAS
cagcugaaacaccu

SEQ ID NO: 2210011 - RNA, 16 nt, Streptococcus pyogenes M1 GAS
cagcugaaacaccugc

SEQ ID NO: 2210012 - RNA, 21 nt, Streptococcus pyogenes M1 GAS
cagcugaaacaccugcugcuc

SEQ ID NO: 2210013 - RNA, 23 nt, Streptococcus pyogenes M1 GAS
cagcuacauugggccccauggcg

SEQ ID NO: 2210014 - RNA, 16 nt, Streptococcus pyogenes M1 GAS
cagcuaaaaacaaugc

SEQ ID NO: 2210015 - RNA, 21 nt, Streptococcus pyogenes M1 GAS
cauggcuaaugauaaggcugc

SEQ ID NO: 2210016 - RNA, 18 nt, Streptococcus pyogenes M1 GAS
caugaguaagaaauuacu

SEQ ID NO: 2210017 - RNA, 19 nt, Streptococcus pyogenes M1 GAS
caugaguaagaaauuacuu

SEQ ID NO: 2210018 - RNA, 21 nt, Streptococcus pyogenes M1 GAS
caugaugccauuuaaaagggc

SEQ ID NO: 2210019 - RNA, 22 nt, Streptococcus pyogenes M1 GAS
caugaaguauaguuauguuaua

SEQ ID NO: 2210020 - RNA, 15 nt, Streptococcus pyogenes M1 GAS
caugaagugguucaa

SEQ ID NO: 2210021 - RNA, 19 nt, Streptococcus pyogenes M1 GAS
cauuucggacuguuuuuua

SEQ ID NO: 2210022 - RNA, 16 nt, Streptococcus pyogenes M1 GAS
cauuuccuacaaaaua

SEQ ID NO: 2210023 - RNA, 18 nt, Streptococcus pyogenes M1 GAS
cauuuagcgguaucccuu

SEQ ID NO: 2210024 - RNA, 15 nt, Streptococcus pyogenes M1 GAS
cauugccauuaauaa

SEQ ID NO: 2210025 - RNA, 21 nt, Streptococcus pyogenes M1 GAS
cauugccauuaauaauauuaa

SEQ ID NO: 2210026 - RNA, 22 nt, Streptococcus pyogenes M1 GAS
cauugccaucgacgaugugacu

SEQ ID NO: 2210027 - RNA, 18 nt, Streptococcus pyogenes M1 GAS
cauucuugcagaauagaa

SEQ ID NO: 2210028 - RNA, 19 nt, Streptococcus pyogenes M1 GAS
cauuaguccaaaauacauc

SEQ ID NO: 2210029 - RNA, 14 nt, Streptococcus pyogenes M1 GAS
cauuauaaaagagu

SEQ ID NO: 2210030 - RNA, 18 nt, Streptococcus pyogenes M1 GAS
cauguguuguuaggguag

SEQ ID NO: 2210031 - RNA, 21 nt, Streptococcus pyogenes M1 GAS
cauagaagacggaguauuuuu

SEQ ID NO: 2210032 - RNA, 18 nt, Streptococcus pyogenes M1 GAS
cauacaacugacuagcca

SEQ ID NO: 2210033 - RNA, 19 nt, Streptococcus pyogenes M1 GAS
caucaaaggguguuuuuua

SEQ ID NO: 2210034 - RNA, 15 nt, Streptococcus pyogenes M1 GAS
caucaaugauagcuu

SEQ ID NO: 2210035 - RNA, 15 nt, Streptococcus pyogenes M1 GAS
caucacguacagaaa

SEQ ID NO: 2210036 - RNA, 16 nt, Streptococcus pyogenes M1 GAS
caucacguacagaaau

SEQ ID NO: 2210037 - RNA, 16 nt, Streptococcus pyogenes M1 GAS
caucaauguuuugcuc

SEQ ID NO: 2210038 - RNA, 15 nt, Streptococcus pyogenes M1 GAS
caucacuuccauaua

SEQ ID NO: 2210039 - RNA, 20 nt, Streptococcus pyogenes M1 GAS
caucguuaaguggaauguuu

SEQ ID NO: 2210040 - RNA, 15 nt, Streptococcus pyogenes M1 GAS
caucaggauugccau

SEQ ID NO: 2210041 - RNA, 18 nt, Streptococcus pyogenes M1 GAS
caaaauuauuauuuugcu

SEQ ID NO: 2210042 - RNA, 19 nt, Streptococcus pyogenes M1 GAS
caaaauuauuauuuugcuu

SEQ ID NO: 2210043 - RNA, 18 nt, Streptococcus pyogenes M1 GAS
caaaaguccguacacucc

SEQ ID NO: 2210044 - RNA, 23 nt, Streptococcus pyogenes M1 GAS
auuuuucaaaaaaacuucacauu

SEQ ID NO: 2210045 - RNA, 22 nt, Streptococcus pyogenes M1 GAS
auuuuuauaacaauuacaaccc

SEQ ID NO: 2210046 - RNA, 20 nt, Streptococcus pyogenes M1 GAS
caaacucugccaauuguuca

SEQ ID NO: 2210047 - RNA, 15 nt, Streptococcus pyogenes M1 GAS
caaacuauauuguua

SEQ ID NO: 2210048 - RNA, 14 nt, Streptococcus pyogenes M1 GAS
caaacagaaauacu

SEQ ID NO: 2210049 - RNA, 24 nt, Streptococcus pyogenes M1 GAS
caaaucaacauggcuaaugauaag

SEQ ID NO: 2210050 - RNA, 20 nt, Streptococcus pyogenes M1 GAS
caaaggcuucaucaaugaua

SEQ ID NO: 2210051 - RNA, 21 nt, Streptococcus pyogenes M1 GAS
caaaggcuucaucaaugauag

SEQ ID NO: 2210052 - RNA, 17 nt, Streptococcus pyogenes M1 GAS
caaaggauaugaggguc

SEQ ID NO: 2210053 - RNA, 17 nt, Streptococcus pyogenes M1 GAS
caaaucuucugcauuau

SEQ ID NO: 2210054 - RNA, 23 nt, Streptococcus pyogenes M1 GAS
caacaguugcuugcuuuuuucua

SEQ ID NO: 2210055 - RNA, 16 nt, Streptococcus pyogenes M1 GAS
caaggcugucgugcuc

SEQ ID NO: 2210056 - RNA, 20 nt, Streptococcus pyogenes M1 GAS
caaguccugcuuuugaugca

SEQ ID NO: 2210057 - RNA, 22 nt, Streptococcus pyogenes M1 GAS
caagugacaaccuuaaagaccc

SEQ ID NO: 2210058 - RNA, 19 nt, Streptococcus pyogenes M1 GAS
caauaaugccaucaaaaaa

SEQ ID NO: 2210059 - RNA, 13 nt, Streptococcus pyogenes M1 GAS
caauacaguugac

SEQ ID NO: 2210060 - RNA, 18 nt, Streptococcus pyogenes M1 GAS
caauauaauaaaaagcag

SEQ ID NO: 2210061 - RNA, 15 nt, Streptococcus pyogenes M1 GAS
caaucaccuuucuau

SEQ ID NO: 2210062 - RNA, 20 nt, Streptococcus pyogenes M1 GAS
caagaauagcuuuuguaaua

SEQ ID NO: 2210063 - RNA, 19 nt, Streptococcus pyogenes M1 GAS
caacuugggagaguuccug

SEQ ID NO: 2210064 - RNA, 21 nt, Streptococcus pyogenes M1 GAS
caagagcucaaccucugaagg

SEQ ID NO: 2210065 - RNA, 19 nt, Streptococcus pyogenes M1 GAS
caagagcuuaaaaguuagc

SEQ ID NO: 2210066 - RNA, 22 nt, Streptococcus pyogenes M1 GAS
caagaggaggcaacuguggguu

SEQ ID NO: 2210067 - RNA, 23 nt, Streptococcus pyogenes M1 GAS
caagaggaggcaacuguggguua

SEQ ID NO: 2210068 - RNA, 15 nt, Streptococcus pyogenes M1 GAS
caagaggaguugaac

SEQ ID NO: 2210069 - RNA, 14 nt, Streptococcus pyogenes M1 GAS
caagaggaguugaa

SEQ ID NO: 2210070 - RNA, 13 nt, Streptococcus pyogenes M1 GAS
caagauaauauug

SEQ ID NO: 2210071 - RNA, 21 nt, Streptococcus pyogenes M1 GAS
caagacacccccugcuguccc

SEQ ID NO: 2210072 - RNA, 20 nt, Streptococcus pyogenes M1 GAS
caagagcaccgcgaauauga

SEQ ID NO: 2210073 - RNA, 21 nt, Streptococcus pyogenes M1 GAS
caacgaccuccagcugacagc

SEQ ID NO: 2210074 - RNA, 16 nt, Streptococcus pyogenes M1 GAS
caacucgauaaaaacg

SEQ ID NO: 2210075 - RNA, 21 nt, Streptococcus pyogenes M1 GAS
auuuuagguaaaguuaggaaa

SEQ ID NO: 2210076 - RNA, 23 nt, Streptococcus pyogenes M1 GAS
auuuucaagguuguggcugauaa

SEQ ID NO: 2210077 - RNA, 15 nt, Streptococcus pyogenes M1 GAS
auuuuauuuuuuaaa

SEQ ID NO: 2210078 - RNA, 19 nt, Streptococcus pyogenes M1 GAS
auuuugcagguaauuaucu

SEQ ID NO: 2210079 - RNA, 18 nt, Streptococcus pyogenes M1 GAS
auuuuggagagauuuuaa

SEQ ID NO: 2210080 - RNA, 16 nt, Streptococcus pyogenes M1 GAS
auuugacuacuagcau

SEQ ID NO: 2210081 - RNA, 14 nt, Streptococcus pyogenes M1 GAS
auuugacauuaguc

SEQ ID NO: 2210082 - RNA, 17 nt, Streptococcus pyogenes M1 GAS
auuugacauuaguccaa

SEQ ID NO: 2210083 - RNA, 22 nt, Streptococcus pyogenes M1 GAS
auuugaccacaccuaauaaaau

SEQ ID NO: 2210084 - RNA, 20 nt, Streptococcus pyogenes M1 GAS
auuugcagaggcuugcauuu

SEQ ID NO: 2210085 - RNA, 22 nt, Streptococcus pyogenes M1 GAS
auuugcagaggcuugcauuuuu

SEQ ID NO: 2210086 - RNA, 13 nt, Streptococcus pyogenes M1 GAS
auuuggaggugaa

SEQ ID NO: 2210087 - RNA, 14 nt, Streptococcus pyogenes M1 GAS
auuuuaaaauaguu

SEQ ID NO: 2210088 - RNA, 14 nt, Streptococcus pyogenes M1 GAS
auuuuaauuuuucu

SEQ ID NO: 2210089 - RNA, 14 nt, Streptococcus pyogenes M1 GAS
auuuguuuucuuua

SEQ ID NO: 2210090 - RNA, 20 nt, Streptococcus pyogenes M1 GAS
auuucuuucauguuuacagu

SEQ ID NO: 2210091 - RNA, 15 nt, Streptococcus pyogenes M1 GAS
auuucuuugcaaaag

SEQ ID NO: 2210092 - RNA, 23 nt, Streptococcus pyogenes M1 GAS
auuucgucuaaaaagccuuaaug

SEQ ID NO: 2210093 - RNA, 17 nt, Streptococcus pyogenes M1 GAS
auuuaauuuaccccaaa

SEQ ID NO: 2210094 - RNA, 17 nt, Streptococcus pyogenes M1 GAS
auuuaagguauuguuca

SEQ ID NO: 2210095 - RNA, 18 nt, Streptococcus pyogenes M1 GAS
auuguuuuaguaaagccu

SEQ ID NO: 2210096 - RNA, 20 nt, Streptococcus pyogenes M1 GAS
auuuccucuaacauguccaa

SEQ ID NO: 2210097 - RNA, 18 nt, Streptococcus pyogenes M1 GAS
auuucacuagacauucgu

SEQ ID NO: 2210098 - RNA, 18 nt, Streptococcus pyogenes M1 GAS
auuuaugucuugcuaaaa

SEQ ID NO: 2210099 - RNA, 24 nt, Streptococcus pyogenes M1 GAS
auuuaugaggccaauaaugccauc

SEQ ID NO: 2210100 - RNA, 22 nt, Streptococcus pyogenes M1 GAS
auuuaugcugauuuuggaugaa

SEQ ID NO: 2210101 - RNA, 13 nt, Streptococcus pyogenes M1 GAS
auucauuuucuuc

SEQ ID NO: 2210102 - RNA, 14 nt, Streptococcus pyogenes M1 GAS
auuccaaacaucca

SEQ ID NO: 2210103 - RNA, 17 nt, Streptococcus pyogenes M1 GAS
auugcagcuaaaaacaa

SEQ ID NO: 2210104 - RNA, 21 nt, Streptococcus pyogenes M1 GAS
auugacaaauccaaugacuaa

SEQ ID NO: 2210105 - RNA, 23 nt, Streptococcus pyogenes M1 GAS
auugaucucugcaacaucaaggg

SEQ ID NO: 2210106 - RNA, 22 nt, Streptococcus pyogenes M1 GAS
auugaucucugcaacaucaagg

SEQ ID NO: 2210107 - RNA, 14 nt, Streptococcus pyogenes M1 GAS
auuggaaaauacau

SEQ ID NO: 2210108 - RNA, 22 nt, Streptococcus pyogenes M1 GAS
auuggccuucuuggaaaacaga

SEQ ID NO: 2210109 - RNA, 20 nt, Streptococcus pyogenes M1 GAS
auucuagacucuagcauaaa

SEQ ID NO: 2210110 - RNA, 21 nt, Streptococcus pyogenes M1 GAS
auucuaaaauccucuuuuaau

SEQ ID NO: 2210111 - RNA, 22 nt, Streptococcus pyogenes M1 GAS
auucuaacucuuguagaauuuc

SEQ ID NO: 2210112 - RNA, 16 nt, Streptococcus pyogenes M1 GAS
auugaagacaaacauc

SEQ ID NO: 2210113 - RNA, 15 nt, Streptococcus pyogenes M1 GAS
auucuuuauaauggu

SEQ ID NO: 2210114 - RNA, 16 nt, Streptococcus pyogenes M1 GAS
cacuacucguuacaua

SEQ ID NO: 2210115 - RNA, 14 nt, Streptococcus pyogenes M1 GAS
cacucguaaaaaga

SEQ ID NO: 2210116 - RNA, 16 nt, Streptococcus pyogenes M1 GAS
cacguuccaugauuga

SEQ ID NO: 2210117 - RNA, 19 nt, Streptococcus pyogenes M1 GAS
cacgcucaacuggcacaaa

SEQ ID NO: 2210118 - RNA, 21 nt, Streptococcus pyogenes M1 GAS
caccuuaggcagacaauuauu

SEQ ID NO: 2210119 - RNA, 22 nt, Streptococcus pyogenes M1 GAS
caccuucguauuggccuucuug

SEQ ID NO: 2210120 - RNA, 15 nt, Streptococcus pyogenes M1 GAS
caccagccacuacaa

SEQ ID NO: 2210121 - RNA, 13 nt, Streptococcus pyogenes M1 GAS
cacccaaacauuc

SEQ ID NO: 2210122 - RNA, 21 nt, Streptococcus pyogenes M1 GAS
caccauuaaaaaaaccagcuu

SEQ ID NO: 2210123 - RNA, 10 nt, Streptococcus pyogenes M1 GAS
caccaccaau

SEQ ID NO: 2210124 - RNA, 13 nt, Streptococcus pyogenes M1 GAS
caccaccaauaau

SEQ ID NO: 2210125 - RNA, 14 nt, Streptococcus pyogenes M1 GAS
cacaugcauaggau

SEQ ID NO: 2210126 - RNA, 15 nt, Streptococcus pyogenes M1 GAS
cacagccgaauaagg

SEQ ID NO: 2210127 - RNA, 18 nt, Streptococcus pyogenes M1 GAS
cacagccgaauaaggcuc

SEQ ID NO: 2210128 - RNA, 15 nt, Streptococcus pyogenes M1 GAS
cacaguuagugaggu

SEQ ID NO: 2210129 - RNA, 13 nt, Streptococcus pyogenes M1 GAS
cacaauuagccaa

SEQ ID NO: 2210130 - RNA, 13 nt, Streptococcus pyogenes M1 GAS
cacacaaaucuuc

SEQ ID NO: 2210131 - RNA, 17 nt, Streptococcus pyogenes M1 GAS
cacacaaaucuucuaga

SEQ ID NO: 2210132 - RNA, 21 nt, Streptococcus pyogenes M1 GAS
cacagaaaaaagauaaacauc

SEQ ID NO: 2210133 - RNA, 14 nt, Streptococcus pyogenes M1 GAS
caaucaggacaguc

SEQ ID NO: 2210134 - RNA, 21 nt, Streptococcus pyogenes M1 GAS
caauuguuuuuucaacaaauc

SEQ ID NO: 2210135 - RNA, 23 nt, Streptococcus pyogenes M1 GAS
caauuccauacgcuccaacgaua

SEQ ID NO: 2210136 - RNA, 16 nt, Streptococcus pyogenes M1 GAS
aucgccaauaaaaaag

SEQ ID NO: 2210137 - RNA, 22 nt, Streptococcus pyogenes M1 GAS
aucgcuuugaauacguaaaaag

SEQ ID NO: 2210138 - RNA, 23 nt, Streptococcus pyogenes M1 GAS
aucgcuuugaauacguaaaaaga

SEQ ID NO: 2210139 - RNA, 13 nt, Streptococcus pyogenes M1 GAS
aucguuuugcaau

SEQ ID NO: 2210140 - RNA, 15 nt, Streptococcus pyogenes M1 GAS
auccuccuaaauaua

SEQ ID NO: 2210141 - RNA, 21 nt, Streptococcus pyogenes M1 GAS
auccuggaacuccuaaaacau

SEQ ID NO: 2210142 - RNA, 17 nt, Streptococcus pyogenes M1 GAS
auccuaacaauuuuuca

SEQ ID NO: 2210143 - RNA, 11 nt, Streptococcus pyogenes M1 GAS
auccuacugac

SEQ ID NO: 2210144 - RNA, 21 nt, Streptococcus pyogenes M1 GAS
aucccuucauuuuacuauggc

SEQ ID NO: 2210145 - RNA, 14 nt, Streptococcus pyogenes M1 GAS
aucccuacuaggcu

SEQ ID NO: 2210146 - RNA, 22 nt, Streptococcus pyogenes M1 GAS
aucauucuaacauggauaccau

SEQ ID NO: 2210147 - RNA, 20 nt, Streptococcus pyogenes M1 GAS
aucauggagucaaugaaaag

SEQ ID NO: 2210148 - RNA, 17 nt, Streptococcus pyogenes M1 GAS
aucaucaggguugcaug

SEQ ID NO: 2210149 - RNA, 18 nt, Streptococcus pyogenes M1 GAS
aucauauuguuaauaugu

SEQ ID NO: 2210150 - RNA, 19 nt, Streptococcus pyogenes M1 GAS
aucauacaacugacuagcc

SEQ ID NO: 2210151 - RNA, 22 nt, Streptococcus pyogenes M1 GAS
aucauacaacugacuagccaaa

SEQ ID NO: 2210152 - RNA, 14 nt, Streptococcus pyogenes M1 GAS
aucaguagugauga

SEQ ID NO: 2210153 - RNA, 17 nt, Streptococcus pyogenes M1 GAS
aucaggcuuaaacauau

SEQ ID NO: 2210154 - RNA, 16 nt, Streptococcus pyogenes M1 GAS
aucaggcaaaacaaaa

SEQ ID NO: 2210155 - RNA, 22 nt, Streptococcus pyogenes M1 GAS
augcuccuccaccaaaaccaag

SEQ ID NO: 2210156 - RNA, 16 nt, Streptococcus pyogenes M1 GAS
augcuaacugauaaaa

SEQ ID NO: 2210157 - RNA, 17 nt, Streptococcus pyogenes M1 GAS
augcucauaggcagaga

SEQ ID NO: 2210158 - RNA, 19 nt, Streptococcus pyogenes M1 GAS
augcuugcucaauuuuuga

SEQ ID NO: 2210159 - RNA, 16 nt, Streptococcus pyogenes M1 GAS
augcuucuuucaaacg

SEQ ID NO: 2210160 - RNA, 16 nt, Streptococcus pyogenes M1 GAS
augcugaguucuuuuu

SEQ ID NO: 2210161 - RNA, 16 nt, Streptococcus pyogenes M1 GAS
augcuuuuaauuuuau

SEQ ID NO: 2210162 - RNA, 22 nt, Streptococcus pyogenes M1 GAS
auggaugcuccuccaccaaaac

SEQ ID NO: 2210163 - RNA, 21 nt, Streptococcus pyogenes M1 GAS
auggacgucuucuuuuuauua

SEQ ID NO: 2210164 - RNA, 17 nt, Streptococcus pyogenes M1 GAS
auggacggucguguuaa

SEQ ID NO: 2210165 - RNA, 16 nt, Streptococcus pyogenes M1 GAS
auguuauuaaauaaua

SEQ ID NO: 2210166 - RNA, 19 nt, Streptococcus pyogenes M1 GAS
auguucucauaaacaauga

SEQ ID NO: 2210167 - RNA, 22 nt, Streptococcus pyogenes M1 GAS
augucacgaucaagaaacucau

SEQ ID NO: 2210168 - RNA, 22 nt, Streptococcus pyogenes M1 GAS
auguaaauauaaagucagacuu

SEQ ID NO: 2210169 - RNA, 17 nt, Streptococcus pyogenes M1 GAS
auggggugucaggggaa

SEQ ID NO: 2210170 - RNA, 15 nt, Streptococcus pyogenes M1 GAS
auggcuaaaaagaga

SEQ ID NO: 2210171 - RNA, 17 nt, Streptococcus pyogenes M1 GAS
auggcuaaaaagagagc

SEQ ID NO: 2210172 - RNA, 20 nt, Streptococcus pyogenes M1 GAS
augauugaguaagcagcauc

SEQ ID NO: 2210173 - RNA, 21 nt, Streptococcus pyogenes M1 GAS
augauugaguaagcagcauca

SEQ ID NO: 2210174 - RNA, 16 nt, Streptococcus pyogenes M1 GAS
augauuuuaacguuuu

SEQ ID NO: 2210175 - RNA, 21 nt, Streptococcus pyogenes M1 GAS
augaucuguuuaaaaacaaau

SEQ ID NO: 2210176 - RNA, 22 nt, Streptococcus pyogenes M1 GAS
augaugccauuuaaaagggcaa

SEQ ID NO: 2210177 - RNA, 21 nt, Streptococcus pyogenes M1 GAS
augauaauaguagguagaacg

SEQ ID NO: 2210178 - RNA, 13 nt, Streptococcus pyogenes M1 GAS
augauauaaaaau

SEQ ID NO: 2210179 - RNA, 18 nt, Streptococcus pyogenes M1 GAS
augacuauagaaaguaaa

SEQ ID NO: 2210180 - RNA, 19 nt, Streptococcus pyogenes M1 GAS
augacuauagaaaguaaaa

SEQ ID NO: 2210181 - RNA, 18 nt, Streptococcus pyogenes M1 GAS
augacugacaaaacuuca

SEQ ID NO: 2210182 - RNA, 16 nt, Streptococcus pyogenes M1 GAS
augacgguaaauaaag

SEQ ID NO: 2210183 - RNA, 14 nt, Streptococcus pyogenes M1 GAS
aucuuugacaaugu

SEQ ID NO: 2210184 - RNA, 23 nt, Streptococcus pyogenes M1 GAS
augaaaacguguauucuuaaaaa

SEQ ID NO: 2210185 - RNA, 13 nt, Streptococcus pyogenes M1 GAS
augaaaaagaagu

SEQ ID NO: 2210186 - RNA, 14 nt, Streptococcus pyogenes M1 GAS
augaaaacguguau

SEQ ID NO: 2210187 - RNA, 14 nt, Streptococcus pyogenes M1 GAS
augaaaaaagaaca

SEQ ID NO: 2210188 - RNA, 16 nt, Streptococcus pyogenes M1 GAS
aucuucuaaaaugaug

SEQ ID NO: 2210189 - RNA, 17 nt, Streptococcus pyogenes M1 GAS
aucuguuuaaaaacaaa

SEQ ID NO: 2210190 - RNA, 14 nt, Streptococcus pyogenes M1 GAS
aucuuaaauaugac

SEQ ID NO: 2210191 - RNA, 19 nt, Streptococcus pyogenes M1 GAS
aucuucaauuuuugccaaa

SEQ ID NO: 2210192 - RNA, 13 nt, Streptococcus pyogenes M1 GAS
aucuuauuuuuua

SEQ ID NO: 2210193 - RNA, 13 nt, Streptococcus pyogenes M1 GAS
aucuuauuuuaag

SEQ ID NO: 2210194 - RNA, 15 nt, Streptococcus pyogenes M1 GAS
aucuucaacaccuuc

SEQ ID NO: 2210195 - RNA, 19 nt, Streptococcus pyogenes M1 GAS
auauccccuccuugcaaua

SEQ ID NO: 2210196 - RNA, 15 nt, Streptococcus pyogenes M1 GAS
auaguucccuuaaua

SEQ ID NO: 2210197 - RNA, 13 nt, Streptococcus pyogenes M1 GAS
auaguucccuuaa

SEQ ID NO: 2210198 - RNA, 19 nt, Streptococcus pyogenes M1 GAS
auagcgccagcaauuuucc

SEQ ID NO: 2210199 - RNA, 19 nt, Streptococcus pyogenes M1 GAS
auauaagcaaucaucauuu

SEQ ID NO: 2210200 - RNA, 15 nt, Streptococcus pyogenes M1 GAS
auauacugaaaaugc

SEQ ID NO: 2210201 - RNA, 14 nt, Streptococcus pyogenes M1 GAS
auauuagcaaaaug

SEQ ID NO: 2210202 - RNA, 20 nt, Streptococcus pyogenes M1 GAS
auauggguguuggaggucug

SEQ ID NO: 2210203 - RNA, 18 nt, Streptococcus pyogenes M1 GAS
auaugguggguaaaacca

SEQ ID NO: 2210204 - RNA, 22 nt, Streptococcus pyogenes M1 GAS
auaugguggguaaaaccaaccu

SEQ ID NO: 2210205 - RNA, 13 nt, Streptococcus pyogenes M1 GAS
auauuccauauga

SEQ ID NO: 2210206 - RNA, 23 nt, Streptococcus pyogenes M1 GAS
auauuauaguaaccauugccauu

SEQ ID NO: 2210207 - RNA, 16 nt, Streptococcus pyogenes M1 GAS
auauugggacuuuuca

SEQ ID NO: 2210208 - RNA, 19 nt, Streptococcus pyogenes M1 GAS
aucaauaacagaaauuaau

SEQ ID NO: 2210209 - RNA, 18 nt, Streptococcus pyogenes M1 GAS
aucaaaggguguuuuuua

SEQ ID NO: 2210210 - RNA, 18 nt, Streptococcus pyogenes M1 GAS
aucaaaagaccauaaaaa

SEQ ID NO: 2210211 - RNA, 19 nt, Streptococcus pyogenes M1 GAS
aucaaaagaccauaaaaaa

SEQ ID NO: 2210212 - RNA, 14 nt, Streptococcus pyogenes M1 GAS
auacagcauacauc

SEQ ID NO: 2210213 - RNA, 19 nt, Streptococcus pyogenes M1 GAS
auacaagguuaaguaaaag

SEQ ID NO: 2210214 - RNA, 22 nt, Streptococcus pyogenes M1 GAS
auacaacugacuagccaaaucu

SEQ ID NO: 2210215 - RNA, 18 nt, Streptococcus pyogenes M1 GAS
auaaugccaucaaaaaaa

SEQ ID NO: 2210216 - RNA, 19 nt, Streptococcus pyogenes M1 GAS
auaaugccaucaaaaaaag

SEQ ID NO: 2210217 - RNA, 16 nt, Streptococcus pyogenes M1 GAS
auaaugccaucaaaaa

SEQ ID NO: 2210218 - RNA, 15 nt, Streptococcus pyogenes M1 GAS
auaaucugagcgguu

SEQ ID NO: 2210219 - RNA, 21 nt, Streptococcus pyogenes M1 GAS
auaauuccugugacaacccaa

SEQ ID NO: 2210220 - RNA, 13 nt, Streptococcus pyogenes M1 GAS
auaaugguuuuuu

SEQ ID NO: 2210221 - RNA, 19 nt, Streptococcus pyogenes M1 GAS
auaaugguuuuuuugucuu

SEQ ID NO: 2210222 - RNA, 15 nt, Streptococcus pyogenes M1 GAS
auaauuucaauaaua

SEQ ID NO: 2210223 - RNA, 17 nt, Streptococcus pyogenes M1 GAS
auaccaaaucaaaaagc

SEQ ID NO: 2210224 - RNA, 20 nt, Streptococcus pyogenes M1 GAS
auaccaaaucaaaaagcuaa

SEQ ID NO: 2210225 - RNA, 15 nt, Streptococcus pyogenes M1 GAS
auaccauuucuuugc

SEQ ID NO: 2210226 - RNA, 16 nt, Streptococcus pyogenes M1 GAS
auaccauuucuuugca

SEQ ID NO: 2210227 - RNA, 21 nt, Streptococcus pyogenes M1 GAS
auaccauuucuuugcaaaaga

SEQ ID NO: 2210228 - RNA, 14 nt, Streptococcus pyogenes M1 GAS
auaccuaaaaaaua

SEQ ID NO: 2210229 - RNA, 22 nt, Streptococcus pyogenes M1 GAS
auacguuuauuguugcaauaau

SEQ ID NO: 2210230 - RNA, 17 nt, Streptococcus pyogenes M1 GAS
auacuaacuauuuuuac

SEQ ID NO: 2210231 - RNA, 16 nt, Streptococcus pyogenes M1 GAS
auagcauaaaauaguu

SEQ ID NO: 2210232 - RNA, 18 nt, Streptococcus pyogenes M1 GAS
auagcauugucaaauaaa

SEQ ID NO: 2210233 - RNA, 14 nt, Streptococcus pyogenes M1 GAS
auagcauuaaggau

SEQ ID NO: 2210234 - RNA, 19 nt, Streptococcus pyogenes M1 GAS
auagauaauguuguuuuug

SEQ ID NO: 2210235 - RNA, 20 nt, Streptococcus pyogenes M1 GAS
auagauaauguuguuuuugg

SEQ ID NO: 2210236 - RNA, 14 nt, Streptococcus pyogenes M1 GAS
auacuagaaaaagc

SEQ ID NO: 2210237 - RNA, 16 nt, Streptococcus pyogenes M1 GAS
auacuagaaaaagcaa

SEQ ID NO: 2210238 - RNA, 21 nt, Streptococcus pyogenes M1 GAS
auagaagacggaguauuuuuu

SEQ ID NO: 2210239 - RNA, 18 nt, Streptococcus pyogenes M1 GAS
aguugagacuaaaggucu

SEQ ID NO: 2210240 - RNA, 16 nt, Streptococcus pyogenes M1 GAS
aguugguauauagcuc

SEQ ID NO: 2210241 - RNA, 16 nt, Streptococcus pyogenes M1 GAS
aguuuagugcugcuuu

SEQ ID NO: 2210242 - RNA, 16 nt, Streptococcus pyogenes M1 GAS
aguuuauguaugcugu

SEQ ID NO: 2210243 - RNA, 18 nt, Streptococcus pyogenes M1 GAS
aguuaagcuugcuaagag

SEQ ID NO: 2210244 - RNA, 17 nt, Streptococcus pyogenes M1 GAS
aguuaucacuaaggcug

SEQ ID NO: 2210245 - RNA, 14 nt, Streptococcus pyogenes M1 GAS
auaaaacaaauaau

SEQ ID NO: 2210246 - RNA, 15 nt, Streptococcus pyogenes M1 GAS
auaaaacaaauaauu

SEQ ID NO: 2210247 - RNA, 22 nt, Streptococcus pyogenes M1 GAS
auaaaaauauucccaaugcccc

SEQ ID NO: 2210248 - RNA, 14 nt, Streptococcus pyogenes M1 GAS
auaaaaauggcugu

SEQ ID NO: 2210249 - RNA, 20 nt, Streptococcus pyogenes M1 GAS
auaaaacucaaaaagcauuu

SEQ ID NO: 2210250 - RNA, 14 nt, Streptococcus pyogenes M1 GAS
auaaaagauauuuu

SEQ ID NO: 2210251 - RNA, 18 nt, Streptococcus pyogenes M1 GAS
auaaaagauauuuuaaaa

SEQ ID NO: 2210252 - RNA, 20 nt, Streptococcus pyogenes M1 GAS
auaaaagauauuuuaaaaua

SEQ ID NO: 2210253 - RNA, 23 nt, Streptococcus pyogenes M1 GAS
auaaaaucguuauuaauuguuuu

SEQ ID NO: 2210254 - RNA, 23 nt, Streptococcus pyogenes M1 GAS
auaaaauuccccacaaaagacaa

SEQ ID NO: 2210255 - RNA, 17 nt, Streptococcus pyogenes M1 GAS
auaaaauuccccacaaa

SEQ ID NO: 2210256 - RNA, 12 nt, Streptococcus pyogenes M1 GAS
auaaagaaaaag

SEQ ID NO: 2210257 - RNA, 14 nt, Streptococcus pyogenes M1 GAS
auaaagucagacuu

SEQ ID NO: 2210258 - RNA, 21 nt, Streptococcus pyogenes M1 GAS
auaaagucagacuuaauugaa

SEQ ID NO: 2210259 - RNA, 22 nt, Streptococcus pyogenes M1 GAS
auaaauucuaacucuuguagaa

SEQ ID NO: 2210260 - RNA, 21 nt, Streptococcus pyogenes M1 GAS
agugagguuaaucgaccaaaa

SEQ ID NO: 2210261 - RNA, 17 nt, Streptococcus pyogenes M1 GAS
agugaguauaaugcuga

SEQ ID NO: 2210262 - RNA, 15 nt, Streptococcus pyogenes M1 GAS
agugcgcuuccagaa

SEQ ID NO: 2210263 - RNA, 17 nt, Streptococcus pyogenes M1 GAS
agugcuuuuuuauuagu

SEQ ID NO: 2210264 - RNA, 18 nt, Streptococcus pyogenes M1 GAS
aguccaaaauacauccua

SEQ ID NO: 2210265 - RNA, 21 nt, Streptococcus pyogenes M1 GAS
aguccuccucuuuagaauucu

SEQ ID NO: 2210266 - RNA, 14 nt, Streptococcus pyogenes M1 GAS
agucaaugaaaagu

SEQ ID NO: 2210267 - RNA, 16 nt, Streptococcus pyogenes M1 GAS
agucaauuuagccguc

SEQ ID NO: 2210268 - RNA, 20 nt, Streptococcus pyogenes M1 GAS
agucaaaaagacuucuuccu

SEQ ID NO: 2210269 - RNA, 22 nt, Streptococcus pyogenes M1 GAS
agucagaucauuaaauugauua

SEQ ID NO: 2210270 - RNA, 20 nt, Streptococcus pyogenes M1 GAS
aguauaaugcugaacucuuu

SEQ ID NO: 2210271 - RNA, 15 nt, Streptococcus pyogenes M1 GAS
aguagcaccuuuuuu

SEQ ID NO: 2210272 - RNA, 13 nt, Streptococcus pyogenes M1 GAS
aguagcaaauaac

SEQ ID NO: 2210273 - RNA, 17 nt, Streptococcus pyogenes M1 GAS
agccucuuggaaacaag

SEQ ID NO: 2210274 - RNA, 13 nt, Streptococcus pyogenes M1 GAS
agccuuauccauu

SEQ ID NO: 2210275 - RNA, 13 nt, Streptococcus pyogenes M1 GAS
agccgaauaaggc

SEQ ID NO: 2210276 - RNA, 20 nt, Streptococcus pyogenes M1 GAS
agcgccagcaauuuucccau

SEQ ID NO: 2210277 - RNA, 23 nt, Streptococcus pyogenes M1 GAS
agcgccagcaauuuucccaucaa

SEQ ID NO: 2210278 - RNA, 13 nt, Streptococcus pyogenes M1 GAS
agcuaaaaacaau

SEQ ID NO: 2210279 - RNA, 17 nt, Streptococcus pyogenes M1 GAS
agcuaaaagcauaaaaa

SEQ ID NO: 2210280 - RNA, 14 nt, Streptococcus pyogenes M1 GAS
agcuauagaaacuu

SEQ ID NO: 2210281 - RNA, 16 nt, Streptococcus pyogenes M1 GAS
agcuagggcaacugca

SEQ ID NO: 2210282 - RNA, 18 nt, Streptococcus pyogenes M1 GAS
agcguugacaguuaaaaa

SEQ ID NO: 2210283 - RNA, 17 nt, Streptococcus pyogenes M1 GAS
agcguaagccaaaucuu

SEQ ID NO: 2210284 - RNA, 22 nt, Streptococcus pyogenes M1 GAS
agcggcacguuauucucugcua

SEQ ID NO: 2210285 - RNA, 15 nt, Streptococcus pyogenes M1 GAS
agcucgcuaagggaa

SEQ ID NO: 2210286 - RNA, 20 nt, Streptococcus pyogenes M1 GAS
agcucgcuaagggaaaaauu

SEQ ID NO: 2210287 - RNA, 14 nt, Streptococcus pyogenes M1 GAS
agcuccuaaaacca

SEQ ID NO: 2210288 - RNA, 18 nt, Streptococcus pyogenes M1 GAS
agcuccaacgaccuccag

SEQ ID NO: 2210289 - RNA, 20 nt, Streptococcus pyogenes M1 GAS
agcuccaacgaccuccagcu

SEQ ID NO: 2210290 - RNA, 14 nt, Streptococcus pyogenes M1 GAS
agcucuuuaucacc

SEQ ID NO: 2210291 - RNA, 18 nt, Streptococcus pyogenes M1 GAS
agcugacagccucuugga

SEQ ID NO: 2210292 - RNA, 16 nt, Streptococcus pyogenes M1 GAS
agcucugucagcaaua

SEQ ID NO: 2210293 - RNA, 15 nt, Streptococcus pyogenes M1 GAS
agcugagcaaaacaa

SEQ ID NO: 2210294 - RNA, 18 nt, Streptococcus pyogenes M1 GAS
agcugagcaaaacaauaa

SEQ ID NO: 2210295 - RNA, 17 nt, Streptococcus pyogenes M1 GAS
agcaaggaugaaaugau

SEQ ID NO: 2210296 - RNA, 21 nt, Streptococcus pyogenes M1 GAS
agcaagugugacuaguuuauu

SEQ ID NO: 2210297 - RNA, 14 nt, Streptococcus pyogenes M1 GAS
agcaaucuucaaca

SEQ ID NO: 2210298 - RNA, 21 nt, Streptococcus pyogenes M1 GAS
agcaaucuucaacaccuucgu

SEQ ID NO: 2210299 - RNA, 22 nt, Streptococcus pyogenes M1 GAS
agcaaucauacccgcguuaucu

SEQ ID NO: 2210300 - RNA, 23 nt, Streptococcus pyogenes M1 GAS
agcaauggcuaaaaagagagcuu

SEQ ID NO: 2210301 - RNA, 19 nt, Streptococcus pyogenes M1 GAS
agcaacacgcuaucaacag

SEQ ID NO: 2210302 - RNA, 13 nt, Streptococcus pyogenes M1 GAS
agcaaauugaaaa

SEQ ID NO: 2210303 - RNA, 20 nt, Streptococcus pyogenes M1 GAS
agcaaaacaauaacacagaa

SEQ ID NO: 2210304 - RNA, 22 nt, Streptococcus pyogenes M1 GAS
agcaaaacaauaacacagaagc

SEQ ID NO: 2210305 - RNA, 20 nt, Streptococcus pyogenes M1 GAS
agcaaacuaggccaauccua

SEQ ID NO: 2210306 - RNA, 13 nt, Streptococcus pyogenes M1 GAS
agauuuuaaaaaa

SEQ ID NO: 2210307 - RNA, 14 nt, Streptococcus pyogenes M1 GAS
agauuuuaagacaa

SEQ ID NO: 2210308 - RNA, 22 nt, Streptococcus pyogenes M1 GAS
agcagcaccaguaaaggcagga

SEQ ID NO: 2210309 - RNA, 11 nt, Streptococcus pyogenes M1 GAS
agcagcagaag

SEQ ID NO: 2210310 - RNA, 16 nt, Streptococcus pyogenes M1 GAS
agcagcagaagcaaau

SEQ ID NO: 2210311 - RNA, 20 nt, Streptococcus pyogenes M1 GAS
agcagcagaagcaaauucuu

SEQ ID NO: 2210312 - RNA, 22 nt, Streptococcus pyogenes M1 GAS
agcacuggcuuuuuugcuuuuu

SEQ ID NO: 2210313 - RNA, 13 nt, Streptococcus pyogenes M1 GAS
agcaccuucaacc

SEQ ID NO: 2210314 - RNA, 16 nt, Streptococcus pyogenes M1 GAS
agcaauuguuuuuuca

SEQ ID NO: 2210315 - RNA, 12 nt, Streptococcus pyogenes M1 GAS
agcagcaucacg

SEQ ID NO: 2210316 - RNA, 22 nt, Streptococcus pyogenes M1 GAS
agcagcaucacguacagaaaug

SEQ ID NO: 2210317 - RNA, 18 nt, Streptococcus pyogenes M1 GAS
agcaguucagcagcacug

SEQ ID NO: 2210318 - RNA, 18 nt, Streptococcus pyogenes M1 GAS
agcauaaccuuugccauu

SEQ ID NO: 2210319 - RNA, 23 nt, Streptococcus pyogenes M1 GAS
agcauaaaagauauuuuaaaaua

SEQ ID NO: 2210320 - RNA, 15 nt, Streptococcus pyogenes M1 GAS
agcaucugaaaaaau

SEQ ID NO: 2210321 - RNA, 14 nt, Streptococcus pyogenes M1 GAS
agcauauugccacu

SEQ ID NO: 2210322 - RNA, 15 nt, Streptococcus pyogenes M1 GAS
agcauauuuugauua

SEQ ID NO: 2210323 - RNA, 15 nt, Streptococcus pyogenes M1 GAS
agccagagcaguuca

SEQ ID NO: 2210324 - RNA, 23 nt, Streptococcus pyogenes M1 GAS
agccagauggugcuacugaugua

SEQ ID NO: 2210325 - RNA, 22 nt, Streptococcus pyogenes M1 GAS
agccauuagcguagcccucgcu

SEQ ID NO: 2210326 - RNA, 22 nt, Streptococcus pyogenes M1 GAS
agcauuaaggauuaugaaaaag

SEQ ID NO: 2210327 - RNA, 19 nt, Streptococcus pyogenes M1 GAS
agccaaagaaggccagcaa

SEQ ID NO: 2210328 - RNA, 22 nt, Streptococcus pyogenes M1 GAS
agccaaaucuggcuuagcagca

SEQ ID NO: 2210329 - RNA, 13 nt, Streptococcus pyogenes M1 GAS
agcauuuucauca

SEQ ID NO: 2210330 - RNA, 19 nt, Streptococcus pyogenes M1 GAS
agcauuuucaucaucaaga

SEQ ID NO: 2210331 - RNA, 19 nt, Streptococcus pyogenes M1 GAS
agcauuuguuuugauaaaa

SEQ ID NO: 2210332 - RNA, 15 nt, Streptococcus pyogenes M1 GAS
agccaagcuuuaaaa

SEQ ID NO: 2210333 - RNA, 16 nt, Streptococcus pyogenes M1 GAS
acuuggccagcgucug

SEQ ID NO: 2210334 - RNA, 14 nt, Streptococcus pyogenes M1 GAS
acuugggagaguuc

SEQ ID NO: 2210335 - RNA, 16 nt, Streptococcus pyogenes M1 GAS
acuugcuuugacaaag

SEQ ID NO: 2210336 - RNA, 17 nt, Streptococcus pyogenes M1 GAS
acuugcaucgcaaacag

SEQ ID NO: 2210337 - RNA, 20 nt, Streptococcus pyogenes M1 GAS
acuucuuccuuguacaagag

SEQ ID NO: 2210338 - RNA, 22 nt, Streptococcus pyogenes M1 GAS
acuguaauauuuccuuuuaaag

SEQ ID NO: 2210339 - RNA, 15 nt, Streptococcus pyogenes M1 GAS
acuuacaaaaagccu

SEQ ID NO: 2210340 - RNA, 16 nt, Streptococcus pyogenes M1 GAS
acuucaaaaucaccgu

SEQ ID NO: 2210341 - RNA, 14 nt, Streptococcus pyogenes M1 GAS
acuucaaaaauacu

SEQ ID NO: 2210342 - RNA, 15 nt, Streptococcus pyogenes M1 GAS
acuuauuuuuuuaag

SEQ ID NO: 2210343 - RNA, 21 nt, Streptococcus pyogenes M1 GAS
acuuaccagcaccuucuuuua

SEQ ID NO: 2210344 - RNA, 21 nt, Streptococcus pyogenes M1 GAS
acuuugacagacaccaaaaaa

SEQ ID NO: 2210345 - RNA, 19 nt, Streptococcus pyogenes M1 GAS
acuuugacagacaccaaaa

SEQ ID NO: 2210346 - RNA, 21 nt, Streptococcus pyogenes M1 GAS
acuuugcaaaagaauugaaaa

SEQ ID NO: 2210347 - RNA, 16 nt, Streptococcus pyogenes M1 GAS
acuuugguauucuuuu

SEQ ID NO: 2210348 - RNA, 17 nt, Streptococcus pyogenes M1 GAS
acuuuauugaugauaaa

SEQ ID NO: 2210349 - RNA, 22 nt, Streptococcus pyogenes M1 GAS
acuuucaguuaucugauauuuc

SEQ ID NO: 2210350 - RNA, 15 nt, Streptococcus pyogenes M1 GAS
acuuuaaacacuacc

SEQ ID NO: 2210351 - RNA, 21 nt, Streptococcus pyogenes M1 GAS
acuuuaaacacuaccuuaaau

SEQ ID NO: 2210352 - RNA, 18 nt, Streptococcus pyogenes M1 GAS
acuuguuacaaaaaacaa

SEQ ID NO: 2210353 - RNA, 22 nt, Streptococcus pyogenes M1 GAS
agaaauacuccguuucuaguuu

SEQ ID NO: 2210354 - RNA, 11 nt, Streptococcus pyogenes M1 GAS
agaaaaaagau

SEQ ID NO: 2210355 - RNA, 19 nt, Streptococcus pyogenes M1 GAS
agagcaguucagcagcacu

SEQ ID NO: 2210356 - RNA, 16 nt, Streptococcus pyogenes M1 GAS
agauaaacuacaccau

SEQ ID NO: 2210357 - RNA, 15 nt, Streptococcus pyogenes M1 GAS
agagguugguaaaaa

SEQ ID NO: 2210358 - RNA, 19 nt, Streptococcus pyogenes M1 GAS
agagguugguaaaaaggca

SEQ ID NO: 2210359 - RNA, 14 nt, Streptococcus pyogenes M1 GAS
agaguacaaggcaa

SEQ ID NO: 2210360 - RNA, 15 nt, Streptococcus pyogenes M1 GAS
agaguacaaggcaau

SEQ ID NO: 2210361 - RNA, 16 nt, Streptococcus pyogenes M1 GAS
agaguacaaggcaauc

SEQ ID NO: 2210362 - RNA, 19 nt, Streptococcus pyogenes M1 GAS
agaguacaaggcaauccaa

SEQ ID NO: 2210363 - RNA, 16 nt, Streptococcus pyogenes M1 GAS
agagaaucaaagggau

SEQ ID NO: 2210364 - RNA, 20 nt, Streptococcus pyogenes M1 GAS
agacuuggccagcgucugau

SEQ ID NO: 2210365 - RNA, 19 nt, Streptococcus pyogenes M1 GAS
agacuuaauugaaagaggu

SEQ ID NO: 2210366 - RNA, 14 nt, Streptococcus pyogenes M1 GAS
agacuuaaggauuu

SEQ ID NO: 2210367 - RNA, 15 nt, Streptococcus pyogenes M1 GAS
agaccuucaaaaaag

SEQ ID NO: 2210368 - RNA, 14 nt, Streptococcus pyogenes M1 GAS
agacauucguucua

SEQ ID NO: 2210369 - RNA, 14 nt, Streptococcus pyogenes M1 GAS
agacaccaaaaaaa

SEQ ID NO: 2210370 - RNA, 15 nt, Streptococcus pyogenes M1 GAS
agacacccccugcug

SEQ ID NO: 2210371 - RNA, 20 nt, Streptococcus pyogenes M1 GAS
agaauuuuuauaacaauuac

SEQ ID NO: 2210372 - RNA, 14 nt, Streptococcus pyogenes M1 GAS
agacaaacaucgau

SEQ ID NO: 2210373 - RNA, 20 nt, Streptococcus pyogenes M1 GAS
agaagauccuacaagaggag

SEQ ID NO: 2210374 - RNA, 17 nt, Streptococcus pyogenes M1 GAS
agaagauccuacaagag

SEQ ID NO: 2210375 - RNA, 15 nt, Streptococcus pyogenes M1 GAS
agaaauuaauaaauu

SEQ ID NO: 2210376 - RNA, 21 nt, Streptococcus pyogenes M1 GAS
agaaugauaguaaacgaaaau

SEQ ID NO: 2210377 - RNA, 22 nt, Streptococcus pyogenes M1 GAS
agaaguugagacuaaaggucug

SEQ ID NO: 2210378 - RNA, 20 nt, Streptococcus pyogenes M1 GAS
agaauaacgguauccuggaa

SEQ ID NO: 2210379 - RNA, 16 nt, Streptococcus pyogenes M1 GAS
agaauaaagaaaaagu

SEQ ID NO: 2210380 - RNA, 16 nt, Streptococcus pyogenes M1 GAS
agaauagguaaagauu

SEQ ID NO: 2210381 - RNA, 14 nt, Streptococcus pyogenes M1 GAS
agaauaaucugagc

SEQ ID NO: 2210382 - RNA, 16 nt, Streptococcus pyogenes M1 GAS
acgcauuucuuuuuug

SEQ ID NO: 2210383 - RNA, 15 nt, Streptococcus pyogenes M1 GAS
acucuccaaaguucu

SEQ ID NO: 2210384 - RNA, 23 nt, Streptococcus pyogenes M1 GAS
acucgucuuuguccauuuuuuau

SEQ ID NO: 2210385 - RNA, 12 nt, Streptococcus pyogenes M1 GAS
acuaugaaaaaa

SEQ ID NO: 2210386 - RNA, 13 nt, Streptococcus pyogenes M1 GAS
acuaugaaaaaag

SEQ ID NO: 2210387 - RNA, 14 nt, Streptococcus pyogenes M1 GAS
acucaucuaaaaaa

SEQ ID NO: 2210388 - RNA, 15 nt, Streptococcus pyogenes M1 GAS
acucaucuaaaaaag

SEQ ID NO: 2210389 - RNA, 17 nt, Streptococcus pyogenes M1 GAS
acucaucuaaaaaagca

SEQ ID NO: 2210390 - RNA, 18 nt, Streptococcus pyogenes M1 GAS
acucaucauauuguuaau

SEQ ID NO: 2210391 - RNA, 23 nt, Streptococcus pyogenes M1 GAS
acucaugauaucccaucuuuguu

SEQ ID NO: 2210392 - RNA, 13 nt, Streptococcus pyogenes M1 GAS
acuaaguccuuuu

SEQ ID NO: 2210393 - RNA, 17 nt, Streptococcus pyogenes M1 GAS
acuaagguuacccuuga

SEQ ID NO: 2210394 - RNA, 19 nt, Streptococcus pyogenes M1 GAS
acuaggaaucgcuuuagga

SEQ ID NO: 2210395 - RNA, 20 nt, Streptococcus pyogenes M1 GAS
acuaggaaucgcuuuaggaa

SEQ ID NO: 2210396 - RNA, 20 nt, Streptococcus pyogenes M1 GAS
acuagucggguaagggugaa

SEQ ID NO: 2210397 - RNA, 22 nt, Streptococcus pyogenes M1 GAS
acuauauuguuaguuuuauccc

SEQ ID NO: 2210398 - RNA, 13 nt, Streptococcus pyogenes M1 GAS
acuagccaaaucu

SEQ ID NO: 2210399 - RNA, 17 nt, Streptococcus pyogenes M1 GAS
acuagcacaaaaucauu

SEQ ID NO: 2210400 - RNA, 18 nt, Streptococcus pyogenes M1 GAS
acguguauucuuaaaaaa

SEQ ID NO: 2210401 - RNA, 19 nt, Streptococcus pyogenes M1 GAS
acguguauucuuaaaaaaa

SEQ ID NO: 2210402 - RNA, 20 nt, Streptococcus pyogenes M1 GAS
acguguauucuuaaaaaaau

SEQ ID NO: 2210403 - RNA, 15 nt, Streptococcus pyogenes M1 GAS
acguuccaaaaagaa

SEQ ID NO: 2210404 - RNA, 16 nt, Streptococcus pyogenes M1 GAS
acguuccaaaaagaaa

SEQ ID NO: 2210405 - RNA, 15 nt, Streptococcus pyogenes M1 GAS
acgucaaaaaaaagg

SEQ ID NO: 2210406 - RNA, 17 nt, Streptococcus pyogenes M1 GAS
accgcuaggauuuuucc

SEQ ID NO: 2210407 - RNA, 15 nt, Streptococcus pyogenes M1 GAS
acccgucuuacaauu

SEQ ID NO: 2210408 - RNA, 21 nt, Streptococcus pyogenes M1 GAS
accaucaaugacuugaccaaa

SEQ ID NO: 2210409 - RNA, 15 nt, Streptococcus pyogenes M1 GAS
accacaccuaauaaa

SEQ ID NO: 2210410 - RNA, 18 nt, Streptococcus pyogenes M1 GAS
accacaccuaauaaaaua

SEQ ID NO: 2210411 - RNA, 12 nt, Streptococcus pyogenes M1 GAS
accaagauucau

SEQ ID NO: 2210412 - RNA, 22 nt, Streptococcus pyogenes M1 GAS
acauuucgugucuaaaauaauc

SEQ ID NO: 2210413 - RNA, 18 nt, Streptococcus pyogenes M1 GAS
acauuguuuuucuuuguc

SEQ ID NO: 2210414 - RNA, 23 nt, Streptococcus pyogenes M1 GAS
acauuguauuagcaaagugauau

SEQ ID NO: 2210415 - RNA, 22 nt, Streptococcus pyogenes M1 GAS
acauuaguccaaaauacauccu

SEQ ID NO: 2210416 - RNA, 16 nt, Streptococcus pyogenes M1 GAS
acauucguucuaguuu

SEQ ID NO: 2210417 - RNA, 17 nt, Streptococcus pyogenes M1 GAS
acauugacugacagagu

SEQ ID NO: 2210418 - RNA, 13 nt, Streptococcus pyogenes M1 GAS
acauaguguuuug

SEQ ID NO: 2210419 - RNA, 11 nt, Streptococcus pyogenes M1 GAS
acagagucuua

SEQ ID NO: 2210420 - RNA, 23 nt, Streptococcus pyogenes M1 GAS
acagagucuuaguuuaggaauca

SEQ ID NO: 2210421 - RNA, 17 nt, Streptococcus pyogenes M1 GAS
acagauagucaaaaaga

SEQ ID NO: 2210422 - RNA, 13 nt, Streptococcus pyogenes M1 GAS
acacguaagcucc

SEQ ID NO: 2210423 - RNA, 22 nt, Streptococcus pyogenes M1 GAS
acacguuccaugauugauuuua

SEQ ID NO: 2210424 - RNA, 18 nt, Streptococcus pyogenes M1 GAS
acagaaagcggaagaaca

SEQ ID NO: 2210425 - RNA, 12 nt, Streptococcus pyogenes M1 GAS
acagaaagcgga

SEQ ID NO: 2210426 - RNA, 16 nt, Streptococcus pyogenes M1 GAS
acagaagccucuucug

SEQ ID NO: 2210427 - RNA, 13 nt, Streptococcus pyogenes M1 GAS
acagaaaaaagau

SEQ ID NO: 2210428 - RNA, 14 nt, Streptococcus pyogenes M1 GAS
acaccaaaaaaagc

SEQ ID NO: 2210429 - RNA, 21 nt, Streptococcus pyogenes M1 GAS
acaccauuaaaaaaaccagcu

SEQ ID NO: 2210430 - RNA, 23 nt, Streptococcus pyogenes M1 GAS
acaccguuuuuuguuguaaaaag

SEQ ID NO: 2210431 - RNA, 14 nt, Streptococcus pyogenes M1 GAS
acaccuaauaaaau

SEQ ID NO: 2210432 - RNA, 14 nt, Streptococcus pyogenes M1 GAS
acaaugaaacguua

SEQ ID NO: 2210433 - RNA, 20 nt, Streptococcus pyogenes M1 GAS
acaaucaggacagucuuuuu

SEQ ID NO: 2210434 - RNA, 15 nt, Streptococcus pyogenes M1 GAS
acaauaacacagaag

SEQ ID NO: 2210435 - RNA, 13 nt, Streptococcus pyogenes M1 GAS
acaagugcuuuuu

SEQ ID NO: 2210436 - RNA, 20 nt, Streptococcus pyogenes M1 GAS
acacagaugcgcaccuccac

SEQ ID NO: 2210437 - RNA, 19 nt, Streptococcus pyogenes M1 GAS
acacagauaagauacugcc

SEQ ID NO: 2210438 - RNA, 21 nt, Streptococcus pyogenes M1 GAS
acaaugcucuuaacucucaua

SEQ ID NO: 2210439 - RNA, 12 nt, Streptococcus pyogenes M1 GAS
acaauuagccaa

SEQ ID NO: 2210440 - RNA, 17 nt, Streptococcus pyogenes M1 GAS
acaauuauuuugcaggu

SEQ ID NO: 2210441 - RNA, 22 nt, Streptococcus pyogenes M1 GAS
acacaaaaaaccgcccagaaua

SEQ ID NO: 2210442 - RNA, 12 nt, Streptococcus pyogenes M1 GAS
aauuaguuuaac

SEQ ID NO: 2210443 - RNA, 15 nt, Streptococcus pyogenes M1 GAS
aauuaguauauugua

SEQ ID NO: 2210444 - RNA, 13 nt, Streptococcus pyogenes M1 GAS
aauuauacuaacu

SEQ ID NO: 2210445 - RNA, 20 nt, Streptococcus pyogenes M1 GAS
aauuauacuaacuauuuuua

SEQ ID NO: 2210446 - RNA, 17 nt, Streptococcus pyogenes M1 GAS
aauuugguggaagagua

SEQ ID NO: 2210447 - RNA, 13 nt, Streptococcus pyogenes M1 GAS
acaaaagggaaga

SEQ ID NO: 2210448 - RNA, 13 nt, Streptococcus pyogenes M1 GAS
acaaaaagagacc

SEQ ID NO: 2210449 - RNA, 12 nt, Streptococcus pyogenes M1 GAS
aauuuuuccuua

SEQ ID NO: 2210450 - RNA, 18 nt, Streptococcus pyogenes M1 GAS
aauuuuucaaaaaaacuu

SEQ ID NO: 2210451 - RNA, 17 nt, Streptococcus pyogenes M1 GAS
aauuuuuauaacaauua

SEQ ID NO: 2210452 - RNA, 14 nt, Streptococcus pyogenes M1 GAS
aauuuuugccaaaa

SEQ ID NO: 2210453 - RNA, 16 nt, Streptococcus pyogenes M1 GAS
acaacgcuauuuuuaa

SEQ ID NO: 2210454 - RNA, 13 nt, Streptococcus pyogenes M1 GAS
acaaccuuaaaga

SEQ ID NO: 2210455 - RNA, 20 nt, Streptococcus pyogenes M1 GAS
acaacugacuagccaaaucu

SEQ ID NO: 2210456 - RNA, 17 nt, Streptococcus pyogenes M1 GAS
acaagcauuuugcaagu

SEQ ID NO: 2210457 - RNA, 14 nt, Streptococcus pyogenes M1 GAS
acaagagcuuaaaa

SEQ ID NO: 2210458 - RNA, 18 nt, Streptococcus pyogenes M1 GAS
acaagagcuuaaaaguua

SEQ ID NO: 2210459 - RNA, 15 nt, Streptococcus pyogenes M1 GAS
acaagagcuuaaaag

SEQ ID NO: 2210460 - RNA, 19 nt, Streptococcus pyogenes M1 GAS
acaagcaagcaucagcucu

SEQ ID NO: 2210461 - RNA, 14 nt, Streptococcus pyogenes M1 GAS
acaaacugcccuug

SEQ ID NO: 2210462 - RNA, 15 nt, Streptococcus pyogenes M1 GAS
acaaacagaaauacu

SEQ ID NO: 2210463 - RNA, 14 nt, Streptococcus pyogenes M1 GAS
acaaagcaucagga

SEQ ID NO: 2210464 - RNA, 16 nt, Streptococcus pyogenes M1 GAS
acaaagauuggauuuc

SEQ ID NO: 2210465 - RNA, 15 nt, Streptococcus pyogenes M1 GAS
acaaaggauaugagg

SEQ ID NO: 2210466 - RNA, 13 nt, Streptococcus pyogenes M1 GAS
acaaauucuuuuu

SEQ ID NO: 2210467 - RNA, 18 nt, Streptococcus pyogenes M1 GAS
aaggcaauccaaaucaac

SEQ ID NO: 2210468 - RNA, 21 nt, Streptococcus pyogenes M1 GAS
aaggcaauccaaaucaacaug

SEQ ID NO: 2210469 - RNA, 22 nt, Streptococcus pyogenes M1 GAS
aaggcgauuagcccaagggcaa

SEQ ID NO: 2210470 - RNA, 22 nt, Streptococcus pyogenes M1 GAS
aaggcuuguucuuuauuuugau

SEQ ID NO: 2210471 - RNA, 15 nt, Streptococcus pyogenes M1 GAS
aaggcugucgugcuc

SEQ ID NO: 2210472 - RNA, 22 nt, Streptococcus pyogenes M1 GAS
aagguacacgugauaaaugccg

SEQ ID NO: 2210473 - RNA, 15 nt, Streptococcus pyogenes M1 GAS
aaggucucaaauuuu

SEQ ID NO: 2210474 - RNA, 15 nt, Streptococcus pyogenes M1 GAS
aagcuuuaagcuuug

SEQ ID NO: 2210475 - RNA, 17 nt, Streptococcus pyogenes M1 GAS
aaggagcuagauugcuu

SEQ ID NO: 2210476 - RNA, 16 nt, Streptococcus pyogenes M1 GAS
aagcggaagaacagca

SEQ ID NO: 2210477 - RNA, 17 nt, Streptococcus pyogenes M1 GAS
aagcuaucauacaacug

SEQ ID NO: 2210478 - RNA, 22 nt, Streptococcus pyogenes M1 GAS
aagugccaguaaggaaaucaau

SEQ ID NO: 2210479 - RNA, 18 nt, Streptococcus pyogenes M1 GAS
aagugccaguaaggaaau

SEQ ID NO: 2210480 - RNA, 18 nt, Streptococcus pyogenes M1 GAS
aagugauguuuuuacauu

SEQ ID NO: 2210481 - RNA, 12 nt, Streptococcus pyogenes M1 GAS
aaguuaccaauu

SEQ ID NO: 2210482 - RNA, 24 nt, Streptococcus pyogenes M1 GAS
aaguaauaaguagcguacauggau

SEQ ID NO: 2210483 - RNA, 19 nt, Streptococcus pyogenes M1 GAS
aagguuuuuuuaagcauga

SEQ ID NO: 2210484 - RNA, 22 nt, Streptococcus pyogenes M1 GAS
aagucuaucugcagauuuuaag

SEQ ID NO: 2210485 - RNA, 21 nt, Streptococcus pyogenes M1 GAS
aaguuugcggcucggugcuga

SEQ ID NO: 2210486 - RNA, 19 nt, Streptococcus pyogenes M1 GAS
aaguuuuuaucauauucca

SEQ ID NO: 2210487 - RNA, 12 nt, Streptococcus pyogenes M1 GAS
aaguucuuugcc

SEQ ID NO: 2210488 - RNA, 19 nt, Streptococcus pyogenes M1 GAS
aaguuggcuacucuauuuu

SEQ ID NO: 2210489 - RNA, 17 nt, Streptococcus pyogenes M1 GAS
aaguuggcuacucuauu

SEQ ID NO: 2210490 - RNA, 14 nt, Streptococcus pyogenes M1 GAS
aaguuuuuuuguaa

SEQ ID NO: 2210491 - RNA, 12 nt, Streptococcus pyogenes M1 GAS
aagauuggauuu

SEQ ID NO: 2210492 - RNA, 22 nt, Streptococcus pyogenes M1 GAS
aagaugucauggauauuacaag

SEQ ID NO: 2210493 - RNA, 21 nt, Streptococcus pyogenes M1 GAS
aagauuaauuuacuaauccuu

SEQ ID NO: 2210494 - RNA, 18 nt, Streptococcus pyogenes M1 GAS
aagauuaaacuuacaaaa

SEQ ID NO: 2210495 - RNA, 19 nt, Streptococcus pyogenes M1 GAS
aagauuaaacuuacaaaaa

SEQ ID NO: 2210496 - RNA, 19 nt, Streptococcus pyogenes M1 GAS
aagaucugcacacacuuuu

SEQ ID NO: 2210497 - RNA, 17 nt, Streptococcus pyogenes M1 GAS
aagauaccaaaucaaaa

SEQ ID NO: 2210498 - RNA, 21 nt, Streptococcus pyogenes M1 GAS
aagauaccggguuguuuuuuc

SEQ ID NO: 2210499 - RNA, 20 nt, Streptococcus pyogenes M1 GAS
aagauaccaaaucaaaaagc

SEQ ID NO: 2210500 - RNA, 15 nt, Streptococcus pyogenes M1 GAS
aagcauaaaaauauu

SEQ ID NO: 2210501 - RNA, 20 nt, Streptococcus pyogenes M1 GAS
aagcaauguaugacaacuau

SEQ ID NO: 2210502 - RNA, 20 nt, Streptococcus pyogenes M1 GAS
aagcaaaauuauuauuuugc

SEQ ID NO: 2210503 - RNA, 15 nt, Streptococcus pyogenes M1 GAS
aagauaaacaucucc

SEQ ID NO: 2210504 - RNA, 19 nt, Streptococcus pyogenes M1 GAS
aagagcguuagcuuuuuaa

SEQ ID NO: 2210505 - RNA, 15 nt, Streptococcus pyogenes M1 GAS
aagacuagagucucu

SEQ ID NO: 2210506 - RNA, 15 nt, Streptococcus pyogenes M1 GAS
aagacggaguauuuu

SEQ ID NO: 2210507 - RNA, 15 nt, Streptococcus pyogenes M1 GAS
aagagagcuugguuu

SEQ ID NO: 2210508 - RNA, 23 nt, Streptococcus pyogenes M1 GAS
aagagagguugguaaaaaggcag

SEQ ID NO: 2210509 - RNA, 17 nt, Streptococcus pyogenes M1 GAS
aaauugaccaaaagaau

SEQ ID NO: 2210510 - RNA, 22 nt, Streptococcus pyogenes M1 GAS
aagaauuaacguuccaaaaaga

SEQ ID NO: 2210511 - RNA, 14 nt, Streptococcus pyogenes M1 GAS
aagacacacaacac

SEQ ID NO: 2210512 - RNA, 15 nt, Streptococcus pyogenes M1 GAS
aagacacccccugcu

SEQ ID NO: 2210513 - RNA, 13 nt, Streptococcus pyogenes M1 GAS
aagacaaaaaacu

SEQ ID NO: 2210514 - RNA, 17 nt, Streptococcus pyogenes M1 GAS
aagaccuucaaaaaagg

SEQ ID NO: 2210515 - RNA, 20 nt, Streptococcus pyogenes M1 GAS
aagacccuccacccaaacau

SEQ ID NO: 2210516 - RNA, 17 nt, Streptococcus pyogenes M1 GAS
aagaccauaaaaaaccu

SEQ ID NO: 2210517 - RNA, 16 nt, Streptococcus pyogenes M1 GAS
aagaccauaaaaaacc

SEQ ID NO: 2210518 - RNA, 16 nt, Streptococcus pyogenes M1 GAS
aauguccgaaaaaaac

SEQ ID NO: 2210519 - RNA, 15 nt, Streptococcus pyogenes M1 GAS
aauguaugauuuuaa

SEQ ID NO: 2210520 - RNA, 18 nt, Streptococcus pyogenes M1 GAS
aaugcuguuugucauacu

SEQ ID NO: 2210521 - RNA, 23 nt, Streptococcus pyogenes M1 GAS
aaugcccaagauggguuagcucu

SEQ ID NO: 2210522 - RNA, 14 nt, Streptococcus pyogenes M1 GAS
aaugccaucaaaaa

SEQ ID NO: 2210523 - RNA, 17 nt, Streptococcus pyogenes M1 GAS
aaugccaucaaaaaaag

SEQ ID NO: 2210524 - RNA, 16 nt, Streptococcus pyogenes M1 GAS
aauuacuuaucaucau

SEQ ID NO: 2210525 - RNA, 16 nt, Streptococcus pyogenes M1 GAS
aauuaauaaauuuuug

SEQ ID NO: 2210526 - RNA, 16 nt, Streptococcus pyogenes M1 GAS
aauuaacguuccaaaa

SEQ ID NO: 2210527 - RNA, 20 nt, Streptococcus pyogenes M1 GAS
aauuaacguuccaaaaagaa

SEQ ID NO: 2210528 - RNA, 18 nt, Streptococcus pyogenes M1 GAS
aaucgcuuuaggaauauc

SEQ ID NO: 2210529 - RNA, 20 nt, Streptococcus pyogenes M1 GAS
aaucguuacuccuuugacca

SEQ ID NO: 2210530 - RNA, 17 nt, Streptococcus pyogenes M1 GAS
aauccuuuugaaaaauu

SEQ ID NO: 2210531 - RNA, 17 nt, Streptococcus pyogenes M1 GAS
aauccuuuugcuucuag

SEQ ID NO: 2210532 - RNA, 16 nt, Streptococcus pyogenes M1 GAS
aaugacuucaaaauca

SEQ ID NO: 2210533 - RNA, 18 nt, Streptococcus pyogenes M1 GAS
aaugauaaggcugcgaug

SEQ ID NO: 2210534 - RNA, 14 nt, Streptococcus pyogenes M1 GAS
aaugauaaggcugc

SEQ ID NO: 2210535 - RNA, 15 nt, Streptococcus pyogenes M1 GAS
aaugauagcaccuaa

SEQ ID NO: 2210536 - RNA, 18 nt, Streptococcus pyogenes M1 GAS
aaugauaguaaacgaaaa

SEQ ID NO: 2210537 - RNA, 22 nt, Streptococcus pyogenes M1 GAS
aaugauagcuuucaauugauuu

SEQ ID NO: 2210538 - RNA, 14 nt, Streptococcus pyogenes M1 GAS
aaucuuguuuaacc

SEQ ID NO: 2210539 - RNA, 14 nt, Streptococcus pyogenes M1 GAS
aaucuggcuuagca

SEQ ID NO: 2210540 - RNA, 20 nt, Streptococcus pyogenes M1 GAS
aaucuucugcauuaucaucu

SEQ ID NO: 2210541 - RNA, 17 nt, Streptococcus pyogenes M1 GAS
aaucuggagaugagaaa

SEQ ID NO: 2210542 - RNA, 18 nt, Streptococcus pyogenes M1 GAS
aaucuggagaugagaaag

SEQ ID NO: 2210543 - RNA, 18 nt, Streptococcus pyogenes M1 GAS
aaucaccguaacuugcuu

SEQ ID NO: 2210544 - RNA, 14 nt, Streptococcus pyogenes M1 GAS
aaucagaaagaaga

SEQ ID NO: 2210545 - RNA, 18 nt, Streptococcus pyogenes M1 GAS
aaucagaaagaagaaaau

SEQ ID NO: 2210546 - RNA, 12 nt, Streptococcus pyogenes M1 GAS
aaucagaacucg

SEQ ID NO: 2210547 - RNA, 12 nt, Streptococcus pyogenes M1 GAS
aaucaaaaaacu

SEQ ID NO: 2210548 - RNA, 20 nt, Streptococcus pyogenes M1 GAS
aauauuuccuuuuaaagaca

SEQ ID NO: 2210549 - RNA, 12 nt, Streptococcus pyogenes M1 GAS
aauauuuccuuu

SEQ ID NO: 2210550 - RNA, 16 nt, Streptococcus pyogenes M1 GAS
aauauuuccuuuuaaa

SEQ ID NO: 2210551 - RNA, 20 nt, Streptococcus pyogenes M1 GAS
aaucaaaaagcuaacaccau

SEQ ID NO: 2210552 - RNA, 22 nt, Streptococcus pyogenes M1 GAS
aaucaaaaagcuaacaccauaa

SEQ ID NO: 2210553 - RNA, 12 nt, Streptococcus pyogenes M1 GAS
aauaugauauaa

SEQ ID NO: 2210554 - RNA, 13 nt, Streptococcus pyogenes M1 GAS
aauauaauaaaaa

SEQ ID NO: 2210555 - RNA, 16 nt, Streptococcus pyogenes M1 GAS
aauauaauaaaaagca

SEQ ID NO: 2210556 - RNA, 17 nt, Streptococcus pyogenes M1 GAS
aauaucgccaauaaaaa

SEQ ID NO: 2210557 - RNA, 18 nt, Streptococcus pyogenes M1 GAS
aauaucgccaauaaaaaa

SEQ ID NO: 2210558 - RNA, 19 nt, Streptococcus pyogenes M1 GAS
aauagcugcugcuaaagca

SEQ ID NO: 2210559 - RNA, 18 nt, Streptococcus pyogenes M1 GAS
aauaguagcaaauaacau

SEQ ID NO: 2210560 - RNA, 16 nt, Streptococcus pyogenes M1 GAS
aauacguaaaaagaga

SEQ ID NO: 2210561 - RNA, 17 nt, Streptococcus pyogenes M1 GAS
aauagaagacaagguga

SEQ ID NO: 2210562 - RNA, 17 nt, Streptococcus pyogenes M1 GAS
aaauuauuauuuugcuu

SEQ ID NO: 2210563 - RNA, 21 nt, Streptococcus pyogenes M1 GAS
aaauuauuaacguuaacaaaa

SEQ ID NO: 2210564 - RNA, 13 nt, Streptococcus pyogenes M1 GAS
uuuuuuuaaagcu

SEQ ID NO: 2210565 - RNA, 12 nt, Streptococcus pyogenes M1 GAS
uuuuuuguaauu

SEQ ID NO: 2210566 - RNA, 19 nt, Streptococcus pyogenes M1 GAS
aaauuccccacaaaagaca

SEQ ID NO: 2210567 - RNA, 20 nt, Streptococcus pyogenes M1 GAS
aaauuccccacaaaagacaa

SEQ ID NO: 2210568 - RNA, 21 nt, Streptococcus pyogenes M1 GAS
uuuuuggaucgcugugaccaa

SEQ ID NO: 2210569 - RNA, 13 nt, Streptococcus pyogenes M1 GAS
uuuuuguguucag

SEQ ID NO: 2210570 - RNA, 17 nt, Streptococcus pyogenes M1 GAS
uuuuuggugucagcaua

SEQ ID NO: 2210571 - RNA, 18 nt, Streptococcus pyogenes M1 GAS
uuuuuggugucagcauaa

SEQ ID NO: 2210572 - RNA, 14 nt, Streptococcus pyogenes M1 GAS
uuuuuuaaagcuaa

SEQ ID NO: 2210573 - RNA, 16 nt, Streptococcus pyogenes M1 GAS
uuuuucuuuugaccua

SEQ ID NO: 2210574 - RNA, 15 nt, Streptococcus pyogenes M1 GAS
aaauuaagaaggaac

SEQ ID NO: 2210575 - RNA, 14 nt, Streptococcus pyogenes M1 GAS
uuuuuuauacggua

SEQ ID NO: 2210576 - RNA, 23 nt, Streptococcus pyogenes M1 GAS
uuuuguugaguguuaugaugaug

SEQ ID NO: 2210577 - RNA, 14 nt, Streptococcus pyogenes M1 GAS
uuuugucuucuucu

SEQ ID NO: 2210578 - RNA, 15 nt, Streptococcus pyogenes M1 GAS
uuuugucuucuucuu

SEQ ID NO: 2210579 - RNA, 19 nt, Streptococcus pyogenes M1 GAS
uuuugguccugugacacgu

SEQ ID NO: 2210580 - RNA, 18 nt, Streptococcus pyogenes M1 GAS
uuuugguugauauaaaau

SEQ ID NO: 2210581 - RNA, 14 nt, Streptococcus pyogenes M1 GAS
uuuuuaauuauuuu

SEQ ID NO: 2210582 - RNA, 12 nt, Streptococcus pyogenes M1 GAS
uuuuuaguguuu

SEQ ID NO: 2210583 - RNA, 19 nt, Streptococcus pyogenes M1 GAS
uuuuuaguugugauauaaa

SEQ ID NO: 2210584 - RNA, 16 nt, Streptococcus pyogenes M1 GAS
uuuuuacgaaaaauuc

SEQ ID NO: 2210585 - RNA, 15 nt, Streptococcus pyogenes M1 GAS
uuuucugguuuuaau

SEQ ID NO: 2210586 - RNA, 23 nt, Streptococcus pyogenes M1 GAS
uuuucucaaaaauauauucuaau

SEQ ID NO: 2210587 - RNA, 12 nt, Streptococcus pyogenes M1 GAS
uuuugauaaaaa

SEQ ID NO: 2210588 - RNA, 14 nt, Streptococcus pyogenes M1 GAS
uuuugauaaaaaac

SEQ ID NO: 2210589 - RNA, 15 nt, Streptococcus pyogenes M1 GAS
uuuugauaaaaaaca

SEQ ID NO: 2210590 - RNA, 20 nt, Streptococcus pyogenes M1 GAS
uuuugaugcagcuaaaagca

SEQ ID NO: 2210591 - RNA, 20 nt, Streptococcus pyogenes M1 GAS
uuuuggaugaaaguaacaug

SEQ ID NO: 2210592 - RNA, 19 nt, Streptococcus pyogenes M1 GAS
uuuuaaauaucuuaccauu

SEQ ID NO: 2210593 - RNA, 16 nt, Streptococcus pyogenes M1 GAS
uuuguuaccagauaaa

SEQ ID NO: 2210594 - RNA, 15 nt, Streptococcus pyogenes M1 GAS
uuuuaacguuuugaa

SEQ ID NO: 2210595 - RNA, 13 nt, Streptococcus pyogenes M1 GAS
uuuuacaucaaaa

SEQ ID NO: 2210596 - RNA, 21 nt, Streptococcus pyogenes M1 GAS
uuuggaccacucgugcugcca

SEQ ID NO: 2210597 - RNA, 20 nt, Streptococcus pyogenes M1 GAS
uuuggaggugaaaauaucuu

SEQ ID NO: 2210598 - RNA, 18 nt, Streptococcus pyogenes M1 GAS
uuugcugagcuaaagcca

SEQ ID NO: 2210599 - RNA, 13 nt, Streptococcus pyogenes M1 GAS
uuuguaugacauu

SEQ ID NO: 2210600 - RNA, 19 nt, Streptococcus pyogenes M1 GAS
uuuguaucucauaacaaau

SEQ ID NO: 2210601 - RNA, 17 nt, Streptococcus pyogenes M1 GAS
uuuguaucucauaacaa

SEQ ID NO: 2210602 - RNA, 15 nt, Streptococcus pyogenes M1 GAS
uuugucaaaaaguaa

SEQ ID NO: 2210603 - RNA, 13 nt, Streptococcus pyogenes M1 GAS
uuuguuaacaggu

SEQ ID NO: 2210604 - RNA, 13 nt, Streptococcus pyogenes M1 GAS
uuugugauggucu

SEQ ID NO: 2210605 - RNA, 12 nt, Streptococcus pyogenes M1 GAS
uuugucuucuuc

SEQ ID NO: 2210606 - RNA, 16 nt, Streptococcus pyogenes M1 GAS
uuugucuucuucuuug

SEQ ID NO: 2210607 - RNA, 19 nt, Streptococcus pyogenes M1 GAS
uuuuauuagucuuuaaaaa

SEQ ID NO: 2210608 - RNA, 18 nt, Streptococcus pyogenes M1 GAS
uuuuauaugucaucaaaa

SEQ ID NO: 2210609 - RNA, 14 nt, Streptococcus pyogenes M1 GAS
uuuuacuuuuaaaa

SEQ ID NO: 2210610 - RNA, 13 nt, Streptococcus pyogenes M1 GAS
uuuuacuuuuaaa

SEQ ID NO: 2210611 - RNA, 19 nt, Streptococcus pyogenes M1 GAS
uuuuaguguuuuuagauaa

SEQ ID NO: 2210612 - RNA, 19 nt, Streptococcus pyogenes M1 GAS
uuuuaguugugauauaaaa

SEQ ID NO: 2210613 - RNA, 19 nt, Streptococcus pyogenes M1 GAS
uuuuaguaaagccuuaucc

SEQ ID NO: 2210614 - RNA, 16 nt, Streptococcus pyogenes M1 GAS
uuuuagcuaagaauaa

SEQ ID NO: 2210615 - RNA, 20 nt, Streptococcus pyogenes M1 GAS
uuuuagcggcacguuauucu

SEQ ID NO: 2210616 - RNA, 19 nt, Streptococcus pyogenes M1 GAS
uuuuauagcugauuuguuu

SEQ ID NO: 2210617 - RNA, 15 nt, Streptococcus pyogenes M1 GAS
uuuucguauacuuua

SEQ ID NO: 2210618 - RNA, 17 nt, Streptococcus pyogenes M1 GAS
uuuucagagaugcuucu

SEQ ID NO: 2210619 - RNA, 14 nt, Streptococcus pyogenes M1 GAS
uuucugauaggagu

SEQ ID NO: 2210620 - RNA, 17 nt, Streptococcus pyogenes M1 GAS
uuucuauauaacuguuc

SEQ ID NO: 2210621 - RNA, 12 nt, Streptococcus pyogenes M1 GAS
uuucuauauaac

SEQ ID NO: 2210622 - RNA, 15 nt, Streptococcus pyogenes M1 GAS
uuucgugucuaaaau

SEQ ID NO: 2210623 - RNA, 21 nt, Streptococcus pyogenes M1 GAS
uuucggaaaacuuuugacuug

SEQ ID NO: 2210624 - RNA, 14 nt, Streptococcus pyogenes M1 GAS
uuuccuacaaaaua

SEQ ID NO: 2210625 - RNA, 15 nt, Streptococcus pyogenes M1 GAS
uuugaaguaaaggau

SEQ ID NO: 2210626 - RNA, 22 nt, Streptococcus pyogenes M1 GAS
uuugacauuaguccaaaauaca

SEQ ID NO: 2210627 - RNA, 21 nt, Streptococcus pyogenes M1 GAS
uuugaccuacuagcacaaaau

SEQ ID NO: 2210628 - RNA, 21 nt, Streptococcus pyogenes M1 GAS
uuugacuuguuacaaaaaaca

SEQ ID NO: 2210629 - RNA, 16 nt, Streptococcus pyogenes M1 GAS
uuugacuucaaaaaua

SEQ ID NO: 2210630 - RNA, 19 nt, Streptococcus pyogenes M1 GAS
uuucuucagguuucuuuug

SEQ ID NO: 2210631 - RNA, 14 nt, Streptococcus pyogenes M1 GAS
uuucuuguuuuggu

SEQ ID NO: 2210632 - RNA, 13 nt, Streptococcus pyogenes M1 GAS
uuucuuugucaug

SEQ ID NO: 2210633 - RNA, 20 nt, Streptococcus pyogenes M1 GAS
uuucuuugugacaugaguau

SEQ ID NO: 2210634 - RNA, 15 nt, Streptococcus pyogenes M1 GAS
uuugauaaaaaacaa

SEQ ID NO: 2210635 - RNA, 19 nt, Streptococcus pyogenes M1 GAS
uuugauauuuuuucucaaa

SEQ ID NO: 2210636 - RNA, 20 nt, Streptococcus pyogenes M1 GAS
uuugauauuuuuucucaaaa

SEQ ID NO: 2210637 - RNA, 21 nt, Streptococcus pyogenes M1 GAS
uuugauugauuugucuucucc

SEQ ID NO: 2210638 - RNA, 15 nt, Streptococcus pyogenes M1 GAS
uuugcaaaagaauug

SEQ ID NO: 2210639 - RNA, 13 nt, Streptococcus pyogenes M1 GAS
uuugcacugcuau

SEQ ID NO: 2210640 - RNA, 18 nt, Streptococcus pyogenes M1 GAS
uuugcguuguagguaaua

SEQ ID NO: 2210641 - RNA, 16 nt, Streptococcus pyogenes M1 GAS
uuucagucuucuguaa

SEQ ID NO: 2210642 - RNA, 13 nt, Streptococcus pyogenes M1 GAS
uuucauuauagac

SEQ ID NO: 2210643 - RNA, 18 nt, Streptococcus pyogenes M1 GAS
uuuauacgguaaaaacuc

SEQ ID NO: 2210644 - RNA, 22 nt, Streptococcus pyogenes M1 GAS
uuuauuugcuuuucggugaugc

SEQ ID NO: 2210645 - RNA, 23 nt, Streptococcus pyogenes M1 GAS
uuuauuuugauauuuuuucucaa

SEQ ID NO: 2210646 - RNA, 21 nt, Streptococcus pyogenes M1 GAS
uuucaacaaauccuuuugcuu

SEQ ID NO: 2210647 - RNA, 22 nt, Streptococcus pyogenes M1 GAS
uuucaauugauuugcagaggcu

SEQ ID NO: 2210648 - RNA, 13 nt, Streptococcus pyogenes M1 GAS
uuucaaguucucu

SEQ ID NO: 2210649 - RNA, 13 nt, Streptococcus pyogenes M1 GAS
uuucacgauaaga

SEQ ID NO: 2210650 - RNA, 15 nt, Streptococcus pyogenes M1 GAS
uuucacgauaagaag

SEQ ID NO: 2210651 - RNA, 15 nt, Streptococcus pyogenes M1 GAS
uuuaacaugauguac

SEQ ID NO: 2210652 - RNA, 13 nt, Streptococcus pyogenes M1 GAS
uuguuacaaaaaa

SEQ ID NO: 2210653 - RNA, 21 nt, Streptococcus pyogenes M1 GAS
uuguucaaccgucacuauuga

SEQ ID NO: 2210654 - RNA, 13 nt, Streptococcus pyogenes M1 GAS
uuuaggucuaauu

SEQ ID NO: 2210655 - RNA, 17 nt, Streptococcus pyogenes M1 GAS
uuuagugaauucuaaaa

SEQ ID NO: 2210656 - RNA, 19 nt, Streptococcus pyogenes M1 GAS
uuuauaaaguuuucucaga

SEQ ID NO: 2210657 - RNA, 15 nt, Streptococcus pyogenes M1 GAS
uuuaguugcuucuuu

SEQ ID NO: 2210658 - RNA, 21 nt, Streptococcus pyogenes M1 GAS
uuuacuauggcuucuaaaaaa

SEQ ID NO: 2210659 - RNA, 13 nt, Streptococcus pyogenes M1 GAS
uuuagcuaagaau

SEQ ID NO: 2210660 - RNA, 17 nt, Streptococcus pyogenes M1 GAS
uuuagcgguaucccuuu

SEQ ID NO: 2210661 - RNA, 21 nt, Streptococcus pyogenes M1 GAS
uuuagcuuauaguuugacuuc

SEQ ID NO: 2210662 - RNA, 14 nt, Streptococcus pyogenes M1 GAS
uuuagcuucuaaau

SEQ ID NO: 2210663 - RNA, 15 nt, Streptococcus pyogenes M1 GAS
uuuagcuucuaaaug

SEQ ID NO: 2210664 - RNA, 20 nt, Streptococcus pyogenes M1 GAS
uuuaacguaauaaaauaaca

SEQ ID NO: 2210665 - RNA, 18 nt, Streptococcus pyogenes M1 GAS
uugacagacaccaaaaaa

SEQ ID NO: 2210666 - RNA, 22 nt, Streptococcus pyogenes M1 GAS
uugacagacaccaaaaaaagca

SEQ ID NO: 2210667 - RNA, 13 nt, Streptococcus pyogenes M1 GAS
uugaccacaccua

SEQ ID NO: 2210668 - RNA, 15 nt, Streptococcus pyogenes M1 GAS
uugaccacaccuaau

SEQ ID NO: 2210669 - RNA, 24 nt, Streptococcus pyogenes M1 GAS
uugaccacaccuaauaaaauagca

SEQ ID NO: 2210670 - RNA, 13 nt, Streptococcus pyogenes M1 GAS
uugacaaagccau

SEQ ID NO: 2210671 - RNA, 17 nt, Streptococcus pyogenes M1 GAS
uugaauugaaaaaagac

SEQ ID NO: 2210672 - RNA, 22 nt, Streptococcus pyogenes M1 GAS
uugaaggacagguagauguugu

SEQ ID NO: 2210673 - RNA, 18 nt, Streptococcus pyogenes M1 GAS
uucuugaggugauucuuu

SEQ ID NO: 2210674 - RNA, 17 nt, Streptococcus pyogenes M1 GAS
uucuugacgcaucuccu

SEQ ID NO: 2210675 - RNA, 23 nt, Streptococcus pyogenes M1 GAS
uucugcagucuuuuucauuuuua

SEQ ID NO: 2210676 - RNA, 23 nt, Streptococcus pyogenes M1 GAS
uucuuuauuuugauauuuuuucu

SEQ ID NO: 2210677 - RNA, 21 nt, Streptococcus pyogenes M1 GAS
uucuuuuaaccauaucacaaa

SEQ ID NO: 2210678 - RNA, 22 nt, Streptococcus pyogenes M1 GAS
uucuuuggcaagauaauauuga

SEQ ID NO: 2210679 - RNA, 20 nt, Streptococcus pyogenes M1 GAS
uucuuugcagagaugcuucu

SEQ ID NO: 2210680 - RNA, 17 nt, Streptococcus pyogenes M1 GAS
uucuuugccuuuagcaa

SEQ ID NO: 2210681 - RNA, 20 nt, Streptococcus pyogenes M1 GAS
uucuuuuaggccaccagaug

SEQ ID NO: 2210682 - RNA, 20 nt, Streptococcus pyogenes M1 GAS
uucuuuucagagaugcuucu

SEQ ID NO: 2210683 - RNA, 13 nt, Streptococcus pyogenes M1 GAS
uucuuuuuccguu

SEQ ID NO: 2210684 - RNA, 24 nt, Streptococcus pyogenes M1 GAS
uugaaaguuccuuagcaguuauaa

SEQ ID NO: 2210685 - RNA, 18 nt, Streptococcus pyogenes M1 GAS
uugauauuuuuucucaaa

SEQ ID NO: 2210686 - RNA, 16 nt, Streptococcus pyogenes M1 GAS
uugaugagacuaaccu

SEQ ID NO: 2210687 - RNA, 15 nt, Streptococcus pyogenes M1 GAS
uugacuucaaaaaua

SEQ ID NO: 2210688 - RNA, 14 nt, Streptococcus pyogenes M1 GAS
uugcaagucucuug

SEQ ID NO: 2210689 - RNA, 22 nt, Streptococcus pyogenes M1 GAS
uugcaauagagccaagauuuua

SEQ ID NO: 2210690 - RNA, 22 nt, Streptococcus pyogenes M1 GAS
uugaugauugaguaagcagcau

SEQ ID NO: 2210691 - RNA, 17 nt, Streptococcus pyogenes M1 GAS
uugcaaaagaauugaaa

SEQ ID NO: 2210692 - RNA, 18 nt, Streptococcus pyogenes M1 GAS
uugccugaaauauaaccu

SEQ ID NO: 2210693 - RNA, 17 nt, Streptococcus pyogenes M1 GAS
uuccccacaaaagacaa

SEQ ID NO: 2210694 - RNA, 19 nt, Streptococcus pyogenes M1 GAS
uucccaaugccccaaagua

SEQ ID NO: 2210695 - RNA, 17 nt, Streptococcus pyogenes M1 GAS
uuccuaugcuaacugau

SEQ ID NO: 2210696 - RNA, 22 nt, Streptococcus pyogenes M1 GAS
uuccuaugcuaacugauaaaac

SEQ ID NO: 2210697 - RNA, 16 nt, Streptococcus pyogenes M1 GAS
uuccagaacaugggag

SEQ ID NO: 2210698 - RNA, 14 nt, Streptococcus pyogenes M1 GAS
uuccauacgcucca

SEQ ID NO: 2210699 - RNA, 22 nt, Streptococcus pyogenes M1 GAS
uucuaaaugacaguauacauca

SEQ ID NO: 2210700 - RNA, 20 nt, Streptococcus pyogenes M1 GAS
uucguucauaaauucuaacu

SEQ ID NO: 2210701 - RNA, 19 nt, Streptococcus pyogenes M1 GAS
uucugauaggagugauuga

SEQ ID NO: 2210702 - RNA, 16 nt, Streptococcus pyogenes M1 GAS
uucucuacuugucaug

SEQ ID NO: 2210703 - RNA, 20 nt, Streptococcus pyogenes M1 GAS
uucucauaaacaaugaguca

SEQ ID NO: 2210704 - RNA, 13 nt, Streptococcus pyogenes M1 GAS
uucuaaguuuuua

SEQ ID NO: 2210705 - RNA, 19 nt, Streptococcus pyogenes M1 GAS
uucuaguuucauagaagac

SEQ ID NO: 2210706 - RNA, 18 nt, Streptococcus pyogenes M1 GAS
uucuauugucguugaugc

SEQ ID NO: 2210707 - RNA, 14 nt, Streptococcus pyogenes M1 GAS
uucuauuaccuaua

SEQ ID NO: 2210708 - RNA, 16 nt, Streptococcus pyogenes M1 GAS
uuaucauauuccauau

SEQ ID NO: 2210709 - RNA, 13 nt, Streptococcus pyogenes M1 GAS
uuaucauuuuggu

SEQ ID NO: 2210710 - RNA, 15 nt, Streptococcus pyogenes M1 GAS
uuaucaaaccaaggu

SEQ ID NO: 2210711 - RNA, 14 nt, Streptococcus pyogenes M1 GAS
uuauagcuccuaaa

SEQ ID NO: 2210712 - RNA, 22 nt, Streptococcus pyogenes M1 GAS
uuauagcacguuggaaaaggaa

SEQ ID NO: 2210713 - RNA, 14 nt, Streptococcus pyogenes M1 GAS
uuaugauuugucaa

SEQ ID NO: 2210714 - RNA, 21 nt, Streptococcus pyogenes M1 GAS
uuaugauuugucaaaaaguaa

SEQ ID NO: 2210715 - RNA, 18 nt, Streptococcus pyogenes M1 GAS
uuaucugauauuucaucu

SEQ ID NO: 2210716 - RNA, 16 nt, Streptococcus pyogenes M1 GAS
uuauguuauaagagaa

SEQ ID NO: 2210717 - RNA, 21 nt, Streptococcus pyogenes M1 GAS
uucagcaucguuaaguggaau

SEQ ID NO: 2210718 - RNA, 23 nt, Streptococcus pyogenes M1 GAS
uucaggauguuuauuccaaacau

SEQ ID NO: 2210719 - RNA, 19 nt, Streptococcus pyogenes M1 GAS
uucacuauaauuucaauaa

SEQ ID NO: 2210720 - RNA, 21 nt, Streptococcus pyogenes M1 GAS
uucacuauaauuucaauaaua

SEQ ID NO: 2210721 - RNA, 21 nt, Streptococcus pyogenes M1 GAS
uucagcagcacuggcuuuuuu

SEQ ID NO: 2210722 - RNA, 11 nt, Streptococcus pyogenes M1 GAS
uucagcagcac

SEQ ID NO: 2210723 - RNA, 17 nt, Streptococcus pyogenes M1 GAS
uucacgauaagaagcua

SEQ ID NO: 2210724 - RNA, 15 nt, Streptococcus pyogenes M1 GAS
uucaauauuuuauua

SEQ ID NO: 2210725 - RNA, 19 nt, Streptococcus pyogenes M1 GAS
uucaauauuuuauuaauaa

SEQ ID NO: 2210726 - RNA, 19 nt, Streptococcus pyogenes M1 GAS
uuauuaguaaccauagaag

SEQ ID NO: 2210727 - RNA, 17 nt, Streptococcus pyogenes M1 GAS
uuauuugacauuagucc

SEQ ID NO: 2210728 - RNA, 14 nt, Streptococcus pyogenes M1 GAS
uucaaaaauacuac

SEQ ID NO: 2210729 - RNA, 17 nt, Streptococcus pyogenes M1 GAS
uucaaaaauacuaccuu

SEQ ID NO: 2210730 - RNA, 19 nt, Streptococcus pyogenes M1 GAS
uucaaaaaagggaagaaga

SEQ ID NO: 2210731 - RNA, 16 nt, Streptococcus pyogenes M1 GAS
uuauuuuuuaaagcua

SEQ ID NO: 2210732 - RNA, 16 nt, Streptococcus pyogenes M1 GAS
uuauuuuugagacagu

SEQ ID NO: 2210733 - RNA, 16 nt, Streptococcus pyogenes M1 GAS
uucaaacggaguucuc

SEQ ID NO: 2210734 - RNA, 19 nt, Streptococcus pyogenes M1 GAS
uucaauaauaccauuuuua

SEQ ID NO: 2210735 - RNA, 19 nt, Streptococcus pyogenes M1 GAS
uuagcaccagcauuugcca

SEQ ID NO: 2210736 - RNA, 15 nt, Streptococcus pyogenes M1 GAS
uuagcagacaaaagg

SEQ ID NO: 2210737 - RNA, 17 nt, Streptococcus pyogenes M1 GAS
uuagcagacaaaaggga

SEQ ID NO: 2210738 - RNA, 15 nt, Streptococcus pyogenes M1 GAS
uuagcaguuauaauu

SEQ ID NO: 2210739 - RNA, 14 nt, Streptococcus pyogenes M1 GAS
uuagcauauuuuga

SEQ ID NO: 2210740 - RNA, 18 nt, Streptococcus pyogenes M1 GAS
uuagacuaugauacauug

SEQ ID NO: 2210741 - RNA, 15 nt, Streptococcus pyogenes M1 GAS
uuagcuuuuuaaaga

SEQ ID NO: 2210742 - RNA, 19 nt, Streptococcus pyogenes M1 GAS
uuagcugauaaucuucaau

SEQ ID NO: 2210743 - RNA, 18 nt, Streptococcus pyogenes M1 GAS
uuacuuggaucuucuucu

SEQ ID NO: 2210744 - RNA, 15 nt, Streptococcus pyogenes M1 GAS
uuacuaacuagcaag

SEQ ID NO: 2210745 - RNA, 16 nt, Streptococcus pyogenes M1 GAS
uuaguguuuuuagaua

SEQ ID NO: 2210746 - RNA, 19 nt, Streptococcus pyogenes M1 GAS
uuaguguuuuuagauaaaa

SEQ ID NO: 2210747 - RNA, 17 nt, Streptococcus pyogenes M1 GAS
uuagucuuuaaaaaacg

SEQ ID NO: 2210748 - RNA, 16 nt, Streptococcus pyogenes M1 GAS
uuaguguagauaaacu

SEQ ID NO: 2210749 - RNA, 14 nt, Streptococcus pyogenes M1 GAS
uuaguuuuguauug

SEQ ID NO: 2210750 - RNA, 12 nt, Streptococcus pyogenes M1 GAS
uuaguuuuauuu

SEQ ID NO: 2210751 - RNA, 21 nt, Streptococcus pyogenes M1 GAS
uuaguaaagccuuauccauuc

SEQ ID NO: 2210752 - RNA, 21 nt, Streptococcus pyogenes M1 GAS
uuaguaccguuagcagacaaa

SEQ ID NO: 2210753 - RNA, 19 nt, Streptococcus pyogenes M1 GAS
uuagguggagcuuuaguug

SEQ ID NO: 2210754 - RNA, 13 nt, Streptococcus pyogenes M1 GAS
uuagucauuucuu

SEQ ID NO: 2210755 - RNA, 12 nt, Streptococcus pyogenes M1 GAS
uuaguagagacg

SEQ ID NO: 2210756 - RNA, 23 nt, Streptococcus pyogenes M1 GAS
uuacaguugugugacuguaaaua

SEQ ID NO: 2210757 - RNA, 12 nt, Streptococcus pyogenes M1 GAS
uuaauuuuauuu

SEQ ID NO: 2210758 - RNA, 19 nt, Streptococcus pyogenes M1 GAS
uuaauguauuggaaaauac

SEQ ID NO: 2210759 - RNA, 16 nt, Streptococcus pyogenes M1 GAS
uuaauuauuuuaauuu

SEQ ID NO: 2210760 - RNA, 17 nt, Streptococcus pyogenes M1 GAS
uuaagcuuuguugcauu

SEQ ID NO: 2210761 - RNA, 18 nt, Streptococcus pyogenes M1 GAS
uuaauagagaacagauaa

SEQ ID NO: 2210762 - RNA, 16 nt, Streptococcus pyogenes M1 GAS
uuaauaguuuuccaua

SEQ ID NO: 2210763 - RNA, 22 nt, Streptococcus pyogenes M1 GAS
uuaauaggcuuuuuuuguaucu

SEQ ID NO: 2210764 - RNA, 12 nt, Streptococcus pyogenes M1 GAS
uuaaucaaaaaa

SEQ ID NO: 2210765 - RNA, 19 nt, Streptococcus pyogenes M1 GAS
uuaagacuauguugcuuaa

SEQ ID NO: 2210766 - RNA, 18 nt, Streptococcus pyogenes M1 GAS
uuaagagggccaaggucu

SEQ ID NO: 2210767 - RNA, 20 nt, Streptococcus pyogenes M1 GAS
uuaagauaccaaaucaaaaa

SEQ ID NO: 2210768 - RNA, 17 nt, Streptococcus pyogenes M1 GAS
uuaagcuugcuaagaga

SEQ ID NO: 2210769 - RNA, 19 nt, Streptococcus pyogenes M1 GAS
uuaagcuugcuaagagaau

SEQ ID NO: 2210770 - RNA, 14 nt, Streptococcus pyogenes M1 GAS
uuaacucucauaaa

SEQ ID NO: 2210771 - RNA, 18 nt, Streptococcus pyogenes M1 GAS
uuaacguuaacaaaaaua

SEQ ID NO: 2210772 - RNA, 18 nt, Streptococcus pyogenes M1 GAS
uuaacguuccaaaaagaa

SEQ ID NO: 2210773 - RNA, 22 nt, Streptococcus pyogenes M1 GAS
uuaacuauuucacuuaucauuu

SEQ ID NO: 2210774 - RNA, 18 nt, Streptococcus pyogenes M1 GAS
uuaaccggcucuaaaaua

SEQ ID NO: 2210775 - RNA, 22 nt, Streptococcus pyogenes M1 GAS
uggauuaaaugcccaagauggg

SEQ ID NO: 2210776 - RNA, 22 nt, Streptococcus pyogenes M1 GAS
uggaguucuugacgcaucuccu

SEQ ID NO: 2210777 - RNA, 16 nt, Streptococcus pyogenes M1 GAS
uggauaccauuucuuu

SEQ ID NO: 2210778 - RNA, 21 nt, Streptococcus pyogenes M1 GAS
uggauaccauuucuuugcaaa

SEQ ID NO: 2210779 - RNA, 15 nt, Streptococcus pyogenes M1 GAS
uggaucguuuugcaa

SEQ ID NO: 2210780 - RNA, 14 nt, Streptococcus pyogenes M1 GAS
uggagaugagaaag

SEQ ID NO: 2210781 - RNA, 22 nt, Streptococcus pyogenes M1 GAS
uggagcuuuaguugcuucuuuu

SEQ ID NO: 2210782 - RNA, 16 nt, Streptococcus pyogenes M1 GAS
uggagagauaaaaagu

SEQ ID NO: 2210783 - RNA, 21 nt, Streptococcus pyogenes M1 GAS
uggacgucuucuuuuuauuau

SEQ ID NO: 2210784 - RNA, 18 nt, Streptococcus pyogenes M1 GAS
uggcuaaaaagagagcuu

SEQ ID NO: 2210785 - RNA, 21 nt, Streptococcus pyogenes M1 GAS
ugugaugaaucauuuuggaga

SEQ ID NO: 2210786 - RNA, 22 nt, Streptococcus pyogenes M1 GAS
ugugauuaguuuuuagcagcag

SEQ ID NO: 2210787 - RNA, 15 nt, Streptococcus pyogenes M1 GAS
ugucuucuucuuuuc

SEQ ID NO: 2210788 - RNA, 18 nt, Streptococcus pyogenes M1 GAS
ugucuugcuaaaauuucu

SEQ ID NO: 2210789 - RNA, 16 nt, Streptococcus pyogenes M1 GAS
ugucguuuuuugcuuu

SEQ ID NO: 2210790 - RNA, 21 nt, Streptococcus pyogenes M1 GAS
ugucguuuuuugcuuuugaua

SEQ ID NO: 2210791 - RNA, 13 nt, Streptococcus pyogenes M1 GAS
ugucucuacgaua

SEQ ID NO: 2210792 - RNA, 18 nt, Streptococcus pyogenes M1 GAS
uguccuaaccuuuuggcu

SEQ ID NO: 2210793 - RNA, 19 nt, Streptococcus pyogenes M1 GAS
uguccuacacguuccauga

SEQ ID NO: 2210794 - RNA, 20 nt, Streptococcus pyogenes M1 GAS
uguccuaaccuuuuggcugu

SEQ ID NO: 2210795 - RNA, 17 nt, Streptococcus pyogenes M1 GAS
ugucaggggaauuuccu

SEQ ID NO: 2210796 - RNA, 18 nt, Streptococcus pyogenes M1 GAS
ugucagcauaaaggguaa

SEQ ID NO: 2210797 - RNA, 16 nt, Streptococcus pyogenes M1 GAS
uguauuaugaggugaa

SEQ ID NO: 2210798 - RNA, 15 nt, Streptococcus pyogenes M1 GAS
uguauuucuuuagua

SEQ ID NO: 2210799 - RNA, 21 nt, Streptococcus pyogenes M1 GAS
uggugacucuguuccuaugcu

SEQ ID NO: 2210800 - RNA, 23 nt, Streptococcus pyogenes M1 GAS
uggucuaccgcuaggauuuuucc

SEQ ID NO: 2210801 - RNA, 19 nt, Streptococcus pyogenes M1 GAS
uguaauacgagcuagggca

SEQ ID NO: 2210802 - RNA, 22 nt, Streptococcus pyogenes M1 GAS
ugguucaucuugccaucagcau

SEQ ID NO: 2210803 - RNA, 18 nt, Streptococcus pyogenes M1 GAS
uguaaauauaaagucaga

SEQ ID NO: 2210804 - RNA, 20 nt, Streptococcus pyogenes M1 GAS
ugccuguuuuugcugucucu

SEQ ID NO: 2210805 - RNA, 21 nt, Streptococcus pyogenes M1 GAS
ugcgacacagauaagauacug

SEQ ID NO: 2210806 - RNA, 16 nt, Streptococcus pyogenes M1 GAS
ugcuaucauggaguca

SEQ ID NO: 2210807 - RNA, 19 nt, Streptococcus pyogenes M1 GAS
ugcuagacggcuaauaaga

SEQ ID NO: 2210808 - RNA, 21 nt, Streptococcus pyogenes M1 GAS
uggacgaaggcucuuaucuuu

SEQ ID NO: 2210809 - RNA, 18 nt, Streptococcus pyogenes M1 GAS
uggaccacucgugcugcc

SEQ ID NO: 2210810 - RNA, 23 nt, Streptococcus pyogenes M1 GAS
uggaaggcacagaaaaaagauaa

SEQ ID NO: 2210811 - RNA, 18 nt, Streptococcus pyogenes M1 GAS
uggaaauuuuaaaugaca

SEQ ID NO: 2210812 - RNA, 15 nt, Streptococcus pyogenes M1 GAS
uggaacuccuaaaac

SEQ ID NO: 2210813 - RNA, 17 nt, Streptococcus pyogenes M1 GAS
uggaacuccuaaaacau

SEQ ID NO: 2210814 - RNA, 23 nt, Streptococcus pyogenes M1 GAS
uggaaaguaaggguuaacaauga

SEQ ID NO: 2210815 - RNA, 21 nt, Streptococcus pyogenes M1 GAS
ugcuuuuuaugauuugucaaa

SEQ ID NO: 2210816 - RNA, 21 nt, Streptococcus pyogenes M1 GAS
ugcuugucuuuuuuuggccuc

SEQ ID NO: 2210817 - RNA, 16 nt, Streptococcus pyogenes M1 GAS
ugcuucuagcucuuua

SEQ ID NO: 2210818 - RNA, 12 nt, Streptococcus pyogenes M1 GAS
ugcuucuuucaa

SEQ ID NO: 2210819 - RNA, 13 nt, Streptococcus pyogenes M1 GAS
ugcuucuagucag

SEQ ID NO: 2210820 - RNA, 16 nt, Streptococcus pyogenes M1 GAS
ugcuguuugucauacu

SEQ ID NO: 2210821 - RNA, 12 nt, Streptococcus pyogenes M1 GAS
ugcuggugacua

SEQ ID NO: 2210822 - RNA, 17 nt, Streptococcus pyogenes M1 GAS
aaauguaugauuuuaac

SEQ ID NO: 2210823 - RNA, 18 nt, Streptococcus pyogenes M1 GAS
aaauguccgaaaaaaacu

SEQ ID NO: 2210824 - RNA, 20 nt, Streptococcus pyogenes M1 GAS
aaauguccgaaaaaaacuug

SEQ ID NO: 2210825 - RNA, 15 nt, Streptococcus pyogenes M1 GAS
ugcugauuuuggaug

SEQ ID NO: 2210826 - RNA, 15 nt, Streptococcus pyogenes M1 GAS
ugcugaguucuuuuu

SEQ ID NO: 2210827 - RNA, 17 nt, Streptococcus pyogenes M1 GAS
ugaaaauaucuuuuuua

SEQ ID NO: 2210828 - RNA, 16 nt, Streptococcus pyogenes M1 GAS
ugaaaguuccuuagca

SEQ ID NO: 2210829 - RNA, 13 nt, Streptococcus pyogenes M1 GAS
ugaaaauaaaaua

SEQ ID NO: 2210830 - RNA, 12 nt, Streptococcus pyogenes M1 GAS
ugaaaaaagaac

SEQ ID NO: 2210831 - RNA, 17 nt, Streptococcus pyogenes M1 GAS
ucuuuuuuacuuuuaaa

SEQ ID NO: 2210832 - RNA, 19 nt, Streptococcus pyogenes M1 GAS
ucuuuuuuacuuuuaaaau

SEQ ID NO: 2210833 - RNA, 14 nt, Streptococcus pyogenes M1 GAS
ugaaaaacuugggu

SEQ ID NO: 2210834 - RNA, 15 nt, Streptococcus pyogenes M1 GAS
ugaaccgcuauaaca

SEQ ID NO: 2210835 - RNA, 13 nt, Streptococcus pyogenes M1 GAS
ucuuuuuuaccuu

SEQ ID NO: 2210836 - RNA, 13 nt, Streptococcus pyogenes M1 GAS
ucuuuuaguucag

SEQ ID NO: 2210837 - RNA, 22 nt, Streptococcus pyogenes M1 GAS
ucuuuuaggccaccagaugcuu

SEQ ID NO: 2210838 - RNA, 18 nt, Streptococcus pyogenes M1 GAS
ucuuuucagagaugcuuc

SEQ ID NO: 2210839 - RNA, 19 nt, Streptococcus pyogenes M1 GAS
ucuuugcagagaugcuucu

SEQ ID NO: 2210840 - RNA, 17 nt, Streptococcus pyogenes M1 GAS
ucuuucuuuugccuguc

SEQ ID NO: 2210841 - RNA, 19 nt, Streptococcus pyogenes M1 GAS
ucuugcucuuguuuucuca

SEQ ID NO: 2210842 - RNA, 18 nt, Streptococcus pyogenes M1 GAS
ucuuguagaauuucaagu

SEQ ID NO: 2210843 - RNA, 22 nt, Streptococcus pyogenes M1 GAS
ucuuguccgaucuuuuggacca

SEQ ID NO: 2210844 - RNA, 23 nt, Streptococcus pyogenes M1 GAS
ucuuguuuaacccccuaaacuaa

SEQ ID NO: 2210845 - RNA, 13 nt, Streptococcus pyogenes M1 GAS
ucuuguuuugguu

SEQ ID NO: 2210846 - RNA, 20 nt, Streptococcus pyogenes M1 GAS
ucuuguuuugguugauauaa

SEQ ID NO: 2210847 - RNA, 22 nt, Streptococcus pyogenes M1 GAS
ucuuuauaaugguuuuuugucu

SEQ ID NO: 2210848 - RNA, 21 nt, Streptococcus pyogenes M1 GAS
ucuuuauuuugauauuuuuuc

SEQ ID NO: 2210849 - RNA, 13 nt, Streptococcus pyogenes M1 GAS
ucuugcauuaccu

SEQ ID NO: 2210850 - RNA, 22 nt, Streptococcus pyogenes M1 GAS
ucuugaggugauucuuuuuuac

SEQ ID NO: 2210851 - RNA, 18 nt, Streptococcus pyogenes M1 GAS
ucuucuaaaaugaugaga

SEQ ID NO: 2210852 - RNA, 12 nt, Streptococcus pyogenes M1 GAS
ucuucuucuuuu

SEQ ID NO: 2210853 - RNA, 14 nt, Streptococcus pyogenes M1 GAS
ucuucagguuucuu

SEQ ID NO: 2210854 - RNA, 12 nt, Streptococcus pyogenes M1 GAS
ucuucaucuguu

SEQ ID NO: 2210855 - RNA, 20 nt, Streptococcus pyogenes M1 GAS
ucugaugcguuuauaaaguu

SEQ ID NO: 2210856 - RNA, 22 nt, Streptococcus pyogenes M1 GAS
ucugaugcguuuauaaaguuuu

SEQ ID NO: 2210857 - RNA, 15 nt, Streptococcus pyogenes M1 GAS
ucuggagaugagaaa

SEQ ID NO: 2210858 - RNA, 23 nt, Streptococcus pyogenes M1 GAS
ucuggaaggcacagaaaaaagau

SEQ ID NO: 2210859 - RNA, 15 nt, Streptococcus pyogenes M1 GAS
ucugcuagacggcua

SEQ ID NO: 2210860 - RNA, 21 nt, Streptococcus pyogenes M1 GAS
ucugcuagacggcuaauaaga

SEQ ID NO: 2210861 - RNA, 15 nt, Streptococcus pyogenes M1 GAS
ucugagauauucauu

SEQ ID NO: 2210862 - RNA, 23 nt, Streptococcus pyogenes M1 GAS
ugacauuucgugucuaaaauaau

SEQ ID NO: 2210863 - RNA, 19 nt, Streptococcus pyogenes M1 GAS
ugaccaauauagcaaucuu

SEQ ID NO: 2210864 - RNA, 21 nt, Streptococcus pyogenes M1 GAS
ugaccaaaagaauuauacuaa

SEQ ID NO: 2210865 - RNA, 20 nt, Streptococcus pyogenes M1 GAS
ugaccacaccuaauaaaaua

SEQ ID NO: 2210866 - RNA, 15 nt, Streptococcus pyogenes M1 GAS
ugaccccaaaaguug

SEQ ID NO: 2210867 - RNA, 16 nt, Streptococcus pyogenes M1 GAS
ugacuagccaaaucug

SEQ ID NO: 2210868 - RNA, 14 nt, Streptococcus pyogenes M1 GAS
ugacuaguuuauua

SEQ ID NO: 2210869 - RNA, 23 nt, Streptococcus pyogenes M1 GAS
ugaugaaucauuuuggagagauu

SEQ ID NO: 2210870 - RNA, 13 nt, Streptococcus pyogenes M1 GAS
ugauauaaaaaug

SEQ ID NO: 2210871 - RNA, 16 nt, Streptococcus pyogenes M1 GAS
ugauauaaaaauggag

SEQ ID NO: 2210872 - RNA, 13 nt, Streptococcus pyogenes M1 GAS
ugauaaaacucaa

SEQ ID NO: 2210873 - RNA, 18 nt, Streptococcus pyogenes M1 GAS
ugaguuuuuucuaaaaga

SEQ ID NO: 2210874 - RNA, 16 nt, Streptococcus pyogenes M1 GAS
ugagcaaggcaagagg

SEQ ID NO: 2210875 - RNA, 14 nt, Streptococcus pyogenes M1 GAS
ugagcaaaacaaua

SEQ ID NO: 2210876 - RNA, 21 nt, Streptococcus pyogenes M1 GAS
ugagcaaaacaauaacacaga

SEQ ID NO: 2210877 - RNA, 20 nt, Streptococcus pyogenes M1 GAS
ugcaucgucugcaaguucuu

SEQ ID NO: 2210878 - RNA, 15 nt, Streptococcus pyogenes M1 GAS
ugcagucuuuuucau

SEQ ID NO: 2210879 - RNA, 20 nt, Streptococcus pyogenes M1 GAS
ugcacacaaaucuucuagaa

SEQ ID NO: 2210880 - RNA, 14 nt, Streptococcus pyogenes M1 GAS
ugcaaguucuuugc

SEQ ID NO: 2210881 - RNA, 17 nt, Streptococcus pyogenes M1 GAS
ugcaaguucuuugccuu

SEQ ID NO: 2210882 - RNA, 13 nt, Streptococcus pyogenes M1 GAS
ugauugccauuua

SEQ ID NO: 2210883 - RNA, 15 nt, Streptococcus pyogenes M1 GAS
ugauugauuugucuu

SEQ ID NO: 2210884 - RNA, 20 nt, Streptococcus pyogenes M1 GAS
ugauuuuaacguuuugaacu

SEQ ID NO: 2210885 - RNA, 15 nt, Streptococcus pyogenes M1 GAS
ugaugagacuaaccu

SEQ ID NO: 2210886 - RNA, 20 nt, Streptococcus pyogenes M1 GAS
ucaguucugagauauucauu

SEQ ID NO: 2210887 - RNA, 23 nt, Streptococcus pyogenes M1 GAS
ucaguucugagauauucauuuuc

SEQ ID NO: 2210888 - RNA, 22 nt, Streptococcus pyogenes M1 GAS
ucauuuucuuugugacaugagu

SEQ ID NO: 2210889 - RNA, 11 nt, Streptococcus pyogenes M1 GAS
ucauuuugguu

SEQ ID NO: 2210890 - RNA, 21 nt, Streptococcus pyogenes M1 GAS
ucauuuuggagagauuuuaaa

SEQ ID NO: 2210891 - RNA, 17 nt, Streptococcus pyogenes M1 GAS
uccaaacauccaaucac

SEQ ID NO: 2210892 - RNA, 12 nt, Streptococcus pyogenes M1 GAS
uccaacaacgcu

SEQ ID NO: 2210893 - RNA, 17 nt, Streptococcus pyogenes M1 GAS
uccaaugaaaacuccag

SEQ ID NO: 2210894 - RNA, 13 nt, Streptococcus pyogenes M1 GAS
uccaaugacuaag

SEQ ID NO: 2210895 - RNA, 15 nt, Streptococcus pyogenes M1 GAS
uccaaucuuucauua

SEQ ID NO: 2210896 - RNA, 16 nt, Streptococcus pyogenes M1 GAS
uccaacuuuuaucacu

SEQ ID NO: 2210897 - RNA, 18 nt, Streptococcus pyogenes M1 GAS
uccauaggccacccaaua

SEQ ID NO: 2210898 - RNA, 15 nt, Streptococcus pyogenes M1 GAS
uccauucuuuauaau

SEQ ID NO: 2210899 - RNA, 12 nt, Streptococcus pyogenes M1 GAS
uccaugauuuuc

SEQ ID NO: 2210900 - RNA, 23 nt, Streptococcus pyogenes M1 GAS
uccauuauaaaucuuacuaacua

SEQ ID NO: 2210901 - RNA, 18 nt, Streptococcus pyogenes M1 GAS
aaaucuggcuuagcagca

SEQ ID NO: 2210902 - RNA, 22 nt, Streptococcus pyogenes M1 GAS
aaaucuggcuuagcagcaccag

SEQ ID NO: 2210903 - RNA, 18 nt, Streptococcus pyogenes M1 GAS
uccccuccuugcaauaga

SEQ ID NO: 2210904 - RNA, 15 nt, Streptococcus pyogenes M1 GAS
ucccauguuuuauua

SEQ ID NO: 2210905 - RNA, 12 nt, Streptococcus pyogenes M1 GAS
ucccauguuuua

SEQ ID NO: 2210906 - RNA, 17 nt, Streptococcus pyogenes M1 GAS
ucccagcagcaaaggcg

SEQ ID NO: 2210907 - RNA, 20 nt, Streptococcus pyogenes M1 GAS
ucccaucuuuaucagucugu

SEQ ID NO: 2210908 - RNA, 18 nt, Streptococcus pyogenes M1 GAS
uccuuagcaguuauaauu

SEQ ID NO: 2210909 - RNA, 15 nt, Streptococcus pyogenes M1 GAS
uccuccuaaauauaa

SEQ ID NO: 2210910 - RNA, 17 nt, Streptococcus pyogenes M1 GAS
uccucuaacauguccaa

SEQ ID NO: 2210911 - RNA, 16 nt, Streptococcus pyogenes M1 GAS
uccucgguuuuuuuaa

SEQ ID NO: 2210912 - RNA, 23 nt, Streptococcus pyogenes M1 GAS
uccucuuuuaauuuggaggugaa

SEQ ID NO: 2210913 - RNA, 23 nt, Streptococcus pyogenes M1 GAS
uccucuuauagcacguuggaaaa

SEQ ID NO: 2210914 - RNA, 13 nt, Streptococcus pyogenes M1 GAS
uccucugaaaagu

SEQ ID NO: 2210915 - RNA, 22 nt, Streptococcus pyogenes M1 GAS
uccuaacaaaaucacaccauua

SEQ ID NO: 2210916 - RNA, 13 nt, Streptococcus pyogenes M1 GAS
uccuaacaauuuu

SEQ ID NO: 2210917 - RNA, 17 nt, Streptococcus pyogenes M1 GAS
uccuaacaauuuuucaa

SEQ ID NO: 2210918 - RNA, 14 nt, Streptococcus pyogenes M1 GAS
uccguacacuccug

SEQ ID NO: 2210919 - RNA, 16 nt, Streptococcus pyogenes M1 GAS
uccuaaaaccauaccu

SEQ ID NO: 2210920 - RNA, 21 nt, Streptococcus pyogenes M1 GAS
uccggcaggggucauuauugu

SEQ ID NO: 2210921 - RNA, 18 nt, Streptococcus pyogenes M1 GAS
ucgagcuuucuacuaaaa

SEQ ID NO: 2210922 - RNA, 21 nt, Streptococcus pyogenes M1 GAS
ucgacauuuaugcugauuuug

SEQ ID NO: 2210923 - RNA, 22 nt, Streptococcus pyogenes M1 GAS
uccuuguacaagagcuuaaaag

SEQ ID NO: 2210924 - RNA, 12 nt, Streptococcus pyogenes M1 GAS
uagucuuuaaaa

SEQ ID NO: 2210925 - RNA, 15 nt, Streptococcus pyogenes M1 GAS
uagugaauucuaaaa

SEQ ID NO: 2210926 - RNA, 18 nt, Streptococcus pyogenes M1 GAS
uagugguauagacaaaca

SEQ ID NO: 2210927 - RNA, 18 nt, Streptococcus pyogenes M1 GAS
uaguuauguuauaagaga

SEQ ID NO: 2210928 - RNA, 14 nt, Streptococcus pyogenes M1 GAS
uagguuaaaauaga

SEQ ID NO: 2210929 - RNA, 15 nt, Streptococcus pyogenes M1 GAS
uaguaaccauugcca

SEQ ID NO: 2210930 - RNA, 15 nt, Streptococcus pyogenes M1 GAS
uagguuaaaauagaa

SEQ ID NO: 2210931 - RNA, 14 nt, Streptococcus pyogenes M1 GAS
uagguucuuugguu

SEQ ID NO: 2210932 - RNA, 17 nt, Streptococcus pyogenes M1 GAS
uagguucuuugguuuga

SEQ ID NO: 2210933 - RNA, 20 nt, Streptococcus pyogenes M1 GAS
uagucagaucauuaaauuga

SEQ ID NO: 2210934 - RNA, 11 nt, Streptococcus pyogenes M1 GAS
uauaaacaaag

SEQ ID NO: 2210935 - RNA, 17 nt, Streptococcus pyogenes M1 GAS
uauaaacaaagccagug

SEQ ID NO: 2210936 - RNA, 13 nt, Streptococcus pyogenes M1 GAS
uauaaugguuuuu

SEQ ID NO: 2210937 - RNA, 21 nt, Streptococcus pyogenes M1 GAS
uauaauuaguauauuguaaua

SEQ ID NO: 2210938 - RNA, 13 nt, Streptococcus pyogenes M1 GAS
uauaguuauguua

SEQ ID NO: 2210939 - RNA, 23 nt, Streptococcus pyogenes M1 GAS
uauaguaaccauugccauuaaua

SEQ ID NO: 2210940 - RNA, 14 nt, Streptococcus pyogenes M1 GAS
uauaauuucaauaa

SEQ ID NO: 2210941 - RNA, 18 nt, Streptococcus pyogenes M1 GAS
uauauggguguuggaggu

SEQ ID NO: 2210942 - RNA, 21 nt, Streptococcus pyogenes M1 GAS
uaucaaguaugcuuuuaauuu

SEQ ID NO: 2210943 - RNA, 20 nt, Streptococcus pyogenes M1 GAS
uaucaauaacagaaauuaau

SEQ ID NO: 2210944 - RNA, 20 nt, Streptococcus pyogenes M1 GAS
uauccuccuaaauauaaauu

SEQ ID NO: 2210945 - RNA, 14 nt, Streptococcus pyogenes M1 GAS
uaucccauaucucu

SEQ ID NO: 2210946 - RNA, 18 nt, Streptococcus pyogenes M1 GAS
uaucaggcaaaacaaaaa

SEQ ID NO: 2210947 - RNA, 19 nt, Streptococcus pyogenes M1 GAS
uaugcuaacugauaaaacu

SEQ ID NO: 2210948 - RNA, 17 nt, Streptococcus pyogenes M1 GAS
uauggguguuggagguc

SEQ ID NO: 2210949 - RNA, 13 nt, Streptococcus pyogenes M1 GAS
uaugacuaaacgu

SEQ ID NO: 2210950 - RNA, 20 nt, Streptococcus pyogenes M1 GAS
uaugauacauugaauaaagu

SEQ ID NO: 2210951 - RNA, 18 nt, Streptococcus pyogenes M1 GAS
uaucuagaacagcugcuu

SEQ ID NO: 2210952 - RNA, 14 nt, Streptococcus pyogenes M1 GAS
uaucuagaacagcu

SEQ ID NO: 2210953 - RNA, 17 nt, Streptococcus pyogenes M1 GAS
uaucuaagcuauagaaa

SEQ ID NO: 2210954 - RNA, 23 nt, Streptococcus pyogenes M1 GAS
uaucugcagauuuuaagacaaca

SEQ ID NO: 2210955 - RNA, 14 nt, Streptococcus pyogenes M1 GAS
uaucucguaauccu

SEQ ID NO: 2210956 - RNA, 18 nt, Streptococcus pyogenes M1 GAS
uaugaaaaaagaacaaag

SEQ ID NO: 2210957 - RNA, 13 nt, Streptococcus pyogenes M1 GAS
uaugaaaaagaag

SEQ ID NO: 2210958 - RNA, 16 nt, Streptococcus pyogenes M1 GAS
uauucuuaaaaaaauc

SEQ ID NO: 2210959 - RNA, 15 nt, Streptococcus pyogenes M1 GAS
uauuguuaauauagu

SEQ ID NO: 2210960 - RNA, 19 nt, Streptococcus pyogenes M1 GAS
uauguaacgcuuguuuaug

SEQ ID NO: 2210961 - RNA, 16 nt, Streptococcus pyogenes M1 GAS
uaugucgucgugacaa

SEQ ID NO: 2210962 - RNA, 16 nt, Streptococcus pyogenes M1 GAS
uaugucuugcuaaaau

SEQ ID NO: 2210963 - RNA, 17 nt, Streptococcus pyogenes M1 GAS
uaugucuugcuaaaauu

SEQ ID NO: 2210964 - RNA, 15 nt, Streptococcus pyogenes M1 GAS
uaugugauuauuauu

SEQ ID NO: 2210965 - RNA, 16 nt, Streptococcus pyogenes M1 GAS
uauuacaaaacugucu

SEQ ID NO: 2210966 - RNA, 20 nt, Streptococcus pyogenes M1 GAS
uauuaacguuaacaaaaaua

SEQ ID NO: 2210967 - RNA, 12 nt, Streptococcus pyogenes M1 GAS
uauuaaagacaa

SEQ ID NO: 2210968 - RNA, 15 nt, Streptococcus pyogenes M1 GAS
uauuaaauaauacag

SEQ ID NO: 2210969 - RNA, 17 nt, Streptococcus pyogenes M1 GAS
ucaauauaauaaaaagc

SEQ ID NO: 2210970 - RNA, 14 nt, Streptococcus pyogenes M1 GAS
ucaauauaauaaaa

SEQ ID NO: 2210971 - RNA, 19 nt, Streptococcus pyogenes M1 GAS
ucaauaacagaaauuaaua

SEQ ID NO: 2210972 - RNA, 19 nt, Streptococcus pyogenes M1 GAS
ucaauuuagccguccuuaa

SEQ ID NO: 2210973 - RNA, 20 nt, Streptococcus pyogenes M1 GAS
ucaaugauagcuuucaauug

SEQ ID NO: 2210974 - RNA, 22 nt, Streptococcus pyogenes M1 GAS
ucaaugacuugaccaaauacag

SEQ ID NO: 2210975 - RNA, 23 nt, Streptococcus pyogenes M1 GAS
ucaacaguauaacuguuuuucuu

SEQ ID NO: 2210976 - RNA, 21 nt, Streptococcus pyogenes M1 GAS
ucaacuaucaaguaugcuuuu

SEQ ID NO: 2210977 - RNA, 22 nt, Streptococcus pyogenes M1 GAS
ucaacuaucaaguaugcuuuua

SEQ ID NO: 2210978 - RNA, 17 nt, Streptococcus pyogenes M1 GAS
ucaaccgcuuccuuugc

SEQ ID NO: 2210979 - RNA, 12 nt, Streptococcus pyogenes M1 GAS
uauuuaauagca

SEQ ID NO: 2210980 - RNA, 18 nt, Streptococcus pyogenes M1 GAS
ucaaaagaccauaaaaaa

SEQ ID NO: 2210981 - RNA, 20 nt, Streptococcus pyogenes M1 GAS
ucaaacuauauuguuaguuu

SEQ ID NO: 2210982 - RNA, 12 nt, Streptococcus pyogenes M1 GAS
ucacuauaauuu

SEQ ID NO: 2210983 - RNA, 17 nt, Streptococcus pyogenes M1 GAS
ucacuuuguuaccagau

SEQ ID NO: 2210984 - RNA, 20 nt, Streptococcus pyogenes M1 GAS
ucagagcuuuuuuuguuuug

SEQ ID NO: 2210985 - RNA, 19 nt, Streptococcus pyogenes M1 GAS
ucagagaugcuucuuucaa

SEQ ID NO: 2210986 - RNA, 15 nt, Streptococcus pyogenes M1 GAS
ucagagacaauaagg

SEQ ID NO: 2210987 - RNA, 14 nt, Streptococcus pyogenes M1 GAS
ucagaauaaagaaa

SEQ ID NO: 2210988 - RNA, 14 nt, Streptococcus pyogenes M1 GAS
ucagaauaagaaaa

SEQ ID NO: 2210989 - RNA, 16 nt, Streptococcus pyogenes M1 GAS
ucagaauaagaaaacc

SEQ ID NO: 2210990 - RNA, 23 nt, Streptococcus pyogenes M1 GAS
aaaucuaaucagaacucgucuuu

SEQ ID NO: 2210991 - RNA, 16 nt, Streptococcus pyogenes M1 GAS
ucaguagugaugagua

SEQ ID NO: 2210992 - RNA, 18 nt, Streptococcus pyogenes M1 GAS
aaaucucagaagcuuuau

SEQ ID NO: 2210993 - RNA, 20 nt, Streptococcus pyogenes M1 GAS
ucagcccccucuuuaccauu

SEQ ID NO: 2210994 - RNA, 18 nt, Streptococcus pyogenes M1 GAS
gugggcuuuuuuguguuc

SEQ ID NO: 2210995 - RNA, 16 nt, Streptococcus pyogenes M1 GAS
guggcuaguaaguuuu

SEQ ID NO: 2210996 - RNA, 18 nt, Streptococcus pyogenes M1 GAS
aaauauaaccucuagcuu

SEQ ID NO: 2210997 - RNA, 21 nt, Streptococcus pyogenes M1 GAS
aaauauauucuaauuugugaa

SEQ ID NO: 2210998 - RNA, 18 nt, Streptococcus pyogenes M1 GAS
guuccaugauugauuuua

SEQ ID NO: 2210999 - RNA, 17 nt, Streptococcus pyogenes M1 GAS
guuauagcuccuaaaac

SEQ ID NO: 2211000 - RNA, 16 nt, Streptococcus pyogenes M1 GAS
guuaucugauauuuca

SEQ ID NO: 2211001 - RNA, 20 nt, Streptococcus pyogenes M1 GAS
guguuggaggucugugauga

SEQ ID NO: 2211002 - RNA, 14 nt, Streptococcus pyogenes M1 GAS
guuaaaauagaaga

SEQ ID NO: 2211003 - RNA, 20 nt, Streptococcus pyogenes M1 GAS
guuaacaaaaauaaguauag

SEQ ID NO: 2211004 - RNA, 18 nt, Streptococcus pyogenes M1 GAS
guuaacaaaaauaaguau

SEQ ID NO: 2211005 - RNA, 17 nt, Streptococcus pyogenes M1 GAS
guuaacugguaaaguau

SEQ ID NO: 2211006 - RNA, 15 nt, Streptococcus pyogenes M1 GAS
guuaaguaaaaggga

SEQ ID NO: 2211007 - RNA, 17 nt, Streptococcus pyogenes M1 GAS
guuaagcuugcuaagag

SEQ ID NO: 2211008 - RNA, 20 nt, Streptococcus pyogenes M1 GAS
guuaagcuugcuaagagaau

SEQ ID NO: 2211009 - RNA, 17 nt, Streptococcus pyogenes M1 GAS
guugcagaguacaaggc

SEQ ID NO: 2211010 - RNA, 20 nt, Streptococcus pyogenes M1 GAS
guucuaguuuaggauauaag

SEQ ID NO: 2211011 - RNA, 15 nt, Streptococcus pyogenes M1 GAS
guuguauuaugaggu

SEQ ID NO: 2211012 - RNA, 19 nt, Streptococcus pyogenes M1 GAS
guugcuacaauuuuuucaa

SEQ ID NO: 2211013 - RNA, 12 nt, Streptococcus pyogenes M1 GAS
aaauaucuagaa

SEQ ID NO: 2211014 - RNA, 13 nt, Streptococcus pyogenes M1 GAS
guuuuauuuugau

SEQ ID NO: 2211015 - RNA, 14 nt, Streptococcus pyogenes M1 GAS
guuuugauaaaaaa

SEQ ID NO: 2211016 - RNA, 17 nt, Streptococcus pyogenes M1 GAS
guuuugauuaaaucuuc

SEQ ID NO: 2211017 - RNA, 20 nt, Streptococcus pyogenes M1 GAS
guuucggaaaacuuuugacu

SEQ ID NO: 2211018 - RNA, 21 nt, Streptococcus pyogenes M1 GAS
aaaucaaaaagcuaacaccau

SEQ ID NO: 2211019 - RNA, 13 nt, Streptococcus pyogenes M1 GAS
guuucgaaaaagg

SEQ ID NO: 2211020 - RNA, 17 nt, Streptococcus pyogenes M1 GAS
gugaggacuuauuuuuu

SEQ ID NO: 2211021 - RNA, 14 nt, Streptococcus pyogenes M1 GAS
gugcaaggcuaaga

SEQ ID NO: 2211022 - RNA, 21 nt, Streptococcus pyogenes M1 GAS
gugaacaccccccgcuuuuaa

SEQ ID NO: 2211023 - RNA, 21 nt, Streptococcus pyogenes M1 GAS
gucuugcucuuguuuucucaa

SEQ ID NO: 2211024 - RNA, 16 nt, Streptococcus pyogenes M1 GAS
gucuuuauccauucuu

SEQ ID NO: 2211025 - RNA, 18 nt, Streptococcus pyogenes M1 GAS
gucuuuucuuuuuggcug

SEQ ID NO: 2211026 - RNA, 21 nt, Streptococcus pyogenes M1 GAS
gucuuuucuuuuuggcugaug

SEQ ID NO: 2211027 - RNA, 21 nt, Streptococcus pyogenes M1 GAS
gucuuaguuuugcacugcuau

SEQ ID NO: 2211028 - RNA, 18 nt, Streptococcus pyogenes M1 GAS
gucuugcuaaaauuucug

SEQ ID NO: 2211029 - RNA, 12 nt, Streptococcus pyogenes M1 GAS
gucucuuuugug

SEQ ID NO: 2211030 - RNA, 17 nt, Streptococcus pyogenes M1 GAS
gucuggaaacuggucaa

SEQ ID NO: 2211031 - RNA, 18 nt, Streptococcus pyogenes M1 GAS
guccuaaccuuuuggcug

SEQ ID NO: 2211032 - RNA, 21 nt, Streptococcus pyogenes M1 GAS
guccuaaccuuuuggcuguau

SEQ ID NO: 2211033 - RNA, 19 nt, Streptococcus pyogenes M1 GAS
gucacugaaaaagccuuua

SEQ ID NO: 2211034 - RNA, 20 nt, Streptococcus pyogenes M1 GAS
gucaacuuaccagcaccuuc

SEQ ID NO: 2211035 - RNA, 13 nt, Streptococcus pyogenes M1 GAS
gucaacuccaauc

SEQ ID NO: 2211036 - RNA, 22 nt, Streptococcus pyogenes M1 GAS
ggugaacaccccccgcuuuuaa

SEQ ID NO: 2211037 - RNA, 19 nt, Streptococcus pyogenes M1 GAS
gucccagcagcaaaggcga

SEQ ID NO: 2211038 - RNA, 19 nt, Streptococcus pyogenes M1 GAS
uacuaacuauuuuuaccuu

SEQ ID NO: 2211039 - RNA, 13 nt, Streptococcus pyogenes M1 GAS
uacuaacaacaac

SEQ ID NO: 2211040 - RNA, 19 nt, Streptococcus pyogenes M1 GAS
uacggcuucuacacaaaag

SEQ ID NO: 2211041 - RNA, 13 nt, Streptococcus pyogenes M1 GAS
uacugauaaacuu

SEQ ID NO: 2211042 - RNA, 15 nt, Streptococcus pyogenes M1 GAS
uacugauaaacuuga

SEQ ID NO: 2211043 - RNA, 16 nt, Streptococcus pyogenes M1 GAS
uacucuauuuuaagua

SEQ ID NO: 2211044 - RNA, 18 nt, Streptococcus pyogenes M1 GAS
uacuagcacaaaaucauu

SEQ ID NO: 2211045 - RNA, 22 nt, Streptococcus pyogenes M1 GAS
uacuucaaggaaggcuuguucu

SEQ ID NO: 2211046 - RNA, 12 nt, Streptococcus pyogenes M1 GAS
uacugcccuuga

SEQ ID NO: 2211047 - RNA, 13 nt, Streptococcus pyogenes M1 GAS
uaccccaaaggcu

SEQ ID NO: 2211048 - RNA, 23 nt, Streptococcus pyogenes M1 GAS
uaccauuuaugaggccaauaaug

SEQ ID NO: 2211049 - RNA, 14 nt, Streptococcus pyogenes M1 GAS
uaccagcaccuucu

SEQ ID NO: 2211050 - RNA, 14 nt, Streptococcus pyogenes M1 GAS
uacauugaauaaag

SEQ ID NO: 2211051 - RNA, 17 nt, Streptococcus pyogenes M1 GAS
uacauugaauaaaguga

SEQ ID NO: 2211052 - RNA, 17 nt, Streptococcus pyogenes M1 GAS
uaccaaaucaaaaagcu

SEQ ID NO: 2211053 - RNA, 19 nt, Streptococcus pyogenes M1 GAS
uacaucaaaaaaagcaaug

SEQ ID NO: 2211054 - RNA, 20 nt, Streptococcus pyogenes M1 GAS
uacaucaaaaaaagcaauga

SEQ ID NO: 2211055 - RNA, 21 nt, Streptococcus pyogenes M1 GAS
uacaucaaaaaaagcaaugac

SEQ ID NO: 2211056 - RNA, 14 nt, Streptococcus pyogenes M1 GAS
uacaaggcaagcag

SEQ ID NO: 2211057 - RNA, 21 nt, Streptococcus pyogenes M1 GAS
uacaagguuaaguaaaaggga

SEQ ID NO: 2211058 - RNA, 16 nt, Streptococcus pyogenes M1 GAS
uacaguauguaaauau

SEQ ID NO: 2211059 - RNA, 12 nt, Streptococcus pyogenes M1 GAS
uaauuuuuccuu

SEQ ID NO: 2211060 - RNA, 11 nt, Streptococcus pyogenes M1 GAS
uacaaaaaaca

SEQ ID NO: 2211061 - RNA, 12 nt, Streptococcus pyogenes M1 GAS
uacaaaaaacaa

SEQ ID NO: 2211062 - RNA, 21 nt, Streptococcus pyogenes M1 GAS
uacaaaacugucuggaaacug

SEQ ID NO: 2211063 - RNA, 13 nt, Streptococcus pyogenes M1 GAS
uacaaaauaaccc

SEQ ID NO: 2211064 - RNA, 17 nt, Streptococcus pyogenes M1 GAS
uacaagcguuguagccu

SEQ ID NO: 2211065 - RNA, 18 nt, Streptococcus pyogenes M1 GAS
uacaagagcuuaaaaguu

SEQ ID NO: 2211066 - RNA, 18 nt, Streptococcus pyogenes M1 GAS
uacaacugacuagccaaa

SEQ ID NO: 2211067 - RNA, 21 nt, Streptococcus pyogenes M1 GAS
uaauuauuuuaauuuuuccuu

SEQ ID NO: 2211068 - RNA, 11 nt, Streptococcus pyogenes M1 GAS
uaauuagcaua

SEQ ID NO: 2211069 - RNA, 13 nt, Streptococcus pyogenes M1 GAS
uaauuaucugaau

SEQ ID NO: 2211070 - RNA, 17 nt, Streptococcus pyogenes M1 GAS
uaauuaucugaauuauu

SEQ ID NO: 2211071 - RNA, 18 nt, Streptococcus pyogenes M1 GAS
uaauguauuggaaaauac

SEQ ID NO: 2211072 - RNA, 20 nt, Streptococcus pyogenes M1 GAS
uaaugucuugggcgcugucu

SEQ ID NO: 2211073 - RNA, 20 nt, Streptococcus pyogenes M1 GAS
uaaugagcaaggcaagagga

SEQ ID NO: 2211074 - RNA, 14 nt, Streptococcus pyogenes M1 GAS
uaaucgaugauaau

SEQ ID NO: 2211075 - RNA, 16 nt, Streptococcus pyogenes M1 GAS
uaauauguaacgcuug

SEQ ID NO: 2211076 - RNA, 13 nt, Streptococcus pyogenes M1 GAS
uaaucaaaaaacu

SEQ ID NO: 2211077 - RNA, 23 nt, Streptococcus pyogenes M1 GAS
uaaucagaaagaagaaaauuagu

SEQ ID NO: 2211078 - RNA, 18 nt, Streptococcus pyogenes M1 GAS
uaauaagauucaauauga

SEQ ID NO: 2211079 - RNA, 20 nt, Streptococcus pyogenes M1 GAS
uaauaagauucaauaugaaa

SEQ ID NO: 2211080 - RNA, 22 nt, Streptococcus pyogenes M1 GAS
uaauaagauucaauaugaaaac

SEQ ID NO: 2211081 - RNA, 17 nt, Streptococcus pyogenes M1 GAS
uaauaaguauucuaaaa

SEQ ID NO: 2211082 - RNA, 20 nt, Streptococcus pyogenes M1 GAS
uaauaaguauucuaaaaucc

SEQ ID NO: 2211083 - RNA, 21 nt, Streptococcus pyogenes M1 GAS
uaauaguuuuccauaauauca

SEQ ID NO: 2211084 - RNA, 15 nt, Streptococcus pyogenes M1 GAS
uaacuauuucacuua

SEQ ID NO: 2211085 - RNA, 18 nt, Streptococcus pyogenes M1 GAS
uaacguuccaaaaagaaa

SEQ ID NO: 2211086 - RNA, 16 nt, Streptococcus pyogenes M1 GAS
uaacugguaaaguauu

SEQ ID NO: 2211087 - RNA, 18 nt, Streptococcus pyogenes M1 GAS
uaacugguccaucauuga

SEQ ID NO: 2211088 - RNA, 14 nt, Streptococcus pyogenes M1 GAS
uaagaccuucaaaa

SEQ ID NO: 2211089 - RNA, 18 nt, Streptococcus pyogenes M1 GAS
uaagaccuucaaaaaagg

SEQ ID NO: 2211090 - RNA, 20 nt, Streptococcus pyogenes M1 GAS
uaagaccuucaaaaaaggga

SEQ ID NO: 2211091 - RNA, 13 nt, Streptococcus pyogenes M1 GAS
uaagaccuucaaa

SEQ ID NO: 2211092 - RNA, 24 nt, Streptococcus pyogenes M1 GAS
uaagacccuccacccaaacauuca

SEQ ID NO: 2211093 - RNA, 18 nt, Streptococcus pyogenes M1 GAS
uaacuuuuagcuaagaau

SEQ ID NO: 2211094 - RNA, 13 nt, Streptococcus pyogenes M1 GAS
uaacuuucuauua

SEQ ID NO: 2211095 - RNA, 20 nt, Streptococcus pyogenes M1 GAS
uaacuuuaaaagggcugacc

SEQ ID NO: 2211096 - RNA, 20 nt, Streptococcus pyogenes M1 GAS
uaagaaggaacucuccaaag

SEQ ID NO: 2211097 - RNA, 16 nt, Streptococcus pyogenes M1 GAS
uaagaagcuaaugucu

SEQ ID NO: 2211098 - RNA, 18 nt, Streptococcus pyogenes M1 GAS
uaagcugacgauaaguca

SEQ ID NO: 2211099 - RNA, 17 nt, Streptococcus pyogenes M1 GAS
uaaggcucgacaaaggc

SEQ ID NO: 2211100 - RNA, 15 nt, Streptococcus pyogenes M1 GAS
uaaggauuaugaaaa

SEQ ID NO: 2211101 - RNA, 20 nt, Streptococcus pyogenes M1 GAS
uaaggauuaugaaaaagaag

SEQ ID NO: 2211102 - RNA, 15 nt, Streptococcus pyogenes M1 GAS
uaagcccuuaaucua

SEQ ID NO: 2211103 - RNA, 13 nt, Streptococcus pyogenes M1 GAS
uaagcauuuugag

SEQ ID NO: 2211104 - RNA, 13 nt, Streptococcus pyogenes M1 GAS
uaagccaaaucuu

SEQ ID NO: 2211105 - RNA, 21 nt, Streptococcus pyogenes M1 GAS
uaagguacacgugauaaaugc

SEQ ID NO: 2211106 - RNA, 14 nt, Streptococcus pyogenes M1 GAS
uaaguaagauggug

SEQ ID NO: 2211107 - RNA, 13 nt, Streptococcus pyogenes M1 GAS
uaaguaaaaggga

SEQ ID NO: 2211108 - RNA, 18 nt, Streptococcus pyogenes M1 GAS
uaaguccuuuuaguuuua

SEQ ID NO: 2211109 - RNA, 17 nt, Streptococcus pyogenes M1 GAS
uaaguauucuaaaaucc

SEQ ID NO: 2211110 - RNA, 18 nt, Streptococcus pyogenes M1 GAS
uaaguaauguguuguaua

SEQ ID NO: 2211111 - RNA, 17 nt, Streptococcus pyogenes M1 GAS
uaagugagcgcccuaaa

SEQ ID NO: 2211112 - RNA, 19 nt, Streptococcus pyogenes M1 GAS
uaauaaacuguauacaaaa

SEQ ID NO: 2211113 - RNA, 21 nt, Streptococcus pyogenes M1 GAS
uaacaauuacaacccacauac

SEQ ID NO: 2211114 - RNA, 23 nt, Streptococcus pyogenes M1 GAS
uaacaaaaugaagcaaaauaaac

SEQ ID NO: 2211115 - RNA, 15 nt, Streptococcus pyogenes M1 GAS
uaacaaaaauaagua

SEQ ID NO: 2211116 - RNA, 14 nt, Streptococcus pyogenes M1 GAS
uaacgcuaugcuug

SEQ ID NO: 2211117 - RNA, 16 nt, Streptococcus pyogenes M1 GAS
uaaccauaucacaaaa

SEQ ID NO: 2211118 - RNA, 13 nt, Streptococcus pyogenes M1 GAS
uaacaucuugauu

SEQ ID NO: 2211119 - RNA, 20 nt, Streptococcus pyogenes M1 GAS
uaacagaaauuaauaaauuu

SEQ ID NO: 2211120 - RNA, 15 nt, Streptococcus pyogenes M1 GAS
uaacacgguuuucug

SEQ ID NO: 2211121 - RNA, 19 nt, Streptococcus pyogenes M1 GAS
uaaauaucuuaccauugua

SEQ ID NO: 2211122 - RNA, 21 nt, Streptococcus pyogenes M1 GAS
uaaauauccaaugaaaacucc

SEQ ID NO: 2211123 - RNA, 15 nt, Streptococcus pyogenes M1 GAS
uaaauauaaauuauu

SEQ ID NO: 2211124 - RNA, 14 nt, Streptococcus pyogenes M1 GAS
uaaauauaaauuau

SEQ ID NO: 2211125 - RNA, 13 nt, Streptococcus pyogenes M1 GAS
uaaaguuaggaaa

SEQ ID NO: 2211126 - RNA, 15 nt, Streptococcus pyogenes M1 GAS
uaaaguuaggaaaga

SEQ ID NO: 2211127 - RNA, 18 nt, Streptococcus pyogenes M1 GAS
uaaaguuaggaaagauag

SEQ ID NO: 2211128 - RNA, 15 nt, Streptococcus pyogenes M1 GAS
uaaaguaauaaguag

SEQ ID NO: 2211129 - RNA, 16 nt, Streptococcus pyogenes M1 GAS
uaaagccaaccccaag

SEQ ID NO: 2211130 - RNA, 16 nt, Streptococcus pyogenes M1 GAS
uaaagcaucagcauaa

SEQ ID NO: 2211131 - RNA, 13 nt, Streptococcus pyogenes M1 GAS
uaaagcaucagca

SEQ ID NO: 2211132 - RNA, 21 nt, Streptococcus pyogenes M1 GAS
uaaacacuaccuuaaauguau

SEQ ID NO: 2211133 - RNA, 15 nt, Streptococcus pyogenes M1 GAS
uaaagacaaaaaacu

SEQ ID NO: 2211134 - RNA, 19 nt, Streptococcus pyogenes M1 GAS
uaaacuguauacaaaaagg

SEQ ID NO: 2211135 - RNA, 14 nt, Streptococcus pyogenes M1 GAS
uaaacuuacaaaaa

SEQ ID NO: 2211136 - RNA, 12 nt, Streptococcus pyogenes M1 GAS
uaaacuuaugau

SEQ ID NO: 2211137 - RNA, 19 nt, Streptococcus pyogenes M1 GAS
gcugaacucuuuauuccac

SEQ ID NO: 2211138 - RNA, 14 nt, Streptococcus pyogenes M1 GAS
gcugcgaugauuuu

SEQ ID NO: 2211139 - RNA, 14 nt, Streptococcus pyogenes M1 GAS
gcugcuaaggacaa

SEQ ID NO: 2211140 - RNA, 15 nt, Streptococcus pyogenes M1 GAS
gcugcugcuaaagca

SEQ ID NO: 2211141 - RNA, 17 nt, Streptococcus pyogenes M1 GAS
gcucggugcugacuggu

SEQ ID NO: 2211142 - RNA, 17 nt, Streptococcus pyogenes M1 GAS
gcucuaauuuagucauu

SEQ ID NO: 2211143 - RNA, 21 nt, Streptococcus pyogenes M1 GAS
gcucuaauuuagucauuucuu

SEQ ID NO: 2211144 - RNA, 16 nt, Streptococcus pyogenes M1 GAS
gcuccaacgaccucca

SEQ ID NO: 2211145 - RNA, 17 nt, Streptococcus pyogenes M1 GAS
gcuuguagauaccuaca

SEQ ID NO: 2211146 - RNA, 23 nt, Streptococcus pyogenes M1 GAS
aaaggauuuaguuuuguauugua

SEQ ID NO: 2211147 - RNA, 16 nt, Streptococcus pyogenes M1 GAS
gcuugcucaauuuuug

SEQ ID NO: 2211148 - RNA, 13 nt, Streptococcus pyogenes M1 GAS
gcuucuuucaaac

SEQ ID NO: 2211149 - RNA, 21 nt, Streptococcus pyogenes M1 GAS
gcuucuauguggagcuuuuuu

SEQ ID NO: 2211150 - RNA, 15 nt, Streptococcus pyogenes M1 GAS
gcuguuauuggaaag

SEQ ID NO: 2211151 - RNA, 13 nt, Streptococcus pyogenes M1 GAS
aaaggauaugagg

SEQ ID NO: 2211152 - RNA, 15 nt, Streptococcus pyogenes M1 GAS
aaagucacgaguguu

SEQ ID NO: 2211153 - RNA, 20 nt, Streptococcus pyogenes M1 GAS
aaagugauauacugaaaaug

SEQ ID NO: 2211154 - RNA, 14 nt, Streptococcus pyogenes M1 GAS
ggccccauggcgug

SEQ ID NO: 2211155 - RNA, 16 nt, Streptococcus pyogenes M1 GAS
ggcaaaacaaaaagag

SEQ ID NO: 2211156 - RNA, 22 nt, Streptococcus pyogenes M1 GAS
aaaguaauaaguagcguacaug

SEQ ID NO: 2211157 - RNA, 17 nt, Streptococcus pyogenes M1 GAS
ggacuuuucagucuucu

SEQ ID NO: 2211158 - RNA, 13 nt, Streptococcus pyogenes M1 GAS
aaagggaagaaga

SEQ ID NO: 2211159 - RNA, 15 nt, Streptococcus pyogenes M1 GAS
aaaggcuucaucaau

SEQ ID NO: 2211160 - RNA, 16 nt, Streptococcus pyogenes M1 GAS
aaaggcuucaucaaug

SEQ ID NO: 2211161 - RNA, 21 nt, Streptococcus pyogenes M1 GAS
ggaauguuuacuggacgaaca

SEQ ID NO: 2211162 - RNA, 15 nt, Streptococcus pyogenes M1 GAS
ggucaucagaauaag

SEQ ID NO: 2211163 - RNA, 16 nt, Streptococcus pyogenes M1 GAS
gguaaagauuuuaaau

SEQ ID NO: 2211164 - RNA, 14 nt, Streptococcus pyogenes M1 GAS
gguaaaaaggcagu

SEQ ID NO: 2211165 - RNA, 17 nt, Streptococcus pyogenes M1 GAS
ggguaaaaugacugaca

SEQ ID NO: 2211166 - RNA, 18 nt, Streptococcus pyogenes M1 GAS
ggcuuucauuauagacua

SEQ ID NO: 2211167 - RNA, 14 nt, Streptococcus pyogenes M1 GAS
ggcugccuuggccc

SEQ ID NO: 2211168 - RNA, 16 nt, Streptococcus pyogenes M1 GAS
ggcucgacaaaggcug

SEQ ID NO: 2211169 - RNA, 17 nt, Streptococcus pyogenes M1 GAS
ggcucgacaaaggcugc

SEQ ID NO: 2211170 - RNA, 18 nt, Streptococcus pyogenes M1 GAS
ggcucgucgcgacgcuga

SEQ ID NO: 2211171 - RNA, 16 nt, Streptococcus pyogenes M1 GAS
ggcuguuuccgugcuu

SEQ ID NO: 2211172 - RNA, 20 nt, Streptococcus pyogenes M1 GAS
ggcuuaaucuggagaugaga

SEQ ID NO: 2211173 - RNA, 17 nt, Streptococcus pyogenes M1 GAS
ggcuugcauuuuuugua

SEQ ID NO: 2211174 - RNA, 15 nt, Streptococcus pyogenes M1 GAS
ggcuucuaaaaaagu

SEQ ID NO: 2211175 - RNA, 14 nt, Streptococcus pyogenes M1 GAS
aaauaacuuuaaaa

SEQ ID NO: 2211176 - RNA, 15 nt, Streptococcus pyogenes M1 GAS
aaauaacuuuaaaag

SEQ ID NO: 2211177 - RNA, 20 nt, Streptococcus pyogenes M1 GAS
aaauaacaucaaaggguguu

SEQ ID NO: 2211178 - RNA, 19 nt, Streptococcus pyogenes M1 GAS
gccguccuuaaaagaaaau

SEQ ID NO: 2211179 - RNA, 22 nt, Streptococcus pyogenes M1 GAS
gcgcauguugacuauuuuucgc

SEQ ID NO: 2211180 - RNA, 20 nt, Streptococcus pyogenes M1 GAS
gcgcgacuaaaaucauggga

SEQ ID NO: 2211181 - RNA, 20 nt, Streptococcus pyogenes M1 GAS
gcgccguuuuucaaggcugu

SEQ ID NO: 2211182 - RNA, 19 nt, Streptococcus pyogenes M1 GAS
gcaguuauaauuaguauau

SEQ ID NO: 2211183 - RNA, 17 nt, Streptococcus pyogenes M1 GAS
gcagcuaaaaacaaugc

SEQ ID NO: 2211184 - RNA, 13 nt, Streptococcus pyogenes M1 GAS
gcaggcguuuugu

SEQ ID NO: 2211185 - RNA, 15 nt, Streptococcus pyogenes M1 GAS
gcaucuacagcaccu

SEQ ID NO: 2211186 - RNA, 16 nt, Streptococcus pyogenes M1 GAS
gcaucuacagcaccuu

SEQ ID NO: 2211187 - RNA, 14 nt, Streptococcus pyogenes M1 GAS
gcauguaacaagcc

SEQ ID NO: 2211188 - RNA, 15 nt, Streptococcus pyogenes M1 GAS
gccaaagaaggccag

SEQ ID NO: 2211189 - RNA, 15 nt, Streptococcus pyogenes M1 GAS
gcauuuucaucauca

SEQ ID NO: 2211190 - RNA, 15 nt, Streptococcus pyogenes M1 GAS
gccaaaucuggcuua

SEQ ID NO: 2211191 - RNA, 21 nt, Streptococcus pyogenes M1 GAS
gccaaaucuucugcauuauca

SEQ ID NO: 2211192 - RNA, 14 nt, Streptococcus pyogenes M1 GAS
gccauuuaaaaggg

SEQ ID NO: 2211193 - RNA, 14 nt, Streptococcus pyogenes M1 GAS
gccccauggcgugc

SEQ ID NO: 2211194 - RNA, 17 nt, Streptococcus pyogenes M1 GAS
gcaaauaguagcaaaua

SEQ ID NO: 2211195 - RNA, 19 nt, Streptococcus pyogenes M1 GAS
gcaaauaguucagauauuc

SEQ ID NO: 2211196 - RNA, 20 nt, Streptococcus pyogenes M1 GAS
gcaaauagcaauggcuaaaa

SEQ ID NO: 2211197 - RNA, 15 nt, Streptococcus pyogenes M1 GAS
gcaaaggcuucauca

SEQ ID NO: 2211198 - RNA, 14 nt, Streptococcus pyogenes M1 GAS
gcaaaagaauugaa

SEQ ID NO: 2211199 - RNA, 23 nt, Streptococcus pyogenes M1 GAS
gauuuuuccuagcgggaacacuc

SEQ ID NO: 2211200 - RNA, 20 nt, Streptococcus pyogenes M1 GAS
gauuucggaccaugccuaaa

SEQ ID NO: 2211201 - RNA, 13 nt, Streptococcus pyogenes M1 GAS
gauuuguauuuuu

SEQ ID NO: 2211202 - RNA, 16 nt, Streptococcus pyogenes M1 GAS
gauuugucaaaaagua

SEQ ID NO: 2211203 - RNA, 20 nt, Streptococcus pyogenes M1 GAS
gauuugcugagcuaaagcca

SEQ ID NO: 2211204 - RNA, 21 nt, Streptococcus pyogenes M1 GAS
gauuugaccacaccuaauaaa

SEQ ID NO: 2211205 - RNA, 13 nt, Streptococcus pyogenes M1 GAS
gauucaauaugaa

SEQ ID NO: 2211206 - RNA, 14 nt, Streptococcus pyogenes M1 GAS
gauugcuuccaacu

SEQ ID NO: 2211207 - RNA, 19 nt, Streptococcus pyogenes M1 GAS
gauguuuauuccaaacauc

SEQ ID NO: 2211208 - RNA, 14 nt, Streptococcus pyogenes M1 GAS
gauguuuauuccaa

SEQ ID NO: 2211209 - RNA, 23 nt, Streptococcus pyogenes M1 GAS
gauguuuacgcuuuacauuuuau

SEQ ID NO: 2211210 - RNA, 20 nt, Streptococcus pyogenes M1 GAS
gauuauuauucuaaaugaca

SEQ ID NO: 2211211 - RNA, 15 nt, Streptococcus pyogenes M1 GAS
gauuaugaaaaagaa

SEQ ID NO: 2211212 - RNA, 17 nt, Streptococcus pyogenes M1 GAS
gauuauuagguucuuug

SEQ ID NO: 2211213 - RNA, 12 nt, Streptococcus pyogenes M1 GAS
gauuaugaaaaa

SEQ ID NO: 2211214 - RNA, 18 nt, Streptococcus pyogenes M1 GAS
gauuaguuuuuagcagca

SEQ ID NO: 2211215 - RNA, 19 nt, Streptococcus pyogenes M1 GAS
gauuaguuuuuagcagcag

SEQ ID NO: 2211216 - RNA, 19 nt, Streptococcus pyogenes M1 GAS
gauggacgucuucuuuuua

SEQ ID NO: 2211217 - RNA, 16 nt, Streptococcus pyogenes M1 GAS
gaugccauuuaaaagg

SEQ ID NO: 2211218 - RNA, 19 nt, Streptococcus pyogenes M1 GAS
gaugauugaguaagcagca

SEQ ID NO: 2211219 - RNA, 15 nt, Streptococcus pyogenes M1 GAS
gaugcgcaccuccac

SEQ ID NO: 2211220 - RNA, 15 nt, Streptococcus pyogenes M1 GAS
gaugcguuuauaaag

SEQ ID NO: 2211221 - RNA, 14 nt, Streptococcus pyogenes M1 GAS
gaugaaaugauugu

SEQ ID NO: 2211222 - RNA, 17 nt, Streptococcus pyogenes M1 GAS
gaugagacuaaccugca

SEQ ID NO: 2211223 - RNA, 14 nt, Streptococcus pyogenes M1 GAS
gagauuaacugaca

SEQ ID NO: 2211224 - RNA, 17 nt, Streptococcus pyogenes M1 GAS
gagccaauaacgccagc

SEQ ID NO: 2211225 - RNA, 17 nt, Streptococcus pyogenes M1 GAS
gagcaaggcaagaggag

SEQ ID NO: 2211226 - RNA, 17 nt, Streptococcus pyogenes M1 GAS
gagccuccaacauagcu

SEQ ID NO: 2211227 - RNA, 23 nt, Streptococcus pyogenes M1 GAS
gagcuagauugcuuccaacuccu

SEQ ID NO: 2211228 - RNA, 14 nt, Streptococcus pyogenes M1 GAS
gagucaaugaaaag

SEQ ID NO: 2211229 - RNA, 22 nt, Streptococcus pyogenes M1 GAS
gagucggaaauugaccaaaaga

SEQ ID NO: 2211230 - RNA, 15 nt, Streptococcus pyogenes M1 GAS
gaguuccucgguuuu

SEQ ID NO: 2211231 - RNA, 15 nt, Streptococcus pyogenes M1 GAS
gauaaacuacaccau

SEQ ID NO: 2211232 - RNA, 14 nt, Streptococcus pyogenes M1 GAS
gaguacaaggcaau

SEQ ID NO: 2211233 - RNA, 15 nt, Streptococcus pyogenes M1 GAS
gaguaagcagcauca

SEQ ID NO: 2211234 - RNA, 15 nt, Streptococcus pyogenes M1 GAS
gaucugcacacacuu

SEQ ID NO: 2211235 - RNA, 22 nt, Streptococcus pyogenes M1 GAS
gauaagaccuucaaaaaaggga

SEQ ID NO: 2211236 - RNA, 20 nt, Streptococcus pyogenes M1 GAS
gauaagauacugcccuugau

SEQ ID NO: 2211237 - RNA, 18 nt, Streptococcus pyogenes M1 GAS
gauaagaccuucaaaaaa

SEQ ID NO: 2211238 - RNA, 15 nt, Streptococcus pyogenes M1 GAS
gauaguaaagaagaa

SEQ ID NO: 2211239 - RNA, 19 nt, Streptococcus pyogenes M1 GAS
gauauaguccguacaauca

SEQ ID NO: 2211240 - RNA, 19 nt, Streptococcus pyogenes M1 GAS
gauauagaauagguaaaga

SEQ ID NO: 2211241 - RNA, 21 nt, Streptococcus pyogenes M1 GAS
gauauagaauagguaaagauu

SEQ ID NO: 2211242 - RNA, 13 nt, Streptococcus pyogenes M1 GAS
gauagugugugug

SEQ ID NO: 2211243 - RNA, 14 nt, Streptococcus pyogenes M1 GAS
cuuuccauucuugc

SEQ ID NO: 2211244 - RNA, 17 nt, Streptococcus pyogenes M1 GAS
cuuucauuagcuuuuuu

SEQ ID NO: 2211245 - RNA, 17 nt, Streptococcus pyogenes M1 GAS
cuuucauuauagacuau

SEQ ID NO: 2211246 - RNA, 19 nt, Streptococcus pyogenes M1 GAS
cuuugacaaugucaauuga

SEQ ID NO: 2211247 - RNA, 12 nt, Streptococcus pyogenes M1 GAS
cuuucuuuugcc

SEQ ID NO: 2211248 - RNA, 21 nt, Streptococcus pyogenes M1 GAS
cuuugacagacaccaaaaaaa

SEQ ID NO: 2211249 - RNA, 18 nt, Streptococcus pyogenes M1 GAS
cuuugauuuuucuuguuu

SEQ ID NO: 2211250 - RNA, 14 nt, Streptococcus pyogenes M1 GAS
cuuugcaaaagaau

SEQ ID NO: 2211251 - RNA, 17 nt, Streptococcus pyogenes M1 GAS
cuuuauccauucuuuau

SEQ ID NO: 2211252 - RNA, 17 nt, Streptococcus pyogenes M1 GAS
cuuuauuaaucaaaaaa

SEQ ID NO: 2211253 - RNA, 15 nt, Streptococcus pyogenes M1 GAS
cuuucaguuaucuga

SEQ ID NO: 2211254 - RNA, 20 nt, Streptococcus pyogenes M1 GAS
cuuucaauugauuugcagag

SEQ ID NO: 2211255 - RNA, 13 nt, Streptococcus pyogenes M1 GAS
cuuuauugaugau

SEQ ID NO: 2211256 - RNA, 19 nt, Streptococcus pyogenes M1 GAS
cuuuaacaaugagaucuuc

SEQ ID NO: 2211257 - RNA, 23 nt, Streptococcus pyogenes M1 GAS
cuuuaacaaugagaucuucuuuu

SEQ ID NO: 2211258 - RNA, 11 nt, Streptococcus pyogenes M1 GAS
gaaaacagaaa

SEQ ID NO: 2211259 - RNA, 21 nt, Streptococcus pyogenes M1 GAS
gaaaacguguauucuuaaaaa

SEQ ID NO: 2211260 - RNA, 20 nt, Streptococcus pyogenes M1 GAS
gaaaagaugcacacaaaucu

SEQ ID NO: 2211261 - RNA, 19 nt, Streptococcus pyogenes M1 GAS
cuuuuuuauaauuauuuug

SEQ ID NO: 2211262 - RNA, 14 nt, Streptococcus pyogenes M1 GAS
gaaaaaagaacaaa

SEQ ID NO: 2211263 - RNA, 14 nt, Streptococcus pyogenes M1 GAS
gaaaaaaacuugca

SEQ ID NO: 2211264 - RNA, 14 nt, Streptococcus pyogenes M1 GAS
gaaaaagcaaugau

SEQ ID NO: 2211265 - RNA, 16 nt, Streptococcus pyogenes M1 GAS
gaaaaagucucuagaa

SEQ ID NO: 2211266 - RNA, 13 nt, Streptococcus pyogenes M1 GAS
cuuuuaaaaucug

SEQ ID NO: 2211267 - RNA, 17 nt, Streptococcus pyogenes M1 GAS
cuuuucagagaugcuuc

SEQ ID NO: 2211268 - RNA, 19 nt, Streptococcus pyogenes M1 GAS
cuuuucguuuuauuuugau

SEQ ID NO: 2211269 - RNA, 14 nt, Streptococcus pyogenes M1 GAS
aaagacuucuuccu

SEQ ID NO: 2211270 - RNA, 21 nt, Streptococcus pyogenes M1 GAS
gaaccaacuuggacgaaggcu

SEQ ID NO: 2211271 - RNA, 17 nt, Streptococcus pyogenes M1 GAS
gaacuccuggauuaaau

SEQ ID NO: 2211272 - RNA, 20 nt, Streptococcus pyogenes M1 GAS
gaacagcugaaacaccugcu

SEQ ID NO: 2211273 - RNA, 15 nt, Streptococcus pyogenes M1 GAS
gaacaccguuuuuug

SEQ ID NO: 2211274 - RNA, 15 nt, Streptococcus pyogenes M1 GAS
gaaaugauagcaccu

SEQ ID NO: 2211275 - RNA, 20 nt, Streptococcus pyogenes M1 GAS
gaaauugaccaaaagaauua

SEQ ID NO: 2211276 - RNA, 16 nt, Streptococcus pyogenes M1 GAS
gaaauucaaauacuuc

SEQ ID NO: 2211277 - RNA, 13 nt, Streptococcus pyogenes M1 GAS
gaaacuaaaggca

SEQ ID NO: 2211278 - RNA, 19 nt, Streptococcus pyogenes M1 GAS
gaaacuaaaggcaauagca

SEQ ID NO: 2211279 - RNA, 21 nt, Streptococcus pyogenes M1 GAS
gaaauacuccguuucuaguuu

SEQ ID NO: 2211280 - RNA, 19 nt, Streptococcus pyogenes M1 GAS
gaaauacuccguuucuagu

SEQ ID NO: 2211281 - RNA, 13 nt, Streptococcus pyogenes M1 GAS
gaaaguagcaccu

SEQ ID NO: 2211282 - RNA, 14 nt, Streptococcus pyogenes M1 GAS
gaaaguaaaaauac

SEQ ID NO: 2211283 - RNA, 20 nt, Streptococcus pyogenes M1 GAS
gacagacaccaaaaaaagca

SEQ ID NO: 2211284 - RNA, 23 nt, Streptococcus pyogenes M1 GAS
gacagacaccaaaaaaagcaugg

SEQ ID NO: 2211285 - RNA, 15 nt, Streptococcus pyogenes M1 GAS
gacaguuaaaaauaa

SEQ ID NO: 2211286 - RNA, 20 nt, Streptococcus pyogenes M1 GAS
gacauuucgugucuaaaaua

SEQ ID NO: 2211287 - RNA, 17 nt, Streptococcus pyogenes M1 GAS
gacauuuaugcugauuu

SEQ ID NO: 2211288 - RNA, 21 nt, Streptococcus pyogenes M1 GAS
gacauuuaugcugauuuugga

SEQ ID NO: 2211289 - RNA, 14 nt, Streptococcus pyogenes M1 GAS
gaccauuaucaaua

SEQ ID NO: 2211290 - RNA, 16 nt, Streptococcus pyogenes M1 GAS
gaccuuucaagacaag

SEQ ID NO: 2211291 - RNA, 18 nt, Streptococcus pyogenes M1 GAS
gaccuuucaagacaagca

SEQ ID NO: 2211292 - RNA, 13 nt, Streptococcus pyogenes M1 GAS
gaccuuugauaag

SEQ ID NO: 2211293 - RNA, 20 nt, Streptococcus pyogenes M1 GAS
gacuauagaaaguaaaaaua

SEQ ID NO: 2211294 - RNA, 23 nt, Streptococcus pyogenes M1 GAS
gacuaucauuggggaaacuagca

SEQ ID NO: 2211295 - RNA, 21 nt, Streptococcus pyogenes M1 GAS
gacuaggaaucgcuuuaggaa

SEQ ID NO: 2211296 - RNA, 19 nt, Streptococcus pyogenes M1 GAS
gacacccccugcuguccca

SEQ ID NO: 2211297 - RNA, 19 nt, Streptococcus pyogenes M1 GAS
gacaauuauuuugcaggua

SEQ ID NO: 2211298 - RNA, 14 nt, Streptococcus pyogenes M1 GAS
gacaacccaacgca

SEQ ID NO: 2211299 - RNA, 18 nt, Streptococcus pyogenes M1 GAS
gacaaccuuaaagacccu

SEQ ID NO: 2211300 - RNA, 19 nt, Streptococcus pyogenes M1 GAS
gacaaaaaacuagaaacug

SEQ ID NO: 2211301 - RNA, 20 nt, Streptococcus pyogenes M1 GAS
gacaaaaaacuagaaacugc

SEQ ID NO: 2211302 - RNA, 21 nt, Streptococcus pyogenes M1 GAS
gaauuuuuauaacaauuacaa

SEQ ID NO: 2211303 - RNA, 22 nt, Streptococcus pyogenes M1 GAS
gaaucauuuuggagagauuuua

SEQ ID NO: 2211304 - RNA, 13 nt, Streptococcus pyogenes M1 GAS
gaauaaagaaaaa

SEQ ID NO: 2211305 - RNA, 14 nt, Streptococcus pyogenes M1 GAS
gaauaaagaaaaag

SEQ ID NO: 2211306 - RNA, 22 nt, Streptococcus pyogenes M1 GAS
gaaguuugcggcucggugcuga

SEQ ID NO: 2211307 - RNA, 23 nt, Streptococcus pyogenes M1 GAS
gaauaaaaagacuagagucucua

SEQ ID NO: 2211308 - RNA, 20 nt, Streptococcus pyogenes M1 GAS
aaagauauuuuaaaauaguu

SEQ ID NO: 2211309 - RNA, 13 nt, Streptococcus pyogenes M1 GAS
aaagauauuuuaa

SEQ ID NO: 2211310 - RNA, 15 nt, Streptococcus pyogenes M1 GAS
gaagucucuuuugug

SEQ ID NO: 2211311 - RNA, 22 nt, Streptococcus pyogenes M1 GAS
gaaggaacucuccaaaguucuu

SEQ ID NO: 2211312 - RNA, 15 nt, Streptococcus pyogenes M1 GAS
gaaggcacagaaaaa

SEQ ID NO: 2211313 - RNA, 23 nt, Streptococcus pyogenes M1 GAS
gaagaacagcauuuucaucauca

SEQ ID NO: 2211314 - RNA, 19 nt, Streptococcus pyogenes M1 GAS
cuguauccccuugauaugg

SEQ ID NO: 2211315 - RNA, 14 nt, Streptococcus pyogenes M1 GAS
cuguauauuuaaua

SEQ ID NO: 2211316 - RNA, 14 nt, Streptococcus pyogenes M1 GAS
cuguauacaaaaag

SEQ ID NO: 2211317 - RNA, 13 nt, Streptococcus pyogenes M1 GAS
cuguauaaacuug

SEQ ID NO: 2211318 - RNA, 23 nt, Streptococcus pyogenes M1 GAS
cugucaacuuaccagcaccuucu

SEQ ID NO: 2211319 - RNA, 12 nt, Streptococcus pyogenes M1 GAS
aaacucugccaa

SEQ ID NO: 2211320 - RNA, 12 nt, Streptococcus pyogenes M1 GAS
cuguccaauacc

SEQ ID NO: 2211321 - RNA, 21 nt, Streptococcus pyogenes M1 GAS
cuguccaauaccuagguaguu

SEQ ID NO: 2211322 - RNA, 22 nt, Streptococcus pyogenes M1 GAS
cugucuggaaacuggucaaaag

SEQ ID NO: 2211323 - RNA, 23 nt, Streptococcus pyogenes M1 GAS
cugucuacuuauuugacauuagu

SEQ ID NO: 2211324 - RNA, 14 nt, Streptococcus pyogenes M1 GAS
cuguggguuaagag

SEQ ID NO: 2211325 - RNA, 16 nt, Streptococcus pyogenes M1 GAS
cugugaugaaucauuu

SEQ ID NO: 2211326 - RNA, 19 nt, Streptococcus pyogenes M1 GAS
cugugcagugggcuuuuuu

SEQ ID NO: 2211327 - RNA, 21 nt, Streptococcus pyogenes M1 GAS
cuggguaucaguccuccucuu

SEQ ID NO: 2211328 - RNA, 21 nt, Streptococcus pyogenes M1 GAS
cugguacguugauugccauuu

SEQ ID NO: 2211329 - RNA, 19 nt, Streptococcus pyogenes M1 GAS
cuguaaaauguuauuuaug

SEQ ID NO: 2211330 - RNA, 19 nt, Streptococcus pyogenes M1 GAS
cuguaaaucaguagugaug

SEQ ID NO: 2211331 - RNA, 14 nt, Streptococcus pyogenes M1 GAS
cugguguugagacc

SEQ ID NO: 2211332 - RNA, 15 nt, Streptococcus pyogenes M1 GAS
cugguuuaucauuuu

SEQ ID NO: 2211333 - RNA, 14 nt, Streptococcus pyogenes M1 GAS
aaacuuacaaaaag

SEQ ID NO: 2211334 - RNA, 21 nt, Streptococcus pyogenes M1 GAS
aaacuuaugauuauccucuua

SEQ ID NO: 2211335 - RNA, 20 nt, Streptococcus pyogenes M1 GAS
cuucaaggaaggcuuguucu

SEQ ID NO: 2211336 - RNA, 13 nt, Streptococcus pyogenes M1 GAS
cuuaaggauuuag

SEQ ID NO: 2211337 - RNA, 23 nt, Streptococcus pyogenes M1 GAS
cuuaauaaacuguauacaaaaag

SEQ ID NO: 2211338 - RNA, 21 nt, Streptococcus pyogenes M1 GAS
cuuacaaaaagccuauuuaau

SEQ ID NO: 2211339 - RNA, 14 nt, Streptococcus pyogenes M1 GAS
cuuacaaaaagccu

SEQ ID NO: 2211340 - RNA, 19 nt, Streptococcus pyogenes M1 GAS
cuuacaaaaagccuauuua

SEQ ID NO: 2211341 - RNA, 18 nt, Streptococcus pyogenes M1 GAS
cuuacagcugguuuuuua

SEQ ID NO: 2211342 - RNA, 19 nt, Streptococcus pyogenes M1 GAS
cuuacagcugguuuuuuaa

SEQ ID NO: 2211343 - RNA, 15 nt, Streptococcus pyogenes M1 GAS
cuuacuaacuagcaa

SEQ ID NO: 2211344 - RNA, 17 nt, Streptococcus pyogenes M1 GAS
cuuaguguagauaaacu

SEQ ID NO: 2211345 - RNA, 15 nt, Streptococcus pyogenes M1 GAS
cuuaaacauauuaua

SEQ ID NO: 2211346 - RNA, 16 nt, Streptococcus pyogenes M1 GAS
cuguuugccguguucu

SEQ ID NO: 2211347 - RNA, 22 nt, Streptococcus pyogenes M1 GAS
cuguuugugauggucuugcucu

SEQ ID NO: 2211348 - RNA, 13 nt, Streptococcus pyogenes M1 GAS
cuguucucuuugg

SEQ ID NO: 2211349 - RNA, 22 nt, Streptococcus pyogenes M1 GAS
cuguucucuuuggagaaauuca

SEQ ID NO: 2211350 - RNA, 20 nt, Streptococcus pyogenes M1 GAS
cugcugucccagcagcaaag

SEQ ID NO: 2211351 - RNA, 15 nt, Streptococcus pyogenes M1 GAS
cugcuguuggauaca

SEQ ID NO: 2211352 - RNA, 13 nt, Streptococcus pyogenes M1 GAS
aaacuauauuguu

SEQ ID NO: 2211353 - RNA, 21 nt, Streptococcus pyogenes M1 GAS
cugcuaguaugucuaagaugu

SEQ ID NO: 2211354 - RNA, 19 nt, Streptococcus pyogenes M1 GAS
cugcuagacggcuaauaag

SEQ ID NO: 2211355 - RNA, 20 nt, Streptococcus pyogenes M1 GAS
cugcuaguugugucuuuucu

SEQ ID NO: 2211356 - RNA, 12 nt, Streptococcus pyogenes M1 GAS
cugccuuggccc

SEQ ID NO: 2211357 - RNA, 14 nt, Streptococcus pyogenes M1 GAS
cugcauaucugccc

SEQ ID NO: 2211358 - RNA, 13 nt, Streptococcus pyogenes M1 GAS
cugauaaaaagag

SEQ ID NO: 2211359 - RNA, 20 nt, Streptococcus pyogenes M1 GAS
cugagccuccaacauagcua

SEQ ID NO: 2211360 - RNA, 20 nt, Streptococcus pyogenes M1 GAS
cugagcuaaagccaacccca

SEQ ID NO: 2211361 - RNA, 14 nt, Streptococcus pyogenes M1 GAS
cugauuuuggauga

SEQ ID NO: 2211362 - RNA, 17 nt, Streptococcus pyogenes M1 GAS
cugacuuaaauuuggag

SEQ ID NO: 2211363 - RNA, 22 nt, Streptococcus pyogenes M1 GAS
cugacgauaagucaguuuuuuc

SEQ ID NO: 2211364 - RNA, 19 nt, Streptococcus pyogenes M1 GAS
cugacaaaaaaagcaagca

SEQ ID NO: 2211365 - RNA, 17 nt, Streptococcus pyogenes M1 GAS
cguuagcagacaaaagg

SEQ ID NO: 2211366 - RNA, 19 nt, Streptococcus pyogenes M1 GAS
cguuaucuccacagagucu

SEQ ID NO: 2211367 - RNA, 22 nt, Streptococcus pyogenes M1 GAS
cuaaaauuucugauaggaguga

SEQ ID NO: 2211368 - RNA, 17 nt, Streptococcus pyogenes M1 GAS
cuaaaagcauaaaaaua

SEQ ID NO: 2211369 - RNA, 13 nt, Streptococcus pyogenes M1 GAS
cuaaaaaaggagc

SEQ ID NO: 2211370 - RNA, 18 nt, Streptococcus pyogenes M1 GAS
cuaaaaaagcaauguaug

SEQ ID NO: 2211371 - RNA, 19 nt, Streptococcus pyogenes M1 GAS
cguuuuguuguauuaugag

SEQ ID NO: 2211372 - RNA, 17 nt, Streptococcus pyogenes M1 GAS
cguuuuuuguuguaaaa

SEQ ID NO: 2211373 - RNA, 13 nt, Streptococcus pyogenes M1 GAS
cuaauccaauaau

SEQ ID NO: 2211374 - RNA, 14 nt, Streptococcus pyogenes M1 GAS
cuaauccaauaaua

SEQ ID NO: 2211375 - RNA, 13 nt, Streptococcus pyogenes M1 GAS
cuaauccuuuuuc

SEQ ID NO: 2211376 - RNA, 22 nt, Streptococcus pyogenes M1 GAS
cuaaucuaggacuaaccccuaa

SEQ ID NO: 2211377 - RNA, 17 nt, Streptococcus pyogenes M1 GAS
cuaauaagagugugacg

SEQ ID NO: 2211378 - RNA, 12 nt, Streptococcus pyogenes M1 GAS
cuacaaaauaac

SEQ ID NO: 2211379 - RNA, 17 nt, Streptococcus pyogenes M1 GAS
cuaauggugucgcuuuu

SEQ ID NO: 2211380 - RNA, 17 nt, Streptococcus pyogenes M1 GAS
cuaauuuagucauuucu

SEQ ID NO: 2211381 - RNA, 16 nt, Streptococcus pyogenes M1 GAS
cuaauugugagaaacu

SEQ ID NO: 2211382 - RNA, 23 nt, Streptococcus pyogenes M1 GAS
cuaagcuauagaaacuuuuuaua

SEQ ID NO: 2211383 - RNA, 24 nt, Streptococcus pyogenes M1 GAS
cuaagauguuuacgcuuuacauuu

SEQ ID NO: 2211384 - RNA, 17 nt, Streptococcus pyogenes M1 GAS
cuaaguagauacuuugg

SEQ ID NO: 2211385 - RNA, 22 nt, Streptococcus pyogenes M1 GAS
cuaacagcaacaucaaaaagag

SEQ ID NO: 2211386 - RNA, 20 nt, Streptococcus pyogenes M1 GAS
cuaacaauuuuucaaaaaaa

SEQ ID NO: 2211387 - RNA, 21 nt, Streptococcus pyogenes M1 GAS
cuaacaacaacaacccuugau

SEQ ID NO: 2211388 - RNA, 23 nt, Streptococcus pyogenes M1 GAS
cuaacucuuguagaauuucaagu

SEQ ID NO: 2211389 - RNA, 15 nt, Streptococcus pyogenes M1 GAS
cuaaccugcauaucu

SEQ ID NO: 2211390 - RNA, 15 nt, Streptococcus pyogenes M1 GAS
cgucuggcaauaagu

SEQ ID NO: 2211391 - RNA, 16 nt, Streptococcus pyogenes M1 GAS
cgucuggaaggcacag

SEQ ID NO: 2211392 - RNA, 13 nt, Streptococcus pyogenes M1 GAS
cgucuaaaaagcc

SEQ ID NO: 2211393 - RNA, 15 nt, Streptococcus pyogenes M1 GAS
cguauuggccuucuu

SEQ ID NO: 2211394 - RNA, 14 nt, Streptococcus pyogenes M1 GAS
cguagcccucgcua

SEQ ID NO: 2211395 - RNA, 19 nt, Streptococcus pyogenes M1 GAS
cguauaggugaguuuuuuc

SEQ ID NO: 2211396 - RNA, 17 nt, Streptococcus pyogenes M1 GAS
cguaaugucuuguucug

SEQ ID NO: 2211397 - RNA, 14 nt, Streptococcus pyogenes M1 GAS
cuacacaaaagcuu

SEQ ID NO: 2211398 - RNA, 17 nt, Streptococcus pyogenes M1 GAS
cuacacuugauuucauu

SEQ ID NO: 2211399 - RNA, 19 nt, Streptococcus pyogenes M1 GAS
cuacacuugauuucauuuu

SEQ ID NO: 2211400 - RNA, 14 nt, Streptococcus pyogenes M1 GAS
cuagaaaaagcaau

SEQ ID NO: 2211401 - RNA, 16 nt, Streptococcus pyogenes M1 GAS
cuagaaaaagcaauga

SEQ ID NO: 2211402 - RNA, 21 nt, Streptococcus pyogenes M1 GAS
cuaggagggacugucaaaaaa

SEQ ID NO: 2211403 - RNA, 21 nt, Streptococcus pyogenes M1 GAS
cuagcuuuuuacaucaaaaaa

SEQ ID NO: 2211404 - RNA, 22 nt, Streptococcus pyogenes M1 GAS
cuagucgaaauugguccucuga

SEQ ID NO: 2211405 - RNA, 21 nt, Streptococcus pyogenes M1 GAS
cuaguguguugucaaacauaa

SEQ ID NO: 2211406 - RNA, 21 nt, Streptococcus pyogenes M1 GAS
cuaguuaagcuugcuaagaga

SEQ ID NO: 2211407 - RNA, 23 nt, Streptococcus pyogenes M1 GAS
cuaguuaagcuugcuaagagaau

SEQ ID NO: 2211408 - RNA, 19 nt, Streptococcus pyogenes M1 GAS
cucaauuuuugauuuuaau

SEQ ID NO: 2211409 - RNA, 19 nt, Streptococcus pyogenes M1 GAS
cuaugauacauugaauaaa

SEQ ID NO: 2211410 - RNA, 15 nt, Streptococcus pyogenes M1 GAS
cuauggcuucuaaaa

SEQ ID NO: 2211411 - RNA, 21 nt, Streptococcus pyogenes M1 GAS
cuaugaaaaaagaacaaagau

SEQ ID NO: 2211412 - RNA, 22 nt, Streptococcus pyogenes M1 GAS
cuaucugcagauuuuaagacaa

SEQ ID NO: 2211413 - RNA, 16 nt, Streptococcus pyogenes M1 GAS
cuauagaaaguaaaaa

SEQ ID NO: 2211414 - RNA, 18 nt, Streptococcus pyogenes M1 GAS
cuauagcauuaaggauua

SEQ ID NO: 2211415 - RNA, 20 nt, Streptococcus pyogenes M1 GAS
cucaaaaauauauucuaauu

SEQ ID NO: 2211416 - RNA, 15 nt, Streptococcus pyogenes M1 GAS
cuauuuuuccuuggc

SEQ ID NO: 2211417 - RNA, 12 nt, Streptococcus pyogenes M1 GAS
cuauuuuaagua

SEQ ID NO: 2211418 - RNA, 20 nt, Streptococcus pyogenes M1 GAS
cuauuuuaaguaaaggauuu

SEQ ID NO: 2211419 - RNA, 15 nt, Streptococcus pyogenes M1 GAS
cucgguuuuuuuaag

SEQ ID NO: 2211420 - RNA, 18 nt, Streptococcus pyogenes M1 GAS
cucgugcugccaucggaa

SEQ ID NO: 2211421 - RNA, 21 nt, Streptococcus pyogenes M1 GAS
cucuaauuuagucauuucuuc

SEQ ID NO: 2211422 - RNA, 14 nt, Streptococcus pyogenes M1 GAS
cuccuaaaacaugu

SEQ ID NO: 2211423 - RNA, 17 nt, Streptococcus pyogenes M1 GAS
cuccguuucuaguuuca

SEQ ID NO: 2211424 - RNA, 18 nt, Streptococcus pyogenes M1 GAS
cuccaacgaccuccagcu

SEQ ID NO: 2211425 - RNA, 22 nt, Streptococcus pyogenes M1 GAS
aaaaaagaagcaaaauuauuau

SEQ ID NO: 2211426 - RNA, 15 nt, Streptococcus pyogenes M1 GAS
aaaaaacuucacauu

SEQ ID NO: 2211427 - RNA, 12 nt, Streptococcus pyogenes M1 GAS
aaaaaaaggaca

SEQ ID NO: 2211428 - RNA, 14 nt, Streptococcus pyogenes M1 GAS
aaaaaaagcaauga

SEQ ID NO: 2211429 - RNA, 18 nt, Streptococcus pyogenes M1 GAS
aaaaaauuuaauaguuuu

SEQ ID NO: 2211430 - RNA, 13 nt, Streptococcus pyogenes M1 GAS
aaaaagauaaaca

SEQ ID NO: 2211431 - RNA, 10 nt, Streptococcus pyogenes M1 GAS
aaaaagauaa

SEQ ID NO: 2211432 - RNA, 12 nt, Streptococcus pyogenes M1 GAS
aaaaagcaagca

SEQ ID NO: 2211433 - RNA, 17 nt, Streptococcus pyogenes M1 GAS
aaaaagaacaaagauug

SEQ ID NO: 2211434 - RNA, 14 nt, Streptococcus pyogenes M1 GAS
aaaaagaacaaaga

SEQ ID NO: 2211435 - RNA, 19 nt, Streptococcus pyogenes M1 GAS
aaaaacuuggguugggaua

SEQ ID NO: 2211436 - RNA, 16 nt, Streptococcus pyogenes M1 GAS
aaaaagggaagaagau

SEQ ID NO: 2211437 - RNA, 16 nt, Streptococcus pyogenes M1 GAS
aaaaagguaucccaua

SEQ ID NO: 2211438 - RNA, 15 nt, Streptococcus pyogenes M1 GAS
aaaaaguaaaaucuu

SEQ ID NO: 2211439 - RNA, 13 nt, Streptococcus pyogenes M1 GAS
aaaaagccuauuu

SEQ ID NO: 2211440 - RNA, 23 nt, Streptococcus pyogenes M1 GAS
aaaaagccuauuuaauaggcuuu

SEQ ID NO: 2211441 - RNA, 21 nt, Streptococcus pyogenes M1 GAS
aaaaaccuuuagagaaucaaa

SEQ ID NO: 2211442 - RNA, 21 nt, Streptococcus pyogenes M1 GAS
aaaaacgccacgcucaacugg

SEQ ID NO: 2211443 - RNA, 19 nt, Streptococcus pyogenes M1 GAS
aaaaacgaucaaaaaucuu

SEQ ID NO: 2211444 - RNA, 17 nt, Streptococcus pyogenes M1 GAS
aaaaaccuuuagagaau

SEQ ID NO: 2211445 - RNA, 18 nt, Streptococcus pyogenes M1 GAS
aaaaacgaucaaaaaucu

SEQ ID NO: 2211446 - RNA, 13 nt, Streptococcus pyogenes M1 GAS
aaaaacucaaaaa

SEQ ID NO: 2211447 - RNA, 18 nt, Streptococcus pyogenes M1 GAS
aaaaacucaaaaaauaca

SEQ ID NO: 2211448 - RNA, 19 nt, Streptococcus pyogenes M1 GAS
aaaaccauuauaaaagagu

SEQ ID NO: 2211449 - RNA, 13 nt, Streptococcus pyogenes M1 GAS
aaaaccgcccaga

SEQ ID NO: 2211450 - RNA, 13 nt, Streptococcus pyogenes M1 GAS
aaaacaaaaagag

SEQ ID NO: 2211451 - RNA, 14 nt, Streptococcus pyogenes M1 GAS
aaaacaaaaagaga

SEQ ID NO: 2211452 - RNA, 21 nt, Streptococcus pyogenes M1 GAS
aaaaaguuucugaguugauuu

SEQ ID NO: 2211453 - RNA, 22 nt, Streptococcus pyogenes M1 GAS
aaaaauuuaauaguuuuccaua

SEQ ID NO: 2211454 - RNA, 17 nt, Streptococcus pyogenes M1 GAS
aaaccauuauaaaagag

SEQ ID NO: 2211455 - RNA, 22 nt, Streptococcus pyogenes M1 GAS
aaaccaagcuaaagggcuuaau

SEQ ID NO: 2211456 - RNA, 22 nt, Streptococcus pyogenes M1 GAS
aaaccaagugccaguaaggaaa

SEQ ID NO: 2211457 - RNA, 16 nt, Streptococcus pyogenes M1 GAS
aaacaucgauuuggug

SEQ ID NO: 2211458 - RNA, 13 nt, Streptococcus pyogenes M1 GAS
aaacauccaauca

SEQ ID NO: 2211459 - RNA, 18 nt, Streptococcus pyogenes M1 GAS
aaacaagucuaucugcag

SEQ ID NO: 2211460 - RNA, 14 nt, Streptococcus pyogenes M1 GAS
aaacaagugauacu

SEQ ID NO: 2211461 - RNA, 20 nt, Streptococcus pyogenes M1 GAS
aaacaccaccaauaaugagc

SEQ ID NO: 2211462 - RNA, 18 nt, Streptococcus pyogenes M1 GAS
aaacacuaccuuaaaugu

SEQ ID NO: 2211463 - RNA, 21 nt, Streptococcus pyogenes M1 GAS
aaacacuaccuuaaauguaug

SEQ ID NO: 2211464 - RNA, 12 nt, Streptococcus pyogenes M1 GAS
aaacagaaauac

SEQ ID NO: 2211465 - RNA, 20 nt, Streptococcus pyogenes M1 GAS
aaacagaugcucaaacuaua

SEQ ID NO: 2211466 - RNA, 14 nt, Streptococcus pyogenes M1 GAS
aaaacgaucaaaaa

SEQ ID NO: 2211467 - RNA, 20 nt, Streptococcus pyogenes M1 GAS
aaaacgagcuggugcaccga

SEQ ID NO: 2211468 - RNA, 14 nt, Streptococcus pyogenes M1 GAS
aaaagcuaacacca

SEQ ID NO: 2211469 - RNA, 21 nt, Streptococcus pyogenes M1 GAS
aaaaguugauauccccuccuu

SEQ ID NO: 2211470 - RNA, 14 nt, Streptococcus pyogenes M1 GAS
aaaauaacuuuaaa

SEQ ID NO: 2211471 - RNA, 23 nt, Streptococcus pyogenes M1 GAS
aaaaggaauugguaguugucaug

SEQ ID NO: 2211472 - RNA, 22 nt, Streptococcus pyogenes M1 GAS
aaaagguaucccauaucucuau

SEQ ID NO: 2211473 - RNA, 14 nt, Streptococcus pyogenes M1 GAS
aaaaguaaaaagca

SEQ ID NO: 2211474 - RNA, 14 nt, Streptococcus pyogenes M1 GAS
aaaauguuauuuau

SEQ ID NO: 2211475 - RNA, 19 nt, Streptococcus pyogenes M1 GAS
aaaauaucuuuuuuacuuu

SEQ ID NO: 2211476 - RNA, 14 nt, Streptococcus pyogenes M1 GAS
aaaauacauccuaa

SEQ ID NO: 2211477 - RNA, 20 nt, Streptococcus pyogenes M1 GAS
aaaauacaauaaagcguuga

SEQ ID NO: 2211478 - RNA, 23 nt, Streptococcus pyogenes M1 GAS
aaaauauauucuaauuugugaaa

SEQ ID NO: 2211479 - RNA, 17 nt, Streptococcus pyogenes M1 GAS
aaaaucuucuauugucg

SEQ ID NO: 2211480 - RNA, 20 nt, Streptococcus pyogenes M1 GAS
aaagcggaagaacagcauuu

SEQ ID NO: 2211481 - RNA, 16 nt, Streptococcus pyogenes M1 GAS
aaagcauaaaaauauu

SEQ ID NO: 2211482 - RNA, 19 nt, Streptococcus pyogenes M1 GAS
aaagcaucaggauugccau

SEQ ID NO: 2211483 - RNA, 22 nt, Streptococcus pyogenes M1 GAS
aaagccuuaaugagaaaccuau

SEQ ID NO: 2211484 - RNA, 19 nt, Streptococcus pyogenes M1 GAS
aaaggagucggaaauugac

SEQ ID NO: 2211485 - RNA, 13 nt, Streptococcus pyogenes M1 GAS
aaaggcugccuug

SEQ ID NO: 2211486 - RNA, 18 nt, Streptococcus pyogenes M1 GAS
aaaguaaggguuaacaau

SEQ ID NO: 2211487 - RNA, 20 nt, Streptococcus pyogenes M1 GAS
aaaguaaggguuaacaauga

SEQ ID NO: 2211488 - RNA, 15 nt, Streptococcus pyogenes M1 GAS
aaagaauuauacuaa

SEQ ID NO: 2211489 - RNA, 15 nt, Streptococcus pyogenes M1 GAS
aaaccuauaaggaga

SEQ ID NO: 2211490 - RNA, 16 nt, Streptococcus pyogenes M1 GAS
aaagaaaggaauugaa

SEQ ID NO: 2211491 - RNA, 15 nt, Streptococcus pyogenes M1 GAS
aaagaaaaagucucu

SEQ ID NO: 2211492 - RNA, 18 nt, Streptococcus pyogenes M1 GAS
aaagcaaauugaaaaaau

SEQ ID NO: 2211493 - RNA, 20 nt, Streptococcus pyogenes M1 GAS
aaagcaauguaugacaacua

SEQ ID NO: 2211494 - RNA, 14 nt, Streptococcus pyogenes M1 GAS
aaagacaaaaaacu

SEQ ID NO: 2211495 - RNA, 19 nt, Streptococcus pyogenes M1 GAS
aaagacccuccuagacugu

SEQ ID NO: 2211496 - RNA, 17 nt, Streptococcus pyogenes M1 GAS
aaagaccauaaaaaacc

SEQ ID NO: 2211497 - RNA, 13 nt, Streptococcus pyogenes M1 GAS
aaauauaaauuau

SEQ ID NO: 2211498 - RNA, 17 nt, Streptococcus pyogenes M1 GAS
aaauauaaauuauuaac

SEQ ID NO: 2211499 - RNA, 21 nt, Streptococcus pyogenes M1 GAS
aaauauaaagucagacuuaau

SEQ ID NO: 2211500 - RNA, 14 nt, Streptococcus pyogenes M1 GAS
aaauauauucuaau

SEQ ID NO: 2211501 - RNA, 15 nt, Streptococcus pyogenes M1 GAS
aaauaucuuaccauu

SEQ ID NO: 2211502 - RNA, 22 nt, Streptococcus pyogenes M1 GAS
aaaguuggcuacucuauuuuaa

SEQ ID NO: 2211503 - RNA, 23 nt, Streptococcus pyogenes M1 GAS
aaaguuuucucagagacaauaag

SEQ ID NO: 2211504 - RNA, 22 nt, Streptococcus pyogenes M1 GAS
aaaaagagaccgaagucucuuu

SEQ ID NO: 2211505 - RNA, 16 nt, Streptococcus pyogenes M1 GAS
aaaaagauaaacaucu

SEQ ID NO: 2211506 - RNA, 15 nt, Streptococcus pyogenes M1 GAS
aaaaagcaaauugaa

SEQ ID NO: 2211507 - RNA, 21 nt, Streptococcus pyogenes M1 GAS
aaaaagcaaauugaaaaaauc

SEQ ID NO: 2211508 - RNA, 16 nt, Streptococcus pyogenes M1 GAS
aaauuaauaaauuuuu

SEQ ID NO: 2211509 - RNA, 18 nt, Streptococcus pyogenes M1 GAS
aaauguaugauuuuaacg

SEQ ID NO: 2211510 - RNA, 16 nt, Streptococcus pyogenes M1 GAS
aaaugccaaucuuugu

SEQ ID NO: 2211511 - RNA, 13 nt, Streptococcus pyogenes M1 GAS
aaaugauacuuuc

SEQ ID NO: 2211512 - RNA, 13 nt, Streptococcus pyogenes M1 GAS
aaaugauagcacc

SEQ ID NO: 2211513 - RNA, 13 nt, Streptococcus pyogenes M1 GAS
aaaucuucuagaa

SEQ ID NO: 2211514 - RNA, 14 nt, Streptococcus pyogenes M1 GAS
aaaugacuucaaaa

SEQ ID NO: 2211515 - RNA, 17 nt, Streptococcus pyogenes M1 GAS
aaaugacuucaaaauca

SEQ ID NO: 2211516 - RNA, 14 nt, Streptococcus pyogenes M1 GAS
aaauccuuuugcuu

SEQ ID NO: 2211517 - RNA, 22 nt, Streptococcus pyogenes M1 GAS
aaauccuuuugcuucuagcucu

SEQ ID NO: 2211518 - RNA, 21 nt, Streptococcus pyogenes M1 GAS
aaauuuaauaguuuuccauaa

SEQ ID NO: 2211519 - RNA, 23 nt, Streptococcus pyogenes M1 GAS
aaauuucaugauguuauuaaaua

SEQ ID NO: 2211520 - RNA, 22 nt, Streptococcus pyogenes M1 GAS
aaauugguccucugaaaaguug

SEQ ID NO: 2211521 - RNA, 22 nt, Streptococcus pyogenes M1 GAS
aaauuguagggauuuuuuaacu

SEQ ID NO: 2211522 - RNA, 14 nt, Streptococcus pyogenes M1 GAS
aaauugauuauucu

SEQ ID NO: 2211523 - RNA, 17 nt, Streptococcus pyogenes M1 GAS
aaauugauuauucuuua

SEQ ID NO: 2211524 - RNA, 13 nt, Streptococcus pyogenes M1 GAS
aaauucaaauacu

SEQ ID NO: 2211525 - RNA, 14 nt, Streptococcus pyogenes M1 GAS
aaauucuuuuugaa

SEQ ID NO: 2211526 - RNA, 23 nt, Streptococcus pyogenes M1 GAS
aaauucuuuuugaauugaaaaaa

SEQ ID NO: 2211527 - RNA, 12 nt, Streptococcus pyogenes M1 GAS
aacaaagauugg

SEQ ID NO: 2211528 - RNA, 12 nt, Streptococcus pyogenes M1 GAS
aacaaaaucaca

SEQ ID NO: 2211529 - RNA, 13 nt, Streptococcus pyogenes M1 GAS
aacaaauccuuuu

SEQ ID NO: 2211530 - RNA, 20 nt, Streptococcus pyogenes M1 GAS
caacuguggguuaagagagg

SEQ ID NO: 2211531 - RNA, 22 nt, Streptococcus pyogenes M1 GAS
caacugcaauaccguagaaagu

SEQ ID NO: 2211532 - RNA, 14 nt, Streptococcus pyogenes M1 GAS
caacuccugauaau

SEQ ID NO: 2211533 - RNA, 19 nt, Streptococcus pyogenes M1 GAS
caacuucuauauguguaau

SEQ ID NO: 2211534 - RNA, 15 nt, Streptococcus pyogenes M1 GAS
caagagcuuaaaagu

SEQ ID NO: 2211535 - RNA, 13 nt, Streptococcus pyogenes M1 GAS
caagagcuuaaaa

SEQ ID NO: 2211536 - RNA, 19 nt, Streptococcus pyogenes M1 GAS
caagguuguggcugauaaa

SEQ ID NO: 2211537 - RNA, 19 nt, Streptococcus pyogenes M1 GAS
caagguuaaguaaaaggga

SEQ ID NO: 2211538 - RNA, 22 nt, Streptococcus pyogenes M1 GAS
caaggaauugcagcuaaaaaca

SEQ ID NO: 2211539 - RNA, 23 nt, Streptococcus pyogenes M1 GAS
caauagcaaguccugcuuuugau

SEQ ID NO: 2211540 - RNA, 16 nt, Streptococcus pyogenes M1 GAS
caauacucccuucucu

SEQ ID NO: 2211541 - RNA, 19 nt, Streptococcus pyogenes M1 GAS
caauacucccuucucuagu

SEQ ID NO: 2211542 - RNA, 15 nt, Streptococcus pyogenes M1 GAS
caauagcugcugcua

SEQ ID NO: 2211543 - RNA, 20 nt, Streptococcus pyogenes M1 GAS
caauagcugcugcuaaagca

SEQ ID NO: 2211544 - RNA, 21 nt, Streptococcus pyogenes M1 GAS
caauaugugauuauuauucua

SEQ ID NO: 2211545 - RNA, 17 nt, Streptococcus pyogenes M1 GAS
caauauaacuuuuagcu

SEQ ID NO: 2211546 - RNA, 20 nt, Streptococcus pyogenes M1 GAS
caauaaugccaucaaaaaaa

SEQ ID NO: 2211547 - RNA, 17 nt, Streptococcus pyogenes M1 GAS
caauaacagaaauuaau

SEQ ID NO: 2211548 - RNA, 15 nt, Streptococcus pyogenes M1 GAS
caauaacacagaagc

SEQ ID NO: 2211549 - RNA, 23 nt, Streptococcus pyogenes M1 GAS
caauaacacagaagccucuucug

SEQ ID NO: 2211550 - RNA, 22 nt, Streptococcus pyogenes M1 GAS
caauaacgccagcuacauuggg

SEQ ID NO: 2211551 - RNA, 20 nt, Streptococcus pyogenes M1 GAS
caaugaaaaguuauucccau

SEQ ID NO: 2211552 - RNA, 15 nt, Streptococcus pyogenes M1 GAS
caaucgguuuuagcu

SEQ ID NO: 2211553 - RNA, 16 nt, Streptococcus pyogenes M1 GAS
caaucaucaggguugc

SEQ ID NO: 2211554 - RNA, 14 nt, Streptococcus pyogenes M1 GAS
caacauacuuuauu

SEQ ID NO: 2211555 - RNA, 21 nt, Streptococcus pyogenes M1 GAS
caacgcauuucuuuuuugguu

SEQ ID NO: 2211556 - RNA, 14 nt, Streptococcus pyogenes M1 GAS
caaauuuuuuucag

SEQ ID NO: 2211557 - RNA, 20 nt, Streptococcus pyogenes M1 GAS
caaauucuuccuuagcaaag

SEQ ID NO: 2211558 - RNA, 14 nt, Streptococcus pyogenes M1 GAS
caaauucuuuuuga

SEQ ID NO: 2211559 - RNA, 14 nt, Streptococcus pyogenes M1 GAS
caaacuauauuguu

SEQ ID NO: 2211560 - RNA, 13 nt, Streptococcus pyogenes M1 GAS
caaaguaauccaa

SEQ ID NO: 2211561 - RNA, 16 nt, Streptococcus pyogenes M1 GAS
caaacauccaaucacc

SEQ ID NO: 2211562 - RNA, 15 nt, Streptococcus pyogenes M1 GAS
caaacagaaauacuc

SEQ ID NO: 2211563 - RNA, 16 nt, Streptococcus pyogenes M1 GAS
caaacagaaauacucc

SEQ ID NO: 2211564 - RNA, 21 nt, Streptococcus pyogenes M1 GAS
caaacuaggccaauccuaaca

SEQ ID NO: 2211565 - RNA, 23 nt, Streptococcus pyogenes M1 GAS
caaaacccuuucguaagaaagac

SEQ ID NO: 2211566 - RNA, 21 nt, Streptococcus pyogenes M1 GAS
caaaaguuggcuacucuauuu

SEQ ID NO: 2211567 - RNA, 16 nt, Streptococcus pyogenes M1 GAS
cacguaagcuccaacg

SEQ ID NO: 2211568 - RNA, 16 nt, Streptococcus pyogenes M1 GAS
cacgaucaagaaacuc

SEQ ID NO: 2211569 - RNA, 14 nt, Streptococcus pyogenes M1 GAS
aaaaguuggcuacu

SEQ ID NO: 2211570 - RNA, 22 nt, Streptococcus pyogenes M1 GAS
caccaauaaugagcaaggcaag

SEQ ID NO: 2211571 - RNA, 23 nt, Streptococcus pyogenes M1 GAS
caauugauuugcagaggcuugca

SEQ ID NO: 2211572 - RNA, 16 nt, Streptococcus pyogenes M1 GAS
caauucaagauaguga

SEQ ID NO: 2211573 - RNA, 20 nt, Streptococcus pyogenes M1 GAS
caauuauuucgucuaaaaag

SEQ ID NO: 2211574 - RNA, 15 nt, Streptococcus pyogenes M1 GAS
cacaccuacuaacaa

SEQ ID NO: 2211575 - RNA, 18 nt, Streptococcus pyogenes M1 GAS
auuucauuuucuuuguga

SEQ ID NO: 2211576 - RNA, 16 nt, Streptococcus pyogenes M1 GAS
auuuccuacaaaauaa

SEQ ID NO: 2211577 - RNA, 17 nt, Streptococcus pyogenes M1 GAS
auuucagauaagaccuu

SEQ ID NO: 2211578 - RNA, 17 nt, Streptococcus pyogenes M1 GAS
auuucaaguucucuacu

SEQ ID NO: 2211579 - RNA, 16 nt, Streptococcus pyogenes M1 GAS
auuucaauaauaccau

SEQ ID NO: 2211580 - RNA, 18 nt, Streptococcus pyogenes M1 GAS
auuucaauaauaccauuu

SEQ ID NO: 2211581 - RNA, 22 nt, Streptococcus pyogenes M1 GAS
auuucaauaauaccauuuuuau

SEQ ID NO: 2211582 - RNA, 23 nt, Streptococcus pyogenes M1 GAS
auuuagguacucguaagcauuuu

SEQ ID NO: 2211583 - RNA, 16 nt, Streptococcus pyogenes M1 GAS
auuuaguuauuuuuga

SEQ ID NO: 2211584 - RNA, 19 nt, Streptococcus pyogenes M1 GAS
auuugccauggcaagagca

SEQ ID NO: 2211585 - RNA, 14 nt, Streptococcus pyogenes M1 GAS
auuucuuugcaaaa

SEQ ID NO: 2211586 - RNA, 22 nt, Streptococcus pyogenes M1 GAS
auuugacauuaguccaaaauac

SEQ ID NO: 2211587 - RNA, 23 nt, Streptococcus pyogenes M1 GAS
auuugacauuaguccaaaauaca

SEQ ID NO: 2211588 - RNA, 14 nt, Streptococcus pyogenes M1 GAS
auuuuuauuuaagc

SEQ ID NO: 2211589 - RNA, 14 nt, Streptococcus pyogenes M1 GAS
auuuuugccaaaau

SEQ ID NO: 2211590 - RNA, 21 nt, Streptococcus pyogenes M1 GAS
auuuuucaaaaaaacuucaca

SEQ ID NO: 2211591 - RNA, 13 nt, Streptococcus pyogenes M1 GAS
auuuuuauaacaa

SEQ ID NO: 2211592 - RNA, 18 nt, Streptococcus pyogenes M1 GAS
auuuuuauaacaauuaca

SEQ ID NO: 2211593 - RNA, 20 nt, Streptococcus pyogenes M1 GAS
auuuuuuucaggauguuuau

SEQ ID NO: 2211594 - RNA, 20 nt, Streptococcus pyogenes M1 GAS
auuuuuuguaauucagcauc

SEQ ID NO: 2211595 - RNA, 23 nt, Streptococcus pyogenes M1 GAS
caaaaauauauucuaauuuguga

SEQ ID NO: 2211596 - RNA, 16 nt, Streptococcus pyogenes M1 GAS
caaaaaguaaaaagca

SEQ ID NO: 2211597 - RNA, 17 nt, Streptococcus pyogenes M1 GAS
caaaaaguaaaaagcaa

SEQ ID NO: 2211598 - RNA, 19 nt, Streptococcus pyogenes M1 GAS
caaaaaguaaaaagcaaau

SEQ ID NO: 2211599 - RNA, 20 nt, Streptococcus pyogenes M1 GAS
auuuuaaauaucuuaccauu

SEQ ID NO: 2211600 - RNA, 17 nt, Streptococcus pyogenes M1 GAS
auuuugguugauagaag

SEQ ID NO: 2211601 - RNA, 11 nt, Streptococcus pyogenes M1 GAS
auuuugguuga

SEQ ID NO: 2211602 - RNA, 19 nt, Streptococcus pyogenes M1 GAS
auuuugguugauagaagua

SEQ ID NO: 2211603 - RNA, 18 nt, Streptococcus pyogenes M1 GAS
auuuuuaccuuuauuugc

SEQ ID NO: 2211604 - RNA, 15 nt, Streptococcus pyogenes M1 GAS
auuuuuacgaaaaau

SEQ ID NO: 2211605 - RNA, 17 nt, Streptococcus pyogenes M1 GAS
auuuugcaagucucuug

SEQ ID NO: 2211606 - RNA, 18 nt, Streptococcus pyogenes M1 GAS
auuuugcagguaauuauc

SEQ ID NO: 2211607 - RNA, 20 nt, Streptococcus pyogenes M1 GAS
auuuucuuugugacaugagu

SEQ ID NO: 2211608 - RNA, 22 nt, Streptococcus pyogenes M1 GAS
auuuucuuugugacaugaguau

SEQ ID NO: 2211609 - RNA, 17 nt, Streptococcus pyogenes M1 GAS
auuccgguuuuaaaagg

SEQ ID NO: 2211610 - RNA, 23 nt, Streptococcus pyogenes M1 GAS
auucuaaaauaaaccaagcuaaa

SEQ ID NO: 2211611 - RNA, 22 nt, Streptococcus pyogenes M1 GAS
auugagguaaucguaaugucuu

SEQ ID NO: 2211612 - RNA, 16 nt, Streptococcus pyogenes M1 GAS
auugaguaagcagcau

SEQ ID NO: 2211613 - RNA, 15 nt, Streptococcus pyogenes M1 GAS
auugaguaagcagca

SEQ ID NO: 2211614 - RNA, 23 nt, Streptococcus pyogenes M1 GAS
auugacuugguucugaaaauaaa

SEQ ID NO: 2211615 - RNA, 16 nt, Streptococcus pyogenes M1 GAS
auugaaucuuguuuaa

SEQ ID NO: 2211616 - RNA, 17 nt, Streptococcus pyogenes M1 GAS
auugaccaaaagaauua

SEQ ID NO: 2211617 - RNA, 14 nt, Streptococcus pyogenes M1 GAS
auugauagauaguu

SEQ ID NO: 2211618 - RNA, 15 nt, Streptococcus pyogenes M1 GAS
aaaaguaaaaagcaa

SEQ ID NO: 2211619 - RNA, 17 nt, Streptococcus pyogenes M1 GAS
auugucacugaaaaagc

SEQ ID NO: 2211620 - RNA, 19 nt, Streptococcus pyogenes M1 GAS
auuggaacaccguuuuuug

SEQ ID NO: 2211621 - RNA, 21 nt, Streptococcus pyogenes M1 GAS
auuggaacaccguuuuuuguu

SEQ ID NO: 2211622 - RNA, 18 nt, Streptococcus pyogenes M1 GAS
auuggggcggcacuucca

SEQ ID NO: 2211623 - RNA, 18 nt, Streptococcus pyogenes M1 GAS
auuuaagguauuguucaa

SEQ ID NO: 2211624 - RNA, 17 nt, Streptococcus pyogenes M1 GAS
auuuacugggucaacuc

SEQ ID NO: 2211625 - RNA, 20 nt, Streptococcus pyogenes M1 GAS
augcauuacauuuaaaggag

SEQ ID NO: 2211626 - RNA, 16 nt, Streptococcus pyogenes M1 GAS
aaaagagagaaugaua

SEQ ID NO: 2211627 - RNA, 17 nt, Streptococcus pyogenes M1 GAS
auguauuggaaaauaca

SEQ ID NO: 2211628 - RNA, 18 nt, Streptococcus pyogenes M1 GAS
augucauggauauuacaa

SEQ ID NO: 2211629 - RNA, 15 nt, Streptococcus pyogenes M1 GAS
aaaagauauuuuaaa

SEQ ID NO: 2211630 - RNA, 19 nt, Streptococcus pyogenes M1 GAS
aaaagaugcacacaaaucu

SEQ ID NO: 2211631 - RNA, 18 nt, Streptococcus pyogenes M1 GAS
aaaagcaaauugaaaaaa

SEQ ID NO: 2211632 - RNA, 13 nt, Streptococcus pyogenes M1 GAS
auggucuugcucu

SEQ ID NO: 2211633 - RNA, 16 nt, Streptococcus pyogenes M1 GAS
auggguaaaaugacug

SEQ ID NO: 2211634 - RNA, 20 nt, Streptococcus pyogenes M1 GAS
augcuguccaugauuuucau

SEQ ID NO: 2211635 - RNA, 14 nt, Streptococcus pyogenes M1 GAS
augcuguccaugau

SEQ ID NO: 2211636 - RNA, 15 nt, Streptococcus pyogenes M1 GAS
augcugaguucuuuu

SEQ ID NO: 2211637 - RNA, 14 nt, Streptococcus pyogenes M1 GAS
augcugguguugag

SEQ ID NO: 2211638 - RNA, 23 nt, Streptococcus pyogenes M1 GAS
auuaucugaauuauuaguaacca

SEQ ID NO: 2211639 - RNA, 15 nt, Streptococcus pyogenes M1 GAS
auuaucugauaaggu

SEQ ID NO: 2211640 - RNA, 13 nt, Streptococcus pyogenes M1 GAS
auuaucaauaaca

SEQ ID NO: 2211641 - RNA, 15 nt, Streptococcus pyogenes M1 GAS
auuacgauuaaaaga

SEQ ID NO: 2211642 - RNA, 17 nt, Streptococcus pyogenes M1 GAS
auuagguucuuugguuu

SEQ ID NO: 2211643 - RNA, 17 nt, Streptococcus pyogenes M1 GAS
auuaguuuuuagcagca

SEQ ID NO: 2211644 - RNA, 18 nt, Streptococcus pyogenes M1 GAS
auuaguuuuuagcagcag

SEQ ID NO: 2211645 - RNA, 18 nt, Streptococcus pyogenes M1 GAS
auuauacuaacuauuuuu

SEQ ID NO: 2211646 - RNA, 23 nt, Streptococcus pyogenes M1 GAS
auuauacuaacuauuuuuaccuu

SEQ ID NO: 2211647 - RNA, 19 nt, Streptococcus pyogenes M1 GAS
auuauacucaauauaauaa

SEQ ID NO: 2211648 - RNA, 17 nt, Streptococcus pyogenes M1 GAS
auguuuacgcuuuacau

SEQ ID NO: 2211649 - RNA, 17 nt, Streptococcus pyogenes M1 GAS
auguccgaaaaaaacuu

SEQ ID NO: 2211650 - RNA, 23 nt, Streptococcus pyogenes M1 GAS
auuaaauaauacagcauacauca

SEQ ID NO: 2211651 - RNA, 17 nt, Streptococcus pyogenes M1 GAS
auuaaacuuacaaaaag

SEQ ID NO: 2211652 - RNA, 22 nt, Streptococcus pyogenes M1 GAS
auuaaaagaugucgcaaaggcu

SEQ ID NO: 2211653 - RNA, 16 nt, Streptococcus pyogenes M1 GAS
aaaagcauuuguuuug

SEQ ID NO: 2211654 - RNA, 13 nt, Streptococcus pyogenes M1 GAS
auuaaucaaaaaa

SEQ ID NO: 2211655 - RNA, 22 nt, Streptococcus pyogenes M1 GAS
auuaaucaaaaaacugagacaa

SEQ ID NO: 2211656 - RNA, 17 nt, Streptococcus pyogenes M1 GAS
auuacaagcauuuugca

SEQ ID NO: 2211657 - RNA, 16 nt, Streptococcus pyogenes M1 GAS
auauugauauuccuag

SEQ ID NO: 2211658 - RNA, 16 nt, Streptococcus pyogenes M1 GAS
auauugaucucugcaa

SEQ ID NO: 2211659 - RNA, 13 nt, Streptococcus pyogenes M1 GAS
auauucauuuucu

SEQ ID NO: 2211660 - RNA, 13 nt, Streptococcus pyogenes M1 GAS
auauuuuauuaau

SEQ ID NO: 2211661 - RNA, 15 nt, Streptococcus pyogenes M1 GAS
aucaaaagaccauaa

SEQ ID NO: 2211662 - RNA, 14 nt, Streptococcus pyogenes M1 GAS
auauuguuaauaua

SEQ ID NO: 2211663 - RNA, 22 nt, Streptococcus pyogenes M1 GAS
auauugguugccugaaauauaa

SEQ ID NO: 2211664 - RNA, 14 nt, Streptococcus pyogenes M1 GAS
aucaaguaugcuuu

SEQ ID NO: 2211665 - RNA, 14 nt, Streptococcus pyogenes M1 GAS
aucaaggaauugca

SEQ ID NO: 2211666 - RNA, 22 nt, Streptococcus pyogenes M1 GAS
aucaagcuaucgcuaacauuua

SEQ ID NO: 2211667 - RNA, 22 nt, Streptococcus pyogenes M1 GAS
aucaagaaacucaucuggguag

SEQ ID NO: 2211668 - RNA, 17 nt, Streptococcus pyogenes M1 GAS
aucaagaauagcuuuug

SEQ ID NO: 2211669 - RNA, 18 nt, Streptococcus pyogenes M1 GAS
aucaaaccaagguauuua

SEQ ID NO: 2211670 - RNA, 19 nt, Streptococcus pyogenes M1 GAS
aucacgccaguaaagucac

SEQ ID NO: 2211671 - RNA, 22 nt, Streptococcus pyogenes M1 GAS
aucacuuccauauaauuuucag

SEQ ID NO: 2211672 - RNA, 21 nt, Streptococcus pyogenes M1 GAS
aucaucgaguggauacaaggu

SEQ ID NO: 2211673 - RNA, 12 nt, Streptococcus pyogenes M1 GAS
auaugauauaaa

SEQ ID NO: 2211674 - RNA, 20 nt, Streptococcus pyogenes M1 GAS
auaucuuucaguuguuuuaa

SEQ ID NO: 2211675 - RNA, 17 nt, Streptococcus pyogenes M1 GAS
auaucucuauaucuaug

SEQ ID NO: 2211676 - RNA, 19 nt, Streptococcus pyogenes M1 GAS
auaucuagaacagcugcuu

SEQ ID NO: 2211677 - RNA, 12 nt, Streptococcus pyogenes M1 GAS
auaucuagaaca

SEQ ID NO: 2211678 - RNA, 18 nt, Streptococcus pyogenes M1 GAS
auaucuagaacagcugcu

SEQ ID NO: 2211679 - RNA, 13 nt, Streptococcus pyogenes M1 GAS
auaucuaugauuu

SEQ ID NO: 2211680 - RNA, 21 nt, Streptococcus pyogenes M1 GAS
auaucauaaguuaccaauuca

SEQ ID NO: 2211681 - RNA, 23 nt, Streptococcus pyogenes M1 GAS
auauaagcaaucaucauuuagcu

SEQ ID NO: 2211682 - RNA, 13 nt, Streptococcus pyogenes M1 GAS
auauaauaaaaag

SEQ ID NO: 2211683 - RNA, 15 nt, Streptococcus pyogenes M1 GAS
auauaagcaaucauc

SEQ ID NO: 2211684 - RNA, 15 nt, Streptococcus pyogenes M1 GAS
auagcuaauccaaua

SEQ ID NO: 2211685 - RNA, 15 nt, Streptococcus pyogenes M1 GAS
auagcugauuuguuu

SEQ ID NO: 2211686 - RNA, 19 nt, Streptococcus pyogenes M1 GAS
auagugaguauaaugcuga

SEQ ID NO: 2211687 - RNA, 10 nt, Streptococcus pyogenes M1 GAS
auauaaaauu

SEQ ID NO: 2211688 - RNA, 16 nt, Streptococcus pyogenes M1 GAS
auacuuugguauucuu

SEQ ID NO: 2211689 - RNA, 23 nt, Streptococcus pyogenes M1 GAS
auagauaguugguauauagcuca

SEQ ID NO: 2211690 - RNA, 19 nt, Streptococcus pyogenes M1 GAS
auagcguaaagcaagggaa

SEQ ID NO: 2211691 - RNA, 20 nt, Streptococcus pyogenes M1 GAS
auagcguaaagcaagggaaa

SEQ ID NO: 2211692 - RNA, 13 nt, Streptococcus pyogenes M1 GAS
auagcauaaaaua

SEQ ID NO: 2211693 - RNA, 23 nt, Streptococcus pyogenes M1 GAS
auagcauuaaggauuaugaaaaa

SEQ ID NO: 2211694 - RNA, 21 nt, Streptococcus pyogenes M1 GAS
auagcaccuacgauaaaacaa

SEQ ID NO: 2211695 - RNA, 18 nt, Streptococcus pyogenes M1 GAS
auagcacguuggaaaagg

SEQ ID NO: 2211696 - RNA, 19 nt, Streptococcus pyogenes M1 GAS
auagcaauggcuaaaaaga

SEQ ID NO: 2211697 - RNA, 23 nt, Streptococcus pyogenes M1 GAS
auacugguacguugauugccauu

SEQ ID NO: 2211698 - RNA, 22 nt, Streptococcus pyogenes M1 GAS
auacuggucaauggaaauuuua

SEQ ID NO: 2211699 - RNA, 21 nt, Streptococcus pyogenes M1 GAS
auacuuuaaacacuaccuuaa

SEQ ID NO: 2211700 - RNA, 17 nt, Streptococcus pyogenes M1 GAS
auaccugagccuccaac

SEQ ID NO: 2211701 - RNA, 14 nt, Streptococcus pyogenes M1 GAS
aucgacauuuaugc

SEQ ID NO: 2211702 - RNA, 22 nt, Streptococcus pyogenes M1 GAS
aucgacauuuaugcugauuuug

SEQ ID NO: 2211703 - RNA, 17 nt, Streptococcus pyogenes M1 GAS
aucguaaugucuuguuc

SEQ ID NO: 2211704 - RNA, 16 nt, Streptococcus pyogenes M1 GAS
aucgcuaacauuuaug

SEQ ID NO: 2211705 - RNA, 15 nt, Streptococcus pyogenes M1 GAS
aucggaacagcugaa

SEQ ID NO: 2211706 - RNA, 18 nt, Streptococcus pyogenes M1 GAS
aucccauaucucuauauc

SEQ ID NO: 2211707 - RNA, 18 nt, Streptococcus pyogenes M1 GAS
auccccucguuuaaaugu

SEQ ID NO: 2211708 - RNA, 16 nt, Streptococcus pyogenes M1 GAS
auccauuauaaaucuu

SEQ ID NO: 2211709 - RNA, 20 nt, Streptococcus pyogenes M1 GAS
aucauuuugggacuaggaau

SEQ ID NO: 2211710 - RNA, 17 nt, Streptococcus pyogenes M1 GAS
auccaacuuuuaucacu

SEQ ID NO: 2211711 - RNA, 22 nt, Streptococcus pyogenes M1 GAS
aucauuuuggagagauuuuaaa

SEQ ID NO: 2211712 - RNA, 16 nt, Streptococcus pyogenes M1 GAS
aaaacuucaaauuuca

SEQ ID NO: 2211713 - RNA, 23 nt, Streptococcus pyogenes M1 GAS
aaaacuucacauuguauuagcaa

SEQ ID NO: 2211714 - RNA, 22 nt, Streptococcus pyogenes M1 GAS
aaaacuugcaucgcaaacagau

SEQ ID NO: 2211715 - RNA, 17 nt, Streptococcus pyogenes M1 GAS
aaaagaaaaucuaauca

SEQ ID NO: 2211716 - RNA, 13 nt, Streptococcus pyogenes M1 GAS
aucauuauccuuu

SEQ ID NO: 2211717 - RNA, 21 nt, Streptococcus pyogenes M1 GAS
aucuguauauuuaauagcauu

SEQ ID NO: 2211718 - RNA, 16 nt, Streptococcus pyogenes M1 GAS
aucuguuuaaaaacaa

SEQ ID NO: 2211719 - RNA, 15 nt, Streptococcus pyogenes M1 GAS
aucuguuuaaaaaca

SEQ ID NO: 2211720 - RNA, 16 nt, Streptococcus pyogenes M1 GAS
aucuagaacagcugcu

SEQ ID NO: 2211721 - RNA, 15 nt, Streptococcus pyogenes M1 GAS
aucuacagcaccuuc

SEQ ID NO: 2211722 - RNA, 15 nt, Streptococcus pyogenes M1 GAS
aucuccuaggcgcaa

SEQ ID NO: 2211723 - RNA, 19 nt, Streptococcus pyogenes M1 GAS
augauaucccaucuuuguu

SEQ ID NO: 2211724 - RNA, 14 nt, Streptococcus pyogenes M1 GAS
augauauaaaaaug

SEQ ID NO: 2211725 - RNA, 14 nt, Streptococcus pyogenes M1 GAS
augaguauaaauuu

SEQ ID NO: 2211726 - RNA, 18 nt, Streptococcus pyogenes M1 GAS
augaguaagaaauuacuu

SEQ ID NO: 2211727 - RNA, 17 nt, Streptococcus pyogenes M1 GAS
augacaguauacaucaa

SEQ ID NO: 2211728 - RNA, 16 nt, Streptococcus pyogenes M1 GAS
augacauugacugaca

SEQ ID NO: 2211729 - RNA, 22 nt, Streptococcus pyogenes M1 GAS
augacuauagaaaguaaaaaua

SEQ ID NO: 2211730 - RNA, 14 nt, Streptococcus pyogenes M1 GAS
augacuguauguau

SEQ ID NO: 2211731 - RNA, 18 nt, Streptococcus pyogenes M1 GAS
augaaaacguguauucuu

SEQ ID NO: 2211732 - RNA, 15 nt, Streptococcus pyogenes M1 GAS
aucuuuaucagucug

SEQ ID NO: 2211733 - RNA, 20 nt, Streptococcus pyogenes M1 GAS
aucuuuaucagucuguccaa

SEQ ID NO: 2211734 - RNA, 13 nt, Streptococcus pyogenes M1 GAS
aguucagcagcac

SEQ ID NO: 2211735 - RNA, 15 nt, Streptococcus pyogenes M1 GAS
aguucagauauucuu

SEQ ID NO: 2211736 - RNA, 23 nt, Streptococcus pyogenes M1 GAS
aguuagccaagcaaucuaagaau

SEQ ID NO: 2211737 - RNA, 14 nt, Streptococcus pyogenes M1 GAS
aguucuucuaaacg

SEQ ID NO: 2211738 - RNA, 20 nt, Streptococcus pyogenes M1 GAS
aguucugagauauucauuuu

SEQ ID NO: 2211739 - RNA, 17 nt, Streptococcus pyogenes M1 GAS
aguuuaggauauaagaa

SEQ ID NO: 2211740 - RNA, 20 nt, Streptococcus pyogenes M1 GAS
aguuuaggauauaagaaggu

SEQ ID NO: 2211741 - RNA, 17 nt, Streptococcus pyogenes M1 GAS
aguugugauauaaaaug

SEQ ID NO: 2211742 - RNA, 13 nt, Streptococcus pyogenes M1 GAS
aguugugucuuuu

SEQ ID NO: 2211743 - RNA, 13 nt, Streptococcus pyogenes M1 GAS
aguauuuuuuagu

SEQ ID NO: 2211744 - RNA, 14 nt, Streptococcus pyogenes M1 GAS
agucggaaauugac

SEQ ID NO: 2211745 - RNA, 22 nt, Streptococcus pyogenes M1 GAS
agucggaaauugaccaaaagaa

SEQ ID NO: 2211746 - RNA, 18 nt, Streptococcus pyogenes M1 GAS
agucuuuuucauuuuuau

SEQ ID NO: 2211747 - RNA, 13 nt, Streptococcus pyogenes M1 GAS
agucuuuaaaaaa

SEQ ID NO: 2211748 - RNA, 15 nt, Streptococcus pyogenes M1 GAS
agucuuuaaaaaacg

SEQ ID NO: 2211749 - RNA, 15 nt, Streptococcus pyogenes M1 GAS
agucugcaugaagug

SEQ ID NO: 2211750 - RNA, 23 nt, Streptococcus pyogenes M1 GAS
auacaacugacuagccaaaucug

SEQ ID NO: 2211751 - RNA, 23 nt, Streptococcus pyogenes M1 GAS
auacaaagcaucaggauugccau

SEQ ID NO: 2211752 - RNA, 21 nt, Streptococcus pyogenes M1 GAS
auaauuuucagugguaauggu

SEQ ID NO: 2211753 - RNA, 18 nt, Streptococcus pyogenes M1 GAS
auaaucgaugauaauagu

SEQ ID NO: 2211754 - RNA, 16 nt, Streptococcus pyogenes M1 GAS
auaaugagcaaggcaa

SEQ ID NO: 2211755 - RNA, 17 nt, Streptococcus pyogenes M1 GAS
auaagaagcuaaugucu

SEQ ID NO: 2211756 - RNA, 18 nt, Streptococcus pyogenes M1 GAS
auaagaagcuaaugucuu

SEQ ID NO: 2211757 - RNA, 12 nt, Streptococcus pyogenes M1 GAS
auaauaaaaagc

SEQ ID NO: 2211758 - RNA, 18 nt, Streptococcus pyogenes M1 GAS
auaaaaucguuauuaauu

SEQ ID NO: 2211759 - RNA, 16 nt, Streptococcus pyogenes M1 GAS
auaaaauauuuuucca

SEQ ID NO: 2211760 - RNA, 14 nt, Streptococcus pyogenes M1 GAS
aguuuuauuuugau

SEQ ID NO: 2211761 - RNA, 20 nt, Streptococcus pyogenes M1 GAS
auaaaauuccccacaaaaga

SEQ ID NO: 2211762 - RNA, 12 nt, Streptococcus pyogenes M1 GAS
auaaaaugccuc

SEQ ID NO: 2211763 - RNA, 11 nt, Streptococcus pyogenes M1 GAS
auaaacaaagc

SEQ ID NO: 2211764 - RNA, 22 nt, Streptococcus pyogenes M1 GAS
auaaagcguugacaguuaaaaa

SEQ ID NO: 2211765 - RNA, 15 nt, Streptococcus pyogenes M1 GAS
auaacaaauuuaucc

SEQ ID NO: 2211766 - RNA, 20 nt, Streptococcus pyogenes M1 GAS
aggaauugcagcuaaaaaca

SEQ ID NO: 2211767 - RNA, 21 nt, Streptococcus pyogenes M1 GAS
aggaauugcagcuaaaaacaa

SEQ ID NO: 2211768 - RNA, 13 nt, Streptococcus pyogenes M1 GAS
aggacagguagau

SEQ ID NO: 2211769 - RNA, 22 nt, Streptococcus pyogenes M1 GAS
agcuuauaguuugacuucaaaa

SEQ ID NO: 2211770 - RNA, 13 nt, Streptococcus pyogenes M1 GAS
agcuuaucaaggu

SEQ ID NO: 2211771 - RNA, 14 nt, Streptococcus pyogenes M1 GAS
agcuuaucaagguu

SEQ ID NO: 2211772 - RNA, 20 nt, Streptococcus pyogenes M1 GAS
agcugguugaccaauauagc

SEQ ID NO: 2211773 - RNA, 22 nt, Streptococcus pyogenes M1 GAS
agcugguugaccaauauagcaa

SEQ ID NO: 2211774 - RNA, 22 nt, Streptococcus pyogenes M1 GAS
agcugucgcguuucgaaaaagg

SEQ ID NO: 2211775 - RNA, 20 nt, Streptococcus pyogenes M1 GAS
agcugcugcuaaagcaauca

SEQ ID NO: 2211776 - RNA, 15 nt, Streptococcus pyogenes M1 GAS
aggccgucacaaacu

SEQ ID NO: 2211777 - RNA, 13 nt, Streptococcus pyogenes M1 GAS
aggauuaugaaaa

SEQ ID NO: 2211778 - RNA, 17 nt, Streptococcus pyogenes M1 GAS
aggauuauuagguucuu

SEQ ID NO: 2211779 - RNA, 23 nt, Streptococcus pyogenes M1 GAS
aggcaacuguggguuaagagagg

SEQ ID NO: 2211780 - RNA, 12 nt, Streptococcus pyogenes M1 GAS
aggcacagaaaa

SEQ ID NO: 2211781 - RNA, 16 nt, Streptococcus pyogenes M1 GAS
aggcacagaaaaaaga

SEQ ID NO: 2211782 - RNA, 21 nt, Streptococcus pyogenes M1 GAS
aggguaucugcucagagcuuu

SEQ ID NO: 2211783 - RNA, 19 nt, Streptococcus pyogenes M1 GAS
aggguagcugguuugauua

SEQ ID NO: 2211784 - RNA, 20 nt, Streptococcus pyogenes M1 GAS
agguagauguuguucuaagu

SEQ ID NO: 2211785 - RNA, 15 nt, Streptococcus pyogenes M1 GAS
aggucaucagaauaa

SEQ ID NO: 2211786 - RNA, 15 nt, Streptococcus pyogenes M1 GAS
aggucucaaauuuuu

SEQ ID NO: 2211787 - RNA, 15 nt, Streptococcus pyogenes M1 GAS
agggcuguaaaaugu

SEQ ID NO: 2211788 - RNA, 20 nt, Streptococcus pyogenes M1 GAS
agggaaacaccaccaauaau

SEQ ID NO: 2211789 - RNA, 21 nt, Streptococcus pyogenes M1 GAS
aggcuuguucuuuauuuugau

SEQ ID NO: 2211790 - RNA, 18 nt, Streptococcus pyogenes M1 GAS
agggauuuuuacgaaaaa

SEQ ID NO: 2211791 - RNA, 20 nt, Streptococcus pyogenes M1 GAS
aguagugaugaguaggcgaa

SEQ ID NO: 2211792 - RNA, 13 nt, Streptococcus pyogenes M1 GAS
aguagauacuuug

SEQ ID NO: 2211793 - RNA, 14 nt, Streptococcus pyogenes M1 GAS
aguagcaaauaaca

SEQ ID NO: 2211794 - RNA, 13 nt, Streptococcus pyogenes M1 GAS
aguagcaccuuuu

SEQ ID NO: 2211795 - RNA, 17 nt, Streptococcus pyogenes M1 GAS
aguagcggcaauuuuau

SEQ ID NO: 2211796 - RNA, 18 nt, Streptococcus pyogenes M1 GAS
aguauauuguaauaacaa

SEQ ID NO: 2211797 - RNA, 12 nt, Streptococcus pyogenes M1 GAS
aguauacaucaa

SEQ ID NO: 2211798 - RNA, 21 nt, Streptococcus pyogenes M1 GAS
aguaucuaggagggacuguca

SEQ ID NO: 2211799 - RNA, 14 nt, Streptococcus pyogenes M1 GAS
aguaugcuuuuaau

SEQ ID NO: 2211800 - RNA, 19 nt, Streptococcus pyogenes M1 GAS
aguaugcuuuuaauuuuau

SEQ ID NO: 2211801 - RNA, 18 nt, Streptococcus pyogenes M1 GAS
aguaaggguuaacaauga

SEQ ID NO: 2211802 - RNA, 13 nt, Streptococcus pyogenes M1 GAS
aguaaguuuuuuu

SEQ ID NO: 2211803 - RNA, 18 nt, Streptococcus pyogenes M1 GAS
aguaaagccuuauccauu

SEQ ID NO: 2211804 - RNA, 16 nt, Streptococcus pyogenes M1 GAS
aguaaaggauuuaguu

SEQ ID NO: 2211805 - RNA, 22 nt, Streptococcus pyogenes M1 GAS
agguggagcuuuaguugcuucu

SEQ ID NO: 2211806 - RNA, 20 nt, Streptococcus pyogenes M1 GAS
agguugguaaaaaggcaguu

SEQ ID NO: 2211807 - RNA, 22 nt, Streptococcus pyogenes M1 GAS
agguuguggcugauaaaaagag

SEQ ID NO: 2211808 - RNA, 16 nt, Streptococcus pyogenes M1 GAS
aguaaaaucuuauuuu

SEQ ID NO: 2211809 - RNA, 22 nt, Streptococcus pyogenes M1 GAS
aguaaaaauacuagaaaaagca

SEQ ID NO: 2211810 - RNA, 21 nt, Streptococcus pyogenes M1 GAS
agcuacauugggccccauggc

SEQ ID NO: 2211811 - RNA, 16 nt, Streptococcus pyogenes M1 GAS
agcuacacuugauuuc

SEQ ID NO: 2211812 - RNA, 16 nt, Streptococcus pyogenes M1 GAS
agcuaauccaauaaua

SEQ ID NO: 2211813 - RNA, 22 nt, Streptococcus pyogenes M1 GAS
agcguugacaguuaaaaauaac

SEQ ID NO: 2211814 - RNA, 22 nt, Streptococcus pyogenes M1 GAS
agcuaucauacaacugacuagc

SEQ ID NO: 2211815 - RNA, 21 nt, Streptococcus pyogenes M1 GAS
agcgggaacacucaucauauu

SEQ ID NO: 2211816 - RNA, 16 nt, Streptococcus pyogenes M1 GAS
agcgguuuugucuuau

SEQ ID NO: 2211817 - RNA, 15 nt, Streptococcus pyogenes M1 GAS
agcaggcguuuuguu

SEQ ID NO: 2211818 - RNA, 23 nt, Streptococcus pyogenes M1 GAS
agcaucaggauugccaucaaugu

SEQ ID NO: 2211819 - RNA, 17 nt, Streptococcus pyogenes M1 GAS
agcaucacguacagaaa

SEQ ID NO: 2211820 - RNA, 18 nt, Streptococcus pyogenes M1 GAS
agcaucacguacagaaau

SEQ ID NO: 2211821 - RNA, 19 nt, Streptococcus pyogenes M1 GAS
agcaucacguacagaaaug

SEQ ID NO: 2211822 - RNA, 16 nt, Streptococcus pyogenes M1 GAS
agcaucguuaagugga

SEQ ID NO: 2211823 - RNA, 20 nt, Streptococcus pyogenes M1 GAS
agcagcaucacguacagaaa

SEQ ID NO: 2211824 - RNA, 18 nt, Streptococcus pyogenes M1 GAS
agcagcagaagcaaauuc

SEQ ID NO: 2211825 - RNA, 22 nt, Streptococcus pyogenes M1 GAS
agcaccuucaaccgcuuccuuu

SEQ ID NO: 2211826 - RNA, 16 nt, Streptococcus pyogenes M1 GAS
agcaacaucaaaaaga

SEQ ID NO: 2211827 - RNA, 16 nt, Streptococcus pyogenes M1 GAS
agcaaccucaguucug

SEQ ID NO: 2211828 - RNA, 18 nt, Streptococcus pyogenes M1 GAS
agcaccuacgauaaaaca

SEQ ID NO: 2211829 - RNA, 12 nt, Streptococcus pyogenes M1 GAS
agccaagcaauc

SEQ ID NO: 2211830 - RNA, 18 nt, Streptococcus pyogenes M1 GAS
agcaugauuuaguuuuua

SEQ ID NO: 2211831 - RNA, 20 nt, Streptococcus pyogenes M1 GAS
agcccuuaaucuaaaagcac

SEQ ID NO: 2211832 - RNA, 16 nt, Streptococcus pyogenes M1 GAS
agcaaaaugcuguuug

SEQ ID NO: 2211833 - RNA, 19 nt, Streptococcus pyogenes M1 GAS
agcaaaggcuucaucaaug

SEQ ID NO: 2211834 - RNA, 20 nt, Streptococcus pyogenes M1 GAS
agcaaaggcgauuagcccaa

SEQ ID NO: 2211835 - RNA, 16 nt, Streptococcus pyogenes M1 GAS
agcaaauugaaaaaau

SEQ ID NO: 2211836 - RNA, 19 nt, Streptococcus pyogenes M1 GAS
agcaaagugauauacugaa

SEQ ID NO: 2211837 - RNA, 21 nt, Streptococcus pyogenes M1 GAS
agcaaagugauauacugaaaa

SEQ ID NO: 2211838 - RNA, 15 nt, Streptococcus pyogenes M1 GAS
agauuuuaaaaaacc

SEQ ID NO: 2211839 - RNA, 13 nt, Streptococcus pyogenes M1 GAS
agauuuuaaauau

SEQ ID NO: 2211840 - RNA, 16 nt, Streptococcus pyogenes M1 GAS
agauuggauuucgacu

SEQ ID NO: 2211841 - RNA, 19 nt, Streptococcus pyogenes M1 GAS
agaugucauggauauuaca

SEQ ID NO: 2211842 - RNA, 16 nt, Streptococcus pyogenes M1 GAS
agaugucgcaaaggcu

SEQ ID NO: 2211843 - RNA, 18 nt, Streptococcus pyogenes M1 GAS
aaaaccauaccuacugcc

SEQ ID NO: 2211844 - RNA, 18 nt, Streptococcus pyogenes M1 GAS
agaugacgguaaauaaag

SEQ ID NO: 2211845 - RNA, 15 nt, Streptococcus pyogenes M1 GAS
agauaccuacaaccu

SEQ ID NO: 2211846 - RNA, 18 nt, Streptococcus pyogenes M1 GAS
agauaagugccaucaggc

SEQ ID NO: 2211847 - RNA, 21 nt, Streptococcus pyogenes M1 GAS
agauacuuugguauucuuuuu

SEQ ID NO: 2211848 - RNA, 23 nt, Streptococcus pyogenes M1 GAS
agauacuuugguauucuuuuucc

SEQ ID NO: 2211849 - RNA, 17 nt, Streptococcus pyogenes M1 GAS
agaucauuaaauugauu

SEQ ID NO: 2211850 - RNA, 13 nt, Streptococcus pyogenes M1 GAS
agaggacuaaguc

SEQ ID NO: 2211851 - RNA, 16 nt, Streptococcus pyogenes M1 GAS
agaggugcaacugcua

SEQ ID NO: 2211852 - RNA, 21 nt, Streptococcus pyogenes M1 GAS
agagguugguaaaaaggcagu

SEQ ID NO: 2211853 - RNA, 17 nt, Streptococcus pyogenes M1 GAS
agagcaguucagcagca

SEQ ID NO: 2211854 - RNA, 20 nt, Streptococcus pyogenes M1 GAS
agagcaguucagcagcacug

SEQ ID NO: 2211855 - RNA, 18 nt, Streptococcus pyogenes M1 GAS
agacaguuagcaaauugu

SEQ ID NO: 2211856 - RNA, 15 nt, Streptococcus pyogenes M1 GAS
agaauccuccucuuu

SEQ ID NO: 2211857 - RNA, 22 nt, Streptococcus pyogenes M1 GAS
agaauuaacguuccaaaaagaa

SEQ ID NO: 2211858 - RNA, 21 nt, Streptococcus pyogenes M1 GAS
agaauuggggcggcacuucca

SEQ ID NO: 2211859 - RNA, 14 nt, Streptococcus pyogenes M1 GAS
agaauugaaaaacu

SEQ ID NO: 2211860 - RNA, 13 nt, Streptococcus pyogenes M1 GAS
agaauuuuuauaa

SEQ ID NO: 2211861 - RNA, 15 nt, Streptococcus pyogenes M1 GAS
agacaccaaaaaaag

SEQ ID NO: 2211862 - RNA, 17 nt, Streptococcus pyogenes M1 GAS
agaacagcugcuugaaa

SEQ ID NO: 2211863 - RNA, 15 nt, Streptococcus pyogenes M1 GAS
agaacagcauuuuca

SEQ ID NO: 2211864 - RNA, 18 nt, Streptococcus pyogenes M1 GAS
agaacagauugaagacaa

SEQ ID NO: 2211865 - RNA, 23 nt, Streptococcus pyogenes M1 GAS
agaagauccuacaagaggaguug

SEQ ID NO: 2211866 - RNA, 15 nt, Streptococcus pyogenes M1 GAS
agaagcuaaugucuu

SEQ ID NO: 2211867 - RNA, 16 nt, Streptococcus pyogenes M1 GAS
agaagcuaaugucuug

SEQ ID NO: 2211868 - RNA, 13 nt, Streptococcus pyogenes M1 GAS
agaaaaagcaaug

SEQ ID NO: 2211869 - RNA, 18 nt, Streptococcus pyogenes M1 GAS
acuugauuucauuuucuu

SEQ ID NO: 2211870 - RNA, 20 nt, Streptococcus pyogenes M1 GAS
acuugauaaucccuugcuuu

SEQ ID NO: 2211871 - RNA, 21 nt, Streptococcus pyogenes M1 GAS
agaaagcggaagaacagcauu

SEQ ID NO: 2211872 - RNA, 22 nt, Streptococcus pyogenes M1 GAS
agaaagcggaagaacagcauuu

SEQ ID NO: 2211873 - RNA, 22 nt, Streptococcus pyogenes M1 GAS
agaaaguaaaaauacuagaaaa

SEQ ID NO: 2211874 - RNA, 15 nt, Streptococcus pyogenes M1 GAS
agaaagauucuugcu

SEQ ID NO: 2211875 - RNA, 19 nt, Streptococcus pyogenes M1 GAS
agaaagacuuaaggauuua

SEQ ID NO: 2211876 - RNA, 20 nt, Streptococcus pyogenes M1 GAS
agaaagacuuaaggauuuag

SEQ ID NO: 2211877 - RNA, 21 nt, Streptococcus pyogenes M1 GAS
accauuuaugaggccaauaau

SEQ ID NO: 2211878 - RNA, 15 nt, Streptococcus pyogenes M1 GAS
accauuguagaguuu

SEQ ID NO: 2211879 - RNA, 19 nt, Streptococcus pyogenes M1 GAS
acccgucuuacaauuaaua

SEQ ID NO: 2211880 - RNA, 16 nt, Streptococcus pyogenes M1 GAS
accugaggcaauggcu

SEQ ID NO: 2211881 - RNA, 20 nt, Streptococcus pyogenes M1 GAS
accuuaugcagguguuuaaa

SEQ ID NO: 2211882 - RNA, 16 nt, Streptococcus pyogenes M1 GAS
accuuccccaucaaga

SEQ ID NO: 2211883 - RNA, 16 nt, Streptococcus pyogenes M1 GAS
accucugaaggcacag

SEQ ID NO: 2211884 - RNA, 21 nt, Streptococcus pyogenes M1 GAS
accucugaaggcacagccgaa

SEQ ID NO: 2211885 - RNA, 19 nt, Streptococcus pyogenes M1 GAS
accucucaugggcaaauaa

SEQ ID NO: 2211886 - RNA, 14 nt, Streptococcus pyogenes M1 GAS
accugaauugcugg

SEQ ID NO: 2211887 - RNA, 20 nt, Streptococcus pyogenes M1 GAS
accugaauugcuggugacua

SEQ ID NO: 2211888 - RNA, 15 nt, Streptococcus pyogenes M1 GAS
accucuaucccuuca

SEQ ID NO: 2211889 - RNA, 18 nt, Streptococcus pyogenes M1 GAS
acggcuaauaagagugug

SEQ ID NO: 2211890 - RNA, 18 nt, Streptococcus pyogenes M1 GAS
acggcuucuacacaaaag

SEQ ID NO: 2211891 - RNA, 12 nt, Streptococcus pyogenes M1 GAS
acguacagaaau

SEQ ID NO: 2211892 - RNA, 16 nt, Streptococcus pyogenes M1 GAS
acguaaccaauuguug

SEQ ID NO: 2211893 - RNA, 19 nt, Streptococcus pyogenes M1 GAS
acguaaaaagagaagauga

SEQ ID NO: 2211894 - RNA, 13 nt, Streptococcus pyogenes M1 GAS
acgguuuucuguc

SEQ ID NO: 2211895 - RNA, 22 nt, Streptococcus pyogenes M1 GAS
acgcuuuacauuuuauuugaag

SEQ ID NO: 2211896 - RNA, 14 nt, Streptococcus pyogenes M1 GAS
acgcuuaccgcaua

SEQ ID NO: 2211897 - RNA, 16 nt, Streptococcus pyogenes M1 GAS
acgugcuuuaaucuca

SEQ ID NO: 2211898 - RNA, 21 nt, Streptococcus pyogenes M1 GAS
acguuauuaaagacaaaaaac

SEQ ID NO: 2211899 - RNA, 20 nt, Streptococcus pyogenes M1 GAS
acuauugaaucuuguuuaac

SEQ ID NO: 2211900 - RNA, 14 nt, Streptococcus pyogenes M1 GAS
acuauaauuucaau

SEQ ID NO: 2211901 - RNA, 19 nt, Streptococcus pyogenes M1 GAS
acuaauccuuuuucacaau

SEQ ID NO: 2211902 - RNA, 16 nt, Streptococcus pyogenes M1 GAS
acuaagguacggucau

SEQ ID NO: 2211903 - RNA, 21 nt, Streptococcus pyogenes M1 GAS
acuaacagcaacaucaaaaag

SEQ ID NO: 2211904 - RNA, 18 nt, Streptococcus pyogenes M1 GAS
acuaaccccuaaucagaa

SEQ ID NO: 2211905 - RNA, 15 nt, Streptococcus pyogenes M1 GAS
acuaacuauuuuuac

SEQ ID NO: 2211906 - RNA, 12 nt, Streptococcus pyogenes M1 GAS
acuuaauugaaa

SEQ ID NO: 2211907 - RNA, 15 nt, Streptococcus pyogenes M1 GAS
acuggcacaaacucu

SEQ ID NO: 2211908 - RNA, 18 nt, Streptococcus pyogenes M1 GAS
acuggcauagaaauaguu

SEQ ID NO: 2211909 - RNA, 23 nt, Streptococcus pyogenes M1 GAS
acuuaucauuuugggacuaggaa

SEQ ID NO: 2211910 - RNA, 16 nt, Streptococcus pyogenes M1 GAS
acuucaaggaaggcuu

SEQ ID NO: 2211911 - RNA, 19 nt, Streptococcus pyogenes M1 GAS
acuucugcagucuuuuuca

SEQ ID NO: 2211912 - RNA, 23 nt, Streptococcus pyogenes M1 GAS
acuucugcagucuuuuucauuuu

SEQ ID NO: 2211913 - RNA, 19 nt, Streptococcus pyogenes M1 GAS
acucuuguagaauuucaag

SEQ ID NO: 2211914 - RNA, 15 nt, Streptococcus pyogenes M1 GAS
acucuucgguacuga

SEQ ID NO: 2211915 - RNA, 12 nt, Streptococcus pyogenes M1 GAS
acucaaaaagca

SEQ ID NO: 2211916 - RNA, 20 nt, Streptococcus pyogenes M1 GAS
acugaaaaagccuuuacauc

SEQ ID NO: 2211917 - RNA, 18 nt, Streptococcus pyogenes M1 GAS
acugaaaaugcauuacau

SEQ ID NO: 2211918 - RNA, 18 nt, Streptococcus pyogenes M1 GAS
acugagccccaaaaguug

SEQ ID NO: 2211919 - RNA, 13 nt, Streptococcus pyogenes M1 GAS
aaucgaaaugaua

SEQ ID NO: 2211920 - RNA, 14 nt, Streptococcus pyogenes M1 GAS
aaucgaccaaaauc

SEQ ID NO: 2211921 - RNA, 13 nt, Streptococcus pyogenes M1 GAS
aauccuuuugcuu

SEQ ID NO: 2211922 - RNA, 23 nt, Streptococcus pyogenes M1 GAS
aaucuaggacuaaccccuaauca

SEQ ID NO: 2211923 - RNA, 15 nt, Streptococcus pyogenes M1 GAS
aauggcuaaaaagag

SEQ ID NO: 2211924 - RNA, 17 nt, Streptococcus pyogenes M1 GAS
aaugcauuacauuuaaa

SEQ ID NO: 2211925 - RNA, 21 nt, Streptococcus pyogenes M1 GAS
aaugacuauagaaaguaaaaa

SEQ ID NO: 2211926 - RNA, 16 nt, Streptococcus pyogenes M1 GAS
aaugagaucuucuuuu

SEQ ID NO: 2211927 - RNA, 13 nt, Streptococcus pyogenes M1 GAS
aaugagcaaggca

SEQ ID NO: 2211928 - RNA, 20 nt, Streptococcus pyogenes M1 GAS
aaugagcaaggcaagaggag

SEQ ID NO: 2211929 - RNA, 19 nt, Streptococcus pyogenes M1 GAS
aaucuuucauuagcuuuuu

SEQ ID NO: 2211930 - RNA, 17 nt, Streptococcus pyogenes M1 GAS
aaaacaaaaagagaccg

SEQ ID NO: 2211931 - RNA, 15 nt, Streptococcus pyogenes M1 GAS
aauugauuugcagag

SEQ ID NO: 2211932 - RNA, 16 nt, Streptococcus pyogenes M1 GAS
aauguaugauuuuaac

SEQ ID NO: 2211933 - RNA, 19 nt, Streptococcus pyogenes M1 GAS
aauuagcauauuuugauua

SEQ ID NO: 2211934 - RNA, 22 nt, Streptococcus pyogenes M1 GAS
aauuacuuaucaucaugacaac

SEQ ID NO: 2211935 - RNA, 12 nt, Streptococcus pyogenes M1 GAS
aauuauuuuaau

SEQ ID NO: 2211936 - RNA, 17 nt, Streptococcus pyogenes M1 GAS
aauuauuuuaauuuuuc

SEQ ID NO: 2211937 - RNA, 20 nt, Streptococcus pyogenes M1 GAS
aauuauuuuaauuuuuccuu

SEQ ID NO: 2211938 - RNA, 19 nt, Streptococcus pyogenes M1 GAS
aauuauuuuggaauaguuu

SEQ ID NO: 2211939 - RNA, 14 nt, Streptococcus pyogenes M1 GAS
aauuuuaaaugaca

SEQ ID NO: 2211940 - RNA, 17 nt, Streptococcus pyogenes M1 GAS
aauuuuaaaugacauga

SEQ ID NO: 2211941 - RNA, 21 nt, Streptococcus pyogenes M1 GAS
aauuuggagagauaaaaagua

SEQ ID NO: 2211942 - RNA, 15 nt, Streptococcus pyogenes M1 GAS
aauuuuucuucugac

SEQ ID NO: 2211943 - RNA, 17 nt, Streptococcus pyogenes M1 GAS
aauuucaauaauaccau

SEQ ID NO: 2211944 - RNA, 16 nt, Streptococcus pyogenes M1 GAS
aauuuagccguccuua

SEQ ID NO: 2211945 - RNA, 23 nt, Streptococcus pyogenes M1 GAS
aauuucugauaggagugauugau

SEQ ID NO: 2211946 - RNA, 20 nt, Streptococcus pyogenes M1 GAS
accacacgauuaaccguucc

SEQ ID NO: 2211947 - RNA, 17 nt, Streptococcus pyogenes M1 GAS
accaauuuaagguauug

SEQ ID NO: 2211948 - RNA, 18 nt, Streptococcus pyogenes M1 GAS
accaauaaugagcaaggc

SEQ ID NO: 2211949 - RNA, 18 nt, Streptococcus pyogenes M1 GAS
accaauauagcaaucuuc

SEQ ID NO: 2211950 - RNA, 19 nt, Streptococcus pyogenes M1 GAS
acauuucgugucuaaaaua

SEQ ID NO: 2211951 - RNA, 17 nt, Streptococcus pyogenes M1 GAS
acaugaguauaaauuug

SEQ ID NO: 2211952 - RNA, 18 nt, Streptococcus pyogenes M1 GAS
acauuguauuagcaaagu

SEQ ID NO: 2211953 - RNA, 21 nt, Streptococcus pyogenes M1 GAS
acauuguauuagcaaagugau

SEQ ID NO: 2211954 - RNA, 21 nt, Streptococcus pyogenes M1 GAS
acauacuuuauuaaucaaaaa

SEQ ID NO: 2211955 - RNA, 13 nt, Streptococcus pyogenes M1 GAS
acaucaaaaagag

SEQ ID NO: 2211956 - RNA, 14 nt, Streptococcus pyogenes M1 GAS
acaucaaaaagagg

SEQ ID NO: 2211957 - RNA, 16 nt, Streptococcus pyogenes M1 GAS
acaucaaaaaaagcaa

SEQ ID NO: 2211958 - RNA, 19 nt, Streptococcus pyogenes M1 GAS
acaucaaaaaaagcaauga

SEQ ID NO: 2211959 - RNA, 14 nt, Streptococcus pyogenes M1 GAS
acaucaaaaaaagc

SEQ ID NO: 2211960 - RNA, 13 nt, Streptococcus pyogenes M1 GAS
acagaaagcggaa

SEQ ID NO: 2211961 - RNA, 14 nt, Streptococcus pyogenes M1 GAS
acagacaccaaaaa

SEQ ID NO: 2211962 - RNA, 24 nt, Streptococcus pyogenes M1 GAS
acacuacuauuacggcaacuccaa

SEQ ID NO: 2211963 - RNA, 20 nt, Streptococcus pyogenes M1 GAS
acagaugcucaaacuauauu

SEQ ID NO: 2211964 - RNA, 18 nt, Streptococcus pyogenes M1 GAS
acagcugaaacaccugcu

SEQ ID NO: 2211965 - RNA, 19 nt, Streptococcus pyogenes M1 GAS
acagcugaaacaccugcug

SEQ ID NO: 2211966 - RNA, 18 nt, Streptococcus pyogenes M1 GAS
acagcguaagccaaaucu

SEQ ID NO: 2211967 - RNA, 19 nt, Streptococcus pyogenes M1 GAS
acagcguaagccaaaucuu

SEQ ID NO: 2211968 - RNA, 19 nt, Streptococcus pyogenes M1 GAS
acagcauuuucaucaucaa

SEQ ID NO: 2211969 - RNA, 22 nt, Streptococcus pyogenes M1 GAS
acagccgaauaaggcucgacaa

SEQ ID NO: 2211970 - RNA, 15 nt, Streptococcus pyogenes M1 GAS
acacagaagccucuu

SEQ ID NO: 2211971 - RNA, 19 nt, Streptococcus pyogenes M1 GAS
acacagaugcgcaccucca

SEQ ID NO: 2211972 - RNA, 21 nt, Streptococcus pyogenes M1 GAS
acaauaucgagcugauugacc

SEQ ID NO: 2211973 - RNA, 13 nt, Streptococcus pyogenes M1 GAS
acaaugcucuuaa

SEQ ID NO: 2211974 - RNA, 19 nt, Streptococcus pyogenes M1 GAS
acaagcaucuuugcagggu

SEQ ID NO: 2211975 - RNA, 18 nt, Streptococcus pyogenes M1 GAS
acaagcaucuuugcaggg

SEQ ID NO: 2211976 - RNA, 14 nt, Streptococcus pyogenes M1 GAS
acaagcaagcauca

SEQ ID NO: 2211977 - RNA, 20 nt, Streptococcus pyogenes M1 GAS
acaagcaagcaucagcucuu

SEQ ID NO: 2211978 - RNA, 21 nt, Streptococcus pyogenes M1 GAS
acaagcaagcaucagcucuug

SEQ ID NO: 2211979 - RNA, 20 nt, Streptococcus pyogenes M1 GAS
acaagucuugauaacaauau

SEQ ID NO: 2211980 - RNA, 13 nt, Streptococcus pyogenes M1 GAS
acaagucaggaau

SEQ ID NO: 2211981 - RNA, 23 nt, Streptococcus pyogenes M1 GAS
acaagucaggaauuguugacuuu

SEQ ID NO: 2211982 - RNA, 23 nt, Streptococcus pyogenes M1 GAS
acaauagugaguauaaugcugaa

SEQ ID NO: 2211983 - RNA, 18 nt, Streptococcus pyogenes M1 GAS
acaauaagcccuuaaucu

SEQ ID NO: 2211984 - RNA, 19 nt, Streptococcus pyogenes M1 GAS
acaauaaggucaucagaau

SEQ ID NO: 2211985 - RNA, 16 nt, Streptococcus pyogenes M1 GAS
aauuuuugauuuuaau

SEQ ID NO: 2211986 - RNA, 22 nt, Streptococcus pyogenes M1 GAS
aagccgugaggacuuauuuuuu

SEQ ID NO: 2211987 - RNA, 16 nt, Streptococcus pyogenes M1 GAS
aagauccuacaagagg

SEQ ID NO: 2211988 - RNA, 20 nt, Streptococcus pyogenes M1 GAS
aagcuaucgcuaacauuuau

SEQ ID NO: 2211989 - RNA, 20 nt, Streptococcus pyogenes M1 GAS
aagcuccaacgaccuccagc

SEQ ID NO: 2211990 - RNA, 18 nt, Streptococcus pyogenes M1 GAS
aagcuugaucuuacaaag

SEQ ID NO: 2211991 - RNA, 13 nt, Streptococcus pyogenes M1 GAS
aagcuugcuaaga

SEQ ID NO: 2211992 - RNA, 20 nt, Streptococcus pyogenes M1 GAS
aagcuugcuaagagaauaac

SEQ ID NO: 2211993 - RNA, 15 nt, Streptococcus pyogenes M1 GAS
aaggaugaaaugauu

SEQ ID NO: 2211994 - RNA, 21 nt, Streptococcus pyogenes M1 GAS
aaggaaggcuuguucuuuauu

SEQ ID NO: 2211995 - RNA, 21 nt, Streptococcus pyogenes M1 GAS
aaggaauugcagcuaaaaaca

SEQ ID NO: 2211996 - RNA, 23 nt, Streptococcus pyogenes M1 GAS
aaggaauugcagcuaaaaacaau

SEQ ID NO: 2211997 - RNA, 15 nt, Streptococcus pyogenes M1 GAS
aaggcaguugcagag

SEQ ID NO: 2211998 - RNA, 21 nt, Streptococcus pyogenes M1 GAS
aaggcaguugcagaguacaag

SEQ ID NO: 2211999 - RNA, 16 nt, Streptococcus pyogenes M1 GAS
aaggcaccugaggcaa

SEQ ID NO: 2212000 - RNA, 15 nt, Streptococcus pyogenes M1 GAS
aaggcacagaaaaaa

SEQ ID NO: 2212001 - RNA, 19 nt, Streptococcus pyogenes M1 GAS
aaggcacagaaaaaagaua

SEQ ID NO: 2212002 - RNA, 20 nt, Streptococcus pyogenes M1 GAS
aaggcacagaaaaaagauaa

SEQ ID NO: 2212003 - RNA, 18 nt, Streptococcus pyogenes M1 GAS
aaggauuauuagguucuu

SEQ ID NO: 2212004 - RNA, 16 nt, Streptococcus pyogenes M1 GAS
aaggauuaugaaaaag

SEQ ID NO: 2212005 - RNA, 16 nt, Streptococcus pyogenes M1 GAS
aaggcugcgaugauuu

SEQ ID NO: 2212006 - RNA, 13 nt, Streptococcus pyogenes M1 GAS
aaguugaaugagu

SEQ ID NO: 2212007 - RNA, 18 nt, Streptococcus pyogenes M1 GAS
aagucuaucugcagauuu

SEQ ID NO: 2212008 - RNA, 22 nt, Streptococcus pyogenes M1 GAS
aagucaguuuuuucugccauau

SEQ ID NO: 2212009 - RNA, 16 nt, Streptococcus pyogenes M1 GAS
aaguauaguuauguua

SEQ ID NO: 2212010 - RNA, 19 nt, Streptococcus pyogenes M1 GAS
aaguagcguacauggaugc

SEQ ID NO: 2212011 - RNA, 20 nt, Streptococcus pyogenes M1 GAS
aagucagacuuaauugaaag

SEQ ID NO: 2212012 - RNA, 22 nt, Streptococcus pyogenes M1 GAS
aagucagacuuaauugaaagag

SEQ ID NO: 2212013 - RNA, 18 nt, Streptococcus pyogenes M1 GAS
aaguauuuuaugacaaau

SEQ ID NO: 2212014 - RNA, 23 nt, Streptococcus pyogenes M1 GAS
aaguauucuaaaauccucuuuua

SEQ ID NO: 2212015 - RNA, 14 nt, Streptococcus pyogenes M1 GAS
aagggaagaagauc

SEQ ID NO: 2212016 - RNA, 17 nt, Streptococcus pyogenes M1 GAS
aaggcuuuuuguuuuau

SEQ ID NO: 2212017 - RNA, 21 nt, Streptococcus pyogenes M1 GAS
aaguaaaagggauaauaaagu

SEQ ID NO: 2212018 - RNA, 13 nt, Streptococcus pyogenes M1 GAS
aaguaaaaagcaa

SEQ ID NO: 2212019 - RNA, 22 nt, Streptococcus pyogenes M1 GAS
aagguuuuuuuaagcaugauuu

SEQ ID NO: 2212020 - RNA, 14 nt, Streptococcus pyogenes M1 GAS
aaguagauacuuug

SEQ ID NO: 2212021 - RNA, 21 nt, Streptococcus pyogenes M1 GAS
aauaucagcuacacuugauuu

SEQ ID NO: 2212022 - RNA, 24 nt, Streptococcus pyogenes M1 GAS
aauaucagcuacacuugauuucau

SEQ ID NO: 2212023 - RNA, 14 nt, Streptococcus pyogenes M1 GAS
aauaucaugaagua

SEQ ID NO: 2212024 - RNA, 20 nt, Streptococcus pyogenes M1 GAS
aauaucgccaauaaaaaaga

SEQ ID NO: 2212025 - RNA, 23 nt, Streptococcus pyogenes M1 GAS
aauaucuuaccauuguagaguuu

SEQ ID NO: 2212026 - RNA, 21 nt, Streptococcus pyogenes M1 GAS
aauaucuuuuuuacuuuuaaa

SEQ ID NO: 2212027 - RNA, 24 nt, Streptococcus pyogenes M1 GAS
aauaugaaaacguguauucuuaaa

SEQ ID NO: 2212028 - RNA, 14 nt, Streptococcus pyogenes M1 GAS
aauauagucugcau

SEQ ID NO: 2212029 - RNA, 20 nt, Streptococcus pyogenes M1 GAS
aauaguucccuuaauaaacu

SEQ ID NO: 2212030 - RNA, 23 nt, Streptococcus pyogenes M1 GAS
aauagguaaagauuuuaaauauc

SEQ ID NO: 2212031 - RNA, 16 nt, Streptococcus pyogenes M1 GAS
aauagcugcugcuaaa

SEQ ID NO: 2212032 - RNA, 21 nt, Streptococcus pyogenes M1 GAS
aauagcaauggcuaaaaagag

SEQ ID NO: 2212033 - RNA, 21 nt, Streptococcus pyogenes M1 GAS
aauagcguaaagcaagggaaa

SEQ ID NO: 2212034 - RNA, 13 nt, Streptococcus pyogenes M1 GAS
aauaccauuuuua

SEQ ID NO: 2212035 - RNA, 14 nt, Streptococcus pyogenes M1 GAS
aauaccauuuuuau

SEQ ID NO: 2212036 - RNA, 15 nt, Streptococcus pyogenes M1 GAS
aauacauuguuuuuc

SEQ ID NO: 2212037 - RNA, 19 nt, Streptococcus pyogenes M1 GAS
aauaauacagcauacauca

SEQ ID NO: 2212038 - RNA, 22 nt, Streptococcus pyogenes M1 GAS
aauaaugccaucaaaaaaagac

SEQ ID NO: 2212039 - RNA, 22 nt, Streptococcus pyogenes M1 GAS
aaaaaguuucugaguugauuua

SEQ ID NO: 2212040 - RNA, 18 nt, Streptococcus pyogenes M1 GAS
aauaaggcucgacaaagg

SEQ ID NO: 2212041 - RNA, 16 nt, Streptococcus pyogenes M1 GAS
aauaaguauucuaaaa

SEQ ID NO: 2212042 - RNA, 21 nt, Streptococcus pyogenes M1 GAS
aauaaguauagcauaaaauag

SEQ ID NO: 2212043 - RNA, 23 nt, Streptococcus pyogenes M1 GAS
aauaaguauagcauaaaauaguu

SEQ ID NO: 2212044 - RNA, 11 nt, Streptococcus pyogenes M1 GAS
aauaagauuca

SEQ ID NO: 2212045 - RNA, 19 nt, Streptococcus pyogenes M1 GAS
aauaagauucaauaugaaa

SEQ ID NO: 2212046 - RNA, 13 nt, Streptococcus pyogenes M1 GAS
aauaagaaaaccu

SEQ ID NO: 2212047 - RNA, 13 nt, Streptococcus pyogenes M1 GAS
aauaacuuuaaaa

SEQ ID NO: 2212048 - RNA, 15 nt, Streptococcus pyogenes M1 GAS
aauaacuuuaaaagg

SEQ ID NO: 2212049 - RNA, 20 nt, Streptococcus pyogenes M1 GAS
aauaacaucuugauuguaag

SEQ ID NO: 2212050 - RNA, 16 nt, Streptococcus pyogenes M1 GAS
aagagagguugguaaa

SEQ ID NO: 2212051 - RNA, 13 nt, Streptococcus pyogenes M1 GAS
aagauaaacaucu

SEQ ID NO: 2212052 - RNA, 19 nt, Streptococcus pyogenes M1 GAS
aagagucauuugacuacua

SEQ ID NO: 2212053 - RNA, 18 nt, Streptococcus pyogenes M1 GAS
aagagugcaguguacuca

SEQ ID NO: 2212054 - RNA, 15 nt, Streptococcus pyogenes M1 GAS
aagauaguaaagaag

SEQ ID NO: 2212055 - RNA, 21 nt, Streptococcus pyogenes M1 GAS
aagauagugauggcuugaagc

SEQ ID NO: 2212056 - RNA, 17 nt, Streptococcus pyogenes M1 GAS
aagauauuuuaaaauag

SEQ ID NO: 2212057 - RNA, 21 nt, Streptococcus pyogenes M1 GAS
aagacaaaaaacuagaaacug

SEQ ID NO: 2212058 - RNA, 12 nt, Streptococcus pyogenes M1 GAS
aagaauugaaaa

SEQ ID NO: 2212059 - RNA, 15 nt, Streptococcus pyogenes M1 GAS
aagaauugaaaaacu

SEQ ID NO: 2212060 - RNA, 22 nt, Streptococcus pyogenes M1 GAS
aagaauuggggcggcacuucca

SEQ ID NO: 2212061 - RNA, 14 nt, Streptococcus pyogenes M1 GAS
aagaccauaaaaaa

SEQ ID NO: 2212062 - RNA, 22 nt, Streptococcus pyogenes M1 GAS
aagacccuccacccaaacauuc

SEQ ID NO: 2212063 - RNA, 19 nt, Streptococcus pyogenes M1 GAS
aagaccuucaaaaaaggga

SEQ ID NO: 2212064 - RNA, 18 nt, Streptococcus pyogenes M1 GAS
aagacuauguugcuuaau

SEQ ID NO: 2212065 - RNA, 16 nt, Streptococcus pyogenes M1 GAS
aagacuuaaggauuua

SEQ ID NO: 2212066 - RNA, 20 nt, Streptococcus pyogenes M1 GAS
aacuccuggauuaaaugccc

SEQ ID NO: 2212067 - RNA, 15 nt, Streptococcus pyogenes M1 GAS
aacucgauaaaaacg

SEQ ID NO: 2212068 - RNA, 19 nt, Streptococcus pyogenes M1 GAS
aacucuccaaaguucuucu

SEQ ID NO: 2212069 - RNA, 18 nt, Streptococcus pyogenes M1 GAS
aacugacuagccaaaucu

SEQ ID NO: 2212070 - RNA, 20 nt, Streptococcus pyogenes M1 GAS
aacuuuuagcuaagaauaac

SEQ ID NO: 2212071 - RNA, 16 nt, Streptococcus pyogenes M1 GAS
aacuuucuauuaccua

SEQ ID NO: 2212072 - RNA, 13 nt, Streptococcus pyogenes M1 GAS
aacuuucaguuau

SEQ ID NO: 2212073 - RNA, 13 nt, Streptococcus pyogenes M1 GAS
aacggaguuccuc

SEQ ID NO: 2212074 - RNA, 19 nt, Streptococcus pyogenes M1 GAS
aaccucuuaguuguagaga

SEQ ID NO: 2212075 - RNA, 21 nt, Streptococcus pyogenes M1 GAS
aaccuuccuguaucaggaggg

SEQ ID NO: 2212076 - RNA, 13 nt, Streptococcus pyogenes M1 GAS
aaccuuugccauu

SEQ ID NO: 2212077 - RNA, 16 nt, Streptococcus pyogenes M1 GAS
aaccagcuuacagcug

SEQ ID NO: 2212078 - RNA, 14 nt, Streptococcus pyogenes M1 GAS
aaccauagaagcca

SEQ ID NO: 2212079 - RNA, 16 nt, Streptococcus pyogenes M1 GAS
aaccauaucacaaaac

SEQ ID NO: 2212080 - RNA, 22 nt, Streptococcus pyogenes M1 GAS
aacauggauaccauuucuuugc

SEQ ID NO: 2212081 - RNA, 17 nt, Streptococcus pyogenes M1 GAS
aacaguuccaguucugu

SEQ ID NO: 2212082 - RNA, 12 nt, Streptococcus pyogenes M1 GAS
aacauaacaauc

SEQ ID NO: 2212083 - RNA, 22 nt, Streptococcus pyogenes M1 GAS
aacagcugcuugaaaagaugca

SEQ ID NO: 2212084 - RNA, 17 nt, Streptococcus pyogenes M1 GAS
cggcaucuacagcaccu

SEQ ID NO: 2212085 - RNA, 13 nt, Streptococcus pyogenes M1 GAS
cgcuuccagaaca

SEQ ID NO: 2212086 - RNA, 18 nt, Streptococcus pyogenes M1 GAS
cgcucuaauuuagucauu

SEQ ID NO: 2212087 - RNA, 21 nt, Streptococcus pyogenes M1 GAS
cgcucaacuggcacaaacucu

SEQ ID NO: 2212088 - RNA, 19 nt, Streptococcus pyogenes M1 GAS
cgcuauaccuaaaaaauaa

SEQ ID NO: 2212089 - RNA, 16 nt, Streptococcus pyogenes M1 GAS
cgaucaagaaacucau

SEQ ID NO: 2212090 - RNA, 19 nt, Streptococcus pyogenes M1 GAS
aaacguaacguaauagaau

SEQ ID NO: 2212091 - RNA, 22 nt, Streptococcus pyogenes M1 GAS
cgccaguaaagucacgaguguu

SEQ ID NO: 2212092 - RNA, 16 nt, Streptococcus pyogenes M1 GAS
ccauuuccuacaaaau

SEQ ID NO: 2212093 - RNA, 15 nt, Streptococcus pyogenes M1 GAS
ccauuauaaaucuua

SEQ ID NO: 2212094 - RNA, 19 nt, Streptococcus pyogenes M1 GAS
ccaucaggcuuaaacauau

SEQ ID NO: 2212095 - RNA, 17 nt, Streptococcus pyogenes M1 GAS
cccagcagcaaaggcga

SEQ ID NO: 2212096 - RNA, 14 nt, Streptococcus pyogenes M1 GAS
cccaucaagacacc

SEQ ID NO: 2212097 - RNA, 15 nt, Streptococcus pyogenes M1 GAS
cccaucaagacaccc

SEQ ID NO: 2212098 - RNA, 16 nt, Streptococcus pyogenes M1 GAS
cccuaaacuaauaaga

SEQ ID NO: 2212099 - RNA, 21 nt, Streptococcus pyogenes M1 GAS
cccuaaacuaauaagauucaa

SEQ ID NO: 2212100 - RNA, 14 nt, Streptococcus pyogenes M1 GAS
cccuaucacaugca

SEQ ID NO: 2212101 - RNA, 15 nt, Streptococcus pyogenes M1 GAS
cccuaucacaugcau

SEQ ID NO: 2212102 - RNA, 17 nt, Streptococcus pyogenes M1 GAS
cccguuagucugcugcu

SEQ ID NO: 2212103 - RNA, 20 nt, Streptococcus pyogenes M1 GAS
aaacauucacggugggcuuu

SEQ ID NO: 2212104 - RNA, 13 nt, Streptococcus pyogenes M1 GAS
aaacauauuauag

SEQ ID NO: 2212105 - RNA, 14 nt, Streptococcus pyogenes M1 GAS
ccgaauaaggcucg

SEQ ID NO: 2212106 - RNA, 21 nt, Streptococcus pyogenes M1 GAS
ccgaauaaggcucgacaaagg

SEQ ID NO: 2212107 - RNA, 13 nt, Streptococcus pyogenes M1 GAS
ccgaaaaaaacuu

SEQ ID NO: 2212108 - RNA, 18 nt, Streptococcus pyogenes M1 GAS
ccgguucguuauaaacaa

SEQ ID NO: 2212109 - RNA, 14 nt, Streptococcus pyogenes M1 GAS
ccuaaaaaauaacu

SEQ ID NO: 2212110 - RNA, 19 nt, Streptococcus pyogenes M1 GAS
ccuaauaaaauagcaccua

SEQ ID NO: 2212111 - RNA, 11 nt, Streptococcus pyogenes M1 GAS
ccuaacaaaau

SEQ ID NO: 2212112 - RNA, 22 nt, Streptococcus pyogenes M1 GAS
ccuaaauccuuuugaaaaauua

SEQ ID NO: 2212113 - RNA, 14 nt, Streptococcus pyogenes M1 GAS
ccuaacaauuuuuc

SEQ ID NO: 2212114 - RNA, 16 nt, Streptococcus pyogenes M1 GAS
ccuaacaauuuuucaa

SEQ ID NO: 2212115 - RNA, 17 nt, Streptococcus pyogenes M1 GAS
ccuccuugcaauagagc

SEQ ID NO: 2212116 - RNA, 21 nt, Streptococcus pyogenes M1 GAS
ccuccaacauagcuaauccaa

SEQ ID NO: 2212117 - RNA, 19 nt, Streptococcus pyogenes M1 GAS
ccuaucauaggguucacuu

SEQ ID NO: 2212118 - RNA, 19 nt, Streptococcus pyogenes M1 GAS
ccuauugagucuuuuccua

SEQ ID NO: 2212119 - RNA, 13 nt, Streptococcus pyogenes M1 GAS
ccuaggaauaaaa

SEQ ID NO: 2212120 - RNA, 16 nt, Streptococcus pyogenes M1 GAS
ccuacuagcacaaaau

SEQ ID NO: 2212121 - RNA, 21 nt, Streptococcus pyogenes M1 GAS
ccuacuaacaacaacaacccu

SEQ ID NO: 2212122 - RNA, 18 nt, Streptococcus pyogenes M1 GAS
ccuaauuuaauuuacccc

SEQ ID NO: 2212123 - RNA, 20 nt, Streptococcus pyogenes M1 GAS
cgaauugugucauuucuuga

SEQ ID NO: 2212124 - RNA, 16 nt, Streptococcus pyogenes M1 GAS
cgaauaugauauaaaa

SEQ ID NO: 2212125 - RNA, 20 nt, Streptococcus pyogenes M1 GAS
cgaauaugauauaaaaaugg

SEQ ID NO: 2212126 - RNA, 14 nt, Streptococcus pyogenes M1 GAS
ccuuuugcuucuag

SEQ ID NO: 2212127 - RNA, 15 nt, Streptococcus pyogenes M1 GAS
cgacauuuaugcuga

SEQ ID NO: 2212128 - RNA, 22 nt, Streptococcus pyogenes M1 GAS
ccuuguacaagagcuuaaaagu

SEQ ID NO: 2212129 - RNA, 21 nt, Streptococcus pyogenes M1 GAS
ccuuuagcaauuguuuuuuca

SEQ ID NO: 2212130 - RNA, 14 nt, Streptococcus pyogenes M1 GAS
ccuuuaucuuauuu

SEQ ID NO: 2212131 - RNA, 19 nt, Streptococcus pyogenes M1 GAS
ccuuuaucuuauuuuaaga

SEQ ID NO: 2212132 - RNA, 22 nt, Streptococcus pyogenes M1 GAS
ccuuuaacuguuagccaugugu

SEQ ID NO: 2212133 - RNA, 18 nt, Streptococcus pyogenes M1 GAS
ccuuaugcagguguuuaa

SEQ ID NO: 2212134 - RNA, 13 nt, Streptococcus pyogenes M1 GAS
ccuuaucucaguu

SEQ ID NO: 2212135 - RNA, 18 nt, Streptococcus pyogenes M1 GAS
ccuucaaccgcuuccuuu

SEQ ID NO: 2212136 - RNA, 22 nt, Streptococcus pyogenes M1 GAS
ccuucaaaaaagggaagaagau

SEQ ID NO: 2212137 - RNA, 15 nt, Streptococcus pyogenes M1 GAS
ccuucaaaaaaggga

SEQ ID NO: 2212138 - RNA, 17 nt, Streptococcus pyogenes M1 GAS
ccuucaaaaaagggaag

SEQ ID NO: 2212139 - RNA, 14 nt, Streptococcus pyogenes M1 GAS
cauucuugcagaau

SEQ ID NO: 2212140 - RNA, 12 nt, Streptococcus pyogenes M1 GAS
cauucuugcaga

SEQ ID NO: 2212141 - RNA, 13 nt, Streptococcus pyogenes M1 GAS
cauugaauaaagu

SEQ ID NO: 2212142 - RNA, 18 nt, Streptococcus pyogenes M1 GAS
cauugagaauuuuuauaa

SEQ ID NO: 2212143 - RNA, 14 nt, Streptococcus pyogenes M1 GAS
cauuauugacaaau

SEQ ID NO: 2212144 - RNA, 21 nt, Streptococcus pyogenes M1 GAS
cauuauugacaaauccaauga

SEQ ID NO: 2212145 - RNA, 19 nt, Streptococcus pyogenes M1 GAS
cauuaaauugauuauucuu

SEQ ID NO: 2212146 - RNA, 23 nt, Streptococcus pyogenes M1 GAS
cauuaaagcuaucauacaacuga

SEQ ID NO: 2212147 - RNA, 16 nt, Streptococcus pyogenes M1 GAS
cauuaaaaaaaccagc

SEQ ID NO: 2212148 - RNA, 20 nt, Streptococcus pyogenes M1 GAS
cauguuuacaguugugugac

SEQ ID NO: 2212149 - RNA, 16 nt, Streptococcus pyogenes M1 GAS
cauggguaaaaugacu

SEQ ID NO: 2212150 - RNA, 18 nt, Streptococcus pyogenes M1 GAS
caugauguuauuaaauaa

SEQ ID NO: 2212151 - RNA, 19 nt, Streptococcus pyogenes M1 GAS
caugaugccauuuaaaagg

SEQ ID NO: 2212152 - RNA, 23 nt, Streptococcus pyogenes M1 GAS
caugaugguuucacgauaagaag

SEQ ID NO: 2212153 - RNA, 19 nt, Streptococcus pyogenes M1 GAS
caugauaucccaucuuugu

SEQ ID NO: 2212154 - RNA, 15 nt, Streptococcus pyogenes M1 GAS
caugcccauugauga

SEQ ID NO: 2212155 - RNA, 22 nt, Streptococcus pyogenes M1 GAS
caugccuaaagcccauaaagga

SEQ ID NO: 2212156 - RNA, 19 nt, Streptococcus pyogenes M1 GAS
caucuugccaucagcaucu

SEQ ID NO: 2212157 - RNA, 16 nt, Streptococcus pyogenes M1 GAS
caucuugcauuaccuu

SEQ ID NO: 2212158 - RNA, 18 nt, Streptococcus pyogenes M1 GAS
caucuugccaucagcauc

SEQ ID NO: 2212159 - RNA, 16 nt, Streptococcus pyogenes M1 GAS
caucggaacagcugaa

SEQ ID NO: 2212160 - RNA, 21 nt, Streptococcus pyogenes M1 GAS
caucgaguggauacaagguua

SEQ ID NO: 2212161 - RNA, 15 nt, Streptococcus pyogenes M1 GAS
cauaucgacauuuau

SEQ ID NO: 2212162 - RNA, 13 nt, Streptococcus pyogenes M1 GAS
cauauuccauaug

SEQ ID NO: 2212163 - RNA, 23 nt, Streptococcus pyogenes M1 GAS
caucaaaggcuuuuuguuuuauu

SEQ ID NO: 2212164 - RNA, 16 nt, Streptococcus pyogenes M1 GAS
caucaaaaaaagcaau

SEQ ID NO: 2212165 - RNA, 22 nt, Streptococcus pyogenes M1 GAS
cauaggaucagugcacucgacc

SEQ ID NO: 2212166 - RNA, 22 nt, Streptococcus pyogenes M1 GAS
cauacuuuauuaaucaaaaaac

SEQ ID NO: 2212167 - RNA, 21 nt, Streptococcus pyogenes M1 GAS
cauacuuuauuaaucaaaaaa

SEQ ID NO: 2212168 - RNA, 19 nt, Streptococcus pyogenes M1 GAS
cauacucuugucgcugaau

SEQ ID NO: 2212169 - RNA, 16 nt, Streptococcus pyogenes M1 GAS
ccagccacuacaagca

SEQ ID NO: 2212170 - RNA, 15 nt, Streptococcus pyogenes M1 GAS
ccagcauuugccaug

SEQ ID NO: 2212171 - RNA, 15 nt, Streptococcus pyogenes M1 GAS
ccagcaccuucuuuu

SEQ ID NO: 2212172 - RNA, 22 nt, Streptococcus pyogenes M1 GAS
ccacaaaagacaacgacgcuua

SEQ ID NO: 2212173 - RNA, 16 nt, Streptococcus pyogenes M1 GAS
ccaauaaugagcaagg

SEQ ID NO: 2212174 - RNA, 12 nt, Streptococcus pyogenes M1 GAS
ccaaucuuugug

SEQ ID NO: 2212175 - RNA, 16 nt, Streptococcus pyogenes M1 GAS
ccaaagaaggccagca

SEQ ID NO: 2212176 - RNA, 16 nt, Streptococcus pyogenes M1 GAS
ccaaaauacauccuaa

SEQ ID NO: 2212177 - RNA, 21 nt, Streptococcus pyogenes M1 GAS
cauuuuuuauaaugguuuuuu

SEQ ID NO: 2212178 - RNA, 20 nt, Streptococcus pyogenes M1 GAS
cauuuuggagagauuuuaaa

SEQ ID NO: 2212179 - RNA, 22 nt, Streptococcus pyogenes M1 GAS
cauuuugcaagucucuugcaag

SEQ ID NO: 2212180 - RNA, 16 nt, Streptococcus pyogenes M1 GAS
cauuuucuuugugaca

SEQ ID NO: 2212181 - RNA, 19 nt, Streptococcus pyogenes M1 GAS
cauuuucuuugugacauga

SEQ ID NO: 2212182 - RNA, 21 nt, Streptococcus pyogenes M1 GAS
cauugaugagacuaaccugca

SEQ ID NO: 2212183 - RNA, 16 nt, Streptococcus pyogenes M1 GAS
cagguuucuuuugguu

SEQ ID NO: 2212184 - RNA, 21 nt, Streptococcus pyogenes M1 GAS
caguauaaccgccaucuaagc

SEQ ID NO: 2212185 - RNA, 20 nt, Streptococcus pyogenes M1 GAS
caguauguaaauauaaaguc

SEQ ID NO: 2212186 - RNA, 23 nt, Streptococcus pyogenes M1 GAS
caguccuccucuuuagaauucuu

SEQ ID NO: 2212187 - RNA, 16 nt, Streptococcus pyogenes M1 GAS
cagucuuuuuuauaau

SEQ ID NO: 2212188 - RNA, 19 nt, Streptococcus pyogenes M1 GAS
cagucuuuuucauuuuuau

SEQ ID NO: 2212189 - RNA, 15 nt, Streptococcus pyogenes M1 GAS
cagcuacacuugauu

SEQ ID NO: 2212190 - RNA, 14 nt, Streptococcus pyogenes M1 GAS
cagaaaugaaaaga

SEQ ID NO: 2212191 - RNA, 14 nt, Streptococcus pyogenes M1 GAS
cagaaaaaagauaa

SEQ ID NO: 2212192 - RNA, 21 nt, Streptococcus pyogenes M1 GAS
cagaaauuaauaaauuuuugu

SEQ ID NO: 2212193 - RNA, 20 nt, Streptococcus pyogenes M1 GAS
cagaagcaaauucuuccuua

SEQ ID NO: 2212194 - RNA, 18 nt, Streptococcus pyogenes M1 GAS
cagacuuaauugaaagag

SEQ ID NO: 2212195 - RNA, 22 nt, Streptococcus pyogenes M1 GAS
cagacuuuuaauguauuggaaa

SEQ ID NO: 2212196 - RNA, 19 nt, Streptococcus pyogenes M1 GAS
aaaaucaugggaaaagcua

SEQ ID NO: 2212197 - RNA, 16 nt, Streptococcus pyogenes M1 GAS
cagagcaguucagcag

SEQ ID NO: 2212198 - RNA, 15 nt, Streptococcus pyogenes M1 GAS
cagagcaguucagca

SEQ ID NO: 2212199 - RNA, 20 nt, Streptococcus pyogenes M1 GAS
cagauaagaccuucaaaaaa

SEQ ID NO: 2212200 - RNA, 16 nt, Streptococcus pyogenes M1 GAS
cagcaaggcaccugag

SEQ ID NO: 2212201 - RNA, 15 nt, Streptococcus pyogenes M1 GAS
cagcauuuucaucau

SEQ ID NO: 2212202 - RNA, 19 nt, Streptococcus pyogenes M1 GAS
cagccucuuggaaacaaga

SEQ ID NO: 2212203 - RNA, 15 nt, Streptococcus pyogenes M1 GAS
uuuuugucuucuucu

SEQ ID NO: 2212204 - RNA, 22 nt, Streptococcus pyogenes M1 GAS
uuuuuuaagacuauguugcuua

SEQ ID NO: 2212205 - RNA, 12 nt, Streptococcus pyogenes M1 GAS
uuuuugacacag

SEQ ID NO: 2212206 - RNA, 14 nt, Streptococcus pyogenes M1 GAS
uuuugauuuuaauu

SEQ ID NO: 2212207 - RNA, 16 nt, Streptococcus pyogenes M1 GAS
uuuugauuuucucagu

SEQ ID NO: 2212208 - RNA, 23 nt, Streptococcus pyogenes M1 GAS
uuuuucucaaaaauauauucuaa

SEQ ID NO: 2212209 - RNA, 20 nt, Streptococcus pyogenes M1 GAS
uuuuauagcugauuuguuuu

SEQ ID NO: 2212210 - RNA, 23 nt, Streptococcus pyogenes M1 GAS
uuuuaguugugauauaaaaugcc

SEQ ID NO: 2212211 - RNA, 12 nt, Streptococcus pyogenes M1 GAS
uuuuaguuuuau

SEQ ID NO: 2212212 - RNA, 16 nt, Streptococcus pyogenes M1 GAS
uuuuauaacaauuaca

SEQ ID NO: 2212213 - RNA, 19 nt, Streptococcus pyogenes M1 GAS
uuuuaggccaccagaugcu

SEQ ID NO: 2212214 - RNA, 22 nt, Streptococcus pyogenes M1 GAS
uuuuaguaaagccuuauccauu

SEQ ID NO: 2212215 - RNA, 18 nt, Streptococcus pyogenes M1 GAS
uuuuaugauuugucaaaa

SEQ ID NO: 2212216 - RNA, 22 nt, Streptococcus pyogenes M1 GAS
uuuuauccccuauucaauauuu

SEQ ID NO: 2212217 - RNA, 18 nt, Streptococcus pyogenes M1 GAS
uuuuauccccuauucaau

SEQ ID NO: 2212218 - RNA, 22 nt, Streptococcus pyogenes M1 GAS
uuuuaauguauuggaaaauaca

SEQ ID NO: 2212219 - RNA, 13 nt, Streptococcus pyogenes M1 GAS
uuuuacauuuuua

SEQ ID NO: 2212220 - RNA, 19 nt, Streptococcus pyogenes M1 GAS
uuuuacaucaaaaaaagca

SEQ ID NO: 2212221 - RNA, 16 nt, Streptococcus pyogenes M1 GAS
uuuuacgaaaaauucu

SEQ ID NO: 2212222 - RNA, 13 nt, Streptococcus pyogenes M1 GAS
uuuuagauaaaaa

SEQ ID NO: 2212223 - RNA, 23 nt, Streptococcus pyogenes M1 GAS
uuuuagcagcagaagcaaauucu

SEQ ID NO: 2212224 - RNA, 14 nt, Streptococcus pyogenes M1 GAS
uuuucuuuuuggcu

SEQ ID NO: 2212225 - RNA, 15 nt, Streptococcus pyogenes M1 GAS
uuuucccaucaauag

SEQ ID NO: 2212226 - RNA, 16 nt, Streptococcus pyogenes M1 GAS
uuuuauuauacucaau

SEQ ID NO: 2212227 - RNA, 15 nt, Streptococcus pyogenes M1 GAS
uuuuauuuuuuaaag

SEQ ID NO: 2212228 - RNA, 18 nt, Streptococcus pyogenes M1 GAS
uuuggagagauuuuaaaa

SEQ ID NO: 2212229 - RNA, 20 nt, Streptococcus pyogenes M1 GAS
uuuggagagauuuuaaaaaa

SEQ ID NO: 2212230 - RNA, 14 nt, Streptococcus pyogenes M1 GAS
uuugcuuuuuaauu

SEQ ID NO: 2212231 - RNA, 20 nt, Streptococcus pyogenes M1 GAS
uuugcugaaauaucuuucag

SEQ ID NO: 2212232 - RNA, 21 nt, Streptococcus pyogenes M1 GAS
uuugucaaaaaguaaaaagca

SEQ ID NO: 2212233 - RNA, 21 nt, Streptococcus pyogenes M1 GAS
uuugucaacucgauaaaaacg

SEQ ID NO: 2212234 - RNA, 18 nt, Streptococcus pyogenes M1 GAS
uuuguauuguagaggacu

SEQ ID NO: 2212235 - RNA, 19 nt, Streptococcus pyogenes M1 GAS
uuuguaugacauugacuga

SEQ ID NO: 2212236 - RNA, 19 nt, Streptococcus pyogenes M1 GAS
uuuggccaauaaaauaucu

SEQ ID NO: 2212237 - RNA, 22 nt, Streptococcus pyogenes M1 GAS
uuuuaagauuaaacuuacaaaa

SEQ ID NO: 2212238 - RNA, 15 nt, Streptococcus pyogenes M1 GAS
uuuuaaaaaaccuuu

SEQ ID NO: 2212239 - RNA, 21 nt, Streptococcus pyogenes M1 GAS
uuuguguugaagaaggucaug

SEQ ID NO: 2212240 - RNA, 15 nt, Streptococcus pyogenes M1 GAS
uuuguuaacagguga

SEQ ID NO: 2212241 - RNA, 17 nt, Streptococcus pyogenes M1 GAS
uuuguuuauuuauaauu

SEQ ID NO: 2212242 - RNA, 20 nt, Streptococcus pyogenes M1 GAS
uuuguccauuuuuuauaaug

SEQ ID NO: 2212243 - RNA, 19 nt, Streptococcus pyogenes M1 GAS
uuugucuucuucuuuucag

SEQ ID NO: 2212244 - RNA, 21 nt, Streptococcus pyogenes M1 GAS
uuugucugacuuaaauuugga

SEQ ID NO: 2212245 - RNA, 17 nt, Streptococcus pyogenes M1 GAS
uuuacgcuuuacauuuu

SEQ ID NO: 2212246 - RNA, 18 nt, Streptococcus pyogenes M1 GAS
uuuacuauggcuucuaaa

SEQ ID NO: 2212247 - RNA, 20 nt, Streptococcus pyogenes M1 GAS
uuuacuauggcuucuaaaaa

SEQ ID NO: 2212248 - RNA, 18 nt, Streptococcus pyogenes M1 GAS
uuuagugaauucuaaaau

SEQ ID NO: 2212249 - RNA, 22 nt, Streptococcus pyogenes M1 GAS
uuuaguugugauauaaaaugcc

SEQ ID NO: 2212250 - RNA, 21 nt, Streptococcus pyogenes M1 GAS
uuuagugguauagacaaacag

SEQ ID NO: 2212251 - RNA, 17 nt, Streptococcus pyogenes M1 GAS
uuuagguacucguaagc

SEQ ID NO: 2212252 - RNA, 16 nt, Streptococcus pyogenes M1 GAS
uuuagcgguaucccuu

SEQ ID NO: 2212253 - RNA, 13 nt, Streptococcus pyogenes M1 GAS
uuuagauaaaaau

SEQ ID NO: 2212254 - RNA, 13 nt, Streptococcus pyogenes M1 GAS
uuuauaauuucuu

SEQ ID NO: 2212255 - RNA, 11 nt, Streptococcus pyogenes M1 GAS
uuuauaacaau

SEQ ID NO: 2212256 - RNA, 22 nt, Streptococcus pyogenes M1 GAS
uuuaugucgucgugacaaugug

SEQ ID NO: 2212257 - RNA, 21 nt, Streptococcus pyogenes M1 GAS
uuuaugucuugcuaaaauuuc

SEQ ID NO: 2212258 - RNA, 14 nt, Streptococcus pyogenes M1 GAS
uuuaugaaagguau

SEQ ID NO: 2212259 - RNA, 13 nt, Streptococcus pyogenes M1 GAS
uuucaucaucaag

SEQ ID NO: 2212260 - RNA, 14 nt, Streptococcus pyogenes M1 GAS
uuucacuuaucauu

SEQ ID NO: 2212261 - RNA, 16 nt, Streptococcus pyogenes M1 GAS
uuucaggauguuuauu

SEQ ID NO: 2212262 - RNA, 15 nt, Streptococcus pyogenes M1 GAS
uuucaguuguuuuaa

SEQ ID NO: 2212263 - RNA, 20 nt, Streptococcus pyogenes M1 GAS
uuucaauaauaccauuuuua

SEQ ID NO: 2212264 - RNA, 16 nt, Streptococcus pyogenes M1 GAS
uuuauuccgguuuuaa

SEQ ID NO: 2212265 - RNA, 16 nt, Streptococcus pyogenes M1 GAS
uuuauuuugauauuuu

SEQ ID NO: 2212266 - RNA, 19 nt, Streptococcus pyogenes M1 GAS
uuuauuuguugaagugucu

SEQ ID NO: 2212267 - RNA, 20 nt, Streptococcus pyogenes M1 GAS
uuucaaaaaaacuucacauu

SEQ ID NO: 2212268 - RNA, 14 nt, Streptococcus pyogenes M1 GAS
uuucaacaaauccu

SEQ ID NO: 2212269 - RNA, 21 nt, Streptococcus pyogenes M1 GAS
uuucuuauauugugcuauuca

SEQ ID NO: 2212270 - RNA, 19 nt, Streptococcus pyogenes M1 GAS
uuugaauacguaaaaagag

SEQ ID NO: 2212271 - RNA, 12 nt, Streptococcus pyogenes M1 GAS
uuugaauguugu

SEQ ID NO: 2212272 - RNA, 19 nt, Streptococcus pyogenes M1 GAS
uuugacagacaccaaaaaa

SEQ ID NO: 2212273 - RNA, 17 nt, Streptococcus pyogenes M1 GAS
uuugaccuacuagcaca

SEQ ID NO: 2212274 - RNA, 22 nt, Streptococcus pyogenes M1 GAS
uuugaccuacuagcacaaaauc

SEQ ID NO: 2212275 - RNA, 13 nt, Streptococcus pyogenes M1 GAS
uuugagaacgaau

SEQ ID NO: 2212276 - RNA, 21 nt, Streptococcus pyogenes M1 GAS
uuugagacaguuagcaaauug

SEQ ID NO: 2212277 - RNA, 20 nt, Streptococcus pyogenes M1 GAS
uuugaggugauguucucaua

SEQ ID NO: 2212278 - RNA, 19 nt, Streptococcus pyogenes M1 GAS
uuugccauggcaagagcac

SEQ ID NO: 2212279 - RNA, 20 nt, Streptococcus pyogenes M1 GAS
uuugcaaauaguagcaaaua

SEQ ID NO: 2212280 - RNA, 18 nt, Streptococcus pyogenes M1 GAS
uuuccuagcgggaacacu

SEQ ID NO: 2212281 - RNA, 13 nt, Streptococcus pyogenes M1 GAS
uuucuagguuaaa

SEQ ID NO: 2212282 - RNA, 16 nt, Streptococcus pyogenes M1 GAS
uuucggacuguuuuuu

SEQ ID NO: 2212283 - RNA, 18 nt, Streptococcus pyogenes M1 GAS
uuucguugacaacaauau

SEQ ID NO: 2212284 - RNA, 13 nt, Streptococcus pyogenes M1 GAS
uuucgucuaaaaa

SEQ ID NO: 2212285 - RNA, 11 nt, Streptococcus pyogenes M1 GAS
uuucucaguaa

SEQ ID NO: 2212286 - RNA, 20 nt, Streptococcus pyogenes M1 GAS
uuucucagagacaauaaggu

SEQ ID NO: 2212287 - RNA, 17 nt, Streptococcus pyogenes M1 GAS
uugcauggguaugccug

SEQ ID NO: 2212288 - RNA, 16 nt, Streptococcus pyogenes M1 GAS
uugcaucgcaaacaga

SEQ ID NO: 2212289 - RNA, 17 nt, Streptococcus pyogenes M1 GAS
uugcauuuuuuguaauu

SEQ ID NO: 2212290 - RNA, 16 nt, Streptococcus pyogenes M1 GAS
uugguggaagaguaag

SEQ ID NO: 2212291 - RNA, 17 nt, Streptococcus pyogenes M1 GAS
uuggcuacucuauuuua

SEQ ID NO: 2212292 - RNA, 21 nt, Streptococcus pyogenes M1 GAS
uuggcuacucuauuuuaagua

SEQ ID NO: 2212293 - RNA, 17 nt, Streptococcus pyogenes M1 GAS
uugcuuuuuucuaaccu

SEQ ID NO: 2212294 - RNA, 14 nt, Streptococcus pyogenes M1 GAS
uugcuuuugauacc

SEQ ID NO: 2212295 - RNA, 23 nt, Streptococcus pyogenes M1 GAS
uuguuuuuucaaagggagauucu

SEQ ID NO: 2212296 - RNA, 23 nt, Streptococcus pyogenes M1 GAS
uuguuguauuaugaggugaacac

SEQ ID NO: 2212297 - RNA, 20 nt, Streptococcus pyogenes M1 GAS
uuuaacaugauguaccaauu

SEQ ID NO: 2212298 - RNA, 23 nt, Streptococcus pyogenes M1 GAS
uuuaaaauaguucccuuaauaaa

SEQ ID NO: 2212299 - RNA, 17 nt, Streptococcus pyogenes M1 GAS
uuuaaaagggcugaccu

SEQ ID NO: 2212300 - RNA, 21 nt, Streptococcus pyogenes M1 GAS
uuuaaaagggucaguuuguuu

SEQ ID NO: 2212301 - RNA, 23 nt, Streptococcus pyogenes M1 GAS
uuuaacuguuagccauguguugu

SEQ ID NO: 2212302 - RNA, 20 nt, Streptococcus pyogenes M1 GAS
uugucacugaaaaagccuuu

SEQ ID NO: 2212303 - RNA, 12 nt, Streptococcus pyogenes M1 GAS
uuguauagguag

SEQ ID NO: 2212304 - RNA, 22 nt, Streptococcus pyogenes M1 GAS
uugugauuaguuuuuagcagca

SEQ ID NO: 2212305 - RNA, 22 nt, Streptococcus pyogenes M1 GAS
uugugcuaaucuaucucguaau

SEQ ID NO: 2212306 - RNA, 22 nt, Streptococcus pyogenes M1 GAS
uuguggcgggccuucuaucaaa

SEQ ID NO: 2212307 - RNA, 19 nt, Streptococcus pyogenes M1 GAS
uuguggcugauaaaaagag

SEQ ID NO: 2212308 - RNA, 16 nt, Streptococcus pyogenes M1 GAS
uuguuacaaaaaacaa

SEQ ID NO: 2212309 - RNA, 14 nt, Streptococcus pyogenes M1 GAS
uuguuacaaaaaac

SEQ ID NO: 2212310 - RNA, 16 nt, Streptococcus pyogenes M1 GAS
uucuaaaaugaugaga

SEQ ID NO: 2212311 - RNA, 14 nt, Streptococcus pyogenes M1 GAS
uucuacuaaaaaag

SEQ ID NO: 2212312 - RNA, 16 nt, Streptococcus pyogenes M1 GAS
uucuacuaaaaaagga

SEQ ID NO: 2212313 - RNA, 19 nt, Streptococcus pyogenes M1 GAS
uucguauugucaucgcuuu

SEQ ID NO: 2212314 - RNA, 19 nt, Streptococcus pyogenes M1 GAS
uucggugaugccucuuguc

SEQ ID NO: 2212315 - RNA, 12 nt, Streptococcus pyogenes M1 GAS
uucugcauuauc

SEQ ID NO: 2212316 - RNA, 16 nt, Streptococcus pyogenes M1 GAS
uucugaaaauaaaaua

SEQ ID NO: 2212317 - RNA, 14 nt, Streptococcus pyogenes M1 GAS
uucuuauccauuau

SEQ ID NO: 2212318 - RNA, 20 nt, Streptococcus pyogenes M1 GAS
uugauaucauaaguuaccaa

SEQ ID NO: 2212319 - RNA, 16 nt, Streptococcus pyogenes M1 GAS
uugauacguuuauugu

SEQ ID NO: 2212320 - RNA, 13 nt, Streptococcus pyogenes M1 GAS
uugauacguuuau

SEQ ID NO: 2212321 - RNA, 14 nt, Streptococcus pyogenes M1 GAS
uugacuauuuuucg

SEQ ID NO: 2212322 - RNA, 19 nt, Streptococcus pyogenes M1 GAS
uugagauaacucuucggua

SEQ ID NO: 2212323 - RNA, 19 nt, Streptococcus pyogenes M1 GAS
uugaaaagaugcacacaaa

SEQ ID NO: 2212324 - RNA, 21 nt, Streptococcus pyogenes M1 GAS
uugaauaucgccaauaaaaaa

SEQ ID NO: 2212325 - RNA, 16 nt, Streptococcus pyogenes M1 GAS
uugacaguuaaaaaua

SEQ ID NO: 2212326 - RNA, 17 nt, Streptococcus pyogenes M1 GAS
uugaauacguaaaaaga

SEQ ID NO: 2212327 - RNA, 20 nt, Streptococcus pyogenes M1 GAS
ugauguagggcuguaaaaug

SEQ ID NO: 2212328 - RNA, 22 nt, Streptococcus pyogenes M1 GAS
ugauguagggcuguaaaauguu

SEQ ID NO: 2212329 - RNA, 14 nt, Streptococcus pyogenes M1 GAS
ugauguuuuuacau

SEQ ID NO: 2212330 - RNA, 15 nt, Streptococcus pyogenes M1 GAS
ugauuauucuuuauu

SEQ ID NO: 2212331 - RNA, 23 nt, Streptococcus pyogenes M1 GAS
ugauuuuucuuguuuugguugau

SEQ ID NO: 2212332 - RNA, 17 nt, Streptococcus pyogenes M1 GAS
ugauuuuaauuuuucuu

SEQ ID NO: 2212333 - RNA, 14 nt, Streptococcus pyogenes M1 GAS
ugaugcguuuauaa

SEQ ID NO: 2212334 - RNA, 15 nt, Streptococcus pyogenes M1 GAS
ugaugcguuuauaaa

SEQ ID NO: 2212335 - RNA, 23 nt, Streptococcus pyogenes M1 GAS
ugaugauugaguaagcagcauca

SEQ ID NO: 2212336 - RNA, 22 nt, Streptococcus pyogenes M1 GAS
ugaugagacuaaccugcauauc

SEQ ID NO: 2212337 - RNA, 23 nt, Streptococcus pyogenes M1 GAS
ugauauuuuuucucaaaaauaua

SEQ ID NO: 2212338 - RNA, 14 nt, Streptococcus pyogenes M1 GAS
ugauauuucaucuu

SEQ ID NO: 2212339 - RNA, 13 nt, Streptococcus pyogenes M1 GAS
ugauauacugaaa

SEQ ID NO: 2212340 - RNA, 21 nt, Streptococcus pyogenes M1 GAS
ugcacacaaaucuucuagaau

SEQ ID NO: 2212341 - RNA, 18 nt, Streptococcus pyogenes M1 GAS
ugcagagaugcuucuuuc

SEQ ID NO: 2212342 - RNA, 16 nt, Streptococcus pyogenes M1 GAS
ugcagaguacaaggca

SEQ ID NO: 2212343 - RNA, 15 nt, Streptococcus pyogenes M1 GAS
ugcagcuaaaaacaa

SEQ ID NO: 2212344 - RNA, 14 nt, Streptococcus pyogenes M1 GAS
ugagucuuuuccua

SEQ ID NO: 2212345 - RNA, 16 nt, Streptococcus pyogenes M1 GAS
ugaggugauucuuuuu

SEQ ID NO: 2212346 - RNA, 13 nt, Streptococcus pyogenes M1 GAS
ugaggugaacacc

SEQ ID NO: 2212347 - RNA, 17 nt, Streptococcus pyogenes M1 GAS
ugagauauucauuuucu

SEQ ID NO: 2212348 - RNA, 16 nt, Streptococcus pyogenes M1 GAS
ugagauuaacugacaa

SEQ ID NO: 2212349 - RNA, 15 nt, Streptococcus pyogenes M1 GAS
ugagaucuucuuuug

SEQ ID NO: 2212350 - RNA, 14 nt, Streptococcus pyogenes M1 GAS
ugagaucuucuuuu

SEQ ID NO: 2212351 - RNA, 19 nt, Streptococcus pyogenes M1 GAS
ugagccuccaacauagcua

SEQ ID NO: 2212352 - RNA, 16 nt, Streptococcus pyogenes M1 GAS
ugagccccaaaaguug

SEQ ID NO: 2212353 - RNA, 19 nt, Streptococcus pyogenes M1 GAS
ugacuuguuacaaaaaaca

SEQ ID NO: 2212354 - RNA, 15 nt, Streptococcus pyogenes M1 GAS
ugacuugguuuaaua

SEQ ID NO: 2212355 - RNA, 15 nt, Streptococcus pyogenes M1 GAS
ugacuguaaauagau

SEQ ID NO: 2212356 - RNA, 17 nt, Streptococcus pyogenes M1 GAS
ugaccauuuuuacugua

SEQ ID NO: 2212357 - RNA, 19 nt, Streptococcus pyogenes M1 GAS
ugacagacaccaaaaaaag

SEQ ID NO: 2212358 - RNA, 20 nt, Streptococcus pyogenes M1 GAS
ugacagacaccaaaaaaagc

SEQ ID NO: 2212359 - RNA, 17 nt, Streptococcus pyogenes M1 GAS
ugacagccaccuucagg

SEQ ID NO: 2212360 - RNA, 17 nt, Streptococcus pyogenes M1 GAS
ugacaguuaaaaauaac

SEQ ID NO: 2212361 - RNA, 16 nt, Streptococcus pyogenes M1 GAS
ugacaguuaaaaauaa

SEQ ID NO: 2212362 - RNA, 23 nt, Streptococcus pyogenes M1 GAS
ugacaagucaggaauuguugacu

SEQ ID NO: 2212363 - RNA, 15 nt, Streptococcus pyogenes M1 GAS
ugacaaauucuuuuu

SEQ ID NO: 2212364 - RNA, 14 nt, Streptococcus pyogenes M1 GAS
ugaauucuaaaaua

SEQ ID NO: 2212365 - RNA, 15 nt, Streptococcus pyogenes M1 GAS
ugaauugaaaaaaga

SEQ ID NO: 2212366 - RNA, 13 nt, Streptococcus pyogenes M1 GAS
ugaauuauuagua

SEQ ID NO: 2212367 - RNA, 17 nt, Streptococcus pyogenes M1 GAS
ugaauuauuaguaacca

SEQ ID NO: 2212368 - RNA, 23 nt, Streptococcus pyogenes M1 GAS
ucuuuauuuugauauuuuuucuc

SEQ ID NO: 2212369 - RNA, 17 nt, Streptococcus pyogenes M1 GAS
ugccuuggccccuuuuu

SEQ ID NO: 2212370 - RNA, 14 nt, Streptococcus pyogenes M1 GAS
ugcgcaccuccacc

SEQ ID NO: 2212371 - RNA, 18 nt, Streptococcus pyogenes M1 GAS
ugccaucaaaaaaagaca

SEQ ID NO: 2212372 - RNA, 13 nt, Streptococcus pyogenes M1 GAS
ugcagucuuuuuc

SEQ ID NO: 2212373 - RNA, 14 nt, Streptococcus pyogenes M1 GAS
ugcagucuuuuuca

SEQ ID NO: 2212374 - RNA, 13 nt, Streptococcus pyogenes M1 GAS
ugcagguaauuau

SEQ ID NO: 2212375 - RNA, 20 nt, Streptococcus pyogenes M1 GAS
ugccacuaccugaauugcug

SEQ ID NO: 2212376 - RNA, 21 nt, Streptococcus pyogenes M1 GAS
ugcuauuucagcuagacuaua

SEQ ID NO: 2212377 - RNA, 13 nt, Streptococcus pyogenes M1 GAS
ugcucuuguuuuc

SEQ ID NO: 2212378 - RNA, 17 nt, Streptococcus pyogenes M1 GAS
ugcucuuguuuucucaa

SEQ ID NO: 2212379 - RNA, 12 nt, Streptococcus pyogenes M1 GAS
uggacgaaggcu

SEQ ID NO: 2212380 - RNA, 14 nt, Streptococcus pyogenes M1 GAS
uggaaggcacagaa

SEQ ID NO: 2212381 - RNA, 14 nt, Streptococcus pyogenes M1 GAS
uggaaauuuuaaau

SEQ ID NO: 2212382 - RNA, 21 nt, Streptococcus pyogenes M1 GAS
ugcuuuugaugcagcuaaaag

SEQ ID NO: 2212383 - RNA, 21 nt, Streptococcus pyogenes M1 GAS
ugcuuugacaaagcagugcuu

SEQ ID NO: 2212384 - RNA, 19 nt, Streptococcus pyogenes M1 GAS
ugcuugcucaauuuuugau

SEQ ID NO: 2212385 - RNA, 15 nt, Streptococcus pyogenes M1 GAS
ugcuucuuacuauga

SEQ ID NO: 2212386 - RNA, 12 nt, Streptococcus pyogenes M1 GAS
ugcuuuaaaaag

SEQ ID NO: 2212387 - RNA, 23 nt, Streptococcus pyogenes M1 GAS
ugcuguuugucauacucaauagc

SEQ ID NO: 2212388 - RNA, 17 nt, Streptococcus pyogenes M1 GAS
ugcugucucuacgauag

SEQ ID NO: 2212389 - RNA, 17 nt, Streptococcus pyogenes M1 GAS
ugcuguuugucauacuc

SEQ ID NO: 2212390 - RNA, 18 nt, Streptococcus pyogenes M1 GAS
uuagugguauagacaaac

SEQ ID NO: 2212391 - RNA, 15 nt, Streptococcus pyogenes M1 GAS
uuagucugaauugga

SEQ ID NO: 2212392 - RNA, 18 nt, Streptococcus pyogenes M1 GAS
uuaguccaaaauacaucc

SEQ ID NO: 2212393 - RNA, 22 nt, Streptococcus pyogenes M1 GAS
uuaguccaaaauacauccuaau

SEQ ID NO: 2212394 - RNA, 14 nt, Streptococcus pyogenes M1 GAS
uuagucauuucuuc

SEQ ID NO: 2212395 - RNA, 17 nt, Streptococcus pyogenes M1 GAS
uuaguugcuucuuuuaa

SEQ ID NO: 2212396 - RNA, 19 nt, Streptococcus pyogenes M1 GAS
uuaguuuaggaaucacaac

SEQ ID NO: 2212397 - RNA, 12 nt, Streptococcus pyogenes M1 GAS
uuaguuuuuaaa

SEQ ID NO: 2212398 - RNA, 15 nt, Streptococcus pyogenes M1 GAS
uuaguuuuauuuuga

SEQ ID NO: 2212399 - RNA, 16 nt, Streptococcus pyogenes M1 GAS
uuauauugugcuauuc

SEQ ID NO: 2212400 - RNA, 22 nt, Streptococcus pyogenes M1 GAS
uuauaguuugacuucaaaaaua

SEQ ID NO: 2212401 - RNA, 14 nt, Streptococcus pyogenes M1 GAS
uuacuuaucaucau

SEQ ID NO: 2212402 - RNA, 15 nt, Streptococcus pyogenes M1 GAS
uuagcaauuguuuuu

SEQ ID NO: 2212403 - RNA, 19 nt, Streptococcus pyogenes M1 GAS
uuagcaaaaugcuguuugu

SEQ ID NO: 2212404 - RNA, 20 nt, Streptococcus pyogenes M1 GAS
uuagcaaaggcuucaucaau

SEQ ID NO: 2212405 - RNA, 21 nt, Streptococcus pyogenes M1 GAS
uuagcaaaggcuucaucaaug

SEQ ID NO: 2212406 - RNA, 20 nt, Streptococcus pyogenes M1 GAS
uuagcaaagugauauacuga

SEQ ID NO: 2212407 - RNA, 14 nt, Streptococcus pyogenes M1 GAS
uuagccaaagaagg

SEQ ID NO: 2212408 - RNA, 19 nt, Streptococcus pyogenes M1 GAS
uuagcuuuuuuuaaagcua

SEQ ID NO: 2212409 - RNA, 20 nt, Streptococcus pyogenes M1 GAS
uuaaguaaaggauuuaguuu

SEQ ID NO: 2212410 - RNA, 15 nt, Streptococcus pyogenes M1 GAS
uuaaggauuuagcug

SEQ ID NO: 2212411 - RNA, 22 nt, Streptococcus pyogenes M1 GAS
uuaagggcaaugccaucugcuu

SEQ ID NO: 2212412 - RNA, 23 nt, Streptococcus pyogenes M1 GAS
uuaagacaacauacuuuauuaau

SEQ ID NO: 2212413 - RNA, 15 nt, Streptococcus pyogenes M1 GAS
uuaacugacaaaaaa

SEQ ID NO: 2212414 - RNA, 18 nt, Streptococcus pyogenes M1 GAS
uuaacuguuagccaugug

SEQ ID NO: 2212415 - RNA, 20 nt, Streptococcus pyogenes M1 GAS
uuaagaaggaacucuccaaa

SEQ ID NO: 2212416 - RNA, 17 nt, Streptococcus pyogenes M1 GAS
uuaacugguaaaguauu

SEQ ID NO: 2212417 - RNA, 17 nt, Streptococcus pyogenes M1 GAS
uuaauauagucugcaug

SEQ ID NO: 2212418 - RNA, 20 nt, Streptococcus pyogenes M1 GAS
uuaauagcauugucaaauaa

SEQ ID NO: 2212419 - RNA, 21 nt, Streptococcus pyogenes M1 GAS
uuaauagcauugucaaauaaa

SEQ ID NO: 2212420 - RNA, 18 nt, Streptococcus pyogenes M1 GAS
uuaauaguuuuccauaau

SEQ ID NO: 2212421 - RNA, 23 nt, Streptococcus pyogenes M1 GAS
uuaauagcauugucaaauaaaau

SEQ ID NO: 2212422 - RNA, 14 nt, Streptococcus pyogenes M1 GAS
uuaauaauauuaac

SEQ ID NO: 2212423 - RNA, 19 nt, Streptococcus pyogenes M1 GAS
uuaauauagucugcaugaa

SEQ ID NO: 2212424 - RNA, 21 nt, Streptococcus pyogenes M1 GAS
uuaauauagucugcaugaagu

SEQ ID NO: 2212425 - RNA, 15 nt, Streptococcus pyogenes M1 GAS
uuaaucaaaaaacug

SEQ ID NO: 2212426 - RNA, 14 nt, Streptococcus pyogenes M1 GAS
uuaaucgaccaaaa

SEQ ID NO: 2212427 - RNA, 14 nt, Streptococcus pyogenes M1 GAS
uuaccagcaccuuc

SEQ ID NO: 2212428 - RNA, 14 nt, Streptococcus pyogenes M1 GAS
uuacagcugguuuu

SEQ ID NO: 2212429 - RNA, 22 nt, Streptococcus pyogenes M1 GAS
ugugucuuuucuuuuuggcuga

SEQ ID NO: 2212430 - RNA, 21 nt, Streptococcus pyogenes M1 GAS
ugugacggaagauguggcuag

SEQ ID NO: 2212431 - RNA, 22 nt, Streptococcus pyogenes M1 GAS
ugugacuaguuuauuacaaaac

SEQ ID NO: 2212432 - RNA, 23 nt, Streptococcus pyogenes M1 GAS
ugugacaugaguauaaauuuggg

SEQ ID NO: 2212433 - RNA, 18 nt, Streptococcus pyogenes M1 GAS
ugugaggccgucacaaac

SEQ ID NO: 2212434 - RNA, 15 nt, Streptococcus pyogenes M1 GAS
uguugucaaacauaa

SEQ ID NO: 2212435 - RNA, 15 nt, Streptococcus pyogenes M1 GAS
uguucucauaaacaa

SEQ ID NO: 2212436 - RNA, 22 nt, Streptococcus pyogenes M1 GAS
uguuauuggaaaguaaggguua

SEQ ID NO: 2212437 - RNA, 22 nt, Streptococcus pyogenes M1 GAS
uguuuuggccaauaaaauaucu

SEQ ID NO: 2212438 - RNA, 20 nt, Streptococcus pyogenes M1 GAS
uguuuuuucaacaaauccuu

SEQ ID NO: 2212439 - RNA, 15 nt, Streptococcus pyogenes M1 GAS
uuaaaauagaagaca

SEQ ID NO: 2212440 - RNA, 18 nt, Streptococcus pyogenes M1 GAS
uuaaaagggucaguuugu

SEQ ID NO: 2212441 - RNA, 19 nt, Streptococcus pyogenes M1 GAS
uuaaaagaugucgcaaagg

SEQ ID NO: 2212442 - RNA, 12 nt, Streptococcus pyogenes M1 GAS
uuaaaagaaaau

SEQ ID NO: 2212443 - RNA, 15 nt, Streptococcus pyogenes M1 GAS
uguuuauuuauaauu

SEQ ID NO: 2212444 - RNA, 13 nt, Streptococcus pyogenes M1 GAS
uguuuauuccaaa

SEQ ID NO: 2212445 - RNA, 14 nt, Streptococcus pyogenes M1 GAS
uguuuaagauggug

SEQ ID NO: 2212446 - RNA, 16 nt, Streptococcus pyogenes M1 GAS
uguuuugauaaaaaac

SEQ ID NO: 2212447 - RNA, 21 nt, Streptococcus pyogenes M1 GAS
uguuugugauggucuugcucu

SEQ ID NO: 2212448 - RNA, 16 nt, Streptococcus pyogenes M1 GAS
uggaugaaaguaacau

SEQ ID NO: 2212449 - RNA, 23 nt, Streptococcus pyogenes M1 GAS
uggauuaaaugcccaagaugggu

SEQ ID NO: 2212450 - RNA, 20 nt, Streptococcus pyogenes M1 GAS
uggacgucuucuuuuuauua

SEQ ID NO: 2212451 - RNA, 21 nt, Streptococcus pyogenes M1 GAS
uggagagauuucguugacaaa

SEQ ID NO: 2212452 - RNA, 19 nt, Streptococcus pyogenes M1 GAS
uggagcuuuaguugcuucu

SEQ ID NO: 2212453 - RNA, 23 nt, Streptococcus pyogenes M1 GAS
uggagcuuuaguugcuucuuuua

SEQ ID NO: 2212454 - RNA, 18 nt, Streptococcus pyogenes M1 GAS
uggagcuuuaguugcuuc

SEQ ID NO: 2212455 - RNA, 23 nt, Streptococcus pyogenes M1 GAS
uggccuucuagucggacuuggua

SEQ ID NO: 2212456 - RNA, 16 nt, Streptococcus pyogenes M1 GAS
uggccuucuuggaaaa

SEQ ID NO: 2212457 - RNA, 21 nt, Streptococcus pyogenes M1 GAS
uggccaauaaaauaucuagaa

SEQ ID NO: 2212458 - RNA, 24 nt, Streptococcus pyogenes M1 GAS
uguaauuucuugugcuaaucuauc

SEQ ID NO: 2212459 - RNA, 12 nt, Streptococcus pyogenes M1 GAS
uguaauaacaaa

SEQ ID NO: 2212460 - RNA, 23 nt, Streptococcus pyogenes M1 GAS
uguaauaacaaaaugaagcaaaa

SEQ ID NO: 2212461 - RNA, 20 nt, Streptococcus pyogenes M1 GAS
uguaacgcuuguuuaugaaa

SEQ ID NO: 2212462 - RNA, 19 nt, Streptococcus pyogenes M1 GAS
uguaacgcuuguuuaugaa

SEQ ID NO: 2212463 - RNA, 21 nt, Streptococcus pyogenes M1 GAS
uguaacuguagcguuuguguu

SEQ ID NO: 2212464 - RNA, 17 nt, Streptococcus pyogenes M1 GAS
uguaaauagauaauguu

SEQ ID NO: 2212465 - RNA, 19 nt, Streptococcus pyogenes M1 GAS
uguaaaucaguagugauga

SEQ ID NO: 2212466 - RNA, 12 nt, Streptococcus pyogenes M1 GAS
uguaaaaugaua

SEQ ID NO: 2212467 - RNA, 15 nt, Streptococcus pyogenes M1 GAS
uguaggacacuuuga

SEQ ID NO: 2212468 - RNA, 14 nt, Streptococcus pyogenes M1 GAS
uguagccugugcag

SEQ ID NO: 2212469 - RNA, 13 nt, Streptococcus pyogenes M1 GAS
uguauagguagau

SEQ ID NO: 2212470 - RNA, 13 nt, Streptococcus pyogenes M1 GAS
uguauacaaaaag

SEQ ID NO: 2212471 - RNA, 21 nt, Streptococcus pyogenes M1 GAS
uguauauuuaauagcauuguc

SEQ ID NO: 2212472 - RNA, 21 nt, Streptococcus pyogenes M1 GAS
uguaucaagagucauuugacu

SEQ ID NO: 2212473 - RNA, 20 nt, Streptococcus pyogenes M1 GAS
uguaucucauaacaaauuua

SEQ ID NO: 2212474 - RNA, 15 nt, Streptococcus pyogenes M1 GAS
ugucaaaaaguaaaa

SEQ ID NO: 2212475 - RNA, 19 nt, Streptococcus pyogenes M1 GAS
uguauuuuuuucuaguucg

SEQ ID NO: 2212476 - RNA, 15 nt, Streptococcus pyogenes M1 GAS
ugggcaguaguuuua

SEQ ID NO: 2212477 - RNA, 18 nt, Streptococcus pyogenes M1 GAS
ugggauauuuagauggua

SEQ ID NO: 2212478 - RNA, 21 nt, Streptococcus pyogenes M1 GAS
uggcuuuuuugcuuuuuaauu

SEQ ID NO: 2212479 - RNA, 20 nt, Streptococcus pyogenes M1 GAS
ucugcuucuuacuaugaaaa

SEQ ID NO: 2212480 - RNA, 15 nt, Streptococcus pyogenes M1 GAS
ucuggucccacaccu

SEQ ID NO: 2212481 - RNA, 21 nt, Streptococcus pyogenes M1 GAS
ucugugaugaaucauuuugga

SEQ ID NO: 2212482 - RNA, 18 nt, Streptococcus pyogenes M1 GAS
ucuuaaauaugacuaaac

SEQ ID NO: 2212483 - RNA, 21 nt, Streptococcus pyogenes M1 GAS
ucuuaaaagaaaaucuaauca

SEQ ID NO: 2212484 - RNA, 16 nt, Streptococcus pyogenes M1 GAS
ucuguuucuaagcaaa

SEQ ID NO: 2212485 - RNA, 17 nt, Streptococcus pyogenes M1 GAS
ucugcagucuuuuucau

SEQ ID NO: 2212486 - RNA, 18 nt, Streptococcus pyogenes M1 GAS
ucugcagucuuuuucauu

SEQ ID NO: 2212487 - RNA, 12 nt, Streptococcus pyogenes M1 GAS
ucugaauuauua

SEQ ID NO: 2212488 - RNA, 15 nt, Streptococcus pyogenes M1 GAS
ucugagcgguuuugu

SEQ ID NO: 2212489 - RNA, 22 nt, Streptococcus pyogenes M1 GAS
ucuucugaugcguuuauaaagu

SEQ ID NO: 2212490 - RNA, 15 nt, Streptococcus pyogenes M1 GAS
ucuucugcauuauca

SEQ ID NO: 2212491 - RNA, 19 nt, Streptococcus pyogenes M1 GAS
ucuucuuuuuauuauacuc

SEQ ID NO: 2212492 - RNA, 23 nt, Streptococcus pyogenes M1 GAS
ucuucuuuuuauuauacucaaua

SEQ ID NO: 2212493 - RNA, 14 nt, Streptococcus pyogenes M1 GAS
ucuuuaccauuuau

SEQ ID NO: 2212494 - RNA, 16 nt, Streptococcus pyogenes M1 GAS
ucuuguagaauuucaa

SEQ ID NO: 2212495 - RNA, 19 nt, Streptococcus pyogenes M1 GAS
ucuugucgcugaauaaaca

SEQ ID NO: 2212496 - RNA, 14 nt, Streptococcus pyogenes M1 GAS
ucuugcauuaccuu

SEQ ID NO: 2212497 - RNA, 22 nt, Streptococcus pyogenes M1 GAS
ucuucuaaaaugaugagauuaa

SEQ ID NO: 2212498 - RNA, 14 nt, Streptococcus pyogenes M1 GAS
ucuucuaaacguuu

SEQ ID NO: 2212499 - RNA, 19 nt, Streptococcus pyogenes M1 GAS
ucgucugcaaguucuuugc

SEQ ID NO: 2212500 - RNA, 17 nt, Streptococcus pyogenes M1 GAS
ucgucuuuguccauuuu

SEQ ID NO: 2212501 - RNA, 13 nt, Streptococcus pyogenes M1 GAS
ucguguuaagacc

SEQ ID NO: 2212502 - RNA, 18 nt, Streptococcus pyogenes M1 GAS
ucguuuugcaauuaagua

SEQ ID NO: 2212503 - RNA, 11 nt, Streptococcus pyogenes M1 GAS
ucuaaaauaua

SEQ ID NO: 2212504 - RNA, 14 nt, Streptococcus pyogenes M1 GAS
ucuaaaauauauug

SEQ ID NO: 2212505 - RNA, 19 nt, Streptococcus pyogenes M1 GAS
ucuaauuagcauauuuuga

SEQ ID NO: 2212506 - RNA, 22 nt, Streptococcus pyogenes M1 GAS
ucuaaucagaacucgucuuuau

SEQ ID NO: 2212507 - RNA, 12 nt, Streptococcus pyogenes M1 GAS
ucuaaucagaac

SEQ ID NO: 2212508 - RNA, 15 nt, Streptococcus pyogenes M1 GAS
ucuacagcaccuuca

SEQ ID NO: 2212509 - RNA, 17 nt, Streptococcus pyogenes M1 GAS
ucuagcucuuuaucacc

SEQ ID NO: 2212510 - RNA, 14 nt, Streptococcus pyogenes M1 GAS
ucuagcuugugagg

SEQ ID NO: 2212511 - RNA, 16 nt, Streptococcus pyogenes M1 GAS
ucuagucuuuuuaugu

SEQ ID NO: 2212512 - RNA, 22 nt, Streptococcus pyogenes M1 GAS
ucuaguucguucauaaauucua

SEQ ID NO: 2212513 - RNA, 16 nt, Streptococcus pyogenes M1 GAS
ucuagaacagcugcuu

SEQ ID NO: 2212514 - RNA, 20 nt, Streptococcus pyogenes M1 GAS
ucuagacucuagcauaaaag

SEQ ID NO: 2212515 - RNA, 22 nt, Streptococcus pyogenes M1 GAS
ucuauagcauuaaggauuauga

SEQ ID NO: 2212516 - RNA, 13 nt, Streptococcus pyogenes M1 GAS
ucuauaucuauga

SEQ ID NO: 2212517 - RNA, 12 nt, Streptococcus pyogenes M1 GAS
ucuaucaaaacg

SEQ ID NO: 2212518 - RNA, 15 nt, Streptococcus pyogenes M1 GAS
ucuaucaaaacguua

SEQ ID NO: 2212519 - RNA, 12 nt, Streptococcus pyogenes M1 GAS
ucuaucugcaga

SEQ ID NO: 2212520 - RNA, 20 nt, Streptococcus pyogenes M1 GAS
ucucaaaaauauauucuaau

SEQ ID NO: 2212521 - RNA, 15 nt, Streptococcus pyogenes M1 GAS
ucuauuuuaaguaaa

SEQ ID NO: 2212522 - RNA, 16 nt, Streptococcus pyogenes M1 GAS
ucucauaacaaauuua

SEQ ID NO: 2212523 - RNA, 21 nt, Streptococcus pyogenes M1 GAS
ucuccaaaguucuucuaaacg

SEQ ID NO: 2212524 - RNA, 12 nt, Streptococcus pyogenes M1 GAS
uccguuugagau

SEQ ID NO: 2212525 - RNA, 17 nt, Streptococcus pyogenes M1 GAS
uccuagacugugaaagu

SEQ ID NO: 2212526 - RNA, 18 nt, Streptococcus pyogenes M1 GAS
uccuagacugugaaagua

SEQ ID NO: 2212527 - RNA, 18 nt, Streptococcus pyogenes M1 GAS
uccuaaccuuuuggcugu

SEQ ID NO: 2212528 - RNA, 19 nt, Streptococcus pyogenes M1 GAS
uccuccucuuuuuuuuauc

SEQ ID NO: 2212529 - RNA, 19 nt, Streptococcus pyogenes M1 GAS
uccucgguuuuuuuaagua

SEQ ID NO: 2212530 - RNA, 13 nt, Streptococcus pyogenes M1 GAS
uccucuuuuaauu

SEQ ID NO: 2212531 - RNA, 14 nt, Streptococcus pyogenes M1 GAS
uccucugaaaaguu

SEQ ID NO: 2212532 - RNA, 23 nt, Streptococcus pyogenes M1 GAS
ucgacauuuaugcugauuuugga

SEQ ID NO: 2212533 - RNA, 17 nt, Streptococcus pyogenes M1 GAS
ucgccuaggaauaaaau

SEQ ID NO: 2212534 - RNA, 17 nt, Streptococcus pyogenes M1 GAS
ucggaaauugaccaaaa

SEQ ID NO: 2212535 - RNA, 20 nt, Streptococcus pyogenes M1 GAS
uccgaucuuuuggaccacuc

SEQ ID NO: 2212536 - RNA, 16 nt, Streptococcus pyogenes M1 GAS
uccgaaaaaaacuugc

SEQ ID NO: 2212537 - RNA, 16 nt, Streptococcus pyogenes M1 GAS
ucccuucauuuuacua

SEQ ID NO: 2212538 - RNA, 16 nt, Streptococcus pyogenes M1 GAS
ucccuacuaggcuuuc

SEQ ID NO: 2212539 - RNA, 15 nt, Streptococcus pyogenes M1 GAS
uccauuuuuuauaau

SEQ ID NO: 2212540 - RNA, 15 nt, Streptococcus pyogenes M1 GAS
uccauuauaaaucuu

SEQ ID NO: 2212541 - RNA, 18 nt, Streptococcus pyogenes M1 GAS
uccauuauaaaucuuacu

SEQ ID NO: 2212542 - RNA, 13 nt, Streptococcus pyogenes M1 GAS
uccauuauaaauc

SEQ ID NO: 2212543 - RNA, 13 nt, Streptococcus pyogenes M1 GAS
uccaugauugauu

SEQ ID NO: 2212544 - RNA, 16 nt, Streptococcus pyogenes M1 GAS
uccaugauugauuuua

SEQ ID NO: 2212545 - RNA, 20 nt, Streptococcus pyogenes M1 GAS
ucccagcagcaaaggcgauu

SEQ ID NO: 2212546 - RNA, 14 nt, Streptococcus pyogenes M1 GAS
ucccauaucucuau

SEQ ID NO: 2212547 - RNA, 18 nt, Streptococcus pyogenes M1 GAS
uccaccggucgauggguc

SEQ ID NO: 2212548 - RNA, 18 nt, Streptococcus pyogenes M1 GAS
uccaaucuuucauuagcu

SEQ ID NO: 2212549 - RNA, 17 nt, Streptococcus pyogenes M1 GAS
uccaagaucugcacaca

SEQ ID NO: 2212550 - RNA, 19 nt, Streptococcus pyogenes M1 GAS
uccaagaucugcacacacu

SEQ ID NO: 2212551 - RNA, 22 nt, Streptococcus pyogenes M1 GAS
uccaguucuguuucuaagcaaa

SEQ ID NO: 2212552 - RNA, 13 nt, Streptococcus pyogenes M1 GAS
uccauauaauuuu

SEQ ID NO: 2212553 - RNA, 15 nt, Streptococcus pyogenes M1 GAS
uccauaauaucagcu

SEQ ID NO: 2212554 - RNA, 14 nt, Streptococcus pyogenes M1 GAS
ucauuuucuucuug

SEQ ID NO: 2212555 - RNA, 14 nt, Streptococcus pyogenes M1 GAS
ucauuuugguugau

SEQ ID NO: 2212556 - RNA, 18 nt, Streptococcus pyogenes M1 GAS
uccaaacauccaaucacc

SEQ ID NO: 2212557 - RNA, 12 nt, Streptococcus pyogenes M1 GAS
uccaaaauacau

SEQ ID NO: 2212558 - RNA, 18 nt, Streptococcus pyogenes M1 GAS
uccaacaacgcuauuuuu

SEQ ID NO: 2212559 - RNA, 18 nt, Streptococcus pyogenes M1 GAS
ucauuaaagcuaucauac

SEQ ID NO: 2212560 - RNA, 21 nt, Streptococcus pyogenes M1 GAS
ucauggagucaaugaaaaguu

SEQ ID NO: 2212561 - RNA, 19 nt, Streptococcus pyogenes M1 GAS
ucaugugcuaucauggagu

SEQ ID NO: 2212562 - RNA, 12 nt, Streptococcus pyogenes M1 GAS
ucauuauagacu

SEQ ID NO: 2212563 - RNA, 22 nt, Streptococcus pyogenes M1 GAS
ucaugacgccuccaaauacugg

SEQ ID NO: 2212564 - RNA, 18 nt, Streptococcus pyogenes M1 GAS
ucaucuugccaucagcau

SEQ ID NO: 2212565 - RNA, 12 nt, Streptococcus pyogenes M1 GAS
ucaucuaaaaaa

SEQ ID NO: 2212566 - RNA, 16 nt, Streptococcus pyogenes M1 GAS
ucaucagaauaagaaa

SEQ ID NO: 2212567 - RNA, 21 nt, Streptococcus pyogenes M1 GAS
ucauacucaauagcugcugcu

SEQ ID NO: 2212568 - RNA, 19 nt, Streptococcus pyogenes M1 GAS
ucauacucaauagcugcug

SEQ ID NO: 2212569 - RNA, 15 nt, Streptococcus pyogenes M1 GAS
ucauaacuugucaag

SEQ ID NO: 2212570 - RNA, 12 nt, Streptococcus pyogenes M1 GAS
ucauauuccaua

SEQ ID NO: 2212571 - RNA, 14 nt, Streptococcus pyogenes M1 GAS
ucaucaaaagacca

SEQ ID NO: 2212572 - RNA, 16 nt, Streptococcus pyogenes M1 GAS
ucaucaaaagaccaua

SEQ ID NO: 2212573 - RNA, 21 nt, Streptococcus pyogenes M1 GAS
ucaucaaaagaccauaaaaaa

SEQ ID NO: 2212574 - RNA, 17 nt, Streptococcus pyogenes M1 GAS
ucaucaagaauagcuuu

SEQ ID NO: 2212575 - RNA, 21 nt, Streptococcus pyogenes M1 GAS
ucauaaacaaugagucaccug

SEQ ID NO: 2212576 - RNA, 15 nt, Streptococcus pyogenes M1 GAS
ucaguuuuuuugauu

SEQ ID NO: 2212577 - RNA, 18 nt, Streptococcus pyogenes M1 GAS
ucagucuguccaauaccu

SEQ ID NO: 2212578 - RNA, 17 nt, Streptococcus pyogenes M1 GAS
ucaguccuccucuuuag

SEQ ID NO: 2212579 - RNA, 23 nt, Streptococcus pyogenes M1 GAS
ucaguaaucuaaagcaucagcau

SEQ ID NO: 2212580 - RNA, 21 nt, Streptococcus pyogenes M1 GAS
ucagcucuugcuugucuuuuu

SEQ ID NO: 2212581 - RNA, 16 nt, Streptococcus pyogenes M1 GAS
ucagcuagacuauaaa

SEQ ID NO: 2212582 - RNA, 17 nt, Streptococcus pyogenes M1 GAS
ucagcuagacuauaaaa

SEQ ID NO: 2212583 - RNA, 14 nt, Streptococcus pyogenes M1 GAS
ucaggcaaaacaaa

SEQ ID NO: 2212584 - RNA, 15 nt, Streptococcus pyogenes M1 GAS
ucaggggguaaaaaa

SEQ ID NO: 2212585 - RNA, 19 nt, Streptococcus pyogenes M1 GAS
ggcaccugaggcaauggcu

SEQ ID NO: 2212586 - RNA, 16 nt, Streptococcus pyogenes M1 GAS
ggcaauggcugagcca

SEQ ID NO: 2212587 - RNA, 20 nt, Streptococcus pyogenes M1 GAS
ggaccaugccuaaagcccau

SEQ ID NO: 2212588 - RNA, 22 nt, Streptococcus pyogenes M1 GAS
ggacacuuugaaaguuccuuag

SEQ ID NO: 2212589 - RNA, 16 nt, Streptococcus pyogenes M1 GAS
ggccaauaaaauaucu

SEQ ID NO: 2212590 - RNA, 14 nt, Streptococcus pyogenes M1 GAS
ggccccuuuuuuga

SEQ ID NO: 2212591 - RNA, 19 nt, Streptococcus pyogenes M1 GAS
ggcuacucuauuugaagua

SEQ ID NO: 2212592 - RNA, 20 nt, Streptococcus pyogenes M1 GAS
ggccuucuagucggacuugg

SEQ ID NO: 2212593 - RNA, 17 nt, Streptococcus pyogenes M1 GAS
ggccuucuaucaaaacg

SEQ ID NO: 2212594 - RNA, 23 nt, Streptococcus pyogenes M1 GAS
gucaggggaauuuccuaauguaa

SEQ ID NO: 2212595 - RNA, 21 nt, Streptococcus pyogenes M1 GAS
gucaugugcuaucauggaguc

SEQ ID NO: 2212596 - RNA, 20 nt, Streptococcus pyogenes M1 GAS
gucauacucaauagcugcug

SEQ ID NO: 2212597 - RNA, 20 nt, Streptococcus pyogenes M1 GAS
gucaauuuagccguccuuaa

SEQ ID NO: 2212598 - RNA, 19 nt, Streptococcus pyogenes M1 GAS
gucaacuuaccagcaccuu

SEQ ID NO: 2212599 - RNA, 14 nt, Streptococcus pyogenes M1 GAS
guauacaaaaaggc

SEQ ID NO: 2212600 - RNA, 17 nt, Streptococcus pyogenes M1 GAS
guauacaucaacuauca

SEQ ID NO: 2212601 - RNA, 13 nt, Streptococcus pyogenes M1 GAS
guauuuuuuucua

SEQ ID NO: 2212602 - RNA, 22 nt, Streptococcus pyogenes M1 GAS
gucaaaaaauuaagaaggaacu

SEQ ID NO: 2212603 - RNA, 17 nt, Streptococcus pyogenes M1 GAS
gucaaaagcuaaacuag

SEQ ID NO: 2212604 - RNA, 13 nt, Streptococcus pyogenes M1 GAS
guccaugauuuuc

SEQ ID NO: 2212605 - RNA, 23 nt, Streptococcus pyogenes M1 GAS
gucauuucuucagguuucuuuug

SEQ ID NO: 2212606 - RNA, 17 nt, Streptococcus pyogenes M1 GAS
guccaucauugaugaga

SEQ ID NO: 2212607 - RNA, 19 nt, Streptococcus pyogenes M1 GAS
guccuaaccuuuuggcugu

SEQ ID NO: 2212608 - RNA, 17 nt, Streptococcus pyogenes M1 GAS
guccuuaaaagaaaauc

SEQ ID NO: 2212609 - RNA, 18 nt, Streptococcus pyogenes M1 GAS
guccuuaaaagaaaaucu

SEQ ID NO: 2212610 - RNA, 22 nt, Streptococcus pyogenes M1 GAS
guagcguuuguguugaagaagg

SEQ ID NO: 2212611 - RNA, 17 nt, Streptococcus pyogenes M1 GAS
guacggucauuaauaaa

SEQ ID NO: 2212612 - RNA, 19 nt, Streptococcus pyogenes M1 GAS
guacucaucuaaaaaagca

SEQ ID NO: 2212613 - RNA, 20 nt, Streptococcus pyogenes M1 GAS
guaauggugaccgguuucuu

SEQ ID NO: 2212614 - RNA, 11 nt, Streptococcus pyogenes M1 GAS
guaaaaugacu

SEQ ID NO: 2212615 - RNA, 13 nt, Streptococcus pyogenes M1 GAS
gguuaaaauagaa

SEQ ID NO: 2212616 - RNA, 22 nt, Streptococcus pyogenes M1 GAS
guaaauauaaagucagacuuaa

SEQ ID NO: 2212617 - RNA, 21 nt, Streptococcus pyogenes M1 GAS
guaaaguuaggaaagauagua

SEQ ID NO: 2212618 - RNA, 21 nt, Streptococcus pyogenes M1 GAS
guaaaggauuuaguucuguau

SEQ ID NO: 2212619 - RNA, 22 nt, Streptococcus pyogenes M1 GAS
guaaaggauuuaguuuuguauu

SEQ ID NO: 2212620 - RNA, 20 nt, Streptococcus pyogenes M1 GAS
guaaccauagaagccaauua

SEQ ID NO: 2212621 - RNA, 23 nt, Streptococcus pyogenes M1 GAS
guaacaugcccauugaugaguuu

SEQ ID NO: 2212622 - RNA, 20 nt, Streptococcus pyogenes M1 GAS
guaacguaauagaauaaaaa

SEQ ID NO: 2212623 - RNA, 19 nt, Streptococcus pyogenes M1 GAS
guaacgcuuguuuaugaaa

SEQ ID NO: 2212624 - RNA, 17 nt, Streptococcus pyogenes M1 GAS
guaacgcuuguuuauga

SEQ ID NO: 2212625 - RNA, 13 nt, Streptococcus pyogenes M1 GAS
guaagaaagacuu

SEQ ID NO: 2212626 - RNA, 16 nt, Streptococcus pyogenes M1 GAS
guaagaaauuacuugg

SEQ ID NO: 2212627 - RNA, 18 nt, Streptococcus pyogenes M1 GAS
guaauauuuccuuuuaaa

SEQ ID NO: 2212628 - RNA, 17 nt, Streptococcus pyogenes M1 GAS
guaauagcguaaagcaa

SEQ ID NO: 2212629 - RNA, 20 nt, Streptococcus pyogenes M1 GAS
guaaggaaaucaauccugua

SEQ ID NO: 2212630 - RNA, 18 nt, Streptococcus pyogenes M1 GAS
guaagccaaaucuucugc

SEQ ID NO: 2212631 - RNA, 13 nt, Streptococcus pyogenes M1 GAS
guaagccaaaucu

SEQ ID NO: 2212632 - RNA, 21 nt, Streptococcus pyogenes M1 GAS
guaagcuccaacgaccuccag

SEQ ID NO: 2212633 - RNA, 23 nt, Streptococcus pyogenes M1 GAS
guaagcuccaacgaccuccagcu

SEQ ID NO: 2212634 - RNA, 19 nt, Streptococcus pyogenes M1 GAS
ggugaguuuuuucuaaaag

SEQ ID NO: 2212635 - RNA, 20 nt, Streptococcus pyogenes M1 GAS
gguaaaaacucaaaaaauac

SEQ ID NO: 2212636 - RNA, 23 nt, Streptococcus pyogenes M1 GAS
gguagcauauugccacuaccuga

SEQ ID NO: 2212637 - RNA, 19 nt, Streptococcus pyogenes M1 GAS
gguagguuugaaacauaug

SEQ ID NO: 2212638 - RNA, 17 nt, Streptococcus pyogenes M1 GAS
ggcucauauuagcaaaa

SEQ ID NO: 2212639 - RNA, 18 nt, Streptococcus pyogenes M1 GAS
ggcucgacaaaggcugcc

SEQ ID NO: 2212640 - RNA, 13 nt, Streptococcus pyogenes M1 GAS
ggcuuaaacauau

SEQ ID NO: 2212641 - RNA, 12 nt, Streptococcus pyogenes M1 GAS
ggcuuuuuugcu

SEQ ID NO: 2212642 - RNA, 16 nt, Streptococcus pyogenes M1 GAS
ggcuucuaaaaaaguu

SEQ ID NO: 2212643 - RNA, 15 nt, Streptococcus pyogenes M1 GAS
uaauuaguauauugu

SEQ ID NO: 2212644 - RNA, 15 nt, Streptococcus pyogenes M1 GAS
uaauuagcauauuuu

SEQ ID NO: 2212645 - RNA, 19 nt, Streptococcus pyogenes M1 GAS
uaauuccugugacaaccca

SEQ ID NO: 2212646 - RNA, 24 nt, Streptococcus pyogenes M1 GAS
uaauguuguuuuuggaucgcugug

SEQ ID NO: 2212647 - RNA, 20 nt, Streptococcus pyogenes M1 GAS
uaaucguaaugucuuguucu

SEQ ID NO: 2212648 - RNA, 18 nt, Streptococcus pyogenes M1 GAS
uaaucguaaugucuuguu

SEQ ID NO: 2212649 - RNA, 15 nt, Streptococcus pyogenes M1 GAS
uaaucguaaugucuu

SEQ ID NO: 2212650 - RNA, 18 nt, Streptococcus pyogenes M1 GAS
uaaucgagagauuauucu

SEQ ID NO: 2212651 - RNA, 20 nt, Streptococcus pyogenes M1 GAS
uaaucaaaaaacugagacaa

SEQ ID NO: 2212652 - RNA, 13 nt, Streptococcus pyogenes M1 GAS
uaauagaauaaaa

SEQ ID NO: 2212653 - RNA, 14 nt, Streptococcus pyogenes M1 GAS
uaaggguuaacaau

SEQ ID NO: 2212654 - RNA, 17 nt, Streptococcus pyogenes M1 GAS
uaaggcugcgaugauuu

SEQ ID NO: 2212655 - RNA, 13 nt, Streptococcus pyogenes M1 GAS
uaaggauuuagcu

SEQ ID NO: 2212656 - RNA, 15 nt, Streptococcus pyogenes M1 GAS
uaaggaccaagauuc

SEQ ID NO: 2212657 - RNA, 14 nt, Streptococcus pyogenes M1 GAS
uaaguaauguguug

SEQ ID NO: 2212658 - RNA, 18 nt, Streptococcus pyogenes M1 GAS
uaaguaaaggauuuaguu

SEQ ID NO: 2212659 - RNA, 18 nt, Streptococcus pyogenes M1 GAS
uaaguccuuuucguuuua

SEQ ID NO: 2212660 - RNA, 15 nt, Streptococcus pyogenes M1 GAS
uaaguauucuaaaau

SEQ ID NO: 2212661 - RNA, 20 nt, Streptococcus pyogenes M1 GAS
uaaguugaaugaguuagucu

SEQ ID NO: 2212662 - RNA, 15 nt, Streptococcus pyogenes M1 GAS
uaaguuuuuaucaua

SEQ ID NO: 2212663 - RNA, 17 nt, Streptococcus pyogenes M1 GAS
uaaguuuuuaucauauu

SEQ ID NO: 2212664 - RNA, 15 nt, Streptococcus pyogenes M1 GAS
uaauaaacuguauac

SEQ ID NO: 2212665 - RNA, 15 nt, Streptococcus pyogenes M1 GAS
uaauaacaaaaugaa

SEQ ID NO: 2212666 - RNA, 12 nt, Streptococcus pyogenes M1 GAS
uaauaagauuca

SEQ ID NO: 2212667 - RNA, 15 nt, Streptococcus pyogenes M1 GAS
uaauaagauucaaua

SEQ ID NO: 2212668 - RNA, 21 nt, Streptococcus pyogenes M1 GAS
uaauaaguauucuaaaauccu

SEQ ID NO: 2212669 - RNA, 19 nt, Streptococcus pyogenes M1 GAS
uaauacguuuauuuaguua

SEQ ID NO: 2212670 - RNA, 16 nt, Streptococcus pyogenes M1 GAS
uaauacgagcuagggc

SEQ ID NO: 2212671 - RNA, 10 nt, Streptococcus pyogenes M1 GAS
uacuaacuau

SEQ ID NO: 2212672 - RNA, 20 nt, Streptococcus pyogenes M1 GAS
uacuaacuauuuuuaccuuu

SEQ ID NO: 2212673 - RNA, 18 nt, Streptococcus pyogenes M1 GAS
uaccccaaaggcugaugc

SEQ ID NO: 2212674 - RNA, 14 nt, Streptococcus pyogenes M1 GAS
uaccauuucuuugc

SEQ ID NO: 2212675 - RNA, 16 nt, Streptococcus pyogenes M1 GAS
uaccauuucuuugcaa

SEQ ID NO: 2212676 - RNA, 17 nt, Streptococcus pyogenes M1 GAS
uaccuaaaaaauaacuu

SEQ ID NO: 2212677 - RNA, 21 nt, Streptococcus pyogenes M1 GAS
uaccguuaguauuagcaccag

SEQ ID NO: 2212678 - RNA, 14 nt, Streptococcus pyogenes M1 GAS
uacaucaaaaaaag

SEQ ID NO: 2212679 - RNA, 16 nt, Streptococcus pyogenes M1 GAS
uacaucaaaaaaagca

SEQ ID NO: 2212680 - RNA, 13 nt, Streptococcus pyogenes M1 GAS
uacaucaaaaaaa

SEQ ID NO: 2212681 - RNA, 19 nt, Streptococcus pyogenes M1 GAS
uacauugaauaaagugaua

SEQ ID NO: 2212682 - RNA, 21 nt, Streptococcus pyogenes M1 GAS
uacauugagaauuuuuauaac

SEQ ID NO: 2212683 - RNA, 15 nt, Streptococcus pyogenes M1 GAS
uaccaaaucaaaaag

SEQ ID NO: 2212684 - RNA, 17 nt, Streptococcus pyogenes M1 GAS
uacaaucgguuuuagcu

SEQ ID NO: 2212685 - RNA, 19 nt, Streptococcus pyogenes M1 GAS
uacaaaggauaugaggguc

SEQ ID NO: 2212686 - RNA, 13 nt, Streptococcus pyogenes M1 GAS
uacacuugauuuc

SEQ ID NO: 2212687 - RNA, 19 nt, Streptococcus pyogenes M1 GAS
uagacaaacagaaauacuc

SEQ ID NO: 2212688 - RNA, 23 nt, Streptococcus pyogenes M1 GAS
uagaauucuuagguggagcuuua

SEQ ID NO: 2212689 - RNA, 18 nt, Streptococcus pyogenes M1 GAS
uagaauuucaaguucucu

SEQ ID NO: 2212690 - RNA, 15 nt, Streptococcus pyogenes M1 GAS
uagaauaaaaagacu

SEQ ID NO: 2212691 - RNA, 13 nt, Streptococcus pyogenes M1 GAS
uagaauaaaaaga

SEQ ID NO: 2212692 - RNA, 14 nt, Streptococcus pyogenes M1 GAS
uagaauaaaaagac

SEQ ID NO: 2212693 - RNA, 13 nt, Streptococcus pyogenes M1 GAS
uacuaugaaaaaa

SEQ ID NO: 2212694 - RNA, 21 nt, Streptococcus pyogenes M1 GAS
uacuaggcuuucauuauagac

SEQ ID NO: 2212695 - RNA, 24 nt, Streptococcus pyogenes M1 GAS
uacuaguguguugucaaacauaac

SEQ ID NO: 2212696 - RNA, 16 nt, Streptococcus pyogenes M1 GAS
uacuagaaaaagcaau

SEQ ID NO: 2212697 - RNA, 19 nt, Streptococcus pyogenes M1 GAS
uacuagaaaaagcaaugau

SEQ ID NO: 2212698 - RNA, 15 nt, Streptococcus pyogenes M1 GAS
uagaaaguuauaaag

SEQ ID NO: 2212699 - RNA, 16 nt, Streptococcus pyogenes M1 GAS
uagauaaaaauggcug

SEQ ID NO: 2212700 - RNA, 19 nt, Streptococcus pyogenes M1 GAS
uagauaaaaauggcuguuu

SEQ ID NO: 2212701 - RNA, 12 nt, Streptococcus pyogenes M1 GAS
uagauaaaaaug

SEQ ID NO: 2212702 - RNA, 16 nt, Streptococcus pyogenes M1 GAS
uagagauagaucaauu

SEQ ID NO: 2212703 - RNA, 16 nt, Streptococcus pyogenes M1 GAS
uaggaauaucaugaag

SEQ ID NO: 2212704 - RNA, 18 nt, Streptococcus pyogenes M1 GAS
uaggaauaucaugaagua

SEQ ID NO: 2212705 - RNA, 21 nt, Streptococcus pyogenes M1 GAS
uaggauauagaauagguaaag

SEQ ID NO: 2212706 - RNA, 19 nt, Streptococcus pyogenes M1 GAS
uaggguagcugguuugauu

SEQ ID NO: 2212707 - RNA, 19 nt, Streptococcus pyogenes M1 GAS
uaggaaagauaguaaagaa

SEQ ID NO: 2212708 - RNA, 22 nt, Streptococcus pyogenes M1 GAS
uaggaaagauaguaaagaagaa

SEQ ID NO: 2212709 - RNA, 14 nt, Streptococcus pyogenes M1 GAS
uagcuuuuguaaua

SEQ ID NO: 2212710 - RNA, 23 nt, Streptococcus pyogenes M1 GAS
uagcuuuuuacaucaaaaaaagc

SEQ ID NO: 2212711 - RNA, 15 nt, Streptococcus pyogenes M1 GAS
uagcuuuuuaaagag

SEQ ID NO: 2212712 - RNA, 21 nt, Streptococcus pyogenes M1 GAS
uagcucaucccuacuaggcuu

SEQ ID NO: 2212713 - RNA, 19 nt, Streptococcus pyogenes M1 GAS
uagcaauggcuaaaaagag

SEQ ID NO: 2212714 - RNA, 17 nt, Streptococcus pyogenes M1 GAS
uagcaaguccugcuuuu

SEQ ID NO: 2212715 - RNA, 14 nt, Streptococcus pyogenes M1 GAS
uagcauauuuugau

SEQ ID NO: 2212716 - RNA, 22 nt, Streptococcus pyogenes M1 GAS
uagccaaagaaggccagcaagg

SEQ ID NO: 2212717 - RNA, 19 nt, Streptococcus pyogenes M1 GAS
uagcaccuuuuuuauugau

SEQ ID NO: 2212718 - RNA, 15 nt, Streptococcus pyogenes M1 GAS
uagcacguuggaaaa

SEQ ID NO: 2212719 - RNA, 18 nt, Streptococcus pyogenes M1 GAS
uagcacguuggaaaagga

SEQ ID NO: 2212720 - RNA, 19 nt, Streptococcus pyogenes M1 GAS
uagcacguuggaaaaggaa

SEQ ID NO: 2212721 - RNA, 21 nt, Streptococcus pyogenes M1 GAS
uagccagauggugcuacugau

SEQ ID NO: 2212722 - RNA, 22 nt, Streptococcus pyogenes M1 GAS
uagccugugcagugggcuuuuu

SEQ ID NO: 2212723 - RNA, 15 nt, Streptococcus pyogenes M1 GAS
uaucugauauuucau

SEQ ID NO: 2212724 - RNA, 18 nt, Streptococcus pyogenes M1 GAS
uaucugauaagguuuuuu

SEQ ID NO: 2212725 - RNA, 17 nt, Streptococcus pyogenes M1 GAS
uaucuaugauuuguauu

SEQ ID NO: 2212726 - RNA, 18 nt, Streptococcus pyogenes M1 GAS
uaucauggagucaaugaa

SEQ ID NO: 2212727 - RNA, 16 nt, Streptococcus pyogenes M1 GAS
uauaggugaguuuuuu

SEQ ID NO: 2212728 - RNA, 20 nt, Streptococcus pyogenes M1 GAS
uauagguagaugauuacauu

SEQ ID NO: 2212729 - RNA, 23 nt, Streptococcus pyogenes M1 GAS
uauagcuccuaaaaccauaccua

SEQ ID NO: 2212730 - RNA, 17 nt, Streptococcus pyogenes M1 GAS
uauauugugcuauucaa

SEQ ID NO: 2212731 - RNA, 16 nt, Streptococcus pyogenes M1 GAS
uaucaggcaaaacaaa

SEQ ID NO: 2212732 - RNA, 17 nt, Streptococcus pyogenes M1 GAS
uaucauauuccauauga

SEQ ID NO: 2212733 - RNA, 17 nt, Streptococcus pyogenes M1 GAS
uaguuuugcacugcuau

SEQ ID NO: 2212734 - RNA, 19 nt, Streptococcus pyogenes M1 GAS
uauaaaucuuacuaacuag

SEQ ID NO: 2212735 - RNA, 13 nt, Streptococcus pyogenes M1 GAS
uauaaacaaagcc

SEQ ID NO: 2212736 - RNA, 21 nt, Streptococcus pyogenes M1 GAS
uaguuaagcuugcuaagagaa

SEQ ID NO: 2212737 - RNA, 16 nt, Streptococcus pyogenes M1 GAS
uagugaauucuaaaau

SEQ ID NO: 2212738 - RNA, 17 nt, Streptococcus pyogenes M1 GAS
uagugugugugauguaa

SEQ ID NO: 2212739 - RNA, 14 nt, Streptococcus pyogenes M1 GAS
uagugguauagaca

SEQ ID NO: 2212740 - RNA, 15 nt, Streptococcus pyogenes M1 GAS
uagucuuuaaaaaac

SEQ ID NO: 2212741 - RNA, 20 nt, Streptococcus pyogenes M1 GAS
uagucuaggcguauagguga

SEQ ID NO: 2212742 - RNA, 18 nt, Streptococcus pyogenes M1 GAS
uauaaugguuuuuugucu

SEQ ID NO: 2212743 - RNA, 15 nt, Streptococcus pyogenes M1 GAS
uauaccuaaaaaaua

SEQ ID NO: 2212744 - RNA, 22 nt, Streptococcus pyogenes M1 GAS
uauacgguaaaaacucaaaaaa

SEQ ID NO: 2212745 - RNA, 14 nt, Streptococcus pyogenes M1 GAS
uauacuuuaaacac

SEQ ID NO: 2212746 - RNA, 13 nt, Streptococcus pyogenes M1 GAS
uauagcauaaaau

SEQ ID NO: 2212747 - RNA, 21 nt, Streptococcus pyogenes M1 GAS
uaagagcguuagcuuuuuaaa

SEQ ID NO: 2212748 - RNA, 12 nt, Streptococcus pyogenes M1 GAS
uaagagaauaac

SEQ ID NO: 2212749 - RNA, 23 nt, Streptococcus pyogenes M1 GAS
uaagagagguugguaaaaaggca

SEQ ID NO: 2212750 - RNA, 22 nt, Streptococcus pyogenes M1 GAS
uaagagagguugguaaaaaggc

SEQ ID NO: 2212751 - RNA, 17 nt, Streptococcus pyogenes M1 GAS
uaagacuauguugcuua

SEQ ID NO: 2212752 - RNA, 16 nt, Streptococcus pyogenes M1 GAS
uaagaaauuacuugga

SEQ ID NO: 2212753 - RNA, 17 nt, Streptococcus pyogenes M1 GAS
uaacuuuuagcuaagaa

SEQ ID NO: 2212754 - RNA, 19 nt, Streptococcus pyogenes M1 GAS
uaacuuuuagcuaagaaua

SEQ ID NO: 2212755 - RNA, 21 nt, Streptococcus pyogenes M1 GAS
uaacuuuuagcuaagaauaac

SEQ ID NO: 2212756 - RNA, 20 nt, Streptococcus pyogenes M1 GAS
uaagauuugaccacaccuaa

SEQ ID NO: 2212757 - RNA, 20 nt, Streptococcus pyogenes M1 GAS
uaagauuaaacuuacaaaaa

SEQ ID NO: 2212758 - RNA, 13 nt, Streptococcus pyogenes M1 GAS
uaagauucaauau

SEQ ID NO: 2212759 - RNA, 22 nt, Streptococcus pyogenes M1 GAS
uaagauguuuacgcuuuacauu

SEQ ID NO: 2212760 - RNA, 16 nt, Streptococcus pyogenes M1 GAS
uaagauggugcuuuaa

SEQ ID NO: 2212761 - RNA, 21 nt, Streptococcus pyogenes M1 GAS
uaagcaucauuauugacaaau

SEQ ID NO: 2212762 - RNA, 23 nt, Streptococcus pyogenes M1 GAS
uaagcagcaucacguacagaaau

SEQ ID NO: 2212763 - RNA, 15 nt, Streptococcus pyogenes M1 GAS
uaagcaaucaucauu

SEQ ID NO: 2212764 - RNA, 12 nt, Streptococcus pyogenes M1 GAS
uaagccaaaucu

SEQ ID NO: 2212765 - RNA, 15 nt, Streptococcus pyogenes M1 GAS
uaagcauuuugagaa

SEQ ID NO: 2212766 - RNA, 23 nt, Streptococcus pyogenes M1 GAS
uaaccucuuaguuguagagacua

SEQ ID NO: 2212767 - RNA, 17 nt, Streptococcus pyogenes M1 GAS
uaaccugcauaucugcc

SEQ ID NO: 2212768 - RNA, 16 nt, Streptococcus pyogenes M1 GAS
uaacgccagcuacauu

SEQ ID NO: 2212769 - RNA, 16 nt, Streptococcus pyogenes M1 GAS
uaacuaacagcaacau

SEQ ID NO: 2212770 - RNA, 20 nt, Streptococcus pyogenes M1 GAS
uaacuauuucacuuaucauu

SEQ ID NO: 2212771 - RNA, 13 nt, Streptococcus pyogenes M1 GAS
uaacugauaaaac

SEQ ID NO: 2212772 - RNA, 16 nt, Streptococcus pyogenes M1 GAS
uaacugauaaaacuca

SEQ ID NO: 2212773 - RNA, 23 nt, Streptococcus pyogenes M1 GAS
uaacugguccaucauugaugaga

SEQ ID NO: 2212774 - RNA, 17 nt, Streptococcus pyogenes M1 GAS
uaacagaaauuaauaaa

SEQ ID NO: 2212775 - RNA, 13 nt, Streptococcus pyogenes M1 GAS
uaacaaaaauaag

SEQ ID NO: 2212776 - RNA, 19 nt, Streptococcus pyogenes M1 GAS
uaacacgguuuucugucua

SEQ ID NO: 2212777 - RNA, 15 nt, Streptococcus pyogenes M1 GAS
uaaacuuacaaaaag

SEQ ID NO: 2212778 - RNA, 17 nt, Streptococcus pyogenes M1 GAS
uaaagaagaauuaacgu

SEQ ID NO: 2212779 - RNA, 17 nt, Streptococcus pyogenes M1 GAS
uaaaggccuguauuucu

SEQ ID NO: 2212780 - RNA, 21 nt, Streptococcus pyogenes M1 GAS
uaaagcuaucauacaacugac

SEQ ID NO: 2212781 - RNA, 14 nt, Streptococcus pyogenes M1 GAS
uaaagcaagggaaa

SEQ ID NO: 2212782 - RNA, 17 nt, Streptococcus pyogenes M1 GAS
uaaagcuaaguugaaug

SEQ ID NO: 2212783 - RNA, 17 nt, Streptococcus pyogenes M1 GAS
uaaacuguauacaaaaa

SEQ ID NO: 2212784 - RNA, 23 nt, Streptococcus pyogenes M1 GAS
uaaacauauuauaguaaccauug

SEQ ID NO: 2212785 - RNA, 20 nt, Streptococcus pyogenes M1 GAS
uaaacauauuauaguaacca

SEQ ID NO: 2212786 - RNA, 23 nt, Streptococcus pyogenes M1 GAS
uaaaggccuguauuucuuuagua

SEQ ID NO: 2212787 - RNA, 17 nt, Streptococcus pyogenes M1 GAS
uaaauccuuuugaaaaa

SEQ ID NO: 2212788 - RNA, 21 nt, Streptococcus pyogenes M1 GAS
uaaaauaucuagaacagcugc

SEQ ID NO: 2212789 - RNA, 19 nt, Streptococcus pyogenes M1 GAS
uaaaauccucuuuuaauuu

SEQ ID NO: 2212790 - RNA, 14 nt, Streptococcus pyogenes M1 GAS
uaaaauuuuaggua

SEQ ID NO: 2212791 - RNA, 23 nt, Streptococcus pyogenes M1 GAS
uaaacacuaccuuaaauguauga

SEQ ID NO: 2212792 - RNA, 14 nt, Streptococcus pyogenes M1 GAS
uaaaaccauaccua

SEQ ID NO: 2212793 - RNA, 18 nt, Streptococcus pyogenes M1 GAS
uaaaagauauuuuaaaau

SEQ ID NO: 2212794 - RNA, 20 nt, Streptococcus pyogenes M1 GAS
uaaaagauauuuuaaaauag

SEQ ID NO: 2212795 - RNA, 20 nt, Streptococcus pyogenes M1 GAS
uaaaagaugucgcaaaggcu

SEQ ID NO: 2212796 - RNA, 22 nt, Streptococcus pyogenes M1 GAS
uaaaaagguaucccauaucucu

SEQ ID NO: 2212797 - RNA, 20 nt, Streptococcus pyogenes M1 GAS
uaaaaagcaaauugaaaaaa

SEQ ID NO: 2212798 - RNA, 17 nt, Streptococcus pyogenes M1 GAS
uaaaaauacuagaaaaa

SEQ ID NO: 2212799 - RNA, 16 nt, Streptococcus pyogenes M1 GAS
uaaaaaguaaaaucuu

SEQ ID NO: 2212800 - RNA, 21 nt, Streptococcus pyogenes M1 GAS
uaaaaaguuucugaguugauu

SEQ ID NO: 2212801 - RNA, 18 nt, Streptococcus pyogenes M1 GAS
guuugauugauuugucuu

SEQ ID NO: 2212802 - RNA, 20 nt, Streptococcus pyogenes M1 GAS
uaaaaacgaucaaaaaucuu

SEQ ID NO: 2212803 - RNA, 16 nt, Streptococcus pyogenes M1 GAS
guuuaacguaauaaaa

SEQ ID NO: 2212804 - RNA, 18 nt, Streptococcus pyogenes M1 GAS
guuucuaguuucauagaa

SEQ ID NO: 2212805 - RNA, 14 nt, Streptococcus pyogenes M1 GAS
guuucgaaaaaggg

SEQ ID NO: 2212806 - RNA, 23 nt, Streptococcus pyogenes M1 GAS
guuggaggucugugaugaaucau

SEQ ID NO: 2212807 - RNA, 13 nt, Streptococcus pyogenes M1 GAS
guuguaaaaaggu

SEQ ID NO: 2212808 - RNA, 16 nt, Streptococcus pyogenes M1 GAS
guugacuuugcaaaag

SEQ ID NO: 2212809 - RNA, 19 nt, Streptococcus pyogenes M1 GAS
guugacuuugcaaaagaau

SEQ ID NO: 2212810 - RNA, 13 nt, Streptococcus pyogenes M1 GAS
guugcaauaaucg

SEQ ID NO: 2212811 - RNA, 16 nt, Streptococcus pyogenes M1 GAS
guugaugcaaauaguu

SEQ ID NO: 2212812 - RNA, 14 nt, Streptococcus pyogenes M1 GAS
guugacaacaauau

SEQ ID NO: 2212813 - RNA, 19 nt, Streptococcus pyogenes M1 GAS
guucauuuagugguauaga

SEQ ID NO: 2212814 - RNA, 20 nt, Streptococcus pyogenes M1 GAS
guucaggggguaaaaaaggg

SEQ ID NO: 2212815 - RNA, 21 nt, Streptococcus pyogenes M1 GAS
guuccuaugcuaacugauaaa

SEQ ID NO: 2212816 - RNA, 22 nt, Streptococcus pyogenes M1 GAS
guuaauauagucugcaugaagu

SEQ ID NO: 2212817 - RNA, 21 nt, Streptococcus pyogenes M1 GAS
gugucuuuucuuuuuggcuga

SEQ ID NO: 2212818 - RNA, 20 nt, Streptococcus pyogenes M1 GAS
guguuuaaagaccucucaug

SEQ ID NO: 2212819 - RNA, 16 nt, Streptococcus pyogenes M1 GAS
guguugucaaacauaa

SEQ ID NO: 2212820 - RNA, 21 nt, Streptococcus pyogenes M1 GAS
gugauguagggcuguaaaaug

SEQ ID NO: 2212821 - RNA, 24 nt, Streptococcus pyogenes M1 GAS
gugauguagggcuguaaaauguua

SEQ ID NO: 2212822 - RNA, 17 nt, Streptococcus pyogenes M1 GAS
gugauuaguuuuuagca

SEQ ID NO: 2212823 - RNA, 21 nt, Streptococcus pyogenes M1 GAS
gugaugaguaggcgaacuuua

SEQ ID NO: 2212824 - RNA, 17 nt, Streptococcus pyogenes M1 GAS
gugauggucuugcucuu

SEQ ID NO: 2212825 - RNA, 20 nt, Streptococcus pyogenes M1 GAS
gugcucauaaaacugugcuu

SEQ ID NO: 2212826 - RNA, 14 nt, Streptococcus pyogenes M1 GAS
gccuuaaugagaaa

SEQ ID NO: 2212827 - RNA, 15 nt, Streptococcus pyogenes M1 GAS
gccuucuaucaaaac

SEQ ID NO: 2212828 - RNA, 20 nt, Streptococcus pyogenes M1 GAS
gccuuuaacaugauguacca

SEQ ID NO: 2212829 - RNA, 12 nt, Streptococcus pyogenes M1 GAS
gcguuagcuuuu

SEQ ID NO: 2212830 - RNA, 16 nt, Streptococcus pyogenes M1 GAS
gcgucuggcaauaagu

SEQ ID NO: 2212831 - RNA, 21 nt, Streptococcus pyogenes M1 GAS
gcuacauugggccccauggcg

SEQ ID NO: 2212832 - RNA, 18 nt, Streptococcus pyogenes M1 GAS
gcuaaguagauacuuugg

SEQ ID NO: 2212833 - RNA, 14 nt, Streptococcus pyogenes M1 GAS
gcuaacugauaaaa

SEQ ID NO: 2212834 - RNA, 18 nt, Streptococcus pyogenes M1 GAS
gcuaacugauaaaacuca

SEQ ID NO: 2212835 - RNA, 14 nt, Streptococcus pyogenes M1 GAS
gcuaaucuaggacu

SEQ ID NO: 2212836 - RNA, 16 nt, Streptococcus pyogenes M1 GAS
gcggcacguuauucuc

SEQ ID NO: 2212837 - RNA, 17 nt, Streptococcus pyogenes M1 GAS
gccucuuggaaacaaga

SEQ ID NO: 2212838 - RNA, 23 nt, Streptococcus pyogenes M1 GAS
gccucuuggaaacaagagcucaa

SEQ ID NO: 2212839 - RNA, 23 nt, Streptococcus pyogenes M1 GAS
gccucuucugaugcguuuauaaa

SEQ ID NO: 2212840 - RNA, 15 nt, Streptococcus pyogenes M1 GAS
gccuccaacauagcu

SEQ ID NO: 2212841 - RNA, 15 nt, Streptococcus pyogenes M1 GAS
gcauaggaucagugc

SEQ ID NO: 2212842 - RNA, 18 nt, Streptococcus pyogenes M1 GAS
gcccccucuuuaccauuu

SEQ ID NO: 2212843 - RNA, 17 nt, Streptococcus pyogenes M1 GAS
gcaacaucaaaaagagg

SEQ ID NO: 2212844 - RNA, 19 nt, Streptococcus pyogenes M1 GAS
gcaauaaucgaugauaaua

SEQ ID NO: 2212845 - RNA, 22 nt, Streptococcus pyogenes M1 GAS
gcacaaacucugccaauuguuc

SEQ ID NO: 2212846 - RNA, 20 nt, Streptococcus pyogenes M1 GAS
gcaguuauaauuaguauauu

SEQ ID NO: 2212847 - RNA, 17 nt, Streptococcus pyogenes M1 GAS
gcaggguaucugcucag

SEQ ID NO: 2212848 - RNA, 15 nt, Streptococcus pyogenes M1 GAS
gcaggguaucugcuc

SEQ ID NO: 2212849 - RNA, 20 nt, Streptococcus pyogenes M1 GAS
gcagguaauuaucugaauua

SEQ ID NO: 2212850 - RNA, 15 nt, Streptococcus pyogenes M1 GAS
gcagaauagaaauag

SEQ ID NO: 2212851 - RNA, 14 nt, Streptococcus pyogenes M1 GAS
gcagcagaagcaaa

SEQ ID NO: 2212852 - RNA, 13 nt, Streptococcus pyogenes M1 GAS
gagucuuuuccua

SEQ ID NO: 2212853 - RNA, 11 nt, Streptococcus pyogenes M1 GAS
gaguggauaca

SEQ ID NO: 2212854 - RNA, 21 nt, Streptococcus pyogenes M1 GAS
gauaagaccuucaaaaaaggg

SEQ ID NO: 2212855 - RNA, 22 nt, Streptococcus pyogenes M1 GAS
gagguuaaucgaccaaaaucuu

SEQ ID NO: 2212856 - RNA, 18 nt, Streptococcus pyogenes M1 GAS
gagguugguaaaaaggca

SEQ ID NO: 2212857 - RNA, 19 nt, Streptococcus pyogenes M1 GAS
gaguaaggaccaagauuca

SEQ ID NO: 2212858 - RNA, 12 nt, Streptococcus pyogenes M1 GAS
gauauaagaagg

SEQ ID NO: 2212859 - RNA, 20 nt, Streptococcus pyogenes M1 GAS
gauagucaaaaagacuucuu

SEQ ID NO: 2212860 - RNA, 18 nt, Streptococcus pyogenes M1 GAS
gauagucaaaaagacuuc

SEQ ID NO: 2212861 - RNA, 18 nt, Streptococcus pyogenes M1 GAS
gaugaaaugauuguuauu

SEQ ID NO: 2212862 - RNA, 17 nt, Streptococcus pyogenes M1 GAS
gaugaaccucagcaagu

SEQ ID NO: 2212863 - RNA, 15 nt, Streptococcus pyogenes M1 GAS
gaugcacacaaaucu

SEQ ID NO: 2212864 - RNA, 17 nt, Streptococcus pyogenes M1 GAS
gaugauugaguaagcag

SEQ ID NO: 2212865 - RNA, 18 nt, Streptococcus pyogenes M1 GAS
gaugccauuuaaaagggc

SEQ ID NO: 2212866 - RNA, 19 nt, Streptococcus pyogenes M1 GAS
gauugccauuuaauuggua

SEQ ID NO: 2212867 - RNA, 14 nt, Streptococcus pyogenes M1 GAS
gauuuguauuuuuu

SEQ ID NO: 2212868 - RNA, 17 nt, Streptococcus pyogenes M1 GAS
gauuuccucuaacaugu

SEQ ID NO: 2212869 - RNA, 22 nt, Streptococcus pyogenes M1 GAS
gauuuccucuaacauguccaaa

SEQ ID NO: 2212870 - RNA, 13 nt, Streptococcus pyogenes M1 GAS
gcaaaacaauaac

SEQ ID NO: 2212871 - RNA, 15 nt, Streptococcus pyogenes M1 GAS
gauuuuggaugaaag

SEQ ID NO: 2212872 - RNA, 20 nt, Streptococcus pyogenes M1 GAS
gauuuuaaauaucuuaccau

SEQ ID NO: 2212873 - RNA, 15 nt, Streptococcus pyogenes M1 GAS
gauucccagagauga

SEQ ID NO: 2212874 - RNA, 21 nt, Streptococcus pyogenes M1 GAS
gauuagaauccuccucuuuuu

SEQ ID NO: 2212875 - RNA, 21 nt, Streptococcus pyogenes M1 GAS
gagagguugguaaaaaggcag

SEQ ID NO: 2212876 - RNA, 17 nt, Streptococcus pyogenes M1 GAS
gagaugagaaagccaag

SEQ ID NO: 2212877 - RNA, 18 nt, Streptococcus pyogenes M1 GAS
gagcacguuuucugguuu

SEQ ID NO: 2212878 - RNA, 17 nt, Streptococcus pyogenes M1 GAS
gagauuuuaaaaaaccu

SEQ ID NO: 2212879 - RNA, 19 nt, Streptococcus pyogenes M1 GAS
gagcaaggcaagaggaggc

SEQ ID NO: 2212880 - RNA, 12 nt, Streptococcus pyogenes M1 GAS
gagcaaggcaag

SEQ ID NO: 2212881 - RNA, 18 nt, Streptococcus pyogenes M1 GAS
gagcaaggcaagaggagg

SEQ ID NO: 2212882 - RNA, 19 nt, Streptococcus pyogenes M1 GAS
gagcuuuuuuuguuuuggc

SEQ ID NO: 2212883 - RNA, 14 nt, Streptococcus pyogenes M1 GAS
gaggcaauggcuga

SEQ ID NO: 2212884 - RNA, 15 nt, Streptococcus pyogenes M1 GAS
gaggcaauggcugag

SEQ ID NO: 2212885 - RNA, 16 nt, Streptococcus pyogenes M1 GAS
gacgucuggauugaua

SEQ ID NO: 2212886 - RNA, 13 nt, Streptococcus pyogenes M1 GAS
gacuaaguccuuu

SEQ ID NO: 2212887 - RNA, 23 nt, Streptococcus pyogenes M1 GAS
gacuaucugaguccgagaaagau

SEQ ID NO: 2212888 - RNA, 19 nt, Streptococcus pyogenes M1 GAS
gacuaaccugcauaucugc

SEQ ID NO: 2212889 - RNA, 12 nt, Streptococcus pyogenes M1 GAS
gacuauaaaagu

SEQ ID NO: 2212890 - RNA, 16 nt, Streptococcus pyogenes M1 GAS
gacucuagcauaaaag

SEQ ID NO: 2212891 - RNA, 17 nt, Streptococcus pyogenes M1 GAS
gagaagugauguuuuua

SEQ ID NO: 2212892 - RNA, 22 nt, Streptococcus pyogenes M1 GAS
gagaagugauguuuuuacauuu

SEQ ID NO: 2212893 - RNA, 22 nt, Streptococcus pyogenes M1 GAS
gagacaaguugccuuaucucag

SEQ ID NO: 2212894 - RNA, 14 nt, Streptococcus pyogenes M1 GAS
gagagguugguaaa

SEQ ID NO: 2212895 - RNA, 23 nt, Streptococcus pyogenes M1 GAS
gagaaacuaaaggcaauagcaag

SEQ ID NO: 2212896 - RNA, 19 nt, Streptococcus pyogenes M1 GAS
gagaaaccuauaaggagau

SEQ ID NO: 2212897 - RNA, 21 nt, Streptococcus pyogenes M1 GAS
gacuuguuacaaaaaacaagu

SEQ ID NO: 2212898 - RNA, 20 nt, Streptococcus pyogenes M1 GAS
gacuugguucugaaaauaaa

SEQ ID NO: 2212899 - RNA, 21 nt, Streptococcus pyogenes M1 GAS
gacuuguaaaaugauacuuuc

SEQ ID NO: 2212900 - RNA, 21 nt, Streptococcus pyogenes M1 GAS
gacuugguucugaaaauaaaa

SEQ ID NO: 2212901 - RNA, 14 nt, Streptococcus pyogenes M1 GAS
gacuguaaauagau

SEQ ID NO: 2212902 - RNA, 14 nt, Streptococcus pyogenes M1 GAS
gacuuaauugaaag

SEQ ID NO: 2212903 - RNA, 19 nt, Streptococcus pyogenes M1 GAS
gacuuaauugaaagaggug

SEQ ID NO: 2212904 - RNA, 16 nt, Streptococcus pyogenes M1 GAS
gacaguuaaaaauaac

SEQ ID NO: 2212905 - RNA, 19 nt, Streptococcus pyogenes M1 GAS
gacauuaguccaaaauaca

SEQ ID NO: 2212906 - RNA, 19 nt, Streptococcus pyogenes M1 GAS
gacauuuaugcugauuuug

SEQ ID NO: 2212907 - RNA, 13 nt, Streptococcus pyogenes M1 GAS
gacauucguucua

SEQ ID NO: 2212908 - RNA, 15 nt, Streptococcus pyogenes M1 GAS
gacauucguucuagu

SEQ ID NO: 2212909 - RNA, 19 nt, Streptococcus pyogenes M1 GAS
gaccacucgugcugccauc

SEQ ID NO: 2212910 - RNA, 19 nt, Streptococcus pyogenes M1 GAS
gacaacaauaucgagcuga

SEQ ID NO: 2212911 - RNA, 20 nt, Streptococcus pyogenes M1 GAS
gacaacauccauaccaucaa

SEQ ID NO: 2212912 - RNA, 18 nt, Streptococcus pyogenes M1 GAS
gacaauaagcccuuaauc

SEQ ID NO: 2212913 - RNA, 23 nt, Streptococcus pyogenes M1 GAS
gacaaucgaaaugauagcaccua

SEQ ID NO: 2212914 - RNA, 18 nt, Streptococcus pyogenes M1 GAS
gacagacaccaaaaaaag

SEQ ID NO: 2212915 - RNA, 21 nt, Streptococcus pyogenes M1 GAS
gacacuaaaaccauuauaaaa

SEQ ID NO: 2212916 - RNA, 22 nt, Streptococcus pyogenes M1 GAS
gacacagaugcgcaccuccacc

SEQ ID NO: 2212917 - RNA, 15 nt, Streptococcus pyogenes M1 GAS
gacacagauaagaua

SEQ ID NO: 2212918 - RNA, 15 nt, Streptococcus pyogenes M1 GAS
gacacccccugcugu

SEQ ID NO: 2212919 - RNA, 21 nt, Streptococcus pyogenes M1 GAS
gacacccccugcugucccagc

SEQ ID NO: 2212920 - RNA, 15 nt, Streptococcus pyogenes M1 GAS
gacggaguauuuuuu

SEQ ID NO: 2212921 - RNA, 20 nt, Streptococcus pyogenes M1 GAS
gacgauaagucaguuuuuuc

SEQ ID NO: 2212922 - RNA, 14 nt, Streptococcus pyogenes M1 GAS
gaccuuugauaaga

SEQ ID NO: 2212923 - RNA, 17 nt, Streptococcus pyogenes M1 GAS
gaccuuucaagacaagc

SEQ ID NO: 2212924 - RNA, 16 nt, Streptococcus pyogenes M1 GAS
gaccuucaaaaaaggg

SEQ ID NO: 2212925 - RNA, 17 nt, Streptococcus pyogenes M1 GAS
gaccuucaaaaaaggga

SEQ ID NO: 2212926 - RNA, 12 nt, Streptococcus pyogenes M1 GAS
gaccccuuaguu

SEQ ID NO: 2212927 - RNA, 19 nt, Streptococcus pyogenes M1 GAS
gaccccuuaguucaaugga

SEQ ID NO: 2212928 - RNA, 17 nt, Streptococcus pyogenes M1 GAS
cguucauauaagcaauc

SEQ ID NO: 2212929 - RNA, 16 nt, Streptococcus pyogenes M1 GAS
cguugauugccauuua

SEQ ID NO: 2212930 - RNA, 15 nt, Streptococcus pyogenes M1 GAS
cuaaaauauauuggu

SEQ ID NO: 2212931 - RNA, 15 nt, Streptococcus pyogenes M1 GAS
cuaaaauccucuuuu

SEQ ID NO: 2212932 - RNA, 22 nt, Streptococcus pyogenes M1 GAS
cguuuuauuuugauacguuuau

SEQ ID NO: 2212933 - RNA, 12 nt, Streptococcus pyogenes M1 GAS
cuaauaagauuc

SEQ ID NO: 2212934 - RNA, 18 nt, Streptococcus pyogenes M1 GAS
cuaauaaaauagcaccua

SEQ ID NO: 2212935 - RNA, 11 nt, Streptococcus pyogenes M1 GAS
cuaauaaaaua

SEQ ID NO: 2212936 - RNA, 23 nt, Streptococcus pyogenes M1 GAS
cuaaauccuuuugaaaaauuaug

SEQ ID NO: 2212937 - RNA, 20 nt, Streptococcus pyogenes M1 GAS
cuaaauccuuuugaaaaauu

SEQ ID NO: 2212938 - RNA, 21 nt, Streptococcus pyogenes M1 GAS
cuaaauccuuuugaaaaauua

SEQ ID NO: 2212939 - RNA, 14 nt, Streptococcus pyogenes M1 GAS
cuaaauauaaauua

SEQ ID NO: 2212940 - RNA, 14 nt, Streptococcus pyogenes M1 GAS
cuaacuauuuuuac

SEQ ID NO: 2212941 - RNA, 22 nt, Streptococcus pyogenes M1 GAS
cuaacuauuuuuaccuuuauuu

SEQ ID NO: 2212942 - RNA, 20 nt, Streptococcus pyogenes M1 GAS
cuaaucagaacucgucuuua

SEQ ID NO: 2212943 - RNA, 23 nt, Streptococcus pyogenes M1 GAS
cuaaucagaacucgucuuuaucc

SEQ ID NO: 2212944 - RNA, 20 nt, Streptococcus pyogenes M1 GAS
cuaauccaauaauagccauu

SEQ ID NO: 2212945 - RNA, 15 nt, Streptococcus pyogenes M1 GAS
cuaaucuaggacuaa

SEQ ID NO: 2212946 - RNA, 18 nt, Streptococcus pyogenes M1 GAS
cuaauuuagucauuucuu

SEQ ID NO: 2212947 - RNA, 20 nt, Streptococcus pyogenes M1 GAS
cuacauugggccccauggcg

SEQ ID NO: 2212948 - RNA, 21 nt, Streptococcus pyogenes M1 GAS
cuacacguuccaugauugauu

SEQ ID NO: 2212949 - RNA, 14 nt, Streptococcus pyogenes M1 GAS
cuacagcaccuuca

SEQ ID NO: 2212950 - RNA, 15 nt, Streptococcus pyogenes M1 GAS
cucauaacaaauuua

SEQ ID NO: 2212951 - RNA, 19 nt, Streptococcus pyogenes M1 GAS
cucauaacaaauuuauccu

SEQ ID NO: 2212952 - RNA, 18 nt, Streptococcus pyogenes M1 GAS
cucaguucugagauauuc

SEQ ID NO: 2212953 - RNA, 16 nt, Streptococcus pyogenes M1 GAS
cuccaaaguucuucua

SEQ ID NO: 2212954 - RNA, 15 nt, Streptococcus pyogenes M1 GAS
cuccaacgaccucca

SEQ ID NO: 2212955 - RNA, 24 nt, Streptococcus pyogenes M1 GAS
cucacuaggccuagcuuuuuacau

SEQ ID NO: 2212956 - RNA, 14 nt, Streptococcus pyogenes M1 GAS
cucaauagcugcug

SEQ ID NO: 2212957 - RNA, 16 nt, Streptococcus pyogenes M1 GAS
cuauugacuugguucu

SEQ ID NO: 2212958 - RNA, 18 nt, Streptococcus pyogenes M1 GAS
cuauugaaucuuguuuaa

SEQ ID NO: 2212959 - RNA, 15 nt, Streptococcus pyogenes M1 GAS
cucaaauuuuuuuca

SEQ ID NO: 2212960 - RNA, 14 nt, Streptococcus pyogenes M1 GAS
cuaguuuaggauau

SEQ ID NO: 2212961 - RNA, 16 nt, Streptococcus pyogenes M1 GAS
cuaucacgccaguaaa

SEQ ID NO: 2212962 - RNA, 19 nt, Streptococcus pyogenes M1 GAS
cuauucaauauuuuauuaa

SEQ ID NO: 2212963 - RNA, 19 nt, Streptococcus pyogenes M1 GAS
cuauguggagcuuuuuuug

SEQ ID NO: 2212964 - RNA, 16 nt, Streptococcus pyogenes M1 GAS
cuaucgcuaacauuua

SEQ ID NO: 2212965 - RNA, 21 nt, Streptococcus pyogenes M1 GAS
cuagcucuuuaucaccuguca

SEQ ID NO: 2212966 - RNA, 19 nt, Streptococcus pyogenes M1 GAS
cuagggauccugcuaguau

SEQ ID NO: 2212967 - RNA, 22 nt, Streptococcus pyogenes M1 GAS
cuaggcuuucauuauagacuau

SEQ ID NO: 2212968 - RNA, 18 nt, Streptococcus pyogenes M1 GAS
cuagcuuugucaacucga

SEQ ID NO: 2212969 - RNA, 14 nt, Streptococcus pyogenes M1 GAS
cuagcgggaacacu

SEQ ID NO: 2212970 - RNA, 13 nt, Streptococcus pyogenes M1 GAS
cuagucuuuuuau

SEQ ID NO: 2212971 - RNA, 17 nt, Streptococcus pyogenes M1 GAS
cuaguacaguauguaaa

SEQ ID NO: 2212972 - RNA, 23 nt, Streptococcus pyogenes M1 GAS
cuaguacaguauguaaauauaaa

SEQ ID NO: 2212973 - RNA, 16 nt, Streptococcus pyogenes M1 GAS
cuaguaaguuuuuuug

SEQ ID NO: 2212974 - RNA, 20 nt, Streptococcus pyogenes M1 GAS
cuagacucuagcauaaaaga

SEQ ID NO: 2212975 - RNA, 12 nt, Streptococcus pyogenes M1 GAS
cuagaaaaagca

SEQ ID NO: 2212976 - RNA, 23 nt, Streptococcus pyogenes M1 GAS
cuacuugucaugaugguuucacg

SEQ ID NO: 2212977 - RNA, 17 nt, Streptococcus pyogenes M1 GAS
cuacucuauuuuaagua

SEQ ID NO: 2212978 - RNA, 13 nt, Streptococcus pyogenes M1 GAS
cucuuuugugauu

SEQ ID NO: 2212979 - RNA, 14 nt, Streptococcus pyogenes M1 GAS
cugaaaauaaaaua

SEQ ID NO: 2212980 - RNA, 16 nt, Streptococcus pyogenes M1 GAS
cugaaaaugcauuaca

SEQ ID NO: 2212981 - RNA, 13 nt, Streptococcus pyogenes M1 GAS
cugaaacaccugc

SEQ ID NO: 2212982 - RNA, 19 nt, Streptococcus pyogenes M1 GAS
cugaaacaccugcugcucc

SEQ ID NO: 2212983 - RNA, 15 nt, Streptococcus pyogenes M1 GAS
cugaaauauaaccuc

SEQ ID NO: 2212984 - RNA, 15 nt, Streptococcus pyogenes M1 GAS
cugaacucuuuauuc

SEQ ID NO: 2212985 - RNA, 20 nt, Streptococcus pyogenes M1 GAS
cugagauauucauuuucuuc

SEQ ID NO: 2212986 - RNA, 17 nt, Streptococcus pyogenes M1 GAS
cugagauauucauuuuc

SEQ ID NO: 2212987 - RNA, 22 nt, Streptococcus pyogenes M1 GAS
cugagcgguuuugucuuaucuc

SEQ ID NO: 2212988 - RNA, 12 nt, Streptococcus pyogenes M1 GAS
cugacuuaaauu

SEQ ID NO: 2212989 - RNA, 15 nt, Streptococcus pyogenes M1 GAS
cugacaaaaaaagca

SEQ ID NO: 2212990 - RNA, 23 nt, Streptococcus pyogenes M1 GAS
cugacaaaacuucaaauuucaug

SEQ ID NO: 2212991 - RNA, 14 nt, Streptococcus pyogenes M1 GAS
cucuccaaaguucu

SEQ ID NO: 2212992 - RNA, 16 nt, Streptococcus pyogenes M1 GAS
cucuaauuuagucauu

SEQ ID NO: 2212993 - RNA, 21 nt, Streptococcus pyogenes M1 GAS
cucuaacauguccaaaucgua

SEQ ID NO: 2212994 - RNA, 17 nt, Streptococcus pyogenes M1 GAS
cucuaacauguccaaau

SEQ ID NO: 2212995 - RNA, 21 nt, Streptococcus pyogenes M1 GAS
cucgugguugucaaccucuau

SEQ ID NO: 2212996 - RNA, 20 nt, Streptococcus pyogenes M1 GAS
cucgagcuuucuacuaaaaa

SEQ ID NO: 2212997 - RNA, 20 nt, Streptococcus pyogenes M1 GAS
cuccuugcaauagagccaag

SEQ ID NO: 2212998 - RNA, 13 nt, Streptococcus pyogenes M1 GAS
cuccuccaccaaa

SEQ ID NO: 2212999 - RNA, 23 nt, Streptococcus pyogenes M1 GAS
cuguucauuuagugguauagaca

SEQ ID NO: 2213000 - RNA, 13 nt, Streptococcus pyogenes M1 GAS
cugugaugaauca

SEQ ID NO: 2213001 - RNA, 20 nt, Streptococcus pyogenes M1 GAS
cugugcagugggcuuuuuug

SEQ ID NO: 2213002 - RNA, 23 nt, Streptococcus pyogenes M1 GAS
cuguagcguuuguguugaagaag

SEQ ID NO: 2213003 - RNA, 19 nt, Streptococcus pyogenes M1 GAS
cugguuuuaauauugggac

SEQ ID NO: 2213004 - RNA, 16 nt, Streptococcus pyogenes M1 GAS
cuggcuuagcagcacc

SEQ ID NO: 2213005 - RNA, 17 nt, Streptococcus pyogenes M1 GAS
cuggcuuagcagcacca

SEQ ID NO: 2213006 - RNA, 19 nt, Streptococcus pyogenes M1 GAS
cuggcuuuuuugcuuuuua

SEQ ID NO: 2213007 - RNA, 14 nt, Streptococcus pyogenes M1 GAS
cugcugcuaaagca

SEQ ID NO: 2213008 - RNA, 13 nt, Streptococcus pyogenes M1 GAS
cugccuuggcccc

SEQ ID NO: 2213009 - RNA, 17 nt, Streptococcus pyogenes M1 GAS
cugccuuggccccuuuu

SEQ ID NO: 2213010 - RNA, 20 nt, Streptococcus pyogenes M1 GAS
cugccuuggccccuuuuuug

SEQ ID NO: 2213011 - RNA, 20 nt, Streptococcus pyogenes M1 GAS
cugcgcuauggacuaucuga

SEQ ID NO: 2213012 - RNA, 16 nt, Streptococcus pyogenes M1 GAS
cugaugacuuguaaaa

SEQ ID NO: 2213013 - RNA, 23 nt, Streptococcus pyogenes M1 GAS
cugaugcgauucccaucuuuauc

SEQ ID NO: 2213014 - RNA, 15 nt, Streptococcus pyogenes M1 GAS
cugaugcguuuauaa

SEQ ID NO: 2213015 - RNA, 17 nt, Streptococcus pyogenes M1 GAS
cuuccaaucuuucauua

SEQ ID NO: 2213016 - RNA, 23 nt, Streptococcus pyogenes M1 GAS
cuuccuuagcaaaggcuucauca

SEQ ID NO: 2213017 - RNA, 15 nt, Streptococcus pyogenes M1 GAS
cuucuaaaaaaguua

SEQ ID NO: 2213018 - RNA, 18 nt, Streptococcus pyogenes M1 GAS
cuucaccuuaggcagaca

SEQ ID NO: 2213019 - RNA, 11 nt, Streptococcus pyogenes M1 GAS
cuuauuuuuuu

SEQ ID NO: 2213020 - RNA, 15 nt, Streptococcus pyogenes M1 GAS
cuuauuuuaagaagc

SEQ ID NO: 2213021 - RNA, 21 nt, Streptococcus pyogenes M1 GAS
cuucaaaaauacuaccuuuag

SEQ ID NO: 2213022 - RNA, 22 nt, Streptococcus pyogenes M1 GAS
cuuaauaaacuguauacaaaaa

SEQ ID NO: 2213023 - RNA, 13 nt, Streptococcus pyogenes M1 GAS
cuuaaucuaaaag

SEQ ID NO: 2213024 - RNA, 17 nt, Streptococcus pyogenes M1 GAS
cuuaacggcaucuacag

SEQ ID NO: 2213025 - RNA, 15 nt, Streptococcus pyogenes M1 GAS
cuuaacggcaucuac

SEQ ID NO: 2213026 - RNA, 20 nt, Streptococcus pyogenes M1 GAS
cuuaaucuggagaugagaaa

SEQ ID NO: 2213027 - RNA, 15 nt, Streptococcus pyogenes M1 GAS
cuuagugguuugcaa

SEQ ID NO: 2213028 - RNA, 14 nt, Streptococcus pyogenes M1 GAS
cuuucuacuaaaaa

SEQ ID NO: 2213029 - RNA, 15 nt, Streptococcus pyogenes M1 GAS
cuuucuacuaaaaaa

SEQ ID NO: 2213030 - RNA, 22 nt, Streptococcus pyogenes M1 GAS
cuuucguaaggguuauuauuua

SEQ ID NO: 2213031 - RNA, 14 nt, Streptococcus pyogenes M1 GAS
cuuugauuuuucuu

SEQ ID NO: 2213032 - RNA, 19 nt, Streptococcus pyogenes M1 GAS
cuuugcaggguaucugcuc

SEQ ID NO: 2213033 - RNA, 11 nt, Streptococcus pyogenes M1 GAS
cuuuacauuuu

SEQ ID NO: 2213034 - RNA, 12 nt, Streptococcus pyogenes M1 GAS
cuuuacauuuua

SEQ ID NO: 2213035 - RNA, 17 nt, Streptococcus pyogenes M1 GAS
cuuuacuguaauauuuc

SEQ ID NO: 2213036 - RNA, 17 nt, Streptococcus pyogenes M1 GAS
cuuuagagaaucaaagg

SEQ ID NO: 2213037 - RNA, 22 nt, Streptococcus pyogenes M1 GAS
cuuuagagaaucaaagggauua

SEQ ID NO: 2213038 - RNA, 19 nt, Streptococcus pyogenes M1 GAS
cuuuagcaauuguuuuuuc

SEQ ID NO: 2213039 - RNA, 13 nt, Streptococcus pyogenes M1 GAS
cuuuagagaauca

SEQ ID NO: 2213040 - RNA, 11 nt, Streptococcus pyogenes M1 GAS
cuuuauugaug

SEQ ID NO: 2213041 - RNA, 19 nt, Streptococcus pyogenes M1 GAS
cuuuaucuuauuuuaagaa

SEQ ID NO: 2213042 - RNA, 15 nt, Streptococcus pyogenes M1 GAS
cuuuaguugcuucuu

SEQ ID NO: 2213043 - RNA, 17 nt, Streptococcus pyogenes M1 GAS
cuuuaguugcuucuuuu

SEQ ID NO: 2213044 - RNA, 16 nt, Streptococcus pyogenes M1 GAS
cuuuaggaucauuauc

SEQ ID NO: 2213045 - RNA, 12 nt, Streptococcus pyogenes M1 GAS
cuuuauuuugau

SEQ ID NO: 2213046 - RNA, 18 nt, Streptococcus pyogenes M1 GAS
cuuuauuuugauauuuuu

SEQ ID NO: 2213047 - RNA, 21 nt, Streptococcus pyogenes M1 GAS
cuugguucugaaaauaaaaua

SEQ ID NO: 2213048 - RNA, 16 nt, Streptococcus pyogenes M1 GAS
cuugggagaguuccug

SEQ ID NO: 2213049 - RNA, 19 nt, Streptococcus pyogenes M1 GAS
cuugauuucauuuucuuug

SEQ ID NO: 2213050 - RNA, 22 nt, Streptococcus pyogenes M1 GAS
cuucuuugcagagaugcuucuu

SEQ ID NO: 2213051 - RNA, 19 nt, Streptococcus pyogenes M1 GAS
cgccguuuuucaaggcugu

SEQ ID NO: 2213052 - RNA, 18 nt, Streptococcus pyogenes M1 GAS
cgccuaggaauaaaaugc

SEQ ID NO: 2213053 - RNA, 14 nt, Streptococcus pyogenes M1 GAS
cgauaaaacaaaua

SEQ ID NO: 2213054 - RNA, 14 nt, Streptococcus pyogenes M1 GAS
cgauuaaaagaugu

SEQ ID NO: 2213055 - RNA, 18 nt, Streptococcus pyogenes M1 GAS
cgauuaaccguuccuguc

SEQ ID NO: 2213056 - RNA, 16 nt, Streptococcus pyogenes M1 GAS
cggagcuuuaccuccu

SEQ ID NO: 2213057 - RNA, 17 nt, Streptococcus pyogenes M1 GAS
cgcugcgcuauggacua

SEQ ID NO: 2213058 - RNA, 21 nt, Streptococcus pyogenes M1 GAS
cguauugucaucgcuuugaau

SEQ ID NO: 2213059 - RNA, 15 nt, Streptococcus pyogenes M1 GAS
cguauaggugaguuu

SEQ ID NO: 2213060 - RNA, 23 nt, Streptococcus pyogenes M1 GAS
cguauaggugaguuuuuucuaaa

SEQ ID NO: 2213061 - RNA, 17 nt, Streptococcus pyogenes M1 GAS
cguaaagcaagggaaac

SEQ ID NO: 2213062 - RNA, 18 nt, Streptococcus pyogenes M1 GAS
cccgucuuacaauuaaua

SEQ ID NO: 2213063 - RNA, 22 nt, Streptococcus pyogenes M1 GAS
ccauuucuuugcaaaagaaaac

SEQ ID NO: 2213064 - RNA, 13 nt, Streptococcus pyogenes M1 GAS
cccauggcgugca

SEQ ID NO: 2213065 - RNA, 11 nt, Streptococcus pyogenes M1 GAS
ccccacaaaag

SEQ ID NO: 2213066 - RNA, 22 nt, Streptococcus pyogenes M1 GAS
ccaucaagacacccccugcugu

SEQ ID NO: 2213067 - RNA, 23 nt, Streptococcus pyogenes M1 GAS
ccagaugcuugcucaauuuuuga

SEQ ID NO: 2213068 - RNA, 16 nt, Streptococcus pyogenes M1 GAS
ccagaugcuugcucaa

SEQ ID NO: 2213069 - RNA, 14 nt, Streptococcus pyogenes M1 GAS
ccacucgugcugcc

SEQ ID NO: 2213070 - RNA, 12 nt, Streptococcus pyogenes M1 GAS
cauuuuuuguaa

SEQ ID NO: 2213071 - RNA, 20 nt, Streptococcus pyogenes M1 GAS
cauuuuuuguaauucagcau

SEQ ID NO: 2213072 - RNA, 20 nt, Streptococcus pyogenes M1 GAS
ccgcgaauaugauauaaaaa

SEQ ID NO: 2213073 - RNA, 20 nt, Streptococcus pyogenes M1 GAS
ccgcccagaauaaucugagc

SEQ ID NO: 2213074 - RNA, 16 nt, Streptococcus pyogenes M1 GAS
ccugcugucccagcag

SEQ ID NO: 2213075 - RNA, 17 nt, Streptococcus pyogenes M1 GAS
ccuuagcaaaggcuuca

SEQ ID NO: 2213076 - RNA, 22 nt, Streptococcus pyogenes M1 GAS
ccuuagcaaaggcuucaucaau

SEQ ID NO: 2213077 - RNA, 13 nt, Streptococcus pyogenes M1 GAS
ccuguuuuugcug

SEQ ID NO: 2213078 - RNA, 14 nt, Streptococcus pyogenes M1 GAS
ccuuaaucuaaaag

SEQ ID NO: 2213079 - RNA, 19 nt, Streptococcus pyogenes M1 GAS
ccugugacacguaagcucc

SEQ ID NO: 2213080 - RNA, 22 nt, Streptococcus pyogenes M1 GAS
ccuauuugacuuguuacaaaaa

SEQ ID NO: 2213081 - RNA, 22 nt, Streptococcus pyogenes M1 GAS
ccuaugcuaacugauaaaacuc

SEQ ID NO: 2213082 - RNA, 16 nt, Streptococcus pyogenes M1 GAS
ccuaugaucuguuuaa

SEQ ID NO: 2213083 - RNA, 21 nt, Streptococcus pyogenes M1 GAS
ccuauagaaaguuauaaagaa

SEQ ID NO: 2213084 - RNA, 13 nt, Streptococcus pyogenes M1 GAS
ccuacaagaggag

SEQ ID NO: 2213085 - RNA, 13 nt, Streptococcus pyogenes M1 GAS
ccuaaagcccaua

SEQ ID NO: 2213086 - RNA, 22 nt, Streptococcus pyogenes M1 GAS
ccguuuuuuguuguaaaaaggu

SEQ ID NO: 2213087 - RNA, 16 nt, Streptococcus pyogenes M1 GAS
ccguuagucugcugcu

SEQ ID NO: 2213088 - RNA, 23 nt, Streptococcus pyogenes M1 GAS
cauccuaauggugucgcuuuuuu

SEQ ID NO: 2213089 - RNA, 17 nt, Streptococcus pyogenes M1 GAS
caucuugccaucagcau

SEQ ID NO: 2213090 - RNA, 14 nt, Streptococcus pyogenes M1 GAS
caucuugcauuacc

SEQ ID NO: 2213091 - RNA, 13 nt, Streptococcus pyogenes M1 GAS
caucugaaaaaau

SEQ ID NO: 2213092 - RNA, 17 nt, Streptococcus pyogenes M1 GAS
caucaggcuuaaacaua

SEQ ID NO: 2213093 - RNA, 15 nt, Streptococcus pyogenes M1 GAS
caucaggguugcaug

SEQ ID NO: 2213094 - RNA, 21 nt, Streptococcus pyogenes M1 GAS
caucaucaagaauagcuuuug

SEQ ID NO: 2213095 - RNA, 22 nt, Streptococcus pyogenes M1 GAS
caucaagacacccccugcuguc

SEQ ID NO: 2213096 - RNA, 14 nt, Streptococcus pyogenes M1 GAS
caucaagaauagcu

SEQ ID NO: 2213097 - RNA, 15 nt, Streptococcus pyogenes M1 GAS
caucaagaauagcuu

SEQ ID NO: 2213098 - RNA, 15 nt, Streptococcus pyogenes M1 GAS
caucaaaaaaagaca

SEQ ID NO: 2213099 - RNA, 14 nt, Streptococcus pyogenes M1 GAS
caucaaaaaaagca

SEQ ID NO: 2213100 - RNA, 15 nt, Streptococcus pyogenes M1 GAS
caucaaaaaaagcaa

SEQ ID NO: 2213101 - RNA, 17 nt, Streptococcus pyogenes M1 GAS
caucaaaaaaagcaaug

SEQ ID NO: 2213102 - RNA, 20 nt, Streptococcus pyogenes M1 GAS
caucaaaagaccauaaaaaa

SEQ ID NO: 2213103 - RNA, 19 nt, Streptococcus pyogenes M1 GAS
cauauuagcaaaaugcugu

SEQ ID NO: 2213104 - RNA, 17 nt, Streptococcus pyogenes M1 GAS
cauugaugagacuaacc

SEQ ID NO: 2213105 - RNA, 21 nt, Streptococcus pyogenes M1 GAS
cauuguuuuucuuugucaugu

SEQ ID NO: 2213106 - RNA, 16 nt, Streptococcus pyogenes M1 GAS
cauuaucaucuggucc

SEQ ID NO: 2213107 - RNA, 17 nt, Streptococcus pyogenes M1 GAS
cauugaauaaagugaua

SEQ ID NO: 2213108 - RNA, 13 nt, Streptococcus pyogenes M1 GAS
cauuucuugaggu

SEQ ID NO: 2213109 - RNA, 23 nt, Streptococcus pyogenes M1 GAS
cauuucuugaggugauucuuuuu

SEQ ID NO: 2213110 - RNA, 18 nt, Streptococcus pyogenes M1 GAS
cauuucuuugcaaaagaa

SEQ ID NO: 2213111 - RNA, 21 nt, Streptococcus pyogenes M1 GAS
cauuugacuacuagcaugucc

SEQ ID NO: 2213112 - RNA, 19 nt, Streptococcus pyogenes M1 GAS
cauuucuucagguuucuuu

SEQ ID NO: 2213113 - RNA, 18 nt, Streptococcus pyogenes M1 GAS
cauuuguuuugauaaaaa

SEQ ID NO: 2213114 - RNA, 14 nt, Streptococcus pyogenes M1 GAS
cauuugccauggca

SEQ ID NO: 2213115 - RNA, 23 nt, Streptococcus pyogenes M1 GAS
cauuuuacuauggcuucuaaaaa

SEQ ID NO: 2213116 - RNA, 16 nt, Streptococcus pyogenes M1 GAS
cauuuucaucaucaag

SEQ ID NO: 2213117 - RNA, 22 nt, Streptococcus pyogenes M1 GAS
cauuuuggagagauuuuaaaaa

SEQ ID NO: 2213118 - RNA, 17 nt, Streptococcus pyogenes M1 GAS
cauuuuuaucuguauau

SEQ ID NO: 2213119 - RNA, 14 nt, Streptococcus pyogenes M1 GAS
cauuaauaaaagau

SEQ ID NO: 2213120 - RNA, 15 nt, Streptococcus pyogenes M1 GAS
cauuaagguuuuuuu

SEQ ID NO: 2213121 - RNA, 23 nt, Streptococcus pyogenes M1 GAS
cauuaaggauuaugaaaaagaag

SEQ ID NO: 2213122 - RNA, 17 nt, Streptococcus pyogenes M1 GAS
cauuagcuuuuuuuaaa

SEQ ID NO: 2213123 - RNA, 16 nt, Streptococcus pyogenes M1 GAS
cauguugacuauuuuu

SEQ ID NO: 2213124 - RNA, 22 nt, Streptococcus pyogenes M1 GAS
caugaaaguuauagcuccuaaa

SEQ ID NO: 2213125 - RNA, 23 nt, Streptococcus pyogenes M1 GAS
cauggcaagagcaccgcgaauau

SEQ ID NO: 2213126 - RNA, 12 nt, Streptococcus pyogenes M1 GAS
cauggguaugcc

SEQ ID NO: 2213127 - RNA, 18 nt, Streptococcus pyogenes M1 GAS
cauggagucaaugaaaag

SEQ ID NO: 2213128 - RNA, 18 nt, Streptococcus pyogenes M1 GAS
cauacucaauagcugcug

SEQ ID NO: 2213129 - RNA, 14 nt, Streptococcus pyogenes M1 GAS
cauaccaucaauga

SEQ ID NO: 2213130 - RNA, 22 nt, Streptococcus pyogenes M1 GAS
cauacccgcguuaucuccacag

SEQ ID NO: 2213131 - RNA, 16 nt, Streptococcus pyogenes M1 GAS
cauaaccuuugccauu

SEQ ID NO: 2213132 - RNA, 22 nt, Streptococcus pyogenes M1 GAS
caguucugagauauucauuuuc

SEQ ID NO: 2213133 - RNA, 21 nt, Streptococcus pyogenes M1 GAS
caguucuguuucuaagcaaau

SEQ ID NO: 2213134 - RNA, 14 nt, Streptococcus pyogenes M1 GAS
caguuaaaaauaac

SEQ ID NO: 2213135 - RNA, 19 nt, Streptococcus pyogenes M1 GAS
caguuaaaaauaacuuuaa

SEQ ID NO: 2213136 - RNA, 12 nt, Streptococcus pyogenes M1 GAS
cauaaauucuaa

SEQ ID NO: 2213137 - RNA, 23 nt, Streptococcus pyogenes M1 GAS
cauaaauucuaacucuuguagaa

SEQ ID NO: 2213138 - RNA, 16 nt, Streptococcus pyogenes M1 GAS
caguaaggaaaucaau

SEQ ID NO: 2213139 - RNA, 14 nt, Streptococcus pyogenes M1 GAS
caguaguuuuagcg

SEQ ID NO: 2213140 - RNA, 18 nt, Streptococcus pyogenes M1 GAS
caguauaacuguuuuucu

SEQ ID NO: 2213141 - RNA, 14 nt, Streptococcus pyogenes M1 GAS
cagugcuuuaacaa

SEQ ID NO: 2213142 - RNA, 20 nt, Streptococcus pyogenes M1 GAS
cagucuuuuuuauaauuauu

SEQ ID NO: 2213143 - RNA, 23 nt, Streptococcus pyogenes M1 GAS
caggaauuguugacuuugcaaaa

SEQ ID NO: 2213144 - RNA, 16 nt, Streptococcus pyogenes M1 GAS
caggacagucuuuuuu

SEQ ID NO: 2213145 - RNA, 20 nt, Streptococcus pyogenes M1 GAS
caggacagucuuuuuuauaa

SEQ ID NO: 2213146 - RNA, 22 nt, Streptococcus pyogenes M1 GAS
cagcugguuuuuuaauuauuuu

SEQ ID NO: 2213147 - RNA, 16 nt, Streptococcus pyogenes M1 GAS
cagaaaaaagauaaac

SEQ ID NO: 2213148 - RNA, 15 nt, Streptococcus pyogenes M1 GAS
cagacaccaaaaaaa

SEQ ID NO: 2213149 - RNA, 15 nt, Streptococcus pyogenes M1 GAS
cagaauaaagaaaaa

SEQ ID NO: 2213150 - RNA, 16 nt, Streptococcus pyogenes M1 GAS
cagaauaagaaaaccu

SEQ ID NO: 2213151 - RNA, 23 nt, Streptococcus pyogenes M1 GAS
cagacaaaagggaagagagaagc

SEQ ID NO: 2213152 - RNA, 20 nt, Streptococcus pyogenes M1 GAS
cagaaauacuccguuucuag

SEQ ID NO: 2213153 - RNA, 22 nt, Streptococcus pyogenes M1 GAS
cagaaauuaauaaauuuuuguc

SEQ ID NO: 2213154 - RNA, 12 nt, Streptococcus pyogenes M1 GAS
cagaaaugaaaa

SEQ ID NO: 2213155 - RNA, 20 nt, Streptococcus pyogenes M1 GAS
cagaaagaagaaaauuaguu

SEQ ID NO: 2213156 - RNA, 16 nt, Streptococcus pyogenes M1 GAS
cagaagccucuucuga

SEQ ID NO: 2213157 - RNA, 14 nt, Streptococcus pyogenes M1 GAS
cagaacgucaaaaa

SEQ ID NO: 2213158 - RNA, 14 nt, Streptococcus pyogenes M1 GAS
cagaacucgucuuu

SEQ ID NO: 2213159 - RNA, 17 nt, Streptococcus pyogenes M1 GAS
cagaacucgucuuuguc

SEQ ID NO: 2213160 - RNA, 21 nt, Streptococcus pyogenes M1 GAS
cagaacucgucuuuguccauu

SEQ ID NO: 2213161 - RNA, 22 nt, Streptococcus pyogenes M1 GAS
cagaacucgucuuuguccauuu

SEQ ID NO: 2213162 - RNA, 17 nt, Streptococcus pyogenes M1 GAS
cagauagucaaaaagac

SEQ ID NO: 2213163 - RNA, 14 nt, Streptococcus pyogenes M1 GAS
cagauaagaccuuc

SEQ ID NO: 2213164 - RNA, 17 nt, Streptococcus pyogenes M1 GAS
cagauaagaccuucaaa

SEQ ID NO: 2213165 - RNA, 23 nt, Streptococcus pyogenes M1 GAS
cagauaagaccuucaaaaaaggg

SEQ ID NO: 2213166 - RNA, 13 nt, Streptococcus pyogenes M1 GAS
cagcaaggcaccu

SEQ ID NO: 2213167 - RNA, 15 nt, Streptococcus pyogenes M1 GAS
cagauugaagacaaa

SEQ ID NO: 2213168 - RNA, 21 nt, Streptococcus pyogenes M1 GAS
cagcacuggcuuuuuugcuuu

SEQ ID NO: 2213169 - RNA, 14 nt, Streptococcus pyogenes M1 GAS
cagcaccuucuuuu

SEQ ID NO: 2213170 - RNA, 17 nt, Streptococcus pyogenes M1 GAS
caacauggcuaaugaua

SEQ ID NO: 2213171 - RNA, 15 nt, Streptococcus pyogenes M1 GAS
caaccgcuuccuuug

SEQ ID NO: 2213172 - RNA, 17 nt, Streptococcus pyogenes M1 GAS
caaccucugaaggcaca

SEQ ID NO: 2213173 - RNA, 13 nt, Streptococcus pyogenes M1 GAS
caaccugaaaagu

SEQ ID NO: 2213174 - RNA, 14 nt, Streptococcus pyogenes M1 GAS
caacuggcacaaac

SEQ ID NO: 2213175 - RNA, 13 nt, Streptococcus pyogenes M1 GAS
caacugacuagcc

SEQ ID NO: 2213176 - RNA, 17 nt, Streptococcus pyogenes M1 GAS
caacacaauucaagaua

SEQ ID NO: 2213177 - RNA, 15 nt, Streptococcus pyogenes M1 GAS
caaauuuauccugau

SEQ ID NO: 2213178 - RNA, 23 nt, Streptococcus pyogenes M1 GAS
caaauuguuugauugauuugucu

SEQ ID NO: 2213179 - RNA, 14 nt, Streptococcus pyogenes M1 GAS
caaauuguuugauu

SEQ ID NO: 2213180 - RNA, 14 nt, Streptococcus pyogenes M1 GAS
caaauugaaaaaau

SEQ ID NO: 2213181 - RNA, 13 nt, Streptococcus pyogenes M1 GAS
caaauucuuuuug

SEQ ID NO: 2213182 - RNA, 20 nt, Streptococcus pyogenes M1 GAS
caaagaaggccagcaaggca

SEQ ID NO: 2213183 - RNA, 18 nt, Streptococcus pyogenes M1 GAS
caaauaguagcaaauaac

SEQ ID NO: 2213184 - RNA, 21 nt, Streptococcus pyogenes M1 GAS
caaggaauugcagcuaaaaac

SEQ ID NO: 2213185 - RNA, 14 nt, Streptococcus pyogenes M1 GAS
caagcaucagcucu

SEQ ID NO: 2213186 - RNA, 16 nt, Streptococcus pyogenes M1 GAS
caacuucuauaugugu

SEQ ID NO: 2213187 - RNA, 20 nt, Streptococcus pyogenes M1 GAS
caagcaggcuacacaguuag

SEQ ID NO: 2213188 - RNA, 22 nt, Streptococcus pyogenes M1 GAS
caauacaaaaaaccuuccugua

SEQ ID NO: 2213189 - RNA, 17 nt, Streptococcus pyogenes M1 GAS
caauaauaccauuuuua

SEQ ID NO: 2213190 - RNA, 16 nt, Streptococcus pyogenes M1 GAS
caauaaggucaucaga

SEQ ID NO: 2213191 - RNA, 16 nt, Streptococcus pyogenes M1 GAS
caaguaugcuuuuaau

SEQ ID NO: 2213192 - RNA, 23 nt, Streptococcus pyogenes M1 GAS
caauaaaauaucuagaacagcug

SEQ ID NO: 2213193 - RNA, 13 nt, Streptococcus pyogenes M1 GAS
caaugccaucugc

SEQ ID NO: 2213194 - RNA, 15 nt, Streptococcus pyogenes M1 GAS
caauggaaauuuuaa

SEQ ID NO: 2213195 - RNA, 21 nt, Streptococcus pyogenes M1 GAS
caauggaaauuuuaaaugaca

SEQ ID NO: 2213196 - RNA, 14 nt, Streptococcus pyogenes M1 GAS
caaugaaaaguuau

SEQ ID NO: 2213197 - RNA, 20 nt, Streptococcus pyogenes M1 GAS
caaugacuugaccaaauaca

SEQ ID NO: 2213198 - RNA, 21 nt, Streptococcus pyogenes M1 GAS
caaucauacccgcguuaucuc

SEQ ID NO: 2213199 - RNA, 22 nt, Streptococcus pyogenes M1 GAS
caaucaucauuuagcugauaau

SEQ ID NO: 2213200 - RNA, 17 nt, Streptococcus pyogenes M1 GAS
caaucgaaaugauagca

SEQ ID NO: 2213201 - RNA, 15 nt, Streptococcus pyogenes M1 GAS
auuuuuuauaauggu

SEQ ID NO: 2213202 - RNA, 16 nt, Streptococcus pyogenes M1 GAS
auuuuuucucaaaaau

SEQ ID NO: 2213203 - RNA, 21 nt, Streptococcus pyogenes M1 GAS
auuuuuuucuaguucguucau

SEQ ID NO: 2213204 - RNA, 15 nt, Streptococcus pyogenes M1 GAS
caaaaaacuagaaac

SEQ ID NO: 2213205 - RNA, 16 nt, Streptococcus pyogenes M1 GAS
caaaaaacuagaaacu

SEQ ID NO: 2213206 - RNA, 22 nt, Streptococcus pyogenes M1 GAS
caaaaaacaagucuaucugcag

SEQ ID NO: 2213207 - RNA, 12 nt, Streptococcus pyogenes M1 GAS
caaaaaaagaca

SEQ ID NO: 2213208 - RNA, 16 nt, Streptococcus pyogenes M1 GAS
caaaaaaagacacaca

SEQ ID NO: 2213209 - RNA, 17 nt, Streptococcus pyogenes M1 GAS
caaaaaaagcaaugacu

SEQ ID NO: 2213210 - RNA, 15 nt, Streptococcus pyogenes M1 GAS
caaaaaguaaaaagc

SEQ ID NO: 2213211 - RNA, 18 nt, Streptococcus pyogenes M1 GAS
caaaaaggcuaagaugga

SEQ ID NO: 2213212 - RNA, 17 nt, Streptococcus pyogenes M1 GAS
caaaaaggcuaagaugg

SEQ ID NO: 2213213 - RNA, 17 nt, Streptococcus pyogenes M1 GAS
caaaaauaaguauagca

SEQ ID NO: 2213214 - RNA, 22 nt, Streptococcus pyogenes M1 GAS
caaaaacgccacgcucaacugg

SEQ ID NO: 2213215 - RNA, 20 nt, Streptococcus pyogenes M1 GAS
caaaaaauuaagaaggaacu

SEQ ID NO: 2213216 - RNA, 18 nt, Streptococcus pyogenes M1 GAS
caaaagaccauaaaaaac

SEQ ID NO: 2213217 - RNA, 15 nt, Streptococcus pyogenes M1 GAS
caaaacccuuucgua

SEQ ID NO: 2213218 - RNA, 17 nt, Streptococcus pyogenes M1 GAS
auuuguuaacaggugac

SEQ ID NO: 2213219 - RNA, 23 nt, Streptococcus pyogenes M1 GAS
auuugucaaaaaguaaaaagcaa

SEQ ID NO: 2213220 - RNA, 19 nt, Streptococcus pyogenes M1 GAS
auuucuugaggugauucuu

SEQ ID NO: 2213221 - RNA, 14 nt, Streptococcus pyogenes M1 GAS
auuucguuuuacgg

SEQ ID NO: 2213222 - RNA, 15 nt, Streptococcus pyogenes M1 GAS
auuucguugacaaag

SEQ ID NO: 2213223 - RNA, 14 nt, Streptococcus pyogenes M1 GAS
auuuucaucaucaa

SEQ ID NO: 2213224 - RNA, 12 nt, Streptococcus pyogenes M1 GAS
auuuucaucauc

SEQ ID NO: 2213225 - RNA, 18 nt, Streptococcus pyogenes M1 GAS
auuuugcaagucucuugc

SEQ ID NO: 2213226 - RNA, 13 nt, Streptococcus pyogenes M1 GAS
auuuuaagacaac

SEQ ID NO: 2213227 - RNA, 22 nt, Streptococcus pyogenes M1 GAS
auuuuacuauggcuucuaaaaa

SEQ ID NO: 2213228 - RNA, 23 nt, Streptococcus pyogenes M1 GAS
auuuuacuauggcuucuaaaaaa

SEQ ID NO: 2213229 - RNA, 11 nt, Streptococcus pyogenes M1 GAS
auuuucaucau

SEQ ID NO: 2213230 - RNA, 22 nt, Streptococcus pyogenes M1 GAS
auuguugacuuugcaaaagaau

SEQ ID NO: 2213231 - RNA, 15 nt, Streptococcus pyogenes M1 GAS
auuguagggauuuuu

SEQ ID NO: 2213232 - RNA, 17 nt, Streptococcus pyogenes M1 GAS
auuguagggauuuuuua

SEQ ID NO: 2213233 - RNA, 14 nt, Streptococcus pyogenes M1 GAS
auugucaaauaaaa

SEQ ID NO: 2213234 - RNA, 15 nt, Streptococcus pyogenes M1 GAS
auugucaaauaaaau

SEQ ID NO: 2213235 - RNA, 20 nt, Streptococcus pyogenes M1 GAS
auuguaauaacaaaaugaag

SEQ ID NO: 2213236 - RNA, 18 nt, Streptococcus pyogenes M1 GAS
auugucaucgcuuugaau

SEQ ID NO: 2213237 - RNA, 14 nt, Streptococcus pyogenes M1 GAS
auuuaguucuaagu

SEQ ID NO: 2213238 - RNA, 15 nt, Streptococcus pyogenes M1 GAS
auuuauuaagauuaa

SEQ ID NO: 2213239 - RNA, 19 nt, Streptococcus pyogenes M1 GAS
auuuauuaagauaccaaau

SEQ ID NO: 2213240 - RNA, 17 nt, Streptococcus pyogenes M1 GAS
auuucaauaauaccauu

SEQ ID NO: 2213241 - RNA, 21 nt, Streptococcus pyogenes M1 GAS
auuucaauaauaccauuuuua

SEQ ID NO: 2213242 - RNA, 18 nt, Streptococcus pyogenes M1 GAS
auuucagauaagaccuuc

SEQ ID NO: 2213243 - RNA, 22 nt, Streptococcus pyogenes M1 GAS
auucuuuuuccguuugagauaa

SEQ ID NO: 2213244 - RNA, 17 nt, Streptococcus pyogenes M1 GAS
auucuuauccauuauaa

SEQ ID NO: 2213245 - RNA, 13 nt, Streptococcus pyogenes M1 GAS
auucuuuuuuacc

SEQ ID NO: 2213246 - RNA, 18 nt, Streptococcus pyogenes M1 GAS
auucuuaaaaaaaucccu

SEQ ID NO: 2213247 - RNA, 13 nt, Streptococcus pyogenes M1 GAS
augccucuugucc

SEQ ID NO: 2213248 - RNA, 22 nt, Streptococcus pyogenes M1 GAS
augcccauugaugaguuuaugu

SEQ ID NO: 2213249 - RNA, 19 nt, Streptococcus pyogenes M1 GAS
augccccaaaguaauccaa

SEQ ID NO: 2213250 - RNA, 23 nt, Streptococcus pyogenes M1 GAS
augccaagauaccggguuguuuu

SEQ ID NO: 2213251 - RNA, 15 nt, Streptococcus pyogenes M1 GAS
augcacacaaaucuu

SEQ ID NO: 2213252 - RNA, 20 nt, Streptococcus pyogenes M1 GAS
augauuugucaaaaaguaaa

SEQ ID NO: 2213253 - RNA, 21 nt, Streptococcus pyogenes M1 GAS
augauuugucaaaaaguaaaa

SEQ ID NO: 2213254 - RNA, 23 nt, Streptococcus pyogenes M1 GAS
augauuugucaaaaaguaaaaag

SEQ ID NO: 2213255 - RNA, 12 nt, Streptococcus pyogenes M1 GAS
augaaucauuuu

SEQ ID NO: 2213256 - RNA, 20 nt, Streptococcus pyogenes M1 GAS
augagauuaacugacaaaaa

SEQ ID NO: 2213257 - RNA, 16 nt, Streptococcus pyogenes M1 GAS
augagggucaaacuga

SEQ ID NO: 2213258 - RNA, 13 nt, Streptococcus pyogenes M1 GAS
augagcaaggcaa

SEQ ID NO: 2213259 - RNA, 20 nt, Streptococcus pyogenes M1 GAS
augaccuuugauaagauauu

SEQ ID NO: 2213260 - RNA, 22 nt, Streptococcus pyogenes M1 GAS
augacgccuccaaauacuggua

SEQ ID NO: 2213261 - RNA, 14 nt, Streptococcus pyogenes M1 GAS
augacuugaccaaa

SEQ ID NO: 2213262 - RNA, 17 nt, Streptococcus pyogenes M1 GAS
augacuucaaaaucacc

SEQ ID NO: 2213263 - RNA, 13 nt, Streptococcus pyogenes M1 GAS
augagaaagccaa

SEQ ID NO: 2213264 - RNA, 14 nt, Streptococcus pyogenes M1 GAS
augaaagguaucua

SEQ ID NO: 2213265 - RNA, 16 nt, Streptococcus pyogenes M1 GAS
auccuuuugaaaaauu

SEQ ID NO: 2213266 - RNA, 13 nt, Streptococcus pyogenes M1 GAS
auccuuuugcuuc

SEQ ID NO: 2213267 - RNA, 22 nt, Streptococcus pyogenes M1 GAS
aucgaaaugauagcaccuaauu

SEQ ID NO: 2213268 - RNA, 14 nt, Streptococcus pyogenes M1 GAS
aucugcagauuuua

SEQ ID NO: 2213269 - RNA, 13 nt, Streptococcus pyogenes M1 GAS
aucugaauuauua

SEQ ID NO: 2213270 - RNA, 19 nt, Streptococcus pyogenes M1 GAS
aucucguaauccuugauuu

SEQ ID NO: 2213271 - RNA, 20 nt, Streptococcus pyogenes M1 GAS
aucuaugauuuguauuuuuu

SEQ ID NO: 2213272 - RNA, 21 nt, Streptococcus pyogenes M1 GAS
aucuccaagaucugcacacac

SEQ ID NO: 2213273 - RNA, 21 nt, Streptococcus pyogenes M1 GAS
aucucaguuuuuuugauuuuc

SEQ ID NO: 2213274 - RNA, 16 nt, Streptococcus pyogenes M1 GAS
augucuugcuaaaauu

SEQ ID NO: 2213275 - RNA, 21 nt, Streptococcus pyogenes M1 GAS
auguccuacacguuccaugau

SEQ ID NO: 2213276 - RNA, 22 nt, Streptococcus pyogenes M1 GAS
auguaugcuguccaugauuuuc

SEQ ID NO: 2213277 - RNA, 18 nt, Streptococcus pyogenes M1 GAS
auuaacguuaacaaaaau

SEQ ID NO: 2213278 - RNA, 23 nt, Streptococcus pyogenes M1 GAS
auuaagauuugaccacaccuaau

SEQ ID NO: 2213279 - RNA, 19 nt, Streptococcus pyogenes M1 GAS
auuaaggauuaugaaaaag

SEQ ID NO: 2213280 - RNA, 23 nt, Streptococcus pyogenes M1 GAS
auuaaggauuaugaaaaagaagu

SEQ ID NO: 2213281 - RNA, 14 nt, Streptococcus pyogenes M1 GAS
auuaauaauauuaa

SEQ ID NO: 2213282 - RNA, 12 nt, Streptococcus pyogenes M1 GAS
auuaauaaauuu

SEQ ID NO: 2213283 - RNA, 17 nt, Streptococcus pyogenes M1 GAS
auguuuauuccaaacau

SEQ ID NO: 2213284 - RNA, 13 nt, Streptococcus pyogenes M1 GAS
auguuuuauuacc

SEQ ID NO: 2213285 - RNA, 22 nt, Streptococcus pyogenes M1 GAS
auguuuugcucgacagugcgca

SEQ ID NO: 2213286 - RNA, 13 nt, Streptococcus pyogenes M1 GAS
auuauaaaagagu

SEQ ID NO: 2213287 - RNA, 14 nt, Streptococcus pyogenes M1 GAS
auuaguaaccauag

SEQ ID NO: 2213288 - RNA, 19 nt, Streptococcus pyogenes M1 GAS
auuauaccaaauuucagau

SEQ ID NO: 2213289 - RNA, 20 nt, Streptococcus pyogenes M1 GAS
auuaccuauugagucuuuuc

SEQ ID NO: 2213290 - RNA, 23 nt, Streptococcus pyogenes M1 GAS
auuaccuauugagucuuuuccua

SEQ ID NO: 2213291 - RNA, 14 nt, Streptococcus pyogenes M1 GAS
auuacgauuaaaag

SEQ ID NO: 2213292 - RNA, 14 nt, Streptococcus pyogenes M1 GAS
auuaauuguuuuag

SEQ ID NO: 2213293 - RNA, 13 nt, Streptococcus pyogenes M1 GAS
auuacauuaggau

SEQ ID NO: 2213294 - RNA, 14 nt, Streptococcus pyogenes M1 GAS
auuacauuaggaua

SEQ ID NO: 2213295 - RNA, 16 nt, Streptococcus pyogenes M1 GAS
auucaagauagugaug

SEQ ID NO: 2213296 - RNA, 13 nt, Streptococcus pyogenes M1 GAS
auuauuuugcuuc

SEQ ID NO: 2213297 - RNA, 17 nt, Streptococcus pyogenes M1 GAS
auuauuuuaauuuuucc

SEQ ID NO: 2213298 - RNA, 18 nt, Streptococcus pyogenes M1 GAS
auuauuuuaauuuuuccu

SEQ ID NO: 2213299 - RNA, 19 nt, Streptococcus pyogenes M1 GAS
auuauuuuaauuuuuccuu

SEQ ID NO: 2213300 - RNA, 21 nt, Streptococcus pyogenes M1 GAS
auuauuaacguuaacaaaaau

SEQ ID NO: 2213301 - RNA, 18 nt, Streptococcus pyogenes M1 GAS
auuauugucacugaaaaa

SEQ ID NO: 2213302 - RNA, 16 nt, Streptococcus pyogenes M1 GAS
auuauucuaaaugaca

SEQ ID NO: 2213303 - RNA, 13 nt, Streptococcus pyogenes M1 GAS
auuaugaggugaa

SEQ ID NO: 2213304 - RNA, 17 nt, Streptococcus pyogenes M1 GAS
auuaugaggugaacacc

SEQ ID NO: 2213305 - RNA, 15 nt, Streptococcus pyogenes M1 GAS
auuaugaaaaagaag

SEQ ID NO: 2213306 - RNA, 20 nt, Streptococcus pyogenes M1 GAS
auuaugaaggugauugacuu

SEQ ID NO: 2213307 - RNA, 14 nt, Streptococcus pyogenes M1 GAS
auuaugaaaaagaa

SEQ ID NO: 2213308 - RNA, 15 nt, Streptococcus pyogenes M1 GAS
auuaucucaacuggu

SEQ ID NO: 2213309 - RNA, 21 nt, Streptococcus pyogenes M1 GAS
auuaucucaacuggugggacu

SEQ ID NO: 2213310 - RNA, 19 nt, Streptococcus pyogenes M1 GAS
auuaucugaauuauuagua

SEQ ID NO: 2213311 - RNA, 14 nt, Streptococcus pyogenes M1 GAS
auuauccaacuuuu

SEQ ID NO: 2213312 - RNA, 17 nt, Streptococcus pyogenes M1 GAS
auuaucaauaacagaaa

SEQ ID NO: 2213313 - RNA, 13 nt, Streptococcus pyogenes M1 GAS
auauaaauuauua

SEQ ID NO: 2213314 - RNA, 22 nt, Streptococcus pyogenes M1 GAS
auauaagaaggucucaaauuuu

SEQ ID NO: 2213315 - RNA, 21 nt, Streptococcus pyogenes M1 GAS
auaguuugacuucaaaaauac

SEQ ID NO: 2213316 - RNA, 22 nt, Streptococcus pyogenes M1 GAS
auaguuugacuucaaaaauacu

SEQ ID NO: 2213317 - RNA, 13 nt, Streptococcus pyogenes M1 GAS
auagggguaauuu

SEQ ID NO: 2213318 - RNA, 14 nt, Streptococcus pyogenes M1 GAS
auaguaaacgaaaa

SEQ ID NO: 2213319 - RNA, 15 nt, Streptococcus pyogenes M1 GAS
auaguaaacgaaaau

SEQ ID NO: 2213320 - RNA, 18 nt, Streptococcus pyogenes M1 GAS
auaguaaccauugccauu

SEQ ID NO: 2213321 - RNA, 17 nt, Streptococcus pyogenes M1 GAS
auaucgccaauaaaaaa

SEQ ID NO: 2213322 - RNA, 17 nt, Streptococcus pyogenes M1 GAS
auaucgacauuuaugcu

SEQ ID NO: 2213323 - RNA, 21 nt, Streptococcus pyogenes M1 GAS
auaucuuuuuuacuuuuaaaa

SEQ ID NO: 2213324 - RNA, 15 nt, Streptococcus pyogenes M1 GAS
auaucuaugauuugu

SEQ ID NO: 2213325 - RNA, 16 nt, Streptococcus pyogenes M1 GAS
auaucuagaacagcug

SEQ ID NO: 2213326 - RNA, 16 nt, Streptococcus pyogenes M1 GAS
auaucuuaccauugua

SEQ ID NO: 2213327 - RNA, 12 nt, Streptococcus pyogenes M1 GAS
auagcugcugcu

SEQ ID NO: 2213328 - RNA, 21 nt, Streptococcus pyogenes M1 GAS
auagcugcugcuaaagcaauc

SEQ ID NO: 2213329 - RNA, 14 nt, Streptococcus pyogenes M1 GAS
auagcucaucccua

SEQ ID NO: 2213330 - RNA, 22 nt, Streptococcus pyogenes M1 GAS
auacuuugguauucuuuuuccg

SEQ ID NO: 2213331 - RNA, 17 nt, Streptococcus pyogenes M1 GAS
auagcaauggcuaaaaa

SEQ ID NO: 2213332 - RNA, 23 nt, Streptococcus pyogenes M1 GAS
auaccguagaaaguagcaccuuu

SEQ ID NO: 2213333 - RNA, 14 nt, Streptococcus pyogenes M1 GAS
auacgguaaaaacu

SEQ ID NO: 2213334 - RNA, 18 nt, Streptococcus pyogenes M1 GAS
auacguaaaaagagaaga

SEQ ID NO: 2213335 - RNA, 21 nt, Streptococcus pyogenes M1 GAS
auacucaauauaauaaaaagc

SEQ ID NO: 2213336 - RNA, 18 nt, Streptococcus pyogenes M1 GAS
auacucaauauaauaaaa

SEQ ID NO: 2213337 - RNA, 15 nt, Streptococcus pyogenes M1 GAS
auauuuuaaaauagu

SEQ ID NO: 2213338 - RNA, 23 nt, Streptococcus pyogenes M1 GAS
auauuguuaauauagucugcaug

SEQ ID NO: 2213339 - RNA, 14 nt, Streptococcus pyogenes M1 GAS
aucaaaaaaagcaa

SEQ ID NO: 2213340 - RNA, 15 nt, Streptococcus pyogenes M1 GAS
aucaaaaaaagcaau

SEQ ID NO: 2213341 - RNA, 18 nt, Streptococcus pyogenes M1 GAS
aucaaaaaaagcaaugac

SEQ ID NO: 2213342 - RNA, 16 nt, Streptococcus pyogenes M1 GAS
auauuuuuucucaaaa

SEQ ID NO: 2213343 - RNA, 19 nt, Streptococcus pyogenes M1 GAS
auaugagggucaaacugau

SEQ ID NO: 2213344 - RNA, 14 nt, Streptococcus pyogenes M1 GAS
auaugauauaaaaa

SEQ ID NO: 2213345 - RNA, 20 nt, Streptococcus pyogenes M1 GAS
aucaaugacuugaccaaaua

SEQ ID NO: 2213346 - RNA, 12 nt, Streptococcus pyogenes M1 GAS
aucaauguuuug

SEQ ID NO: 2213347 - RNA, 17 nt, Streptococcus pyogenes M1 GAS
aucaaccucucagcugu

SEQ ID NO: 2213348 - RNA, 21 nt, Streptococcus pyogenes M1 GAS
aucagcauaaccuuugccauu

SEQ ID NO: 2213349 - RNA, 19 nt, Streptococcus pyogenes M1 GAS
aucaccguaacuugcuuug

SEQ ID NO: 2213350 - RNA, 16 nt, Streptococcus pyogenes M1 GAS
aucacucguaaaaaga

SEQ ID NO: 2213351 - RNA, 23 nt, Streptococcus pyogenes M1 GAS
aguuuucucagagacaauaaggu

SEQ ID NO: 2213352 - RNA, 23 nt, Streptococcus pyogenes M1 GAS
aguuuuuagcagcagaagcaaau

SEQ ID NO: 2213353 - RNA, 15 nt, Streptococcus pyogenes M1 GAS
aguuuuuuuguaauu

SEQ ID NO: 2213354 - RNA, 18 nt, Streptococcus pyogenes M1 GAS
aguugaaccgcuauaaca

SEQ ID NO: 2213355 - RNA, 16 nt, Streptococcus pyogenes M1 GAS
aguugugucuuuucuu

SEQ ID NO: 2213356 - RNA, 20 nt, Streptococcus pyogenes M1 GAS
aguuuaacguaauaaaauaa

SEQ ID NO: 2213357 - RNA, 13 nt, Streptococcus pyogenes M1 GAS
aguguuuugaaug

SEQ ID NO: 2213358 - RNA, 20 nt, Streptococcus pyogenes M1 GAS
aguuaaaaauaacuuuaaaa

SEQ ID NO: 2213359 - RNA, 23 nt, Streptococcus pyogenes M1 GAS
aguguguugucaaacauaacaau

SEQ ID NO: 2213360 - RNA, 19 nt, Streptococcus pyogenes M1 GAS
aguuccugcauguaacaag

SEQ ID NO: 2213361 - RNA, 17 nt, Streptococcus pyogenes M1 GAS
aguuccucgguuuuuuu

SEQ ID NO: 2213362 - RNA, 16 nt, Streptococcus pyogenes M1 GAS
aguucaauggauauaa

SEQ ID NO: 2213363 - RNA, 16 nt, Streptococcus pyogenes M1 GAS
agugguuugcaaauag

SEQ ID NO: 2213364 - RNA, 20 nt, Streptococcus pyogenes M1 GAS
agugguauagacaaacagaa

SEQ ID NO: 2213365 - RNA, 16 nt, Streptococcus pyogenes M1 GAS
aguguagauaaacugg

SEQ ID NO: 2213366 - RNA, 19 nt, Streptococcus pyogenes M1 GAS
aguguacucaucuaaaaaa

SEQ ID NO: 2213367 - RNA, 18 nt, Streptococcus pyogenes M1 GAS
agucucuagucuuuuuau

SEQ ID NO: 2213368 - RNA, 15 nt, Streptococcus pyogenes M1 GAS
agucuuuuucauuuu

SEQ ID NO: 2213369 - RNA, 23 nt, Streptococcus pyogenes M1 GAS
agucuuuuccuaacaaaaucaca

SEQ ID NO: 2213370 - RNA, 14 nt, Streptococcus pyogenes M1 GAS
agucuuuaaaaaac

SEQ ID NO: 2213371 - RNA, 17 nt, Streptococcus pyogenes M1 GAS
auaacuuuuagcuaaga

SEQ ID NO: 2213372 - RNA, 15 nt, Streptococcus pyogenes M1 GAS
auaacuguuuuucuu

SEQ ID NO: 2213373 - RNA, 17 nt, Streptococcus pyogenes M1 GAS
auaacuguuuuucuuau

SEQ ID NO: 2213374 - RNA, 15 nt, Streptococcus pyogenes M1 GAS
auaaccgccaucuaa

SEQ ID NO: 2213375 - RNA, 20 nt, Streptococcus pyogenes M1 GAS
auaaauuugggcaguaguuu

SEQ ID NO: 2213376 - RNA, 15 nt, Streptococcus pyogenes M1 GAS
auaaacaaagccagu

SEQ ID NO: 2213377 - RNA, 22 nt, Streptococcus pyogenes M1 GAS
auaaaaaaccuuaucaaaccaa

SEQ ID NO: 2213378 - RNA, 13 nt, Streptococcus pyogenes M1 GAS
auaaacuacacca

SEQ ID NO: 2213379 - RNA, 16 nt, Streptococcus pyogenes M1 GAS
auaaaucuuacuaacu

SEQ ID NO: 2213380 - RNA, 23 nt, Streptococcus pyogenes M1 GAS
auaaagcguugacaguuaaaaau

SEQ ID NO: 2213381 - RNA, 18 nt, Streptococcus pyogenes M1 GAS
auaauaucagcuacacuu

SEQ ID NO: 2213382 - RNA, 15 nt, Streptococcus pyogenes M1 GAS
auaaucguaacuggu

SEQ ID NO: 2213383 - RNA, 13 nt, Streptococcus pyogenes M1 GAS
auaauaaagugcg

SEQ ID NO: 2213384 - RNA, 15 nt, Streptococcus pyogenes M1 GAS
auaaguauucuaaaa

SEQ ID NO: 2213385 - RNA, 21 nt, Streptococcus pyogenes M1 GAS
auaaguauagcauaaaauagu

SEQ ID NO: 2213386 - RNA, 21 nt, Streptococcus pyogenes M1 GAS
auaaguagcguacauggaugc

SEQ ID NO: 2213387 - RNA, 12 nt, Streptococcus pyogenes M1 GAS
auaagguuuuuu

SEQ ID NO: 2213388 - RNA, 13 nt, Streptococcus pyogenes M1 GAS
auaagguuuuuuu

SEQ ID NO: 2213389 - RNA, 13 nt, Streptococcus pyogenes M1 GAS
auaagauacugcc

SEQ ID NO: 2213390 - RNA, 23 nt, Streptococcus pyogenes M1 GAS
auaagagaagugauguuuuuaca

SEQ ID NO: 2213391 - RNA, 20 nt, Streptococcus pyogenes M1 GAS
auaagaaggucucaaauuuu

SEQ ID NO: 2213392 - RNA, 17 nt, Streptococcus pyogenes M1 GAS
aggcaauccaaaucaac

SEQ ID NO: 2213393 - RNA, 18 nt, Streptococcus pyogenes M1 GAS
aggcaagcaggcuacaca

SEQ ID NO: 2213394 - RNA, 22 nt, Streptococcus pyogenes M1 GAS
aggcaagcaggcuacacaguua

SEQ ID NO: 2213395 - RNA, 17 nt, Streptococcus pyogenes M1 GAS
aggcagacaauuauuuu

SEQ ID NO: 2213396 - RNA, 14 nt, Streptococcus pyogenes M1 GAS
aggcacagaaaaaa

SEQ ID NO: 2213397 - RNA, 15 nt, Streptococcus pyogenes M1 GAS
aggcacagaaaaaag

SEQ ID NO: 2213398 - RNA, 17 nt, Streptococcus pyogenes M1 GAS
aggauuaugaaaaagaa

SEQ ID NO: 2213399 - RNA, 18 nt, Streptococcus pyogenes M1 GAS
aggcaaaacaaaaagaga

SEQ ID NO: 2213400 - RNA, 17 nt, Streptococcus pyogenes M1 GAS
aggauuuagcuguuauu

SEQ ID NO: 2213401 - RNA, 14 nt, Streptococcus pyogenes M1 GAS
aggauuuaguuuug

SEQ ID NO: 2213402 - RNA, 16 nt, Streptococcus pyogenes M1 GAS
aggccagcaaggcacc

SEQ ID NO: 2213403 - RNA, 16 nt, Streptococcus pyogenes M1 GAS
aggaaggcuuguucuu

SEQ ID NO: 2213404 - RNA, 13 nt, Streptococcus pyogenes M1 GAS
aggaauaaaaugc

SEQ ID NO: 2213405 - RNA, 11 nt, Streptococcus pyogenes M1 GAS
aggaauaaaau

SEQ ID NO: 2213406 - RNA, 16 nt, Streptococcus pyogenes M1 GAS
aggaauuguugacuuu

SEQ ID NO: 2213407 - RNA, 22 nt, Streptococcus pyogenes M1 GAS
aggaauugcagcuaaaaacaau

SEQ ID NO: 2213408 - RNA, 19 nt, Streptococcus pyogenes M1 GAS
aggaauaucaugaaguaua

SEQ ID NO: 2213409 - RNA, 20 nt, Streptococcus pyogenes M1 GAS
aggaauaucaugaaguauag

SEQ ID NO: 2213410 - RNA, 20 nt, Streptococcus pyogenes M1 GAS
aggaaagauaguaaagaaga

SEQ ID NO: 2213411 - RNA, 16 nt, Streptococcus pyogenes M1 GAS
agcuuuuuaaagagcc

SEQ ID NO: 2213412 - RNA, 14 nt, Streptococcus pyogenes M1 GAS
aggaggcaacugug

SEQ ID NO: 2213413 - RNA, 12 nt, Streptococcus pyogenes M1 GAS
agcuugcuaaga

SEQ ID NO: 2213414 - RNA, 16 nt, Streptococcus pyogenes M1 GAS
agcuugcuaagagaau

SEQ ID NO: 2213415 - RNA, 18 nt, Streptococcus pyogenes M1 GAS
agcuugaucuuacaaagg

SEQ ID NO: 2213416 - RNA, 17 nt, Streptococcus pyogenes M1 GAS
agcuuuaguugcuucuu

SEQ ID NO: 2213417 - RNA, 18 nt, Streptococcus pyogenes M1 GAS
agcuuucuacuaaaaaag

SEQ ID NO: 2213418 - RNA, 15 nt, Streptococcus pyogenes M1 GAS
agcuuaucaagguug

SEQ ID NO: 2213419 - RNA, 22 nt, Streptococcus pyogenes M1 GAS
agcuuaaaaguuagccaagcaa

SEQ ID NO: 2213420 - RNA, 22 nt, Streptococcus pyogenes M1 GAS
agcuuacagcugguuuuuuaau

SEQ ID NO: 2213421 - RNA, 14 nt, Streptococcus pyogenes M1 GAS
agcuggaguuuuuu

SEQ ID NO: 2213422 - RNA, 12 nt, Streptococcus pyogenes M1 GAS
agcgucugcaug

SEQ ID NO: 2213423 - RNA, 17 nt, Streptococcus pyogenes M1 GAS
agcguuagcuuuuuaaa

SEQ ID NO: 2213424 - RNA, 15 nt, Streptococcus pyogenes M1 GAS
agcguguaccaagcu

SEQ ID NO: 2213425 - RNA, 18 nt, Streptococcus pyogenes M1 GAS
agcucaaccucugaaggc

SEQ ID NO: 2213426 - RNA, 21 nt, Streptococcus pyogenes M1 GAS
agcucaaccucugaaggcaca

SEQ ID NO: 2213427 - RNA, 18 nt, Streptococcus pyogenes M1 GAS
agcuaucauacaacugac

SEQ ID NO: 2213428 - RNA, 15 nt, Streptococcus pyogenes M1 GAS
agggauccugcuagu

SEQ ID NO: 2213429 - RNA, 12 nt, Streptococcus pyogenes M1 GAS
aggcuuucauua

SEQ ID NO: 2213430 - RNA, 16 nt, Streptococcus pyogenes M1 GAS
agggcuuaaucuggag

SEQ ID NO: 2213431 - RNA, 16 nt, Streptococcus pyogenes M1 GAS
agggguaaaaaauuua

SEQ ID NO: 2213432 - RNA, 23 nt, Streptococcus pyogenes M1 GAS
agggguaaaaaauuuaauaguuu

SEQ ID NO: 2213433 - RNA, 16 nt, Streptococcus pyogenes M1 GAS
aggcucgacaaaggcu

SEQ ID NO: 2213434 - RNA, 13 nt, Streptococcus pyogenes M1 GAS
aggcucauauuag

SEQ ID NO: 2213435 - RNA, 23 nt, Streptococcus pyogenes M1 GAS
aggccuagcuuuuuacaucaaaa

SEQ ID NO: 2213436 - RNA, 19 nt, Streptococcus pyogenes M1 GAS
aggcgauuagcccaagggc

SEQ ID NO: 2213437 - RNA, 15 nt, Streptococcus pyogenes M1 GAS
aggccuguauuucuu

SEQ ID NO: 2213438 - RNA, 15 nt, Streptococcus pyogenes M1 GAS
aguaagaaauuacuu

SEQ ID NO: 2213439 - RNA, 23 nt, Streptococcus pyogenes M1 GAS
aguaagauggugcuuuaaaaagu

SEQ ID NO: 2213440 - RNA, 15 nt, Streptococcus pyogenes M1 GAS
aguaaggaaaucaau

SEQ ID NO: 2213441 - RNA, 14 nt, Streptococcus pyogenes M1 GAS
aguaagcagcauca

SEQ ID NO: 2213442 - RNA, 16 nt, Streptococcus pyogenes M1 GAS
aguaaggaccaagauu

SEQ ID NO: 2213443 - RNA, 16 nt, Streptococcus pyogenes M1 GAS
aguacaaggcaaucca

SEQ ID NO: 2213444 - RNA, 21 nt, Streptococcus pyogenes M1 GAS
aguaaugugggauauuuagau

SEQ ID NO: 2213445 - RNA, 13 nt, Streptococcus pyogenes M1 GAS
aguaaaggauuua

SEQ ID NO: 2213446 - RNA, 13 nt, Streptococcus pyogenes M1 GAS
aggguuauuauuu

SEQ ID NO: 2213447 - RNA, 20 nt, Streptococcus pyogenes M1 GAS
agguaucccauaucucuaua

SEQ ID NO: 2213448 - RNA, 20 nt, Streptococcus pyogenes M1 GAS
agguaauagcguaaagcaag

SEQ ID NO: 2213449 - RNA, 21 nt, Streptococcus pyogenes M1 GAS
agguagaugauuacauuagga

SEQ ID NO: 2213450 - RNA, 18 nt, Streptococcus pyogenes M1 GAS
aggugccuguuuuugcug

SEQ ID NO: 2213451 - RNA, 23 nt, Streptococcus pyogenes M1 GAS
aggugaguuuuuucuaaaagaga

SEQ ID NO: 2213452 - RNA, 16 nt, Streptococcus pyogenes M1 GAS
aggugauugacuugug

SEQ ID NO: 2213453 - RNA, 23 nt, Streptococcus pyogenes M1 GAS
aggucugcgcgacuaaaaucaug

SEQ ID NO: 2213454 - RNA, 16 nt, Streptococcus pyogenes M1 GAS
aggucugcuucuuacu

SEQ ID NO: 2213455 - RNA, 15 nt, Streptococcus pyogenes M1 GAS
acguaaaaagagaag

SEQ ID NO: 2213456 - RNA, 23 nt, Streptococcus pyogenes M1 GAS
acgguguaauccccucguuuaaa

SEQ ID NO: 2213457 - RNA, 22 nt, Streptococcus pyogenes M1 GAS
acggucauuaauaaaagauuuc

SEQ ID NO: 2213458 - RNA, 21 nt, Streptococcus pyogenes M1 GAS
acgguaucacucguaaaaaga

SEQ ID NO: 2213459 - RNA, 14 nt, Streptococcus pyogenes M1 GAS
acucaaaaaauaca

SEQ ID NO: 2213460 - RNA, 16 nt, Streptococcus pyogenes M1 GAS
acucaaaaaauacaau

SEQ ID NO: 2213461 - RNA, 19 nt, Streptococcus pyogenes M1 GAS
acuauggcuucuaaaaaag

SEQ ID NO: 2213462 - RNA, 19 nt, Streptococcus pyogenes M1 GAS
acuaucauuggggaaacua

SEQ ID NO: 2213463 - RNA, 16 nt, Streptococcus pyogenes M1 GAS
acuagaaaaagcaaug

SEQ ID NO: 2213464 - RNA, 19 nt, Streptococcus pyogenes M1 GAS
acuagaaaaagcaaugauu

SEQ ID NO: 2213465 - RNA, 14 nt, Streptococcus pyogenes M1 GAS
acuagaaaaagcaa

SEQ ID NO: 2213466 - RNA, 15 nt, Streptococcus pyogenes M1 GAS
acuagaaaaagcaau

SEQ ID NO: 2213467 - RNA, 13 nt, Streptococcus pyogenes M1 GAS
acuagaaaaagca

SEQ ID NO: 2213468 - RNA, 17 nt, Streptococcus pyogenes M1 GAS
acguuauucucugcuag

SEQ ID NO: 2213469 - RNA, 12 nt, Streptococcus pyogenes M1 GAS
acuaaaaucaug

SEQ ID NO: 2213470 - RNA, 21 nt, Streptococcus pyogenes M1 GAS
acuucaaggaaggcuuguucu

SEQ ID NO: 2213471 - RNA, 23 nt, Streptococcus pyogenes M1 GAS
acuuccaucaucgaguggauaca

SEQ ID NO: 2213472 - RNA, 12 nt, Streptococcus pyogenes M1 GAS
acuguaaauaga

SEQ ID NO: 2213473 - RNA, 18 nt, Streptococcus pyogenes M1 GAS
acuguaaauagauaaugu

SEQ ID NO: 2213474 - RNA, 21 nt, Streptococcus pyogenes M1 GAS
acugggucaacuccaaucuca

SEQ ID NO: 2213475 - RNA, 15 nt, Streptococcus pyogenes M1 GAS
acugagccccaaaag

SEQ ID NO: 2213476 - RNA, 15 nt, Streptococcus pyogenes M1 GAS
acugagccuuuuuug

SEQ ID NO: 2213477 - RNA, 20 nt, Streptococcus pyogenes M1 GAS
acucaauauaauaaaaagca

SEQ ID NO: 2213478 - RNA, 19 nt, Streptococcus pyogenes M1 GAS
acuccuggauuaaaugccc

SEQ ID NO: 2213479 - RNA, 16 nt, Streptococcus pyogenes M1 GAS
acuccugagucggcaa

SEQ ID NO: 2213480 - RNA, 12 nt, Streptococcus pyogenes M1 GAS
acuccugauaau

SEQ ID NO: 2213481 - RNA, 21 nt, Streptococcus pyogenes M1 GAS
acuccugauaaugauuuauua

SEQ ID NO: 2213482 - RNA, 16 nt, Streptococcus pyogenes M1 GAS
agauucaauaugaaaa

SEQ ID NO: 2213483 - RNA, 22 nt, Streptococcus pyogenes M1 GAS
agauuggauuucgacucaugau

SEQ ID NO: 2213484 - RNA, 17 nt, Streptococcus pyogenes M1 GAS
agauuaaacuuacaaaa

SEQ ID NO: 2213485 - RNA, 17 nt, Streptococcus pyogenes M1 GAS
agauuaacugacaaaaa

SEQ ID NO: 2213486 - RNA, 17 nt, Streptococcus pyogenes M1 GAS
agauggguuagcucugu

SEQ ID NO: 2213487 - RNA, 21 nt, Streptococcus pyogenes M1 GAS
agauguggcuaguaaguuuuu

SEQ ID NO: 2213488 - RNA, 20 nt, Streptococcus pyogenes M1 GAS
agaugcuugcucaauuuuug

SEQ ID NO: 2213489 - RNA, 14 nt, Streptococcus pyogenes M1 GAS
agauccuacaagag

SEQ ID NO: 2213490 - RNA, 13 nt, Streptococcus pyogenes M1 GAS
agaucuucuuuug

SEQ ID NO: 2213491 - RNA, 23 nt, Streptococcus pyogenes M1 GAS
agaugagaaagccaagcuuuaaa

SEQ ID NO: 2213492 - RNA, 23 nt, Streptococcus pyogenes M1 GAS
agaugagcgucaccuucucuuuu

SEQ ID NO: 2213493 - RNA, 15 nt, Streptococcus pyogenes M1 GAS
agaugacgguaaaua

SEQ ID NO: 2213494 - RNA, 15 nt, Streptococcus pyogenes M1 GAS
agauaguaaagaaga

SEQ ID NO: 2213495 - RNA, 18 nt, Streptococcus pyogenes M1 GAS
agauagucaaaaagacuu

SEQ ID NO: 2213496 - RNA, 18 nt, Streptococcus pyogenes M1 GAS
agauauucuuuggcaaga

SEQ ID NO: 2213497 - RNA, 21 nt, Streptococcus pyogenes M1 GAS
agauauucuuuggcaagauaa

SEQ ID NO: 2213498 - RNA, 20 nt, Streptococcus pyogenes M1 GAS
agauauuguuaauauagucu

SEQ ID NO: 2213499 - RNA, 21 nt, Streptococcus pyogenes M1 GAS
agagucuuaguuuaggaauca

SEQ ID NO: 2213500 - RNA, 19 nt, Streptococcus pyogenes M1 GAS
agaguuugaggugauguuc

SEQ ID NO: 2213501 - RNA, 16 nt, Streptococcus pyogenes M1 GAS
agagaugauagguuuu

SEQ ID NO: 2213502 - RNA, 17 nt, Streptococcus pyogenes M1 GAS
agagagguugguaaaaa

SEQ ID NO: 2213503 - RNA, 18 nt, Streptococcus pyogenes M1 GAS
agagauaaaaaguaaaau

SEQ ID NO: 2213504 - RNA, 21 nt, Streptococcus pyogenes M1 GAS
agagagaaugauaguaaacga

SEQ ID NO: 2213505 - RNA, 20 nt, Streptococcus pyogenes M1 GAS
agagagaagcuguucucuuu

SEQ ID NO: 2213506 - RNA, 20 nt, Streptococcus pyogenes M1 GAS
agacuaugguggguuucguu

SEQ ID NO: 2213507 - RNA, 21 nt, Streptococcus pyogenes M1 GAS
agacuauaaaagucaacugau

SEQ ID NO: 2213508 - RNA, 19 nt, Streptococcus pyogenes M1 GAS
agaaaaucuaaucagaacu

SEQ ID NO: 2213509 - RNA, 13 nt, Streptococcus pyogenes M1 GAS
agaaaggaauuga

SEQ ID NO: 2213510 - RNA, 14 nt, Streptococcus pyogenes M1 GAS
agaaaggaauugaa

SEQ ID NO: 2213511 - RNA, 12 nt, Streptococcus pyogenes M1 GAS
agaaaaagcaau

SEQ ID NO: 2213512 - RNA, 14 nt, Streptococcus pyogenes M1 GAS
agaaaaagcaauga

SEQ ID NO: 2213513 - RNA, 15 nt, Streptococcus pyogenes M1 GAS
agaaaaagcaaugau

SEQ ID NO: 2213514 - RNA, 22 nt, Streptococcus pyogenes M1 GAS
agaacgaauugugucauuucuu

SEQ ID NO: 2213515 - RNA, 17 nt, Streptococcus pyogenes M1 GAS
agaacgagucaauuuag

SEQ ID NO: 2213516 - RNA, 20 nt, Streptococcus pyogenes M1 GAS
agacaucacgauuugcugag

SEQ ID NO: 2213517 - RNA, 20 nt, Streptococcus pyogenes M1 GAS
agaauuucaaguucucuacu

SEQ ID NO: 2213518 - RNA, 21 nt, Streptococcus pyogenes M1 GAS
agacaauaaggucaucagaau

SEQ ID NO: 2213519 - RNA, 19 nt, Streptococcus pyogenes M1 GAS
agacaaggugaguauaaga

SEQ ID NO: 2213520 - RNA, 14 nt, Streptococcus pyogenes M1 GAS
agaagcaaaauuau

SEQ ID NO: 2213521 - RNA, 16 nt, Streptococcus pyogenes M1 GAS
acagguagauguuguu

SEQ ID NO: 2213522 - RNA, 16 nt, Streptococcus pyogenes M1 GAS
acaguauguaaauaua

SEQ ID NO: 2213523 - RNA, 22 nt, Streptococcus pyogenes M1 GAS
acagucuuuuuuauaauuauuu

SEQ ID NO: 2213524 - RNA, 16 nt, Streptococcus pyogenes M1 GAS
acaugaccuuccccau

SEQ ID NO: 2213525 - RNA, 19 nt, Streptococcus pyogenes M1 GAS
acaugcauaggaucagugc

SEQ ID NO: 2213526 - RNA, 15 nt, Streptococcus pyogenes M1 GAS
acaucacguaaccaa

SEQ ID NO: 2213527 - RNA, 15 nt, Streptococcus pyogenes M1 GAS
acaucaaaaagagga

SEQ ID NO: 2213528 - RNA, 20 nt, Streptococcus pyogenes M1 GAS
acaucaaaaaaagcaaugac

SEQ ID NO: 2213529 - RNA, 13 nt, Streptococcus pyogenes M1 GAS
acaucaaaaaaag

SEQ ID NO: 2213530 - RNA, 15 nt, Streptococcus pyogenes M1 GAS
acaucaaaaaaagca

SEQ ID NO: 2213531 - RNA, 15 nt, Streptococcus pyogenes M1 GAS
acagauugaagacaa

SEQ ID NO: 2213532 - RNA, 18 nt, Streptococcus pyogenes M1 GAS
acagcaccuucaaccgcu

SEQ ID NO: 2213533 - RNA, 15 nt, Streptococcus pyogenes M1 GAS
acagcguaagccaaa

SEQ ID NO: 2213534 - RNA, 23 nt, Streptococcus pyogenes M1 GAS
acagccucuuggaaacaagagcu

SEQ ID NO: 2213535 - RNA, 19 nt, Streptococcus pyogenes M1 GAS
acagccguucuuaaaagaa

SEQ ID NO: 2213536 - RNA, 21 nt, Streptococcus pyogenes M1 GAS
acagcugaaacaccugcugcu

SEQ ID NO: 2213537 - RNA, 20 nt, Streptococcus pyogenes M1 GAS
accccaaaggcugaugcgau

SEQ ID NO: 2213538 - RNA, 13 nt, Streptococcus pyogenes M1 GAS
accauugccauua

SEQ ID NO: 2213539 - RNA, 12 nt, Streptococcus pyogenes M1 GAS
accauugccauu

SEQ ID NO: 2213540 - RNA, 22 nt, Streptococcus pyogenes M1 GAS
accauugccauuaauaauauua

SEQ ID NO: 2213541 - RNA, 16 nt, Streptococcus pyogenes M1 GAS
accauaucgacauuua

SEQ ID NO: 2213542 - RNA, 15 nt, Streptococcus pyogenes M1 GAS
accagaugcuugcuc

SEQ ID NO: 2213543 - RNA, 14 nt, Streptococcus pyogenes M1 GAS
accagccacuacaa

SEQ ID NO: 2213544 - RNA, 16 nt, Streptococcus pyogenes M1 GAS
accaauuguugaauaa

SEQ ID NO: 2213545 - RNA, 16 nt, Streptococcus pyogenes M1 GAS
accaauauagcaaucu

SEQ ID NO: 2213546 - RNA, 16 nt, Streptococcus pyogenes M1 GAS
accaaaucaaaaagcu

SEQ ID NO: 2213547 - RNA, 16 nt, Streptococcus pyogenes M1 GAS
accuuuauuugcuuuu

SEQ ID NO: 2213548 - RNA, 15 nt, Streptococcus pyogenes M1 GAS
accuuucaagacaag

SEQ ID NO: 2213549 - RNA, 23 nt, Streptococcus pyogenes M1 GAS
accuuugauaagauauuguuaau

SEQ ID NO: 2213550 - RNA, 12 nt, Streptococcus pyogenes M1 GAS
accuuugccauu

SEQ ID NO: 2213551 - RNA, 13 nt, Streptococcus pyogenes M1 GAS
accuuugccauuu

SEQ ID NO: 2213552 - RNA, 20 nt, Streptococcus pyogenes M1 GAS
accuugcuuguagauaccua

SEQ ID NO: 2213553 - RNA, 18 nt, Streptococcus pyogenes M1 GAS
accuguggucaaaagucc

SEQ ID NO: 2213554 - RNA, 18 nt, Streptococcus pyogenes M1 GAS
accuuagugguuugcaaa

SEQ ID NO: 2213555 - RNA, 22 nt, Streptococcus pyogenes M1 GAS
accuuaggcagacaauuauuuu

SEQ ID NO: 2213556 - RNA, 21 nt, Streptococcus pyogenes M1 GAS
accuuaggcagacaauuauuu

SEQ ID NO: 2213557 - RNA, 18 nt, Streptococcus pyogenes M1 GAS
accugagccuccaacaua

SEQ ID NO: 2213558 - RNA, 19 nt, Streptococcus pyogenes M1 GAS
accugagccuccaacauag

SEQ ID NO: 2213559 - RNA, 19 nt, Streptococcus pyogenes M1 GAS
accuccaccggucgauggg

SEQ ID NO: 2213560 - RNA, 15 nt, Streptococcus pyogenes M1 GAS
accuccagcugacag

SEQ ID NO: 2213561 - RNA, 18 nt, Streptococcus pyogenes M1 GAS
accguuccugucgcagau

SEQ ID NO: 2213562 - RNA, 13 nt, Streptococcus pyogenes M1 GAS
accuaauaaaaua

SEQ ID NO: 2213563 - RNA, 21 nt, Streptococcus pyogenes M1 GAS
accuauagaaaguuauaaaga

SEQ ID NO: 2213564 - RNA, 22 nt, Streptococcus pyogenes M1 GAS
accuacgauaaaacaaauaauu

SEQ ID NO: 2213565 - RNA, 21 nt, Streptococcus pyogenes M1 GAS
accuacuagcacaaaaucauu

SEQ ID NO: 2213566 - RNA, 15 nt, Streptococcus pyogenes M1 GAS
accguaacuugcuuu

SEQ ID NO: 2213567 - RNA, 15 nt, Streptococcus pyogenes M1 GAS
accgcgaauaugaua

SEQ ID NO: 2213568 - RNA, 18 nt, Streptococcus pyogenes M1 GAS
aaccauuauaaaagagug

SEQ ID NO: 2213569 - RNA, 21 nt, Streptococcus pyogenes M1 GAS
aaccauuauaaaagagugcag

SEQ ID NO: 2213570 - RNA, 13 nt, Streptococcus pyogenes M1 GAS
aaccauugccauu

SEQ ID NO: 2213571 - RNA, 15 nt, Streptococcus pyogenes M1 GAS
aacccacauacggcu

SEQ ID NO: 2213572 - RNA, 17 nt, Streptococcus pyogenes M1 GAS
aaccauagaagccaauu

SEQ ID NO: 2213573 - RNA, 14 nt, Streptococcus pyogenes M1 GAS
aaccgcuuccuuug

SEQ ID NO: 2213574 - RNA, 19 nt, Streptococcus pyogenes M1 GAS
aacauucacggugggcuuu

SEQ ID NO: 2213575 - RNA, 14 nt, Streptococcus pyogenes M1 GAS
aacaucaaaaagag

SEQ ID NO: 2213576 - RNA, 15 nt, Streptococcus pyogenes M1 GAS
aacaucaaaaagagg

SEQ ID NO: 2213577 - RNA, 12 nt, Streptococcus pyogenes M1 GAS
aacaguuccagu

SEQ ID NO: 2213578 - RNA, 17 nt, Streptococcus pyogenes M1 GAS
aacauaaggauuauuag

SEQ ID NO: 2213579 - RNA, 12 nt, Streptococcus pyogenes M1 GAS
aacagcauuuuc

SEQ ID NO: 2213580 - RNA, 21 nt, Streptococcus pyogenes M1 GAS
aacagcauuuucaucaucaag

SEQ ID NO: 2213581 - RNA, 11 nt, Streptococcus pyogenes M1 GAS
aacagaaagcg

SEQ ID NO: 2213582 - RNA, 19 nt, Streptococcus pyogenes M1 GAS
aacagaaagcggaagaaca

SEQ ID NO: 2213583 - RNA, 13 nt, Streptococcus pyogenes M1 GAS
aacacucaucaua

SEQ ID NO: 2213584 - RNA, 22 nt, Streptococcus pyogenes M1 GAS
aacaccguuuuuuguuguaaaa

SEQ ID NO: 2213585 - RNA, 22 nt, Streptococcus pyogenes M1 GAS
aacaaugaaacguuauuaaaga

SEQ ID NO: 2213586 - RNA, 19 nt, Streptococcus pyogenes M1 GAS
aacaauuuuucaaaaaaac

SEQ ID NO: 2213587 - RNA, 21 nt, Streptococcus pyogenes M1 GAS
aacaauuuuucaaaaaaacuu

SEQ ID NO: 2213588 - RNA, 15 nt, Streptococcus pyogenes M1 GAS
aacacaauucaagau

SEQ ID NO: 2213589 - RNA, 14 nt, Streptococcus pyogenes M1 GAS
aacaaauaauuccu

SEQ ID NO: 2213590 - RNA, 22 nt, Streptococcus pyogenes M1 GAS
aaauuuuuuucaggauguuuau

SEQ ID NO: 2213591 - RNA, 13 nt, Streptococcus pyogenes M1 GAS
aacaagccauaaa

SEQ ID NO: 2213592 - RNA, 13 nt, Streptococcus pyogenes M1 GAS
aacaagagcucaa

SEQ ID NO: 2213593 - RNA, 20 nt, Streptococcus pyogenes M1 GAS
aacaagagcucaaccucuga

SEQ ID NO: 2213594 - RNA, 21 nt, Streptococcus pyogenes M1 GAS
aaauuugggcaguaguuuuag

SEQ ID NO: 2213595 - RNA, 21 nt, Streptococcus pyogenes M1 GAS
aaauuuuagguaaaguuagga

SEQ ID NO: 2213596 - RNA, 12 nt, Streptococcus pyogenes M1 GAS
aaauuuuaaaug

SEQ ID NO: 2213597 - RNA, 23 nt, Streptococcus pyogenes M1 GAS
aaauuguagggauuuuuuaacua

SEQ ID NO: 2213598 - RNA, 14 nt, Streptococcus pyogenes M1 GAS
aaauuguuugauug

SEQ ID NO: 2213599 - RNA, 15 nt, Streptococcus pyogenes M1 GAS
uuucaaaaaaacuuc

SEQ ID NO: 2213600 - RNA, 23 nt, Streptococcus pyogenes M1 GAS
uuucaaaaaaacuucacauugua

SEQ ID NO: 2213601 - RNA, 20 nt, Streptococcus pyogenes M1 GAS
aaauugauuauucuuuauuu

SEQ ID NO: 2213602 - RNA, 16 nt, Streptococcus pyogenes M1 GAS
aagaaagacuuaagga

SEQ ID NO: 2213603 - RNA, 21 nt, Streptococcus pyogenes M1 GAS
aagaacagcauuuucaucauc

SEQ ID NO: 2213604 - RNA, 16 nt, Streptococcus pyogenes M1 GAS
aacuugucaagccaua

SEQ ID NO: 2213605 - RNA, 22 nt, Streptococcus pyogenes M1 GAS
aacuugaauaucgccaauaaaa

SEQ ID NO: 2213606 - RNA, 15 nt, Streptococcus pyogenes M1 GAS
aacuuuuagcuaaga

SEQ ID NO: 2213607 - RNA, 19 nt, Streptococcus pyogenes M1 GAS
aacuuuuagcuaagaauaa

SEQ ID NO: 2213608 - RNA, 21 nt, Streptococcus pyogenes M1 GAS
aacuucacauuguauuagcaa

SEQ ID NO: 2213609 - RNA, 21 nt, Streptococcus pyogenes M1 GAS
aacuggcacaaacucugccaa

SEQ ID NO: 2213610 - RNA, 22 nt, Streptococcus pyogenes M1 GAS
aacuguuuuucuuauauugugc

SEQ ID NO: 2213611 - RNA, 16 nt, Streptococcus pyogenes M1 GAS
aacugauaaaacucaa

SEQ ID NO: 2213612 - RNA, 21 nt, Streptococcus pyogenes M1 GAS
aacugcacugagccccaaaag

SEQ ID NO: 2213613 - RNA, 19 nt, Streptococcus pyogenes M1 GAS
aacucgauaaaaacgauca

SEQ ID NO: 2213614 - RNA, 13 nt, Streptococcus pyogenes M1 GAS
aacuccugauaau

SEQ ID NO: 2213615 - RNA, 18 nt, Streptococcus pyogenes M1 GAS
aacuccugauaaugauuu

SEQ ID NO: 2213616 - RNA, 14 nt, Streptococcus pyogenes M1 GAS
aacucuuguagaau

SEQ ID NO: 2213617 - RNA, 15 nt, Streptococcus pyogenes M1 GAS
aacucucauaaaauu

SEQ ID NO: 2213618 - RNA, 22 nt, Streptococcus pyogenes M1 GAS
aacucugccaauuguucauuaa

SEQ ID NO: 2213619 - RNA, 17 nt, Streptococcus pyogenes M1 GAS
aacucaaaccaaacaag

SEQ ID NO: 2213620 - RNA, 15 nt, Streptococcus pyogenes M1 GAS
aacuauuuuuaccuu

SEQ ID NO: 2213621 - RNA, 12 nt, Streptococcus pyogenes M1 GAS
aacucaaaaagc

SEQ ID NO: 2213622 - RNA, 14 nt, Streptococcus pyogenes M1 GAS
aacuauaggagaac

SEQ ID NO: 2213623 - RNA, 21 nt, Streptococcus pyogenes M1 GAS
aacuauauuguuaguuuuauc

SEQ ID NO: 2213624 - RNA, 20 nt, Streptococcus pyogenes M1 GAS
aacuauauuguuaguuuuau

SEQ ID NO: 2213625 - RNA, 18 nt, Streptococcus pyogenes M1 GAS
aacuaucaaguaugcuuu

SEQ ID NO: 2213626 - RNA, 20 nt, Streptococcus pyogenes M1 GAS
aacguguauucuuaaaaaaa

SEQ ID NO: 2213627 - RNA, 22 nt, Streptococcus pyogenes M1 GAS
aaccguuccugucgcagauggg

SEQ ID NO: 2213628 - RNA, 16 nt, Streptococcus pyogenes M1 GAS
aaccugcauaucugcc

SEQ ID NO: 2213629 - RNA, 17 nt, Streptococcus pyogenes M1 GAS
aaccugcauaucugccc

SEQ ID NO: 2213630 - RNA, 22 nt, Streptococcus pyogenes M1 GAS
aaccuuuuggcuguauuuacug

SEQ ID NO: 2213631 - RNA, 17 nt, Streptococcus pyogenes M1 GAS
aaccuuuagagaaucaa

SEQ ID NO: 2213632 - RNA, 13 nt, Streptococcus pyogenes M1 GAS
aauaugugauuau

SEQ ID NO: 2213633 - RNA, 17 nt, Streptococcus pyogenes M1 GAS
aauccuaacaauuuuuc

SEQ ID NO: 2213634 - RNA, 21 nt, Streptococcus pyogenes M1 GAS
aaucccuugcuuugauuuuuc

SEQ ID NO: 2213635 - RNA, 23 nt, Streptococcus pyogenes M1 GAS
aaugaaacguuauuaaagacaaa

SEQ ID NO: 2213636 - RNA, 18 nt, Streptococcus pyogenes M1 GAS
aaugaugagauuaacuga

SEQ ID NO: 2213637 - RNA, 15 nt, Streptococcus pyogenes M1 GAS
aaugaccuuugauaa

SEQ ID NO: 2213638 - RNA, 23 nt, Streptococcus pyogenes M1 GAS
aauggaaauuuuaaaugacauga

SEQ ID NO: 2213639 - RNA, 18 nt, Streptococcus pyogenes M1 GAS
aauuccccacaaaagaca

SEQ ID NO: 2213640 - RNA, 20 nt, Streptococcus pyogenes M1 GAS
aauuccaucacuuccauaua

SEQ ID NO: 2213641 - RNA, 20 nt, Streptococcus pyogenes M1 GAS
aauucuaacucuuguagaau

SEQ ID NO: 2213642 - RNA, 14 nt, Streptococcus pyogenes M1 GAS
aauuauuaguaacc

SEQ ID NO: 2213643 - RNA, 22 nt, Streptococcus pyogenes M1 GAS
aauuauuaacguuaacaaaaau

SEQ ID NO: 2213644 - RNA, 22 nt, Streptococcus pyogenes M1 GAS
aauuauuucgucuaaaaagccu

SEQ ID NO: 2213645 - RNA, 21 nt, Streptococcus pyogenes M1 GAS
aauuauuuuggaauaguuuau

SEQ ID NO: 2213646 - RNA, 19 nt, Streptococcus pyogenes M1 GAS
aauugguaguugucauggc

SEQ ID NO: 2213647 - RNA, 14 nt, Streptococcus pyogenes M1 GAS
aauugugucauuuc

SEQ ID NO: 2213648 - RNA, 19 nt, Streptococcus pyogenes M1 GAS
aauuguugacuuugcaaaa

SEQ ID NO: 2213649 - RNA, 19 nt, Streptococcus pyogenes M1 GAS
aauuguuuuaguaaagccu

SEQ ID NO: 2213650 - RNA, 18 nt, Streptococcus pyogenes M1 GAS
aauuucaauaauaccauu

SEQ ID NO: 2213651 - RNA, 17 nt, Streptococcus pyogenes M1 GAS
aauuuaauaguuuucca

SEQ ID NO: 2213652 - RNA, 14 nt, Streptococcus pyogenes M1 GAS
aauuuagucauuuc

SEQ ID NO: 2213653 - RNA, 17 nt, Streptococcus pyogenes M1 GAS
aauugcagcuaaaaaca

SEQ ID NO: 2213654 - RNA, 23 nt, Streptococcus pyogenes M1 GAS
aagggaagaagauccuacaagag

SEQ ID NO: 2213655 - RNA, 17 nt, Streptococcus pyogenes M1 GAS
aaggauuaugaaaaaga

SEQ ID NO: 2213656 - RNA, 14 nt, Streptococcus pyogenes M1 GAS
aaguaaaggauuua

SEQ ID NO: 2213657 - RNA, 20 nt, Streptococcus pyogenes M1 GAS
aaguaaaaagcaaauugaaa

SEQ ID NO: 2213658 - RNA, 14 nt, Streptococcus pyogenes M1 GAS
aagguauuguucaa

SEQ ID NO: 2213659 - RNA, 17 nt, Streptococcus pyogenes M1 GAS
aaguauagcauaaaaua

SEQ ID NO: 2213660 - RNA, 13 nt, Streptococcus pyogenes M1 GAS
aagucucuugcaa

SEQ ID NO: 2213661 - RNA, 22 nt, Streptococcus pyogenes M1 GAS
aagucucuagaacagauugaag

SEQ ID NO: 2213662 - RNA, 16 nt, Streptococcus pyogenes M1 GAS
aaguuaggaaagauag

SEQ ID NO: 2213663 - RNA, 20 nt, Streptococcus pyogenes M1 GAS
aaguuauaaagaaacaaaaa

SEQ ID NO: 2213664 - RNA, 21 nt, Streptococcus pyogenes M1 GAS
aagugugacuaguuuauuaca

SEQ ID NO: 2213665 - RNA, 14 nt, Streptococcus pyogenes M1 GAS
aagucucuugcaag

SEQ ID NO: 2213666 - RNA, 16 nt, Streptococcus pyogenes M1 GAS
aagugauacuugguau

SEQ ID NO: 2213667 - RNA, 17 nt, Streptococcus pyogenes M1 GAS
aagcugagcaaaacaau

SEQ ID NO: 2213668 - RNA, 22 nt, Streptococcus pyogenes M1 GAS
aagcuuggauugccgccaugcu

SEQ ID NO: 2213669 - RNA, 17 nt, Streptococcus pyogenes M1 GAS
aagcuugcuaagagaau

SEQ ID NO: 2213670 - RNA, 19 nt, Streptococcus pyogenes M1 GAS
aagcuugcuaagagaauaa

SEQ ID NO: 2213671 - RNA, 18 nt, Streptococcus pyogenes M1 GAS
aaggaccaagauucauga

SEQ ID NO: 2213672 - RNA, 17 nt, Streptococcus pyogenes M1 GAS
aagcguuguagccugug

SEQ ID NO: 2213673 - RNA, 15 nt, Streptococcus pyogenes M1 GAS
aagaaguugagacua

SEQ ID NO: 2213674 - RNA, 20 nt, Streptococcus pyogenes M1 GAS
aagaaggucucaaauuuuuu

SEQ ID NO: 2213675 - RNA, 16 nt, Streptococcus pyogenes M1 GAS
aagccauaaacaagug

SEQ ID NO: 2213676 - RNA, 17 nt, Streptococcus pyogenes M1 GAS
aagccuuaaugagaaac

SEQ ID NO: 2213677 - RNA, 24 nt, Streptococcus pyogenes M1 GAS
aauagcgccagcaauuuucccauc

SEQ ID NO: 2213678 - RNA, 18 nt, Streptococcus pyogenes M1 GAS
aauagguaaagauuuuaa

SEQ ID NO: 2213679 - RNA, 13 nt, Streptococcus pyogenes M1 GAS
aauaucuuaccau

SEQ ID NO: 2213680 - RNA, 17 nt, Streptococcus pyogenes M1 GAS
aauaucaggcaaaacaa

SEQ ID NO: 2213681 - RNA, 14 nt, Streptococcus pyogenes M1 GAS
aauaucaggcaaaa

SEQ ID NO: 2213682 - RNA, 18 nt, Streptococcus pyogenes M1 GAS
aauaacagaaauuaauaa

SEQ ID NO: 2213683 - RNA, 24 nt, Streptococcus pyogenes M1 GAS
aauaacccgucuuacaauuaauag

SEQ ID NO: 2213684 - RNA, 18 nt, Streptococcus pyogenes M1 GAS
aaguuccuuagcaguuau

SEQ ID NO: 2213685 - RNA, 14 nt, Streptococcus pyogenes M1 GAS
aaguugaaugaguu

SEQ ID NO: 2213686 - RNA, 22 nt, Streptococcus pyogenes M1 GAS
aauaaggcucgacaaaggcugc

SEQ ID NO: 2213687 - RNA, 16 nt, Streptococcus pyogenes M1 GAS
aauaaggucaucagaa

SEQ ID NO: 2213688 - RNA, 15 nt, Streptococcus pyogenes M1 GAS
aauaaguauucuaaa

SEQ ID NO: 2213689 - RNA, 16 nt, Streptococcus pyogenes M1 GAS
aauaaugccaucaaaa

SEQ ID NO: 2213690 - RNA, 19 nt, Streptococcus pyogenes M1 GAS
aauaaugccaucaaaaaaa

SEQ ID NO: 2213691 - RNA, 15 nt, Streptococcus pyogenes M1 GAS
uuggugauuaacgcu

SEQ ID NO: 2213692 - RNA, 22 nt, Streptococcus pyogenes M1 GAS
uugguggaagaguaaggaccaa

SEQ ID NO: 2213693 - RNA, 23 nt, Streptococcus pyogenes M1 GAS
uuggccaauaaaauaucuagaac

SEQ ID NO: 2213694 - RNA, 22 nt, Streptococcus pyogenes M1 GAS
uuggcuacucuauuugaaguaa

SEQ ID NO: 2213695 - RNA, 23 nt, Streptococcus pyogenes M1 GAS
uugggacuuuucagucuucugua

SEQ ID NO: 2213696 - RNA, 20 nt, Streptococcus pyogenes M1 GAS
uugcuuaaugaccuuugaua

SEQ ID NO: 2213697 - RNA, 13 nt, Streptococcus pyogenes M1 GAS
uugcuuaaugacc

SEQ ID NO: 2213698 - RNA, 15 nt, Streptococcus pyogenes M1 GAS
uugcuuaaugaccuu

SEQ ID NO: 2213699 - RNA, 21 nt, Streptococcus pyogenes M1 GAS
uugcuugucuuuuuuuggccu

SEQ ID NO: 2213700 - RNA, 19 nt, Streptococcus pyogenes M1 GAS
uuggaauaguuuaucacuc

SEQ ID NO: 2213701 - RNA, 19 nt, Streptococcus pyogenes M1 GAS
uuggagagauaaaaaguaa

SEQ ID NO: 2213702 - RNA, 14 nt, Streptococcus pyogenes M1 GAS
uuggagagauuuua

SEQ ID NO: 2213703 - RNA, 13 nt, Streptococcus pyogenes M1 GAS
uuggaaaaggaau

SEQ ID NO: 2213704 - RNA, 23 nt, Streptococcus pyogenes M1 GAS
uuggaacaccguuuuuuguugua

SEQ ID NO: 2213705 - RNA, 16 nt, Streptococcus pyogenes M1 GAS
uuggaagaucuccaag

SEQ ID NO: 2213706 - RNA, 17 nt, Streptococcus pyogenes M1 GAS
uugccauuaauaauauu

SEQ ID NO: 2213707 - RNA, 22 nt, Streptococcus pyogenes M1 GAS
uugccauuaauaauauuaaccg

SEQ ID NO: 2213708 - RNA, 16 nt, Streptococcus pyogenes M1 GAS
uugcagcuaaaaacaa

SEQ ID NO: 2213709 - RNA, 20 nt, Streptococcus pyogenes M1 GAS
uugcagguaauuaucugaau

SEQ ID NO: 2213710 - RNA, 20 nt, Streptococcus pyogenes M1 GAS
uugcagaggcuugcauuuuu

SEQ ID NO: 2213711 - RNA, 22 nt, Streptococcus pyogenes M1 GAS
uugcacugcuauuucagcuaga

SEQ ID NO: 2213712 - RNA, 13 nt, Streptococcus pyogenes M1 GAS
uugauauaaaauu

SEQ ID NO: 2213713 - RNA, 17 nt, Streptococcus pyogenes M1 GAS
uugauuacugauaaacu

SEQ ID NO: 2213714 - RNA, 19 nt, Streptococcus pyogenes M1 GAS
uuuaugaccauuuuuacug

SEQ ID NO: 2213715 - RNA, 16 nt, Streptococcus pyogenes M1 GAS
uuuauuaaucaaaaaa

SEQ ID NO: 2213716 - RNA, 21 nt, Streptococcus pyogenes M1 GAS
uuuauuaauaaguauucuaaa

SEQ ID NO: 2213717 - RNA, 19 nt, Streptococcus pyogenes M1 GAS
uuuauguaugcuguccaug

SEQ ID NO: 2213718 - RNA, 18 nt, Streptococcus pyogenes M1 GAS
uuuacaucaaaaaaagca

SEQ ID NO: 2213719 - RNA, 22 nt, Streptococcus pyogenes M1 GAS
uuuacaucaaaaaaagcaauga

SEQ ID NO: 2213720 - RNA, 15 nt, Streptococcus pyogenes M1 GAS
uuuacaucaaaaaaa

SEQ ID NO: 2213721 - RNA, 19 nt, Streptococcus pyogenes M1 GAS
uuuaauaguuuuccauaau

SEQ ID NO: 2213722 - RNA, 16 nt, Streptococcus pyogenes M1 GAS
uuuaauacguuuauuu

SEQ ID NO: 2213723 - RNA, 21 nt, Streptococcus pyogenes M1 GAS
uuuaagauuaaacuuacaaaa

SEQ ID NO: 2213724 - RNA, 20 nt, Streptococcus pyogenes M1 GAS
uuuaagguauuguucaaccg

SEQ ID NO: 2213725 - RNA, 22 nt, Streptococcus pyogenes M1 GAS
uuguacaagagcuuaaaaguua

SEQ ID NO: 2213726 - RNA, 23 nt, Streptococcus pyogenes M1 GAS
uuguagaggacuaaguccuuuua

SEQ ID NO: 2213727 - RNA, 19 nt, Streptococcus pyogenes M1 GAS
uuguaauaacaaaaugaag

SEQ ID NO: 2213728 - RNA, 22 nt, Streptococcus pyogenes M1 GAS
uuguuuuggccaauaaaauauc

SEQ ID NO: 2213729 - RNA, 19 nt, Streptococcus pyogenes M1 GAS
uuguuuuaguaaagccuua

SEQ ID NO: 2213730 - RNA, 16 nt, Streptococcus pyogenes M1 GAS
uuguguugaagaaggu

SEQ ID NO: 2213731 - RNA, 22 nt, Streptococcus pyogenes M1 GAS
uugugguuacagacuuuuaaug

SEQ ID NO: 2213732 - RNA, 17 nt, Streptococcus pyogenes M1 GAS
uuguggcgggccuucua

SEQ ID NO: 2213733 - RNA, 18 nt, Streptococcus pyogenes M1 GAS
uuguggcugauaaaaaga

SEQ ID NO: 2213734 - RNA, 20 nt, Streptococcus pyogenes M1 GAS
uugugacaugaguauaaauu

SEQ ID NO: 2213735 - RNA, 23 nt, Streptococcus pyogenes M1 GAS
uugugaggccgucacaaacugcc

SEQ ID NO: 2213736 - RNA, 13 nt, Streptococcus pyogenes M1 GAS
uugugcuauucaa

SEQ ID NO: 2213737 - RNA, 23 nt, Streptococcus pyogenes M1 GAS
uugugauuaguuuuuagcagcag

SEQ ID NO: 2213738 - RNA, 18 nt, Streptococcus pyogenes M1 GAS
uucucaaaaauauauucu

SEQ ID NO: 2213739 - RNA, 12 nt, Streptococcus pyogenes M1 GAS
uucucaaaaaua

SEQ ID NO: 2213740 - RNA, 12 nt, Streptococcus pyogenes M1 GAS
uucuaucaaaac

SEQ ID NO: 2213741 - RNA, 17 nt, Streptococcus pyogenes M1 GAS
uucuaucaaaacguuau

SEQ ID NO: 2213742 - RNA, 22 nt, Streptococcus pyogenes M1 GAS
uucugagauauucauuuucuuc

SEQ ID NO: 2213743 - RNA, 19 nt, Streptococcus pyogenes M1 GAS
uucucuuuggagaaauuca

SEQ ID NO: 2213744 - RNA, 18 nt, Streptococcus pyogenes M1 GAS
uucuuacuaugaaaaaag

SEQ ID NO: 2213745 - RNA, 22 nt, Streptococcus pyogenes M1 GAS
uucuuaacgaucuauugacuug

SEQ ID NO: 2213746 - RNA, 18 nt, Streptococcus pyogenes M1 GAS
uucugucuacuuauuuga

SEQ ID NO: 2213747 - RNA, 18 nt, Streptococcus pyogenes M1 GAS
uucguugacaaagccauu

SEQ ID NO: 2213748 - RNA, 21 nt, Streptococcus pyogenes M1 GAS
uucguugacaacaauauguga

SEQ ID NO: 2213749 - RNA, 19 nt, Streptococcus pyogenes M1 GAS
uucgacucaugauauccca

SEQ ID NO: 2213750 - RNA, 11 nt, Streptococcus pyogenes M1 GAS
uucgcacagcg

SEQ ID NO: 2213751 - RNA, 20 nt, Streptococcus pyogenes M1 GAS
uucgcacagcguaagccaaa

SEQ ID NO: 2213752 - RNA, 16 nt, Streptococcus pyogenes M1 GAS
uuccuuagcaaaggcu

SEQ ID NO: 2213753 - RNA, 19 nt, Streptococcus pyogenes M1 GAS
uuccuuagcaaaggcuuca

SEQ ID NO: 2213754 - RNA, 13 nt, Streptococcus pyogenes M1 GAS
uucauuuuuauuu

SEQ ID NO: 2213755 - RNA, 21 nt, Streptococcus pyogenes M1 GAS
uucaugauguuauuaaauaau

SEQ ID NO: 2213756 - RNA, 19 nt, Streptococcus pyogenes M1 GAS
uucaugauguuauuaaaua

SEQ ID NO: 2213757 - RNA, 15 nt, Streptococcus pyogenes M1 GAS
uucaucuugcauuac

SEQ ID NO: 2213758 - RNA, 12 nt, Streptococcus pyogenes M1 GAS
uucaucuugcca

SEQ ID NO: 2213759 - RNA, 15 nt, Streptococcus pyogenes M1 GAS
uucaucgugacaaca

SEQ ID NO: 2213760 - RNA, 18 nt, Streptococcus pyogenes M1 GAS
uucauaaauucuaacucu

SEQ ID NO: 2213761 - RNA, 13 nt, Streptococcus pyogenes M1 GAS
uucagcuagacua

SEQ ID NO: 2213762 - RNA, 22 nt, Streptococcus pyogenes M1 GAS
uucauagaagacggaguauuuu

SEQ ID NO: 2213763 - RNA, 15 nt, Streptococcus pyogenes M1 GAS
uucauagaagacgga

SEQ ID NO: 2213764 - RNA, 20 nt, Streptococcus pyogenes M1 GAS
uucacuuuguuaccagauaa

SEQ ID NO: 2213765 - RNA, 21 nt, Streptococcus pyogenes M1 GAS
uucaauuauuucgucuaaaaa

SEQ ID NO: 2213766 - RNA, 14 nt, Streptococcus pyogenes M1 GAS
uuauuggaaaguaa

SEQ ID NO: 2213767 - RNA, 13 nt, Streptococcus pyogenes M1 GAS
uuauuuaugucuu

SEQ ID NO: 2213768 - RNA, 22 nt, Streptococcus pyogenes M1 GAS
uucaacuugggagaguuccugc

SEQ ID NO: 2213769 - RNA, 18 nt, Streptococcus pyogenes M1 GAS
uucaaagggagauucuua

SEQ ID NO: 2213770 - RNA, 13 nt, Streptococcus pyogenes M1 GAS
uggauuuccucua

SEQ ID NO: 2213771 - RNA, 16 nt, Streptococcus pyogenes M1 GAS
uggccagcgucugaua

SEQ ID NO: 2213772 - RNA, 13 nt, Streptococcus pyogenes M1 GAS
ugguaaaaaggca

SEQ ID NO: 2213773 - RNA, 23 nt, Streptococcus pyogenes M1 GAS
uggucaauggaaauuuuaaauga

SEQ ID NO: 2213774 - RNA, 22 nt, Streptococcus pyogenes M1 GAS
uggcuucuagguagguuugaaa

SEQ ID NO: 2213775 - RNA, 18 nt, Streptococcus pyogenes M1 GAS
ugugugacuguaaauaga

SEQ ID NO: 2213776 - RNA, 17 nt, Streptococcus pyogenes M1 GAS
uguuaauauagucugca

SEQ ID NO: 2213777 - RNA, 23 nt, Streptococcus pyogenes M1 GAS
ugucuggaaacuggucaaaagcu

SEQ ID NO: 2213778 - RNA, 18 nt, Streptococcus pyogenes M1 GAS
ugucuuagccuuuuuuug

SEQ ID NO: 2213779 - RNA, 21 nt, Streptococcus pyogenes M1 GAS
ugucuuagccuuuuuuugucu

SEQ ID NO: 2213780 - RNA, 14 nt, Streptococcus pyogenes M1 GAS
ugucauuucuugag

SEQ ID NO: 2213781 - RNA, 13 nt, Streptococcus pyogenes M1 GAS
ugucuacuuauuu

SEQ ID NO: 2213782 - RNA, 20 nt, Streptococcus pyogenes M1 GAS
ugucaaacauaacaauccua

SEQ ID NO: 2213783 - RNA, 14 nt, Streptococcus pyogenes M1 GAS
ugucaaauaaaauc

SEQ ID NO: 2213784 - RNA, 20 nt, Streptococcus pyogenes M1 GAS
ugucacgaucaagaaacuca

SEQ ID NO: 2213785 - RNA, 18 nt, Streptococcus pyogenes M1 GAS
uguauacaaaaaggcuaa

SEQ ID NO: 2213786 - RNA, 12 nt, Streptococcus pyogenes M1 GAS
uguaauccccuc

SEQ ID NO: 2213787 - RNA, 13 nt, Streptococcus pyogenes M1 GAS
uguacaagagcuu

SEQ ID NO: 2213788 - RNA, 23 nt, Streptococcus pyogenes M1 GAS
uguuuacgcuuuacauuuuauuu

SEQ ID NO: 2213789 - RNA, 12 nt, Streptococcus pyogenes M1 GAS
uguuggaggucu

SEQ ID NO: 2213790 - RNA, 16 nt, Streptococcus pyogenes M1 GAS
uguuguauuaugaggu

SEQ ID NO: 2213791 - RNA, 17 nt, Streptococcus pyogenes M1 GAS
uguucuuuauuuugaua

SEQ ID NO: 2213792 - RNA, 20 nt, Streptococcus pyogenes M1 GAS
uguugacucugauccgaguu

SEQ ID NO: 2213793 - RNA, 19 nt, Streptococcus pyogenes M1 GAS
uguucaggggguaaaaaag

SEQ ID NO: 2213794 - RNA, 21 nt, Streptococcus pyogenes M1 GAS
uguuaucccuggaccauuauc

SEQ ID NO: 2213795 - RNA, 15 nt, Streptococcus pyogenes M1 GAS
uuaaaagaugucgca

SEQ ID NO: 2213796 - RNA, 18 nt, Streptococcus pyogenes M1 GAS
uuaaaagaaaaucuaauc

SEQ ID NO: 2213797 - RNA, 23 nt, Streptococcus pyogenes M1 GAS
uuaaaagaaaaucuaaucagaac

SEQ ID NO: 2213798 - RNA, 13 nt, Streptococcus pyogenes M1 GAS
uuaaaaauaacuu

SEQ ID NO: 2213799 - RNA, 13 nt, Streptococcus pyogenes M1 GAS
uuaaacauauuau

SEQ ID NO: 2213800 - RNA, 15 nt, Streptococcus pyogenes M1 GAS
uuaaagacaaaaaac

SEQ ID NO: 2213801 - RNA, 20 nt, Streptococcus pyogenes M1 GAS
uguuuuaguaaagccuuauc

SEQ ID NO: 2213802 - RNA, 13 nt, Streptococcus pyogenes M1 GAS
uguuuuucuuaua

SEQ ID NO: 2213803 - RNA, 19 nt, Streptococcus pyogenes M1 GAS
uguuuuuagauaaaaaugg

SEQ ID NO: 2213804 - RNA, 14 nt, Streptococcus pyogenes M1 GAS
uuaauuuuucuucu

SEQ ID NO: 2213805 - RNA, 23 nt, Streptococcus pyogenes M1 GAS
uuaaugaccuuugauaagauauu

SEQ ID NO: 2213806 - RNA, 19 nt, Streptococcus pyogenes M1 GAS
uuaccagauaaauaguaca

SEQ ID NO: 2213807 - RNA, 14 nt, Streptococcus pyogenes M1 GAS
uuacaucaaaaaaa

SEQ ID NO: 2213808 - RNA, 17 nt, Streptococcus pyogenes M1 GAS
uuacaucaaaaaaagca

SEQ ID NO: 2213809 - RNA, 17 nt, Streptococcus pyogenes M1 GAS
uuacgauuaaaagaugu

SEQ ID NO: 2213810 - RNA, 14 nt, Streptococcus pyogenes M1 GAS
uuaccuuauuuucu

SEQ ID NO: 2213811 - RNA, 17 nt, Streptococcus pyogenes M1 GAS
uuagccguccuuaaaag

SEQ ID NO: 2213812 - RNA, 12 nt, Streptococcus pyogenes M1 GAS
uuagccuuuuuu

SEQ ID NO: 2213813 - RNA, 20 nt, Streptococcus pyogenes M1 GAS
uuagcggcacguuauucucu

SEQ ID NO: 2213814 - RNA, 19 nt, Streptococcus pyogenes M1 GAS
uuagcaaaggcuucaucaa

SEQ ID NO: 2213815 - RNA, 19 nt, Streptococcus pyogenes M1 GAS
uuagaauccuccucuuuuu

SEQ ID NO: 2213816 - RNA, 14 nt, Streptococcus pyogenes M1 GAS
uuacuauggcuucu

SEQ ID NO: 2213817 - RNA, 19 nt, Streptococcus pyogenes M1 GAS
uuacuguauaaacuuguug

SEQ ID NO: 2213818 - RNA, 22 nt, Streptococcus pyogenes M1 GAS
uuacgcuuuacauuuuauuuga

SEQ ID NO: 2213819 - RNA, 19 nt, Streptococcus pyogenes M1 GAS
uuacguccuguuugugaug

SEQ ID NO: 2213820 - RNA, 15 nt, Streptococcus pyogenes M1 GAS
uuaacugguaaagua

SEQ ID NO: 2213821 - RNA, 22 nt, Streptococcus pyogenes M1 GAS
uuaagauggugacucuguuccu

SEQ ID NO: 2213822 - RNA, 16 nt, Streptococcus pyogenes M1 GAS
uuaacucucauaaaau

SEQ ID NO: 2213823 - RNA, 20 nt, Streptococcus pyogenes M1 GAS
uuaacaggugacauaguguu

SEQ ID NO: 2213824 - RNA, 20 nt, Streptococcus pyogenes M1 GAS
uuaaggauuaugaaaaagaa

SEQ ID NO: 2213825 - RNA, 13 nt, Streptococcus pyogenes M1 GAS
uuaauaaaagauu

SEQ ID NO: 2213826 - RNA, 21 nt, Streptococcus pyogenes M1 GAS
uuaaagcuaucauacaacuga

SEQ ID NO: 2213827 - RNA, 24 nt, Streptococcus pyogenes M1 GAS
uuaaauuuggagagauaaaaagua

SEQ ID NO: 2213828 - RNA, 18 nt, Streptococcus pyogenes M1 GAS
ucuauauguguaauuucu

SEQ ID NO: 2213829 - RNA, 13 nt, Streptococcus pyogenes M1 GAS
ucuaucaaaacgu

SEQ ID NO: 2213830 - RNA, 24 nt, Streptococcus pyogenes M1 GAS
ucuagaacagauugaagacaaaca

SEQ ID NO: 2213831 - RNA, 23 nt, Streptococcus pyogenes M1 GAS
ucuagacucuagcauaaaagaua

SEQ ID NO: 2213832 - RNA, 20 nt, Streptococcus pyogenes M1 GAS
ucuagucagaucauuaaauu

SEQ ID NO: 2213833 - RNA, 16 nt, Streptococcus pyogenes M1 GAS
ucuagguuaaaauaga

SEQ ID NO: 2213834 - RNA, 23 nt, Streptococcus pyogenes M1 GAS
ucuaggagggacugucaaaaaau

SEQ ID NO: 2213835 - RNA, 14 nt, Streptococcus pyogenes M1 GAS
aaaugcauuacauu

SEQ ID NO: 2213836 - RNA, 16 nt, Streptococcus pyogenes M1 GAS
aaaugcauuacauuua

SEQ ID NO: 2213837 - RNA, 15 nt, Streptococcus pyogenes M1 GAS
ucucauaaacaauga

SEQ ID NO: 2213838 - RNA, 14 nt, Streptococcus pyogenes M1 GAS
ucucauaacaaauu

SEQ ID NO: 2213839 - RNA, 21 nt, Streptococcus pyogenes M1 GAS
ucucagagacaauaaggucau

SEQ ID NO: 2213840 - RNA, 17 nt, Streptococcus pyogenes M1 GAS
aaaugccaaucuuugug

SEQ ID NO: 2213841 - RNA, 20 nt, Streptococcus pyogenes M1 GAS
aaaugccuccgacaaucgaa

SEQ ID NO: 2213842 - RNA, 13 nt, Streptococcus pyogenes M1 GAS
ucuauuuuaagua

SEQ ID NO: 2213843 - RNA, 22 nt, Streptococcus pyogenes M1 GAS
ucuauuugaaguaaaggauuua

SEQ ID NO: 2213844 - RNA, 14 nt, Streptococcus pyogenes M1 GAS
ucucaaauuuuuuu

SEQ ID NO: 2213845 - RNA, 12 nt, Streptococcus pyogenes M1 GAS
ucucaaaaauau

SEQ ID NO: 2213846 - RNA, 15 nt, Streptococcus pyogenes M1 GAS
ucuacacaaaagcuu

SEQ ID NO: 2213847 - RNA, 22 nt, Streptococcus pyogenes M1 GAS
ucuacuaaaaaaggagcuagau

SEQ ID NO: 2213848 - RNA, 15 nt, Streptococcus pyogenes M1 GAS
aaaugacaugaaagu

SEQ ID NO: 2213849 - RNA, 22 nt, Streptococcus pyogenes M1 GAS
aaaucuuacuaacuagcaagug

SEQ ID NO: 2213850 - RNA, 20 nt, Streptococcus pyogenes M1 GAS
aaaucuucugcauuaucauc

SEQ ID NO: 2213851 - RNA, 19 nt, Streptococcus pyogenes M1 GAS
aaaugaagcaaaauaaacu

SEQ ID NO: 2213852 - RNA, 23 nt, Streptococcus pyogenes M1 GAS
ucuaaguuuuuaucauauuccau

SEQ ID NO: 2213853 - RNA, 13 nt, Streptococcus pyogenes M1 GAS
ucuaaacuuauga

SEQ ID NO: 2213854 - RNA, 21 nt, Streptococcus pyogenes M1 GAS
ucuaaaugacaguauacauca

SEQ ID NO: 2213855 - RNA, 21 nt, Streptococcus pyogenes M1 GAS
ucguuuuacggcuucuacaca

SEQ ID NO: 2213856 - RNA, 22 nt, Streptococcus pyogenes M1 GAS
ucuaaaaagccuuaaugagaaa

SEQ ID NO: 2213857 - RNA, 23 nt, Streptococcus pyogenes M1 GAS
ucuaaaaagccuuaaugagaaac

SEQ ID NO: 2213858 - RNA, 15 nt, Streptococcus pyogenes M1 GAS
ucuaaaagcacuugu

SEQ ID NO: 2213859 - RNA, 21 nt, Streptococcus pyogenes M1 GAS
ucuaaaauccucuuuuaauuu

SEQ ID NO: 2213860 - RNA, 20 nt, Streptococcus pyogenes M1 GAS
ucuggaaacuggucaaaagc

SEQ ID NO: 2213861 - RNA, 15 nt, Streptococcus pyogenes M1 GAS
ucugcauuaucaucu

SEQ ID NO: 2213862 - RNA, 16 nt, Streptococcus pyogenes M1 GAS
ucuguccaauaccuag

SEQ ID NO: 2213863 - RNA, 16 nt, Streptococcus pyogenes M1 GAS
ucugguuuuaauauug

SEQ ID NO: 2213864 - RNA, 17 nt, Streptococcus pyogenes M1 GAS
ucuuccaaucuuucauu

SEQ ID NO: 2213865 - RNA, 13 nt, Streptococcus pyogenes M1 GAS
ucuguuccuaugc

SEQ ID NO: 2213866 - RNA, 14 nt, Streptococcus pyogenes M1 GAS
ucuuacaauuaaua

SEQ ID NO: 2213867 - RNA, 18 nt, Streptococcus pyogenes M1 GAS
ucugagcgguuuugucuu

SEQ ID NO: 2213868 - RNA, 15 nt, Streptococcus pyogenes M1 GAS
ucugcaaguucuuug

SEQ ID NO: 2213869 - RNA, 23 nt, Streptococcus pyogenes M1 GAS
ucugaaaauaaaauauuuuucca

SEQ ID NO: 2213870 - RNA, 14 nt, Streptococcus pyogenes M1 GAS
ucugaaaauaaaau

SEQ ID NO: 2213871 - RNA, 14 nt, Streptococcus pyogenes M1 GAS
ucuccgacugcagu

SEQ ID NO: 2213872 - RNA, 14 nt, Streptococcus pyogenes M1 GAS
ucguucauaaauuc

SEQ ID NO: 2213873 - RNA, 16 nt, Streptococcus pyogenes M1 GAS
ucguucauaaauucua

SEQ ID NO: 2213874 - RNA, 22 nt, Streptococcus pyogenes M1 GAS
ucguucauaaauucuaacucuu

SEQ ID NO: 2213875 - RNA, 19 nt, Streptococcus pyogenes M1 GAS
ucgcuaagggaaaaauuac

SEQ ID NO: 2213876 - RNA, 15 nt, Streptococcus pyogenes M1 GAS
ucgcucagaauaaag

SEQ ID NO: 2213877 - RNA, 20 nt, Streptococcus pyogenes M1 GAS
ucgcguuuaggcucauauua

SEQ ID NO: 2213878 - RNA, 15 nt, Streptococcus pyogenes M1 GAS
ucgccaauaaaaaag

SEQ ID NO: 2213879 - RNA, 19 nt, Streptococcus pyogenes M1 GAS
ugaauacguaaaaagagaa

SEQ ID NO: 2213880 - RNA, 13 nt, Streptococcus pyogenes M1 GAS
ugacauaguguuu

SEQ ID NO: 2213881 - RNA, 22 nt, Streptococcus pyogenes M1 GAS
ugacaacaauaugugauuauua

SEQ ID NO: 2213882 - RNA, 17 nt, Streptococcus pyogenes M1 GAS
ugacaaccuuaaagacc

SEQ ID NO: 2213883 - RNA, 16 nt, Streptococcus pyogenes M1 GAS
ugauguaccaauuuaa

SEQ ID NO: 2213884 - RNA, 21 nt, Streptococcus pyogenes M1 GAS
ugauguagggcuguaaaaugu

SEQ ID NO: 2213885 - RNA, 15 nt, Streptococcus pyogenes M1 GAS
ugauguuauuaaaua

SEQ ID NO: 2213886 - RNA, 14 nt, Streptococcus pyogenes M1 GAS
ugauguuauuaaau

SEQ ID NO: 2213887 - RNA, 15 nt, Streptococcus pyogenes M1 GAS
ugauguuuuuacauu

SEQ ID NO: 2213888 - RNA, 12 nt, Streptococcus pyogenes M1 GAS
ugauuacugaua

SEQ ID NO: 2213889 - RNA, 19 nt, Streptococcus pyogenes M1 GAS
ugauuacugauaaacuuga

SEQ ID NO: 2213890 - RNA, 21 nt, Streptococcus pyogenes M1 GAS
ugauuagaauccuccucuuuu

SEQ ID NO: 2213891 - RNA, 14 nt, Streptococcus pyogenes M1 GAS
ugauuacauuagga

SEQ ID NO: 2213892 - RNA, 19 nt, Streptococcus pyogenes M1 GAS
ugauuauccucuuauagca

SEQ ID NO: 2213893 - RNA, 17 nt, Streptococcus pyogenes M1 GAS
ugauuauuauucuaaau

SEQ ID NO: 2213894 - RNA, 16 nt, Streptococcus pyogenes M1 GAS
ugauuauuauucuaaa

SEQ ID NO: 2213895 - RNA, 12 nt, Streptococcus pyogenes M1 GAS
ugauuauuauuc

SEQ ID NO: 2213896 - RNA, 21 nt, Streptococcus pyogenes M1 GAS
ugauuaguuuuuagcagcaga

SEQ ID NO: 2213897 - RNA, 21 nt, Streptococcus pyogenes M1 GAS
ugauuuaugaccauuuuuacu

SEQ ID NO: 2213898 - RNA, 17 nt, Streptococcus pyogenes M1 GAS
ugauggcuuuccauucu

SEQ ID NO: 2213899 - RNA, 23 nt, Streptococcus pyogenes M1 GAS
ugauauugaucucugcaacauca

SEQ ID NO: 2213900 - RNA, 20 nt, Streptococcus pyogenes M1 GAS
ugauauuucaucuugcauua

SEQ ID NO: 2213901 - RNA, 20 nt, Streptococcus pyogenes M1 GAS
ugauaaaggccuguauuucu

SEQ ID NO: 2213902 - RNA, 16 nt, Streptococcus pyogenes M1 GAS
ugauaacaauauaacu

SEQ ID NO: 2213903 - RNA, 17 nt, Streptococcus pyogenes M1 GAS
ugaguaagcagcaucac

SEQ ID NO: 2213904 - RNA, 13 nt, Streptococcus pyogenes M1 GAS
ugaguauaaauuu

SEQ ID NO: 2213905 - RNA, 14 nt, Streptococcus pyogenes M1 GAS
ugaguauaaugcug

SEQ ID NO: 2213906 - RNA, 16 nt, Streptococcus pyogenes M1 GAS
ugacuuguuacaaaaa

SEQ ID NO: 2213907 - RNA, 21 nt, Streptococcus pyogenes M1 GAS
ugacuugguucugaaaauaaa

SEQ ID NO: 2213908 - RNA, 21 nt, Streptococcus pyogenes M1 GAS
ugagaauuuuuauaacaauua

SEQ ID NO: 2213909 - RNA, 16 nt, Streptococcus pyogenes M1 GAS
ugacuuugcaaaagaa

SEQ ID NO: 2213910 - RNA, 14 nt, Streptococcus pyogenes M1 GAS
ugagauuaacugac

SEQ ID NO: 2213911 - RNA, 21 nt, Streptococcus pyogenes M1 GAS
ugagauuaacugacaaaaaaa

SEQ ID NO: 2213912 - RNA, 16 nt, Streptococcus pyogenes M1 GAS
ugagccuccaacauag

SEQ ID NO: 2213913 - RNA, 23 nt, Streptococcus pyogenes M1 GAS
ugagccuccaacauagcuaaucc

SEQ ID NO: 2213914 - RNA, 24 nt, Streptococcus pyogenes M1 GAS
ugagccaauaacgccagcuacauu

SEQ ID NO: 2213915 - RNA, 20 nt, Streptococcus pyogenes M1 GAS
ugcgcauguugacuauuuuu

SEQ ID NO: 2213916 - RNA, 15 nt, Streptococcus pyogenes M1 GAS
ugccaguaaggaaau

SEQ ID NO: 2213917 - RNA, 21 nt, Streptococcus pyogenes M1 GAS
ugccaucugcuuggauuuccu

SEQ ID NO: 2213918 - RNA, 17 nt, Streptococcus pyogenes M1 GAS
ugccauggguaaaauga

SEQ ID NO: 2213919 - RNA, 17 nt, Streptococcus pyogenes M1 GAS
ugccauuuaaaagggca

SEQ ID NO: 2213920 - RNA, 17 nt, Streptococcus pyogenes M1 GAS
ugcaggguaucugcuca

SEQ ID NO: 2213921 - RNA, 14 nt, Streptococcus pyogenes M1 GAS
ugcaugaagugguu

SEQ ID NO: 2213922 - RNA, 22 nt, Streptococcus pyogenes M1 GAS
ugcagaguacaaggcaauccaa

SEQ ID NO: 2213923 - RNA, 12 nt, Streptococcus pyogenes M1 GAS
ugcagaauagaa

SEQ ID NO: 2213924 - RNA, 17 nt, Streptococcus pyogenes M1 GAS
ugcagaauagaaauagu

SEQ ID NO: 2213925 - RNA, 17 nt, Streptococcus pyogenes M1 GAS
uccaaaguucuucuaaa

SEQ ID NO: 2213926 - RNA, 20 nt, Streptococcus pyogenes M1 GAS
ucaucuugccaucagcaucu

SEQ ID NO: 2213927 - RNA, 20 nt, Streptococcus pyogenes M1 GAS
ucaugacgccuccaaauacu

SEQ ID NO: 2213928 - RNA, 19 nt, Streptococcus pyogenes M1 GAS
ucaugaugguuucacgaua

SEQ ID NO: 2213929 - RNA, 21 nt, Streptococcus pyogenes M1 GAS
ucaugauguuauuaaauaaua

SEQ ID NO: 2213930 - RNA, 23 nt, Streptococcus pyogenes M1 GAS
ucauucuaacauggauaccauuu

SEQ ID NO: 2213931 - RNA, 12 nt, Streptococcus pyogenes M1 GAS
uccaaaaagaaa

SEQ ID NO: 2213932 - RNA, 14 nt, Streptococcus pyogenes M1 GAS
ucauugcuuuuuau

SEQ ID NO: 2213933 - RNA, 18 nt, Streptococcus pyogenes M1 GAS
ucauugcuuuuuaugauu

SEQ ID NO: 2213934 - RNA, 16 nt, Streptococcus pyogenes M1 GAS
ucacucguaaaaagau

SEQ ID NO: 2213935 - RNA, 18 nt, Streptococcus pyogenes M1 GAS
ucaguuuuuuugauuuuc

SEQ ID NO: 2213936 - RNA, 23 nt, Streptococcus pyogenes M1 GAS
ucaguccuccucuuuagaauucu

SEQ ID NO: 2213937 - RNA, 16 nt, Streptococcus pyogenes M1 GAS
ucauaaacaaugaguc

SEQ ID NO: 2213938 - RNA, 18 nt, Streptococcus pyogenes M1 GAS
ucauaaauucuaacucuu

SEQ ID NO: 2213939 - RNA, 15 nt, Streptococcus pyogenes M1 GAS
ucaucaaaagaccau

SEQ ID NO: 2213940 - RNA, 21 nt, Streptococcus pyogenes M1 GAS
ucaucaagaauagcuuuugua

SEQ ID NO: 2213941 - RNA, 21 nt, Streptococcus pyogenes M1 GAS
ucauauaagcaaucaucauuu

SEQ ID NO: 2213942 - RNA, 17 nt, Streptococcus pyogenes M1 GAS
ucauacacaaaaaaccg

SEQ ID NO: 2213943 - RNA, 19 nt, Streptococcus pyogenes M1 GAS
ucauacaacugacuagcca

SEQ ID NO: 2213944 - RNA, 17 nt, Streptococcus pyogenes M1 GAS
ucacguacagaaaugaa

SEQ ID NO: 2213945 - RNA, 19 nt, Streptococcus pyogenes M1 GAS
ucaccuuaggcagacaauu

SEQ ID NO: 2213946 - RNA, 17 nt, Streptococcus pyogenes M1 GAS
ucaccuucucuuuugcu

SEQ ID NO: 2213947 - RNA, 21 nt, Streptococcus pyogenes M1 GAS
ucaccuugcuuguagauaccu

SEQ ID NO: 2213948 - RNA, 23 nt, Streptococcus pyogenes M1 GAS
ucacgauaagaagcuaaugucuu

SEQ ID NO: 2213949 - RNA, 16 nt, Streptococcus pyogenes M1 GAS
ucacauuguauuagca

SEQ ID NO: 2213950 - RNA, 20 nt, Streptococcus pyogenes M1 GAS
ucaaugaaaaguuauuccca

SEQ ID NO: 2213951 - RNA, 22 nt, Streptococcus pyogenes M1 GAS
ucaauauuuuauuaauaaguau

SEQ ID NO: 2213952 - RNA, 15 nt, Streptococcus pyogenes M1 GAS
ucaagguugcaagug

SEQ ID NO: 2213953 - RNA, 12 nt, Streptococcus pyogenes M1 GAS
ucaagaaacuca

SEQ ID NO: 2213954 - RNA, 23 nt, Streptococcus pyogenes M1 GAS
ucaagaaacucaucuggguagag

SEQ ID NO: 2213955 - RNA, 13 nt, Streptococcus pyogenes M1 GAS
uauucauuuucuu

SEQ ID NO: 2213956 - RNA, 22 nt, Streptococcus pyogenes M1 GAS
uauuauacucaauauaauaaaa

SEQ ID NO: 2213957 - RNA, 13 nt, Streptococcus pyogenes M1 GAS
uauccauuauaaa

SEQ ID NO: 2213958 - RNA, 20 nt, Streptococcus pyogenes M1 GAS
aaauccuuuugaaaaauuau

SEQ ID NO: 2213959 - RNA, 21 nt, Streptococcus pyogenes M1 GAS
aaauccuugcguagacagcaa

SEQ ID NO: 2213960 - RNA, 14 nt, Streptococcus pyogenes M1 GAS
uauugugcuauuca

SEQ ID NO: 2213961 - RNA, 15 nt, Streptococcus pyogenes M1 GAS
uauuuacugggucaa

SEQ ID NO: 2213962 - RNA, 22 nt, Streptococcus pyogenes M1 GAS
uauuuacugggucaacuccaau

SEQ ID NO: 2213963 - RNA, 15 nt, Streptococcus pyogenes M1 GAS
uauuuauaauuucuu

SEQ ID NO: 2213964 - RNA, 23 nt, Streptococcus pyogenes M1 GAS
uauuucacuagacauucguucua

SEQ ID NO: 2213965 - RNA, 14 nt, Streptococcus pyogenes M1 GAS
uauuucacuagaca

SEQ ID NO: 2213966 - RNA, 23 nt, Streptococcus pyogenes M1 GAS
ucaaaaagaggauuuauggaacu

SEQ ID NO: 2213967 - RNA, 14 nt, Streptococcus pyogenes M1 GAS
ucaaaaaguaaaaa

SEQ ID NO: 2213968 - RNA, 19 nt, Streptococcus pyogenes M1 GAS
ucaaaaaauuaagaaggaa

SEQ ID NO: 2213969 - RNA, 17 nt, Streptococcus pyogenes M1 GAS
ucaaaaaauuaagaagg

SEQ ID NO: 2213970 - RNA, 13 nt, Streptococcus pyogenes M1 GAS
ucaaaaaagggaa

SEQ ID NO: 2213971 - RNA, 12 nt, Streptococcus pyogenes M1 GAS
uauuuuuuucua

SEQ ID NO: 2213972 - RNA, 17 nt, Streptococcus pyogenes M1 GAS
uauuuuuucucaaaaau

SEQ ID NO: 2213973 - RNA, 13 nt, Streptococcus pyogenes M1 GAS
ucaaagggauuac

SEQ ID NO: 2213974 - RNA, 21 nt, Streptococcus pyogenes M1 GAS
uauuuucuagguuaaaauaga

SEQ ID NO: 2213975 - RNA, 15 nt, Streptococcus pyogenes M1 GAS
uauuuugauauuuuu

SEQ ID NO: 2213976 - RNA, 13 nt, Streptococcus pyogenes M1 GAS
uauuuuaaaauag

SEQ ID NO: 2213977 - RNA, 15 nt, Streptococcus pyogenes M1 GAS
uauuuuauuaauaag

SEQ ID NO: 2213978 - RNA, 15 nt, Streptococcus pyogenes M1 GAS
uauuucgucuaaaaa

SEQ ID NO: 2213979 - RNA, 23 nt, Streptococcus pyogenes M1 GAS
uauuugacuuguuacaaaaaaca

SEQ ID NO: 2213980 - RNA, 17 nt, Streptococcus pyogenes M1 GAS
uauuugaaguaaaggau

SEQ ID NO: 2213981 - RNA, 18 nt, Streptococcus pyogenes M1 GAS
uacacgugauaaaugccg

SEQ ID NO: 2213982 - RNA, 17 nt, Streptococcus pyogenes M1 GAS
uacacuugauuucauuu

SEQ ID NO: 2213983 - RNA, 16 nt, Streptococcus pyogenes M1 GAS
uacagaaaugaaaaga

SEQ ID NO: 2213984 - RNA, 14 nt, Streptococcus pyogenes M1 GAS
uacaacccacauac

SEQ ID NO: 2213985 - RNA, 22 nt, Streptococcus pyogenes M1 GAS
uacagcugguuuuuuaauuauu

SEQ ID NO: 2213986 - RNA, 16 nt, Streptococcus pyogenes M1 GAS
uacaguugacaauaag

SEQ ID NO: 2213987 - RNA, 20 nt, Streptococcus pyogenes M1 GAS
uacaguugacaauaagcccu

SEQ ID NO: 2213988 - RNA, 19 nt, Streptococcus pyogenes M1 GAS
uacauaaaaugacuucaaa

SEQ ID NO: 2213989 - RNA, 15 nt, Streptococcus pyogenes M1 GAS
uaaucuaaagcauca

SEQ ID NO: 2213990 - RNA, 18 nt, Streptococcus pyogenes M1 GAS
uaaucuuugacaauguca

SEQ ID NO: 2213991 - RNA, 23 nt, Streptococcus pyogenes M1 GAS
uaaucuucagagcacguuuucug

SEQ ID NO: 2213992 - RNA, 19 nt, Streptococcus pyogenes M1 GAS
uaaugccaucaaaaaaaga

SEQ ID NO: 2213993 - RNA, 22 nt, Streptococcus pyogenes M1 GAS
uaaugguuuuuuugucuucuuc

SEQ ID NO: 2213994 - RNA, 19 nt, Streptococcus pyogenes M1 GAS
uaauuagcauauuuugauu

SEQ ID NO: 2213995 - RNA, 11 nt, Streptococcus pyogenes M1 GAS
uaauuaucuga

SEQ ID NO: 2213996 - RNA, 10 nt, Streptococcus pyogenes M1 GAS
uaauuuacua

SEQ ID NO: 2213997 - RNA, 22 nt, Streptococcus pyogenes M1 GAS
uaauuguugcaaccugaaaagu

SEQ ID NO: 2213998 - RNA, 16 nt, Streptococcus pyogenes M1 GAS
uacuguauaaacuugu

SEQ ID NO: 2213999 - RNA, 21 nt, Streptococcus pyogenes M1 GAS
uacuuugguauucuuuuuccg

SEQ ID NO: 2214000 - RNA, 18 nt, Streptococcus pyogenes M1 GAS
uagaaacuuuuuauaagc

SEQ ID NO: 2214001 - RNA, 16 nt, Streptococcus pyogenes M1 GAS
uagagaaucaaaggga

SEQ ID NO: 2214002 - RNA, 20 nt, Streptococcus pyogenes M1 GAS
uagagaacagauaagugcca

SEQ ID NO: 2214003 - RNA, 19 nt, Streptococcus pyogenes M1 GAS
uagacugguucaucuugcc

SEQ ID NO: 2214004 - RNA, 21 nt, Streptococcus pyogenes M1 GAS
uagaagacaaggugaguauaa

SEQ ID NO: 2214005 - RNA, 16 nt, Streptococcus pyogenes M1 GAS
uacgguaaaaacucaa

SEQ ID NO: 2214006 - RNA, 14 nt, Streptococcus pyogenes M1 GAS
uacguaaaaagaga

SEQ ID NO: 2214007 - RNA, 23 nt, Streptococcus pyogenes M1 GAS
uacgguaaaaacucaaaaaauac

SEQ ID NO: 2214008 - RNA, 15 nt, Streptococcus pyogenes M1 GAS
uacuaugaaaaaaga

SEQ ID NO: 2214009 - RNA, 18 nt, Streptococcus pyogenes M1 GAS
uacuauggcuucuaaaaa

SEQ ID NO: 2214010 - RNA, 18 nt, Streptococcus pyogenes M1 GAS
uaccuauugagucuuuuc

SEQ ID NO: 2214011 - RNA, 16 nt, Streptococcus pyogenes M1 GAS
uagauaauguuguuuu

SEQ ID NO: 2214012 - RNA, 17 nt, Streptococcus pyogenes M1 GAS
uagagucucuagucuuu

SEQ ID NO: 2214013 - RNA, 15 nt, Streptococcus pyogenes M1 GAS
uagagucucuagucu

SEQ ID NO: 2214014 - RNA, 15 nt, Streptococcus pyogenes M1 GAS
uagauaaacugguua

SEQ ID NO: 2214015 - RNA, 18 nt, Streptococcus pyogenes M1 GAS
uagaucaauuccaucacu

SEQ ID NO: 2214016 - RNA, 16 nt, Streptococcus pyogenes M1 GAS
uagcaauggcuaaaaa

SEQ ID NO: 2214017 - RNA, 21 nt, Streptococcus pyogenes M1 GAS
uagcaaguccugcuuuugaug

SEQ ID NO: 2214018 - RNA, 20 nt, Streptococcus pyogenes M1 GAS
uagcaaagugauauacugaa

SEQ ID NO: 2214019 - RNA, 19 nt, Streptococcus pyogenes M1 GAS
uagcaguuauaauuaguau

SEQ ID NO: 2214020 - RNA, 16 nt, Streptococcus pyogenes M1 GAS
uagcauaaaagauauu

SEQ ID NO: 2214021 - RNA, 12 nt, Streptococcus pyogenes M1 GAS
uagcauaaaaua

SEQ ID NO: 2214022 - RNA, 13 nt, Streptococcus pyogenes M1 GAS
uagcagacaaaag

SEQ ID NO: 2214023 - RNA, 16 nt, Streptococcus pyogenes M1 GAS
uagcagcagaagcaaa

SEQ ID NO: 2214024 - RNA, 23 nt, Streptococcus pyogenes M1 GAS
uagcauuaaggauuaugaaaaag

SEQ ID NO: 2214025 - RNA, 18 nt, Streptococcus pyogenes M1 GAS
uagccaagcaaucuaaga

SEQ ID NO: 2214026 - RNA, 17 nt, Streptococcus pyogenes M1 GAS
uaggacuaaccccuaau

SEQ ID NO: 2214027 - RNA, 22 nt, Streptococcus pyogenes M1 GAS
uaggauauaagaaggucucaaa

SEQ ID NO: 2214028 - RNA, 16 nt, Streptococcus pyogenes M1 GAS
uaggaaucacaacuuc

SEQ ID NO: 2214029 - RNA, 20 nt, Streptococcus pyogenes M1 GAS
uaggaauaguuuagugcugc

SEQ ID NO: 2214030 - RNA, 13 nt, Streptococcus pyogenes M1 GAS
uaggaauaaaaug

SEQ ID NO: 2214031 - RNA, 17 nt, Streptococcus pyogenes M1 GAS
uaggaaucgcuuuagga

SEQ ID NO: 2214032 - RNA, 19 nt, Streptococcus pyogenes M1 GAS
uagcuuuuuacaucaaaaa

SEQ ID NO: 2214033 - RNA, 16 nt, Streptococcus pyogenes M1 GAS
uagcuuuuuuuaaagc

SEQ ID NO: 2214034 - RNA, 18 nt, Streptococcus pyogenes M1 GAS
uagcugguuugauuaccu

SEQ ID NO: 2214035 - RNA, 20 nt, Streptococcus pyogenes M1 GAS
uagcugcugcuaaagcaauc

SEQ ID NO: 2214036 - RNA, 16 nt, Streptococcus pyogenes M1 GAS
uagcuaauccaauaau

SEQ ID NO: 2214037 - RNA, 17 nt, Streptococcus pyogenes M1 GAS
uauaacuguuuuucuua

SEQ ID NO: 2214038 - RNA, 15 nt, Streptococcus pyogenes M1 GAS
uauaacuguucauuu

SEQ ID NO: 2214039 - RNA, 16 nt, Streptococcus pyogenes M1 GAS
uauaacuguuuuucuu

SEQ ID NO: 2214040 - RNA, 21 nt, Streptococcus pyogenes M1 GAS
uauacgguaaaaacucaaaaa

SEQ ID NO: 2214041 - RNA, 12 nt, Streptococcus pyogenes M1 GAS
uauagaaaguaa

SEQ ID NO: 2214042 - RNA, 14 nt, Streptococcus pyogenes M1 GAS
uauagaaaguaaaa

SEQ ID NO: 2214043 - RNA, 14 nt, Streptococcus pyogenes M1 GAS
uauagaauagguaa

SEQ ID NO: 2214044 - RNA, 22 nt, Streptococcus pyogenes M1 GAS
uaucaauaacagaaauuaauaa

SEQ ID NO: 2214045 - RNA, 19 nt, Streptococcus pyogenes M1 GAS
uaucaugaaguauaguuau

SEQ ID NO: 2214046 - RNA, 21 nt, Streptococcus pyogenes M1 GAS
uaucagucuguccaauaccua

SEQ ID NO: 2214047 - RNA, 15 nt, Streptococcus pyogenes M1 GAS
uauccaacuuuuauc

SEQ ID NO: 2214048 - RNA, 16 nt, Streptococcus pyogenes M1 GAS
uauccaaugaaaacuc

SEQ ID NO: 2214049 - RNA, 16 nt, Streptococcus pyogenes M1 GAS
uaguuuuauuuugaua

SEQ ID NO: 2214050 - RNA, 21 nt, Streptococcus pyogenes M1 GAS
uaguuuauuacaaaacugucu

SEQ ID NO: 2214051 - RNA, 17 nt, Streptococcus pyogenes M1 GAS
uaguuuuuagcagcaga

SEQ ID NO: 2214052 - RNA, 14 nt, Streptococcus pyogenes M1 GAS
uauaaagaaacaaa

SEQ ID NO: 2214053 - RNA, 13 nt, Streptococcus pyogenes M1 GAS
uauaacaauuaca

SEQ ID NO: 2214054 - RNA, 15 nt, Streptococcus pyogenes M1 GAS
uauaaagaaacaaaa

SEQ ID NO: 2214055 - RNA, 23 nt, Streptococcus pyogenes M1 GAS
uauaaauuauuaacguuaacaaa

SEQ ID NO: 2214056 - RNA, 21 nt, Streptococcus pyogenes M1 GAS
uaguguuuuuagauaaaaaug

SEQ ID NO: 2214057 - RNA, 21 nt, Streptococcus pyogenes M1 GAS
uaguuuaacguaauaaaauaa

SEQ ID NO: 2214058 - RNA, 22 nt, Streptococcus pyogenes M1 GAS
uaguuuaggaaucacaacuucu

SEQ ID NO: 2214059 - RNA, 15 nt, Streptococcus pyogenes M1 GAS
uaguuuauuacaaaa

SEQ ID NO: 2214060 - RNA, 17 nt, Streptococcus pyogenes M1 GAS
uaggguagcugguuuga

SEQ ID NO: 2214061 - RNA, 23 nt, Streptococcus pyogenes M1 GAS
uagguacucguaagcauuuugag

SEQ ID NO: 2214062 - RNA, 22 nt, Streptococcus pyogenes M1 GAS
uaggucuaauuagcauauuuug

SEQ ID NO: 2214063 - RNA, 14 nt, Streptococcus pyogenes M1 GAS
uaguauuagcacca

SEQ ID NO: 2214064 - RNA, 15 nt, Streptococcus pyogenes M1 GAS
uagucaaaaagacuu

SEQ ID NO: 2214065 - RNA, 15 nt, Streptococcus pyogenes M1 GAS
uaguagcaaauaaca

SEQ ID NO: 2214066 - RNA, 17 nt, Streptococcus pyogenes M1 GAS
uagggauuuuuuaacua

SEQ ID NO: 2214067 - RNA, 17 nt, Streptococcus pyogenes M1 GAS
uaggccaauccuaacaa

SEQ ID NO: 2214068 - RNA, 12 nt, Streptococcus pyogenes M1 GAS
uaacaacaacaa

SEQ ID NO: 2214069 - RNA, 19 nt, Streptococcus pyogenes M1 GAS
uaacaacaacaacccuuga

SEQ ID NO: 2214070 - RNA, 17 nt, Streptococcus pyogenes M1 GAS
uaaauuugggcaguagu

SEQ ID NO: 2214071 - RNA, 18 nt, Streptococcus pyogenes M1 GAS
uaaauugauuauucuuua

SEQ ID NO: 2214072 - RNA, 20 nt, Streptococcus pyogenes M1 GAS
uaaauugauuauucuuuauu

SEQ ID NO: 2214073 - RNA, 21 nt, Streptococcus pyogenes M1 GAS
uaacagcaacaucaaaaagag

SEQ ID NO: 2214074 - RNA, 20 nt, Streptococcus pyogenes M1 GAS
uaacauuuaugagauuagca

SEQ ID NO: 2214075 - RNA, 22 nt, Streptococcus pyogenes M1 GAS
uaaccauugccauuaauaauau

SEQ ID NO: 2214076 - RNA, 14 nt, Streptococcus pyogenes M1 GAS
uaaacuaauaagau

SEQ ID NO: 2214077 - RNA, 18 nt, Streptococcus pyogenes M1 GAS
uaaagaaacaaaaaugaa

SEQ ID NO: 2214078 - RNA, 12 nt, Streptococcus pyogenes M1 GAS
uaaagaagaauu

SEQ ID NO: 2214079 - RNA, 23 nt, Streptococcus pyogenes M1 GAS
uaaaauuccccacaaaagacaac

SEQ ID NO: 2214080 - RNA, 17 nt, Streptococcus pyogenes M1 GAS
uaaaauuccccacaaaa

SEQ ID NO: 2214081 - RNA, 20 nt, Streptococcus pyogenes M1 GAS
uaaacaaugagucaccugua

SEQ ID NO: 2214082 - RNA, 12 nt, Streptococcus pyogenes M1 GAS
uaaauaguacau

SEQ ID NO: 2214083 - RNA, 15 nt, Streptococcus pyogenes M1 GAS
uaaagaccucucaug

SEQ ID NO: 2214084 - RNA, 13 nt, Streptococcus pyogenes M1 GAS
uaaagcaagggaa

SEQ ID NO: 2214085 - RNA, 13 nt, Streptococcus pyogenes M1 GAS
uaaagauuuuaaa

SEQ ID NO: 2214086 - RNA, 16 nt, Streptococcus pyogenes M1 GAS
uaaagauuuuaaauau

SEQ ID NO: 2214087 - RNA, 18 nt, Streptococcus pyogenes M1 GAS
uaaagauuuuaaauaucu

SEQ ID NO: 2214088 - RNA, 15 nt, Streptococcus pyogenes M1 GAS
uaaagggcuuaaucu

SEQ ID NO: 2214089 - RNA, 16 nt, Streptococcus pyogenes M1 GAS
uaaagggcuuaaucug

SEQ ID NO: 2214090 - RNA, 19 nt, Streptococcus pyogenes M1 GAS
uaaaggccuguauuucuuu

SEQ ID NO: 2214091 - RNA, 22 nt, Streptococcus pyogenes M1 GAS
uaaaggucugcuucuuacuaug

SEQ ID NO: 2214092 - RNA, 12 nt, Streptococcus pyogenes M1 GAS
uaaaggauuuag

SEQ ID NO: 2214093 - RNA, 17 nt, Streptococcus pyogenes M1 GAS
uaaaggauuuaguuuug

SEQ ID NO: 2214094 - RNA, 16 nt, Streptococcus pyogenes M1 GAS
uaaaauauuuuuccau

SEQ ID NO: 2214095 - RNA, 22 nt, Streptococcus pyogenes M1 GAS
uaaaauaucuagaacagcugcu

SEQ ID NO: 2214096 - RNA, 23 nt, Streptococcus pyogenes M1 GAS
uaaaauaucuagaacagcugcuu

SEQ ID NO: 2214097 - RNA, 14 nt, Streptococcus pyogenes M1 GAS
uaaaauaucuagaa

SEQ ID NO: 2214098 - RNA, 23 nt, Streptococcus pyogenes M1 GAS
uaaaaucaugggaaaagcuaagu

SEQ ID NO: 2214099 - RNA, 16 nt, Streptococcus pyogenes M1 GAS
uaaaaucguuauuaau

SEQ ID NO: 2214100 - RNA, 15 nt, Streptococcus pyogenes M1 GAS
uaaaaugacugacaa

SEQ ID NO: 2214101 - RNA, 17 nt, Streptococcus pyogenes M1 GAS
uaaaagggucaguuugu

SEQ ID NO: 2214102 - RNA, 18 nt, Streptococcus pyogenes M1 GAS
uaaaagagagaaugauag

SEQ ID NO: 2214103 - RNA, 14 nt, Streptococcus pyogenes M1 GAS
uaaaaccauuauaa

SEQ ID NO: 2214104 - RNA, 20 nt, Streptococcus pyogenes M1 GAS
uaaaaauacuagaaaaagca

SEQ ID NO: 2214105 - RNA, 19 nt, Streptococcus pyogenes M1 GAS
aaaucaguagugaugagua

SEQ ID NO: 2214106 - RNA, 21 nt, Streptococcus pyogenes M1 GAS
aaaucaugggaaaagcuaagu

SEQ ID NO: 2214107 - RNA, 15 nt, Streptococcus pyogenes M1 GAS
guuuuuaaagcgaua

SEQ ID NO: 2214108 - RNA, 20 nt, Streptococcus pyogenes M1 GAS
guuuucucagagacaauaag

SEQ ID NO: 2214109 - RNA, 18 nt, Streptococcus pyogenes M1 GAS
guuuucucaacaguauaa

SEQ ID NO: 2214110 - RNA, 22 nt, Streptococcus pyogenes M1 GAS
guuugauugauuugucuucucc

SEQ ID NO: 2214111 - RNA, 16 nt, Streptococcus pyogenes M1 GAS
guuugauugauuuguc

SEQ ID NO: 2214112 - RNA, 22 nt, Streptococcus pyogenes M1 GAS
guuuuuacauuuuuacaauacg

SEQ ID NO: 2214113 - RNA, 21 nt, Streptococcus pyogenes M1 GAS
guuuuuggaucgcugugacca

SEQ ID NO: 2214114 - RNA, 21 nt, Streptococcus pyogenes M1 GAS
uaaaaaagaagcaaaauuauu

SEQ ID NO: 2214115 - RNA, 16 nt, Streptococcus pyogenes M1 GAS
guuuuuuugucuucuu

SEQ ID NO: 2214116 - RNA, 19 nt, Streptococcus pyogenes M1 GAS
uaaaaacaaugcucuuaac

SEQ ID NO: 2214117 - RNA, 17 nt, Streptococcus pyogenes M1 GAS
uaaaaacucaaaaaaua

SEQ ID NO: 2214118 - RNA, 16 nt, Streptococcus pyogenes M1 GAS
uaaaaaauuuaauagu

SEQ ID NO: 2214119 - RNA, 20 nt, Streptococcus pyogenes M1 GAS
uaaaaagguaucccauaucu

SEQ ID NO: 2214120 - RNA, 18 nt, Streptococcus pyogenes M1 GAS
uaaaaauacuagaaaaag

SEQ ID NO: 2214121 - RNA, 18 nt, Streptococcus pyogenes M1 GAS
uaaaaagcaaauugaaaa

SEQ ID NO: 2214122 - RNA, 13 nt, Streptococcus pyogenes M1 GAS
guugguaaaaagg

SEQ ID NO: 2214123 - RNA, 20 nt, Streptococcus pyogenes M1 GAS
guuuauuuauaauuucuuuc

SEQ ID NO: 2214124 - RNA, 18 nt, Streptococcus pyogenes M1 GAS
guuuauguaugcugucca

SEQ ID NO: 2214125 - RNA, 16 nt, Streptococcus pyogenes M1 GAS
guuuaggauauaagaa

SEQ ID NO: 2214126 - RNA, 20 nt, Streptococcus pyogenes M1 GAS
guuuaggaaucacaacuucu

SEQ ID NO: 2214127 - RNA, 21 nt, Streptococcus pyogenes M1 GAS
guuuaaauguccgaaaaaaac

SEQ ID NO: 2214128 - RNA, 18 nt, Streptococcus pyogenes M1 GAS
guugacaguuaaaaauaa

SEQ ID NO: 2214129 - RNA, 13 nt, Streptococcus pyogenes M1 GAS
guugaaugaguua

SEQ ID NO: 2214130 - RNA, 14 nt, Streptococcus pyogenes M1 GAS
guugauauaaaauu

SEQ ID NO: 2214131 - RNA, 14 nt, Streptococcus pyogenes M1 GAS
guucugaaaauaaa

SEQ ID NO: 2214132 - RNA, 15 nt, Streptococcus pyogenes M1 GAS
guucugaaaauaaaa

SEQ ID NO: 2214133 - RNA, 21 nt, Streptococcus pyogenes M1 GAS
guucugaaaauaaaauauuuu

SEQ ID NO: 2214134 - RNA, 13 nt, Streptococcus pyogenes M1 GAS
guucguuauaaac

SEQ ID NO: 2214135 - RNA, 18 nt, Streptococcus pyogenes M1 GAS
guucucuacuugucauga

SEQ ID NO: 2214136 - RNA, 23 nt, Streptococcus pyogenes M1 GAS
guucuguuucuaagcaaauagca

SEQ ID NO: 2214137 - RNA, 18 nt, Streptococcus pyogenes M1 GAS
guucuuaaaagaaaaucu

SEQ ID NO: 2214138 - RNA, 16 nt, Streptococcus pyogenes M1 GAS
guucagauauucuuug

SEQ ID NO: 2214139 - RNA, 17 nt, Streptococcus pyogenes M1 GAS
guucacuuuguuaccag

SEQ ID NO: 2214140 - RNA, 19 nt, Streptococcus pyogenes M1 GAS
guucaauggauauaacaac

SEQ ID NO: 2214141 - RNA, 16 nt, Streptococcus pyogenes M1 GAS
guucaauacucccuuc

SEQ ID NO: 2214142 - RNA, 17 nt, Streptococcus pyogenes M1 GAS
guucagcagcacuggcu

SEQ ID NO: 2214143 - RNA, 12 nt, Streptococcus pyogenes M1 GAS
guucauuuagug

SEQ ID NO: 2214144 - RNA, 14 nt, Streptococcus pyogenes M1 GAS
guuauuaaagacaa

SEQ ID NO: 2214145 - RNA, 14 nt, Streptococcus pyogenes M1 GAS
guuauguuauaaga

SEQ ID NO: 2214146 - RNA, 19 nt, Streptococcus pyogenes M1 GAS
guuauccucuuuuaguuca

SEQ ID NO: 2214147 - RNA, 21 nt, Streptococcus pyogenes M1 GAS
guguaauccccucguuuaaau

SEQ ID NO: 2214148 - RNA, 14 nt, Streptococcus pyogenes M1 GAS
gugcuacugaugua

SEQ ID NO: 2214149 - RNA, 20 nt, Streptococcus pyogenes M1 GAS
gugauguucucauaaacaau

SEQ ID NO: 2214150 - RNA, 18 nt, Streptococcus pyogenes M1 GAS
gugcagugggcuuuuuug

SEQ ID NO: 2214151 - RNA, 20 nt, Streptococcus pyogenes M1 GAS
gugcaccgacauacaaagca

SEQ ID NO: 2214152 - RNA, 21 nt, Streptococcus pyogenes M1 GAS
gucauuucuucagguuucuuu

SEQ ID NO: 2214153 - RNA, 22 nt, Streptococcus pyogenes M1 GAS
gucaugaugccauuuaaaaggg

SEQ ID NO: 2214154 - RNA, 22 nt, Streptococcus pyogenes M1 GAS
gucagacuuaauugaaagaggu

SEQ ID NO: 2214155 - RNA, 19 nt, Streptococcus pyogenes M1 GAS
gucaauacagccguucuua

SEQ ID NO: 2214156 - RNA, 13 nt, Streptococcus pyogenes M1 GAS
gucguuuuuugcu

SEQ ID NO: 2214157 - RNA, 20 nt, Streptococcus pyogenes M1 GAS
gucgaaauugguccucugaa

SEQ ID NO: 2214158 - RNA, 18 nt, Streptococcus pyogenes M1 GAS
gucaaaaaguaaaaagca

SEQ ID NO: 2214159 - RNA, 19 nt, Streptococcus pyogenes M1 GAS
gucaaaaaauuaagaagga

SEQ ID NO: 2214160 - RNA, 14 nt, Streptococcus pyogenes M1 GAS
guauuguagaggac

SEQ ID NO: 2214161 - RNA, 20 nt, Streptococcus pyogenes M1 GAS
guauuggccuucuuggaaaa

SEQ ID NO: 2214162 - RNA, 20 nt, Streptococcus pyogenes M1 GAS
guauuuacugggucaacucc

SEQ ID NO: 2214163 - RNA, 14 nt, Streptococcus pyogenes M1 GAS
guauucuuaaaaaa

SEQ ID NO: 2214164 - RNA, 13 nt, Streptococcus pyogenes M1 GAS
guauguaaauaua

SEQ ID NO: 2214165 - RNA, 23 nt, Streptococcus pyogenes M1 GAS
guaugcuuuuaauuuuauuuuuu

SEQ ID NO: 2214166 - RNA, 19 nt, Streptococcus pyogenes M1 GAS
guaucacucguaaaaagau

SEQ ID NO: 2214167 - RNA, 20 nt, Streptococcus pyogenes M1 GAS
guaucuaagcuauagaaacu

SEQ ID NO: 2214168 - RNA, 14 nt, Streptococcus pyogenes M1 GAS
guaucuaagcuaua

SEQ ID NO: 2214169 - RNA, 17 nt, Streptococcus pyogenes M1 GAS
guaucuaagcuauagaa

SEQ ID NO: 2214170 - RNA, 15 nt, Streptococcus pyogenes M1 GAS
guauagcauaaaaua

SEQ ID NO: 2214171 - RNA, 16 nt, Streptococcus pyogenes M1 GAS
guauagcauaaaauag

SEQ ID NO: 2214172 - RNA, 14 nt, Streptococcus pyogenes M1 GAS
guauagcauaaaau

SEQ ID NO: 2214173 - RNA, 18 nt, Streptococcus pyogenes M1 GAS
guauaacuguuuuucuua

SEQ ID NO: 2214174 - RNA, 18 nt, Streptococcus pyogenes M1 GAS
guacucaucuaaaaaagc

SEQ ID NO: 2214175 - RNA, 18 nt, Streptococcus pyogenes M1 GAS
guaaaguuaggaaagaua

SEQ ID NO: 2214176 - RNA, 18 nt, Streptococcus pyogenes M1 GAS
guaaaggauuuaguuuug

SEQ ID NO: 2214177 - RNA, 19 nt, Streptococcus pyogenes M1 GAS
guaaaggauuuaguucugu

SEQ ID NO: 2214178 - RNA, 20 nt, Streptococcus pyogenes M1 GAS
guaaagauuuuaaauaucuu

SEQ ID NO: 2214179 - RNA, 16 nt, Streptococcus pyogenes M1 GAS
guaaagcaagggaaac

SEQ ID NO: 2214180 - RNA, 18 nt, Streptococcus pyogenes M1 GAS
guaauagcguaaagcaag

SEQ ID NO: 2214181 - RNA, 13 nt, Streptococcus pyogenes M1 GAS
guaaguuuuuuug

SEQ ID NO: 2214182 - RNA, 20 nt, Streptococcus pyogenes M1 GAS
guaagcaaccucaguucuga

SEQ ID NO: 2214183 - RNA, 13 nt, Streptococcus pyogenes M1 GAS
guaauucagcauc

SEQ ID NO: 2214184 - RNA, 15 nt, Streptococcus pyogenes M1 GAS
guaauuucuugugcu

SEQ ID NO: 2214185 - RNA, 21 nt, Streptococcus pyogenes M1 GAS
guaauggugaccgguuucuug

SEQ ID NO: 2214186 - RNA, 15 nt, Streptococcus pyogenes M1 GAS
guacacgugauaaau

SEQ ID NO: 2214187 - RNA, 19 nt, Streptococcus pyogenes M1 GAS
guacaugaccuuccccauc

SEQ ID NO: 2214188 - RNA, 11 nt, Streptococcus pyogenes M1 GAS
gguuucuuuug

SEQ ID NO: 2214189 - RNA, 21 nt, Streptococcus pyogenes M1 GAS
guaaaaauacuagaaaaagca

SEQ ID NO: 2214190 - RNA, 11 nt, Streptococcus pyogenes M1 GAS
guaaaaaaggg

SEQ ID NO: 2214191 - RNA, 14 nt, Streptococcus pyogenes M1 GAS
gguuuuuuuaagua

SEQ ID NO: 2214192 - RNA, 19 nt, Streptococcus pyogenes M1 GAS
gguuguggcugauaaaaag

SEQ ID NO: 2214193 - RNA, 21 nt, Streptococcus pyogenes M1 GAS
gguguaauccccucguuuaaa

SEQ ID NO: 2214194 - RNA, 12 nt, Streptococcus pyogenes M1 GAS
ggugucagcaua

SEQ ID NO: 2214195 - RNA, 22 nt, Streptococcus pyogenes M1 GAS
gguucaucuugccaucagcauc

SEQ ID NO: 2214196 - RNA, 21 nt, Streptococcus pyogenes M1 GAS
gcgaggcuuuuuugagcauca

SEQ ID NO: 2214197 - RNA, 19 nt, Streptococcus pyogenes M1 GAS
aaagcuaucauacaacuga

SEQ ID NO: 2214198 - RNA, 19 nt, Streptococcus pyogenes M1 GAS
gcccucgcuaucaaagcug

SEQ ID NO: 2214199 - RNA, 13 nt, Streptococcus pyogenes M1 GAS
aaagcuaaguaag

SEQ ID NO: 2214200 - RNA, 21 nt, Streptococcus pyogenes M1 GAS
gccaucaaaaaaagacacaca

SEQ ID NO: 2214201 - RNA, 17 nt, Streptococcus pyogenes M1 GAS
gccaguaaggaaaucaa

SEQ ID NO: 2214202 - RNA, 23 nt, Streptococcus pyogenes M1 GAS
gccaauaacgccagcuacauugg

SEQ ID NO: 2214203 - RNA, 17 nt, Streptococcus pyogenes M1 GAS
gcauaccugagccucca

SEQ ID NO: 2214204 - RNA, 16 nt, Streptococcus pyogenes M1 GAS
gcauugucaaauaaaa

SEQ ID NO: 2214205 - RNA, 16 nt, Streptococcus pyogenes M1 GAS
gcauuaucaucugguc

SEQ ID NO: 2214206 - RNA, 22 nt, Streptococcus pyogenes M1 GAS
gcagauggggugucaggggaau

SEQ ID NO: 2214207 - RNA, 20 nt, Streptococcus pyogenes M1 GAS
gcagauggggugucagggga

SEQ ID NO: 2214208 - RNA, 11 nt, Streptococcus pyogenes M1 GAS
gcacuuguaau

SEQ ID NO: 2214209 - RNA, 17 nt, Streptococcus pyogenes M1 GAS
gcacuuuauuauaccaa

SEQ ID NO: 2214210 - RNA, 12 nt, Streptococcus pyogenes M1 GAS
gcacguuuucug

SEQ ID NO: 2214211 - RNA, 14 nt, Streptococcus pyogenes M1 GAS
gcaccuucuuuuag

SEQ ID NO: 2214212 - RNA, 15 nt, Streptococcus pyogenes M1 GAS
gcaccuuuuuuauug

SEQ ID NO: 2214213 - RNA, 15 nt, Streptococcus pyogenes M1 GAS
gcaccugaggcaaug

SEQ ID NO: 2214214 - RNA, 20 nt, Streptococcus pyogenes M1 GAS
gcaccgacauacaaagcauc

SEQ ID NO: 2214215 - RNA, 19 nt, Streptococcus pyogenes M1 GAS
gcacagcguaagccaaauc

SEQ ID NO: 2214216 - RNA, 17 nt, Streptococcus pyogenes M1 GAS
gcaauggcuaaaaagag

SEQ ID NO: 2214217 - RNA, 18 nt, Streptococcus pyogenes M1 GAS
gcaauggcuaaaaagaga

SEQ ID NO: 2214218 - RNA, 20 nt, Streptococcus pyogenes M1 GAS
gcaauggcuaaaaagagagc

SEQ ID NO: 2214219 - RNA, 14 nt, Streptococcus pyogenes M1 GAS
gcaauccaaaucaa

SEQ ID NO: 2214220 - RNA, 15 nt, Streptococcus pyogenes M1 GAS
gcaauccaaaucaac

SEQ ID NO: 2214221 - RNA, 13 nt, Streptococcus pyogenes M1 GAS
gcaagauaauauu

SEQ ID NO: 2214222 - RNA, 20 nt, Streptococcus pyogenes M1 GAS
gcaauaacaucuugauugua

SEQ ID NO: 2214223 - RNA, 15 nt, Streptococcus pyogenes M1 GAS
gcguaagccaaaucu

SEQ ID NO: 2214224 - RNA, 21 nt, Streptococcus pyogenes M1 GAS
gcguauaggugaguuuuuucu

SEQ ID NO: 2214225 - RNA, 23 nt, Streptococcus pyogenes M1 GAS
gcguagacagcaaggaugaaaug

SEQ ID NO: 2214226 - RNA, 23 nt, Streptococcus pyogenes M1 GAS
gcugaugacuuguaaaaugauac

SEQ ID NO: 2214227 - RNA, 19 nt, Streptococcus pyogenes M1 GAS
gcucuugcuugucuuuuuu

SEQ ID NO: 2214228 - RNA, 17 nt, Streptococcus pyogenes M1 GAS
gcuagggcaacugcaau

SEQ ID NO: 2214229 - RNA, 14 nt, Streptococcus pyogenes M1 GAS
gcuagacuauaaaa

SEQ ID NO: 2214230 - RNA, 14 nt, Streptococcus pyogenes M1 GAS
gcuagauugcuucc

SEQ ID NO: 2214231 - RNA, 17 nt, Streptococcus pyogenes M1 GAS
gcuagaccucugcucac

SEQ ID NO: 2214232 - RNA, 18 nt, Streptococcus pyogenes M1 GAS
gcuaucauacaacugacu

SEQ ID NO: 2214233 - RNA, 21 nt, Streptococcus pyogenes M1 GAS
gcuauagaaacuuuuuauaag

SEQ ID NO: 2214234 - RNA, 18 nt, Streptococcus pyogenes M1 GAS
gcuauaacaguuccaguu

SEQ ID NO: 2214235 - RNA, 16 nt, Streptococcus pyogenes M1 GAS
gcuauggacuaucuga

SEQ ID NO: 2214236 - RNA, 20 nt, Streptococcus pyogenes M1 GAS
gcucaacuggcacaaacucu

SEQ ID NO: 2214237 - RNA, 17 nt, Streptococcus pyogenes M1 GAS
gcucagaauaaagaaaa

SEQ ID NO: 2214238 - RNA, 20 nt, Streptococcus pyogenes M1 GAS
gcguuaucuccacagagucu

SEQ ID NO: 2214239 - RNA, 15 nt, Streptococcus pyogenes M1 GAS
gcguuucgaaaaagg

SEQ ID NO: 2214240 - RNA, 18 nt, Streptococcus pyogenes M1 GAS
gcuaaaaacaaugcucuu

SEQ ID NO: 2214241 - RNA, 13 nt, Streptococcus pyogenes M1 GAS
gcuaaaaagagag

SEQ ID NO: 2214242 - RNA, 16 nt, Streptococcus pyogenes M1 GAS
gcuaaaagcauaaaaa

SEQ ID NO: 2214243 - RNA, 20 nt, Streptococcus pyogenes M1 GAS
gcuuuuuaauuguugcaacc

SEQ ID NO: 2214244 - RNA, 20 nt, Streptococcus pyogenes M1 GAS
gcuuuuuacaucaaaaaaag

SEQ ID NO: 2214245 - RNA, 22 nt, Streptococcus pyogenes M1 GAS
ggaaaacagaaagcggaagaac

SEQ ID NO: 2214246 - RNA, 11 nt, Streptococcus pyogenes M1 GAS
ggaaaacagaa

SEQ ID NO: 2214247 - RNA, 15 nt, Streptococcus pyogenes M1 GAS
gcuuuuuuuguaucu

SEQ ID NO: 2214248 - RNA, 16 nt, Streptococcus pyogenes M1 GAS
gcuuuuuuuauuucac

SEQ ID NO: 2214249 - RNA, 17 nt, Streptococcus pyogenes M1 GAS
gcuuuuuugagcaucag

SEQ ID NO: 2214250 - RNA, 18 nt, Streptococcus pyogenes M1 GAS
gcuuucuacuaaaaaagg

SEQ ID NO: 2214251 - RNA, 22 nt, Streptococcus pyogenes M1 GAS
gcuuugacaaagcagugcuuua

SEQ ID NO: 2214252 - RNA, 19 nt, Streptococcus pyogenes M1 GAS
gcuuugauuuuucuuguuu

SEQ ID NO: 2214253 - RNA, 14 nt, Streptococcus pyogenes M1 GAS
ggaagaacagcauu

SEQ ID NO: 2214254 - RNA, 18 nt, Streptococcus pyogenes M1 GAS
ggaagaacagcauuuuca

SEQ ID NO: 2214255 - RNA, 22 nt, Streptococcus pyogenes M1 GAS
ggaaaguaaggguuaacaauga

SEQ ID NO: 2214256 - RNA, 23 nt, Streptococcus pyogenes M1 GAS
ggauauaacaacucccuccuaag

SEQ ID NO: 2214257 - RNA, 15 nt, Streptococcus pyogenes M1 GAS
aaaguaaaaagcaaa

SEQ ID NO: 2214258 - RNA, 14 nt, Streptococcus pyogenes M1 GAS
aaaguaaaaagcaa

SEQ ID NO: 2214259 - RNA, 20 nt, Streptococcus pyogenes M1 GAS
ggacuaaccccuaaucagaa

SEQ ID NO: 2214260 - RNA, 14 nt, Streptococcus pyogenes M1 GAS
ggacauggaguccu

SEQ ID NO: 2214261 - RNA, 13 nt, Streptococcus pyogenes M1 GAS
ggaccaagauuca

SEQ ID NO: 2214262 - RNA, 19 nt, Streptococcus pyogenes M1 GAS
ggauuuagcuguuauugga

SEQ ID NO: 2214263 - RNA, 15 nt, Streptococcus pyogenes M1 GAS
ggauuuauggaacua

SEQ ID NO: 2214264 - RNA, 14 nt, Streptococcus pyogenes M1 GAS
ggcacagaaaaaag

SEQ ID NO: 2214265 - RNA, 16 nt, Streptococcus pyogenes M1 GAS
ggcaauccaaaucaac

SEQ ID NO: 2214266 - RNA, 13 nt, Streptococcus pyogenes M1 GAS
ggcuaaaaagaga

SEQ ID NO: 2214267 - RNA, 12 nt, Streptococcus pyogenes M1 GAS
ggcuaauaagag

SEQ ID NO: 2214268 - RNA, 14 nt, Streptococcus pyogenes M1 GAS
ggcgccguuuuuca

SEQ ID NO: 2214269 - RNA, 20 nt, Streptococcus pyogenes M1 GAS
ggcgccguuuuucaaggcug

SEQ ID NO: 2214270 - RNA, 22 nt, Streptococcus pyogenes M1 GAS
ggcgccguuuuucaaggcuguc

SEQ ID NO: 2214271 - RNA, 18 nt, Streptococcus pyogenes M1 GAS
aaauacuagaaaaagcaa

SEQ ID NO: 2214272 - RNA, 17 nt, Streptococcus pyogenes M1 GAS
aaauacuagaaaaagca

SEQ ID NO: 2214273 - RNA, 13 nt, Streptococcus pyogenes M1 GAS
aaauaaacuuuca

SEQ ID NO: 2214274 - RNA, 17 nt, Streptococcus pyogenes M1 GAS
ggccuguauuucuuuag

SEQ ID NO: 2214275 - RNA, 13 nt, Streptococcus pyogenes M1 GAS
aaauaaaaucguu

SEQ ID NO: 2214276 - RNA, 14 nt, Streptococcus pyogenes M1 GAS
aaauaaaauauuuu

SEQ ID NO: 2214277 - RNA, 12 nt, Streptococcus pyogenes M1 GAS
aaauaaaccaag

SEQ ID NO: 2214278 - RNA, 15 nt, Streptococcus pyogenes M1 GAS
aaauaaaccaagcua

SEQ ID NO: 2214279 - RNA, 11 nt, Streptococcus pyogenes M1 GAS
aaaguuuucuc

SEQ ID NO: 2214280 - RNA, 16 nt, Streptococcus pyogenes M1 GAS
aaaguuuucucagaga

SEQ ID NO: 2214281 - RNA, 15 nt, Streptococcus pyogenes M1 GAS
aaaguuauaaagaaa

SEQ ID NO: 2214282 - RNA, 17 nt, Streptococcus pyogenes M1 GAS
aaagugcgcuuccagaa

SEQ ID NO: 2214283 - RNA, 22 nt, Streptococcus pyogenes M1 GAS
aaaguuggcuacucuauuugaa

SEQ ID NO: 2214284 - RNA, 17 nt, Streptococcus pyogenes M1 GAS
gagggacugucaaaaaa

SEQ ID NO: 2214285 - RNA, 15 nt, Streptococcus pyogenes M1 GAS
gauaaaacaaauaau

SEQ ID NO: 2214286 - RNA, 12 nt, Streptococcus pyogenes M1 GAS
gauaaaaaacaa

SEQ ID NO: 2214287 - RNA, 14 nt, Streptococcus pyogenes M1 GAS
gauaaauaguacau

SEQ ID NO: 2214288 - RNA, 11 nt, Streptococcus pyogenes M1 GAS
gaguuuugcug

SEQ ID NO: 2214289 - RNA, 17 nt, Streptococcus pyogenes M1 GAS
gagguugguaaaaaggc

SEQ ID NO: 2214290 - RNA, 16 nt, Streptococcus pyogenes M1 GAS
gagguuaaucgaccaa

SEQ ID NO: 2214291 - RNA, 23 nt, Streptococcus pyogenes M1 GAS
gauauuuuuucucaaaaauauau

SEQ ID NO: 2214292 - RNA, 19 nt, Streptococcus pyogenes M1 GAS
gaucaaaaaucuuuuucuu

SEQ ID NO: 2214293 - RNA, 21 nt, Streptococcus pyogenes M1 GAS
gauauugaucucugcaacauc

SEQ ID NO: 2214294 - RNA, 13 nt, Streptococcus pyogenes M1 GAS
gauauaaaauugg

SEQ ID NO: 2214295 - RNA, 16 nt, Streptococcus pyogenes M1 GAS
gauacguuuauuguug

SEQ ID NO: 2214296 - RNA, 17 nt, Streptococcus pyogenes M1 GAS
gauacguuuauuguugc

SEQ ID NO: 2214297 - RNA, 21 nt, Streptococcus pyogenes M1 GAS
gauaauaguagguagaacgag

SEQ ID NO: 2214298 - RNA, 14 nt, Streptococcus pyogenes M1 GAS
gauaagugccauca

SEQ ID NO: 2214299 - RNA, 18 nt, Streptococcus pyogenes M1 GAS
gauaccaaaucaaaaagc

SEQ ID NO: 2214300 - RNA, 18 nt, Streptococcus pyogenes M1 GAS
gauacauugaauaaagug

SEQ ID NO: 2214301 - RNA, 16 nt, Streptococcus pyogenes M1 GAS
aaagccaagcuuuaaa

SEQ ID NO: 2214302 - RNA, 22 nt, Streptococcus pyogenes M1 GAS
gauacaagguuaaguaaaaggg

SEQ ID NO: 2214303 - RNA, 23 nt, Streptococcus pyogenes M1 GAS
gauacaagguuaaguaaaaggga

SEQ ID NO: 2214304 - RNA, 13 nt, Streptococcus pyogenes M1 GAS
aaagcauuuguuu

SEQ ID NO: 2214305 - RNA, 17 nt, Streptococcus pyogenes M1 GAS
gagaugacgguaaauaa

SEQ ID NO: 2214306 - RNA, 20 nt, Streptococcus pyogenes M1 GAS
gagacuaaaggucugcuucu

SEQ ID NO: 2214307 - RNA, 22 nt, Streptococcus pyogenes M1 GAS
gagacggguagcauauugccac

SEQ ID NO: 2214308 - RNA, 16 nt, Streptococcus pyogenes M1 GAS
gagagauuuuaaaaaa

SEQ ID NO: 2214309 - RNA, 14 nt, Streptococcus pyogenes M1 GAS
gagacaauaagguc

SEQ ID NO: 2214310 - RNA, 19 nt, Streptococcus pyogenes M1 GAS
aaagcaagggaaacaccac

SEQ ID NO: 2214311 - RNA, 23 nt, Streptococcus pyogenes M1 GAS
aaagcaagcaacacgcuaucaac

SEQ ID NO: 2214312 - RNA, 17 nt, Streptococcus pyogenes M1 GAS
aaagcaaauugaaaaaa

SEQ ID NO: 2214313 - RNA, 14 nt, Streptococcus pyogenes M1 GAS
gacuucaaaaauac

SEQ ID NO: 2214314 - RNA, 15 nt, Streptococcus pyogenes M1 GAS
gacuucaaaaucacc

SEQ ID NO: 2214315 - RNA, 16 nt, Streptococcus pyogenes M1 GAS
gacuuaauugaaagag

SEQ ID NO: 2214316 - RNA, 23 nt, Streptococcus pyogenes M1 GAS
gacuugguucugaaaauaaaaua

SEQ ID NO: 2214317 - RNA, 15 nt, Streptococcus pyogenes M1 GAS
gacucuguuccuaug

SEQ ID NO: 2214318 - RNA, 17 nt, Streptococcus pyogenes M1 GAS
gacuguauguaucaaga

SEQ ID NO: 2214319 - RNA, 22 nt, Streptococcus pyogenes M1 GAS
gacugcaguagcaugacuguau

SEQ ID NO: 2214320 - RNA, 19 nt, Streptococcus pyogenes M1 GAS
gacugacaaaacuucaaau

SEQ ID NO: 2214321 - RNA, 21 nt, Streptococcus pyogenes M1 GAS
gaccucucaugggcaaauaaa

SEQ ID NO: 2214322 - RNA, 23 nt, Streptococcus pyogenes M1 GAS
gaccuuauuggucgcccuuuuua

SEQ ID NO: 2214323 - RNA, 18 nt, Streptococcus pyogenes M1 GAS
gaccuccagcugacagcc

SEQ ID NO: 2214324 - RNA, 17 nt, Streptococcus pyogenes M1 GAS
gacauuaguccaaaaua

SEQ ID NO: 2214325 - RNA, 17 nt, Streptococcus pyogenes M1 GAS
gacauacaaagcaucag

SEQ ID NO: 2214326 - RNA, 17 nt, Streptococcus pyogenes M1 GAS
gacagcaaggaugaaau

SEQ ID NO: 2214327 - RNA, 16 nt, Streptococcus pyogenes M1 GAS
gacaagcaagcaucag

SEQ ID NO: 2214328 - RNA, 21 nt, Streptococcus pyogenes M1 GAS
gacaacaauaugugauuauua

SEQ ID NO: 2214329 - RNA, 22 nt, Streptococcus pyogenes M1 GAS
gaauagguaaagauuuuaaaua

SEQ ID NO: 2214330 - RNA, 16 nt, Streptococcus pyogenes M1 GAS
aaagaucuuucuuuug

SEQ ID NO: 2214331 - RNA, 19 nt, Streptococcus pyogenes M1 GAS
gaauaucaggcaaaacaaa

SEQ ID NO: 2214332 - RNA, 17 nt, Streptococcus pyogenes M1 GAS
aaagauaguaaagaaga

SEQ ID NO: 2214333 - RNA, 22 nt, Streptococcus pyogenes M1 GAS
aaagauaguaaagaagaauuaa

SEQ ID NO: 2214334 - RNA, 19 nt, Streptococcus pyogenes M1 GAS
gaauacguaaaaagagaag

SEQ ID NO: 2214335 - RNA, 18 nt, Streptococcus pyogenes M1 GAS
gaagccgugaggacuuau

SEQ ID NO: 2214336 - RNA, 19 nt, Streptococcus pyogenes M1 GAS
gaagaugucauggauauua

SEQ ID NO: 2214337 - RNA, 14 nt, Streptococcus pyogenes M1 GAS
gaagcaaaauaaac

SEQ ID NO: 2214338 - RNA, 15 nt, Streptococcus pyogenes M1 GAS
gaagcaaauucuucc

SEQ ID NO: 2214339 - RNA, 19 nt, Streptococcus pyogenes M1 GAS
gaagaaggucaugaugcca

SEQ ID NO: 2214340 - RNA, 15 nt, Streptococcus pyogenes M1 GAS
gaagagagaagcugu

SEQ ID NO: 2214341 - RNA, 23 nt, Streptococcus pyogenes M1 GAS
gaaaguuauagcuccuaaaacca

SEQ ID NO: 2214342 - RNA, 23 nt, Streptococcus pyogenes M1 GAS
gaaauaucuuucaguuguuuuaa

SEQ ID NO: 2214343 - RNA, 16 nt, Streptococcus pyogenes M1 GAS
gaaagauaguaaagaa

SEQ ID NO: 2214344 - RNA, 20 nt, Streptococcus pyogenes M1 GAS
gaaagccaagcuuuaaaauu

SEQ ID NO: 2214345 - RNA, 14 nt, Streptococcus pyogenes M1 GAS
gaacagauugaaga

SEQ ID NO: 2214346 - RNA, 18 nt, Streptococcus pyogenes M1 GAS
gaacagauugaagacaaa

SEQ ID NO: 2214347 - RNA, 19 nt, Streptococcus pyogenes M1 GAS
gaacagauugaagacaaac

SEQ ID NO: 2214348 - RNA, 15 nt, Streptococcus pyogenes M1 GAS
cuuuuagcuaagaau

SEQ ID NO: 2214349 - RNA, 14 nt, Streptococcus pyogenes M1 GAS
cuuuuaguuuuauu

SEQ ID NO: 2214350 - RNA, 22 nt, Streptococcus pyogenes M1 GAS
cuuuuggaccacucgugcugcc

SEQ ID NO: 2214351 - RNA, 17 nt, Streptococcus pyogenes M1 GAS
cuuuugacuugguuuaa

SEQ ID NO: 2214352 - RNA, 19 nt, Streptococcus pyogenes M1 GAS
cuuuugaccuacuagcaca

SEQ ID NO: 2214353 - RNA, 22 nt, Streptococcus pyogenes M1 GAS
cuuuugaccuacuagcacaaaa

SEQ ID NO: 2214354 - RNA, 23 nt, Streptococcus pyogenes M1 GAS
gaaaaacuuggguugggauauua

SEQ ID NO: 2214355 - RNA, 17 nt, Streptococcus pyogenes M1 GAS
cuuuuuggugucagcau

SEQ ID NO: 2214356 - RNA, 17 nt, Streptococcus pyogenes M1 GAS
cuuuuuccguuugagau

SEQ ID NO: 2214357 - RNA, 19 nt, Streptococcus pyogenes M1 GAS
gaaacaccaccaauaauga

SEQ ID NO: 2214358 - RNA, 22 nt, Streptococcus pyogenes M1 GAS
gaaacaccugcugcuccuauca

SEQ ID NO: 2214359 - RNA, 13 nt, Streptococcus pyogenes M1 GAS
gaaacaccaccaa

SEQ ID NO: 2214360 - RNA, 16 nt, Streptococcus pyogenes M1 GAS
gaaaaggaauaucagg

SEQ ID NO: 2214361 - RNA, 13 nt, Streptococcus pyogenes M1 GAS
gaaaauaaaauau

SEQ ID NO: 2214362 - RNA, 19 nt, Streptococcus pyogenes M1 GAS
cuuucaaacggaguuccuc

SEQ ID NO: 2214363 - RNA, 18 nt, Streptococcus pyogenes M1 GAS
cuuuaguugcuucuuuua

SEQ ID NO: 2214364 - RNA, 22 nt, Streptococcus pyogenes M1 GAS
cuuuauaaugguuuuuugucuu

SEQ ID NO: 2214365 - RNA, 17 nt, Streptococcus pyogenes M1 GAS
aaagacacacaacaccg

SEQ ID NO: 2214366 - RNA, 15 nt, Streptococcus pyogenes M1 GAS
cuuugguauucuuuu

SEQ ID NO: 2214367 - RNA, 20 nt, Streptococcus pyogenes M1 GAS
cuuuuaagcugagcaaaaca

SEQ ID NO: 2214368 - RNA, 21 nt, Streptococcus pyogenes M1 GAS
cuuuuaagcugagcaaaacaa

SEQ ID NO: 2214369 - RNA, 22 nt, Streptococcus pyogenes M1 GAS
cuuuuaagcugagcaaaacaau

SEQ ID NO: 2214370 - RNA, 14 nt, Streptococcus pyogenes M1 GAS
cuuuuaauuuggag

SEQ ID NO: 2214371 - RNA, 21 nt, Streptococcus pyogenes M1 GAS
cuuuuaauuuuauuuuuuaaa

SEQ ID NO: 2214372 - RNA, 19 nt, Streptococcus pyogenes M1 GAS
cuuuuaauuuuauuuuuua

SEQ ID NO: 2214373 - RNA, 20 nt, Streptococcus pyogenes M1 GAS
cuuuuaauuuuauuuuuuaa

SEQ ID NO: 2214374 - RNA, 19 nt, Streptococcus pyogenes M1 GAS
cuugguucugaaaauaaaa

SEQ ID NO: 2214375 - RNA, 18 nt, Streptococcus pyogenes M1 GAS
cuugguucugaaaauaaa

SEQ ID NO: 2214376 - RNA, 16 nt, Streptococcus pyogenes M1 GAS
cuuguccgaucuuuug

SEQ ID NO: 2214377 - RNA, 13 nt, Streptococcus pyogenes M1 GAS
cuuggccuucuag

SEQ ID NO: 2214378 - RNA, 21 nt, Streptococcus pyogenes M1 GAS
cuuggacgaaggcucuuaucu

SEQ ID NO: 2214379 - RNA, 13 nt, Streptococcus pyogenes M1 GAS
cuuguuacaaaaa

SEQ ID NO: 2214380 - RNA, 14 nt, Streptococcus pyogenes M1 GAS
cuugucuuuuuuug

SEQ ID NO: 2214381 - RNA, 24 nt, Streptococcus pyogenes M1 GAS
cuugucuuuuuuuggccucaaagc

SEQ ID NO: 2214382 - RNA, 20 nt, Streptococcus pyogenes M1 GAS
cuugucgcugaauaaacaaa

SEQ ID NO: 2214383 - RNA, 16 nt, Streptococcus pyogenes M1 GAS
cuuguccuguaaauca

SEQ ID NO: 2214384 - RNA, 13 nt, Streptococcus pyogenes M1 GAS
aaagaaaggaauu

SEQ ID NO: 2214385 - RNA, 11 nt, Streptococcus pyogenes M1 GAS
cuuuaaaaagu

SEQ ID NO: 2214386 - RNA, 22 nt, Streptococcus pyogenes M1 GAS
cuuguuuugguugauauaaaau

SEQ ID NO: 2214387 - RNA, 20 nt, Streptococcus pyogenes M1 GAS
cuuuaaaaaguuucugaguu

SEQ ID NO: 2214388 - RNA, 12 nt, Streptococcus pyogenes M1 GAS
aaagaagaauua

SEQ ID NO: 2214389 - RNA, 12 nt, Streptococcus pyogenes M1 GAS
cuuguucugguu

SEQ ID NO: 2214390 - RNA, 17 nt, Streptococcus pyogenes M1 GAS
cuuguucuuuauuuuga

SEQ ID NO: 2214391 - RNA, 14 nt, Streptococcus pyogenes M1 GAS
cuucacauuguauu

SEQ ID NO: 2214392 - RNA, 12 nt, Streptococcus pyogenes M1 GAS
cuucaaaaauac

SEQ ID NO: 2214393 - RNA, 19 nt, Streptococcus pyogenes M1 GAS
cuucaucaaugauagcuuu

SEQ ID NO: 2214394 - RNA, 20 nt, Streptococcus pyogenes M1 GAS
cuucaucaaugauagcuuuc

SEQ ID NO: 2214395 - RNA, 20 nt, Streptococcus pyogenes M1 GAS
aaacuucacauuguauuagc

SEQ ID NO: 2214396 - RNA, 24 nt, Streptococcus pyogenes M1 GAS
aaacuucacauuguauuagcaaag

SEQ ID NO: 2214397 - RNA, 18 nt, Streptococcus pyogenes M1 GAS
cuuauuugacauuagucc

SEQ ID NO: 2214398 - RNA, 21 nt, Streptococcus pyogenes M1 GAS
cuuauaguuugacuucaaaaa

SEQ ID NO: 2214399 - RNA, 19 nt, Streptococcus pyogenes M1 GAS
cuuagguggagcuuuaguu

SEQ ID NO: 2214400 - RNA, 21 nt, Streptococcus pyogenes M1 GAS
cuuaggcagacaauuauuuug

SEQ ID NO: 2214401 - RNA, 19 nt, Streptococcus pyogenes M1 GAS
cuuaggcagacaauuauuu

SEQ ID NO: 2214402 - RNA, 19 nt, Streptococcus pyogenes M1 GAS
cuuacuaugaaaaaagaac

SEQ ID NO: 2214403 - RNA, 12 nt, Streptococcus pyogenes M1 GAS
cuuaaugagaaa

SEQ ID NO: 2214404 - RNA, 23 nt, Streptococcus pyogenes M1 GAS
cuuaaucuggagaugagaaagcc

SEQ ID NO: 2214405 - RNA, 22 nt, Streptococcus pyogenes M1 GAS
cuguuaucccuggaccauuauc

SEQ ID NO: 2214406 - RNA, 21 nt, Streptococcus pyogenes M1 GAS
cuuggaaacaagagcucaacc

SEQ ID NO: 2214407 - RNA, 14 nt, Streptococcus pyogenes M1 GAS
cuugcuuugacaaa

SEQ ID NO: 2214408 - RNA, 20 nt, Streptococcus pyogenes M1 GAS
cuugcucuuguuuucucaac

SEQ ID NO: 2214409 - RNA, 20 nt, Streptococcus pyogenes M1 GAS
cuugccuuuauauuuaugga

SEQ ID NO: 2214410 - RNA, 16 nt, Streptococcus pyogenes M1 GAS
cuugccaucagcaucu

SEQ ID NO: 2214411 - RNA, 18 nt, Streptococcus pyogenes M1 GAS
cuugaucuuacaaaggau

SEQ ID NO: 2214412 - RNA, 19 nt, Streptococcus pyogenes M1 GAS
cuugaagccgcucuaauuu

SEQ ID NO: 2214413 - RNA, 22 nt, Streptococcus pyogenes M1 GAS
cuugaauaucgccaauaaaaaa

SEQ ID NO: 2214414 - RNA, 13 nt, Streptococcus pyogenes M1 GAS
cuucuuuuuauua

SEQ ID NO: 2214415 - RNA, 22 nt, Streptococcus pyogenes M1 GAS
cuucuuuucagagaugcuucuu

SEQ ID NO: 2214416 - RNA, 22 nt, Streptococcus pyogenes M1 GAS
cuucuuacuaugaaaaaagaac

SEQ ID NO: 2214417 - RNA, 12 nt, Streptococcus pyogenes M1 GAS
cuucuucuuuuc

SEQ ID NO: 2214418 - RNA, 23 nt, Streptococcus pyogenes M1 GAS
cuucuugaagccgcucuaauuua

SEQ ID NO: 2214419 - RNA, 20 nt, Streptococcus pyogenes M1 GAS
cuucuagcucuuuaucaccu

SEQ ID NO: 2214420 - RNA, 19 nt, Streptococcus pyogenes M1 GAS
cuucuagguagguuugaaa

SEQ ID NO: 2214421 - RNA, 12 nt, Streptococcus pyogenes M1 GAS
cuucuaucaaaa

SEQ ID NO: 2214422 - RNA, 20 nt, Streptococcus pyogenes M1 GAS
cuucuauugucguugaugca

SEQ ID NO: 2214423 - RNA, 15 nt, Streptococcus pyogenes M1 GAS
cuucuacacaaaagc

SEQ ID NO: 2214424 - RNA, 17 nt, Streptococcus pyogenes M1 GAS
cuucuaaaaugaugaga

SEQ ID NO: 2214425 - RNA, 17 nt, Streptococcus pyogenes M1 GAS
cuucguauuggccuucu

SEQ ID NO: 2214426 - RNA, 16 nt, Streptococcus pyogenes M1 GAS
cuucugcauuaucauc

SEQ ID NO: 2214427 - RNA, 13 nt, Streptococcus pyogenes M1 GAS
cuucucuuuugcu

SEQ ID NO: 2214428 - RNA, 16 nt, Streptococcus pyogenes M1 GAS
cuucucuuuugcuuuu

SEQ ID NO: 2214429 - RNA, 19 nt, Streptococcus pyogenes M1 GAS
cuucugaugcguuuauaaa

SEQ ID NO: 2214430 - RNA, 17 nt, Streptococcus pyogenes M1 GAS
cuucugcagucuuuuuc

SEQ ID NO: 2214431 - RNA, 13 nt, Streptococcus pyogenes M1 GAS
cgguaaaaacuca

SEQ ID NO: 2214432 - RNA, 18 nt, Streptococcus pyogenes M1 GAS
aaacuaggccaauccuaa

SEQ ID NO: 2214433 - RNA, 12 nt, Streptococcus pyogenes M1 GAS
cgggauuuaguu

SEQ ID NO: 2214434 - RNA, 23 nt, Streptococcus pyogenes M1 GAS
cuaaaaucaugggaaaagcuaag

SEQ ID NO: 2214435 - RNA, 21 nt, Streptococcus pyogenes M1 GAS
cuaaaaagagagcuuaucaag

SEQ ID NO: 2214436 - RNA, 21 nt, Streptococcus pyogenes M1 GAS
cuaaaaagccuuaaugagaaa

SEQ ID NO: 2214437 - RNA, 14 nt, Streptococcus pyogenes M1 GAS
cuaaaauaaaccaa

SEQ ID NO: 2214438 - RNA, 17 nt, Streptococcus pyogenes M1 GAS
cuaaaauaaaccaagcu

SEQ ID NO: 2214439 - RNA, 19 nt, Streptococcus pyogenes M1 GAS
cguuuauuuaguuauuuuu

SEQ ID NO: 2214440 - RNA, 13 nt, Streptococcus pyogenes M1 GAS
cguuaacaaaaau

SEQ ID NO: 2214441 - RNA, 19 nt, Streptococcus pyogenes M1 GAS
cgugcucauaaaacugugc

SEQ ID NO: 2214442 - RNA, 13 nt, Streptococcus pyogenes M1 GAS
cguguccccuauc

SEQ ID NO: 2214443 - RNA, 17 nt, Streptococcus pyogenes M1 GAS
cgucuuacaauuaauag

SEQ ID NO: 2214444 - RNA, 15 nt, Streptococcus pyogenes M1 GAS
cguaagcauuuugag

SEQ ID NO: 2214445 - RNA, 14 nt, Streptococcus pyogenes M1 GAS
cguaacuugcuuug

SEQ ID NO: 2214446 - RNA, 16 nt, Streptococcus pyogenes M1 GAS
cguaacguaauagaau

SEQ ID NO: 2214447 - RNA, 13 nt, Streptococcus pyogenes M1 GAS
cgucacaaacugc

SEQ ID NO: 2214448 - RNA, 13 nt, Streptococcus pyogenes M1 GAS
cguauacuuuaaa

SEQ ID NO: 2214449 - RNA, 20 nt, Streptococcus pyogenes M1 GAS
cguaaggguuauuauuuagg

SEQ ID NO: 2214450 - RNA, 14 nt, Streptococcus pyogenes M1 GAS
cucugcaacaucaa

SEQ ID NO: 2214451 - RNA, 17 nt, Streptococcus pyogenes M1 GAS
cucucaugggcaaauaa

SEQ ID NO: 2214452 - RNA, 22 nt, Streptococcus pyogenes M1 GAS
cucuauuugaaguaaaggauuu

SEQ ID NO: 2214453 - RNA, 15 nt, Streptococcus pyogenes M1 GAS
cucuauccauuaucg

SEQ ID NO: 2214454 - RNA, 15 nt, Streptococcus pyogenes M1 GAS
cuccagcugacagcc

SEQ ID NO: 2214455 - RNA, 13 nt, Streptococcus pyogenes M1 GAS
cucaguaaucuaa

SEQ ID NO: 2214456 - RNA, 14 nt, Streptococcus pyogenes M1 GAS
cucagagacaauaa

SEQ ID NO: 2214457 - RNA, 20 nt, Streptococcus pyogenes M1 GAS
cucagcaaguugaaggacag

SEQ ID NO: 2214458 - RNA, 16 nt, Streptococcus pyogenes M1 GAS
cucauaaaacugugcu

SEQ ID NO: 2214459 - RNA, 22 nt, Streptococcus pyogenes M1 GAS
cucaacaguauaacuguuuuuc

SEQ ID NO: 2214460 - RNA, 20 nt, Streptococcus pyogenes M1 GAS
cucacuaggccuagcuuuuu

SEQ ID NO: 2214461 - RNA, 13 nt, Streptococcus pyogenes M1 GAS
cucaauauaauaa

SEQ ID NO: 2214462 - RNA, 14 nt, Streptococcus pyogenes M1 GAS
cuauccauuaucgc

SEQ ID NO: 2214463 - RNA, 20 nt, Streptococcus pyogenes M1 GAS
cuaucauggagucaaugaaa

SEQ ID NO: 2214464 - RNA, 22 nt, Streptococcus pyogenes M1 GAS
cuaucauggagucaaugaaaag

SEQ ID NO: 2214465 - RNA, 21 nt, Streptococcus pyogenes M1 GAS
cuaucgcucagaauaaagaaa

SEQ ID NO: 2214466 - RNA, 16 nt, Streptococcus pyogenes M1 GAS
cuaugaucuguuuaaa

SEQ ID NO: 2214467 - RNA, 20 nt, Streptococcus pyogenes M1 GAS
cuaugaucuguuuaaaaaca

SEQ ID NO: 2214468 - RNA, 20 nt, Streptococcus pyogenes M1 GAS
cuauguugcuuaaugaccuu

SEQ ID NO: 2214469 - RNA, 17 nt, Streptococcus pyogenes M1 GAS
cuaucaaguaugcuuuu

SEQ ID NO: 2214470 - RNA, 13 nt, Streptococcus pyogenes M1 GAS
cuaucaaagcuga

SEQ ID NO: 2214471 - RNA, 17 nt, Streptococcus pyogenes M1 GAS
cuagguuaaaauagaag

SEQ ID NO: 2214472 - RNA, 15 nt, Streptococcus pyogenes M1 GAS
cuagguuaaaauaga

SEQ ID NO: 2214473 - RNA, 22 nt, Streptococcus pyogenes M1 GAS
cuagguaguuacgcauaccuga

SEQ ID NO: 2214474 - RNA, 12 nt, Streptococcus pyogenes M1 GAS
cuagcacaaaau

SEQ ID NO: 2214475 - RNA, 22 nt, Streptococcus pyogenes M1 GAS
cuagcucuuuaucaccugucaa

SEQ ID NO: 2214476 - RNA, 13 nt, Streptococcus pyogenes M1 GAS
cuagcgggaacac

SEQ ID NO: 2214477 - RNA, 20 nt, Streptococcus pyogenes M1 GAS
cuaggcguauaggugaguuu

SEQ ID NO: 2214478 - RNA, 15 nt, Streptococcus pyogenes M1 GAS
cuacuaggcuuucau

SEQ ID NO: 2214479 - RNA, 23 nt, Streptococcus pyogenes M1 GAS
cuaacauggauaccauuucuuug

SEQ ID NO: 2214480 - RNA, 16 nt, Streptococcus pyogenes M1 GAS
cugcagucuuuuucau

SEQ ID NO: 2214481 - RNA, 14 nt, Streptococcus pyogenes M1 GAS
cugcuauuucagcu

SEQ ID NO: 2214482 - RNA, 21 nt, Streptococcus pyogenes M1 GAS
cugcuaugcgaggcuuuuuug

SEQ ID NO: 2214483 - RNA, 16 nt, Streptococcus pyogenes M1 GAS
aaacucaaaaaauaca

SEQ ID NO: 2214484 - RNA, 18 nt, Streptococcus pyogenes M1 GAS
aaacucaaaaaauacaau

SEQ ID NO: 2214485 - RNA, 18 nt, Streptococcus pyogenes M1 GAS
cuggaccauuaucaauaa

SEQ ID NO: 2214486 - RNA, 21 nt, Streptococcus pyogenes M1 GAS
cuggaaacuggucaaaagcua

SEQ ID NO: 2214487 - RNA, 17 nt, Streptococcus pyogenes M1 GAS
cugauaaugauuuauua

SEQ ID NO: 2214488 - RNA, 15 nt, Streptococcus pyogenes M1 GAS
cugaguucuuuuucg

SEQ ID NO: 2214489 - RNA, 19 nt, Streptococcus pyogenes M1 GAS
cugagccaauaacgccagc

SEQ ID NO: 2214490 - RNA, 15 nt, Streptococcus pyogenes M1 GAS
cugagauauucauuu

SEQ ID NO: 2214491 - RNA, 16 nt, Streptococcus pyogenes M1 GAS
cugagauauucauuuu

SEQ ID NO: 2214492 - RNA, 18 nt, Streptococcus pyogenes M1 GAS
cugagauauucauuuucu

SEQ ID NO: 2214493 - RNA, 12 nt, Streptococcus pyogenes M1 GAS
cugaaaauaaaa

SEQ ID NO: 2214494 - RNA, 20 nt, Streptococcus pyogenes M1 GAS
cugaaaauaaaauauuuuuc

SEQ ID NO: 2214495 - RNA, 13 nt, Streptococcus pyogenes M1 GAS
cucuuuuuuuuau

SEQ ID NO: 2214496 - RNA, 21 nt, Streptococcus pyogenes M1 GAS
cugaaaaugcauuacauuuaa

SEQ ID NO: 2214497 - RNA, 17 nt, Streptococcus pyogenes M1 GAS
cugaaacaccugcugcu

SEQ ID NO: 2214498 - RNA, 22 nt, Streptococcus pyogenes M1 GAS
cucuugcaaggugcuuuuuuug

SEQ ID NO: 2214499 - RNA, 22 nt, Streptococcus pyogenes M1 GAS
cucuuguccacgccgaagaugu

SEQ ID NO: 2214500 - RNA, 23 nt, Streptococcus pyogenes M1 GAS
cucuucgguacugaacuuguccu

SEQ ID NO: 2214501 - RNA, 12 nt, Streptococcus pyogenes M1 GAS
aaaaaaagcaau

SEQ ID NO: 2214502 - RNA, 22 nt, Streptococcus pyogenes M1 GAS
aaaaaaacuucacauuguauua

SEQ ID NO: 2214503 - RNA, 11 nt, Streptococcus pyogenes M1 GAS
aaaaacaaugc

SEQ ID NO: 2214504 - RNA, 15 nt, Streptococcus pyogenes M1 GAS
aaaaacaaauuguag

SEQ ID NO: 2214505 - RNA, 20 nt, Streptococcus pyogenes M1 GAS
aaaaacaaauuguagggauu

SEQ ID NO: 2214506 - RNA, 14 nt, Streptococcus pyogenes M1 GAS
aaaaaauuaagaag

SEQ ID NO: 2214507 - RNA, 22 nt, Streptococcus pyogenes M1 GAS
aaaaauaaguauagcauaaaau

SEQ ID NO: 2214508 - RNA, 15 nt, Streptococcus pyogenes M1 GAS
aaaaauaacuuuaaa

SEQ ID NO: 2214509 - RNA, 19 nt, Streptococcus pyogenes M1 GAS
aaaaauacaauaaagcguu

SEQ ID NO: 2214510 - RNA, 17 nt, Streptococcus pyogenes M1 GAS
aaaaauacuagaaaaag

SEQ ID NO: 2214511 - RNA, 23 nt, Streptococcus pyogenes M1 GAS
aaaaauacuagaaaaagcaauga

SEQ ID NO: 2214512 - RNA, 18 nt, Streptococcus pyogenes M1 GAS
aaaaauauauucuaauuu

SEQ ID NO: 2214513 - RNA, 13 nt, Streptococcus pyogenes M1 GAS
aaaaauauauucu

SEQ ID NO: 2214514 - RNA, 12 nt, Streptococcus pyogenes M1 GAS
aaaaauuaagaa

SEQ ID NO: 2214515 - RNA, 15 nt, Streptococcus pyogenes M1 GAS
aaaaauuacgaugga

SEQ ID NO: 2214516 - RNA, 17 nt, Streptococcus pyogenes M1 GAS
aaaacaauaacacagaa

SEQ ID NO: 2214517 - RNA, 20 nt, Streptococcus pyogenes M1 GAS
aaaacaauaacacagaagcc

SEQ ID NO: 2214518 - RNA, 15 nt, Streptococcus pyogenes M1 GAS
aaaagagaagaugag

SEQ ID NO: 2214519 - RNA, 19 nt, Streptococcus pyogenes M1 GAS
aaaagaauuauacuaacua

SEQ ID NO: 2214520 - RNA, 12 nt, Streptococcus pyogenes M1 GAS
aaaagaaaggaa

SEQ ID NO: 2214521 - RNA, 15 nt, Streptococcus pyogenes M1 GAS
aaaagaacaaagauu

SEQ ID NO: 2214522 - RNA, 18 nt, Streptococcus pyogenes M1 GAS
aaaagagugcaguguacu

SEQ ID NO: 2214523 - RNA, 15 nt, Streptococcus pyogenes M1 GAS
aaaagauaaacaucu

SEQ ID NO: 2214524 - RNA, 16 nt, Streptococcus pyogenes M1 GAS
aaaagcaaauugaaaa

SEQ ID NO: 2214525 - RNA, 22 nt, Streptococcus pyogenes M1 GAS
aaaacguguauucuuaaaaaaa

SEQ ID NO: 2214526 - RNA, 22 nt, Streptococcus pyogenes M1 GAS
aaaacuuuugacuugguuuaau

SEQ ID NO: 2214527 - RNA, 16 nt, Streptococcus pyogenes M1 GAS
aaaacuucacauugua

SEQ ID NO: 2214528 - RNA, 19 nt, Streptococcus pyogenes M1 GAS
aaaacuuggguugggauau

SEQ ID NO: 2214529 - RNA, 13 nt, Streptococcus pyogenes M1 GAS
aaaagcaugggcu

SEQ ID NO: 2214530 - RNA, 14 nt, Streptococcus pyogenes M1 GAS
aaaagcauuuguuu

SEQ ID NO: 2214531 - RNA, 18 nt, Streptococcus pyogenes M1 GAS
aaaaguaaaaagcaaauu

SEQ ID NO: 2214532 - RNA, 20 nt, Streptococcus pyogenes M1 GAS
aaaagccuauuuaauaggcu

SEQ ID NO: 2214533 - RNA, 15 nt, Streptococcus pyogenes M1 GAS
aaaauaaaauauuuu

SEQ ID NO: 2214534 - RNA, 15 nt, Streptococcus pyogenes M1 GAS
aaaauacuagaaaaa

SEQ ID NO: 2214535 - RNA, 19 nt, Streptococcus pyogenes M1 GAS
aaaauacuagaaaaagcaa

SEQ ID NO: 2214536 - RNA, 18 nt, Streptococcus pyogenes M1 GAS
aaaauccucuuuuaauuu

SEQ ID NO: 2214537 - RNA, 19 nt, Streptococcus pyogenes M1 GAS
aaaauuuuagguaaaguua

SEQ ID NO: 2214538 - RNA, 21 nt, Streptococcus pyogenes M1 GAS
aaaaugaugagauuaacugac

SEQ ID NO: 2214539 - RNA, 21 nt, Streptococcus pyogenes M1 GAS
aaaauccucuuuuaauuugga

SEQ ID NO: 2214540 - RNA, 15 nt, Streptococcus pyogenes M1 GAS
aaaaugcauuacauu

SEQ ID NO: 2214541 - RNA, 17 nt, Streptococcus pyogenes M1 GAS
aaaaugcuguuugucau

SEQ ID NO: 2214542 - RNA, 17 nt, Streptococcus pyogenes M1 GAS
aaaucuuacuaacuagc

SEQ ID NO: 2214543 - RNA, 19 nt, Streptococcus pyogenes M1 GAS
aaaugaugagauuaacuga

SEQ ID NO: 2214544 - RNA, 13 nt, Streptococcus pyogenes M1 GAS
aaaaagccuuaau

SEQ ID NO: 2214545 - RNA, 14 nt, Streptococcus pyogenes M1 GAS
aaaaagccuuuaca

SEQ ID NO: 2214546 - RNA, 15 nt, Streptococcus pyogenes M1 GAS
aaaaagccagagcag

SEQ ID NO: 2214547 - RNA, 18 nt, Streptococcus pyogenes M1 GAS
aaauuccccacaaaagac

SEQ ID NO: 2214548 - RNA, 14 nt, Streptococcus pyogenes M1 GAS
aaauuccccacaaa

SEQ ID NO: 2214549 - RNA, 17 nt, Streptococcus pyogenes M1 GAS
aaauuccccacaaaaga

SEQ ID NO: 2214550 - RNA, 23 nt, Streptococcus pyogenes M1 GAS
aaauucguauugucaucgcuuug

SEQ ID NO: 2214551 - RNA, 19 nt, Streptococcus pyogenes M1 GAS
aaauacuagaaaaagcaau

SEQ ID NO: 2214552 - RNA, 16 nt, Streptococcus pyogenes M1 GAS
aaauacuagaaaaagc

SEQ ID NO: 2214553 - RNA, 18 nt, Streptococcus pyogenes M1 GAS
aaauaucuuuuuuacuuu

SEQ ID NO: 2214554 - RNA, 23 nt, Streptococcus pyogenes M1 GAS
aaauaucuuuuuuacuuuuaaaa

SEQ ID NO: 2214555 - RNA, 21 nt, Streptococcus pyogenes M1 GAS
aaauaucuuuuuuacuuuuaa

SEQ ID NO: 2214556 - RNA, 17 nt, Streptococcus pyogenes M1 GAS
aaaguaaaaucuuauuu

SEQ ID NO: 2214557 - RNA, 12 nt, Streptococcus pyogenes M1 GAS
aaaguaaaaucu

SEQ ID NO: 2214558 - RNA, 22 nt, Streptococcus pyogenes M1 GAS
aaaguaaaaagcaaauugaaaa

SEQ ID NO: 2214559 - RNA, 12 nt, Streptococcus pyogenes M1 GAS
aaaguaaaaaua

SEQ ID NO: 2214560 - RNA, 23 nt, Streptococcus pyogenes M1 GAS
aaaguaaaaauacuagaaaaagc

SEQ ID NO: 2214561 - RNA, 15 nt, Streptococcus pyogenes M1 GAS
aaagcuaaacuaggc

SEQ ID NO: 2214562 - RNA, 20 nt, Streptococcus pyogenes M1 GAS
aaagcguugacaguuaaaaa

SEQ ID NO: 2214563 - RNA, 22 nt, Streptococcus pyogenes M1 GAS
aaaggacauggaguccuuuuuu

SEQ ID NO: 2214564 - RNA, 22 nt, Streptococcus pyogenes M1 GAS
aaaggaauaucaggcaaaacaa

SEQ ID NO: 2214565 - RNA, 14 nt, Streptococcus pyogenes M1 GAS
aaagauauuuuaaa

SEQ ID NO: 2214566 - RNA, 16 nt, Streptococcus pyogenes M1 GAS
aaagauauuuuaaaau

SEQ ID NO: 2214567 - RNA, 14 nt, Streptococcus pyogenes M1 GAS
aaagauuuuaaaua

SEQ ID NO: 2214568 - RNA, 15 nt, Streptococcus pyogenes M1 GAS
aaagccagagcaguu

SEQ ID NO: 2214569 - RNA, 13 nt, Streptococcus pyogenes M1 GAS
aaacuuuugacuu

SEQ ID NO: 2214570 - RNA, 14 nt, Streptococcus pyogenes M1 GAS
aaagaccucucaug

SEQ ID NO: 2214571 - RNA, 15 nt, Streptococcus pyogenes M1 GAS
aaagagaagaugagc

SEQ ID NO: 2214572 - RNA, 16 nt, Streptococcus pyogenes M1 GAS
aaacuuucaguuaucu

SEQ ID NO: 2214573 - RNA, 16 nt, Streptococcus pyogenes M1 GAS
aaacuggucaaaagcu

SEQ ID NO: 2214574 - RNA, 17 nt, Streptococcus pyogenes M1 GAS
aaacuguauacaaaaag

SEQ ID NO: 2214575 - RNA, 14 nt, Streptococcus pyogenes M1 GAS
aaacugagacaagu

SEQ ID NO: 2214576 - RNA, 23 nt, Streptococcus pyogenes M1 GAS
aaacguuauuaaagacaaaaaac

SEQ ID NO: 2214577 - RNA, 21 nt, Streptococcus pyogenes M1 GAS
aaacucaaaaaauacaauaaa

SEQ ID NO: 2214578 - RNA, 15 nt, Streptococcus pyogenes M1 GAS
aaacucaaaaagcau

SEQ ID NO: 2214579 - RNA, 18 nt, Streptococcus pyogenes M1 GAS
aaacguguauucuuaaaa

SEQ ID NO: 2214580 - RNA, 17 nt, Streptococcus pyogenes M1 GAS
aaacguuauuaaagaca

SEQ ID NO: 2214581 - RNA, 16 nt, Streptococcus pyogenes M1 GAS
aaacgccacgcucaac

SEQ ID NO: 2214582 - RNA, 14 nt, Streptococcus pyogenes M1 GAS
auuuaauaguuuuc

SEQ ID NO: 2214583 - RNA, 17 nt, Streptococcus pyogenes M1 GAS
aaaagucaacugauaua

SEQ ID NO: 2214584 - RNA, 16 nt, Streptococcus pyogenes M1 GAS
auuuauuaagauuaau

SEQ ID NO: 2214585 - RNA, 14 nt, Streptococcus pyogenes M1 GAS
auuuaugucuugcu

SEQ ID NO: 2214586 - RNA, 20 nt, Streptococcus pyogenes M1 GAS
auuucagcuagacuauaaaa

SEQ ID NO: 2214587 - RNA, 16 nt, Streptococcus pyogenes M1 GAS
auuucguugacaaagc

SEQ ID NO: 2214588 - RNA, 16 nt, Streptococcus pyogenes M1 GAS
auuucgucuaaaaagc

SEQ ID NO: 2214589 - RNA, 14 nt, Streptococcus pyogenes M1 GAS
auuucguugacaaa

SEQ ID NO: 2214590 - RNA, 20 nt, Streptococcus pyogenes M1 GAS
auuucuugaggugauucuuu

SEQ ID NO: 2214591 - RNA, 14 nt, Streptococcus pyogenes M1 GAS
auuucuucagguuu

SEQ ID NO: 2214592 - RNA, 13 nt, Streptococcus pyogenes M1 GAS
auuuucaucauca

SEQ ID NO: 2214593 - RNA, 22 nt, Streptococcus pyogenes M1 GAS
auuuucaucgugacaacacaau

SEQ ID NO: 2214594 - RNA, 16 nt, Streptococcus pyogenes M1 GAS
auuuuauuuuuuaaag

SEQ ID NO: 2214595 - RNA, 13 nt, Streptococcus pyogenes M1 GAS
auuuuaauuuuuc

SEQ ID NO: 2214596 - RNA, 14 nt, Streptococcus pyogenes M1 GAS
auuuuaauuuuucc

SEQ ID NO: 2214597 - RNA, 16 nt, Streptococcus pyogenes M1 GAS
auuuuacuauggcuuc

SEQ ID NO: 2214598 - RNA, 16 nt, Streptococcus pyogenes M1 GAS
auuuguuuugauaaaa

SEQ ID NO: 2214599 - RNA, 19 nt, Streptococcus pyogenes M1 GAS
auuugacuuguuacaaaaa

SEQ ID NO: 2214600 - RNA, 20 nt, Streptococcus pyogenes M1 GAS
auuugacuuguuacaaaaaa

SEQ ID NO: 2214601 - RNA, 22 nt, Streptococcus pyogenes M1 GAS
auuuucuagguuaaaauagaag

SEQ ID NO: 2214602 - RNA, 20 nt, Streptococcus pyogenes M1 GAS
auuuuuuaccguaacguuug

SEQ ID NO: 2214603 - RNA, 21 nt, Streptococcus pyogenes M1 GAS
auuuuugauuuuaauuuuucu

SEQ ID NO: 2214604 - RNA, 10 nt, Streptococcus pyogenes M1 GAS
auuuuuccuu

SEQ ID NO: 2214605 - RNA, 13 nt, Streptococcus pyogenes M1 GAS
caaaaaaagcaau

SEQ ID NO: 2214606 - RNA, 18 nt, Streptococcus pyogenes M1 GAS
caaaaaaagcaagcaaca

SEQ ID NO: 2214607 - RNA, 13 nt, Streptococcus pyogenes M1 GAS
caaaaaagggaag

SEQ ID NO: 2214608 - RNA, 15 nt, Streptococcus pyogenes M1 GAS
aaaaggggagacgga

SEQ ID NO: 2214609 - RNA, 19 nt, Streptococcus pyogenes M1 GAS
aaaagggauaauaaagugc

SEQ ID NO: 2214610 - RNA, 20 nt, Streptococcus pyogenes M1 GAS
aaaagguaucccauaucucu

SEQ ID NO: 2214611 - RNA, 19 nt, Streptococcus pyogenes M1 GAS
auuguaauaacaaaaugaa

SEQ ID NO: 2214612 - RNA, 20 nt, Streptococcus pyogenes M1 GAS
auuguagggauuuuuuaacu

SEQ ID NO: 2214613 - RNA, 22 nt, Streptococcus pyogenes M1 GAS
auuguucauuaaagcuaucaua

SEQ ID NO: 2214614 - RNA, 15 nt, Streptococcus pyogenes M1 GAS
auugcagcuaaaaac

SEQ ID NO: 2214615 - RNA, 14 nt, Streptococcus pyogenes M1 GAS
auucuuuuuuaccu

SEQ ID NO: 2214616 - RNA, 12 nt, Streptococcus pyogenes M1 GAS
auucuuuuuccg

SEQ ID NO: 2214617 - RNA, 21 nt, Streptococcus pyogenes M1 GAS
auugaugaguuuauguaugcu

SEQ ID NO: 2214618 - RNA, 10 nt, Streptococcus pyogenes M1 GAS
auucuugcag

SEQ ID NO: 2214619 - RNA, 21 nt, Streptococcus pyogenes M1 GAS
auucuugcagaauagaaauag

SEQ ID NO: 2214620 - RNA, 15 nt, Streptococcus pyogenes M1 GAS
auucuaacucuugua

SEQ ID NO: 2214621 - RNA, 18 nt, Streptococcus pyogenes M1 GAS
auucuaacucuuguagaa

SEQ ID NO: 2214622 - RNA, 14 nt, Streptococcus pyogenes M1 GAS
auucuaacauggau

SEQ ID NO: 2214623 - RNA, 15 nt, Streptococcus pyogenes M1 GAS
auuccaaacauccaa

SEQ ID NO: 2214624 - RNA, 20 nt, Streptococcus pyogenes M1 GAS
auuccaaacauccaaucacc

SEQ ID NO: 2214625 - RNA, 15 nt, Streptococcus pyogenes M1 GAS
auuagcaaaaugcug

SEQ ID NO: 2214626 - RNA, 14 nt, Streptococcus pyogenes M1 GAS
auuagcaaagugau

SEQ ID NO: 2214627 - RNA, 17 nt, Streptococcus pyogenes M1 GAS
auuagcaccagcauuug

SEQ ID NO: 2214628 - RNA, 17 nt, Streptococcus pyogenes M1 GAS
auuacauuaggauauag

SEQ ID NO: 2214629 - RNA, 16 nt, Streptococcus pyogenes M1 GAS
aaaagccagagcaguu

SEQ ID NO: 2214630 - RNA, 12 nt, Streptococcus pyogenes M1 GAS
aaaagcaaugac

SEQ ID NO: 2214631 - RNA, 14 nt, Streptococcus pyogenes M1 GAS
auuauugucacuga

SEQ ID NO: 2214632 - RNA, 17 nt, Streptococcus pyogenes M1 GAS
auuaucugaauuauuag

SEQ ID NO: 2214633 - RNA, 16 nt, Streptococcus pyogenes M1 GAS
auuaguccaaaauaca

SEQ ID NO: 2214634 - RNA, 21 nt, Streptococcus pyogenes M1 GAS
auuaguccaaaauacauccua

SEQ ID NO: 2214635 - RNA, 20 nt, Streptococcus pyogenes M1 GAS
aaaagcuaaguaagcgucug

SEQ ID NO: 2214636 - RNA, 16 nt, Streptococcus pyogenes M1 GAS
auuaaccguuccuguc

SEQ ID NO: 2214637 - RNA, 16 nt, Streptococcus pyogenes M1 GAS
auuaauaaguauucua

SEQ ID NO: 2214638 - RNA, 15 nt, Streptococcus pyogenes M1 GAS
auuaauaaauuuuug

SEQ ID NO: 2214639 - RNA, 17 nt, Streptococcus pyogenes M1 GAS
auuaagauuaauuuacu

SEQ ID NO: 2214640 - RNA, 15 nt, Streptococcus pyogenes M1 GAS
augucuugcuaaaau

SEQ ID NO: 2214641 - RNA, 19 nt, Streptococcus pyogenes M1 GAS
augucuuggauagacuggu

SEQ ID NO: 2214642 - RNA, 23 nt, Streptococcus pyogenes M1 GAS
auguaccaauuuaagguauuguu

SEQ ID NO: 2214643 - RNA, 20 nt, Streptococcus pyogenes M1 GAS
auggaaauuuuaaaugacau

SEQ ID NO: 2214644 - RNA, 16 nt, Streptococcus pyogenes M1 GAS
auggagucaaugaaaa

SEQ ID NO: 2214645 - RNA, 15 nt, Streptococcus pyogenes M1 GAS
augcgaggcuuuuuu

SEQ ID NO: 2214646 - RNA, 14 nt, Streptococcus pyogenes M1 GAS
augagcaaggcaag

SEQ ID NO: 2214647 - RNA, 16 nt, Streptococcus pyogenes M1 GAS
augaucuguuuaaaaa

SEQ ID NO: 2214648 - RNA, 17 nt, Streptococcus pyogenes M1 GAS
augaucuguuuaaaaac

SEQ ID NO: 2214649 - RNA, 18 nt, Streptococcus pyogenes M1 GAS
augauuacauuaggauau

SEQ ID NO: 2214650 - RNA, 17 nt, Streptococcus pyogenes M1 GAS
augauuuaguuuuuaaa

SEQ ID NO: 2214651 - RNA, 13 nt, Streptococcus pyogenes M1 GAS
augauuuguauuu

SEQ ID NO: 2214652 - RNA, 14 nt, Streptococcus pyogenes M1 GAS
augauuuguauuuu

SEQ ID NO: 2214653 - RNA, 15 nt, Streptococcus pyogenes M1 GAS
augauuugucaaaaa

SEQ ID NO: 2214654 - RNA, 23 nt, Streptococcus pyogenes M1 GAS
augcacacaaaucuucuagaauc

SEQ ID NO: 2214655 - RNA, 17 nt, Streptococcus pyogenes M1 GAS
caauuccaucacuucca

SEQ ID NO: 2214656 - RNA, 19 nt, Streptococcus pyogenes M1 GAS
caaugugacaauuggugau

SEQ ID NO: 2214657 - RNA, 13 nt, Streptococcus pyogenes M1 GAS
caauggaaauuuu

SEQ ID NO: 2214658 - RNA, 13 nt, Streptococcus pyogenes M1 GAS
caauguaugacaa

SEQ ID NO: 2214659 - RNA, 16 nt, Streptococcus pyogenes M1 GAS
caauggcuaaaaagag

SEQ ID NO: 2214660 - RNA, 19 nt, Streptococcus pyogenes M1 GAS
cacagcguaagccaaaucu

SEQ ID NO: 2214661 - RNA, 21 nt, Streptococcus pyogenes M1 GAS
cacauacuggucaauggaaau

SEQ ID NO: 2214662 - RNA, 14 nt, Streptococcus pyogenes M1 GAS
caccaaaaaaagca

SEQ ID NO: 2214663 - RNA, 20 nt, Streptococcus pyogenes M1 GAS
caccuuagugguuugcaaau

SEQ ID NO: 2214664 - RNA, 16 nt, Streptococcus pyogenes M1 GAS
aaaauacuagaaaaag

SEQ ID NO: 2214665 - RNA, 23 nt, Streptococcus pyogenes M1 GAS
aaaauacauuguuuuucuuuguc

SEQ ID NO: 2214666 - RNA, 19 nt, Streptococcus pyogenes M1 GAS
aaaauaaacuuucaguuau

SEQ ID NO: 2214667 - RNA, 15 nt, Streptococcus pyogenes M1 GAS
caccuacuaacaaca

SEQ ID NO: 2214668 - RNA, 23 nt, Streptococcus pyogenes M1 GAS
caccuacgauaaaacaaauaauu

SEQ ID NO: 2214669 - RNA, 17 nt, Streptococcus pyogenes M1 GAS
caccgacauacaaagca

SEQ ID NO: 2214670 - RNA, 14 nt, Streptococcus pyogenes M1 GAS
caaaggcuuuuugu

SEQ ID NO: 2214671 - RNA, 16 nt, Streptococcus pyogenes M1 GAS
caaagaaggccagcaa

SEQ ID NO: 2214672 - RNA, 15 nt, Streptococcus pyogenes M1 GAS
caaacggaguuccuc

SEQ ID NO: 2214673 - RNA, 14 nt, Streptococcus pyogenes M1 GAS
caaacggaguucuc

SEQ ID NO: 2214674 - RNA, 17 nt, Streptococcus pyogenes M1 GAS
caaaagaauugaaaaac

SEQ ID NO: 2214675 - RNA, 16 nt, Streptococcus pyogenes M1 GAS
caaaacuucaaauuuc

SEQ ID NO: 2214676 - RNA, 18 nt, Streptococcus pyogenes M1 GAS
caaaaagccuauuuaaua

SEQ ID NO: 2214677 - RNA, 12 nt, Streptococcus pyogenes M1 GAS
caaaaagacuuc

SEQ ID NO: 2214678 - RNA, 13 nt, Streptococcus pyogenes M1 GAS
caaaagcuaaacu

SEQ ID NO: 2214679 - RNA, 11 nt, Streptococcus pyogenes M1 GAS
caaaauuauua

SEQ ID NO: 2214680 - RNA, 18 nt, Streptococcus pyogenes M1 GAS
caacauccauaccaucaa

SEQ ID NO: 2214681 - RNA, 11 nt, Streptococcus pyogenes M1 GAS
caacaucaagg

SEQ ID NO: 2214682 - RNA, 18 nt, Streptococcus pyogenes M1 GAS
caacccuugauuaauagc

SEQ ID NO: 2214683 - RNA, 14 nt, Streptococcus pyogenes M1 GAS
caaaucaacauggc

SEQ ID NO: 2214684 - RNA, 23 nt, Streptococcus pyogenes M1 GAS
caaagggauuacgauuaaaagau

SEQ ID NO: 2214685 - RNA, 14 nt, Streptococcus pyogenes M1 GAS
caaauucuuccuua

SEQ ID NO: 2214686 - RNA, 17 nt, Streptococcus pyogenes M1 GAS
caaauuucagauaagac

SEQ ID NO: 2214687 - RNA, 20 nt, Streptococcus pyogenes M1 GAS
caaauuucagauaagaccuu

SEQ ID NO: 2214688 - RNA, 14 nt, Streptococcus pyogenes M1 GAS
caaauuuauccuga

SEQ ID NO: 2214689 - RNA, 16 nt, Streptococcus pyogenes M1 GAS
caaaucguacugucug

SEQ ID NO: 2214690 - RNA, 22 nt, Streptococcus pyogenes M1 GAS
caaccucgcuggcuagacuugg

SEQ ID NO: 2214691 - RNA, 17 nt, Streptococcus pyogenes M1 GAS
caacuuaccagcaccuu

SEQ ID NO: 2214692 - RNA, 22 nt, Streptococcus pyogenes M1 GAS
caacuaucgcucagaauaaaga

SEQ ID NO: 2214693 - RNA, 23 nt, Streptococcus pyogenes M1 GAS
caacuaucaaguaugcuuuuaau

SEQ ID NO: 2214694 - RNA, 13 nt, Streptococcus pyogenes M1 GAS
caagcaucagcuc

SEQ ID NO: 2214695 - RNA, 17 nt, Streptococcus pyogenes M1 GAS
caagaucugcacacacu

SEQ ID NO: 2214696 - RNA, 23 nt, Streptococcus pyogenes M1 GAS
caagcauuuugcaagucucuugc

SEQ ID NO: 2214697 - RNA, 21 nt, Streptococcus pyogenes M1 GAS
caagcuaucgcuaacauuuau

SEQ ID NO: 2214698 - RNA, 13 nt, Streptococcus pyogenes M1 GAS
caaucgaaaugau

SEQ ID NO: 2214699 - RNA, 20 nt, Streptococcus pyogenes M1 GAS
caaucgaaaugauagcaccu

SEQ ID NO: 2214700 - RNA, 17 nt, Streptococcus pyogenes M1 GAS
caauaaaaaagaagcaa

SEQ ID NO: 2214701 - RNA, 17 nt, Streptococcus pyogenes M1 GAS
caagugauacuugguau

SEQ ID NO: 2214702 - RNA, 19 nt, Streptococcus pyogenes M1 GAS
caagugauacuugguauug

SEQ ID NO: 2214703 - RNA, 18 nt, Streptococcus pyogenes M1 GAS
caagugccaguaaggaaa

SEQ ID NO: 2214704 - RNA, 23 nt, Streptococcus pyogenes M1 GAS
caagugccaguaaggaaaucaau

SEQ ID NO: 2214705 - RNA, 21 nt, Streptococcus pyogenes M1 GAS
caagcuugaucuuacaaagga

SEQ ID NO: 2214706 - RNA, 20 nt, Streptococcus pyogenes M1 GAS
caagucaggaauuguugacu

SEQ ID NO: 2214707 - RNA, 22 nt, Streptococcus pyogenes M1 GAS
caaggcaccugaggcaauggcu

SEQ ID NO: 2214708 - RNA, 14 nt, Streptococcus pyogenes M1 GAS
caaggcaagaggag

SEQ ID NO: 2214709 - RNA, 16 nt, Streptococcus pyogenes M1 GAS
aucaguccuccucuuu

SEQ ID NO: 2214710 - RNA, 18 nt, Streptococcus pyogenes M1 GAS
aucagaaagaagaaaauu

SEQ ID NO: 2214711 - RNA, 19 nt, Streptococcus pyogenes M1 GAS
aucaggauugccaucaaug

SEQ ID NO: 2214712 - RNA, 19 nt, Streptococcus pyogenes M1 GAS
aucagcucuugcuugucuu

SEQ ID NO: 2214713 - RNA, 18 nt, Streptococcus pyogenes M1 GAS
aucagcuacacuugauuu

SEQ ID NO: 2214714 - RNA, 15 nt, Streptococcus pyogenes M1 GAS
aucacucguaaaaag

SEQ ID NO: 2214715 - RNA, 17 nt, Streptococcus pyogenes M1 GAS
aucacucguaaaaagau

SEQ ID NO: 2214716 - RNA, 15 nt, Streptococcus pyogenes M1 GAS
auauuagcaaaaugc

SEQ ID NO: 2214717 - RNA, 17 nt, Streptococcus pyogenes M1 GAS
auauuagcaaaaugcug

SEQ ID NO: 2214718 - RNA, 21 nt, Streptococcus pyogenes M1 GAS
auauuaaccggcucuaaaaua

SEQ ID NO: 2214719 - RNA, 14 nt, Streptococcus pyogenes M1 GAS
auaugucaucaaaa

SEQ ID NO: 2214720 - RNA, 22 nt, Streptococcus pyogenes M1 GAS
aucaaagggauuacgauuaaaa

SEQ ID NO: 2214721 - RNA, 18 nt, Streptococcus pyogenes M1 GAS
aucaacauggcuaaugau

SEQ ID NO: 2214722 - RNA, 19 nt, Streptococcus pyogenes M1 GAS
aucaaaaaaagacacacaa

SEQ ID NO: 2214723 - RNA, 18 nt, Streptococcus pyogenes M1 GAS
auauuuuuucucaaaaau

SEQ ID NO: 2214724 - RNA, 20 nt, Streptococcus pyogenes M1 GAS
auauuuuuucucaaaaauau

SEQ ID NO: 2214725 - RNA, 20 nt, Streptococcus pyogenes M1 GAS
aucaaaaaaagcaaugacua

SEQ ID NO: 2214726 - RNA, 16 nt, Streptococcus pyogenes M1 GAS
aucaaaaaaagcaaug

SEQ ID NO: 2214727 - RNA, 17 nt, Streptococcus pyogenes M1 GAS
aucaaaaaaagcaauga

SEQ ID NO: 2214728 - RNA, 21 nt, Streptococcus pyogenes M1 GAS
auaguuaacugguaaaguauu

SEQ ID NO: 2214729 - RNA, 22 nt, Streptococcus pyogenes M1 GAS
auauaacuuuuagcuaagaaua

SEQ ID NO: 2214730 - RNA, 17 nt, Streptococcus pyogenes M1 GAS
auaguaaagaagaauua

SEQ ID NO: 2214731 - RNA, 12 nt, Streptococcus pyogenes M1 GAS
auaggcuuuuuu

SEQ ID NO: 2214732 - RNA, 17 nt, Streptococcus pyogenes M1 GAS
auagguaaagauuuuaa

SEQ ID NO: 2214733 - RNA, 22 nt, Streptococcus pyogenes M1 GAS
auaggagugauugaugcgcugc

SEQ ID NO: 2214734 - RNA, 17 nt, Streptococcus pyogenes M1 GAS
auaggaauaguuuagug

SEQ ID NO: 2214735 - RNA, 20 nt, Streptococcus pyogenes M1 GAS
auagagccaagauuuuaagg

SEQ ID NO: 2214736 - RNA, 23 nt, Streptococcus pyogenes M1 GAS
auacaguccaaacucaaaccaaa

SEQ ID NO: 2214737 - RNA, 21 nt, Streptococcus pyogenes M1 GAS
auacauugagaauuuuuauaa

SEQ ID NO: 2214738 - RNA, 16 nt, Streptococcus pyogenes M1 GAS
auaccaucaaugacuu

SEQ ID NO: 2214739 - RNA, 12 nt, Streptococcus pyogenes M1 GAS
auaccauuucuu

SEQ ID NO: 2214740 - RNA, 15 nt, Streptococcus pyogenes M1 GAS
auaccaaaucaaaaa

SEQ ID NO: 2214741 - RNA, 18 nt, Streptococcus pyogenes M1 GAS
auaccaaaucaaaaagcu

SEQ ID NO: 2214742 - RNA, 19 nt, Streptococcus pyogenes M1 GAS
auaccaaaucaaaaagcua

SEQ ID NO: 2214743 - RNA, 18 nt, Streptococcus pyogenes M1 GAS
auagaaacuuuuuauaag

SEQ ID NO: 2214744 - RNA, 20 nt, Streptococcus pyogenes M1 GAS
auagaaacuuuuuauaagca

SEQ ID NO: 2214745 - RNA, 14 nt, Streptococcus pyogenes M1 GAS
auagaaaguaaaaa

SEQ ID NO: 2214746 - RNA, 15 nt, Streptococcus pyogenes M1 GAS
auagaaaguaaaaau

SEQ ID NO: 2214747 - RNA, 19 nt, Streptococcus pyogenes M1 GAS
auagaagacggaguauuuu

SEQ ID NO: 2214748 - RNA, 14 nt, Streptococcus pyogenes M1 GAS
auagacaaacagaa

SEQ ID NO: 2214749 - RNA, 18 nt, Streptococcus pyogenes M1 GAS
auagacaaacagaaauac

SEQ ID NO: 2214750 - RNA, 14 nt, Streptococcus pyogenes M1 GAS
auagaauaaaaaga

SEQ ID NO: 2214751 - RNA, 23 nt, Streptococcus pyogenes M1 GAS
auagaagacggaguauuuuuuag

SEQ ID NO: 2214752 - RNA, 23 nt, Streptococcus pyogenes M1 GAS
auacguuuauuuaguuauuuuug

SEQ ID NO: 2214753 - RNA, 16 nt, Streptococcus pyogenes M1 GAS
auacuaacuauuuuua

SEQ ID NO: 2214754 - RNA, 13 nt, Streptococcus pyogenes M1 GAS
auacguaaaaaga

SEQ ID NO: 2214755 - RNA, 12 nt, Streptococcus pyogenes M1 GAS
auacgguaaaaa

SEQ ID NO: 2214756 - RNA, 20 nt, Streptococcus pyogenes M1 GAS
augaaacguuauuaaagaca

SEQ ID NO: 2214757 - RNA, 21 nt, Streptococcus pyogenes M1 GAS
augaaacguuauuaaagacaa

SEQ ID NO: 2214758 - RNA, 18 nt, Streptococcus pyogenes M1 GAS
augaaaaaagaacaaaga

SEQ ID NO: 2214759 - RNA, 20 nt, Streptococcus pyogenes M1 GAS
augacaacuaucgcucagaa

SEQ ID NO: 2214760 - RNA, 18 nt, Streptococcus pyogenes M1 GAS
augacgccuccaaauacu

SEQ ID NO: 2214761 - RNA, 12 nt, Streptococcus pyogenes M1 GAS
augagaaagcca

SEQ ID NO: 2214762 - RNA, 21 nt, Streptococcus pyogenes M1 GAS
aucugcagauuuuaagacaac

SEQ ID NO: 2214763 - RNA, 21 nt, Streptococcus pyogenes M1 GAS
aucuggagaugagaaagccaa

SEQ ID NO: 2214764 - RNA, 14 nt, Streptococcus pyogenes M1 GAS
aucuggucccacac

SEQ ID NO: 2214765 - RNA, 16 nt, Streptococcus pyogenes M1 GAS
aucuaaagcaucagca

SEQ ID NO: 2214766 - RNA, 15 nt, Streptococcus pyogenes M1 GAS
aucgcaaacagaugc

SEQ ID NO: 2214767 - RNA, 15 nt, Streptococcus pyogenes M1 GAS
aucgauuugguguuu

SEQ ID NO: 2214768 - RNA, 20 nt, Streptococcus pyogenes M1 GAS
auccuuuaucuuauuuuaag

SEQ ID NO: 2214769 - RNA, 22 nt, Streptococcus pyogenes M1 GAS
auccuuuacuguaauauuuccu

SEQ ID NO: 2214770 - RNA, 13 nt, Streptococcus pyogenes M1 GAS
auccuaacaauuu

SEQ ID NO: 2214771 - RNA, 13 nt, Streptococcus pyogenes M1 GAS
aucccaucuuugu

SEQ ID NO: 2214772 - RNA, 12 nt, Streptococcus pyogenes M1 GAS
aaaagaauugaa

SEQ ID NO: 2214773 - RNA, 13 nt, Streptococcus pyogenes M1 GAS
aaaagaaguugag

SEQ ID NO: 2214774 - RNA, 20 nt, Streptococcus pyogenes M1 GAS
aaaagaagcaaaauuauuau

SEQ ID NO: 2214775 - RNA, 17 nt, Streptococcus pyogenes M1 GAS
aucauggagucaaugaa

SEQ ID NO: 2214776 - RNA, 15 nt, Streptococcus pyogenes M1 GAS
aaaacuccagcugga

SEQ ID NO: 2214777 - RNA, 14 nt, Streptococcus pyogenes M1 GAS
aaaacucaaaaagc

SEQ ID NO: 2214778 - RNA, 14 nt, Streptococcus pyogenes M1 GAS
aaaacucaaaaaau

SEQ ID NO: 2214779 - RNA, 15 nt, Streptococcus pyogenes M1 GAS
auaaagugauaguga

SEQ ID NO: 2214780 - RNA, 15 nt, Streptococcus pyogenes M1 GAS
auaaauucuaacucu

SEQ ID NO: 2214781 - RNA, 19 nt, Streptococcus pyogenes M1 GAS
auaaacuguauacaaaaag

SEQ ID NO: 2214782 - RNA, 18 nt, Streptococcus pyogenes M1 GAS
auaaagaaacaaaaauga

SEQ ID NO: 2214783 - RNA, 16 nt, Streptococcus pyogenes M1 GAS
aguuuucucagagaca

SEQ ID NO: 2214784 - RNA, 11 nt, Streptococcus pyogenes M1 GAS
auaaaaaacaa

SEQ ID NO: 2214785 - RNA, 18 nt, Streptococcus pyogenes M1 GAS
auaaaaaagaagcaaaau

SEQ ID NO: 2214786 - RNA, 18 nt, Streptococcus pyogenes M1 GAS
aguuuuuucuaaaagaga

SEQ ID NO: 2214787 - RNA, 23 nt, Streptococcus pyogenes M1 GAS
auaaaaacgaucaaaaaucuuuu

SEQ ID NO: 2214788 - RNA, 18 nt, Streptococcus pyogenes M1 GAS
auaauauugauauuccua

SEQ ID NO: 2214789 - RNA, 19 nt, Streptococcus pyogenes M1 GAS
auaaguauucuaaaauccu

SEQ ID NO: 2214790 - RNA, 21 nt, Streptococcus pyogenes M1 GAS
auaauuaguauauuguaauaa

SEQ ID NO: 2214791 - RNA, 17 nt, Streptococcus pyogenes M1 GAS
auaaucguaacuggucc

SEQ ID NO: 2214792 - RNA, 20 nt, Streptococcus pyogenes M1 GAS
auaaggcugcgaugauuuug

SEQ ID NO: 2214793 - RNA, 16 nt, Streptococcus pyogenes M1 GAS
auaagauucaauauga

SEQ ID NO: 2214794 - RNA, 22 nt, Streptococcus pyogenes M1 GAS
auaacuuuuagcuaagaauaac

SEQ ID NO: 2214795 - RNA, 20 nt, Streptococcus pyogenes M1 GAS
auaagaccuucaaaaaaggg

SEQ ID NO: 2214796 - RNA, 15 nt, Streptococcus pyogenes M1 GAS
auaagaccuucaaaa

SEQ ID NO: 2214797 - RNA, 15 nt, Streptococcus pyogenes M1 GAS
aguucagcagcacug

SEQ ID NO: 2214798 - RNA, 21 nt, Streptococcus pyogenes M1 GAS
aguucccuuaauaaacuguau

SEQ ID NO: 2214799 - RNA, 16 nt, Streptococcus pyogenes M1 GAS
aguuccucgguuuuuu

SEQ ID NO: 2214800 - RNA, 20 nt, Streptococcus pyogenes M1 GAS
aguuauaauuaguauauugu

SEQ ID NO: 2214801 - RNA, 23 nt, Streptococcus pyogenes M1 GAS
aguuauaaagaaacaaaaaugaa

SEQ ID NO: 2214802 - RNA, 20 nt, Streptococcus pyogenes M1 GAS
aguuauaaagaaacaaaaau

SEQ ID NO: 2214803 - RNA, 21 nt, Streptococcus pyogenes M1 GAS
aguuaagcuugcuaagagaau

SEQ ID NO: 2214804 - RNA, 15 nt, Streptococcus pyogenes M1 GAS
aguuaggaaagauag

SEQ ID NO: 2214805 - RNA, 19 nt, Streptococcus pyogenes M1 GAS
aguucaauggauauaacaa

SEQ ID NO: 2214806 - RNA, 12 nt, Streptococcus pyogenes M1 GAS
aguuauuuuuga

SEQ ID NO: 2214807 - RNA, 20 nt, Streptococcus pyogenes M1 GAS
aguuauagcuccuaaaacca

SEQ ID NO: 2214808 - RNA, 14 nt, Streptococcus pyogenes M1 GAS
aguugcuucuuuua

SEQ ID NO: 2214809 - RNA, 19 nt, Streptococcus pyogenes M1 GAS
agugucugacaagucagga

SEQ ID NO: 2214810 - RNA, 15 nt, Streptococcus pyogenes M1 GAS
aguguacucaucuaa

SEQ ID NO: 2214811 - RNA, 19 nt, Streptococcus pyogenes M1 GAS
agucuaggcguauagguga

SEQ ID NO: 2214812 - RNA, 23 nt, Streptococcus pyogenes M1 GAS
agucuaggcguauaggugaguuu

SEQ ID NO: 2214813 - RNA, 23 nt, Streptococcus pyogenes M1 GAS
agugaauucuaaaauaaaccaag

SEQ ID NO: 2214814 - RNA, 16 nt, Streptococcus pyogenes M1 GAS
aguccaaacucaaacc

SEQ ID NO: 2214815 - RNA, 17 nt, Streptococcus pyogenes M1 GAS
aguccaaaauacauccu

SEQ ID NO: 2214816 - RNA, 20 nt, Streptococcus pyogenes M1 GAS
agucacgaguguuaaaacga

SEQ ID NO: 2214817 - RNA, 14 nt, Streptococcus pyogenes M1 GAS
agucagaucauuaa

SEQ ID NO: 2214818 - RNA, 23 nt, Streptococcus pyogenes M1 GAS
aggugaaaauaucuuuuuuacuu

SEQ ID NO: 2214819 - RNA, 18 nt, Streptococcus pyogenes M1 GAS
aggucugugaugaaucau

SEQ ID NO: 2214820 - RNA, 22 nt, Streptococcus pyogenes M1 GAS
aggucugcgcgacuaaaaucau

SEQ ID NO: 2214821 - RNA, 23 nt, Streptococcus pyogenes M1 GAS
aggucugcuucuuacuaugaaaa

SEQ ID NO: 2214822 - RNA, 16 nt, Streptococcus pyogenes M1 GAS
agguaaagauuuuaaa

SEQ ID NO: 2214823 - RNA, 18 nt, Streptococcus pyogenes M1 GAS
aggugaguuuuuucuaaa

SEQ ID NO: 2214824 - RNA, 22 nt, Streptococcus pyogenes M1 GAS
aggugaguuuuuucuaaaagag

SEQ ID NO: 2214825 - RNA, 18 nt, Streptococcus pyogenes M1 GAS
agguuaaucgaccaaaau

SEQ ID NO: 2214826 - RNA, 16 nt, Streptococcus pyogenes M1 GAS
agguuaaguaaaaggg

SEQ ID NO: 2214827 - RNA, 17 nt, Streptococcus pyogenes M1 GAS
agguuaaguaaaaggga

SEQ ID NO: 2214828 - RNA, 19 nt, Streptococcus pyogenes M1 GAS
aguaaggaaaucaauccug

SEQ ID NO: 2214829 - RNA, 14 nt, Streptococcus pyogenes M1 GAS
aguaagaaauuacu

SEQ ID NO: 2214830 - RNA, 13 nt, Streptococcus pyogenes M1 GAS
aguaaaaagcaaa

SEQ ID NO: 2214831 - RNA, 12 nt, Streptococcus pyogenes M1 GAS
aggcuucaucaa

SEQ ID NO: 2214832 - RNA, 19 nt, Streptococcus pyogenes M1 GAS
aggguguuuuuuauauguc

SEQ ID NO: 2214833 - RNA, 19 nt, Streptococcus pyogenes M1 GAS
aggguuuuucuuuugaccu

SEQ ID NO: 2214834 - RNA, 23 nt, Streptococcus pyogenes M1 GAS
agggguaauuugguggaagagua

SEQ ID NO: 2214835 - RNA, 21 nt, Streptococcus pyogenes M1 GAS
aggggagacggacuuaaccau

SEQ ID NO: 2214836 - RNA, 15 nt, Streptococcus pyogenes M1 GAS
aggcguauaggugag

SEQ ID NO: 2214837 - RNA, 20 nt, Streptococcus pyogenes M1 GAS
aggcaauccaaaucaacaug

SEQ ID NO: 2214838 - RNA, 14 nt, Streptococcus pyogenes M1 GAS
aggcaggacgguuu

SEQ ID NO: 2214839 - RNA, 19 nt, Streptococcus pyogenes M1 GAS
aggcaggacgguuucccuu

SEQ ID NO: 2214840 - RNA, 20 nt, Streptococcus pyogenes M1 GAS
aggagucggaaauugaccaa

SEQ ID NO: 2214841 - RNA, 23 nt, Streptococcus pyogenes M1 GAS
aggauaugagggucaaacugaug

SEQ ID NO: 2214842 - RNA, 16 nt, Streptococcus pyogenes M1 GAS
aggaucauuauccuuu

SEQ ID NO: 2214843 - RNA, 15 nt, Streptococcus pyogenes M1 GAS
aggacgguuucccuu

SEQ ID NO: 2214844 - RNA, 16 nt, Streptococcus pyogenes M1 GAS
aggaaaaagccagagc

SEQ ID NO: 2214845 - RNA, 20 nt, Streptococcus pyogenes M1 GAS
aggaauaucaggcaaaacaa

SEQ ID NO: 2214846 - RNA, 19 nt, Streptococcus pyogenes M1 GAS
agcuugcuaagagaauaac

SEQ ID NO: 2214847 - RNA, 23 nt, Streptococcus pyogenes M1 GAS
agcuuuuuuuguuuuggccaaua

SEQ ID NO: 2214848 - RNA, 23 nt, Streptococcus pyogenes M1 GAS
agcucgcuaagggaaaaauuacg

SEQ ID NO: 2214849 - RNA, 21 nt, Streptococcus pyogenes M1 GAS
agcugacaguaucaccuugcu

SEQ ID NO: 2214850 - RNA, 21 nt, Streptococcus pyogenes M1 GAS
accgaaacguaacguaauaga

SEQ ID NO: 2214851 - RNA, 16 nt, Streptococcus pyogenes M1 GAS
accgaagucucuuuug

SEQ ID NO: 2214852 - RNA, 13 nt, Streptococcus pyogenes M1 GAS
accagcaccuucu

SEQ ID NO: 2214853 - RNA, 18 nt, Streptococcus pyogenes M1 GAS
accaacuuggacgaaggc

SEQ ID NO: 2214854 - RNA, 19 nt, Streptococcus pyogenes M1 GAS
accuaauugugagaaacua

SEQ ID NO: 2214855 - RNA, 16 nt, Streptococcus pyogenes M1 GAS
accuacgauaaaacaa

SEQ ID NO: 2214856 - RNA, 15 nt, Streptococcus pyogenes M1 GAS
accuacuagcacaaa

SEQ ID NO: 2214857 - RNA, 20 nt, Streptococcus pyogenes M1 GAS
accuacuagcacaaaaucau

SEQ ID NO: 2214858 - RNA, 23 nt, Streptococcus pyogenes M1 GAS
accuacugccauggguaaaauga

SEQ ID NO: 2214859 - RNA, 16 nt, Streptococcus pyogenes M1 GAS
accuauugagucuuuu

SEQ ID NO: 2214860 - RNA, 20 nt, Streptococcus pyogenes M1 GAS
accguucauauaagcaauca

SEQ ID NO: 2214861 - RNA, 22 nt, Streptococcus pyogenes M1 GAS
accuucaggcugcuaaggacaa

SEQ ID NO: 2214862 - RNA, 15 nt, Streptococcus pyogenes M1 GAS
accugcugcuccuau

SEQ ID NO: 2214863 - RNA, 13 nt, Streptococcus pyogenes M1 GAS
accuccagcugac

SEQ ID NO: 2214864 - RNA, 13 nt, Streptococcus pyogenes M1 GAS
acuguaauauuuc

SEQ ID NO: 2214865 - RNA, 19 nt, Streptococcus pyogenes M1 GAS
acuguaaauagauaauguu

SEQ ID NO: 2214866 - RNA, 13 nt, Streptococcus pyogenes M1 GAS
acuguuuuucuua

SEQ ID NO: 2214867 - RNA, 13 nt, Streptococcus pyogenes M1 GAS
acuggucaaaagc

SEQ ID NO: 2214868 - RNA, 20 nt, Streptococcus pyogenes M1 GAS
acucuauuuuaaguaaagga

SEQ ID NO: 2214869 - RNA, 13 nt, Streptococcus pyogenes M1 GAS
acucguaagcauu

SEQ ID NO: 2214870 - RNA, 21 nt, Streptococcus pyogenes M1 GAS
acugacuagccaaaucuggcu

SEQ ID NO: 2214871 - RNA, 19 nt, Streptococcus pyogenes M1 GAS
acugccauggguaaaauga

SEQ ID NO: 2214872 - RNA, 22 nt, Streptococcus pyogenes M1 GAS
acuccagcuggaguuuuuuuau

SEQ ID NO: 2214873 - RNA, 21 nt, Streptococcus pyogenes M1 GAS
acucauuaagguuuuuuuagu

SEQ ID NO: 2214874 - RNA, 18 nt, Streptococcus pyogenes M1 GAS
acucaucuaaaaaagcaa

SEQ ID NO: 2214875 - RNA, 15 nt, Streptococcus pyogenes M1 GAS
acuaugaaaaaagaa

SEQ ID NO: 2214876 - RNA, 16 nt, Streptococcus pyogenes M1 GAS
acuaugaaaaaagaac

SEQ ID NO: 2214877 - RNA, 21 nt, Streptococcus pyogenes M1 GAS
acuaguuuauuacaaaacugu

SEQ ID NO: 2214878 - RNA, 19 nt, Streptococcus pyogenes M1 GAS
acuaguuuauuacaaaacu

SEQ ID NO: 2214879 - RNA, 17 nt, Streptococcus pyogenes M1 GAS
acuagaaaaagcaauga

SEQ ID NO: 2214880 - RNA, 16 nt, Streptococcus pyogenes M1 GAS
acuaccuuaaauguau

SEQ ID NO: 2214881 - RNA, 18 nt, Streptococcus pyogenes M1 GAS
acguuccaugauugauuu

SEQ ID NO: 2214882 - RNA, 19 nt, Streptococcus pyogenes M1 GAS
acguuccaugauugauuuu

SEQ ID NO: 2214883 - RNA, 23 nt, Streptococcus pyogenes M1 GAS
acuauggcuucuaaaaaaguuau

SEQ ID NO: 2214884 - RNA, 17 nt, Streptococcus pyogenes M1 GAS
acucaauagcugcugcu

SEQ ID NO: 2214885 - RNA, 15 nt, Streptococcus pyogenes M1 GAS
agcaaggcaccugag

SEQ ID NO: 2214886 - RNA, 15 nt, Streptococcus pyogenes M1 GAS
agcaagcaucagcuc

SEQ ID NO: 2214887 - RNA, 23 nt, Streptococcus pyogenes M1 GAS
agcaaugacuauagaaaguaaaa

SEQ ID NO: 2214888 - RNA, 15 nt, Streptococcus pyogenes M1 GAS
agcaaucuaagaauu

SEQ ID NO: 2214889 - RNA, 19 nt, Streptococcus pyogenes M1 GAS
agcaauuguuuuuucaaca

SEQ ID NO: 2214890 - RNA, 18 nt, Streptococcus pyogenes M1 GAS
agcaauggcuaaaaagag

SEQ ID NO: 2214891 - RNA, 23 nt, Streptococcus pyogenes M1 GAS
agcagacaaaagggaagagagaa

SEQ ID NO: 2214892 - RNA, 17 nt, Streptococcus pyogenes M1 GAS
agcauuuugagaacgaa

SEQ ID NO: 2214893 - RNA, 15 nt, Streptococcus pyogenes M1 GAS
agcauuuucaucauc

SEQ ID NO: 2214894 - RNA, 21 nt, Streptococcus pyogenes M1 GAS
agcauuuguuuugauaaaaaa

SEQ ID NO: 2214895 - RNA, 23 nt, Streptococcus pyogenes M1 GAS
agcauuuguuuugauaaaaaaca

SEQ ID NO: 2214896 - RNA, 16 nt, Streptococcus pyogenes M1 GAS
agcauuugccauggca

SEQ ID NO: 2214897 - RNA, 12 nt, Streptococcus pyogenes M1 GAS
agccaauuacuu

SEQ ID NO: 2214898 - RNA, 14 nt, Streptococcus pyogenes M1 GAS
agccaaauccaccu

SEQ ID NO: 2214899 - RNA, 20 nt, Streptococcus pyogenes M1 GAS
agccaauaacgccagcuaca

SEQ ID NO: 2214900 - RNA, 15 nt, Streptococcus pyogenes M1 GAS
agcaguucagcagca

SEQ ID NO: 2214901 - RNA, 17 nt, Streptococcus pyogenes M1 GAS
agcaguucagcagcacu

SEQ ID NO: 2214902 - RNA, 23 nt, Streptococcus pyogenes M1 GAS
agcguagcccucgcuaucaaagc

SEQ ID NO: 2214903 - RNA, 21 nt, Streptococcus pyogenes M1 GAS
agccguccuuaaaagaaaauc

SEQ ID NO: 2214904 - RNA, 16 nt, Streptococcus pyogenes M1 GAS
agccuauuuaauaggc

SEQ ID NO: 2214905 - RNA, 19 nt, Streptococcus pyogenes M1 GAS
agccucuuggaaacaagag

SEQ ID NO: 2214906 - RNA, 22 nt, Streptococcus pyogenes M1 GAS
agcccucgcuaucaaagcugac

SEQ ID NO: 2214907 - RNA, 21 nt, Streptococcus pyogenes M1 GAS
agccgcucuaauuuagucauu

SEQ ID NO: 2214908 - RNA, 18 nt, Streptococcus pyogenes M1 GAS
agccgcucuaauuuaguc

SEQ ID NO: 2214909 - RNA, 17 nt, Streptococcus pyogenes M1 GAS
acuugguaucuuaaaua

SEQ ID NO: 2214910 - RNA, 17 nt, Streptococcus pyogenes M1 GAS
acuugggagaguuccug

SEQ ID NO: 2214911 - RNA, 14 nt, Streptococcus pyogenes M1 GAS
acuuguaaaaugau

SEQ ID NO: 2214912 - RNA, 17 nt, Streptococcus pyogenes M1 GAS
acuugguucugaaaaua

SEQ ID NO: 2214913 - RNA, 21 nt, Streptococcus pyogenes M1 GAS
acuugguucugaaaauaaaau

SEQ ID NO: 2214914 - RNA, 16 nt, Streptococcus pyogenes M1 GAS
acuuguuacaaaaaac

SEQ ID NO: 2214915 - RNA, 19 nt, Streptococcus pyogenes M1 GAS
acuuguuacaaaaaacaag

SEQ ID NO: 2214916 - RNA, 18 nt, Streptococcus pyogenes M1 GAS
acuugcaucgcaaacaga

SEQ ID NO: 2214917 - RNA, 22 nt, Streptococcus pyogenes M1 GAS
acuuuauugaugauaaaggccu

SEQ ID NO: 2214918 - RNA, 18 nt, Streptococcus pyogenes M1 GAS
agaaaaucuaaucagaac

SEQ ID NO: 2214919 - RNA, 14 nt, Streptococcus pyogenes M1 GAS
acuuugcaaaagaa

SEQ ID NO: 2214920 - RNA, 17 nt, Streptococcus pyogenes M1 GAS
acuuugcaaaagaauug

SEQ ID NO: 2214921 - RNA, 15 nt, Streptococcus pyogenes M1 GAS
acuuugguauucuuu

SEQ ID NO: 2214922 - RNA, 22 nt, Streptococcus pyogenes M1 GAS
agaauuauacuaacuauuuuua

SEQ ID NO: 2214923 - RNA, 14 nt, Streptococcus pyogenes M1 GAS
agaagccaauuacu

SEQ ID NO: 2214924 - RNA, 21 nt, Streptococcus pyogenes M1 GAS
agaagugauguuuuuacauuu

SEQ ID NO: 2214925 - RNA, 14 nt, Streptococcus pyogenes M1 GAS
agaauagaaauagu

SEQ ID NO: 2214926 - RNA, 21 nt, Streptococcus pyogenes M1 GAS
agaauagguaaagauuuuaaa

SEQ ID NO: 2214927 - RNA, 22 nt, Streptococcus pyogenes M1 GAS
aaaacagaaagcggaagaacag

SEQ ID NO: 2214928 - RNA, 11 nt, Streptococcus pyogenes M1 GAS
aaaacagaaag

SEQ ID NO: 2214929 - RNA, 15 nt, Streptococcus pyogenes M1 GAS
agaaacuaaaggcaa

SEQ ID NO: 2214930 - RNA, 14 nt, Streptococcus pyogenes M1 GAS
agaaauuaauaaau

SEQ ID NO: 2214931 - RNA, 20 nt, Streptococcus pyogenes M1 GAS
agaacgucaaaaaaaaggac

SEQ ID NO: 2214932 - RNA, 17 nt, Streptococcus pyogenes M1 GAS
agauaccaaaucaaaaa

SEQ ID NO: 2214933 - RNA, 16 nt, Streptococcus pyogenes M1 GAS
agauagucaaaaagac

SEQ ID NO: 2214934 - RNA, 17 nt, Streptococcus pyogenes M1 GAS
agauaguaaagaagaau

SEQ ID NO: 2214935 - RNA, 15 nt, Streptococcus pyogenes M1 GAS
agagucauuugacua

SEQ ID NO: 2214936 - RNA, 12 nt, Streptococcus pyogenes M1 GAS
agauaaaaaugg

SEQ ID NO: 2214937 - RNA, 20 nt, Streptococcus pyogenes M1 GAS
agauaagaccuucaaaaaag

SEQ ID NO: 2214938 - RNA, 19 nt, Streptococcus pyogenes M1 GAS
agaucaauuccaucacuuc

SEQ ID NO: 2214939 - RNA, 15 nt, Streptococcus pyogenes M1 GAS
agaucugcacacacu

SEQ ID NO: 2214940 - RNA, 23 nt, Streptococcus pyogenes M1 GAS
agaugauuacauuaggauauaga

SEQ ID NO: 2214941 - RNA, 18 nt, Streptococcus pyogenes M1 GAS
agauuaaacuuacaaaaa

SEQ ID NO: 2214942 - RNA, 19 nt, Streptococcus pyogenes M1 GAS
agauuaaacuuacaaaaag

SEQ ID NO: 2214943 - RNA, 23 nt, Streptococcus pyogenes M1 GAS
agaugcuugcucaauuuuugauu

SEQ ID NO: 2214944 - RNA, 22 nt, Streptococcus pyogenes M1 GAS
agagcucaaccucugaaggcac

SEQ ID NO: 2214945 - RNA, 22 nt, Streptococcus pyogenes M1 GAS
agagagguugguaaaaaggcag

SEQ ID NO: 2214946 - RNA, 21 nt, Streptococcus pyogenes M1 GAS
agagacaauaaggucaucaga

SEQ ID NO: 2214947 - RNA, 19 nt, Streptococcus pyogenes M1 GAS
agagaaugauaguaaacga

SEQ ID NO: 2214948 - RNA, 10 nt, Streptococcus pyogenes M1 GAS
agagaaucaa

SEQ ID NO: 2214949 - RNA, 15 nt, Streptococcus pyogenes M1 GAS
agacuuuuaauguau

SEQ ID NO: 2214950 - RNA, 22 nt, Streptococcus pyogenes M1 GAS
agacuucuuccuuguacaagag

SEQ ID NO: 2214951 - RNA, 18 nt, Streptococcus pyogenes M1 GAS
acagcaacaucaaaaaga

SEQ ID NO: 2214952 - RNA, 15 nt, Streptococcus pyogenes M1 GAS
acacguaagcuccaa

SEQ ID NO: 2214953 - RNA, 21 nt, Streptococcus pyogenes M1 GAS
acacgguuuucugucuacuua

SEQ ID NO: 2214954 - RNA, 17 nt, Streptococcus pyogenes M1 GAS
acacgugauaaaugccg

SEQ ID NO: 2214955 - RNA, 14 nt, Streptococcus pyogenes M1 GAS
acaguuaaaaauaa

SEQ ID NO: 2214956 - RNA, 15 nt, Streptococcus pyogenes M1 GAS
acaguuaaaaauaac

SEQ ID NO: 2214957 - RNA, 16 nt, Streptococcus pyogenes M1 GAS
acaguugugugacugu

SEQ ID NO: 2214958 - RNA, 16 nt, Streptococcus pyogenes M1 GAS
acaguauacaucaacu

SEQ ID NO: 2214959 - RNA, 18 nt, Streptococcus pyogenes M1 GAS
acaucaacuaucaaguau

SEQ ID NO: 2214960 - RNA, 13 nt, Streptococcus pyogenes M1 GAS
acaucuccuaggc

SEQ ID NO: 2214961 - RNA, 16 nt, Streptococcus pyogenes M1 GAS
acauuuuauuugaaga

SEQ ID NO: 2214962 - RNA, 16 nt, Streptococcus pyogenes M1 GAS
acauugaauaaaguga

SEQ ID NO: 2214963 - RNA, 15 nt, Streptococcus pyogenes M1 GAS
acauuaguccaaaau

SEQ ID NO: 2214964 - RNA, 15 nt, Streptococcus pyogenes M1 GAS
accaaaaccaagugc

SEQ ID NO: 2214965 - RNA, 19 nt, Streptococcus pyogenes M1 GAS
accaaaagaauuauacuaa

SEQ ID NO: 2214966 - RNA, 21 nt, Streptococcus pyogenes M1 GAS
accaaaagaauuauacuaacu

SEQ ID NO: 2214967 - RNA, 18 nt, Streptococcus pyogenes M1 GAS
accaaaucaaaaagcuaa

SEQ ID NO: 2214968 - RNA, 22 nt, Streptococcus pyogenes M1 GAS
accaaauuucagauaagaccuu

SEQ ID NO: 2214969 - RNA, 13 nt, Streptococcus pyogenes M1 GAS
acaacauccauac

SEQ ID NO: 2214970 - RNA, 13 nt, Streptococcus pyogenes M1 GAS
acaaauccuuuug

SEQ ID NO: 2214971 - RNA, 15 nt, Streptococcus pyogenes M1 GAS
aauuuagucauuucu

SEQ ID NO: 2214972 - RNA, 16 nt, Streptococcus pyogenes M1 GAS
acaaaacccuuucgua

SEQ ID NO: 2214973 - RNA, 15 nt, Streptococcus pyogenes M1 GAS
acaccaaaaaaagca

SEQ ID NO: 2214974 - RNA, 12 nt, Streptococcus pyogenes M1 GAS
acaccugcugcu

SEQ ID NO: 2214975 - RNA, 21 nt, Streptococcus pyogenes M1 GAS
acaccuaauaaaauagcaccu

SEQ ID NO: 2214976 - RNA, 15 nt, Streptococcus pyogenes M1 GAS
acaccguuuuuuguu

SEQ ID NO: 2214977 - RNA, 20 nt, Streptococcus pyogenes M1 GAS
acaaggcaauccaaaucaac

SEQ ID NO: 2214978 - RNA, 19 nt, Streptococcus pyogenes M1 GAS
acaauacaaaaaaccuucc

SEQ ID NO: 2214979 - RNA, 19 nt, Streptococcus pyogenes M1 GAS
acaaugagaucuucuuuug

SEQ ID NO: 2214980 - RNA, 22 nt, Streptococcus pyogenes M1 GAS
acaaugagaucuucuuuugguu

SEQ ID NO: 2214981 - RNA, 21 nt, Streptococcus pyogenes M1 GAS
acaaucgaaaugauagcaccu

SEQ ID NO: 2214982 - RNA, 22 nt, Streptococcus pyogenes M1 GAS
aaucuaagaauuggggcggcac

SEQ ID NO: 2214983 - RNA, 12 nt, Streptococcus pyogenes M1 GAS
aaaaauucugau

SEQ ID NO: 2214984 - RNA, 15 nt, Streptococcus pyogenes M1 GAS
aaucuggagaugaga

SEQ ID NO: 2214985 - RNA, 14 nt, Streptococcus pyogenes M1 GAS
aauauuuuauuaau

SEQ ID NO: 2214986 - RNA, 21 nt, Streptococcus pyogenes M1 GAS
aauaugugauuauuauucuaa

SEQ ID NO: 2214987 - RNA, 22 nt, Streptococcus pyogenes M1 GAS
aauaugugauuauuauucuaaa

SEQ ID NO: 2214988 - RNA, 15 nt, Streptococcus pyogenes M1 GAS
aauaugauauaaaaa

SEQ ID NO: 2214989 - RNA, 17 nt, Streptococcus pyogenes M1 GAS
aauaugauauaaaaaug

SEQ ID NO: 2214990 - RNA, 21 nt, Streptococcus pyogenes M1 GAS
aauagcauugucaaauaaaau

SEQ ID NO: 2214991 - RNA, 22 nt, Streptococcus pyogenes M1 GAS
aauagcauugucaaauaaaauc

SEQ ID NO: 2214992 - RNA, 18 nt, Streptococcus pyogenes M1 GAS
aaucagaacucgucuuua

SEQ ID NO: 2214993 - RNA, 20 nt, Streptococcus pyogenes M1 GAS
aaucaacauggcuaaugaua

SEQ ID NO: 2214994 - RNA, 12 nt, Streptococcus pyogenes M1 GAS
aauugaaaaaau

SEQ ID NO: 2214995 - RNA, 16 nt, Streptococcus pyogenes M1 GAS
aaaacaauaacacaga

SEQ ID NO: 2214996 - RNA, 23 nt, Streptococcus pyogenes M1 GAS
aauugggucuuccaaucuuucau

SEQ ID NO: 2214997 - RNA, 13 nt, Streptococcus pyogenes M1 GAS
aauuuaauaguuu

SEQ ID NO: 2214998 - RNA, 13 nt, Streptococcus pyogenes M1 GAS
aauuguugaauaa

SEQ ID NO: 2214999 - RNA, 18 nt, Streptococcus pyogenes M1 GAS
aauuguucauuaaagcua

SEQ ID NO: 2215000 - RNA, 22 nt, Streptococcus pyogenes M1 GAS
aauuguagggauuuuuuaacua

SEQ ID NO: 2215001 - RNA, 12 nt, Streptococcus pyogenes M1 GAS
aauguuuugcuc

SEQ ID NO: 2215002 - RNA, 12 nt, Streptococcus pyogenes M1 GAS
aaugucuuguuc

SEQ ID NO: 2215003 - RNA, 21 nt, Streptococcus pyogenes M1 GAS
aaugugacaauuggugauuaa

SEQ ID NO: 2215004 - RNA, 17 nt, Streptococcus pyogenes M1 GAS
aaucuucugcauuauca

SEQ ID NO: 2215005 - RNA, 15 nt, Streptococcus pyogenes M1 GAS
aaugccaaucuuugu

SEQ ID NO: 2215006 - RNA, 20 nt, Streptococcus pyogenes M1 GAS
aauggaaauuuuaaaugaca

SEQ ID NO: 2215007 - RNA, 24 nt, Streptococcus pyogenes M1 GAS
aaugcuguuugucauacucaauag

SEQ ID NO: 2215008 - RNA, 18 nt, Streptococcus pyogenes M1 GAS
aaugguuuuuugucuucu

SEQ ID NO: 2215009 - RNA, 19 nt, Streptococcus pyogenes M1 GAS
aaugguuuuuuugucuucu

SEQ ID NO: 2215010 - RNA, 15 nt, Streptococcus pyogenes M1 GAS
aacagauaagugcca

SEQ ID NO: 2215011 - RNA, 22 nt, Streptococcus pyogenes M1 GAS
aacagauaagugccaucaggcu

SEQ ID NO: 2215012 - RNA, 18 nt, Streptococcus pyogenes M1 GAS
aacagauagucaaaaaga

SEQ ID NO: 2215013 - RNA, 19 nt, Streptococcus pyogenes M1 GAS
aacagauagucaaaaagac

SEQ ID NO: 2215014 - RNA, 18 nt, Streptococcus pyogenes M1 GAS
aacacucaucauauuguu

SEQ ID NO: 2215015 - RNA, 18 nt, Streptococcus pyogenes M1 GAS
aacaccccccgcuuuuaa

SEQ ID NO: 2215016 - RNA, 21 nt, Streptococcus pyogenes M1 GAS
aacaccccccgcuuuuaagcu

SEQ ID NO: 2215017 - RNA, 22 nt, Streptococcus pyogenes M1 GAS
aacaccguucauauaagcaauc

SEQ ID NO: 2215018 - RNA, 14 nt, Streptococcus pyogenes M1 GAS
aaaaaguaaaaagc

SEQ ID NO: 2215019 - RNA, 18 nt, Streptococcus pyogenes M1 GAS
aaaaaguaaaaucuuauu

SEQ ID NO: 2215020 - RNA, 12 nt, Streptococcus pyogenes M1 GAS
aaaaaguaaaaa

SEQ ID NO: 2215021 - RNA, 15 nt, Streptococcus pyogenes M1 GAS
aaaaaguaaaaagca

SEQ ID NO: 2215022 - RNA, 20 nt, Streptococcus pyogenes M1 GAS
aacaccaccaauaaugagca

SEQ ID NO: 2215023 - RNA, 18 nt, Streptococcus pyogenes M1 GAS
aacacaaugcuuuuugua

SEQ ID NO: 2215024 - RNA, 17 nt, Streptococcus pyogenes M1 GAS
aacacaauucaagauag

SEQ ID NO: 2215025 - RNA, 18 nt, Streptococcus pyogenes M1 GAS
aacaaugagaucuucuuu

SEQ ID NO: 2215026 - RNA, 15 nt, Streptococcus pyogenes M1 GAS
aacaauaacacagaa

SEQ ID NO: 2215027 - RNA, 18 nt, Streptococcus pyogenes M1 GAS
aacaauaacacagaagcc

SEQ ID NO: 2215028 - RNA, 17 nt, Streptococcus pyogenes M1 GAS
aaccauaucacaaaacc

SEQ ID NO: 2215029 - RNA, 19 nt, Streptococcus pyogenes M1 GAS
aaccauaucacaaaacccu

SEQ ID NO: 2215030 - RNA, 20 nt, Streptococcus pyogenes M1 GAS
aaccauaucacaaaacccuu

SEQ ID NO: 2215031 - RNA, 16 nt, Streptococcus pyogenes M1 GAS
aaccgcuauaacaguu

SEQ ID NO: 2215032 - RNA, 17 nt, Streptococcus pyogenes M1 GAS
aacaucuugauuguaag

SEQ ID NO: 2215033 - RNA, 15 nt, Streptococcus pyogenes M1 GAS
aacaucuugauugua

SEQ ID NO: 2215034 - RNA, 20 nt, Streptococcus pyogenes M1 GAS
aacauauuauaguaaccauu

SEQ ID NO: 2215035 - RNA, 22 nt, Streptococcus pyogenes M1 GAS
aaccaagugccaguaaggaaau

SEQ ID NO: 2215036 - RNA, 16 nt, Streptococcus pyogenes M1 GAS
aaccaagcuaaagggc

SEQ ID NO: 2215037 - RNA, 12 nt, Streptococcus pyogenes M1 GAS
aaccaagugcca

SEQ ID NO: 2215038 - RNA, 19 nt, Streptococcus pyogenes M1 GAS
aaccaauuguugaauaagu

SEQ ID NO: 2215039 - RNA, 14 nt, Streptococcus pyogenes M1 GAS
aagaaggucaugau

SEQ ID NO: 2215040 - RNA, 15 nt, Streptococcus pyogenes M1 GAS
aagaaggucaugaug

SEQ ID NO: 2215041 - RNA, 22 nt, Streptococcus pyogenes M1 GAS
aagaaggaacucuccaaaguuc

SEQ ID NO: 2215042 - RNA, 17 nt, Streptococcus pyogenes M1 GAS
aagaagaauuaacguuc

SEQ ID NO: 2215043 - RNA, 23 nt, Streptococcus pyogenes M1 GAS
aagaagaauuaacguuccaaaaa

SEQ ID NO: 2215044 - RNA, 23 nt, Streptococcus pyogenes M1 GAS
aagaacuccuggauuaaaugccc

SEQ ID NO: 2215045 - RNA, 11 nt, Streptococcus pyogenes M1 GAS
aagaaaaccuu

SEQ ID NO: 2215046 - RNA, 18 nt, Streptococcus pyogenes M1 GAS
aacuugggagaguuccug

SEQ ID NO: 2215047 - RNA, 22 nt, Streptococcus pyogenes M1 GAS
aacuugcaucgcaaacagaugc

SEQ ID NO: 2215048 - RNA, 24 nt, Streptococcus pyogenes M1 GAS
aagaaauuacuuggaucuucuucu

SEQ ID NO: 2215049 - RNA, 17 nt, Streptococcus pyogenes M1 GAS
aacuucaaauuucauga

SEQ ID NO: 2215050 - RNA, 22 nt, Streptococcus pyogenes M1 GAS
aacugguccaucauugaugaga

SEQ ID NO: 2215051 - RNA, 17 nt, Streptococcus pyogenes M1 GAS
aacuguuuuucuuauau

SEQ ID NO: 2215052 - RNA, 21 nt, Streptococcus pyogenes M1 GAS
aacuguuuuucuuauauugug

SEQ ID NO: 2215053 - RNA, 14 nt, Streptococcus pyogenes M1 GAS
aacuuacaaaaagc

SEQ ID NO: 2215054 - RNA, 15 nt, Streptococcus pyogenes M1 GAS
aacucaaaccaaaca

SEQ ID NO: 2215055 - RNA, 19 nt, Streptococcus pyogenes M1 GAS
aacuauuucacuuaucauu

SEQ ID NO: 2215056 - RNA, 18 nt, Streptococcus pyogenes M1 GAS
aacucaaaaaauacaaua

SEQ ID NO: 2215057 - RNA, 19 nt, Streptococcus pyogenes M1 GAS
aacuggcacaaacucugcc

SEQ ID NO: 2215058 - RNA, 17 nt, Streptococcus pyogenes M1 GAS
aacguaauagaauaaaa

SEQ ID NO: 2215059 - RNA, 17 nt, Streptococcus pyogenes M1 GAS
aacguuauuaaagacaa

SEQ ID NO: 2215060 - RNA, 15 nt, Streptococcus pyogenes M1 GAS
aacguuaacaaaaau

SEQ ID NO: 2215061 - RNA, 14 nt, Streptococcus pyogenes M1 GAS
aacguuccaaaaag

SEQ ID NO: 2215062 - RNA, 22 nt, Streptococcus pyogenes M1 GAS
aacgguaucacucguaaaaaga

SEQ ID NO: 2215063 - RNA, 14 nt, Streptococcus pyogenes M1 GAS
aacgaucaaaaauc

SEQ ID NO: 2215064 - RNA, 18 nt, Streptococcus pyogenes M1 GAS
aaggagauaggaaacuca

SEQ ID NO: 2215065 - RNA, 13 nt, Streptococcus pyogenes M1 GAS
aaggaguuuuaua

SEQ ID NO: 2215066 - RNA, 18 nt, Streptococcus pyogenes M1 GAS
aaggaguuuuauagcuga

SEQ ID NO: 2215067 - RNA, 15 nt, Streptococcus pyogenes M1 GAS
aagcugagcaaaaca

SEQ ID NO: 2215068 - RNA, 21 nt, Streptococcus pyogenes M1 GAS
aagcguugacaguuaaaaaua

SEQ ID NO: 2215069 - RNA, 21 nt, Streptococcus pyogenes M1 GAS
aagggugaaucguuacuccuu

SEQ ID NO: 2215070 - RNA, 19 nt, Streptococcus pyogenes M1 GAS
aagggauaauaaagugcgc

SEQ ID NO: 2215071 - RNA, 15 nt, Streptococcus pyogenes M1 GAS
aaggauuuagcuguu

SEQ ID NO: 2215072 - RNA, 17 nt, Streptococcus pyogenes M1 GAS
aaggucaucagaauaag

SEQ ID NO: 2215073 - RNA, 16 nt, Streptococcus pyogenes M1 GAS
aagcaugggcuaagua

SEQ ID NO: 2215074 - RNA, 12 nt, Streptococcus pyogenes M1 GAS
aagcauuuugag

SEQ ID NO: 2215075 - RNA, 23 nt, Streptococcus pyogenes M1 GAS
aagcauuuguuuugauaaaaaac

SEQ ID NO: 2215076 - RNA, 14 nt, Streptococcus pyogenes M1 GAS
aagccaaaucuucu

SEQ ID NO: 2215077 - RNA, 22 nt, Streptococcus pyogenes M1 GAS
aagccagagcaguucagcagca

SEQ ID NO: 2215078 - RNA, 18 nt, Streptococcus pyogenes M1 GAS
aagcccguuagucugcug

SEQ ID NO: 2215079 - RNA, 16 nt, Streptococcus pyogenes M1 GAS
aagcagugcuuuaaca

SEQ ID NO: 2215080 - RNA, 19 nt, Streptococcus pyogenes M1 GAS
aagcagugcuuuaacaaug

SEQ ID NO: 2215081 - RNA, 21 nt, Streptococcus pyogenes M1 GAS
aagcaguuucccauguuuuau

SEQ ID NO: 2215082 - RNA, 13 nt, Streptococcus pyogenes M1 GAS
aagcauaaaaaua

SEQ ID NO: 2215083 - RNA, 17 nt, Streptococcus pyogenes M1 GAS
aagcaaucuaagaauug

SEQ ID NO: 2215084 - RNA, 13 nt, Streptococcus pyogenes M1 GAS
aagcaaucuaaga

SEQ ID NO: 2215085 - RNA, 21 nt, Streptococcus pyogenes M1 GAS
aagauggugacucuguuccua

SEQ ID NO: 2215086 - RNA, 20 nt, Streptococcus pyogenes M1 GAS
aagauguggcuaguaaguuu

SEQ ID NO: 2215087 - RNA, 21 nt, Streptococcus pyogenes M1 GAS
aagauguuuacgcuuuacauu

SEQ ID NO: 2215088 - RNA, 17 nt, Streptococcus pyogenes M1 GAS
aauacuagaaaaagcaa

SEQ ID NO: 2215089 - RNA, 21 nt, Streptococcus pyogenes M1 GAS
aauacuagaaaaagcaaugau

SEQ ID NO: 2215090 - RNA, 19 nt, Streptococcus pyogenes M1 GAS
aauacuagaaaaagcaaug

SEQ ID NO: 2215091 - RNA, 20 nt, Streptococcus pyogenes M1 GAS
aauacuagaaaaagcaauga

SEQ ID NO: 2215092 - RNA, 22 nt, Streptococcus pyogenes M1 GAS
aauacuccguuucuaguuucau

SEQ ID NO: 2215093 - RNA, 19 nt, Streptococcus pyogenes M1 GAS
aauaccguagaaaguagca

SEQ ID NO: 2215094 - RNA, 15 nt, Streptococcus pyogenes M1 GAS
aauacguaaaaagag

SEQ ID NO: 2215095 - RNA, 18 nt, Streptococcus pyogenes M1 GAS
aauacguaaaaagagaag

SEQ ID NO: 2215096 - RNA, 17 nt, Streptococcus pyogenes M1 GAS
aauacgcuucuaugugg

SEQ ID NO: 2215097 - RNA, 18 nt, Streptococcus pyogenes M1 GAS
aaaaauacuagaaaaagc

SEQ ID NO: 2215098 - RNA, 20 nt, Streptococcus pyogenes M1 GAS
aauacagccguucuuaaaag

SEQ ID NO: 2215099 - RNA, 23 nt, Streptococcus pyogenes M1 GAS
aagugugacuaguuuauuacaaa

SEQ ID NO: 2215100 - RNA, 15 nt, Streptococcus pyogenes M1 GAS
aaguuaggaaagaua

SEQ ID NO: 2215101 - RNA, 16 nt, Streptococcus pyogenes M1 GAS
aaguuauaaagaaaca

SEQ ID NO: 2215102 - RNA, 19 nt, Streptococcus pyogenes M1 GAS
aaguucuaaacuuaugauu

SEQ ID NO: 2215103 - RNA, 20 nt, Streptococcus pyogenes M1 GAS
aaguugccuuaucucaguuu

SEQ ID NO: 2215104 - RNA, 16 nt, Streptococcus pyogenes M1 GAS
aaguuggcuacucuau

SEQ ID NO: 2215105 - RNA, 15 nt, Streptococcus pyogenes M1 GAS
aaguucuuugccuuu

SEQ ID NO: 2215106 - RNA, 11 nt, Streptococcus pyogenes M1 GAS
aaguucuuugc

SEQ ID NO: 2215107 - RNA, 14 nt, Streptococcus pyogenes M1 GAS
aagugauauacuga

SEQ ID NO: 2215108 - RNA, 22 nt, Streptococcus pyogenes M1 GAS
aauaacagaaauuaauaaauuu

SEQ ID NO: 2215109 - RNA, 12 nt, Streptococcus pyogenes M1 GAS
aauaacaucaaa

SEQ ID NO: 2215110 - RNA, 13 nt, Streptococcus pyogenes M1 GAS
aauaacaucaaag

SEQ ID NO: 2215111 - RNA, 17 nt, Streptococcus pyogenes M1 GAS
aauaaagugcgcuucca

SEQ ID NO: 2215112 - RNA, 22 nt, Streptococcus pyogenes M1 GAS
aauaaagcguugacaguuaaaa

SEQ ID NO: 2215113 - RNA, 14 nt, Streptococcus pyogenes M1 GAS
aauaaaauagcacc

SEQ ID NO: 2215114 - RNA, 15 nt, Streptococcus pyogenes M1 GAS
aauaaaauagcaccu

SEQ ID NO: 2215115 - RNA, 19 nt, Streptococcus pyogenes M1 GAS
aauaaaaucguuauuaauu

SEQ ID NO: 2215116 - RNA, 21 nt, Streptococcus pyogenes M1 GAS
aaguuuucucagagacaauaa

SEQ ID NO: 2215117 - RNA, 16 nt, Streptococcus pyogenes M1 GAS
cggaaauugaccaaaa

SEQ ID NO: 2215118 - RNA, 17 nt, Streptococcus pyogenes M1 GAS
cgcuaagggaaaaauua

SEQ ID NO: 2215119 - RNA, 19 nt, Streptococcus pyogenes M1 GAS
cgauaaaaacgaucaaaaa

SEQ ID NO: 2215120 - RNA, 18 nt, Streptococcus pyogenes M1 GAS
cgauaaucuuugacaaug

SEQ ID NO: 2215121 - RNA, 18 nt, Streptococcus pyogenes M1 GAS
cgacucaugauaucccau

SEQ ID NO: 2215122 - RNA, 20 nt, Streptococcus pyogenes M1 GAS
aaacgcuauaccuaaaaaau

SEQ ID NO: 2215123 - RNA, 13 nt, Streptococcus pyogenes M1 GAS
cgcaccuccaccg

SEQ ID NO: 2215124 - RNA, 21 nt, Streptococcus pyogenes M1 GAS
cgauuugcugagcuaaagcca

SEQ ID NO: 2215125 - RNA, 20 nt, Streptococcus pyogenes M1 GAS
aaacguguauucuuaaaaaa

SEQ ID NO: 2215126 - RNA, 22 nt, Streptococcus pyogenes M1 GAS
aaacguuauuaaagacaaaaaa

SEQ ID NO: 2215127 - RNA, 22 nt, Streptococcus pyogenes M1 GAS
aaacguguauucuuaaaaaaau

SEQ ID NO: 2215128 - RNA, 15 nt, Streptococcus pyogenes M1 GAS
ccguacaaucaggac

SEQ ID NO: 2215129 - RNA, 22 nt, Streptococcus pyogenes M1 GAS
ccgguuucuugccuuuauauuu

SEQ ID NO: 2215130 - RNA, 16 nt, Streptococcus pyogenes M1 GAS
ccgucuggaaggcaca

SEQ ID NO: 2215131 - RNA, 15 nt, Streptococcus pyogenes M1 GAS
ccggcucuaaaauau

SEQ ID NO: 2215132 - RNA, 17 nt, Streptococcus pyogenes M1 GAS
ccgcuauaacaguucca

SEQ ID NO: 2215133 - RNA, 17 nt, Streptococcus pyogenes M1 GAS
ccucugaaggcacagcc

SEQ ID NO: 2215134 - RNA, 19 nt, Streptococcus pyogenes M1 GAS
ccucgcuaucaaagcugac

SEQ ID NO: 2215135 - RNA, 19 nt, Streptococcus pyogenes M1 GAS
ccuaugcuaacugauaaaa

SEQ ID NO: 2215136 - RNA, 20 nt, Streptococcus pyogenes M1 GAS
ccuaugcuaacugauaaaac

SEQ ID NO: 2215137 - RNA, 12 nt, Streptococcus pyogenes M1 GAS
ccgugaggacuu

SEQ ID NO: 2215138 - RNA, 18 nt, Streptococcus pyogenes M1 GAS
ccgugaggacuuauuuuu

SEQ ID NO: 2215139 - RNA, 12 nt, Streptococcus pyogenes M1 GAS
ccugaggcaaug

SEQ ID NO: 2215140 - RNA, 17 nt, Streptococcus pyogenes M1 GAS
ccugauaaugauuuauu

SEQ ID NO: 2215141 - RNA, 16 nt, Streptococcus pyogenes M1 GAS
ccucuuuagaauucuu

SEQ ID NO: 2215142 - RNA, 17 nt, Streptococcus pyogenes M1 GAS
ccugaucccuucauuuu

SEQ ID NO: 2215143 - RNA, 17 nt, Streptococcus pyogenes M1 GAS
ccuuuuugccuuuaaca

SEQ ID NO: 2215144 - RNA, 22 nt, Streptococcus pyogenes M1 GAS
ccuuuuuggugucagcauaaag

SEQ ID NO: 2215145 - RNA, 21 nt, Streptococcus pyogenes M1 GAS
ccuugauuaauagcgccagca

SEQ ID NO: 2215146 - RNA, 23 nt, Streptococcus pyogenes M1 GAS
ccuucguauuggccuucuuggaa

SEQ ID NO: 2215147 - RNA, 20 nt, Streptococcus pyogenes M1 GAS
ccuuaggcagacaauuauuu

SEQ ID NO: 2215148 - RNA, 23 nt, Streptococcus pyogenes M1 GAS
ccugucaacuuaccagcaccuuc

SEQ ID NO: 2215149 - RNA, 23 nt, Streptococcus pyogenes M1 GAS
aaaccaagugccaguaaggaaau

SEQ ID NO: 2215150 - RNA, 13 nt, Streptococcus pyogenes M1 GAS
aaacagaaauacu

SEQ ID NO: 2215151 - RNA, 13 nt, Streptococcus pyogenes M1 GAS
aaacaccugcugc

SEQ ID NO: 2215152 - RNA, 15 nt, Streptococcus pyogenes M1 GAS
ccaugcucauaggca

SEQ ID NO: 2215153 - RNA, 16 nt, Streptococcus pyogenes M1 GAS
ccaucaucgaguggau

SEQ ID NO: 2215154 - RNA, 22 nt, Streptococcus pyogenes M1 GAS
ccaugauugauuuuagcggcac

SEQ ID NO: 2215155 - RNA, 23 nt, Streptococcus pyogenes M1 GAS
ccaugauuuucaucgugacaaca

SEQ ID NO: 2215156 - RNA, 15 nt, Streptococcus pyogenes M1 GAS
ccauagaagccaauu

SEQ ID NO: 2215157 - RNA, 11 nt, Streptococcus pyogenes M1 GAS
ccauagaagcc

SEQ ID NO: 2215158 - RNA, 18 nt, Streptococcus pyogenes M1 GAS
ccauaauaucagcuacac

SEQ ID NO: 2215159 - RNA, 19 nt, Streptococcus pyogenes M1 GAS
ccaucaagacacccccugc

SEQ ID NO: 2215160 - RNA, 17 nt, Streptococcus pyogenes M1 GAS
ccagcugacagccucuu

SEQ ID NO: 2215161 - RNA, 22 nt, Streptococcus pyogenes M1 GAS
ccagcgucugauauugaucucu

SEQ ID NO: 2215162 - RNA, 20 nt, Streptococcus pyogenes M1 GAS
cauuucgugucuaaaauaau

SEQ ID NO: 2215163 - RNA, 15 nt, Streptococcus pyogenes M1 GAS
cauuuccuacaaaau

SEQ ID NO: 2215164 - RNA, 22 nt, Streptococcus pyogenes M1 GAS
cauuucuugaggugauucuuuu

SEQ ID NO: 2215165 - RNA, 15 nt, Streptococcus pyogenes M1 GAS
cauuucuuugcaaaa

SEQ ID NO: 2215166 - RNA, 11 nt, Streptococcus pyogenes M1 GAS
cauuucuucag

SEQ ID NO: 2215167 - RNA, 17 nt, Streptococcus pyogenes M1 GAS
cauuucuucagguuucu

SEQ ID NO: 2215168 - RNA, 15 nt, Streptococcus pyogenes M1 GAS
cauugucaaauaaaa

SEQ ID NO: 2215169 - RNA, 17 nt, Streptococcus pyogenes M1 GAS
cauugucaaauaaaauc

SEQ ID NO: 2215170 - RNA, 13 nt, Streptococcus pyogenes M1 GAS
cauugcuuuuuau

SEQ ID NO: 2215171 - RNA, 22 nt, Streptococcus pyogenes M1 GAS
cauucguucuaguuuaggauau

SEQ ID NO: 2215172 - RNA, 13 nt, Streptococcus pyogenes M1 GAS
cauuagcuuuuuu

SEQ ID NO: 2215173 - RNA, 13 nt, Streptococcus pyogenes M1 GAS
cauuauaaaagag

SEQ ID NO: 2215174 - RNA, 17 nt, Streptococcus pyogenes M1 GAS
cauguguuguuagggua

SEQ ID NO: 2215175 - RNA, 19 nt, Streptococcus pyogenes M1 GAS
cauuaaggauuaugaaaaa

SEQ ID NO: 2215176 - RNA, 18 nt, Streptococcus pyogenes M1 GAS
cauuaaggauuaugaaaa

SEQ ID NO: 2215177 - RNA, 15 nt, Streptococcus pyogenes M1 GAS
cauuaauaauauuaa

SEQ ID NO: 2215178 - RNA, 17 nt, Streptococcus pyogenes M1 GAS
cauuaccuuauuuucua

SEQ ID NO: 2215179 - RNA, 15 nt, Streptococcus pyogenes M1 GAS
cauggaguccuuuuu

SEQ ID NO: 2215180 - RNA, 14 nt, Streptococcus pyogenes M1 GAS
caugggaaaagcua

SEQ ID NO: 2215181 - RNA, 20 nt, Streptococcus pyogenes M1 GAS
ccaagugccaguaaggaaau

SEQ ID NO: 2215182 - RNA, 16 nt, Streptococcus pyogenes M1 GAS
ccaagugccaguaagg

SEQ ID NO: 2215183 - RNA, 21 nt, Streptococcus pyogenes M1 GAS
ccaagcuugaucuuacaaagg

SEQ ID NO: 2215184 - RNA, 16 nt, Streptococcus pyogenes M1 GAS
caucuaaaaaagcaau

SEQ ID NO: 2215185 - RNA, 17 nt, Streptococcus pyogenes M1 GAS
caucuacagcaccuuca

SEQ ID NO: 2215186 - RNA, 12 nt, Streptococcus pyogenes M1 GAS
caucauauuguu

SEQ ID NO: 2215187 - RNA, 18 nt, Streptococcus pyogenes M1 GAS
caucaggcuuaaacauau

SEQ ID NO: 2215188 - RNA, 19 nt, Streptococcus pyogenes M1 GAS
caucaucaagaauagcuuu

SEQ ID NO: 2215189 - RNA, 13 nt, Streptococcus pyogenes M1 GAS
caucauauuguua

SEQ ID NO: 2215190 - RNA, 20 nt, Streptococcus pyogenes M1 GAS
caucaucaagaauagcuuuu

SEQ ID NO: 2215191 - RNA, 22 nt, Streptococcus pyogenes M1 GAS
caucaucgaguggauacaaggu

SEQ ID NO: 2215192 - RNA, 18 nt, Streptococcus pyogenes M1 GAS
caucagaauaagaaaacc

SEQ ID NO: 2215193 - RNA, 12 nt, Streptococcus pyogenes M1 GAS
caucagcucuug

SEQ ID NO: 2215194 - RNA, 11 nt, Streptococcus pyogenes M1 GAS
cauaucucuau

SEQ ID NO: 2215195 - RNA, 22 nt, Streptococcus pyogenes M1 GAS
cauaugauggaucguuuugcaa

SEQ ID NO: 2215196 - RNA, 14 nt, Streptococcus pyogenes M1 GAS
caucaaaaagagga

SEQ ID NO: 2215197 - RNA, 17 nt, Streptococcus pyogenes M1 GAS
caucaaaagaccauaaa

SEQ ID NO: 2215198 - RNA, 21 nt, Streptococcus pyogenes M1 GAS
caucaaaagaccauaaaaaac

SEQ ID NO: 2215199 - RNA, 20 nt, Streptococcus pyogenes M1 GAS
caucaagaauagcuuuugua

SEQ ID NO: 2215200 - RNA, 21 nt, Streptococcus pyogenes M1 GAS
caucaagaauagcuuuuguaa

SEQ ID NO: 2215201 - RNA, 21 nt, Streptococcus pyogenes M1 GAS
caucaagacacccccugcugu

SEQ ID NO: 2215202 - RNA, 14 nt, Streptococcus pyogenes M1 GAS
cauaacaaauuuau

SEQ ID NO: 2215203 - RNA, 12 nt, Streptococcus pyogenes M1 GAS
cauaaaacugug

SEQ ID NO: 2215204 - RNA, 20 nt, Streptococcus pyogenes M1 GAS
cauacaacugacuagccaaa

SEQ ID NO: 2215205 - RNA, 21 nt, Streptococcus pyogenes M1 GAS
cauacaacugacuagccaaau

SEQ ID NO: 2215206 - RNA, 20 nt, Streptococcus pyogenes M1 GAS
cauaaaaaaccuuaucaaac

SEQ ID NO: 2215207 - RNA, 12 nt, Streptococcus pyogenes M1 GAS
caguuuuuucug

SEQ ID NO: 2215208 - RNA, 21 nt, Streptococcus pyogenes M1 GAS
caguuucccauguuuuauuac

SEQ ID NO: 2215209 - RNA, 16 nt, Streptococcus pyogenes M1 GAS
caguuucccauguuuu

SEQ ID NO: 2215210 - RNA, 18 nt, Streptococcus pyogenes M1 GAS
caguugcuugcuuuuuuc

SEQ ID NO: 2215211 - RNA, 23 nt, Streptococcus pyogenes M1 GAS
caguucugagauauucauuuucu

SEQ ID NO: 2215212 - RNA, 20 nt, Streptococcus pyogenes M1 GAS
cagugggcuuuuuuguguuc

SEQ ID NO: 2215213 - RNA, 19 nt, Streptococcus pyogenes M1 GAS
caguguacucaucuaaaaa

SEQ ID NO: 2215214 - RNA, 15 nt, Streptococcus pyogenes M1 GAS
aaaaugacugacaaa

SEQ ID NO: 2215215 - RNA, 19 nt, Streptococcus pyogenes M1 GAS
cagaucauuaaauugauua

SEQ ID NO: 2215216 - RNA, 18 nt, Streptococcus pyogenes M1 GAS
cagcaccuucaaccgcuu

SEQ ID NO: 2215217 - RNA, 19 nt, Streptococcus pyogenes M1 GAS
cagcagcacuggcuuuuuu

SEQ ID NO: 2215218 - RNA, 17 nt, Streptococcus pyogenes M1 GAS
cagaguacuucugcagu

SEQ ID NO: 2215219 - RNA, 15 nt, Streptococcus pyogenes M1 GAS
cagaguacaaggcaa

SEQ ID NO: 2215220 - RNA, 20 nt, Streptococcus pyogenes M1 GAS
aaaaucacaccauuaaaaaa

SEQ ID NO: 2215221 - RNA, 12 nt, Streptococcus pyogenes M1 GAS
cagaauaaagaa

SEQ ID NO: 2215222 - RNA, 17 nt, Streptococcus pyogenes M1 GAS
cagaauaagaaaaccuu

SEQ ID NO: 2215223 - RNA, 15 nt, Streptococcus pyogenes M1 GAS
cagaacucgucuuua

SEQ ID NO: 2215224 - RNA, 21 nt, Streptococcus pyogenes M1 GAS
cagaacucgucuuuauccauu

SEQ ID NO: 2215225 - RNA, 22 nt, Streptococcus pyogenes M1 GAS
cacuacucguuacauaaaauga

SEQ ID NO: 2215226 - RNA, 20 nt, Streptococcus pyogenes M1 GAS
cacuaggccuagcuuuuuac

SEQ ID NO: 2215227 - RNA, 13 nt, Streptococcus pyogenes M1 GAS
cacuaaaaccauu

SEQ ID NO: 2215228 - RNA, 20 nt, Streptococcus pyogenes M1 GAS
cacuaaaaccauuauaaaag

SEQ ID NO: 2215229 - RNA, 14 nt, Streptococcus pyogenes M1 GAS
cacuaccuuaaaug

SEQ ID NO: 2215230 - RNA, 13 nt, Streptococcus pyogenes M1 GAS
cacucgugcugcc

SEQ ID NO: 2215231 - RNA, 19 nt, Streptococcus pyogenes M1 GAS
aaaauuccccacaaaagac

SEQ ID NO: 2215232 - RNA, 16 nt, Streptococcus pyogenes M1 GAS
cagcgucugauauuga

SEQ ID NO: 2215233 - RNA, 12 nt, Streptococcus pyogenes M1 GAS
aaacaaaaagag

SEQ ID NO: 2215234 - RNA, 16 nt, Streptococcus pyogenes M1 GAS
caggauugccaucaau

SEQ ID NO: 2215235 - RNA, 23 nt, Streptococcus pyogenes M1 GAS
cagcuucuacgggauuuaguucu

SEQ ID NO: 2215236 - RNA, 13 nt, Streptococcus pyogenes M1 GAS
cagcugaaacacc

SEQ ID NO: 2215237 - RNA, 19 nt, Streptococcus pyogenes M1 GAS
cagcugaaacaccugcugc

SEQ ID NO: 2215238 - RNA, 20 nt, Streptococcus pyogenes M1 GAS
cagcugaaacaccugcugcu

SEQ ID NO: 2215239 - RNA, 13 nt, Streptococcus pyogenes M1 GAS
cagcuaaaagcau

SEQ ID NO: 2215240 - RNA, 16 nt, Streptococcus pyogenes M1 GAS
cagcugcuugaaaaga

SEQ ID NO: 2215241 - RNA, 15 nt, Streptococcus pyogenes M1 GAS
cagcugcuugaaaag

SEQ ID NO: 2215242 - RNA, 21 nt, Human
uuauugucuagugaaacucgu

SEQ ID NO: 2215243 - RNA, 12 nt, Human
ugauaugccuuu

SEQ ID NO: 2215244 - RNA, 15 nt, Human
ucaggaggaaggcuu

SEQ ID NO: 2215245 - RNA, 12 nt, Human
ucaccucaugga

SEQ ID NO: 2215246 - RNA, 22 nt, Human
uguuggagaagaacugaaauca

SEQ ID NO: 2215247 - RNA, 20 nt, Human
uauauuuacaaaugggaaac

SEQ ID NO: 2215248 - RNA, 13 nt, Human
uaacuggaaacuu

SEQ ID NO: 2215249 - RNA, 10 nt, Human
uaaaauggug

SEQ ID NO: 2215250 - RNA, 22 nt, Human
cuugauaaauggcuuccuggca

SEQ ID NO: 2215251 - RNA, 18 nt, Human
gaaauuguauuacaaauc

SEQ ID NO: 2215252 - RNA, 15 nt, Human
ccuuaccugggaaag

SEQ ID NO: 2215253 - RNA, 16 nt, Human
uucucaacuccaaacu

SEQ ID NO: 2215254 - RNA, 21 nt, Human
cugauauuggacaguaaaauc

SEQ ID NO: 2215255 - RNA, 15 nt, Human
cgaggauugggaaaa

SEQ ID NO: 2215256 - RNA, 15 nt, Human
aaauugacacuuaaa

SEQ ID NO: 2215257 - RNA, 14 nt, Human
aaaaccacuggaaa

SEQ ID NO: 2215258 - RNA, 16 nt, Human
uccagauccuggaaau

SEQ ID NO: 2215259 - RNA, 16 nt, Human
uaagcuucacuguaaa

SEQ ID NO: 2215260 - RNA, 18 nt, Human
gucaauaaaauccauaca

SEQ ID NO: 2215261 - RNA, 19 nt, Human
cuaaacaaagagugaagga

SEQ ID NO: 2215262 - RNA, 14 nt, Human
ggaauuuaaaaauc

SEQ ID NO: 2215263 - RNA, 13 nt, Human
ggacaguaaaauc

SEQ ID NO: 2215264 - RNA, 16 nt, Human
cacaauacaucccuua

SEQ ID NO: 2215265 - RNA, 16 nt, Human
accuagggugauauua

SEQ ID NO: 2215266 - RNA, 15 nt, Human
aacaauaacgauaaa

SEQ ID NO: 2215267 - RNA, 15 nt, Human
aauucacuccacuug

SEQ ID NO: 2215268 - RNA, 19 nt, Human
aauuccacuuauaggaauu

SEQ ID NO: 2215269 - RNA, 16 nt, Human
uauuucuaugaaauau

SEQ ID NO: 2215270 - RNA, 21 nt, Human
uaauuuuuauauuugaaauau

SEQ ID NO: 2215271 - RNA, 15 nt, Human
acauuugcucaugga

SEQ ID NO: 2215272 - RNA, 18 nt, Human
acagugaccauacuaauu

SEQ ID NO: 2215273 - RNA, 11 nt, Human
aguugauaugc

SEQ ID NO: 2215274 - RNA, 11 nt, Human
aggauggcuag

SEQ ID NO: 2215275 - RNA, 16 nt, Human
auuauauuuacaaaug

SEQ ID NO: 2215276 - RNA, 16 nt, Human
aaagcagggacuugaa

SEQ ID NO: 2215277 - RNA, 22 nt, Human
aaagcaucacaugaacuuguaa

SEQ ID NO: 2215278 - RNA, 15 nt, Human
aaagaaaauaacgau

SEQ ID NO: 2215279 - RNA, 14 nt, Human
aaaauaacgauaaa

SEQ ID NO: 2215280 - RNA, 18 nt, Human
aauuccaagugauugaaa

SEQ ID NO: 2215281 - RNA, 22 nt, Human
aaucguguccccuauccuacuu

SEQ ID NO: 2215282 - RNA, 22 nt, Human
acaacacggacgaaccuugaaa

SEQ ID NO: 2215283 - RNA, 16 nt, Human
acacuuaaaaaugguu

SEQ ID NO: 2215284 - RNA, 13 nt, Human
aaugaauggcuaa

SEQ ID NO: 2215285 - RNA, 18 nt, Human
aaugccacuaaauugaca

SEQ ID NO: 2215286 - RNA, 12 nt, Human
aaucacuugaac

SEQ ID NO: 2215287 - RNA, 16 nt, Human
agaaaacaauaacgau

SEQ ID NO: 2215288 - RNA, 15 nt, Human
aagugaaaaucuaca

SEQ ID NO: 2215289 - RNA, 15 nt, Human
ggugagcuacaaaug

SEQ ID NO: 2215290 - RNA, 14 nt, Human
gaaagcagggacuu

SEQ ID NO: 2215291 - RNA, 15 nt, Human
cagggacuugaaccc

SEQ ID NO: 2215292 - RNA, 22 nt, Human
cauauuuguacaccaauauuca

SEQ ID NO: 2215293 - RNA, 18 nt, Human
caugauccugcaauucca

SEQ ID NO: 2215294 - RNA, 22 nt, Human
augagaacucugagcagugcuu

SEQ ID NO: 2215295 - RNA, 18 nt, Human
auccugaggcuccacuug

SEQ ID NO: 2215296 - RNA, 13 nt, Human
aucacuugaaccc

SEQ ID NO: 2215297 - RNA, 16 nt, Human
agugccuguaaucaca

SEQ ID NO: 2215298 - RNA, 15 nt, Human
aggacacugauaugg

SEQ ID NO: 2215299 - RNA, 14 nt, Human
cgucccccucuggc

SEQ ID NO: 2215300 - RNA, 21 nt, Human
acaguuaccucugccucagaa

SEQ ID NO: 2215301 - RNA, 14 nt, Human
aaaagaaagaaaau

SEQ ID NO: 2215302 - RNA, 19 nt, Human
aaacaccucagcugccucc

SEQ ID NO: 2215303 - RNA, 13 nt, Human
agggagggaaggg

SEQ ID NO: 2215304 - RNA, 21 nt, Human
auucauagcagcuuauucaca

SEQ ID NO: 2215305 - RNA, 18 nt, Human
gccugagcgacagugaga

SEQ ID NO: 2215306 - RNA, 22 nt, Human
cuuguaaaggaauuuaaaaauc

SEQ ID NO: 2215307 - RNA, 19 nt, Human
uguauacugugugcuaaaa

SEQ ID NO: 2215308 - RNA, 15 nt, Human
cuaggugcugcagcc

SEQ ID NO: 2215309 - RNA, 15 nt, Human
ccagcacagccucuu

SEQ ID NO: 2215310 - RNA, 20 nt, Human
uaugcuucuguuuuauaauu

SEQ ID NO: 2215311 - RNA, 20 nt, Human
uccagagggaauugcagagu

SEQ ID NO: 2215312 - RNA, 12 nt, Human
agacagugaaag

SEQ ID NO: 2215313 - RNA, 16 nt, Human
agaugcuagaacuccc

SEQ ID NO: 2215314 - RNA, 12 nt, Human
caugggaaguga

SEQ ID NO: 2215315 - RNA, 13 nt, Human
ucuuauaauuuaa

SEQ ID NO: 2215316 - RNA, 15 nt, Human
uuuaauaauuuuuaa

SEQ ID NO: 2215317 - RNA, 12 nt, Human
uugccugcaggc

SEQ ID NO: 2215318 - RNA, 21 nt, Human
uaauaggcguaacuaauuuua

SEQ ID NO: 2215319 - RNA, 15 nt, Human
acuuuauaaaggauu

SEQ ID NO: 2215320 - RNA, 15 nt, Human
caggcacccccagaa

SEQ ID NO: 2215321 - RNA, 14 nt, Human
uccacuuggucugu

SEQ ID NO: 2215322 - RNA, 22 nt, Human
gucaagaagcaucgugucuggc

SEQ ID NO: 2215323 - RNA, 16 nt, Human
auuuguauaaaauaau

SEQ ID NO: 2215324 - RNA, 21 nt, Human
cuucuaaccugaacugauggg

SEQ ID NO: 2215325 - RNA, 14 nt, Human
aguuuuuuuuuaaa

SEQ ID NO: 2215326 - RNA, 23 nt, Human
gggccuaugcagagguccacaac

SEQ ID NO: 2215327 - RNA, 13 nt, Human
uccccagcucuau

SEQ ID NO: 2215328 - RNA, 22 nt, Human
aacucccugccccccagcccuc

SEQ ID NO: 2215329 - RNA, 20 nt, Human
acuagaguuuagcuggaaaa

SEQ ID NO: 2215330 - RNA, 12 nt, Human
guagacacacau

SEQ ID NO: 2215331 - RNA, 15 nt, Human
uaggaaauauuuauu

SEQ ID NO: 2215332 - RNA, 14 nt, Human
auccuugaagauuu

SEQ ID NO: 2215333 - RNA, 22 nt, Human
ucaacuccaaacugacucuuaa

SEQ ID NO: 2215334 - RNA, 11 nt, Human
caucuagugag

SEQ ID NO: 2215335 - RNA, 23 nt, Human
gaacaugagccuuuguugcuauc

SEQ ID NO: 2215336 - RNA, 15 nt, Human
ccccugagcuugcag

SEQ ID NO: 2215337 - RNA, 17 nt, Human
ucgggauuaguacacac

SEQ ID NO: 2215338 - RNA, 19 nt, Human
aaacaaaaggauaaugaau

SEQ ID NO: 2215339 - RNA, 17 nt, Human
augcagagguccacaac

SEQ ID NO: 2215340 - RNA, 16 nt, Human
gccuaagugcagcccc

SEQ ID NO: 2215341 - RNA, 19 nt, Human
ccccugcaaagcccagcuu

SEQ ID NO: 2215342 - RNA, 17 nt, Human
gaagaccucauuuugaa

SEQ ID NO: 2215343 - RNA, 16 nt, Human
auagucauucugccug

SEQ ID NO: 2215344 - RNA, 18 nt, Human
cuccagccugagcgacag

SEQ ID NO: 2215345 - RNA, 17 nt, Human
agggcauagaaguaaaa

SEQ ID NO: 2215346 - RNA, 22 nt, Human
cuccagagggaauugcagagua

SEQ ID NO: 2215347 - RNA, 23 nt, Human
agaaugauuaugaauuacauuug

SEQ ID NO: 2215348 - RNA, 19 nt, Human
auagucauucugccugccc

SEQ ID NO: 2215349 - RNA, 17 nt, Human
uccuacaagacacagug

SEQ ID NO: 2215350 - RNA, 13 nt, Human
cuccccagcucua

SEQ ID NO: 2215351 - RNA, 22 nt, Human
cugcucaauaaaguacaagagc

SEQ ID NO: 2215352 - RNA, 23 nt, Human
cuggccgggagccugaucaccug

SEQ ID NO: 2215353 - RNA, 15 nt, Human
ccagaaugaccuggc

SEQ ID NO: 2215354 - RNA, 20 nt, Human
caaauguucaucaaugaaug

SEQ ID NO: 2215355 - RNA, 12 nt, Human
gcucagcccugg

SEQ ID NO: 2215356 - RNA, 23 nt, Human
gcccuggugccucaccccuugcc

SEQ ID NO: 2215357 - RNA, 19 nt, Human
ugaaauggacuuuuguaca

SEQ ID NO: 2215358 - RNA, 17 nt, Human
ggugcugcagccccugg

SEQ ID NO: 2215359 - RNA, 18 nt, Human
ggaaagacagcuucucau

SEQ ID NO: 2215360 - RNA, 22 nt, Human
ccacagcuguaugauucccagc

SEQ ID NO: 2215361 - RNA, 13 nt, Human
ggcacccccagaa

SEQ ID NO: 2215362 - RNA, 23 nt, Human
aauauuuauuuuaauaauguuuc

SEQ ID NO: 2215363 - RNA, 12 nt, Human
aauacuuuauaa

SEQ ID NO: 2215364 - RNA, 16 nt, Human
aaacuaggugcugcag

SEQ ID NO: 2215365 - RNA, 13 nt, Human
uuccucugagccu

SEQ ID NO: 2215366 - RNA, 14 nt, Human
uuucuaugaaauau

SEQ ID NO: 2215367 - RNA, 18 nt, Human
caaucaguauucauauuu

SEQ ID NO: 2215368 - RNA, 13 nt, Human
aagacagugaaag

SEQ ID NO: 2215369 - RNA, 20 nt, Human
cacuagacccacuggacuca

SEQ ID NO: 2215370 - RNA, 18 nt, Human
uuuauguuuaauucugaa

SEQ ID NO: 2215371 - RNA, 23 nt, Human
aacuuuuccaaugacauuuuguu

SEQ ID NO: 2215372 - RNA, 14 nt, Human
acaagagcuuaaca

SEQ ID NO: 2215373 - RNA, 15 nt, Human
aagccuggcaaggga

SEQ ID NO: 2215374 - RNA, 13 nt, Human
uccugugggaccu

SEQ ID NO: 2215375 - RNA, 17 nt, Human
ccucagcugccucccca

SEQ ID NO: 2215376 - RNA, 15 nt, Human
cuaucuuugagcgcc

SEQ ID NO: 2215377 - RNA, 21 nt, Human
gaccaggcacccccagaauga

SEQ ID NO: 2215378 - RNA, 19 nt, Human
cugccccccagcccuccuu

SEQ ID NO: 2215379 - RNA, 14 nt, Human
guaacuaauuuuaa

SEQ ID NO: 2215380 - RNA, 21 nt, Human
cagagguccacaacacacaga

SEQ ID NO: 2215381 - RNA, 18 nt, Human
auuauuuuuuaaaaaaau

SEQ ID NO: 2215382 - RNA, 19 nt, Human
caauucuugccaaauauaa

SEQ ID NO: 2215383 - RNA, 13 nt, Human
gcagaacagugau

SEQ ID NO: 2215384 - RNA, 17 nt, Human
uugugaagcaaaauuuu

SEQ ID NO: 2215385 - RNA, 18 nt, Human
acagaaagcagaacagug

SEQ ID NO: 2215386 - RNA, 21 nt, Human
cucagugucaaugcagccccc

SEQ ID NO: 2215387 - RNA, 23 nt, Human
uagacacacaugaaguccaagca

SEQ ID NO: 2215388 - RNA, 19 nt, Human
aaguugcauagguuuaaua

SEQ ID NO: 2215389 - RNA, 19 nt, Human
ggaauuucuucaacucccu

SEQ ID NO: 2215390 - RNA, 22 nt, Human
acaccuuguacuuuauuuucua

SEQ ID NO: 2215391 - RNA, 14 nt, Human
cuccagugagacag

SEQ ID NO: 2215392 - RNA, 14 nt, Human
uaaaauccauacau

SEQ ID NO: 2215393 - RNA, 16 nt, Human
aacuugguuuuaauua

SEQ ID NO: 2215394 - RNA, 14 nt, Human
agaguacuggcuga

SEQ ID NO: 2215395 - RNA, 22 nt, Human
cuuuccacagaagcuccaggua

SEQ ID NO: 2215396 - RNA, 13 nt, Human
cucagaaaacaag

SEQ ID NO: 2215397 - RNA, 17 nt, Human
agacacacugaagaagc

SEQ ID NO: 2215398 - RNA, 14 nt, Human
cagauccccaagcc

SEQ ID NO: 2215399 - RNA, 12 nt, Human
acacugaagaag

SEQ ID NO: 2215400 - RNA, 16 nt, Human
auaaugaauacuuuau

SEQ ID NO: 2215401 - RNA, 13 nt, Human
gauggcaggaggc

SEQ ID NO: 2215402 - RNA, 13 nt, Human
auuuuaaaagaau

SEQ ID NO: 2215403 - RNA, 19 nt, Human
guaguccuguaauggaagc

SEQ ID NO: 2215404 - RNA, 17 nt, Human
aguugauaaguacauga

SEQ ID NO: 2215405 - RNA, 13 nt, Human
ccagcccuccuua

SEQ ID NO: 2215406 - RNA, 21 nt, Human
ccuuuuuuugaaaaaaagcuu

SEQ ID NO: 2215407 - RNA, 19 nt, Human
acuucagcgguuuauauaa

SEQ ID NO: 2215408 - RNA, 22 nt, Human
uauagccagguaccuucucacc

SEQ ID NO: 2215409 - RNA, 14 nt, Human
uaaaggaauuuaaa

SEQ ID NO: 2215410 - RNA, 22 nt, Human
cucagcccuggugggcagagag

SEQ ID NO: 2215411 - RNA, 22 nt, Human
uacugagagugaacaaauuuac

SEQ ID NO: 2215412 - RNA, 14 nt, Human
cuguaaucacagcu

SEQ ID NO: 2215413 - RNA, 13 nt, Human
agacacagugacc

SEQ ID NO: 2215414 - RNA, 21 nt, Human
augaauacuuuauaaaggauu

SEQ ID NO: 2215415 - RNA, 15 nt, Human
cuaagcaaaauguga

SEQ ID NO: 2215416 - RNA, 20 nt, Human
guucugcagauaaacaguag

SEQ ID NO: 2215417 - RNA, 21 nt, Human
caacacacagauuugagcuca

SEQ ID NO: 2215418 - RNA, 16 nt, Human
aaauauuuauuuuaau

SEQ ID NO: 2215419 - RNA, 20 nt, Human
aaagacaaggaaaaaauaac

SEQ ID NO: 2215420 - RNA, 18 nt, Human
acugugugcuaaaacaag

SEQ ID NO: 2215421 - RNA, 22 nt, Human
cuaagcuucacuguaaaauaau

SEQ ID NO: 2215422 - RNA, 15 nt, Human
ucugcagauaaacag

SEQ ID NO: 2215423 - RNA, 14 nt, Human
cacuaaacaaagag

SEQ ID NO: 2215424 - RNA, 22 nt, Human
ugccugagcggaccuucccagc

SEQ ID NO: 2215425 - RNA, 23 nt, Human
auucaauaucuuuuuuuuaauaa

SEQ ID NO: 2215426 - RNA, 15 nt, Human
gccagcccucuucug

SEQ ID NO: 2215427 - RNA, 14 nt, Human
accauuuuuacuug

SEQ ID NO: 2215428 - RNA, 20 nt, Human
caaauauaaauaaaaauaau

SEQ ID NO: 2215429 - RNA, 13 nt, Human
aacaagccuccuu

SEQ ID NO: 2215430 - RNA, 15 nt, Human
accuucccagcuaga

SEQ ID NO: 2215431 - RNA, 20 nt, Human
cccuuccuaauuccacagcu

SEQ ID NO: 2215432 - RNA, 23 nt, Human
cagaccgggguucccgugugccu

SEQ ID NO: 2215433 - RNA, 14 nt, Human
aaacuuuuccaaug

SEQ ID NO: 2215434 - RNA, 12 nt, Human
aagaaaauaaca

SEQ ID NO: 2215435 - RNA, 15 nt, Human
cauucugccugcccu

SEQ ID NO: 2215436 - RNA, 13 nt, Human
ccagcacagccuc

SEQ ID NO: 2215437 - RNA, 20 nt, Human
aaacuuuaugcuaagugaaa

SEQ ID NO: 2215438 - RNA, 17 nt, Human
auccugugggaccuggg

SEQ ID NO: 2215439 - RNA, 22 nt, Human
cagcccuggugggcagagaggu

SEQ ID NO: 2215440 - RNA, 21 nt, Human
gaaaacaauaacgauaaaaga

SEQ ID NO: 2215441 - RNA, 22 nt, Human
cucccacuagacaaguccagcc

SEQ ID NO: 2215442 - RNA, 20 nt, Human
agcuucacuguaaaauaaua

SEQ ID NO: 2215443 - RNA, 14 nt, Human
ugacacuaaaacac

SEQ ID NO: 2215444 - RNA, 21 nt, Human
ucaccugggcugaggcauccu

SEQ ID NO: 2215445 - RNA, 17 nt, Human
ucuggcguuguggggau

SEQ ID NO: 2215446 - RNA, 12 nt, Human
aacuuauuugua

SEQ ID NO: 2215447 - RNA, 15 nt, Human
agccucagucucccu

SEQ ID NO: 2215448 - RNA, 19 nt, Human
agucaaugaacuuuccaca

SEQ ID NO: 2215449 - RNA, 18 nt, Human
agucauucugccugcccu

SEQ ID NO: 2215450 - RNA, 16 nt, Human
gagaaacuggaacucu

SEQ ID NO: 2215451 - RNA, 20 nt, Human
aaugaauacuuuauaaagga

SEQ ID NO: 2215452 - RNA, 22 nt, Human
uauuucuaugaaauauuauguu

SEQ ID NO: 2215453 - RNA, 11 nt, Human
ggucacaggaa

SEQ ID NO: 2215454 - RNA, 20 nt, Human
cagccugagcgacagugaga

SEQ ID NO: 2215455 - RNA, 13 nt, Human
gccuccccagcuc

SEQ ID NO: 2215456 - RNA, 15 nt, Human
uaaaagacaaggaaa

SEQ ID NO: 2215457 - RNA, 15 nt, Human
ugagcucagcccugg

SEQ ID NO: 2215458 - RNA, 22 nt, Human
cuggcaaggguucaccugggcu

SEQ ID NO: 2215459 - RNA, 21 nt, Human
ccugagcggaccuucccagcu

SEQ ID NO: 2215460 - RNA, 12 nt, Human
uaagaagacugc

SEQ ID NO: 2215461 - RNA, 17 nt, Human
cuuccucugagccuugg

SEQ ID NO: 2215462 - RNA, 21 nt, Human
auccugugggaccugggccau

SEQ ID NO: 2215463 - RNA, 17 nt, Human
gaacucugagcagugcu

SEQ ID NO: 2215464 - RNA, 15 nt, Human
uugcucauggaauug

SEQ ID NO: 2215465 - RNA, 24 nt, Human
uaauuuaaaauaugcucuaaacau

SEQ ID NO: 2215466 - RNA, 16 nt, Human
gugcugcagccccugg

SEQ ID NO: 2215467 - RNA, 16 nt, Human
cucaauaaaguacaag

SEQ ID NO: 2215468 - RNA, 20 nt, Human
cugagccucagucucccucc

SEQ ID NO: 2215469 - RNA, 22 nt, Human
uggaaaguuuaugguuguauua

SEQ ID NO: 2215470 - RNA, 19 nt, Human
uccccuauccuacuucccc

SEQ ID NO: 2215471 - RNA, 14 nt, Human
aauauuauguuaaa

SEQ ID NO: 2215472 - RNA, 13 nt, Human
ccucuggcuccag

SEQ ID NO: 2215473 - RNA, 18 nt, Human
uacauuuguauaaaauaa

SEQ ID NO: 2215474 - RNA, 18 nt, Human
aucuacacuccagugaga

SEQ ID NO: 2215475 - RNA, 17 nt, Human
aaagcuccauuuuuagu

SEQ ID NO: 2215476 - RNA, 19 nt, Human
aauauuauguuaaaacugg

SEQ ID NO: 2215477 - RNA, 19 nt, Human
gcacacagcacgggggcca

SEQ ID NO: 2215478 - RNA, 20 nt, Human
cagguaccuucucaccugug

SEQ ID NO: 2215479 - RNA, 21 nt, Human
accaccugccuauauuuuuug

SEQ ID NO: 2215480 - RNA, 14 nt, Human
agagacagaaagca

SEQ ID NO: 2215481 - RNA, 18 nt, Human
ggggucagccagcccucu

SEQ ID NO: 2215482 - RNA, 14 nt, Human
cuaagcauuccaac

SEQ ID NO: 2215483 - RNA, 15 nt, Human
ccuugccaugugcua

SEQ ID NO: 2215484 - RNA, 12 nt, Human
cucccugccccc

SEQ ID NO: 2215485 - RNA, 20 nt, Human
uggaauaauccuaaacauau

SEQ ID NO: 2215486 - RNA, 20 nt, Human
gggaggcagagguugcagug

SEQ ID NO: 2215487 - RNA, 21 nt, Human
cagagucaaugaacuuuccac

SEQ ID NO: 2215488 - RNA, 18 nt, Human
acucuuaagaagacugca

SEQ ID NO: 2215489 - RNA, 20 nt, Human
agcccucuucugacacuaaa

SEQ ID NO: 2215490 - RNA, 19 nt, Human
ugaacaaauuuacagagac

SEQ ID NO: 2215491 - RNA, 20 nt, Human
aauaucuuuuuuuuaauaaa

SEQ ID NO: 2215492 - RNA, 22 nt, Human
gaagugaaaaucuacacuccag

SEQ ID NO: 2215493 - RNA, 18 nt, Human
cagugaaagaaaauaaca

SEQ ID NO: 2215494 - RNA, 17 nt, Human
uccacaacacacagauu

SEQ ID NO: 2215495 - RNA, 17 nt, Human
ugaacuugguuuuaauu

SEQ ID NO: 2215496 - RNA, 17 nt, Human
gccaugggacagggagg

SEQ ID NO: 2215497 - RNA, 16 nt, Human
uauuuuugugauuuug

SEQ ID NO: 2215498 - RNA, 14 nt, Human
ugcuguauuuuaaa

SEQ ID NO: 2215499 - RNA, 20 nt, Human
aggcugagaugggagaauca

SEQ ID NO: 2215500 - RNA, 22 nt, Human
uaaaacaagcacuaaacaaaga

SEQ ID NO: 2215501 - RNA, 17 nt, Human
uaaaagacaaggaaaaa

SEQ ID NO: 2215502 - RNA, 19 nt, Human
cgcccacuagacccacugg

SEQ ID NO: 2215503 - RNA, 13 nt, Human
uuauguuuaauuc

SEQ ID NO: 2215504 - RNA, 15 nt, Human
ggccuucggccucca

SEQ ID NO: 2215505 - RNA, 23 nt, Human
cuucaacucccugccccccagcc

SEQ ID NO: 2215506 - RNA, 15 nt, Human
augauaacuggaaac

SEQ ID NO: 2215507 - RNA, 22 nt, Human
accucagcugccuccccagcuc

SEQ ID NO: 2215508 - RNA, 19 nt, Human
aauuuuguuauguauauuu

SEQ ID NO: 2215509 - RNA, 12 nt, Human
acacuuaaaaau

SEQ ID NO: 2215510 - RNA, 19 nt, Human
ugagucccaggcugagccu

SEQ ID NO: 2215511 - RNA, 23 nt, Human
gaaaaaguucugcagauaaacag

SEQ ID NO: 2215512 - RNA, 20 nt, Human
aaggagccaaacauccuaca

SEQ ID NO: 2215513 - RNA, 21 nt, Human
cccugggaccaggcaccccca

SEQ ID NO: 2215514 - RNA, 18 nt, Human
acaaauccaaugaaauga

SEQ ID NO: 2215515 - RNA, 19 nt, Human
uuggcaagcucuaucacca

SEQ ID NO: 2215516 - RNA, 22 nt, Human
caaaugggaaacaaaaggauaa

SEQ ID NO: 2215517 - RNA, 21 nt, Human
aggacagcccuucuuuccaca

SEQ ID NO: 2215518 - RNA, 13 nt, Human
uuuaaaaaagaaa

SEQ ID NO: 2215519 - RNA, 20 nt, Human
accuacacgagauacagaau

SEQ ID NO: 2215520 - RNA, 19 nt, Human
agugaggagcuuugaaacg

SEQ ID NO: 2215521 - RNA, 23 nt, Human
aucgugucuggcguuguggggau

SEQ ID NO: 2215522 - RNA, 12 nt, Human
aaaauaacaaua

SEQ ID NO: 2215523 - RNA, 17 nt, Human
cuaagcuucacuguaaa

SEQ ID NO: 2215524 - RNA, 17 nt, Human
ccucagucucccucccu

SEQ ID NO: 2215525 - RNA, 16 nt, Human
auuuuaauaauguuuc

SEQ ID NO: 2215526 - RNA, 22 nt, Human
auauuuacaaaugggaaacaaa

SEQ ID NO: 2215527 - RNA, 14 nt, Human
caaggaaaaaauaa

SEQ ID NO: 2215528 - RNA, 19 nt, Human
agaugcuagaacucccuuu

SEQ ID NO: 2215529 - RNA, 15 nt, Human
auaucaauuuaaaaa

SEQ ID NO: 2215530 - RNA, 17 nt, Human
agucugacuguuuccau

SEQ ID NO: 2215531 - RNA, 18 nt, Human
uguacuuuauuuucuaua

SEQ ID NO: 2215532 - RNA, 14 nt, Human
ucuauaauuuaaau

SEQ ID NO: 2215533 - RNA, 22 nt, Human
gccauagucauucugccugccc

SEQ ID NO: 2215534 - RNA, 14 nt, Human
aagaagugaaaauc

SEQ ID NO: 2215535 - RNA, 11 nt, Human
augggacaggg

SEQ ID NO: 2215536 - RNA, 21 nt, Human
cgaaguauccuucagccugaa

SEQ ID NO: 2215537 - RNA, 17 nt, Human
ggaaauauuuauuuuaa

SEQ ID NO: 2215538 - RNA, 22 nt, Human
ccauuucuugagguaaaagcau

SEQ ID NO: 2215539 - RNA, 15 nt, Human
auuauuuuuuaaaaa

SEQ ID NO: 2215540 - RNA, 22 nt, Human
auaacaaugcuguauuuuaaaa

SEQ ID NO: 2215541 - RNA, 14 nt, Human
ccucuucugacacu

SEQ ID NO: 2215542 - RNA, 15 nt, Human
cugggaccaggcacc

SEQ ID NO: 2215543 - RNA, 16 nt, Human
cauccuuccucacacc

SEQ ID NO: 2215544 - RNA, 19 nt, Human
uggugagugccuguaauca

SEQ ID NO: 2215545 - RNA, 13 nt, Human
agcucugcccauc

SEQ ID NO: 2215546 - RNA, 19 nt, Human
ugggccccagauaccauga

SEQ ID NO: 2215547 - RNA, 16 nt, Human
aaaugggaaacaaaag

SEQ ID NO: 2215548 - RNA, 20 nt, Human
uuacaaauccaaugaaauga

SEQ ID NO: 2215549 - RNA, 18 nt, Human
gacauuugcucauggaau

SEQ ID NO: 2215550 - RNA, 19 nt, Human
agauaccaugaugcugagc

SEQ ID NO: 2215551 - RNA, 14 nt, Human
aauauuuauuuuaa

SEQ ID NO: 2215552 - RNA, 21 nt, Human
uuuuauggcacuaguauuucu

SEQ ID NO: 2215553 - RNA, 17 nt, Human
gacaaggaaaaaauaac

SEQ ID NO: 2215554 - RNA, 17 nt, Human
gccuccuuuuaaaguaa

SEQ ID NO: 2215555 - RNA, 17 nt, Human
aaucuuucacaggggac

SEQ ID NO: 2215556 - RNA, 12 nt, Human
gaaaauaacaau

SEQ ID NO: 2215557 - RNA, 17 nt, Human
uaugcuaagugaaauaa

SEQ ID NO: 2215558 - RNA, 14 nt, Human
gaaaaaauaacaau

SEQ ID NO: 2215559 - RNA, 15 nt, Human
cagugaaagaaaaua

SEQ ID NO: 2215560 - RNA, 17 nt, Human
accugagccccaaaagg

SEQ ID NO: 2215561 - RNA, 20 nt, Human
caagcucuaucaccaaggag

SEQ ID NO: 2215562 - RNA, 23 nt, Human
caucaacagauaaauaguuuaug

SEQ ID NO: 2215563 - RNA, 21 nt, Human
cugagccucagucucccuccc

SEQ ID NO: 2215564 - RNA, 16 nt, Human
augccccgucccccuc

SEQ ID NO: 2215565 - RNA, 19 nt, Human
cucauggaauuggagcucg

SEQ ID NO: 2215566 - RNA, 13 nt, Human
uaauuuuuauauu

SEQ ID NO: 2215567 - RNA, 19 nt, Human
ugaaauuguauuacaaauc

SEQ ID NO: 2215568 - RNA, 16 nt, Human
cuacacuccagugaga

SEQ ID NO: 2215569 - RNA, 16 nt, Human
cacgggggccaaggau

SEQ ID NO: 2215570 - RNA, 15 nt, Human
ugccugcaggcauga

SEQ ID NO: 2215571 - RNA, 23 nt, Human
aucaccaaggcugauuaaaccaa

SEQ ID NO: 2215572 - RNA, 14 nt, Human
caugaacuuguaaa

SEQ ID NO: 2215573 - RNA, 16 nt, Human
uuaaauuguaauaggc

SEQ ID NO: 2215574 - RNA, 13 nt, Human
ucuaagaagugaa

SEQ ID NO: 2215575 - RNA, 22 nt, Human
uuuuauagcuacuaauuuuaaa

SEQ ID NO: 2215576 - RNA, 17 nt, Human
ugagcggaccuucccag

SEQ ID NO: 2215577 - RNA, 18 nt, Human
gccccgucccccucuggc

SEQ ID NO: 2215578 - RNA, 14 nt, Human
cacuuauaggaauu

SEQ ID NO: 2215579 - RNA, 19 nt, Human
cacaggaaccacaagacug

SEQ ID NO: 2215580 - RNA, 21 nt, Human
cauuuucuucucacauuuaua

SEQ ID NO: 2215581 - RNA, 16 nt, Human
aaaauccauacauuug

SEQ ID NO: 2215582 - RNA, 16 nt, Human
cuucacuguaaaauaa

SEQ ID NO: 2215583 - RNA, 21 nt, Human
ucauucacucaacaaacauaa

SEQ ID NO: 2215584 - RNA, 21 nt, Human
uuacauuuguauaaaauaauu

SEQ ID NO: 2215585 - RNA, 21 nt, Human
ugggaggcugagaugggagaa

SEQ ID NO: 2215586 - RNA, 20 nt, Human
gauugagaaggagcucccag

SEQ ID NO: 2215587 - RNA, 17 nt, Human
uaaaagacagugaaaga

SEQ ID NO: 2215588 - RNA, 22 nt, Human
ucuuccuuuuuuaguucuucaa

SEQ ID NO: 2215589 - RNA, 18 nt, Human
ucaaggguacacugccuu

SEQ ID NO: 2215590 - RNA, 20 nt, Human
ucaggaggaaggcuuacacc

SEQ ID NO: 2215591 - RNA, 18 nt, Human
uguggucacaggaaguag

SEQ ID NO: 2215592 - RNA, 20 nt, Human
ccauuguggucacaggaagu

SEQ ID NO: 2215593 - RNA, 15 nt, Human
ggauacuccaugggg

SEQ ID NO: 2215594 - RNA, 17 nt, Human
ucucuggccuucggccu

SEQ ID NO: 2215595 - RNA, 22 nt, Human
gugccucaccccuugccauaau

SEQ ID NO: 2215596 - RNA, 18 nt, Human
gaauaauccuaaacauau

SEQ ID NO: 2215597 - RNA, 17 nt, Human
ggauacuccauggggug

SEQ ID NO: 2215598 - RNA, 15 nt, Human
gucaaugcagccccc

SEQ ID NO: 2215599 - RNA, 17 nt, Human
acaaaugcauuucuaaa

SEQ ID NO: 2215600 - RNA, 20 nt, Human
cucuucugacacuaaaacac

SEQ ID NO: 2215601 - RNA, 17 nt, Human
caaauauaaauaaaaau

SEQ ID NO: 2215602 - RNA, 17 nt, Human
uauauuguagauaauac

SEQ ID NO: 2215603 - RNA, 22 nt, Human
ugucucuacuaaaaauacaaaa

SEQ ID NO: 2215604 - RNA, 14 nt, Human
uuucaauaaaacuu

SEQ ID NO: 2215605 - RNA, 19 nt, Human
uggauacuccauggggugg

SEQ ID NO: 2215606 - RNA, 17 nt, Human
gacagucaccucaugga

SEQ ID NO: 2215607 - RNA, 17 nt, Human
gcaagcucuaucaccaa

SEQ ID NO: 2215608 - RNA, 18 nt, Human
uguaaaggaauuuaaaaa

SEQ ID NO: 2215609 - RNA, 13 nt, Human
ccccagcccuccu

SEQ ID NO: 2215610 - RNA, 15 nt, Human
caaggaaaaaauaac

SEQ ID NO: 2215611 - RNA, 21 nt, Human
aaacaauaacgauaaaagaca

SEQ ID NO: 2215612 - RNA, 16 nt, Human
cuagaacucccuuuca

SEQ ID NO: 2215613 - RNA, 13 nt, Human
caguuauuauauu

SEQ ID NO: 2215614 - RNA, 19 nt, Human
cucaccucccccaucucuu

SEQ ID NO: 2215615 - RNA, 18 nt, Human
uaaguuuuuuuuuaaaaa

SEQ ID NO: 2215616 - RNA, 22 nt, Human
ucuacuaaaaauacaaaaaaaa

SEQ ID NO: 2215617 - RNA, 15 nt, Human
ucuggcuccagcugg

SEQ ID NO: 2215618 - RNA, 21 nt, Human
aaugaauggcuaagcaaaaug

SEQ ID NO: 2215619 - RNA, 23 nt, Human
caccucauggaauuggagcucgu

SEQ ID NO: 2215620 - RNA, 14 nt, Human
cagagguugcagug

SEQ ID NO: 2215621 - RNA, 23 nt, Human
ucuuagaugcaguucugaagaag

SEQ ID NO: 2215622 - RNA, 11 nt, Human
uuuuuuuucaa

SEQ ID NO: 2215623 - RNA, 19 nt, Human
augcagagguccacaacac

SEQ ID NO: 2215624 - RNA, 14 nt, Human
acuaauuuuaaaau

SEQ ID NO: 2215625 - RNA, 19 nt, Human
auuggagcucgugggacag

SEQ ID NO: 2215626 - RNA, 18 nt, Human
uucucuaggaaauauuua

SEQ ID NO: 2215627 - RNA, 21 nt, Human
auuuuuucucuaggaaauauu

SEQ ID NO: 2215628 - RNA, 15 nt, Human
uguauuuuaaaagaa

SEQ ID NO: 2215629 - RNA, 16 nt, Human
uucccaacuccagaaa

SEQ ID NO: 2215630 - RNA, 21 nt, Human
aauuuacagagacagaaagca

SEQ ID NO: 2215631 - RNA, 13 nt, Human
uauuucuaugaaa

SEQ ID NO: 2215632 - RNA, 15 nt, Human
aaacauaugaauuau

SEQ ID NO: 2215633 - RNA, 16 nt, Human
agauagggagggaagg

SEQ ID NO: 2215634 - RNA, 21 nt, Human
aaagcugaaauggacuuuugu

SEQ ID NO: 2215635 - RNA, 19 nt, Human
ucugagcauuuaauaugga

SEQ ID NO: 2215636 - RNA, 12 nt, Human
cagugaaagaaa

SEQ ID NO: 2215637 - RNA, 13 nt, Human
ccaaaagguauuu

SEQ ID NO: 2215638 - RNA, 15 nt, Human
auccugccccugagc

SEQ ID NO: 2215639 - RNA, 23 nt, Human
gauagauaggucagugcaaauac

SEQ ID NO: 2215640 - RNA, 17 nt, Human
auguugacaugggacau

SEQ ID NO: 2215641 - RNA, 17 nt, Human
aaccuagggugauauua

SEQ ID NO: 2215642 - RNA, 19 nt, Human
cuagaguuuagcuggaaaa

SEQ ID NO: 2215643 - RNA, 18 nt, Human
uuggggccuaugcagagg

SEQ ID NO: 2215644 - RNA, 17 nt, Human
cuuccuaauuccacagc

SEQ ID NO: 2215645 - RNA, 16 nt, Human
ccugagcgacagugag

SEQ ID NO: 2215646 - RNA, 23 nt, Human
uuuguauaaaauaauuuuuauau

SEQ ID NO: 2215647 - RNA, 15 nt, Human
ccucagucucccucc

SEQ ID NO: 2215648 - RNA, 12 nt, Human
cagccccuggga

SEQ ID NO: 2215649 - RNA, 23 nt, Human
uuuaguaagagauuccugagcca

SEQ ID NO: 2215650 - RNA, 21 nt, Human
gagaaggagcucccaggaggg

SEQ ID NO: 2215651 - RNA, 22 nt, Human
cugaggcauccuuccucacacc

SEQ ID NO: 2215652 - RNA, 16 nt, Human
aucaaaagaaagaaaa

SEQ ID NO: 2215653 - RNA, 13 nt, Human
uggacgagaaaac

SEQ ID NO: 2215654 - RNA, 17 nt, Human
aaauaacaauaaaagac

SEQ ID NO: 2215655 - RNA, 14 nt, Human
caaggcuagaacca

SEQ ID NO: 2215656 - RNA, 14 nt, Human
gagagugaacaaau

SEQ ID NO: 2215657 - RNA, 14 nt, Human
ugcuaagucuuaua

SEQ ID NO: 2215658 - RNA, 23 nt, Human
agcuaggggggucagccagcccu

SEQ ID NO: 2215659 - RNA, 21 nt, Human
auuauauuuauuacuguaaga

SEQ ID NO: 2215660 - RNA, 15 nt, Human
aucuuauaauuuaaa

SEQ ID NO: 2215661 - RNA, 15 nt, Human
acucaacaaacauaa

SEQ ID NO: 2215662 - RNA, 23 nt, Human
ccugggaccaggcacccccagaa

SEQ ID NO: 2215663 - RNA, 13 nt, Human
ccugccccccagc

SEQ ID NO: 2215664 - RNA, 15 nt, Human
uauaauuuaaauaua

SEQ ID NO: 2215665 - RNA, 19 nt, Human
ccugagcggaccuucccag

SEQ ID NO: 2215666 - RNA, 17 nt, Human
acaagaaaugaaagcag

SEQ ID NO: 2215667 - RNA, 13 nt, Human
cccagauaccaug

SEQ ID NO: 2215668 - RNA, 15 nt, Human
ucugucucaguccau

SEQ ID NO: 2215669 - RNA, 16 nt, Human
ucccagaucaagccug

SEQ ID NO: 2215670 - RNA, 18 nt, Human
ccucagcugccuccccag

SEQ ID NO: 2215671 - RNA, 21 nt, Human
cuuguuggacgagaaaacaau

SEQ ID NO: 2215672 - RNA, 15 nt, Human
cauguccacugguuc

SEQ ID NO: 2215673 - RNA, 15 nt, Human
aauucugaaagcaac

SEQ ID NO: 2215674 - RNA, 14 nt, Human
acauauauaacaau

SEQ ID NO: 2215675 - RNA, 15 nt, Human
ccucuucugacacua

SEQ ID NO: 2215676 - RNA, 13 nt, Human
auugucuagugaa

SEQ ID NO: 2215677 - RNA, 16 nt, Human
agugaaauauuauuuu

SEQ ID NO: 2215678 - RNA, 23 nt, Human
cugggccauagucauucugccug

SEQ ID NO: 2215679 - RNA, 22 nt, Human
guauucauauuuauagccaggu

SEQ ID NO: 2215680 - RNA, 13 nt, Human
caacucccugccc

SEQ ID NO: 2215681 - RNA, 16 nt, Human
ggcagagagguaggga

SEQ ID NO: 2215682 - RNA, 21 nt, Human
cuggccuucggccuccauccu

SEQ ID NO: 2215683 - RNA, 20 nt, Human
gacauuugcucauggaauug

SEQ ID NO: 2215684 - RNA, 23 nt, Human
ugcauagguuuaauaauuuuuaa

SEQ ID NO: 2215685 - RNA, 18 nt, Human
agucagucugaugagaac

SEQ ID NO: 2215686 - RNA, 22 nt, Human
caauaaaagacaaggaaaaaau

SEQ ID NO: 2215687 - RNA, 20 nt, Human
augaaguuguagguaauauu

SEQ ID NO: 2215688 - RNA, 13 nt, Human
uuuuuuuuuucaa

SEQ ID NO: 2215689 - RNA, 17 nt, Human
aaagacaaggaaaaaau

SEQ ID NO: 2215690 - RNA, 18 nt, Human
uaaaauccauacauuugu

SEQ ID NO: 2215691 - RNA, 16 nt, Human
acaaggaugaauuaag

SEQ ID NO: 2215692 - RNA, 18 nt, Human
cuuccucugagccuuggg

SEQ ID NO: 2215693 - RNA, 18 nt, Human
caagccucauguccacug

SEQ ID NO: 2215694 - RNA, 19 nt, Human
ggcaaggguucaccugggc

SEQ ID NO: 2215695 - RNA, 20 nt, Human
aacaagccuccuuuuaaagu

SEQ ID NO: 2215696 - RNA, 21 nt, Human
gaggugagguaccagccuugg

SEQ ID NO: 2215697 - RNA, 16 nt, Human
cugcugagucccaggc

SEQ ID NO: 2215698 - RNA, 23 nt, Human
caucucuucuggguuccuuccuc

SEQ ID NO: 2215699 - RNA, 19 nt, Human
aaucuacacuccagugaga

SEQ ID NO: 2215700 - RNA, 16 nt, Human
ucucuaggaaauauuu

SEQ ID NO: 2215701 - RNA, 17 nt, Human
uucacuguaaaauaaua

SEQ ID NO: 2215702 - RNA, 16 nt, Human
uucuauaauuuaaaua

SEQ ID NO: 2215703 - RNA, 21 nt, Human
gcccauccugccccugagccc

SEQ ID NO: 2215704 - RNA, 20 nt, Human
auauuuuauaucaauuuaaa

SEQ ID NO: 2215705 - RNA, 18 nt, Human
acugauggguuucuccag

SEQ ID NO: 2215706 - RNA, 17 nt, Human
guuuaauaauuuuuaau

SEQ ID NO: 2215707 - RNA, 13 nt, Human
gcuggagcucugc

SEQ ID NO: 2215708 - RNA, 21 nt, Human
gcaaaauuuuuucucuaggaa

SEQ ID NO: 2215709 - RNA, 22 nt, Human
gaauuaaguuuuuuuuuaaaaa

SEQ ID NO: 2215710 - RNA, 16 nt, Human
uucaguuauuauauuu

SEQ ID NO: 2215711 - RNA, 23 nt, Human
cuaguaauuggaaaggcagcucu

SEQ ID NO: 2215712 - RNA, 11 nt, Human
agccagguacc

SEQ ID NO: 2215713 - RNA, 17 nt, Human
agcucccaggaggggcu

SEQ ID NO: 2215714 - RNA, 20 nt, Human
uauaugcuaagucuuauaua

SEQ ID NO: 2215715 - RNA, 14 nt, Human
cagucugaugagaa

SEQ ID NO: 2215716 - RNA, 20 nt, Human
uauacugugugcuaaaacaa

SEQ ID NO: 2215717 - RNA, 22 nt, Human
accaaucaugaauuaguuuuau

SEQ ID NO: 2215718 - RNA, 16 nt, Human
ccacuuggucugugag

SEQ ID NO: 2215719 - RNA, 21 nt, Human
acacuaaaacaccucagcugc

SEQ ID NO: 2215720 - RNA, 15 nt, Human
ugguuuagaaagcuu

SEQ ID NO: 2215721 - RNA, 22 nt, Human
uauccuacuuccccuuccuaau

SEQ ID NO: 2215722 - RNA, 20 nt, Human
uuaaauggucaauuuuguua

SEQ ID NO: 2215723 - RNA, 20 nt, Human
acuaaaacaccucagcugcc

SEQ ID NO: 2215724 - RNA, 17 nt, Human
gacucaccucccccauc

SEQ ID NO: 2215725 - RNA, 18 nt, Human
cagcugcucaauaaagua

SEQ ID NO: 2215726 - RNA, 22 nt, Human
gaugguucccuugaugaagaag

SEQ ID NO: 2215727 - RNA, 14 nt, Human
cucauccugcaggc

SEQ ID NO: 2215728 - RNA, 16 nt, Human
cacuuaaaaaugguuu

SEQ ID NO: 2215729 - RNA, 15 nt, Human
agccugaaagaggaa

SEQ ID NO: 2215730 - RNA, 16 nt, Human
auuugaugcuacagga

SEQ ID NO: 2215731 - RNA, 22 nt, Human
aggcuccacuuggucugugaga

SEQ ID NO: 2215732 - RNA, 12 nt, Human
accccugagcuu

SEQ ID NO: 2215733 - RNA, 14 nt, Human
cuuucauaauaagu

SEQ ID NO: 2215734 - RNA, 14 nt, Human
ugcuggagcucugc

SEQ ID NO: 2215735 - RNA, 19 nt, Human
ugcacacagcacgggggcc

SEQ ID NO: 2215736 - RNA, 20 nt, Human
agaugcaguucugaagaaga

SEQ ID NO: 2215737 - RNA, 14 nt, Human
cucugccucagaaa

SEQ ID NO: 2215738 - RNA, 20 nt, Human
ugauuauaugucacuuugcu

SEQ ID NO: 2215739 - RNA, 16 nt, Human
uggggaugaacuuuuu

SEQ ID NO: 2215740 - RNA, 17 nt, Human
aagacaaggaaaaaaua

SEQ ID NO: 2215741 - RNA, 22 nt, Human
agaaaacaauaacgauaaaaga

SEQ ID NO: 2215742 - RNA, 18 nt, Human
auaauccuaaacauauga

SEQ ID NO: 2215743 - RNA, 16 nt, Human
uugucaauaaaaucca

SEQ ID NO: 2215744 - RNA, 15 nt, Human
aucaauuuaaaaaaa

SEQ ID NO: 2215745 - RNA, 18 nt, Human
uccuaauuccacagcugc

SEQ ID NO: 2215746 - RNA, 22 nt, Human
caucucuucuggguuccuuccu

SEQ ID NO: 2215747 - RNA, 11 nt, Human
ucaccuccccc

SEQ ID NO: 2215748 - RNA, 20 nt, Human
gaaaauaacaauaaaagaca

SEQ ID NO: 2215749 - RNA, 18 nt, Human
auggcuugaguuuaaauu

SEQ ID NO: 2215750 - RNA, 21 nt, Human
cgacagugagacucugucuca

SEQ ID NO: 2215751 - RNA, 21 nt, Human
cucaaaacuucagacauagaa

SEQ ID NO: 2215752 - RNA, 18 nt, Human
gaggcuccacuuggucug

SEQ ID NO: 2215753 - RNA, 20 nt, Human
cagugaaagaaaauaacgau

SEQ ID NO: 2215754 - RNA, 13 nt, Human
ccuucucaccugu

SEQ ID NO: 2215755 - RNA, 17 nt, Human
auauuugaaauauugac

SEQ ID NO: 2215756 - RNA, 14 nt, Human
cugcugagucccag

SEQ ID NO: 2215757 - RNA, 23 nt, Human
ugucaauucuugccaaauauaaa

SEQ ID NO: 2215758 - RNA, 15 nt, Human
ugagcggaccuuccc

SEQ ID NO: 2215759 - RNA, 17 nt, Human
cccaggcugagccucag

SEQ ID NO: 2215760 - RNA, 22 nt, Human
aagagccuuuuuuugaaaaaaa

SEQ ID NO: 2215761 - RNA, 19 nt, Human
agggaauugcagaguacug

SEQ ID NO: 2215762 - RNA, 18 nt, Human
ccuucggccuccauccug

SEQ ID NO: 2215763 - RNA, 23 nt, Human
ugaaaaucuuauaauuuaaaaua

SEQ ID NO: 2215764 - RNA, 13 nt, Human
augacauuuuguu

SEQ ID NO: 2215765 - RNA, 18 nt, Human
cauagguuuaauaauuuu

SEQ ID NO: 2215766 - RNA, 15 nt, Human
caggauggcaggagg

SEQ ID NO: 2215767 - RNA, 20 nt, Human
guauuauuuuuuaaaaaaau

SEQ ID NO: 2215768 - RNA, 22 nt, Human
ucuggguuccuuccucugagcc

SEQ ID NO: 2215769 - RNA, 22 nt, Human
agcucuaucccaaccucuccca

SEQ ID NO: 2215770 - RNA, 12 nt, Human
uucagccugaaa

SEQ ID NO: 2215771 - RNA, 16 nt, Human
auccuugaagauuuac

SEQ ID NO: 2215772 - RNA, 21 nt, Human
guccccuauccuacuuccccu

SEQ ID NO: 2215773 - RNA, 14 nt, Human
uucacauuuaaaua

SEQ ID NO: 2215774 - RNA, 19 nt, Human
ccgggcgugguggugagug

SEQ ID NO: 2215775 - RNA, 14 nt, Human
cagugucaggagga

SEQ ID NO: 2215776 - RNA, 14 nt, Human
uacuaauuuuaaaa

SEQ ID NO: 2215777 - RNA, 22 nt, Human
ccauacuaauuauacccccugc

SEQ ID NO: 2215778 - RNA, 14 nt, Human
ccacauccuguggg

SEQ ID NO: 2215779 - RNA, 14 nt, Human
ccuuaucaaaggac

SEQ ID NO: 2215780 - RNA, 16 nt, Human
gccaugugcuaguaau

SEQ ID NO: 2215781 - RNA, 13 nt, Human
ugagcgacaguga

SEQ ID NO: 2215782 - RNA, 15 nt, Human
auaaauaaaaauaau

SEQ ID NO: 2215783 - RNA, 14 nt, Human
uugggaaaaaguaa

SEQ ID NO: 2215784 - RNA, 18 nt, Human
cuuuccacagaagcucca

SEQ ID NO: 2215785 - RNA, 13 nt, Human
cacuguaaaauaa

SEQ ID NO: 2215786 - RNA, 15 nt, Human
uucugcacacagcac

SEQ ID NO: 2215787 - RNA, 18 nt, Human
uccagcuggccgggagcc

SEQ ID NO: 2215788 - RNA, 12 nt, Human
ccuucagccuga

SEQ ID NO: 2215789 - RNA, 16 nt, Human
ccucagucucccuccc

SEQ ID NO: 2215790 - RNA, 20 nt, Human
ccagaaugaccuggccgcag

SEQ ID NO: 2215791 - RNA, 20 nt, Human
cuaggggggucagccagccc

SEQ ID NO: 2215792 - RNA, 22 nt, Human
cauuuaaauaaaguguuugaaa

SEQ ID NO: 2215793 - RNA, 18 nt, Human
guuucaaacauauauaac

SEQ ID NO: 2215794 - RNA, 18 nt, Human
ugccauaauuacuauguc

SEQ ID NO: 2215795 - RNA, 22 nt, Human
ccaaacauccuacaagacacag

SEQ ID NO: 2215796 - RNA, 20 nt, Human
ugaaaaucuuauaauuuaaa

SEQ ID NO: 2215797 - RNA, 22 nt, Human
caccagucugacuguuuccauc

SEQ ID NO: 2215798 - RNA, 14 nt, Human
uugccaugugcuag

SEQ ID NO: 2215799 - RNA, 15 nt, Human
agggcucacagaauu

SEQ ID NO: 2215800 - RNA, 21 nt, Human
cugagcccggaaacuccacau

SEQ ID NO: 2215801 - RNA, 23 nt, Human
ucuagcaugucgucaaagcugaa

SEQ ID NO: 2215802 - RNA, 17 nt, Human
uaucaauuuaaaaaaaa

SEQ ID NO: 2215803 - RNA, 21 nt, Human
gugccugagcggaccuuccca

SEQ ID NO: 2215804 - RNA, 18 nt, Human
gggggucagccagcccuc

SEQ ID NO: 2215805 - RNA, 22 nt, Human
ugaccauacuaauuauaccccc

SEQ ID NO: 2215806 - RNA, 18 nt, Human
acugacucuuaagaagac

SEQ ID NO: 2215807 - RNA, 15 nt, Human
auauaaauaaaaaua

SEQ ID NO: 2215808 - RNA, 16 nt, Human
gcugcagccccuggga

SEQ ID NO: 2215809 - RNA, 21 nt, Human
agucucccucccuuggggccu

SEQ ID NO: 2215810 - RNA, 17 nt, Human
cauuuguauaaaauaau

SEQ ID NO: 2215811 - RNA, 22 nt, Human
caaauuuacagagacagaaagc

SEQ ID NO: 2215812 - RNA, 14 nt, Human
cugucucaguccau

SEQ ID NO: 2215813 - RNA, 17 nt, Human
uaacgauaaaagacagu

SEQ ID NO: 2215814 - RNA, 14 nt, Human
cucaacaaacauaa

SEQ ID NO: 2215815 - RNA, 20 nt, Human
ucaagucuuucacauuuaaa

SEQ ID NO: 2215816 - RNA, 20 nt, Human
ccagcuugaaaccuucacuu

SEQ ID NO: 2215817 - RNA, 19 nt, Human
gugacuuaaugccacuaaa

SEQ ID NO: 2215818 - RNA, 23 nt, Human
uggaaauguuuacagauccccaa

SEQ ID NO: 2215819 - RNA, 16 nt, Human
ccucaaucaguauuca

SEQ ID NO: 2215820 - RNA, 18 nt, Human
uuguaaaggaauuuaaaa

SEQ ID NO: 2215821 - RNA, 18 nt, Human
uguauuauuuuuuaaaaa

SEQ ID NO: 2215822 - RNA, 16 nt, Human
ccuaagugcagccccg

SEQ ID NO: 2215823 - RNA, 12 nt, Human
gaaagucccaga

SEQ ID NO: 2215824 - RNA, 17 nt, Human
aauaugcucuaaacaug

SEQ ID NO: 2215825 - RNA, 22 nt, Human
cugccuccccagcucuauccca

SEQ ID NO: 2215826 - RNA, 24 nt, Human
ccagguaccuucucaccugugaga

SEQ ID NO: 2215827 - RNA, 13 nt, Human
augcuagaacucc

SEQ ID NO: 2215828 - RNA, 12 nt, Human
aaggaugccccg

SEQ ID NO: 2215829 - RNA, 18 nt, Human
agccugaucaccugcccu

SEQ ID NO: 2215830 - RNA, 17 nt, Human
guugcugggggggauug

SEQ ID NO: 2215831 - RNA, 16 nt, Human
ugaauuaguuuuauau

SEQ ID NO: 2215832 - RNA, 17 nt, Human
uuccaagccucaugucc

SEQ ID NO: 2215833 - RNA, 14 nt, Human
ccugccccugagcc

SEQ ID NO: 2215834 - RNA, 18 nt, Human
auuaaguuuuuuuuuaaa

SEQ ID NO: 2215835 - RNA, 14 nt, Human
acccgggaggcaga

SEQ ID NO: 2215836 - RNA, 13 nt, Human
auaaauaaaaaua

SEQ ID NO: 2215837 - RNA, 12 nt, Human
cacaacacacag

SEQ ID NO: 2215838 - RNA, 14 nt, Human
ucugccugcccuga

SEQ ID NO: 2215839 - RNA, 13 nt, Human
uaacaauaaaaga

SEQ ID NO: 2215840 - RNA, 15 nt, Human
caagcucacagaccu

SEQ ID NO: 2215841 - RNA, 13 nt, Human
cuuaucaaaggac

SEQ ID NO: 2215842 - RNA, 21 nt, Human
aaauaauuuuuauauuugaaa

SEQ ID NO: 2215843 - RNA, 14 nt, Human
caggaggggcuucu

SEQ ID NO: 2215844 - RNA, 13 nt, Human
aaacauccuacaa

SEQ ID NO: 2215845 - RNA, 18 nt, Human
acaaaaggauaaugaaua

SEQ ID NO: 2215846 - RNA, 13 nt, Human
aaaguguuugaaa

SEQ ID NO: 2215847 - RNA, 21 nt, Human
aguuguugcccacagcuguau

SEQ ID NO: 2215848 - RNA, 15 nt, Human
cuuaagaagacugca

SEQ ID NO: 2215849 - RNA, 21 nt, Human
acaggauggcaggaggcaucc

SEQ ID NO: 2215850 - RNA, 21 nt, Human
acaugagguacugagagugaa

SEQ ID NO: 2215851 - RNA, 20 nt, Human
acuucuuaggguuaugauua

SEQ ID NO: 2215852 - RNA, 11 nt, Human
accauuuuuac

SEQ ID NO: 2215853 - RNA, 14 nt, Human
aagagugaaggauu

SEQ ID NO: 2215854 - RNA, 16 nt, Human
uauguucuaagaagug

SEQ ID NO: 2215855 - RNA, 18 nt, Human
auuuuuagugaaauauua

SEQ ID NO: 2215856 - RNA, 19 nt, Human
ggugcugcagccccuggga

SEQ ID NO: 2215857 - RNA, 22 nt, Human
aauuguauuuuaguaagagauu

SEQ ID NO: 2215858 - RNA, 21 nt, Human
ugaacugauggguuucuccag

SEQ ID NO: 2215859 - RNA, 17 nt, Human
agucccaggcugagccu

SEQ ID NO: 2215860 - RNA, 19 nt, Human
gcacuaguauuucuaugaa

SEQ ID NO: 2215861 - RNA, 16 nt, Human
ugccucaccccuugcc

SEQ ID NO: 2215862 - RNA, 21 nt, Human
ccaggaggggcuucugggcag

SEQ ID NO: 2215863 - RNA, 12 nt, Human
uaauuccacagc

SEQ ID NO: 2215864 - RNA, 10 nt, Human
ccugagcccc

SEQ ID NO: 2215865 - RNA, 15 nt, Human
ggccuccauccugag

SEQ ID NO: 2215866 - RNA, 15 nt, Human
uucggccuccauccu

SEQ ID NO: 2215867 - RNA, 14 nt, Human
ccaaauauaaauaa

SEQ ID NO: 2215868 - RNA, 14 nt, Human
gaaagcagaacagu

SEQ ID NO: 2215869 - RNA, 12 nt, Human
gugggaccuggg

SEQ ID NO: 2215870 - RNA, 12 nt, Human
uaguacacacuu

SEQ ID NO: 2215871 - RNA, 14 nt, Human
cugcaaagcccagc

SEQ ID NO: 2215872 - RNA, 23 nt, Human
aggaugguucccuugaugaagaa

SEQ ID NO: 2215873 - RNA, 22 nt, Human
gaaauaagccagacaucaacag

SEQ ID NO: 2215874 - RNA, 12 nt, Human
aaaugaaagcag

SEQ ID NO: 2215875 - RNA, 14 nt, Human
aaaagaaacauuug

SEQ ID NO: 2215876 - RNA, 11 nt, Human
aauuuaaauau

SEQ ID NO: 2215877 - RNA, 21 nt, Human
gacagugaaagaaaauaacaa

SEQ ID NO: 2215878 - RNA, 22 nt, Human
gugucuggcguuguggggauga

SEQ ID NO: 2215879 - RNA, 13 nt, Human
cacaacacacaga

SEQ ID NO: 2215880 - RNA, 13 nt, Human
aaaugaaagcagg

SEQ ID NO: 2215881 - RNA, 17 nt, Human
uuaauaauuuuuaauua

SEQ ID NO: 2215882 - RNA, 13 nt, Human
ccucauggaauug

SEQ ID NO: 2215883 - RNA, 14 nt, Human
guaacugauuugua

SEQ ID NO: 2215884 - RNA, 19 nt, Human
ccccugagcuugcagagau

SEQ ID NO: 2215885 - RNA, 12 nt, Human
accaggcacccc

SEQ ID NO: 2215886 - RNA, 17 nt, Human
cagugcuugaaugaagu

SEQ ID NO: 2215887 - RNA, 15 nt, Human
gccucuuagaugcag

SEQ ID NO: 2215888 - RNA, 17 nt, Human
uuacagagacagaaagc

SEQ ID NO: 2215889 - RNA, 16 nt, Human
ccaggcugagccucag

SEQ ID NO: 2215890 - RNA, 16 nt, Human
acuaguuucccuugca

SEQ ID NO: 2215891 - RNA, 19 nt, Human
auuaaguuuuuuuuuaaaa

SEQ ID NO: 2215892 - RNA, 13 nt, Human
aaaugggaaacaa

SEQ ID NO: 2215893 - RNA, 14 nt, Human
uauaaauaaaaaua

SEQ ID NO: 2215894 - RNA, 12 nt, Human
gcaaagcccagc

SEQ ID NO: 2215895 - RNA, 15 nt, Human
ccaugaugcugagcc

SEQ ID NO: 2215896 - RNA, 19 nt, Human
agacagugaaagaaaauaa

SEQ ID NO: 2215897 - RNA, 16 nt, Human
ccacuuauaggaauug

SEQ ID NO: 2215898 - RNA, 19 nt, Human
aaagacagugaaagaaaau

SEQ ID NO: 2215899 - RNA, 18 nt, Human
ugaacuugguuuuaauua

SEQ ID NO: 2215900 - RNA, 21 nt, Human
uuauuuucuauaauuuaaaua

SEQ ID NO: 2215901 - RNA, 16 nt, Human
cagggacuugaaccca

SEQ ID NO: 2215902 - RNA, 17 nt, Human
gccccagauaccaugau

SEQ ID NO: 2215903 - RNA, 15 nt, Human
cuacuaauuuuaaaa

SEQ ID NO: 2215904 - RNA, 19 nt, Human
aaugaaauggugaaaugca

SEQ ID NO: 2215905 - RNA, 18 nt, Human
uccugugggaccugggcc

SEQ ID NO: 2215906 - RNA, 21 nt, Human
cacuaaaacaccucagcugcc

SEQ ID NO: 2215907 - RNA, 16 nt, Human
uuucacauuuaaauaa

SEQ ID NO: 2215908 - RNA, 18 nt, Human
ccucuggcuccagcuggc

SEQ ID NO: 2215909 - RNA, 19 nt, Human
uacuucuuaggguuaugau

SEQ ID NO: 2215910 - RNA, 15 nt, Human
auagaaguaaaaaca

SEQ ID NO: 2215911 - RNA, 13 nt, Human
aaaauaacgauaa

SEQ ID NO: 2215912 - RNA, 17 nt, Human
uuauaaucuuucacagg

SEQ ID NO: 2215913 - RNA, 13 nt, Human
agcccagcuugaa

SEQ ID NO: 2215914 - RNA, 16 nt, Human
aauuccacagcugcuc

SEQ ID NO: 2215915 - RNA, 23 nt, Human
ccuuuguugcuaucaauccaaga

SEQ ID NO: 2215916 - RNA, 21 nt, Human
agccucuuagaugcaguucug

SEQ ID NO: 2215917 - RNA, 16 nt, Human
ucagucucccucccuu

SEQ ID NO: 2215918 - RNA, 23 nt, Human
uggcuugaguuuaaauuguaaua

SEQ ID NO: 2215919 - RNA, 22 nt, Human
agacucugucucaguccaugaa

SEQ ID NO: 2215920 - RNA, 21 nt, Human
ugaaauggacuuuuguacaua

SEQ ID NO: 2215921 - RNA, 13 nt, Human
uacuuuauuuucu

SEQ ID NO: 2215922 - RNA, 17 nt, Human
ugaaauggugaaaugca

SEQ ID NO: 2215923 - RNA, 16 nt, Human
caugggacagggagga

SEQ ID NO: 2215924 - RNA, 23 nt, Human
uaauuuguaguguuggagaagaa

SEQ ID NO: 2215925 - RNA, 18 nt, Human
ccuuccuaauuccacagc

SEQ ID NO: 2215926 - RNA, 19 nt, Human
cugcaaagcccagcuugaa

SEQ ID NO: 2215927 - RNA, 19 nt, Human
uuauggcacuaguauuucu

SEQ ID NO: 2215928 - RNA, 12 nt, Human
aauaaaguacaa

SEQ ID NO: 2215929 - RNA, 18 nt, Human
cucauccugcaggcagcu

SEQ ID NO: 2215930 - RNA, 18 nt, Human
aaggagcucccaggaggg

SEQ ID NO: 2215931 - RNA, 14 nt, Human
cagauccuggaaau

SEQ ID NO: 2215932 - RNA, 22 nt, Human
uuuauggcacuaguauuucuau

SEQ ID NO: 2215933 - RNA, 22 nt, Human
ugugccugagcggaccuuccca

SEQ ID NO: 2215934 - RNA, 23 nt, Human
caggcaugagucagucugaugag

SEQ ID NO: 2215935 - RNA, 23 nt, Human
gaccccugagcuugcagagauga

SEQ ID NO: 2215936 - RNA, 17 nt, Human
agacagugaaagaaaau

SEQ ID NO: 2215937 - RNA, 15 nt, Human
gggucagccagcccu

SEQ ID NO: 2215938 - RNA, 23 nt, Human
caugcugucuacacuaagagaga

SEQ ID NO: 2215939 - RNA, 20 nt, Human
acuaaauugacacuuaaaaa

SEQ ID NO: 2215940 - RNA, 17 nt, Human
acacuaagagagaauga

SEQ ID NO: 2215941 - RNA, 15 nt, Human
ugauuucauucaaua

SEQ ID NO: 2215942 - RNA, 14 nt, Human
agaaaauaacaaua

SEQ ID NO: 2215943 - RNA, 14 nt, Human
ggccuucggccucc

SEQ ID NO: 2215944 - RNA, 21 nt, Human
aagcuccauuuuuagugaaau

SEQ ID NO: 2215945 - RNA, 23 nt, Human
cugaaaucauacuucuuaggguu

SEQ ID NO: 2215946 - RNA, 20 nt, Human
ucaauaaaauccauacauuu

SEQ ID NO: 2215947 - RNA, 14 nt, Human
cacuuggacauggg

SEQ ID NO: 2215948 - RNA, 17 nt, Human
aucaaggguacacugcc

SEQ ID NO: 2215949 - RNA, 12 nt, Human
ucugcacacagc

SEQ ID NO: 2215950 - RNA, 22 nt, Human
uuuccaagcaaguauuagaaua

SEQ ID NO: 2215951 - RNA, 21 nt, Human
aaucaccaaggcugauuaaac

SEQ ID NO: 2215952 - RNA, 19 nt, Human
gaaggagcucccaggaggg

SEQ ID NO: 2215953 - RNA, 23 nt, Human
aagagccuuuuuuugaaaaaaag

SEQ ID NO: 2215954 - RNA, 21 nt, Human
agggugauauuaaccaggggc

SEQ ID NO: 2215955 - RNA, 15 nt, Human
auuuuaaaagaauga

SEQ ID NO: 2215956 - RNA, 23 nt, Human
uaaguuuuuuuuuaaaaaagaaa

SEQ ID NO: 2215957 - RNA, 14 nt, Human
ucaagccugccuca

SEQ ID NO: 2215958 - RNA, 19 nt, Human
aguauuucuaugaaauauu

SEQ ID NO: 2215959 - RNA, 16 nt, Human
uggucugugagaugcu

SEQ ID NO: 2215960 - RNA, 13 nt, Human
cagcugccucccc

SEQ ID NO: 2215961 - RNA, 12 nt, Human
ucagcugccucc

SEQ ID NO: 2215962 - RNA, 19 nt, Human
gaggcauccaaaggcuccu

SEQ ID NO: 2215963 - RNA, 19 nt, Human
auagcuacuaauuuuaaaa

SEQ ID NO: 2215964 - RNA, 20 nt, Human
uccacuuggacaugggcccc

SEQ ID NO: 2215965 - RNA, 16 nt, Human
ugaaauuguauuacaa

SEQ ID NO: 2215966 - RNA, 19 nt, Human
cggccuccauccugaggcu

SEQ ID NO: 2215967 - RNA, 15 nt, Human
cuggguuccuuccuc

SEQ ID NO: 2215968 - RNA, 20 nt, Human
accuuuugcuguggcaaaug

SEQ ID NO: 2215969 - RNA, 17 nt, Human
guuuaauucugaaagca

SEQ ID NO: 2215970 - RNA, 21 nt, Human
caaggaaaaaauaacaaugaa

SEQ ID NO: 2215971 - RNA, 11 nt, Human
auuuuugaagc

SEQ ID NO: 2215972 - RNA, 18 nt, Human
auugagaaggagcuccca

SEQ ID NO: 2215973 - RNA, 23 nt, Human
ccagagggaauugcagaguacug

SEQ ID NO: 2215974 - RNA, 17 nt, Human
agcucuaucccaaccuc

SEQ ID NO: 2215975 - RNA, 11 nt, Human
ccugagcccca

SEQ ID NO: 2215976 - RNA, 14 nt, Human
gccucagucucccu

SEQ ID NO: 2215977 - RNA, 20 nt, Human
ugagagacacacugaagaag

SEQ ID NO: 2215978 - RNA, 19 nt, Human
acuuauuuguacauuuuuu

SEQ ID NO: 2215979 - RNA, 12 nt, Human
aaacuccacauc

SEQ ID NO: 2215980 - RNA, 22 nt, Human
ugaaaaaguucugcagauaaac

SEQ ID NO: 2215981 - RNA, 13 nt, Human
gaagaacugaaau

SEQ ID NO: 2215982 - RNA, 16 nt, Human
acagagacagaaagca

SEQ ID NO: 2215983 - RNA, 22 nt, Human
cugggacaggggagaaccuagg

SEQ ID NO: 2215984 - RNA, 15 nt, Human
acauccuacaagaca

SEQ ID NO: 2215985 - RNA, 19 nt, Human
uucccuugaugaagaaguu

SEQ ID NO: 2215986 - RNA, 23 nt, Human
auuauauggcuugaguuuaaauu

SEQ ID NO: 2215987 - RNA, 12 nt, Human
cuugguuuuaau

SEQ ID NO: 2215988 - RNA, 18 nt, Human
ccugcaaagcccagcuug

SEQ ID NO: 2215989 - RNA, 14 nt, Human
ccagcuagaauuca

SEQ ID NO: 2215990 - RNA, 14 nt, Human
auuauuuuuuaaaa

SEQ ID NO: 2215991 - RNA, 14 nt, Human
uauaauuuaaaaua

SEQ ID NO: 2215992 - RNA, 22 nt, Human
gaggggagcaugggaagugacg

SEQ ID NO: 2215993 - RNA, 20 nt, Human
ucgugucuggcguugugggg

SEQ ID NO: 2215994 - RNA, 20 nt, Human
accugauuucugagcauuua

SEQ ID NO: 2215995 - RNA, 12 nt, Human
ucaccccuugcc

SEQ ID NO: 2215996 - RNA, 14 nt, Human
aaaggaauuuaaaa

SEQ ID NO: 2215997 - RNA, 17 nt, Human
uucucuaggaaauauuu

SEQ ID NO: 2215998 - RNA, 21 nt, Human
cucuaucccaaccucucccaa

SEQ ID NO: 2215999 - RNA, 18 nt, Human
uuacuguaagaaaauauc

SEQ ID NO: 2216000 - RNA, 21 nt, Human
gacagaaagcagaacagugau

SEQ ID NO: 2216001 - RNA, 21 nt, Human
gauaaaagacagugaaagaaa

SEQ ID NO: 2216002 - RNA, 16 nt, Human
uacauuuguauaaaau

SEQ ID NO: 2216003 - RNA, 15 nt, Human
acucaccucccccau

SEQ ID NO: 2216004 - RNA, 12 nt, Human
gucccaggcuga

SEQ ID NO: 2216005 - RNA, 15 nt, Human
gacucaccuccccca

SEQ ID NO: 2216006 - RNA, 19 nt, Human
gucaaucagccuaguugau

SEQ ID NO: 2216007 - RNA, 22 nt, Human
uuugaaacgaggauugggaaaa

SEQ ID NO: 2216008 - RNA, 16 nt, Human
caggaaguagaggagg

SEQ ID NO: 2216009 - RNA, 18 nt, Human
caaggcugauuaaaccaa

SEQ ID NO: 2216010 - RNA, 23 nt, Human
uaggauggcuaguaucaaaagaa

SEQ ID NO: 2216011 - RNA, 16 nt, Human
acuaaacaaagaguga

SEQ ID NO: 2216012 - RNA, 14 nt, Human
cauagaaguaaaaa

SEQ ID NO: 2216013 - RNA, 15 nt, Human
ucccccaucucuucu

SEQ ID NO: 2216014 - RNA, 11 nt, Human
aauugcagagu

SEQ ID NO: 2216015 - RNA, 18 nt, Human
uaaaagacagugaaagaa

SEQ ID NO: 2216016 - RNA, 17 nt, Human
cuauccuacuuccccuu

SEQ ID NO: 2216017 - RNA, 18 nt, Human
auccccaagccuggcaag

SEQ ID NO: 2216018 - RNA, 15 nt, Human
ugaaauuguauuaca

SEQ ID NO: 2216019 - RNA, 11 nt, Human
uuauauuuauu

SEQ ID NO: 2216020 - RNA, 15 nt, Human
cccugcaaagcccag

SEQ ID NO: 2216021 - RNA, 19 nt, Human
acagugauuaccagggacu

SEQ ID NO: 2216022 - RNA, 22 nt, Human
caaugcuguauuuuaaaagaau

SEQ ID NO: 2216023 - RNA, 22 nt, Human
cuaucaauccaagaacuuauuu

SEQ ID NO: 2216024 - RNA, 14 nt, Human
cugccccccagccc

SEQ ID NO: 2216025 - RNA, 20 nt, Human
aaaaucuuauaauuuaaaau

SEQ ID NO: 2216026 - RNA, 17 nt, Human
agcgacagugagacucu

SEQ ID NO: 2216027 - RNA, 14 nt, Human
cugaggcuccacuu

SEQ ID NO: 2216028 - RNA, 17 nt, Human
agccagguaccuucuca

SEQ ID NO: 2216029 - RNA, 23 nt, Human
aggcaugagucagucugaugaga

SEQ ID NO: 2216030 - RNA, 18 nt, Human
ccaaaggcuccugagaca

SEQ ID NO: 2216031 - RNA, 17 nt, Human
auaaguacaugauaagc

SEQ ID NO: 2216032 - RNA, 14 nt, Human
cacaacacacagau

SEQ ID NO: 2216033 - RNA, 15 nt, Human
acaggguuuauguuu

SEQ ID NO: 2216034 - RNA, 20 nt, Human
auacugugugcuaaaacaag

SEQ ID NO: 2216035 - RNA, 16 nt, Human
ucaaaagaaagaaaau

SEQ ID NO: 2216036 - RNA, 20 nt, Human
uaaaagacaaggaaaaaaua

SEQ ID NO: 2216037 - RNA, 22 nt, Human
uuccccuuccuaauuccacagc

SEQ ID NO: 2216038 - RNA, 16 nt, Human
acuaggugcugcagcc

SEQ ID NO: 2216039 - RNA, 21 nt, Human
gcaucgugucuggcguugugg

SEQ ID NO: 2216040 - RNA, 14 nt, Human
uugccugcaggcau

SEQ ID NO: 2216041 - RNA, 16 nt, Human
ugcauagguuuaauaa

SEQ ID NO: 2216042 - RNA, 17 nt, Human
cugcacuccagccugag

SEQ ID NO: 2216043 - RNA, 20 nt, Human
gagccucagucucccucccu

SEQ ID NO: 2216044 - RNA, 17 nt, Human
ggagcucguggaacagu

SEQ ID NO: 2216045 - RNA, 19 nt, Human
cccauggcacucuauguuc

SEQ ID NO: 2216046 - RNA, 15 nt, Human
gccccugggaccagg

SEQ ID NO: 2216047 - RNA, 12 nt, Human
acaagacacagu

SEQ ID NO: 2216048 - RNA, 17 nt, Human
cugagcggaccuuccca

SEQ ID NO: 2216049 - RNA, 20 nt, Human
cacagcacgggggccaagga

SEQ ID NO: 2216050 - RNA, 19 nt, Human
ccucagcugccuccccagc

SEQ ID NO: 2216051 - RNA, 20 nt, Human
aauucuugccaaauauaaau

SEQ ID NO: 2216052 - RNA, 14 nt, Human
gcuggagcucugcc

SEQ ID NO: 2216053 - RNA, 24 nt, Human
cauaugaaaaggcuaagcuucacu

SEQ ID NO: 2216054 - RNA, 21 nt, Human
uuauguuuaauucugaaagca

SEQ ID NO: 2216055 - RNA, 16 nt, Human
cuucuggguuccuucc

SEQ ID NO: 2216056 - RNA, 20 nt, Human
augcuucuguuuuauaauuu

SEQ ID NO: 2216057 - RNA, 12 nt, Human
acaugagguacu

SEQ ID NO: 2216058 - RNA, 13 nt, Human
cccuccuuaucaa

SEQ ID NO: 2216059 - RNA, 13 nt, Human
ggaccuucccagc

SEQ ID NO: 2216060 - RNA, 17 nt, Human
agugagacagcucugca

SEQ ID NO: 2216061 - RNA, 19 nt, Human
accccugagcuugcagaga

SEQ ID NO: 2216062 - RNA, 15 nt, Human
aagaagugaaaaucu

SEQ ID NO: 2216063 - RNA, 20 nt, Human
aauuaaguuuuuuuuuaaaa

SEQ ID NO: 2216064 - RNA, 15 nt, Human
ugucaauaaaaucca

SEQ ID NO: 2216065 - RNA, 19 nt, Human
cuccagcuggccgggagcc

SEQ ID NO: 2216066 - RNA, 22 nt, Human
cugagcggaccuucccagcuag

SEQ ID NO: 2216067 - RNA, 21 nt, Human
caaagcccagcuugaaaccuu

SEQ ID NO: 2216068 - RNA, 19 nt, Human
ccccuauccuacuuccccu

SEQ ID NO: 2216069 - RNA, 14 nt, Human
auccaaugaaauga

SEQ ID NO: 2216070 - RNA, 13 nt, Human
acagcccuucuuu

SEQ ID NO: 2216071 - RNA, 14 nt, Human
ugcuucuguuuuau

SEQ ID NO: 2216072 - RNA, 19 nt, Human
cccugcaaagcccagcuug

SEQ ID NO: 2216073 - RNA, 21 nt, Human
aaaagguauuuuaaucaccaa

SEQ ID NO: 2216074 - RNA, 13 nt, Human
ccaaccucuccca

SEQ ID NO: 2216075 - RNA, 17 nt, Human
cugagcgacagugagac

SEQ ID NO: 2216076 - RNA, 15 nt, Human
cucaacaaacauaau

SEQ ID NO: 2216077 - RNA, 15 nt, Human
aagccuccuuuuaaa

SEQ ID NO: 2216078 - RNA, 13 nt, Human
caagccugccuca

SEQ ID NO: 2216079 - RNA, 23 nt, Human
uauguuaaaacugggacagggga

SEQ ID NO: 2216080 - RNA, 14 nt, Human
cagaaugaccuggc

SEQ ID NO: 2216081 - RNA, 17 nt, Human
ccucuggcuccagcugg

SEQ ID NO: 2216082 - RNA, 18 nt, Human
guuaguauuguccagguc

SEQ ID NO: 2216083 - RNA, 20 nt, Human
ugccccccagcccuccuuau

SEQ ID NO: 2216084 - RNA, 21 nt, Human
caucuagcaugucgucaaagc

SEQ ID NO: 2216085 - RNA, 16 nt, Human
cagaucaagccugccu

SEQ ID NO: 2216086 - RNA, 14 nt, Human
ccccugagcuugca

SEQ ID NO: 2216087 - RNA, 22 nt, Human
aaugaaauggugaaaugcagag

SEQ ID NO: 2216088 - RNA, 19 nt, Human
cucugccucagaaaacaag

SEQ ID NO: 2216089 - RNA, 14 nt, Human
uugcuggagcucug

SEQ ID NO: 2216090 - RNA, 16 nt, Human
cugcacuccagccuga

SEQ ID NO: 2216091 - RNA, 18 nt, Human
cuuuucccaacuccagaa

SEQ ID NO: 2216092 - RNA, 17 nt, Human
ggccaugggacagggag

SEQ ID NO: 2216093 - RNA, 19 nt, Human
auugaggacacugauaugg

SEQ ID NO: 2216094 - RNA, 15 nt, Human
aagaaaauaacaaua

SEQ ID NO: 2216095 - RNA, 13 nt, Human
ccaccugccuaua

SEQ ID NO: 2216096 - RNA, 12 nt, Human
caagccugccuc

SEQ ID NO: 2216097 - RNA, 18 nt, Human
gagcgacagugagacucu

SEQ ID NO: 2216098 - RNA, 21 nt, Human
aaaauaugccccauucaacau

SEQ ID NO: 2216099 - RNA, 17 nt, Human
uucugagcauuuaauau

SEQ ID NO: 2216100 - RNA, 20 nt, Human
uaugaaaaggcuaagcuuca

SEQ ID NO: 2216101 - RNA, 17 nt, Human
aaacauccuacaagaca

SEQ ID NO: 2216102 - RNA, 19 nt, Human
cucugcauacucauuagga

SEQ ID NO: 2216103 - RNA, 23 nt, Human
agcccuccuuaucaaaggacacc

SEQ ID NO: 2216104 - RNA, 16 nt, Human
ugacaagcucacagac

SEQ ID NO: 2216105 - RNA, 12 nt, Human
acugaaaucaua

SEQ ID NO: 2216106 - RNA, 18 nt, Human
cugagccuugggaccccu

SEQ ID NO: 2216107 - RNA, 14 nt, Human
gauugagaaggagc

SEQ ID NO: 2216108 - RNA, 18 nt, Human
acaugaacuuguaaagga

SEQ ID NO: 2216109 - RNA, 17 nt, Human
agggaagggggaacaug

SEQ ID NO: 2216110 - RNA, 23 nt, Human
ucugacacuaaaacaccucagcu

SEQ ID NO: 2216111 - RNA, 15 nt, Human
cuggacucaccuccc

SEQ ID NO: 2216112 - RNA, 16 nt, Human
aaaguguuugaaagcu

SEQ ID NO: 2216113 - RNA, 13 nt, Human
gugcugcagcccc

SEQ ID NO: 2216114 - RNA, 11 nt, Human
caacucccugc

SEQ ID NO: 2216115 - RNA, 19 nt, Human
ccaggcacccccagaauga

SEQ ID NO: 2216116 - RNA, 19 nt, Human
acucugucucaguccauga

SEQ ID NO: 2216117 - RNA, 16 nt, Human
aggccaugggacaggg

SEQ ID NO: 2216118 - RNA, 18 nt, Human
agaagcaacccaaauguu

SEQ ID NO: 2216119 - RNA, 23 nt, Human
uugccugcaggcaugagucaguc

SEQ ID NO: 2216120 - RNA, 18 nt, Human
cugcagccccugggacca

SEQ ID NO: 2216121 - RNA, 15 nt, Human
agacaaggaaaaaau

SEQ ID NO: 2216122 - RNA, 15 nt, Human
aaaauacaaaaaaaa

SEQ ID NO: 2216123 - RNA, 17 nt, Human
aaauccuacuuucauaa

SEQ ID NO: 2216124 - RNA, 14 nt, Human
uggcuugaguuuaa

SEQ ID NO: 2216125 - RNA, 16 nt, Human
cuugccugcaggcaug

SEQ ID NO: 2216126 - RNA, 13 nt, Human
auugauuauaugu

SEQ ID NO: 2216127 - RNA, 15 nt, Human
ccccagaaugaccug

SEQ ID NO: 2216128 - RNA, 21 nt, Human
gucucagugucaaugcagccc

SEQ ID NO: 2216129 - RNA, 22 nt, Human
accuaacgaaguauccuucagc

SEQ ID NO: 2216130 - RNA, 18 nt, Human
gaacucugagcagugcuu

SEQ ID NO: 2216131 - RNA, 18 nt, Human
cuaucccaaccucuccca

SEQ ID NO: 2216132 - RNA, 23 nt, Human
aggcuuacacccacaguggaaag

SEQ ID NO: 2216133 - RNA, 20 nt, Human
agaagaacugaaaucauacu

SEQ ID NO: 2216134 - RNA, 22 nt, Human
cacuuccaagagccuuuuuuug

SEQ ID NO: 2216135 - RNA, 13 nt, Human
aucaaugaaugaa

SEQ ID NO: 2216136 - RNA, 13 nt, Human
aaaauaacaauga

SEQ ID NO: 2216137 - RNA, 23 nt, Human
agaguuuagcuggaaaaguaugu

SEQ ID NO: 2216138 - RNA, 16 nt, Human
gaagauguagaggaga

SEQ ID NO: 2216139 - RNA, 11 nt, Human
uucacagggga

SEQ ID NO: 2216140 - RNA, 14 nt, Human
aagcaacccaaaug

SEQ ID NO: 2216141 - RNA, 16 nt, Human
aaagacaaggaaaaaa

SEQ ID NO: 2216142 - RNA, 17 nt, Human
aagcuuuuuuugaauca

SEQ ID NO: 2216143 - RNA, 18 nt, Human
cuuugagcgcccacuaga

SEQ ID NO: 2216144 - RNA, 21 nt, Human
uuuucaggcuagauguaugua

SEQ ID NO: 2216145 - RNA, 13 nt, Human
acuaauuuuaaaa

SEQ ID NO: 2216146 - RNA, 18 nt, Human
gaaggagcucccaggagg

SEQ ID NO: 2216147 - RNA, 21 nt, Human
aaugugacuuaaugccacuaa

SEQ ID NO: 2216148 - RNA, 20 nt, Human
uaauaaguugcauagguuua

SEQ ID NO: 2216149 - RNA, 12 nt, Human
cuucaacucccu

SEQ ID NO: 2216150 - RNA, 20 nt, Human
aauuuugugaagcaaaauuu

SEQ ID NO: 2216151 - RNA, 20 nt, Human
uccaagccucauguccacug

SEQ ID NO: 2216152 - RNA, 22 nt, Human
ggccauagucauucugccugcc

SEQ ID NO: 2216153 - RNA, 19 nt, Human
aaacaauaacgauaaaaga

SEQ ID NO: 2216154 - RNA, 18 nt, Human
gaagcaaaauuuuuucuc

SEQ ID NO: 2216155 - RNA, 21 nt, Human
ucuuaggguuaugauuaagua

SEQ ID NO: 2216156 - RNA, 15 nt, Human
uaacaauaaaagaca

SEQ ID NO: 2216157 - RNA, 15 nt, Human
caccucagcugccuc

SEQ ID NO: 2216158 - RNA, 22 nt, Human
accccugagcuugcagagauga

SEQ ID NO: 2216159 - RNA, 20 nt, Human
agagacacacugaagaagca

SEQ ID NO: 2216160 - RNA, 16 nt, Human
ggcugagccucagucu

SEQ ID NO: 2216161 - RNA, 18 nt, Human
aaagagugaaggauuuau

SEQ ID NO: 2216162 - RNA, 18 nt, Human
gccuuggggcugaugcag

SEQ ID NO: 2216163 - RNA, 18 nt, Human
cagagacagaaagcagaa

SEQ ID NO: 2216164 - RNA, 13 nt, Human
ccucccccaucuc

SEQ ID NO: 2216165 - RNA, 14 nt, Human
cuggaaaucagggu

SEQ ID NO: 2216166 - RNA, 14 nt, Human
cuucucuucacagu

SEQ ID NO: 2216167 - RNA, 19 nt, Human
agacucgggauuaguacac

SEQ ID NO: 2216168 - RNA, 20 nt, Human
uuuaguaagagauuccugag

SEQ ID NO: 2216169 - RNA, 17 nt, Human
agaaucacuugaacccg

SEQ ID NO: 2216170 - RNA, 15 nt, Human
uguuaaaugauuuca

SEQ ID NO: 2216171 - RNA, 22 nt, Human
cagcuagaauucacuccacuug

SEQ ID NO: 2216172 - RNA, 15 nt, Human
uccaaugacauuuug

SEQ ID NO: 2216173 - RNA, 13 nt, Human
agaaguaaaaaca

SEQ ID NO: 2216174 - RNA, 17 nt, Human
aauaacaauaaaagaca

SEQ ID NO: 2216175 - RNA, 18 nt, Human
ccugagcggaccuuccca

SEQ ID NO: 2216176 - RNA, 22 nt, Human
agcccuccuuaucaaaggacac

SEQ ID NO: 2216177 - RNA, 15 nt, Human
auaauccuaaacaua

SEQ ID NO: 2216178 - RNA, 23 nt, Human
gggagccugaucaccugcccugc

SEQ ID NO: 2216179 - RNA, 19 nt, Human
gagggaauugcagaguacu

SEQ ID NO: 2216180 - RNA, 15 nt, Human
aaaaaauaacaauga

SEQ ID NO: 2216181 - RNA, 19 nt, Human
uguaguguuggagaagaac

SEQ ID NO: 2216182 - RNA, 14 nt, Human
aucaaaagaaagaa

SEQ ID NO: 2216183 - RNA, 17 nt, Human
caaauccaaugaaauga

SEQ ID NO: 2216184 - RNA, 22 nt, Human
cccuauccuacuuccccuuccu

SEQ ID NO: 2216185 - RNA, 15 nt, Human
gccccugcacuccag

SEQ ID NO: 2216186 - RNA, 12 nt, Human
cauuauauuuau

SEQ ID NO: 2216187 - RNA, 15 nt, Human
acaagacccaaaagg

SEQ ID NO: 2216188 - RNA, 22 nt, Human
aucucuucuggguuccuuccuc

SEQ ID NO: 2216189 - RNA, 17 nt, Human
auuuucuauaauuuaaa

SEQ ID NO: 2216190 - RNA, 17 nt, Human
ccugugggaccugggcc

SEQ ID NO: 2216191 - RNA, 15 nt, Human
agaauaccacaggaa

SEQ ID NO: 2216192 - RNA, 16 nt, Human
guuuuguuucuuccuu

SEQ ID NO: 2216193 - RNA, 19 nt, Human
gccauagucauucugccug

SEQ ID NO: 2216194 - RNA, 16 nt, Human
augcuaagugaaauaa

SEQ ID NO: 2216195 - RNA, 17 nt, Human
ucuauaauguguucauu

SEQ ID NO: 2216196 - RNA, 17 nt, Human
ugaccacugcagaagac

SEQ ID NO: 2216197 - RNA, 15 nt, Human
cgggagccugaucac

SEQ ID NO: 2216198 - RNA, 13 nt, Human
gcucucuggccuu

SEQ ID NO: 2216199 - RNA, 20 nt, Human
gaaacauuugguaaggggaa

SEQ ID NO: 2216200 - RNA, 18 nt, Human
uaauuuuaacucuauaau

SEQ ID NO: 2216201 - RNA, 16 nt, Human
uaaaagacaaggaaaa

SEQ ID NO: 2216202 - RNA, 17 nt, Human
auuuuaauaauguuuca

SEQ ID NO: 2216203 - RNA, 20 nt, Human
aagggcuguuauaaucuuuc

SEQ ID NO: 2216204 - RNA, 19 nt, Human
uugugccccugcacuccag

SEQ ID NO: 2216205 - RNA, 19 nt, Human
auaaaagacagugaaagaa

SEQ ID NO: 2216206 - RNA, 23 nt, Human
auuuuauagcuacuaauuuuaaa

SEQ ID NO: 2216207 - RNA, 23 nt, Human
gucucccucccuuggggccuaug

SEQ ID NO: 2216208 - RNA, 16 nt, Human
uaggugcugcagcccc

SEQ ID NO: 2216209 - RNA, 23 nt, Human
ccacuuggacaugggccccagau

SEQ ID NO: 2216210 - RNA, 13 nt, Human
uacagagacagaa

SEQ ID NO: 2216211 - RNA, 22 nt, Human
agugagcagucaggaaagagaa

SEQ ID NO: 2216212 - RNA, 13 nt, Human
ugaaaaucuuaua

SEQ ID NO: 2216213 - RNA, 22 nt, Human
aauuuuuucucuaggaaauauu

SEQ ID NO: 2216214 - RNA, 17 nt, Human
agagacagaaagcagaa

SEQ ID NO: 2216215 - RNA, 15 nt, Human
uggacucaccucccc

SEQ ID NO: 2216216 - RNA, 17 nt, Human
agcuucacuguaaaaua

SEQ ID NO: 2216217 - RNA, 15 nt, Human
uagggugauauuaac

SEQ ID NO: 2216218 - RNA, 13 nt, Human
cacauccuguggg

SEQ ID NO: 2216219 - RNA, 19 nt, Human
aaaaucuuauaauuuaaaa

SEQ ID NO: 2216220 - RNA, 18 nt, Human
auagcuacuaauuuuaaa

SEQ ID NO: 2216221 - RNA, 12 nt, Human
gaugcugagccc

SEQ ID NO: 2216222 - RNA, 12 nt, Human
gaauuggagcuc

SEQ ID NO: 2216223 - RNA, 22 nt, Human
auauaaauaaaaauaauccuca

SEQ ID NO: 2216224 - RNA, 16 nt, Human
auuccaccuacaugag

SEQ ID NO: 2216225 - RNA, 20 nt, Human
acggacgaaccuugaaaacu

SEQ ID NO: 2216226 - RNA, 14 nt, Human
cucagcugccuccc

SEQ ID NO: 2216227 - RNA, 14 nt, Human
uauguauauuuuau

SEQ ID NO: 2216228 - RNA, 19 nt, Human
gaaagaaaauaacaauaaa

SEQ ID NO: 2216229 - RNA, 16 nt, Human
aucaagccugccucaa

SEQ ID NO: 2216230 - RNA, 21 nt, Human
cuaagcuucacuguaaaauaa

SEQ ID NO: 2216231 - RNA, 17 nt, Human
ucugugagaugcuagaa

SEQ ID NO: 2216232 - RNA, 22 nt, Human
uauuucagauaaucacaauaca

SEQ ID NO: 2216233 - RNA, 14 nt, Human
aagcaucacaugaa

SEQ ID NO: 2216234 - RNA, 17 nt, Human
agccuuggauacuccau

SEQ ID NO: 2216235 - RNA, 17 nt, Human
aaucuuauaauuuaaaa

SEQ ID NO: 2216236 - RNA, 20 nt, Human
ugagcgcccacuagacccac

SEQ ID NO: 2216237 - RNA, 16 nt, Human
auccuacaagacacag

SEQ ID NO: 2216238 - RNA, 16 nt, Human
acaugaacuuguaaag

SEQ ID NO: 2216239 - RNA, 18 nt, Human
cauccaaaggcuccugag

SEQ ID NO: 2216240 - RNA, 20 nt, Human
aaaacaagcacuaaacaaag

SEQ ID NO: 2216241 - RNA, 19 nt, Human
guuguauuauuuuuuaaaa

SEQ ID NO: 2216242 - RNA, 18 nt, Human
cagaaagcagaacaguga

SEQ ID NO: 2216243 - RNA, 19 nt, Human
agagccuuuuuuugaaaaa

SEQ ID NO: 2216244 - RNA, 14 nt, Human
ugagaugcuagaac

SEQ ID NO: 2216245 - RNA, 16 nt, Human
cauagucauucugccu

SEQ ID NO: 2216246 - RNA, 13 nt, Human
accuggccgcagu

SEQ ID NO: 2216247 - RNA, 16 nt, Human
auaucaauuuaaaaaa

SEQ ID NO: 2216248 - RNA, 20 nt, Human
uguuggugaacuugguuuua

SEQ ID NO: 2216249 - RNA, 14 nt, Human
ugcugcagccccug

SEQ ID NO: 2216250 - RNA, 23 nt, Human
ugagucagucugaugagaacucu

SEQ ID NO: 2216251 - RNA, 13 nt, Human
cagucugaugaga

SEQ ID NO: 2216252 - RNA, 15 nt, Human
auauugacuuuuuau

SEQ ID NO: 2216253 - RNA, 13 nt, Human
cacauuuaaauaa

SEQ ID NO: 2216254 - RNA, 17 nt, Human
agguccacaacacacag

SEQ ID NO: 2216255 - RNA, 20 nt, Human
uugaacccgggaggcagagg

SEQ ID NO: 2216256 - RNA, 20 nt, Human
ugagucccaggcugagccuc

SEQ ID NO: 2216257 - RNA, 12 nt, Human
gauaaaagacag

SEQ ID NO: 2216258 - RNA, 15 nt, Human
cagugucaggaggaa

SEQ ID NO: 2216259 - RNA, 23 nt, Human
gccccugcacuccagccugagcg

SEQ ID NO: 2216260 - RNA, 15 nt, Human
cuuuucccaacucca

SEQ ID NO: 2216261 - RNA, 19 nt, Human
gucuuucacauuuaaauaa

SEQ ID NO: 2216262 - RNA, 21 nt, Human
gccaaauauaaauaaaaauaa

SEQ ID NO: 2216263 - RNA, 22 nt, Human
aggacaccauuuuggcaagcuc

SEQ ID NO: 2216264 - RNA, 22 nt, Human
uaauaggcguaacuaauuuuaa

SEQ ID NO: 2216265 - RNA, 19 nt, Human
gccccccagcccuccuuau

SEQ ID NO: 2216266 - RNA, 20 nt, Human
aagucuuucacauuuaaaua

SEQ ID NO: 2216267 - RNA, 14 nt, Human
ccugggcugaggca

SEQ ID NO: 2216268 - RNA, 14 nt, Human
uaguuucccuugca

SEQ ID NO: 2216269 - RNA, 23 nt, Human
auauaacaaugcuguauuuuaaa

SEQ ID NO: 2216270 - RNA, 18 nt, Human
aagggaauuucuucaacu

SEQ ID NO: 2216271 - RNA, 14 nt, Human
aaaagacagugaaa

SEQ ID NO: 2216272 - RNA, 16 nt, Human
cugagccucagucucc

SEQ ID NO: 2216273 - RNA, 23 nt, Human
aaguauccuucagccugaaagag

SEQ ID NO: 2216274 - RNA, 19 nt, Human
uuguggggaugaacuuuuu

SEQ ID NO: 2216275 - RNA, 17 nt, Human
aaaguacaagagcuuaa

SEQ ID NO: 2216276 - RNA, 12 nt, Human
uauucacaagac

SEQ ID NO: 2216277 - RNA, 14 nt, Human
ccugccccccagcc

SEQ ID NO: 2216278 - RNA, 15 nt, Human
augaauuaaguuuuu

SEQ ID NO: 2216279 - RNA, 16 nt, Human
uuuuagugaaauauua

SEQ ID NO: 2216280 - RNA, 18 nt, Human
caugaauuaguuuuauau

SEQ ID NO: 2216281 - RNA, 22 nt, Human
ugaauggcuaagcaaaauguga

SEQ ID NO: 2216282 - RNA, 17 nt, Human
agugauuaccagggacu

SEQ ID NO: 2216283 - RNA, 19 nt, Human
uggaacaguuaccucugcc

SEQ ID NO: 2216284 - RNA, 18 nt, Human
ccacuuggucugugagau

SEQ ID NO: 2216285 - RNA, 15 nt, Human
uucacuguaaaauaa

SEQ ID NO: 2216286 - RNA, 15 nt, Human
auagucauucugccu

SEQ ID NO: 2216287 - RNA, 19 nt, Human
gguuuaauaauuuuuaauu

SEQ ID NO: 2216288 - RNA, 17 nt, Human
ccaugaugcugagcccg

SEQ ID NO: 2216289 - RNA, 18 nt, Human
cagccucuuagaugcagu

SEQ ID NO: 2216290 - RNA, 17 nt, Human
auaaaguacaagagcuu

SEQ ID NO: 2216291 - RNA, 18 nt, Human
gccccugcacuccagccu

SEQ ID NO: 2216292 - RNA, 18 nt, Human
auuuguauaaaauaauuu

SEQ ID NO: 2216293 - RNA, 16 nt, Human
aauuacauuuguauaa

SEQ ID NO: 2216294 - RNA, 19 nt, Human
acuggacucaccuccccca

SEQ ID NO: 2216295 - RNA, 18 nt, Human
cagguaccuucucaccug

SEQ ID NO: 2216296 - RNA, 22 nt, Human
gucucuacuaaaaauacaaaaa

SEQ ID NO: 2216297 - RNA, 22 nt, Human
gcuucucauccugcaggcagcu

SEQ ID NO: 2216298 - RNA, 15 nt, Human
cucgugggacaguca

SEQ ID NO: 2216299 - RNA, 20 nt, Human
cuuauucacaagacccaaaa

SEQ ID NO: 2216300 - RNA, 23 nt, Human
agcagugcuugaaugaaguugua

SEQ ID NO: 2216301 - RNA, 14 nt, Human
ugagcuugcagaga

SEQ ID NO: 2216302 - RNA, 16 nt, Human
acauuuauauuuuugu

SEQ ID NO: 2216303 - RNA, 20 nt, Human
guaucaaaagaaagaaaauc

SEQ ID NO: 2216304 - RNA, 15 nt, Human
aaaaaagaaacauuu

SEQ ID NO: 2216305 - RNA, 15 nt, Human
aaaauaacaaugaaa

SEQ ID NO: 2216306 - RNA, 13 nt, Human
uuuuaaaaaagaa

SEQ ID NO: 2216307 - RNA, 16 nt, Human
ccccugcacuccagcc

SEQ ID NO: 2216308 - RNA, 12 nt, Human
aauuuaaauaua

SEQ ID NO: 2216309 - RNA, 18 nt, Human
cacuccagugagacagcu

SEQ ID NO: 2216310 - RNA, 17 nt, Human
aaagaaacauuugguaa

SEQ ID NO: 2216311 - RNA, 14 nt, Human
guauuuuaaaagaa

SEQ ID NO: 2216312 - RNA, 18 nt, Human
gcuaucaauccaagaacu

SEQ ID NO: 2216313 - RNA, 20 nt, Human
cccugcacuccagccugagc

SEQ ID NO: 2216314 - RNA, 16 nt, Human
ccagaucaagccugcc

SEQ ID NO: 2216315 - RNA, 14 nt, Human
uuaugauuaaguaa

SEQ ID NO: 2216316 - RNA, 17 nt, Human
ugaaggauuuauguuua

SEQ ID NO: 2216317 - RNA, 16 nt, Human
uauccuacuuccccuu

SEQ ID NO: 2216318 - RNA, 16 nt, Human
aagaaaauaacaauaa

SEQ ID NO: 2216319 - RNA, 19 nt, Human
ugagcgcccacuagaccca

SEQ ID NO: 2216320 - RNA, 14 nt, Human
aauggcuaagcaaa

SEQ ID NO: 2216321 - RNA, 19 nt, Human
ccccucuggcuccagcugg

SEQ ID NO: 2216322 - RNA, 13 nt, Human
ccaaauugagcua

SEQ ID NO: 2216323 - RNA, 17 nt, Human
uccucugagccuuggga

SEQ ID NO: 2216324 - RNA, 12 nt, Human
aaugcagccccc

SEQ ID NO: 2216325 - RNA, 20 nt, Human
aauaagccagacaucaacag

SEQ ID NO: 2216326 - RNA, 14 nt, Human
gugagcuacaaaug

SEQ ID NO: 2216327 - RNA, 23 nt, Human
aaaaacagaccgggguucccgug

SEQ ID NO: 2216328 - RNA, 13 nt, Human
aaaaauccuacuu

SEQ ID NO: 2216329 - RNA, 15 nt, Human
aaauauaaauaaaaa

SEQ ID NO: 2216330 - RNA, 23 nt, Human
aggcacccccagaaugaccuggc

SEQ ID NO: 2216331 - RNA, 13 nt, Human
gauuguaaaaugg

SEQ ID NO: 2216332 - RNA, 14 nt, Human
aauaguuuaugauu

SEQ ID NO: 2216333 - RNA, 15 nt, Human
ugcuucuguuuuaua

SEQ ID NO: 2216334 - RNA, 15 nt, Human
gccucagucucccuc

SEQ ID NO: 2216335 - RNA, 20 nt, Human
gccagcccucuucugacacu

SEQ ID NO: 2216336 - RNA, 17 nt, Human
cguaaucguguccccua

SEQ ID NO: 2216337 - RNA, 18 nt, Human
agcugcucaauaaaguac

SEQ ID NO: 2216338 - RNA, 12 nt, Human
aucguguccccu

SEQ ID NO: 2216339 - RNA, 23 nt, Human
agccuugggaccccugagcuugc

SEQ ID NO: 2216340 - RNA, 16 nt, Human
cagcuuuuucucuccc

SEQ ID NO: 2216341 - RNA, 13 nt, Human
agagguccacaac

SEQ ID NO: 2216342 - RNA, 13 nt, Human
aguuaccucugcc

SEQ ID NO: 2216343 - RNA, 23 nt, Human
uagucauucugccugcccugaaa

SEQ ID NO: 2216344 - RNA, 15 nt, Human
cugcacuccagccug

SEQ ID NO: 2216345 - RNA, 23 nt, Human
aaauuuacagagacagaaagcag

SEQ ID NO: 2216346 - RNA, 13 nt, Human
aucaggcuggcca

SEQ ID NO: 2216347 - RNA, 20 nt, Human
cccugccccccagcccuccu

SEQ ID NO: 2216348 - RNA, 15 nt, Human
uugacccacaagaaa

SEQ ID NO: 2216349 - RNA, 19 nt, Human
gcuuguauuccuuuuucuc

SEQ ID NO: 2216350 - RNA, 19 nt, Human
uggaaauguuuacagaucc

SEQ ID NO: 2216351 - RNA, 14 nt, Human
acagaauuuuaugc

SEQ ID NO: 2216352 - RNA, 20 nt, Human
uuguagguaauauugcaagg

SEQ ID NO: 2216353 - RNA, 13 nt, Human
uuauucacaagac

SEQ ID NO: 2216354 - RNA, 23 nt, Human
uuuccaucaaggguacacugccu

SEQ ID NO: 2216355 - RNA, 22 nt, Human
gaugcaguuguugcccacagcu

SEQ ID NO: 2216356 - RNA, 16 nt, Human
cugcucucaguucacu

SEQ ID NO: 2216357 - RNA, 18 nt, Human
agcuagaauucacuccac

SEQ ID NO: 2216358 - RNA, 22 nt, Human
ccugggaccaggcacccccaga

SEQ ID NO: 2216359 - RNA, 12 nt, Human
auuuuaaaagaa

SEQ ID NO: 2216360 - RNA, 21 nt, Human
cccccauuguggucacaggaa

SEQ ID NO: 2216361 - RNA, 19 nt, Human
ucccagaucaagccugccu

SEQ ID NO: 2216362 - RNA, 23 nt, Human
uccagguagaggguguguaagua

SEQ ID NO: 2216363 - RNA, 14 nt, Human
ccagcuggccggga

SEQ ID NO: 2216364 - RNA, 18 nt, Human
caaggcuagaaccaccug

SEQ ID NO: 2216365 - RNA, 23 nt, Human
cacaagaaaugaaagcagggacu

SEQ ID NO: 2216366 - RNA, 19 nt, Human
aaauggugaaaugcagagu

SEQ ID NO: 2216367 - RNA, 19 nt, Human
augaauuacauuuguauaa

SEQ ID NO: 2216368 - RNA, 23 nt, Human
cauuuuuuuuuucaauaaaacuu

SEQ ID NO: 2216369 - RNA, 15 nt, Human
uuauagcuacuaauu

SEQ ID NO: 2216370 - RNA, 18 nt, Human
gaugcaguucugaagaag

SEQ ID NO: 2216371 - RNA, 17 nt, Human
ccacuggacucaccucc

SEQ ID NO: 2216372 - RNA, 18 nt, Human
gagucccaggcugagccu

SEQ ID NO: 2216373 - RNA, 17 nt, Human
gaaaaucaggcuggcca

SEQ ID NO: 2216374 - RNA, 23 nt, Human
gcagacucuggucaagaagcauc

SEQ ID NO: 2216375 - RNA, 17 nt, Human
acucaccucccccaucu

SEQ ID NO: 2216376 - RNA, 16 nt, Human
ccuaugcagaggucca

SEQ ID NO: 2216377 - RNA, 21 nt, Human
ccugaucaccugcccugcuga

SEQ ID NO: 2216378 - RNA, 19 nt, Human
auuguauuuuaguaagaga

SEQ ID NO: 2216379 - RNA, 14 nt, Human
ugaagauguagagg

SEQ ID NO: 2216380 - RNA, 18 nt, Human
ccuugggaccccugagcu

SEQ ID NO: 2216381 - RNA, 16 nt, Human
gaaaaaauaacaauga

SEQ ID NO: 2216382 - RNA, 16 nt, Human
uccuguaauggaagca

SEQ ID NO: 2216383 - RNA, 16 nt, Human
agagggaauugcagag

SEQ ID NO: 2216384 - RNA, 15 nt, Human
augggacagggagga

SEQ ID NO: 2216385 - RNA, 16 nt, Human
uuguaaaggaauuuaa

SEQ ID NO: 2216386 - RNA, 20 nt, Human
caccucagcugccuccccag

SEQ ID NO: 2216387 - RNA, 22 nt, Human
guacacugccuucucaacucca

SEQ ID NO: 2216388 - RNA, 13 nt, Human
uuuagugaaauau

SEQ ID NO: 2216389 - RNA, 19 nt, Human
aggucuaccaaaaaucuca

SEQ ID NO: 2216390 - RNA, 15 nt, Human
cagaauucauucacu

SEQ ID NO: 2216391 - RNA, 19 nt, Human
accucagcugccuccccag

SEQ ID NO: 2216392 - RNA, 22 nt, Human
uuuaauaauguuucaaacauau

SEQ ID NO: 2216393 - RNA, 15 nt, Human
auaauuuugugaagc

SEQ ID NO: 2216394 - RNA, 18 nt, Human
ugagaaggagcucccagg

SEQ ID NO: 2216395 - RNA, 20 nt, Human
uguaagaaaauaucacuugu

SEQ ID NO: 2216396 - RNA, 19 nt, Human
agucaaauugugugaaagg

SEQ ID NO: 2216397 - RNA, 19 nt, Human
agcuacuaauuuuaaaaug

SEQ ID NO: 2216398 - RNA, 20 nt, Human
ucauucacucaacaaacaua

SEQ ID NO: 2216399 - RNA, 19 nt, Human
acaauaacgauaaaagaca

SEQ ID NO: 2216400 - RNA, 21 nt, Human
guggggaugaacuuuuuguuu

SEQ ID NO: 2216401 - RNA, 12 nt, Human
aauugcagagua

SEQ ID NO: 2216402 - RNA, 16 nt, Human
aaaauaacaauaaaag

SEQ ID NO: 2216403 - RNA, 13 nt, Human
acacuuaaaaaug

SEQ ID NO: 2216404 - RNA, 14 nt, Human
cugaaagucccaga

SEQ ID NO: 2216405 - RNA, 17 nt, Human
auaucaauuuaaaaaaa

SEQ ID NO: 2216406 - RNA, 12 nt, Human
aaaagaaagaaa

SEQ ID NO: 2216407 - RNA, 23 nt, Human
uuguaacaagccuccuuuuaaag

SEQ ID NO: 2216408 - RNA, 16 nt, Human
ucuugagguaaaagca

SEQ ID NO: 2216409 - RNA, 21 nt, Human
cuaccuuuugcuguggcaaau

SEQ ID NO: 2216410 - RNA, 24 nt, Human
gccugcccugaaagucccagauca

SEQ ID NO: 2216411 - RNA, 15 nt, Human
ucuuauaauuuaaaa

SEQ ID NO: 2216412 - RNA, 21 nt, Human
auucagagcuuacuuaaaauu

SEQ ID NO: 2216413 - RNA, 22 nt, Human
cagaguacuggcugauggagua

SEQ ID NO: 2216414 - RNA, 15 nt, Human
ggcagcuuuuucucu

SEQ ID NO: 2216415 - RNA, 18 nt, Human
agaucaagccugccucaa

SEQ ID NO: 2216416 - RNA, 15 nt, Human
uacaaaugcauuucu

SEQ ID NO: 2216417 - RNA, 17 nt, Human
cauauuuauagccaggu

SEQ ID NO: 2216418 - RNA, 14 nt, Human
acauagugaggagc

SEQ ID NO: 2216419 - RNA, 18 nt, Human
ugugaccacugcagaaga

SEQ ID NO: 2216420 - RNA, 19 nt, Human
aagcuuguauuccuuuuuc

SEQ ID NO: 2216421 - RNA, 22 nt, Human
caagcucuaucaccaaggagcc

SEQ ID NO: 2216422 - RNA, 16 nt, Human
ggaugccccguccccc

SEQ ID NO: 2216423 - RNA, 16 nt, Human
agaucaagccugccuc

SEQ ID NO: 2216424 - RNA, 13 nt, Human
gagcuaggggggu

SEQ ID NO: 2216425 - RNA, 19 nt, Human
ccauccugccccugagccc

SEQ ID NO: 2216426 - RNA, 23 nt, Human
ccagaucaagccugccucaauca

SEQ ID NO: 2216427 - RNA, 23 nt, Human
ucaauaucuuuuuuuuaauaaac

SEQ ID NO: 2216428 - RNA, 16 nt, Human
aaacuuuuccaaugac

SEQ ID NO: 2216429 - RNA, 21 nt, Human
ccaaauauaaauaaaaauaau

SEQ ID NO: 2216430 - RNA, 22 nt, Human
ugauaguuguaccgcaauguga

SEQ ID NO: 2216431 - RNA, 19 nt, Human
uccagccuggcaaggguuc

SEQ ID NO: 2216432 - RNA, 16 nt, Human
uguccccuauccuacu

SEQ ID NO: 2216433 - RNA, 12 nt, Human
uuaauaaaccau

SEQ ID NO: 2216434 - RNA, 16 nt, Human
cagggcucacagaauu

SEQ ID NO: 2216435 - RNA, 23 nt, Human
ggaacaguuaccucugccucaga

SEQ ID NO: 2216436 - RNA, 13 nt, Human
caccaaggagcca

SEQ ID NO: 2216437 - RNA, 23 nt, Human
cauuguggucacaggaaguagag

SEQ ID NO: 2216438 - RNA, 23 nt, Human
agggaagggggaacaugagccuu

SEQ ID NO: 2216439 - RNA, 22 nt, Human
cucugagccuugggaccccuga

SEQ ID NO: 2216440 - RNA, 19 nt, Human
gcucauggaauuggagcuc

SEQ ID NO: 2216441 - RNA, 19 nt, Human
cagagaugaggccgccaug

SEQ ID NO: 2216442 - RNA, 22 nt, Human
agacccacuggacucaccuccc

SEQ ID NO: 2216443 - RNA, 17 nt, Human
gaaugagagacacacug

SEQ ID NO: 2216444 - RNA, 17 nt, Human
aaauauaaauaaaaaua

SEQ ID NO: 2216445 - RNA, 20 nt, Human
agaggagaaacuggaacucu

SEQ ID NO: 2216446 - RNA, 22 nt, Human
auagccagguaccuucucaccu

SEQ ID NO: 2216447 - RNA, 15 nt, Human
aaagaaagaaaauca

SEQ ID NO: 2216448 - RNA, 17 nt, Human
ccaaaagguauuuuaau

SEQ ID NO: 2216449 - RNA, 19 nt, Human
caacucccugccccccagc

SEQ ID NO: 2216450 - RNA, 22 nt, Human
uuuauagcuacuaauuuuaaaa

SEQ ID NO: 2216451 - RNA, 16 nt, Human
cuucaacucccugccc

SEQ ID NO: 2216452 - RNA, 12 nt, Human
cuacaagacaca

SEQ ID NO: 2216453 - RNA, 15 nt, Human
ccaaggagccaaaca

SEQ ID NO: 2216454 - RNA, 18 nt, Human
aaauauuuauuuuaauaa

SEQ ID NO: 2216455 - RNA, 16 nt, Human
aucaauuuaaaaaaaa

SEQ ID NO: 2216456 - RNA, 21 nt, Human
agccuuggauacuccaugggg

SEQ ID NO: 2216457 - RNA, 17 nt, Human
ccagaucaagccugccu

SEQ ID NO: 2216458 - RNA, 18 nt, Human
ccaggaggggcuucuggg

SEQ ID NO: 2216459 - RNA, 20 nt, Human
ucuucuggguuccuuccucu

SEQ ID NO: 2216460 - RNA, 15 nt, Human
agccccugggaccag

SEQ ID NO: 2216461 - RNA, 20 nt, Human
ugggccccagauaccaugau

SEQ ID NO: 2216462 - RNA, 13 nt, Human
gagacagcucugc

SEQ ID NO: 2216463 - RNA, 15 nt, Human
gccuugggaccccug

SEQ ID NO: 2216464 - RNA, 21 nt, Human
ccucccuuggggccuaugcag

SEQ ID NO: 2216465 - RNA, 23 nt, Human
agcaugucgucaaagcugaaaug

SEQ ID NO: 2216466 - RNA, 14 nt, Human
acaaauccaaugaa

SEQ ID NO: 2216467 - RNA, 20 nt, Human
ccacuuggacaugggcccca

SEQ ID NO: 2216468 - RNA, 12 nt, Human
gaagaccucauu

SEQ ID NO: 2216469 - RNA, 20 nt, Human
cuacuuccccuuccuaauuc

SEQ ID NO: 2216470 - RNA, 20 nt, Human
ccugccuaagugcagccccg

SEQ ID NO: 2216471 - RNA, 15 nt, Human
uugacacuuaaaaau

SEQ ID NO: 2216472 - RNA, 15 nt, Human
cccccagcccuccuu

SEQ ID NO: 2216473 - RNA, 20 nt, Human
aaagagugaaggauuuaugu

SEQ ID NO: 2216474 - RNA, 19 nt, Human
cccacuggacucaccuccc

SEQ ID NO: 2216475 - RNA, 20 nt, Human
gaaaauaacgauaaaagaca

SEQ ID NO: 2216476 - RNA, 17 nt, Human
ucuauaauuuaaauaua

SEQ ID NO: 2216477 - RNA, 22 nt, Human
caguauggcagcuuuccucaaa

SEQ ID NO: 2216478 - RNA, 20 nt, Human
cucuguucugcacacagcac

SEQ ID NO: 2216479 - RNA, 14 nt, Human
uaugaauuacauuu

SEQ ID NO: 2216480 - RNA, 13 nt, Human
cugagagugaaca

SEQ ID NO: 2216481 - RNA, 23 nt, Human
cacuggacucaccucccccaucu

SEQ ID NO: 2216482 - RNA, 21 nt, Human
aggguuaugauuaaguaauga

SEQ ID NO: 2216483 - RNA, 15 nt, Human
ggacucaccuccccc

SEQ ID NO: 2216484 - RNA, 21 nt, Human
cccccucuggcuccagcuggc

SEQ ID NO: 2216485 - RNA, 14 nt, Human
ugagcucagcccug

SEQ ID NO: 2216486 - RNA, 14 nt, Human
cucagucucccucc

SEQ ID NO: 2216487 - RNA, 19 nt, Human
caucaaggguacacugccu

SEQ ID NO: 2216488 - RNA, 22 nt, Human
cccaugauguuuagaaacacaa

SEQ ID NO: 2216489 - RNA, 19 nt, Human
uaggggggucagccagccc

SEQ ID NO: 2216490 - RNA, 14 nt, Human
cugagucccaggcu

SEQ ID NO: 2216491 - RNA, 19 nt, Human
gucaaauugugugaaaggu

SEQ ID NO: 2216492 - RNA, 17 nt, Human
cugggaccaggcacccc

SEQ ID NO: 2216493 - RNA, 15 nt, Human
uucacauuuaaauaa

SEQ ID NO: 2216494 - RNA, 23 nt, Human
agucccagaucaagccugccuca

SEQ ID NO: 2216495 - RNA, 16 nt, Human
cucagcugccucccca

SEQ ID NO: 2216496 - RNA, 15 nt, Human
acaaggaaaaaauaa

SEQ ID NO: 2216497 - RNA, 16 nt, Human
ugagaugcuagaacuc

SEQ ID NO: 2216498 - RNA, 17 nt, Human
ugaaaaucuuauaauuu

SEQ ID NO: 2216499 - RNA, 18 nt, Human
guuuaugguuguauuauu

SEQ ID NO: 2216500 - RNA, 12 nt, Human
cccccagcccuc

SEQ ID NO: 2216501 - RNA, 22 nt, Human
uucauucacucaacaaacauaa

SEQ ID NO: 2216502 - RNA, 16 nt, Human
gggucagccagcccuc

SEQ ID NO: 2216503 - RNA, 22 nt, Human
uguugcccacagcuguaugauu

SEQ ID NO: 2216504 - RNA, 23 nt, Human
gggaaacaaaaggauaaugaaua

SEQ ID NO: 2216505 - RNA, 14 nt, Human
uugugauugauuau

SEQ ID NO: 2216506 - RNA, 23 nt, Human
uuuuauagcuacuaauuuuaaaa

SEQ ID NO: 2216507 - RNA, 20 nt, Human
acuccacuuggacaugggcc

SEQ ID NO: 2216508 - RNA, 13 nt, Human
ugaaagaaaauaa

SEQ ID NO: 2216509 - RNA, 22 nt, Human
aaauaacaaugaaaguugauaa

SEQ ID NO: 2216510 - RNA, 12 nt, Human
gacagugaaaga

SEQ ID NO: 2216511 - RNA, 21 nt, Human
gccucagggugcacacaggau

SEQ ID NO: 2216512 - RNA, 15 nt, Human
guacuggcugaugga

SEQ ID NO: 2216513 - RNA, 20 nt, Human
auagucauucugccugcccu

SEQ ID NO: 2216514 - RNA, 17 nt, Human
acaaaugggaaacaaaa

SEQ ID NO: 2216515 - RNA, 14 nt, Human
gacaugggccccag

SEQ ID NO: 2216516 - RNA, 18 nt, Human
caguuguugcccacagcu

SEQ ID NO: 2216517 - RNA, 21 nt, Human
aauaauguuucaaacauauau

SEQ ID NO: 2216518 - RNA, 20 nt, Human
cucccugccccccagcccuc

SEQ ID NO: 2216519 - RNA, 21 nt, Human
aagacucgggauuaguacaca

SEQ ID NO: 2216520 - RNA, 11 nt, Human
ugcagugagcc

SEQ ID NO: 2216521 - RNA, 21 nt, Human
cugcccugcugagucccaggc

SEQ ID NO: 2216522 - RNA, 13 nt, Human
aagacaaggaaaa

SEQ ID NO: 2216523 - RNA, 17 nt, Human
aauaacgauaaaagaca

SEQ ID NO: 2216524 - RNA, 19 nt, Human
cuucuggguuccuuccucu

SEQ ID NO: 2216525 - RNA, 16 nt, Human
aaaauaauccucaguu

SEQ ID NO: 2216526 - RNA, 22 nt, Human
auaucuuuuuuuuaauaaacca

SEQ ID NO: 2216527 - RNA, 17 nt, Human
cgauaaaagacagugaa

SEQ ID NO: 2216528 - RNA, 17 nt, Human
auggcuaguaucaaaag

SEQ ID NO: 2216529 - RNA, 13 nt, Human
auccugcaggcag

SEQ ID NO: 2216530 - RNA, 20 nt, Human
ccagcuggccgggagccuga

SEQ ID NO: 2216531 - RNA, 16 nt, Human
caggcuugccugcagg

SEQ ID NO: 2216532 - RNA, 13 nt, Human
aucucaauauuuc

SEQ ID NO: 2216533 - RNA, 21 nt, Human
auguuuaauucugaaagcaac

SEQ ID NO: 2216534 - RNA, 13 nt, Human
ugaaaugcagagu

SEQ ID NO: 2216535 - RNA, 16 nt, Human
auacauguuacaacac

SEQ ID NO: 2216536 - RNA, 21 nt, Human
uuccuaauuccacagcugcuc

SEQ ID NO: 2216537 - RNA, 13 nt, Human
cauuuguauaaaa

SEQ ID NO: 2216538 - RNA, 23 nt, Human
auugcagaguacuggcugaugga

SEQ ID NO: 2216539 - RNA, 18 nt, Human
ucuucuggguuccuuccu

SEQ ID NO: 2216540 - RNA, 17 nt, Human
cuacacuccagugagac

SEQ ID NO: 2216541 - RNA, 17 nt, Human
uggccgcagugaggcgg

SEQ ID NO: 2216542 - RNA, 14 nt, Human
uauuuauuuuaaua

SEQ ID NO: 2216543 - RNA, 23 nt, Human
uagauguauagguugaugguggu

SEQ ID NO: 2216544 - RNA, 17 nt, Human
ccugccccccagcccuc

SEQ ID NO: 2216545 - RNA, 16 nt, Human
cuucggccuccauccu

SEQ ID NO: 2216546 - RNA, 19 nt, Human
cccccucuggcuccagcug

SEQ ID NO: 2216547 - RNA, 15 nt, Human
uuacagagacagaaa

SEQ ID NO: 2216548 - RNA, 17 nt, Human
cuaucucauuuccaagc

SEQ ID NO: 2216549 - RNA, 20 nt, Human
ccagugagacagcucugcau

SEQ ID NO: 2216550 - RNA, 13 nt, Human
agcgacagugaga

SEQ ID NO: 2216551 - RNA, 19 nt, Human
ggagccugaucaccugccc

SEQ ID NO: 2216552 - RNA, 15 nt, Human
cuaguaauuggaaag

SEQ ID NO: 2216553 - RNA, 11 nt, Human
gggaccugggc

SEQ ID NO: 2216554 - RNA, 14 nt, Human
uauuugaaauauug

SEQ ID NO: 2216555 - RNA, 17 nt, Human
cagugaaagaaaauaac

SEQ ID NO: 2216556 - RNA, 19 nt, Human
auuucuucaacucccugcc

SEQ ID NO: 2216557 - RNA, 15 nt, Human
ccugcaaagcccagc

SEQ ID NO: 2216558 - RNA, 21 nt, Human
guauacugugugcuaaaacaa

SEQ ID NO: 2216559 - RNA, 19 nt, Human
uaucacuugucaauaaaau

SEQ ID NO: 2216560 - RNA, 21 nt, Human
cucccaggaggggcuucuggg

SEQ ID NO: 2216561 - RNA, 18 nt, Human
gcuccauuuuuagugaaa

SEQ ID NO: 2216562 - RNA, 23 nt, Human
ucuccauguacuggcaagaccug

SEQ ID NO: 2216563 - RNA, 11 nt, Human
ggguuucucca

SEQ ID NO: 2216564 - RNA, 17 nt, Human
aaaacaccucagcugcc

SEQ ID NO: 2216565 - RNA, 13 nt, Human
agguaccuucuca

SEQ ID NO: 2216566 - RNA, 19 nt, Human
cuggacucaccucccccau

SEQ ID NO: 2216567 - RNA, 15 nt, Human
uaaaacuuuuccaau

SEQ ID NO: 2216568 - RNA, 22 nt, Human
agacucgggauuaguacacacu

SEQ ID NO: 2216569 - RNA, 18 nt, Human
gaaaauaacaauaaaaga

SEQ ID NO: 2216570 - RNA, 24 nt, Human
ccccugagcuugcagagaugaggc

SEQ ID NO: 2216571 - RNA, 13 nt, Human
cugagacacaugg

SEQ ID NO: 2216572 - RNA, 20 nt, Human
uuugcaagccagauuuuccu

SEQ ID NO: 2216573 - RNA, 14 nt, Human
gauaaaagacagug

SEQ ID NO: 2216574 - RNA, 14 nt, Human
gaaaacaauaacga

SEQ ID NO: 2216575 - RNA, 18 nt, Human
ugggcacaggguuuaugu

SEQ ID NO: 2216576 - RNA, 19 nt, Human
cuuccuaauuccacagcug

SEQ ID NO: 2216577 - RNA, 22 nt, Human
caagcacuaaacaaagagugaa

SEQ ID NO: 2216578 - RNA, 16 nt, Human
acaaauccaaugaaau

SEQ ID NO: 2216579 - RNA, 15 nt, Human
aggagcucccaggag

SEQ ID NO: 2216580 - RNA, 15 nt, Human
uagauaggccauggg

SEQ ID NO: 2216581 - RNA, 19 nt, Human
aaaagacagugaaagaaaa

SEQ ID NO: 2216582 - RNA, 15 nt, Human
uccauccugaggcuc

SEQ ID NO: 2216583 - RNA, 13 nt, Human
aucaagccugccu

SEQ ID NO: 2216584 - RNA, 12 nt, Human
ucuuaagaagac

SEQ ID NO: 2216585 - RNA, 15 nt, Human
ugccccccagcccuc

SEQ ID NO: 2216586 - RNA, 17 nt, Human
ccuauccuacuuccccu

SEQ ID NO: 2216587 - RNA, 22 nt, Human
cuuuuccaaugacauuuuguug

SEQ ID NO: 2216588 - RNA, 14 nt, Human
caugggccccagau

SEQ ID NO: 2216589 - RNA, 15 nt, Human
aauugacccacaaga

SEQ ID NO: 2216590 - RNA, 18 nt, Human
gccuucggccuccauccu

SEQ ID NO: 2216591 - RNA, 18 nt, Human
uuauuacuguaagaaaau

SEQ ID NO: 2216592 - RNA, 20 nt, Human
gccgggcgugguggugagug

SEQ ID NO: 2216593 - RNA, 15 nt, Human
ccuggugggcagaga

SEQ ID NO: 2216594 - RNA, 17 nt, Human
uuuccacauucagagcu

SEQ ID NO: 2216595 - RNA, 15 nt, Human
uuuuuaguucuucaa

SEQ ID NO: 2216596 - RNA, 21 nt, Human
ggguucccgugugccugagcg

SEQ ID NO: 2216597 - RNA, 21 nt, Human
aggcucuuuugggauuuuuga

SEQ ID NO: 2216598 - RNA, 14 nt, Human
cuagaauucacucc

SEQ ID NO: 2216599 - RNA, 15 nt, Human
gaaagaaaauaacga

SEQ ID NO: 2216600 - RNA, 18 nt, Human
acugccuucucaacucca

SEQ ID NO: 2216601 - RNA, 21 nt, Human
auaugcucuaaacauguuuau

SEQ ID NO: 2216602 - RNA, 20 nt, Human
aagacagugaaagaaaauaa

SEQ ID NO: 2216603 - RNA, 16 nt, Human
cuccauccugaggcuc

SEQ ID NO: 2216604 - RNA, 12 nt, Human
auaacuggaaac

SEQ ID NO: 2216605 - RNA, 17 nt, Human
ccugcaggcaugaguca

SEQ ID NO: 2216606 - RNA, 19 nt, Human
gaggcagagguugcaguga

SEQ ID NO: 2216607 - RNA, 19 nt, Human
ucaccaaggcugauuaaac

SEQ ID NO: 2216608 - RNA, 20 nt, Human
caagccuccuuuuaaaguaa

SEQ ID NO: 2216609 - RNA, 17 nt, Human
aaaaauccuacuuucau

SEQ ID NO: 2216610 - RNA, 17 nt, Human
uacaaaugcauuucuaa

SEQ ID NO: 2216611 - RNA, 16 nt, Human
uaaaauccauacauuu

SEQ ID NO: 2216612 - RNA, 13 nt, Human
aacuauaaaacua

SEQ ID NO: 2216613 - RNA, 21 nt, Human
caauuuuguuauguauauuuu

SEQ ID NO: 2216614 - RNA, 14 nt, Human
cuggccgggagccu

SEQ ID NO: 2216615 - RNA, 16 nt, Human
acugauggguuucucc

SEQ ID NO: 2216616 - RNA, 16 nt, Human
ccugccccccagcccu

SEQ ID NO: 2216617 - RNA, 18 nt, Human
aucuuauaauuuaaaaua

SEQ ID NO: 2216618 - RNA, 15 nt, Human
acgagauacagaauu

SEQ ID NO: 2216619 - RNA, 19 nt, Human
guacaagagcuuaacagug

SEQ ID NO: 2216620 - RNA, 22 nt, Human
uggguuccuuccucugagccuu

SEQ ID NO: 2216621 - RNA, 21 nt, Human
ucccaggaggggcuucugggc

SEQ ID NO: 2216622 - RNA, 19 nt, Human
cuaagcuucacuguaaaau

SEQ ID NO: 2216623 - RNA, 17 nt, Human
agaaaugaaagcaggga

SEQ ID NO: 2216624 - RNA, 21 nt, Human
ugccugagcggaccuucccag

SEQ ID NO: 2216625 - RNA, 22 nt, Human
gcuaaaacaagcacuaaacaaa

SEQ ID NO: 2216626 - RNA, 22 nt, Human
aaacauguuuaucguauuugau

SEQ ID NO: 2216627 - RNA, 16 nt, Human
aggcuugccugcaggc

SEQ ID NO: 2216628 - RNA, 13 nt, Human
cugcacuccagcc

SEQ ID NO: 2216629 - RNA, 17 nt, Human
caagaaaugaaagcagg

SEQ ID NO: 2216630 - RNA, 12 nt, Human
ggaggggcuucu

SEQ ID NO: 2216631 - RNA, 23 nt, Human
aauaauccucaguuuuugugaaa

SEQ ID NO: 2216632 - RNA, 13 nt, Human
aaauaaaaauaau

SEQ ID NO: 2216633 - RNA, 21 nt, Human
ucaagucuuucacauuuaaau

SEQ ID NO: 2216634 - RNA, 16 nt, Human
caauccaagaacuuau

SEQ ID NO: 2216635 - RNA, 17 nt, Human
caaacauauauaacaau

SEQ ID NO: 2216636 - RNA, 14 nt, Human
uauaauuuaaauau

SEQ ID NO: 2216637 - RNA, 15 nt, Human
uccuacaagacacag

SEQ ID NO: 2216638 - RNA, 15 nt, Human
ggcaauagucaaauu

SEQ ID NO: 2216639 - RNA, 16 nt, Human
cuucugggcagacucu

SEQ ID NO: 2216640 - RNA, 21 nt, Human
aauuaaguuuuuuuuuaaaaa

SEQ ID NO: 2216641 - RNA, 11 nt, Human
cuguuuuauaa

SEQ ID NO: 2216642 - RNA, 21 nt, Human
ggucaagaagcaucgugucug

SEQ ID NO: 2216643 - RNA, 21 nt, Human
auuauauggcuugaguuuaaa

SEQ ID NO: 2216644 - RNA, 20 nt, Human
auaauccuaaacauaugaau

SEQ ID NO: 2216645 - RNA, 21 nt, Human
cccuauccuacuuccccuucc

SEQ ID NO: 2216646 - RNA, 23 nt, Human
gauauuaaccaggggccaugaau

SEQ ID NO: 2216647 - RNA, 16 nt, Human
agugaaggauuuaugu

SEQ ID NO: 2216648 - RNA, 18 nt, Human
uuuucucuccucucccca

SEQ ID NO: 2216649 - RNA, 16 nt, Human
acauuugcucauggaa

SEQ ID NO: 2216650 - RNA, 23 nt, Human
auguuaaaacugggacaggggag

SEQ ID NO: 2216651 - RNA, 19 nt, Human
acaaauuuacagagacaga

SEQ ID NO: 2216652 - RNA, 21 nt, Human
auguuuacagauccccaagcc

SEQ ID NO: 2216653 - RNA, 21 nt, Human
cuaccaaaaaucucaauauuu

SEQ ID NO: 2216654 - RNA, 22 nt, Human
aagacccaaaaggcagaagcaa

SEQ ID NO: 2216655 - RNA, 14 nt, Human
gggaccugggccau

SEQ ID NO: 2216656 - RNA, 20 nt, Human
caaacauccuacaagacaca

SEQ ID NO: 2216657 - RNA, 18 nt, Human
uaaugaauacuuuauaaa

SEQ ID NO: 2216658 - RNA, 20 nt, Human
cugcacacagcacgggggcc

SEQ ID NO: 2216659 - RNA, 15 nt, Human
uucccgugugccuga

SEQ ID NO: 2216660 - RNA, 15 nt, Human
cagucucccucccuu

SEQ ID NO: 2216661 - RNA, 15 nt, Human
uuuaugguuguauua

SEQ ID NO: 2216662 - RNA, 18 nt, Human
gaaaugaaagcagggacu

SEQ ID NO: 2216663 - RNA, 21 nt, Human
gcccugcugagucccaggcug

SEQ ID NO: 2216664 - RNA, 19 nt, Human
aauguuuacagauccccaa

SEQ ID NO: 2216665 - RNA, 16 nt, Human
cagcuucucauccugc

SEQ ID NO: 2216666 - RNA, 23 nt, Human
cacagauuugagcucagcccugg

SEQ ID NO: 2216667 - RNA, 15 nt, Human
auuugguaaggggaa

SEQ ID NO: 2216668 - RNA, 14 nt, Human
uuccugagccagug

SEQ ID NO: 2216669 - RNA, 16 nt, Human
aaauauaaauaaaaau

SEQ ID NO: 2216670 - RNA, 23 nt, Human
gccugagcggaccuucccagcua

SEQ ID NO: 2216671 - RNA, 20 nt, Human
cuggccuucggccuccaucc

SEQ ID NO: 2216672 - RNA, 19 nt, Human
gaaaauaacgauaaaagac

SEQ ID NO: 2216673 - RNA, 16 nt, Human
aggguguguaaguaga

SEQ ID NO: 2216674 - RNA, 16 nt, Human
uucucuaggaaauauu

SEQ ID NO: 2216675 - RNA, 20 nt, Human
acuccagugagacagcucug

SEQ ID NO: 2216676 - RNA, 16 nt, Human
ugacacuuaaaaaugg

SEQ ID NO: 2216677 - RNA, 23 nt, Human
augaauuaaguuuuuuuuuaaaa

SEQ ID NO: 2216678 - RNA, 22 nt, Human
aauaauccuaaacauaugaauu

SEQ ID NO: 2216679 - RNA, 21 nt, Human
aggguucaccugggcugaggc

SEQ ID NO: 2216680 - RNA, 17 nt, Human
ccaaggaugccccgucc

SEQ ID NO: 2216681 - RNA, 19 nt, Human
cccugccccccagcccucc

SEQ ID NO: 2216682 - RNA, 23 nt, Human
aucucuucuggguuccuuccucu

SEQ ID NO: 2216683 - RNA, 10 nt, Human
auguuuucag

SEQ ID NO: 2216684 - RNA, 18 nt, Human
agauccccaagccuggca

SEQ ID NO: 2216685 - RNA, 19 nt, Human
aaugaauggcuaagcaaaa

SEQ ID NO: 2216686 - RNA, 21 nt, Human
aucuuuuuuuuaauaaaccau

SEQ ID NO: 2216687 - RNA, 20 nt, Human
guccccuauccuacuucccc

SEQ ID NO: 2216688 - RNA, 17 nt, Human
aaauguucaucaaugaa

SEQ ID NO: 2216689 - RNA, 13 nt, Human
uaagugcagcccc

SEQ ID NO: 2216690 - RNA, 14 nt, Human
ggccgggagccuga

SEQ ID NO: 2216691 - RNA, 12 nt, Human
ucccccucuggc

SEQ ID NO: 2216692 - RNA, 15 nt, Human
aucaaaggacaccau

SEQ ID NO: 2216693 - RNA, 13 nt, Human
auccugaggcucc

SEQ ID NO: 2216694 - RNA, 20 nt, Human
aaauccuugaagauuuacca

SEQ ID NO: 2216695 - RNA, 13 nt, Human
cuucucaacucca

SEQ ID NO: 2216696 - RNA, 21 nt, Human
auauaugcuaagucuuauaua

SEQ ID NO: 2216697 - RNA, 19 nt, Human
acagucaccucauggaauu

SEQ ID NO: 2216698 - RNA, 15 nt, Human
agagacagaaagcag

SEQ ID NO: 2216699 - RNA, 16 nt, Human
uugccauaauuacuau

SEQ ID NO: 2216700 - RNA, 16 nt, Human
cauuuguauaaaauaa

SEQ ID NO: 2216701 - RNA, 17 nt, Human
uccaaaggcuccugaga

SEQ ID NO: 2216702 - RNA, 14 nt, Human
ugugaaaagcucca

SEQ ID NO: 2216703 - RNA, 12 nt, Human
aagagcuuaaca

SEQ ID NO: 2216704 - RNA, 15 nt, Human
acaucaacagauaaa

SEQ ID NO: 2216705 - RNA, 20 nt, Human
augucgucaaagcugaaaug

SEQ ID NO: 2216706 - RNA, 16 nt, Human
gucuaucuuugagcgc

SEQ ID NO: 2216707 - RNA, 14 nt, Human
uaaauaaaaauaau

SEQ ID NO: 2216708 - RNA, 22 nt, Human
caaggaugccccgucccccucu

SEQ ID NO: 2216709 - RNA, 21 nt, Human
uguauaaaauaauuuuuauau

SEQ ID NO: 2216710 - RNA, 22 nt, Human
cucuggccuucggccuccaucc

SEQ ID NO: 2216711 - RNA, 15 nt, Human
cuugaaaacuuuaug

SEQ ID NO: 2216712 - RNA, 14 nt, Human
cuggagcucugccc

SEQ ID NO: 2216713 - RNA, 21 nt, Human
aggauggcaggaggcauccaa

SEQ ID NO: 2216714 - RNA, 17 nt, Human
gaagcaccaaucaugaa

SEQ ID NO: 2216715 - RNA, 16 nt, Human
aaaaugugauauguac

SEQ ID NO: 2216716 - RNA, 21 nt, Human
acagugaaagaaaauaacaau

SEQ ID NO: 2216717 - RNA, 19 nt, Human
cacauccugugggaccugg

SEQ ID NO: 2216718 - RNA, 21 nt, Human
gaaauguuuacagauccccaa

SEQ ID NO: 2216719 - RNA, 20 nt, Human
gaauucauucacucaacaaa

SEQ ID NO: 2216720 - RNA, 18 nt, Human
ugcugcagccccugggac

SEQ ID NO: 2216721 - RNA, 18 nt, Human
agcaaaauuuuuucucua

SEQ ID NO: 2216722 - RNA, 22 nt, Human
uaaaauaauuuuuauauuugaa

SEQ ID NO: 2216723 - RNA, 14 nt, Human
aauugcagaguacu

SEQ ID NO: 2216724 - RNA, 18 nt, Human
cccacuggacucaccucc

SEQ ID NO: 2216725 - RNA, 15 nt, Human
caggaaguagaggag

SEQ ID NO: 2216726 - RNA, 16 nt, Human
agugagacagcucugc

SEQ ID NO: 2216727 - RNA, 18 nt, Human
acauuugcucauggaauu

SEQ ID NO: 2216728 - RNA, 21 nt, Human
auuuacaaaugggaaacaaaa

SEQ ID NO: 2216729 - RNA, 19 nt, Human
ccaccugccuauauuuuuu

SEQ ID NO: 2216730 - RNA, 17 nt, Human
gcuauugggguuggggg

SEQ ID NO: 2216731 - RNA, 21 nt, Human
gacagucaccucauggaauug

SEQ ID NO: 2216732 - RNA, 20 nt, Human
acagcuucucauccugcagg

SEQ ID NO: 2216733 - RNA, 15 nt, Human
gagauuccugagcca

SEQ ID NO: 2216734 - RNA, 16 nt, Human
gacaaggaaaaaauaa

SEQ ID NO: 2216735 - RNA, 18 nt, Human
acaggauggcaggaggca

SEQ ID NO: 2216736 - RNA, 13 nt, Human
uggcuccagcugg

SEQ ID NO: 2216737 - RNA, 15 nt, Human
aaauauuuauuuuaa

SEQ ID NO: 2216738 - RNA, 13 nt, Human
caacaucuaguga

SEQ ID NO: 2216739 - RNA, 15 nt, Human
agacagcucugcaua

SEQ ID NO: 2216740 - RNA, 20 nt, Human
agugaggcggauugagaagg

SEQ ID NO: 2216741 - RNA, 19 nt, Human
ucaguccaugaagauguag

SEQ ID NO: 2216742 - RNA, 22 nt, Human
agaagcaccaaucaugaauuag

SEQ ID NO: 2216743 - RNA, 16 nt, Human
ccaaauugagcuaggg

SEQ ID NO: 2216744 - RNA, 15 nt, Human
cagccagcacagccu

SEQ ID NO: 2216745 - RNA, 19 nt, Human
agcuucucauccugcaggc

SEQ ID NO: 2216746 - RNA, 19 nt, Human
auuuucuauaauuuaaaua

SEQ ID NO: 2216747 - RNA, 16 nt, Human
auuauacccccugcaa

SEQ ID NO: 2216748 - RNA, 22 nt, Human
cuucaacucccugccccccagc

SEQ ID NO: 2216749 - RNA, 16 nt, Human
ugacuuaaugccacua

SEQ ID NO: 2216750 - RNA, 14 nt, Human
acccaaaaggcaga

SEQ ID NO: 2216751 - RNA, 15 nt, Human
acucugagcagugcu

SEQ ID NO: 2216752 - RNA, 21 nt, Human
ucuucaacucccugcccccca

SEQ ID NO: 2216753 - RNA, 18 nt, Human
cugagucccaggcugagc

SEQ ID NO: 2216754 - RNA, 19 nt, Human
auuuugugaagcaaaauuu

SEQ ID NO: 2216755 - RNA, 17 nt, Human
ucuuucacauuuaaaua

SEQ ID NO: 2216756 - RNA, 14 nt, Human
uuuuuguuuuguuu

SEQ ID NO: 2216757 - RNA, 20 nt, Human
caggaggggcuucugggcag

SEQ ID NO: 2216758 - RNA, 22 nt, Human
aaacaaggaugaauuaaguuuu

SEQ ID NO: 2216759 - RNA, 17 nt, Human
acuugaacccauauuug

SEQ ID NO: 2216760 - RNA, 18 nt, Human
auuuaggccaugggacag

SEQ ID NO: 2216761 - RNA, 14 nt, Human
agaaaugaaagcag

SEQ ID NO: 2216762 - RNA, 16 nt, Human
agaacucugagcagug

SEQ ID NO: 2216763 - RNA, 22 nt, Human
aaccuacacgagauacagaauu

SEQ ID NO: 2216764 - RNA, 20 nt, Human
uuaaugccacuaaauugaca

SEQ ID NO: 2216765 - RNA, 15 nt, Human
caaauccaaugaaau

SEQ ID NO: 2216766 - RNA, 22 nt, Human
ccgggaggcagagguugcagug

SEQ ID NO: 2216767 - RNA, 21 nt, Human
auaguuguaccgcaaugugac

SEQ ID NO: 2216768 - RNA, 19 nt, Human
gccugaucaccugcccugc

SEQ ID NO: 2216769 - RNA, 18 nt, Human
uucugauauuggacagua

SEQ ID NO: 2216770 - RNA, 13 nt, Human
ucucccucccuug

SEQ ID NO: 2216771 - RNA, 19 nt, Human
cuuggggccuaugcagagg

SEQ ID NO: 2216772 - RNA, 13 nt, Human
ccacaacacacag

SEQ ID NO: 2216773 - RNA, 16 nt, Human
ccugagcuugcagaga

SEQ ID NO: 2216774 - RNA, 20 nt, Human
cagcuggccgggagccugau

SEQ ID NO: 2216775 - RNA, 21 nt, Human
aggcaugagucagucugauga

SEQ ID NO: 2216776 - RNA, 16 nt, Human
gcccugaaagucccag

SEQ ID NO: 2216777 - RNA, 23 nt, Human
ccccugggaccaggcacccccag

SEQ ID NO: 2216778 - RNA, 14 nt, Human
cgcuaccuuuugcu

SEQ ID NO: 2216779 - RNA, 15 nt, Human
caaauugagcuaggg

SEQ ID NO: 2216780 - RNA, 17 nt, Human
ugcccugaaagucccag

SEQ ID NO: 2216781 - RNA, 13 nt, Human
aggauuugaaauu

SEQ ID NO: 2216782 - RNA, 14 nt, Human
aagcucuaucacca

SEQ ID NO: 2216783 - RNA, 15 nt, Human
ccacaagaaaugaaa

SEQ ID NO: 2216784 - RNA, 20 nt, Human
cacuguggguagacacacau

SEQ ID NO: 2216785 - RNA, 22 nt, Human
cugagcagugcuugaaugaagu

SEQ ID NO: 2216786 - RNA, 20 nt, Human
accucugccucagaaaacaa

SEQ ID NO: 2216787 - RNA, 18 nt, Human
cucuggccuucggccucc

SEQ ID NO: 2216788 - RNA, 10 nt, Human
aauaaaacuu

SEQ ID NO: 2216789 - RNA, 14 nt, Human
aaagagaacuucca

SEQ ID NO: 2216790 - RNA, 16 nt, Human
ugcaaauugucacagg

SEQ ID NO: 2216791 - RNA, 22 nt, Human
gugaacaaauuuacagagacag

SEQ ID NO: 2216792 - RNA, 13 nt, Human
cacaggauggcag

SEQ ID NO: 2216793 - RNA, 12 nt, Human
agggauggggcu

SEQ ID NO: 2216794 - RNA, 21 nt, Human
uacaugagguacugagaguga

SEQ ID NO: 2216795 - RNA, 22 nt, Human
cacuuggacaugggccccagau

SEQ ID NO: 2216796 - RNA, 14 nt, Human
augauguuuagaaa

SEQ ID NO: 2216797 - RNA, 23 nt, Human
uguagguagaucuggucuuuaga

SEQ ID NO: 2216798 - RNA, 19 nt, Human
ggacucaccucccccaucu

SEQ ID NO: 2216799 - RNA, 21 nt, Human
caagacccaaaaggcagaagc

SEQ ID NO: 2216800 - RNA, 21 nt, Human
ugagccagugucaggaggaag

SEQ ID NO: 2216801 - RNA, 14 nt, Human
ucccuugaugaaga

SEQ ID NO: 2216802 - RNA, 21 nt, Human
gacagcuucucauccugcagg

SEQ ID NO: 2216803 - RNA, 22 nt, Human
gacucaccucccccaucucuuc

SEQ ID NO: 2216804 - RNA, 20 nt, Human
caggcugagccucagucucc

SEQ ID NO: 2216805 - RNA, 16 nt, Human
gauggcaggaggcauc

SEQ ID NO: 2216806 - RNA, 22 nt, Human
acaggauggcaggaggcaucca

SEQ ID NO: 2216807 - RNA, 23 nt, Human
ggaggcagagguugcagugagcc

SEQ ID NO: 2216808 - RNA, 17 nt, Human
uggcuaagcaaaaugug

SEQ ID NO: 2216809 - RNA, 23 nt, Human
aaaauaucacuugucaauaaaau

SEQ ID NO: 2216810 - RNA, 14 nt, Human
gaucaagccugccu

SEQ ID NO: 2216811 - RNA, 14 nt, Human
cuaagucuuauaua

SEQ ID NO: 2216812 - RNA, 18 nt, Human
cuucucacauuuauauuu

SEQ ID NO: 2216813 - RNA, 17 nt, Human
gaggcauccuuccucac

SEQ ID NO: 2216814 - RNA, 15 nt, Human
ugcagauaaacagua

SEQ ID NO: 2216815 - RNA, 17 nt, Human
cuuauuuguacauuuuu

SEQ ID NO: 2216816 - RNA, 18 nt, Human
aggaaggcuuacacccac

SEQ ID NO: 2216817 - RNA, 18 nt, Human
acaccucagcugccuccc

SEQ ID NO: 2216818 - RNA, 12 nt, Human
accuucucaccu

SEQ ID NO: 2216819 - RNA, 19 nt, Human
ucagugucaaugcagcccc

SEQ ID NO: 2216820 - RNA, 17 nt, Human
ugaaauaagccagacau

SEQ ID NO: 2216821 - RNA, 18 nt, Human
gcaaagcccagcuugaaa

SEQ ID NO: 2216822 - RNA, 22 nt, Human
aucaucaagucuuucacauuua

SEQ ID NO: 2216823 - RNA, 16 nt, Human
uucugacacuaaaaca

SEQ ID NO: 2216824 - RNA, 15 nt, Human
gaaaugaaagcaggg

SEQ ID NO: 2216825 - RNA, 14 nt, Human
aauauuauuuuaua

SEQ ID NO: 2216826 - RNA, 16 nt, Human
uaucaaaagaaagaaa

SEQ ID NO: 2216827 - RNA, 18 nt, Human
gccuuggauacuccaugg

SEQ ID NO: 2216828 - RNA, 22 nt, Human
augcagagguccacaacacaca

SEQ ID NO: 2216829 - RNA, 21 nt, Human
uuauagcuacuaauuuuaaaa

SEQ ID NO: 2216830 - RNA, 16 nt, Human
auaacuggaaacuuca

SEQ ID NO: 2216831 - RNA, 19 nt, Human
agaguuuagcuggaaaagu

SEQ ID NO: 2216832 - RNA, 13 nt, Human
cacaccaggcuug

SEQ ID NO: 2216833 - RNA, 12 nt, Human
cagaacagugau

SEQ ID NO: 2216834 - RNA, 18 nt, Human
uaagcuucacuguaaaau

SEQ ID NO: 2216835 - RNA, 20 nt, Human
auaaauggcuuccuggcaau

SEQ ID NO: 2216836 - RNA, 17 nt, Human
aaacaccucagcugccu

SEQ ID NO: 2216837 - RNA, 15 nt, Human
ucaguauucauauuu

SEQ ID NO: 2216838 - RNA, 15 nt, Human
aaugauuaugaauua

SEQ ID NO: 2216839 - RNA, 16 nt, Human
agccucagucucccuc

SEQ ID NO: 2216840 - RNA, 17 nt, Human
augccccgucccccucu

SEQ ID NO: 2216841 - RNA, 11 nt, Human
auaauuuaaau

SEQ ID NO: 2216842 - RNA, 14 nt, Human
cucccugcccccca

SEQ ID NO: 2216843 - RNA, 21 nt, Human
cccacuggacucaccuccccc

SEQ ID NO: 2216844 - RNA, 21 nt, Human
acagcccuucuuuccacagaa

SEQ ID NO: 2216845 - RNA, 22 nt, Human
ggacagcccuucuuuccacaga

SEQ ID NO: 2216846 - RNA, 18 nt, Human
ugcauagguuuaauaauu

SEQ ID NO: 2216847 - RNA, 19 nt, Human
uguuggacgagaaaacaau

SEQ ID NO: 2216848 - RNA, 22 nt, Human
aaaaaaccugagccccaaaagg

SEQ ID NO: 2216849 - RNA, 19 nt, Human
agaaaauaacgauaaaaga

SEQ ID NO: 2216850 - RNA, 15 nt, Human
cucccuuggggccua

SEQ ID NO: 2216851 - RNA, 20 nt, Human
gaccauacuaauuauacccc

SEQ ID NO: 2216852 - RNA, 15 nt, Human
auuucuaugaaauau

SEQ ID NO: 2216853 - RNA, 20 nt, Human
acuuuauuuucuauaauuua

SEQ ID NO: 2216854 - RNA, 14 nt, Human
agaugcuagaacuc

SEQ ID NO: 2216855 - RNA, 12 nt, Human
acagagacagaa

SEQ ID NO: 2216856 - RNA, 18 nt, Human
acuggacucaccuccccc

SEQ ID NO: 2216857 - RNA, 16 nt, Human
ucccugccccccagcc

SEQ ID NO: 2216858 - RNA, 22 nt, Human
uuguaacaagccuccuuuuaaa

SEQ ID NO: 2216859 - RNA, 21 nt, Human
cugauauuggacaguaaaauc

SEQ ID NO: 2216860 - RNA, 18 nt, Human
ucugaugagaacucugag

SEQ ID NO: 2216861 - RNA, 14 nt, Human
aauauaaauaaaaa

SEQ ID NO: 2216862 - RNA, 16 nt, Human
agugaaagaaaauaac

SEQ ID NO: 2216863 - RNA, 21 nt, Human
uauuacuguaagaaaauauca

SEQ ID NO: 2216864 - RNA, 13 nt, Human
uccuacuuccccu

SEQ ID NO: 2216865 - RNA, 14 nt, Human
ggacucaccucccc

SEQ ID NO: 2216866 - RNA, 19 nt, Human
cccagcuagaauucacucc

SEQ ID NO: 2216867 - RNA, 23 nt, Human
uaacgauaaaagacagugaaaga

SEQ ID NO: 2216868 - RNA, 12 nt, Human
cuuccucugagc

SEQ ID NO: 2216869 - RNA, 16 nt, Human
cagccagcccucuucu

SEQ ID NO: 2216870 - RNA, 13 nt, Human
cugccuccccagc

SEQ ID NO: 2216871 - RNA, 19 nt, Human
gcauccuuccucacaccag

SEQ ID NO: 2216872 - RNA, 16 nt, Human
cugauggguuucucca

SEQ ID NO: 2216873 - RNA, 19 nt, Human
uccagaaagugacaagcuc

SEQ ID NO: 2216874 - RNA, 18 nt, Human
uuuuaaaaaagaaacauu

SEQ ID NO: 2216875 - RNA, 21 nt, Human
ucacaugaacuuguaaaggaa

SEQ ID NO: 2216876 - RNA, 16 nt, Human
ccugaucaccugcccu

SEQ ID NO: 2216877 - RNA, 12 nt, Human
ggugcugcagcc

SEQ ID NO: 2216878 - RNA, 22 nt, Human
uugacccacaagaaaugaaagc

SEQ ID NO: 2216879 - RNA, 14 nt, Human
ucuuuuuuuuaaua

SEQ ID NO: 2216880 - RNA, 19 nt, Human
acuaucucauuuccaagca

SEQ ID NO: 2216881 - RNA, 20 nt, Human
caagagccuuuuuuugaaaa

SEQ ID NO: 2216882 - RNA, 22 nt, Human
aggauggcuaguaucaaaagaa

SEQ ID NO: 2216883 - RNA, 19 nt, Human
agauuugagcucagcccug

SEQ ID NO: 2216884 - RNA, 16 nt, Human
ccaggcacccccagaa

SEQ ID NO: 2216885 - RNA, 13 nt, Human
agagauuccugag

SEQ ID NO: 2216886 - RNA, 14 nt, Human
ccccagaaugaccu

SEQ ID NO: 2216887 - RNA, 21 nt, Human
uauaaaauaauuuuuauauuu

SEQ ID NO: 2216888 - RNA, 18 nt, Human
ucuaugaaauauuauguu

SEQ ID NO: 2216889 - RNA, 13 nt, Human
cccugcacuccag

SEQ ID NO: 2216890 - RNA, 20 nt, Human
guuccuuccucugagccuug

SEQ ID NO: 2216891 - RNA, 13 nt, Human
cggauugagaagg

SEQ ID NO: 2216892 - RNA, 16 nt, Human
uauaucaauuuaaaaa

SEQ ID NO: 2216893 - RNA, 13 nt, Human
aacucccugcccc

SEQ ID NO: 2216894 - RNA, 17 nt, Human
ccugagcggaccuuccc

SEQ ID NO: 2216895 - RNA, 21 nt, Human
ccacauccugugggaccuggg

SEQ ID NO: 2216896 - RNA, 21 nt, Human
uguaaaauggugugaccacug

SEQ ID NO: 2216897 - RNA, 21 nt, Human
ccaaggaugccccgucccccu

SEQ ID NO: 2216898 - RNA, 16 nt, Human
uguaguccuguaaugg

SEQ ID NO: 2216899 - RNA, 22 nt, Human
auuacuguaagaaaauaucacu

SEQ ID NO: 2216900 - RNA, 22 nt, Human
cccccugcaaagcccagcuuga

SEQ ID NO: 2216901 - RNA, 19 nt, Human
auaauuuuuauauuugaaa

SEQ ID NO: 2216902 - RNA, 14 nt, Human
uaaaagacaaggaa

SEQ ID NO: 2216903 - RNA, 14 nt, Human
ucuaggaaauauuu

SEQ ID NO: 2216904 - RNA, 14 nt, Human
auuugaaauuguau

SEQ ID NO: 2216905 - RNA, 11 nt, Human
ucaccugcccu

SEQ ID NO: 2216906 - RNA, 22 nt, Human
ggcuaagcuucacuguaaaaua

SEQ ID NO: 2216907 - RNA, 20 nt, Human
ggccuaugcagagguccaca

SEQ ID NO: 2216908 - RNA, 22 nt, Human
cuggguuccuuccucugagccu

SEQ ID NO: 2216909 - RNA, 19 nt, Human
uaguuuaugauuccaccua

SEQ ID NO: 2216910 - RNA, 21 nt, Human
uauacugugugcuaaaacaag

SEQ ID NO: 2216911 - RNA, 18 nt, Human
guaauauugcaaggcaaa

SEQ ID NO: 2216912 - RNA, 18 nt, Human
gaggcggauugagaagga

SEQ ID NO: 2216913 - RNA, 11 nt, Human
gagguaaaagc

SEQ ID NO: 2216914 - RNA, 23 nt, Human
cagagguugcagugagccgagau

SEQ ID NO: 2216915 - RNA, 17 nt, Human
cugagaugggagaauca

SEQ ID NO: 2216916 - RNA, 15 nt, Human
auauuuuuuguuaaa

SEQ ID NO: 2216917 - RNA, 23 nt, Human
auaucuuuuuuuuaauaaaccau

SEQ ID NO: 2216918 - RNA, 22 nt, Human
gaaaacaauaacgauaaaagac

SEQ ID NO: 2216919 - RNA, 14 nt, Human
ugacacuuaaaaau

SEQ ID NO: 2216920 - RNA, 19 nt, Human
uggcaagcucuaucaccaa

SEQ ID NO: 2216921 - RNA, 19 nt, Human
ugggacaggggagaaccua

SEQ ID NO: 2216922 - RNA, 12 nt, Human
ucaagaagcauc

SEQ ID NO: 2216923 - RNA, 15 nt, Human
gacagggaggacgcu

SEQ ID NO: 2216924 - RNA, 16 nt, Human
aaugaaagcagggacu

SEQ ID NO: 2216925 - RNA, 17 nt, Human
uuucacauuuaaauaaa

SEQ ID NO: 2216926 - RNA, 21 nt, Human
aaaauuuuuucucuaggaaau

SEQ ID NO: 2216927 - RNA, 19 nt, Human
auccuacaagacacaguga

SEQ ID NO: 2216928 - RNA, 15 nt, Human
uccaagccucauguc

SEQ ID NO: 2216929 - RNA, 17 nt, Human
cucuuuugggauuuuug

SEQ ID NO: 2216930 - RNA, 16 nt, Human
gugagacagcucugca

SEQ ID NO: 2216931 - RNA, 13 nt, Human
cuaugaaauauua

SEQ ID NO: 2216932 - RNA, 21 nt, Human
aggcagcuuuuucucucccac

SEQ ID NO: 2216933 - RNA, 13 nt, Human
ccugagcuugcag

SEQ ID NO: 2216934 - RNA, 12 nt, Human
aauaauuuuuaa

SEQ ID NO: 2216935 - RNA, 13 nt, Human
acuguaaaauaau

SEQ ID NO: 2216936 - RNA, 12 nt, Human
acucccugcccc

SEQ ID NO: 2216937 - RNA, 12 nt, Human
ucuacacuccag

SEQ ID NO: 2216938 - RNA, 19 nt, Human
guuauuauauuuacaaaug

SEQ ID NO: 2216939 - RNA, 21 nt, Human
cuccacuuggacaugggcccc

SEQ ID NO: 2216940 - RNA, 17 nt, Human
ugaucaccugcccugcu

SEQ ID NO: 2216941 - RNA, 18 nt, Human
aaaucuuauaauuuaaaa

SEQ ID NO: 2216942 - RNA, 12 nt, Human
agugcagccccg

SEQ ID NO: 2216943 - RNA, 14 nt, Human
cacaagaaaugaaa

SEQ ID NO: 2216944 - RNA, 14 nt, Human
gcugauuaaaccaa

SEQ ID NO: 2216945 - RNA, 20 nt, Human
uugauaaguacaugauaagc

SEQ ID NO: 2216946 - RNA, 16 nt, Human
guuccuuccucugagc

SEQ ID NO: 2216947 - RNA, 13 nt, Human
guaacuaauuuua

SEQ ID NO: 2216948 - RNA, 14 nt, Human
cccugccccccagc

SEQ ID NO: 2216949 - RNA, 22 nt, Human
auuuucuucucacauuuauauu

SEQ ID NO: 2216950 - RNA, 19 nt, Human
auauugcaaggcaaagacu

SEQ ID NO: 2216951 - RNA, 14 nt, Human
cuugagguaaaagc

SEQ ID NO: 2216952 - RNA, 22 nt, Human
ccauagucauucugccugcccu

SEQ ID NO: 2216953 - RNA, 14 nt, Human
uugacccacaagaa

SEQ ID NO: 2216954 - RNA, 22 nt, Human
cucuggucaagaagcaucgugu

SEQ ID NO: 2216955 - RNA, 17 nt, Human
caagccuccuuuuaaag

SEQ ID NO: 2216956 - RNA, 14 nt, Human
uccacaacacacag

SEQ ID NO: 2216957 - RNA, 18 nt, Human
aguucuccacuagcuaug

SEQ ID NO: 2216958 - RNA, 23 nt, Human
auuucugagcauuuaauauggau

SEQ ID NO: 2216959 - RNA, 15 nt, Human
ucacaggacagcccu

SEQ ID NO: 2216960 - RNA, 17 nt, Human
uguaaaggaauuuaaaa

SEQ ID NO: 2216961 - RNA, 22 nt, Human
auauaugcuaagucuuauauau

SEQ ID NO: 2216962 - RNA, 21 nt, Human
uccuacaagacacagugacca

SEQ ID NO: 2216963 - RNA, 19 nt, Human
aaaacuaggugcugcagcc

SEQ ID NO: 2216964 - RNA, 15 nt, Human
gagaugcuagaacuc

SEQ ID NO: 2216965 - RNA, 23 nt, Human
caauccaagaacuuauuuguaca

SEQ ID NO: 2216966 - RNA, 23 nt, Human
aauauugcaaggcaaagacuauu

SEQ ID NO: 2216967 - RNA, 20 nt, Human
uuuaaauaaaguguuugaaa

SEQ ID NO: 2216968 - RNA, 22 nt, Human
ucuagcaugucgucaaagcuga

SEQ ID NO: 2216969 - RNA, 13 nt, Human
guggaaaaacaga

SEQ ID NO: 2216970 - RNA, 21 nt, Human
aagucuuucacauuuaaauaa

SEQ ID NO: 2216971 - RNA, 17 nt, Human
aggcuagaaccaccugc

SEQ ID NO: 2216972 - RNA, 13 nt, Human
uaacgauaaaaga

SEQ ID NO: 2216973 - RNA, 14 nt, Human
uggacucaccuccc

SEQ ID NO: 2216974 - RNA, 18 nt, Human
uaaauugacacuuaaaaa

SEQ ID NO: 2216975 - RNA, 14 nt, Human
agcggaccuuccca

SEQ ID NO: 2216976 - RNA, 21 nt, Human
cuauaaaacuaggugcugcag

SEQ ID NO: 2216977 - RNA, 12 nt, Human
ggaggcugagau

SEQ ID NO: 2216978 - RNA, 17 nt, Human
ucauauuuauagccagg

SEQ ID NO: 2216979 - RNA, 14 nt, Human
cucccucccuuggg

SEQ ID NO: 2216980 - RNA, 16 nt, Human
accagccuuggauacu

SEQ ID NO: 2216981 - RNA, 23 nt, Human
ccagguaccuucucaccugugag

SEQ ID NO: 2216982 - RNA, 19 nt, Human
cagcacgggggccaaggau

SEQ ID NO: 2216983 - RNA, 17 nt, Human
gccuaagugcagccccg

SEQ ID NO: 2216984 - RNA, 12 nt, Human
acuauaaaacua

SEQ ID NO: 2216985 - RNA, 12 nt, Human
acacuaaaacac

SEQ ID NO: 2216986 - RNA, 14 nt, Human
agguugcagugagc

SEQ ID NO: 2216987 - RNA, 23 nt, Human
uacaaaugggaaacaaaaggaua

SEQ ID NO: 2216988 - RNA, 18 nt, Human
uaaaagacaaggaaaaaa

SEQ ID NO: 2216989 - RNA, 19 nt, Human
uauacugugugcuaaaaca

SEQ ID NO: 2216990 - RNA, 23 nt, Human
aguaauuggaaaggcagcucuaa

SEQ ID NO: 2216991 - RNA, 20 nt, Human
cuuuuuuaguucuucaaaga

SEQ ID NO: 2216992 - RNA, 17 nt, Human
ucauccugcaggcagcu

SEQ ID NO: 2216993 - RNA, 17 nt, Human
cccccugcaaagcccag

SEQ ID NO: 2216994 - RNA, 20 nt, Human
cccagcuagaauucacucca

SEQ ID NO: 2216995 - RNA, 16 nt, Human
cuagaaccaccugccu

SEQ ID NO: 2216996 - RNA, 19 nt, Human
gagguacugagagugaaca

SEQ ID NO: 2216997 - RNA, 18 nt, Human
acuuuaugcuaagugaaa

SEQ ID NO: 2216998 - RNA, 23 nt, Human
caauaacgauaaaagacagugaa

SEQ ID NO: 2216999 - RNA, 22 nt, Human
ccgggagccugaucaccugccc

SEQ ID NO: 2217000 - RNA, 18 nt, Human
uaucaaaagaaagaaaau

SEQ ID NO: 2217001 - RNA, 16 nt, Human
cagucucccucccuug

SEQ ID NO: 2217002 - RNA, 19 nt, Human
gugaacuugguuuuaauua

SEQ ID NO: 2217003 - RNA, 18 nt, Human
aaauauaaauaaaaauaa

SEQ ID NO: 2217004 - RNA, 14 nt, Human
uucuggaauaaucc

SEQ ID NO: 2217005 - RNA, 13 nt, Human
ucacuguaaaaua

SEQ ID NO: 2217006 - RNA, 19 nt, Human
ugaucaccugcccugcuga

SEQ ID NO: 2217007 - RNA, 15 nt, Human
ucucauccugcaggc

SEQ ID NO: 2217008 - RNA, 16 nt, Human
caggcugagccucagu

SEQ ID NO: 2217009 - RNA, 15 nt, Human
ccacaggaaccacaa

SEQ ID NO: 2217010 - RNA, 17 nt, Human
aauaaaguguuugaaag

SEQ ID NO: 2217011 - RNA, 16 nt, Human
augaauacuuuauaaa

SEQ ID NO: 2217012 - RNA, 20 nt, Human
ugguuguauuauuuuuuaaa

SEQ ID NO: 2217013 - RNA, 16 nt, Human
ccuccuuuuaaaguaa

SEQ ID NO: 2217014 - RNA, 20 nt, Human
ggaggcauccaaaggcuccu

SEQ ID NO: 2217015 - RNA, 20 nt, Human
gcuugcagagaugaggccgc

SEQ ID NO: 2217016 - RNA, 17 nt, Human
ucccagaucaagccugc

SEQ ID NO: 2217017 - RNA, 13 nt, Human
auaacuggaaacu

SEQ ID NO: 2217018 - RNA, 19 nt, Human
augaaguacucauacaugu

SEQ ID NO: 2217019 - RNA, 21 nt, Human
cucaguccaugaagauguaga

SEQ ID NO: 2217020 - RNA, 16 nt, Human
aauauaaauaaaaaua

SEQ ID NO: 2217021 - RNA, 14 nt, Human
ggggaacaugagcc

SEQ ID NO: 2217022 - RNA, 14 nt, Human
accugugagaccaa

SEQ ID NO: 2217023 - RNA, 19 nt, Human
cagguaccuucucaccugu

SEQ ID NO: 2217024 - RNA, 14 nt, Human
cauccugugggacc

SEQ ID NO: 2217025 - RNA, 15 nt, Human
gcacagccucuuaga

SEQ ID NO: 2217026 - RNA, 17 nt, Human
uucugacacuaaaacac

SEQ ID NO: 2217027 - RNA, 16 nt, Human
ccuggugggcagagag

SEQ ID NO: 2217028 - RNA, 14 nt, Human
gagccagugucagg

SEQ ID NO: 2217029 - RNA, 21 nt, Human
cuaguaucaaaagaaagaaaa

SEQ ID NO: 2217030 - RNA, 13 nt, Human
aaaaaugguuuaa

SEQ ID NO: 2217031 - RNA, 22 nt, Human
aaugggcacaggguuuauguuu

SEQ ID NO: 2217032 - RNA, 12 nt, Human
cuccauuuuuag

SEQ ID NO: 2217033 - RNA, 16 nt, Human
augcuguauuuuaaaa

SEQ ID NO: 2217034 - RNA, 18 nt, Human
uaucccaaccucucccaa

SEQ ID NO: 2217035 - RNA, 18 nt, Human
gacccacuggacucaccu

SEQ ID NO: 2217036 - RNA, 15 nt, Human
aauauaaauaaaaau

SEQ ID NO: 2217037 - RNA, 15 nt, Human
uauaaauaaaaauaa

SEQ ID NO: 2217038 - RNA, 16 nt, Human
ggccuccauccugagg

SEQ ID NO: 2217039 - RNA, 21 nt, Human
cauuucuugagguaaaagcau

SEQ ID NO: 2217040 - RNA, 15 nt, Human
gacaugggccccaga

SEQ ID NO: 2217041 - RNA, 15 nt, Human
cacuuggucugugag

SEQ ID NO: 2217042 - RNA, 16 nt, Human
gacauuugcucaugga

SEQ ID NO: 2217043 - RNA, 19 nt, Human
uugagaaggagcucccagg

SEQ ID NO: 2217044 - RNA, 23 nt, Human
cuuaagaagacugcauuauauuu

SEQ ID NO: 2217045 - RNA, 14 nt, Human
uaguaucaaaagaa

SEQ ID NO: 2217046 - RNA, 21 nt, Human
ccuggugccucaccccuugcc

SEQ ID NO: 2217047 - RNA, 19 nt, Human
uuuccugaaaacccuugcc

SEQ ID NO: 2217048 - RNA, 19 nt, Human
uccugugggaccugggcca

SEQ ID NO: 2217049 - RNA, 16 nt, Human
gccucagucucccucc

SEQ ID NO: 2217050 - RNA, 19 nt, Human
cugagcccggaaacuccac

SEQ ID NO: 2217051 - RNA, 16 nt, Human
aaaagcuccauuuuua

SEQ ID NO: 2217052 - RNA, 22 nt, Human
aaagagugaaggauuuauguuu

SEQ ID NO: 2217053 - RNA, 16 nt, Human
ugagcucagcccuggu

SEQ ID NO: 2217054 - RNA, 22 nt, Human
gagccucagucucccucccuug

SEQ ID NO: 2217055 - RNA, 20 nt, Human
aagcuucacuguaaaauaau

SEQ ID NO: 2217056 - RNA, 22 nt, Human
ccaaaggcuccugagacacaug

SEQ ID NO: 2217057 - RNA, 15 nt, Human
aacgauaaaagacag

SEQ ID NO: 2217058 - RNA, 18 nt, Human
accaggcuugccugcagg

SEQ ID NO: 2217059 - RNA, 11 nt, Human
aauuccacagc

SEQ ID NO: 2217060 - RNA, 18 nt, Human
agcuuacuuaaaauugua

SEQ ID NO: 2217061 - RNA, 19 nt, Human
cuuccagauccuggaaauc

SEQ ID NO: 2217062 - RNA, 17 nt, Human
uaauuuuuauauuugaa

SEQ ID NO: 2217063 - RNA, 22 nt, Human
gcuugcagagaugaggccgcca

SEQ ID NO: 2217064 - RNA, 20 nt, Human
uagaugcaguucugaagaag

SEQ ID NO: 2217065 - RNA, 13 nt, Human
auuggacaguaaa

SEQ ID NO: 2217066 - RNA, 15 nt, Human
aguucugaagaagau

SEQ ID NO: 2217067 - RNA, 17 nt, Human
agcucugcccauccugc

SEQ ID NO: 2217068 - RNA, 19 nt, Human
ugcuauugggguugggggg

SEQ ID NO: 2217069 - RNA, 21 nt, Human
gaagugaaaaucuacacucca

SEQ ID NO: 2217070 - RNA, 13 nt, Human
gcuugccugcagg

SEQ ID NO: 2217071 - RNA, 14 nt, Human
gaaugauuaugaau

SEQ ID NO: 2217072 - RNA, 15 nt, Human
gcccacuagacccac

SEQ ID NO: 2217073 - RNA, 20 nt, Human
cacccccagaaugaccuggc

SEQ ID NO: 2217074 - RNA, 23 nt, Human
aaagcccagcuugaaaccuucac

SEQ ID NO: 2217075 - RNA, 15 nt, Human
guaaggggaauugag

SEQ ID NO: 2217076 - RNA, 15 nt, Human
uggaguaaaucgcua

SEQ ID NO: 2217077 - RNA, 18 nt, Human
accaccugccuauauuuu

SEQ ID NO: 2217078 - RNA, 14 nt, Human
auucugccugcccu

SEQ ID NO: 2217079 - RNA, 15 nt, Human
agaaaacaauaacga

SEQ ID NO: 2217080 - RNA, 14 nt, Human
aacgauaaaagaca

SEQ ID NO: 2217081 - RNA, 18 nt, Human
uacuuuauuuucuauaau

SEQ ID NO: 2217082 - RNA, 13 nt, Human
agccucagucucc

SEQ ID NO: 2217083 - RNA, 14 nt, Human
agauguagaggaga

SEQ ID NO: 2217084 - RNA, 24 nt, Human
aaagacagcuucucauccugcagg

SEQ ID NO: 2217085 - RNA, 22 nt, Human
uuugaugcuacaggauuugaaa

SEQ ID NO: 2217086 - RNA, 16 nt, Human
aauuucuucaacuccc

SEQ ID NO: 2217087 - RNA, 14 nt, Human
gagcccauggcacu

SEQ ID NO: 2217088 - RNA, 15 nt, Human
gauuccugagccagu

SEQ ID NO: 2217089 - RNA, 15 nt, Human
aaggcuccugagaca

SEQ ID NO: 2217090 - RNA, 15 nt, Human
uuuagugaaauauua

SEQ ID NO: 2217091 - RNA, 17 nt, Human
gugccuguaaucacagc

SEQ ID NO: 2217092 - RNA, 14 nt, Human
cucuggcuccagcu

SEQ ID NO: 2217093 - RNA, 13 nt, Human
acaauaaaagaca

SEQ ID NO: 2217094 - RNA, 18 nt, Human
gaccccugagcuugcaga

SEQ ID NO: 2217095 - RNA, 23 nt, Human
ggucuaucuuugagcgcccacua

SEQ ID NO: 2217096 - RNA, 23 nt, Human
cucauguccacugguucuucuug

SEQ ID NO: 2217097 - RNA, 22 nt, Human
agccugccucaaucaguauuca

SEQ ID NO: 2217098 - RNA, 13 nt, Human
uuuaaaaauccua

SEQ ID NO: 2217099 - RNA, 13 nt, Human
aauuuuuauauuu

SEQ ID NO: 2217100 - RNA, 21 nt, Human
auggcagcuuuccucaaaacu

SEQ ID NO: 2217101 - RNA, 22 nt, Human
ugggcacuguggguagacacac

SEQ ID NO: 2217102 - RNA, 12 nt, Human
ggcugaugcagu

SEQ ID NO: 2217103 - RNA, 14 nt, Human
uucagccugaaaga

SEQ ID NO: 2217104 - RNA, 16 nt, Human
uggauacuccaugggg

SEQ ID NO: 2217105 - RNA, 20 nt, Human
gauugugccccugcacucca

SEQ ID NO: 2217106 - RNA, 20 nt, Human
uaacaagccuccuuuuaaag

SEQ ID NO: 2217107 - RNA, 21 nt, Human
cuuuuccaaugacauuuuguu

SEQ ID NO: 2217108 - RNA, 15 nt, Human
acagugaaagaaaau

SEQ ID NO: 2217109 - RNA, 17 nt, Human
aagacagugaaagaaaa

SEQ ID NO: 2217110 - RNA, 15 nt, Human
cugacucuuaagaag

SEQ ID NO: 2217111 - RNA, 17 nt, Human
cugccucagaaaacaag

SEQ ID NO: 2217112 - RNA, 14 nt, Human
aucaccaaggcuga

SEQ ID NO: 2217113 - RNA, 12 nt, Human
ucaauaaaacuu

SEQ ID NO: 2217114 - RNA, 22 nt, Human
agcacagccucuuagaugcagu

SEQ ID NO: 2217115 - RNA, 19 nt, Human
cagaaagcagaacagugau

SEQ ID NO: 2217116 - RNA, 18 nt, Human
aaaguaacccuacaaaac

SEQ ID NO: 2217117 - RNA, 15 nt, Human
aagcacuaaacaaag

SEQ ID NO: 2217118 - RNA, 21 nt, Human
ucccagaucaagccugccuca

SEQ ID NO: 2217119 - RNA, 21 nt, Human
uauuauuuuauagcuacuaau

SEQ ID NO: 2217120 - RNA, 17 nt, Human
aauucuugccaaauaua

SEQ ID NO: 2217121 - RNA, 14 nt, Human
auuuauguuuaauu

SEQ ID NO: 2217122 - RNA, 19 nt, Human
cugagccucagucucccuc

SEQ ID NO: 2217123 - RNA, 13 nt, Human
uuggacgagaaaa

SEQ ID NO: 2217124 - RNA, 17 nt, Human
gcaaauugucacaggac

SEQ ID NO: 2217125 - RNA, 14 nt, Human
ggcaauagucaaau

SEQ ID NO: 2217126 - RNA, 21 nt, Human
gaaaaguauguuagugcaaau

SEQ ID NO: 2217127 - RNA, 13 nt, Human
ccaggcugagccu

SEQ ID NO: 2217128 - RNA, 17 nt, Human
uauuuguacauuuuuuu

SEQ ID NO: 2217129 - RNA, 12 nt, Human
aagaaaauaacg

SEQ ID NO: 2217130 - RNA, 15 nt, Human
ugggacagggaggac

SEQ ID NO: 2217131 - RNA, 20 nt, Human
ugagcagugcuugaaugaag

SEQ ID NO: 2217132 - RNA, 20 nt, Human
uaacgauaaaagacagugaa

SEQ ID NO: 2217133 - RNA, 16 nt, Human
gaaucacuugaacccg

SEQ ID NO: 2217134 - RNA, 12 nt, Human
gcugaugcaguu

SEQ ID NO: 2217135 - RNA, 16 nt, Human
auaauccuaaacauau

SEQ ID NO: 2217136 - RNA, 13 nt, Human
agacagcucugca

SEQ ID NO: 2217137 - RNA, 18 nt, Human
uuuuagugaaauauuauu

SEQ ID NO: 2217138 - RNA, 15 nt, Human
ugagaaggagcuccc

SEQ ID NO: 2217139 - RNA, 13 nt, Human
aggagcucccagg

SEQ ID NO: 2217140 - RNA, 13 nt, Human
ugagcggaccuuc

SEQ ID NO: 2217141 - RNA, 14 nt, Human
agaucaagccugcc

SEQ ID NO: 2217142 - RNA, 15 nt, Human
ucuaugaaauauuau

SEQ ID NO: 2217143 - RNA, 14 nt, Human
cuuggucugugaga

SEQ ID NO: 2217144 - RNA, 23 nt, Human
aucacagcuacuugggaggcuga

SEQ ID NO: 2217145 - RNA, 17 nt, Human
cuggacucaccuccccc

SEQ ID NO: 2217146 - RNA, 13 nt, Human
uuuucuuuucauu

SEQ ID NO: 2217147 - RNA, 21 nt, Human
gcugagucccaggcugagccu

SEQ ID NO: 2217148 - RNA, 14 nt, Human
ugaucaccugcccu

SEQ ID NO: 2217149 - RNA, 14 nt, Human
uaaauaguuuauga

SEQ ID NO: 2217150 - RNA, 15 nt, Human
uccagauccuggaaa

SEQ ID NO: 2217151 - RNA, 18 nt, Human
aggcggauugagaaggag

SEQ ID NO: 2217152 - RNA, 12 nt, Human
aguguuugaaag

SEQ ID NO: 2217153 - RNA, 21 nt, Human
acuuuuccaaugacauuuugu

SEQ ID NO: 2217154 - RNA, 16 nt, Human
aaauauuauguuaaaa

SEQ ID NO: 2217155 - RNA, 17 nt, Human
ccccagaaugaccuggc

SEQ ID NO: 2217156 - RNA, 19 nt, Human
cuggccuucggccuccauc

SEQ ID NO: 2217157 - RNA, 16 nt, Human
cuccaugggguggggg

SEQ ID NO: 2217158 - RNA, 16 nt, Human
guuuuuuuuuaaaaaa

SEQ ID NO: 2217159 - RNA, 15 nt, Human
gcaggcaugagucag

SEQ ID NO: 2217160 - RNA, 18 nt, Human
acaaaugggaaacaaaag

SEQ ID NO: 2217161 - RNA, 14 nt, Human
gcaaagcccagcuu

SEQ ID NO: 2217162 - RNA, 16 nt, Human
uuuucucuaggaaaua

SEQ ID NO: 2217163 - RNA, 18 nt, Human
ggaggacgcucucuggcc

SEQ ID NO: 2217164 - RNA, 22 nt, Human
uucaauaucuuuuuuuuaauaa

SEQ ID NO: 2217165 - RNA, 19 nt, Human
augaguaacugauuuguaa

SEQ ID NO: 2217166 - RNA, 16 nt, Human
acaggauggcaggagg

SEQ ID NO: 2217167 - RNA, 23 nt, Human
gaaaacaauaacgauaaaagaca

SEQ ID NO: 2217168 - RNA, 22 nt, Human
ggguggaaaaacagaccggggu

SEQ ID NO: 2217169 - RNA, 12 nt, Human
cucauggaauug

SEQ ID NO: 2217170 - RNA, 15 nt, Human
aauaacgauaaaaga

SEQ ID NO: 2217171 - RNA, 22 nt, Human
cuccugccuaagugcagccccg

SEQ ID NO: 2217172 - RNA, 15 nt, Human
aaggguacacugccu

SEQ ID NO: 2217173 - RNA, 18 nt, Human
cauggaauuggagcucgu

SEQ ID NO: 2217174 - RNA, 20 nt, Human
auaagccagacaucaacaga

SEQ ID NO: 2217175 - RNA, 22 nt, Human
aaagacagugaaagaaaauaac

SEQ ID NO: 2217176 - RNA, 16 nt, Human
gcuuuuucucucccac

SEQ ID NO: 2217177 - RNA, 14 nt, Human
ggaaguagaggagg

SEQ ID NO: 2217178 - RNA, 12 nt, Human
gacgagaaaaca

SEQ ID NO: 2217179 - RNA, 20 nt, Human
auucccagccagcacagccu

SEQ ID NO: 2217180 - RNA, 15 nt, Human
cucccugccccccag

SEQ ID NO: 2217181 - RNA, 11 nt, Human
gccaugggaca

SEQ ID NO: 2217182 - RNA, 21 nt, Human
cagugagacagcucugcauac

SEQ ID NO: 2217183 - RNA, 18 nt, Human
agcugccuccccagcucu

SEQ ID NO: 2217184 - RNA, 23 nt, Human
acugucuuguuggacgagaaaac

SEQ ID NO: 2217185 - RNA, 18 nt, Human
uuuuauaucaauuuaaaa

SEQ ID NO: 2217186 - RNA, 21 nt, Human
cuucucaccugugagaccaaa

SEQ ID NO: 2217187 - RNA, 15 nt, Human
aagugaaaaucuaca

SEQ ID NO: 2217188 - RNA, 16 nt, Human
cacuaguauuucuaug

SEQ ID NO: 2217189 - RNA, 15 nt, Human
cuucucuucacaguc

SEQ ID NO: 2217190 - RNA, 22 nt, Human
aaacauccuacaagacacagug

SEQ ID NO: 2217191 - RNA, 14 nt, Human
aaaacuucagacau

SEQ ID NO: 2217192 - RNA, 12 nt, Human
uucucuaggaaa

SEQ ID NO: 2217193 - RNA, 15 nt, Human
ccugaaagucccaga

SEQ ID NO: 2217194 - RNA, 23 nt, Human
cuacacgagauacagaauuuuau

SEQ ID NO: 2217195 - RNA, 16 nt, Human
caaaaggauaaugaau

SEQ ID NO: 2217196 - RNA, 14 nt, Human
aaagaggaaugaag

SEQ ID NO: 2217197 - RNA, 21 nt, Human
gagcuaggggggucagccagc

SEQ ID NO: 2217198 - RNA, 20 nt, Human
cuucaacucccugcccccca

SEQ ID NO: 2217199 - RNA, 13 nt, Human
aagcauuccaacu

SEQ ID NO: 2217200 - RNA, 19 nt, Human
gacagucaccucauggaau

SEQ ID NO: 2217201 - RNA, 13 nt, Human
auuuuuuaaaaaa

SEQ ID NO: 2217202 - RNA, 21 nt, Human
cuaaauugacacuuaaaaaug

SEQ ID NO: 2217203 - RNA, 20 nt, Human
gagccugaucaccugcccug

SEQ ID NO: 2217204 - RNA, 17 nt, Human
gacacaugggugcuauu

SEQ ID NO: 2217205 - RNA, 17 nt, Human
cugauggguuucuccag

SEQ ID NO: 2217206 - RNA, 15 nt, Human
ccugccccccagccc

SEQ ID NO: 2217207 - RNA, 20 nt, Human
ccccuauccuacuuccccuu

SEQ ID NO: 2217208 - RNA, 17 nt, Human
aauauugcaaggcaaag

SEQ ID NO: 2217209 - RNA, 17 nt, Human
aguauuucuaugaaaua

SEQ ID NO: 2217210 - RNA, 18 nt, Human
aggaaaaaauaacaauga

SEQ ID NO: 2217211 - RNA, 19 nt, Human
agcagcuuauucacaagac

SEQ ID NO: 2217212 - RNA, 22 nt, Human
augcugagcccggaaacuccac

SEQ ID NO: 2217213 - RNA, 14 nt, Human
agaauucauucacu

SEQ ID NO: 2217214 - RNA, 17 nt, Human
gcaugguuuagaaagcu

SEQ ID NO: 2217215 - RNA, 22 nt, Human
uuaccucugccucagaaaacaa

SEQ ID NO: 2217216 - RNA, 11 nt, Human
cauaugaaaag

SEQ ID NO: 2217217 - RNA, 24 nt, Human
cauucuggaauaauccuaaacaua

SEQ ID NO: 2217218 - RNA, 16 nt, Human
aaauaacaaugaaagu

SEQ ID NO: 2217219 - RNA, 13 nt, Human
augauuccaccua

SEQ ID NO: 2217220 - RNA, 15 nt, Human
gugaccacugcagaa

SEQ ID NO: 2217221 - RNA, 16 nt, Human
acauccuacaagacac

SEQ ID NO: 2217222 - RNA, 16 nt, Human
ucuuauaauuuaaaau

SEQ ID NO: 2217223 - RNA, 20 nt, Human
auuacauuuguauaaaauaa

SEQ ID NO: 2217224 - RNA, 20 nt, Human
uuccacagaagcuccaggua

SEQ ID NO: 2217225 - RNA, 16 nt, Human
cuggccuucggccucc

SEQ ID NO: 2217226 - RNA, 17 nt, Human
cuucacuguaaaauaau

SEQ ID NO: 2217227 - RNA, 17 nt, Human
uuauauuugaaauauug

SEQ ID NO: 2217228 - RNA, 17 nt, Human
gauaaaagacagugaaa

SEQ ID NO: 2217229 - RNA, 15 nt, Human
gauccugcaauucca

SEQ ID NO: 2217230 - RNA, 18 nt, Human
ccugaaagaggaaugaag

SEQ ID NO: 2217231 - RNA, 15 nt, Human
aauacuuuauaaagg

SEQ ID NO: 2217232 - RNA, 20 nt, Human
ggagccugaucaccugcccu

SEQ ID NO: 2217233 - RNA, 16 nt, Human
aaaagcaucacaugaa

SEQ ID NO: 2217234 - RNA, 12 nt, Human
uauaauuuaaaa

SEQ ID NO: 2217235 - RNA, 18 nt, Human
ccauccugccccugagcc

SEQ ID NO: 2217236 - RNA, 23 nt, Human
agacagcuucucauccugcaggc

SEQ ID NO: 2217237 - RNA, 23 nt, Human
aagucccagaucaagccugccuc

SEQ ID NO: 2217238 - RNA, 19 nt, Human
auuuucaguuauuauauuu

SEQ ID NO: 2217239 - RNA, 16 nt, Human
ugcuaagucuuauaua

SEQ ID NO: 2217240 - RNA, 19 nt, Human
aagucuuucacauuuaaau

SEQ ID NO: 2217241 - RNA, 18 nt, Human
agggugcacacaggaugg

SEQ ID NO: 2217242 - RNA, 22 nt, Human
agucuuucacauuuaaauaaag

SEQ ID NO: 2217243 - RNA, 12 nt, Human
acaagaaaugaa

SEQ ID NO: 2217244 - RNA, 16 nt, Human
uaaauaaaaauaaucc

SEQ ID NO: 2217245 - RNA, 13 nt, Human
aagaaaauaacga

SEQ ID NO: 2217246 - RNA, 17 nt, Human
acaaguccagccuggca

SEQ ID NO: 2217247 - RNA, 22 nt, Human
aggaugccccgucccccucugg

SEQ ID NO: 2217248 - RNA, 20 nt, Human
accaggcacccccagaauga

SEQ ID NO: 2217249 - RNA, 15 nt, Human
agucaccucauggaa

SEQ ID NO: 2217250 - RNA, 18 nt, Human
auagaauuaacacaugau

SEQ ID NO: 2217251 - RNA, 14 nt, Human
cuccugagacacau

SEQ ID NO: 2217252 - RNA, 20 nt, Human
agccuaguugaucagcuuau

SEQ ID NO: 2217253 - RNA, 22 nt, Human
aucaccaaggcugauuaaacca

SEQ ID NO: 2217254 - RNA, 20 nt, Human
ccaaauguucaucaaugaau

SEQ ID NO: 2217255 - RNA, 14 nt, Human
uuuuaaaaaagaaa

SEQ ID NO: 2217256 - RNA, 22 nt, Human
aggcuccugagacacaugggug

SEQ ID NO: 2217257 - RNA, 20 nt, Human
uccagccugagcgacaguga

SEQ ID NO: 2217258 - RNA, 18 nt, Human
aauaaaacuuuuccaaug

SEQ ID NO: 2217259 - RNA, 22 nt, Human
ggguuccuuccucugagccuug

SEQ ID NO: 2217260 - RNA, 13 nt, Human
acacacaugaagu

SEQ ID NO: 2217261 - RNA, 13 nt, Human
ugaaauuguauua

SEQ ID NO: 2217262 - RNA, 13 nt, Human
gacaaggaaaaaa

SEQ ID NO: 2217263 - RNA, 17 nt, Human
uaucuuuuuuuuaauaa

SEQ ID NO: 2217264 - RNA, 19 nt, Human
auuauuuuuuaaaaaaauu

SEQ ID NO: 2217265 - RNA, 15 nt, Human
agcucuaucaccaag

SEQ ID NO: 2217266 - RNA, 14 nt, Human
auaaaauaauuuuu

SEQ ID NO: 2217267 - RNA, 13 nt, Human
cgggaggcagagg

SEQ ID NO: 2217268 - RNA, 14 nt, Human
cuacaagacacagu

SEQ ID NO: 2217269 - RNA, 21 nt, Human
auuuguauaaaauaauuuuua

SEQ ID NO: 2217270 - RNA, 14 nt, Human
ugcagccccuggga

SEQ ID NO: 2217271 - RNA, 13 nt, Human
aguguuugaaagc

SEQ ID NO: 2217272 - RNA, 18 nt, Human
ucccaacuauaaaacuag

SEQ ID NO: 2217273 - RNA, 12 nt, Human
ugagagacacac

SEQ ID NO: 2217274 - RNA, 16 nt, Human
cacuggacucaccucc

SEQ ID NO: 2217275 - RNA, 20 nt, Human
ucaaaacuucagacauagaa

SEQ ID NO: 2217276 - RNA, 18 nt, Human
cuccauuuuuagugaaau

SEQ ID NO: 2217277 - RNA, 14 nt, Human
auuucuaugaaaua

SEQ ID NO: 2217278 - RNA, 18 nt, Human
aaagaaaaucaggcuggc

SEQ ID NO: 2217279 - RNA, 16 nt, Human
agguacuucaaauccu

SEQ ID NO: 2217280 - RNA, 18 nt, Human
uuuauggcacuaguauuu

SEQ ID NO: 2217281 - RNA, 21 nt, Human
ugccuguaaucacagcuacuu

SEQ ID NO: 2217282 - RNA, 17 nt, Human
uuuuuaauuauauggcu

SEQ ID NO: 2217283 - RNA, 18 nt, Human
uuuguuaaaugauuucau

SEQ ID NO: 2217284 - RNA, 17 nt, Human
caccucccccaucucuu

SEQ ID NO: 2217285 - RNA, 15 nt, Human
cuccacauccugugg

SEQ ID NO: 2217286 - RNA, 15 nt, Human
gaccacugcagaaga

SEQ ID NO: 2217287 - RNA, 14 nt, Human
ucugggcagacucu

SEQ ID NO: 2217288 - RNA, 17 nt, Human
cccacuagacccacugg

SEQ ID NO: 2217289 - RNA, 20 nt, Human
acaugagguacugagaguga

SEQ ID NO: 2217290 - RNA, 15 nt, Human
gaaaacaaggaugaa

SEQ ID NO: 2217291 - RNA, 12 nt, Human
ggggugggggug

SEQ ID NO: 2217292 - RNA, 13 nt, Human
uuaaauuguaaua

SEQ ID NO: 2217293 - RNA, 23 nt, Human
ggaugaauuaaguuuuuuuuuaa

SEQ ID NO: 2217294 - RNA, 17 nt, Human
cccacuggacucaccuc

SEQ ID NO: 2217295 - RNA, 14 nt, Human
cagauuugagcuca

SEQ ID NO: 2217296 - RNA, 22 nt, Human
acagauuugagcucagcccugg

SEQ ID NO: 2217297 - RNA, 19 nt, Human
gagccugaucaccugcccu

SEQ ID NO: 2217298 - RNA, 14 nt, Human
cagugaaagaaaau

SEQ ID NO: 2217299 - RNA, 20 nt, Human
uuucuucaacucccugcccc

SEQ ID NO: 2217300 - RNA, 17 nt, Human
ucucauccugcaggcag

SEQ ID NO: 2217301 - RNA, 11 nt, Human
aaccugagccc

SEQ ID NO: 2217302 - RNA, 16 nt, Human
ucugcagauaaacagu

SEQ ID NO: 2217303 - RNA, 16 nt, Human
agugucaaugcagccc

SEQ ID NO: 2217304 - RNA, 21 nt, Human
aaaaaguucugcagauaaaca

SEQ ID NO: 2217305 - RNA, 16 nt, Human
cugagcgacagugaga

SEQ ID NO: 2217306 - RNA, 16 nt, Human
agcggaccuucccagc

SEQ ID NO: 2217307 - RNA, 18 nt, Human
guauuauuuuuuaaaaaa

SEQ ID NO: 2217308 - RNA, 20 nt, Human
augcaguuguugcccacagc

SEQ ID NO: 2217309 - RNA, 21 nt, Human
ugcccugaaagucccagauca

SEQ ID NO: 2217310 - RNA, 15 nt, Human
acaaaugggaaacaa

SEQ ID NO: 2217311 - RNA, 14 nt, Human
cuucugacacuaaa

SEQ ID NO: 2217312 - RNA, 20 nt, Human
cugagcggaccuucccagcu

SEQ ID NO: 2217313 - RNA, 17 nt, Human
uaauuccacagcugcuc

SEQ ID NO: 2217314 - RNA, 17 nt, Human
agcuacuaauuuuaaaa

SEQ ID NO: 2217315 - RNA, 22 nt, Human
agcuuguauuccuuuuucucuc

SEQ ID NO: 2217316 - RNA, 23 nt, Human
augucaauucuugccaaauauaa

SEQ ID NO: 2217317 - RNA, 23 nt, Human
ucacaccaggcuugccugcaggc

SEQ ID NO: 2217318 - RNA, 16 nt, Human
gucccagaucaagccu

SEQ ID NO: 2217319 - RNA, 16 nt, Human
aacaauaaaagacaag

SEQ ID NO: 2217320 - RNA, 14 nt, Human
ccaaugaaaugagu

SEQ ID NO: 2217321 - RNA, 19 nt, Human
agaaaauaacaauaaaaga

SEQ ID NO: 2217322 - RNA, 15 nt, Human
cugcagauaaacagu

SEQ ID NO: 2217323 - RNA, 21 nt, Human
gaaagcagggacuugaaccca

SEQ ID NO: 2217324 - RNA, 20 nt, Human
uuaacacaugauccugcaau

SEQ ID NO: 2217325 - RNA, 16 nt, Human
aauugacccacaagaa

SEQ ID NO: 2217326 - RNA, 19 nt, Human
guacugagagugaacaaau

SEQ ID NO: 2217327 - RNA, 13 nt, Human
aagugcagccccg

SEQ ID NO: 2217328 - RNA, 16 nt, Human
uggcaagcucuaucac

SEQ ID NO: 2217329 - RNA, 15 nt, Human
cucguggaacaguua

SEQ ID NO: 2217330 - RNA, 16 nt, Human
ccauuuuuagugaaau

SEQ ID NO: 2217331 - RNA, 16 nt, Human
cuagaauucacuccac

SEQ ID NO: 2217332 - RNA, 23 nt, Human
ugaauuacauuuguauaaaauaa

SEQ ID NO: 2217333 - RNA, 23 nt, Human
caaagcugaaauggacuuuugua

SEQ ID NO: 2217334 - RNA, 14 nt, Human
agagguccacaaca

SEQ ID NO: 2217335 - RNA, 13 nt, Human
acaagagcuuaac

SEQ ID NO: 2217336 - RNA, 13 nt, Human
ucuacuaaaaaua

SEQ ID NO: 2217337 - RNA, 14 nt, Human
auuguccaggucua

SEQ ID NO: 2217338 - RNA, 16 nt, Human
gaauggcuaagcaaaa

SEQ ID NO: 2217339 - RNA, 19 nt, Human
aaaauaacgauaaaagaca

SEQ ID NO: 2217340 - RNA, 18 nt, Human
uggucaauuuuguuaugu

SEQ ID NO: 2217341 - RNA, 21 nt, Human
caagacugcacaucaaaauau

SEQ ID NO: 2217342 - RNA, 23 nt, Human
uaaaagacagugaaagaaaauaa

SEQ ID NO: 2217343 - RNA, 12 nt, Human
gagcucccagga

SEQ ID NO: 2217344 - RNA, 21 nt, Human
cacaugaacuuguaaaggaau

SEQ ID NO: 2217345 - RNA, 17 nt, Human
aacaguuaccucugccu

SEQ ID NO: 2217346 - RNA, 16 nt, Human
uuucuauaauuuaaau

SEQ ID NO: 2217347 - RNA, 18 nt, Human
aagucuuucacauuuaaa

SEQ ID NO: 2217348 - RNA, 12 nt, Human
uccugcaggcag

SEQ ID NO: 2217349 - RNA, 21 nt, Human
gaaaugaguuuuucuuuucau

SEQ ID NO: 2217350 - RNA, 17 nt, Human
uugggguugggggggag

SEQ ID NO: 2217351 - RNA, 16 nt, Human
caugguuuagaaagcu

SEQ ID NO: 2217352 - RNA, 17 nt, Human
uguucuaagaagugaaa

SEQ ID NO: 2217353 - RNA, 19 nt, Human
uccacauccugugggaccu

SEQ ID NO: 2217354 - RNA, 17 nt, Human
uccugccccugagccca

SEQ ID NO: 2217355 - RNA, 17 nt, Human
cuccuuaucaaaggaca

SEQ ID NO: 2217356 - RNA, 22 nt, Human
gcacagccucuuagaugcaguu

SEQ ID NO: 2217357 - RNA, 18 nt, Human
agcuucucauccugcagg

SEQ ID NO: 2217358 - RNA, 17 nt, Human
aggcaugagucagucug

SEQ ID NO: 2217359 - RNA, 17 nt, Human
ugaaauauuauuuuaua

SEQ ID NO: 2217360 - RNA, 22 nt, Human
gugugaccacugcagaagacag

SEQ ID NO: 2217361 - RNA, 22 nt, Human
cccagcccuccuuaucaaagga

SEQ ID NO: 2217362 - RNA, 17 nt, Human
acccacuggacucaccu

SEQ ID NO: 2217363 - RNA, 12 nt, Human
uuuuauauuuga

SEQ ID NO: 2217364 - RNA, 20 nt, Human
cugcacuccagccugagcga

SEQ ID NO: 2217365 - RNA, 15 nt, Human
uaucaauuuaaaaaa

SEQ ID NO: 2217366 - RNA, 17 nt, Human
ccugagcuugcagagau

SEQ ID NO: 2217367 - RNA, 19 nt, Human
ugggccauagucauucugc

SEQ ID NO: 2217368 - RNA, 13 nt, Human
ugccugcaggcau

SEQ ID NO: 2217369 - RNA, 24 nt, Human
uggccgggagccugaucaccugcc

SEQ ID NO: 2217370 - RNA, 20 nt, Human
uuaaguuuuuuuuuaaaaaa

SEQ ID NO: 2217371 - RNA, 19 nt, Human
uuugccaaguucuccacua

SEQ ID NO: 2217372 - RNA, 18 nt, Human
gaaaauaacgauaaaaga

SEQ ID NO: 2217373 - RNA, 17 nt, Human
caggaggggcuucuggg

SEQ ID NO: 2217374 - RNA, 12 nt, Human
gggggucagcca

SEQ ID NO: 2217375 - RNA, 17 nt, Human
aggccaugggacaggga

SEQ ID NO: 2217376 - RNA, 13 nt, Human
ugauuauauguca

SEQ ID NO: 2217377 - RNA, 17 nt, Human
uuaaauggucaauuuug

SEQ ID NO: 2217378 - RNA, 17 nt, Human
ucagacauagaauuaac

SEQ ID NO: 2217379 - RNA, 20 nt, Human
auaacaaugcuguauuuuaa

SEQ ID NO: 2217380 - RNA, 21 nt, Human
accaaggagccaaacauccua

SEQ ID NO: 2217381 - RNA, 17 nt, Human
cucgugggacagucacc

SEQ ID NO: 2217382 - RNA, 14 nt, Human
accugggccauagu

SEQ ID NO: 2217383 - RNA, 24 nt, Human
gcuucugggcagacucuggucaag

SEQ ID NO: 2217384 - RNA, 20 nt, Human
acaguggaaagacagcuucu

SEQ ID NO: 2217385 - RNA, 15 nt, Human
aaucucaauauuuca

SEQ ID NO: 2217386 - RNA, 16 nt, Human
uagcuacuaauuuuaa

SEQ ID NO: 2217387 - RNA, 15 nt, Human
gccagugucaggagg

SEQ ID NO: 2217388 - RNA, 22 nt, Human
gcucuaucccaaccucucccaa

SEQ ID NO: 2217389 - RNA, 18 nt, Human
cagaguacuggcugaugg

SEQ ID NO: 2217390 - RNA, 20 nt, Human
ccuucucaccugugagacca

SEQ ID NO: 2217391 - RNA, 21 nt, Human
aauaauccucaguuuuuguga

SEQ ID NO: 2217392 - RNA, 18 nt, Human
gcugagcccggaaacucc

SEQ ID NO: 2217393 - RNA, 18 nt, Human
auucacuccacuuggaca

SEQ ID NO: 2217394 - RNA, 14 nt, Human
aauuguauuacaaa

SEQ ID NO: 2217395 - RNA, 15 nt, Human
ugagcgcccacuaga

SEQ ID NO: 2217396 - RNA, 20 nt, Human
aagaugguaccaccagucug

SEQ ID NO: 2217397 - RNA, 14 nt, Human
aaaauacaaaaaaa

SEQ ID NO: 2217398 - RNA, 22 nt, Human
agcagcauaaauguugacaugg

SEQ ID NO: 2217399 - RNA, 16 nt, Human
ccugcaaagcccagcu

SEQ ID NO: 2217400 - RNA, 18 nt, Human
gaagcaccaaucaugaau

SEQ ID NO: 2217401 - RNA, 13 nt, Human
auugcaaggcaaa

SEQ ID NO: 2217402 - RNA, 13 nt, Human
auaacgauaaaag

SEQ ID NO: 2217403 - RNA, 13 nt, Human
acuauaaaacuag

SEQ ID NO: 2217404 - RNA, 12 nt, Human
gccccugagccc

SEQ ID NO: 2217405 - RNA, 21 nt, Human
acgcucucuggccuucggccu

SEQ ID NO: 2217406 - RNA, 15 nt, Human
acuuuuccaaugaca

SEQ ID NO: 2217407 - RNA, 16 nt, Human
caggaggcauccaaag

SEQ ID NO: 2217408 - RNA, 22 nt, Human
auauauaacaaugcuguauuuu

SEQ ID NO: 2217409 - RNA, 22 nt, Human
uggacgagaaaacaauaacgau

SEQ ID NO: 2217410 - RNA, 22 nt, Human
agaccaaauugagcuagggggg

SEQ ID NO: 2217411 - RNA, 21 nt, Human
cugggaccaggcacccccaga

SEQ ID NO: 2217412 - RNA, 20 nt, Human
caauaaaacuuuuccaauga

SEQ ID NO: 2217413 - RNA, 16 nt, Human
gagcucgugggacagu

SEQ ID NO: 2217414 - RNA, 22 nt, Human
agaauuuuaugcggcauuuucu

SEQ ID NO: 2217415 - RNA, 13 nt, Human
augaacuuuccac

SEQ ID NO: 2217416 - RNA, 18 nt, Human
auuugcuggagcucugcc

SEQ ID NO: 2217417 - RNA, 16 nt, Human
cugaucaccugcccug

SEQ ID NO: 2217418 - RNA, 22 nt, Human
aaacaccucagcugccucccca

SEQ ID NO: 2217419 - RNA, 19 nt, Human
ccugccuaagugcagcccc

SEQ ID NO: 2217420 - RNA, 22 nt, Human
aaauguugacaugggacauuug

SEQ ID NO: 2217421 - RNA, 23 nt, Human
ugcagagguccacaacacacaga

SEQ ID NO: 2217422 - RNA, 19 nt, Human
agcucugcccauccugccc

SEQ ID NO: 2217423 - RNA, 14 nt, Human
gucccaggcugagc

SEQ ID NO: 2217424 - RNA, 14 nt, Human
auuuauuuuaauaa

SEQ ID NO: 2217425 - RNA, 19 nt, Human
acauuuguauaaaauaauu

SEQ ID NO: 2217426 - RNA, 19 nt, Human
caugaguaacugauuugua

SEQ ID NO: 2217427 - RNA, 18 nt, Human
cucccuuggggccuaugc

SEQ ID NO: 2217428 - RNA, 23 nt, Human
cuagacccacuggacucaccucc

SEQ ID NO: 2217429 - RNA, 23 nt, Human
auaauguguucauucuggaauaa

SEQ ID NO: 2217430 - RNA, 18 nt, Human
uuacaaaugggaaacaaa

SEQ ID NO: 2217431 - RNA, 23 nt, Human
gaggcauccaaaggcuccugaga

SEQ ID NO: 2217432 - RNA, 18 nt, Human
acagagacagaaagcaga

SEQ ID NO: 2217433 - RNA, 20 nt, Human
ugauuucugagcauuuaaua

SEQ ID NO: 2217434 - RNA, 16 nt, Human
uguucuaagaagugaa

SEQ ID NO: 2217435 - RNA, 18 nt, Human
aaguugauaugccuuuuc

SEQ ID NO: 2217436 - RNA, 15 nt, Human
gcagagguugcagug

SEQ ID NO: 2217437 - RNA, 17 nt, Human
aaauaacgauaaaagac

SEQ ID NO: 2217438 - RNA, 16 nt, Human
cugagcuugcagagau

SEQ ID NO: 2217439 - RNA, 16 nt, Human
acaugaaguccaagca

SEQ ID NO: 2217440 - RNA, 23 nt, Human
uuauagcuacuaauuuuaaaaug

SEQ ID NO: 2217441 - RNA, 20 nt, Human
uguaauaggcguaacuaauu

SEQ ID NO: 2217442 - RNA, 18 nt, Human
ccugcccugaaaguccca

SEQ ID NO: 2217443 - RNA, 17 nt, Human
agaacucccuuucaaca

SEQ ID NO: 2217444 - RNA, 15 nt, Human
cacaggacagcccuu

SEQ ID NO: 2217445 - RNA, 13 nt, Human
agguaccagccuu

SEQ ID NO: 2217446 - RNA, 22 nt, Human
cacuaguauuucuaugaaauau

SEQ ID NO: 2217447 - RNA, 22 nt, Human
ugaagcaaaauuuuuucucuag

SEQ ID NO: 2217448 - RNA, 17 nt, Human
gccugagcgacagugag

SEQ ID NO: 2217449 - RNA, 13 nt, Human
ccuccuuuuaaag

SEQ ID NO: 2217450 - RNA, 20 nt, Human
auuuugugauugauuauaug

SEQ ID NO: 2217451 - RNA, 18 nt, Human
uauaacaaugcuguauuu

SEQ ID NO: 2217452 - RNA, 19 nt, Human
acuagacaaguccagccug

SEQ ID NO: 2217453 - RNA, 20 nt, Human
acaagacacagugaccauac

SEQ ID NO: 2217454 - RNA, 23 nt, Human
aguacucauacauguuacaacac

SEQ ID NO: 2217455 - RNA, 16 nt, Human
uaaugaauacuuuaua

SEQ ID NO: 2217456 - RNA, 22 nt, Human
accauuucuugagguaaaagca

SEQ ID NO: 2217457 - RNA, 17 nt, Human
ccagguaccuucucacc

SEQ ID NO: 2217458 - RNA, 14 nt, Human
caugagucagucug

SEQ ID NO: 2217459 - RNA, 13 nt, Human
acaaggaaaaaau

SEQ ID NO: 2217460 - RNA, 21 nt, Human
auuccuuuuucucuccucucc

SEQ ID NO: 2217461 - RNA, 15 nt, Human
cugaaagaggaauga

SEQ ID NO: 2217462 - RNA, 22 nt, Human
gaaaaucuuauaauuuaaaaua

SEQ ID NO: 2217463 - RNA, 14 nt, Human
ugcucauggaauug

SEQ ID NO: 2217464 - RNA, 12 nt, Human
aauuuuaaaaug

SEQ ID NO: 2217465 - RNA, 18 nt, Human
cagcuuauugucuaguga

SEQ ID NO: 2217466 - RNA, 12 nt, Human
uauuauuuuuua

SEQ ID NO: 2217467 - RNA, 17 nt, Human
uuccaagugauugaaac

SEQ ID NO: 2217468 - RNA, 21 nt, Human
uaguauuucuaugaaauauua

SEQ ID NO: 2217469 - RNA, 18 nt, Human
gaaaauaucacuugucaa

SEQ ID NO: 2217470 - RNA, 20 nt, Human
gccugagcggaccuucccag

SEQ ID NO: 2217471 - RNA, 18 nt, Human
cugcucaauaaaguacaa

SEQ ID NO: 2217472 - RNA, 16 nt, Human
uaaaggaauuuaaaaa

SEQ ID NO: 2217473 - RNA, 16 nt, Human
ucaucaaugaaugaau

SEQ ID NO: 2217474 - RNA, 18 nt, Human
gaugccccgucccccucu

SEQ ID NO: 2217475 - RNA, 15 nt, Human
ggggcuucugggcag

SEQ ID NO: 2217476 - RNA, 18 nt, Human
ccugccuaagugcagccc

SEQ ID NO: 2217477 - RNA, 14 nt, Human
caggaggcauccaa

SEQ ID NO: 2217478 - RNA, 12 nt, Human
auucugaaagca

SEQ ID NO: 2217479 - RNA, 19 nt, Human
ccuccauccugaggcucca

SEQ ID NO: 2217480 - RNA, 20 nt, Human
cugauauuggacaguaaaau

SEQ ID NO: 2217481 - RNA, 10 nt, Human
caacucccug

SEQ ID NO: 2217482 - RNA, 18 nt, Human
cagauuugagcucagccc

SEQ ID NO: 2217483 - RNA, 12 nt, Human
caacccaaaugu

SEQ ID NO: 2217484 - RNA, 12 nt, Human
ccccugggacca

SEQ ID NO: 2217485 - RNA, 13 nt, Human
cucugagccuugg

SEQ ID NO: 2217486 - RNA, 21 nt, Human
ugaaacgaggauugggaaaaa

SEQ ID NO: 2217487 - RNA, 20 nt, Human
auuuucaguuauuauauuua

SEQ ID NO: 2217488 - RNA, 17 nt, Human
uuauuacuguaagaaaa

SEQ ID NO: 2217489 - RNA, 21 nt, Human
ugaugcuacaggauuugaaau

SEQ ID NO: 2217490 - RNA, 22 nt, Human
uguauacugugugcuaaaacaa

SEQ ID NO: 2217491 - RNA, 16 nt, Human
ugcaugguuuagaaag

SEQ ID NO: 2217492 - RNA, 14 nt, Human
aacaccucagcugc

SEQ ID NO: 2217493 - RNA, 18 nt, Human
caugaagauguagaggag

SEQ ID NO: 2217494 - RNA, 19 nt, Human
aaaauaacaauaaaagaca

SEQ ID NO: 2217495 - RNA, 13 nt, Human
ccagaucaagccu

SEQ ID NO: 2217496 - RNA, 18 nt, Human
cccagaaugaccuggccg

SEQ ID NO: 2217497 - RNA, 22 nt, Human
cacagauuugagcucagcccug

SEQ ID NO: 2217498 - RNA, 11 nt, Human
auuuaaaaauc

SEQ ID NO: 2217499 - RNA, 13 nt, Human
aaauccuugaaga

SEQ ID NO: 2217500 - RNA, 14 nt, Human
ugaaagucccagau

SEQ ID NO: 2217501 - RNA, 18 nt, Human
gcacuccagccugagcga

SEQ ID NO: 2217502 - RNA, 21 nt, Human
gaacuuuccacauucagagcu

SEQ ID NO: 2217503 - RNA, 20 nt, Human
ugaggcuccacuuggucugu

SEQ ID NO: 2217504 - RNA, 13 nt, Human
uuuugaaucauca

SEQ ID NO: 2217505 - RNA, 17 nt, Human
accucagcugccucccc

SEQ ID NO: 2217506 - RNA, 19 nt, Human
cagcuucucauccugcagg

SEQ ID NO: 2217507 - RNA, 13 nt, Human
uauuuauuuuaau

SEQ ID NO: 2217508 - RNA, 16 nt, Human
aagcauuuagauguau

SEQ ID NO: 2217509 - RNA, 20 nt, Human
uccaaaggcuccugagacac

SEQ ID NO: 2217510 - RNA, 15 nt, Human
guuuuucuuuucauu

SEQ ID NO: 2217511 - RNA, 17 nt, Human
ucauacuucuuaggguu

SEQ ID NO: 2217512 - RNA, 17 nt, Human
cauccugugggaccugg

SEQ ID NO: 2217513 - RNA, 22 nt, Human
gaacuuuccacauucagagcuu

SEQ ID NO: 2217514 - RNA, 23 nt, Human
ccccucuggcuccagcuggccgg

SEQ ID NO: 2217515 - RNA, 20 nt, Human
accucauggaauuggagcuc

SEQ ID NO: 2217516 - RNA, 14 nt, Human
ucuaucccaaccuc

SEQ ID NO: 2217517 - RNA, 14 nt, Human
ggccgcagugaggc

SEQ ID NO: 2217518 - RNA, 15 nt, Human
ugcuguauuuuaaaa

SEQ ID NO: 2217519 - RNA, 18 nt, Human
cuccauccugaggcucca

SEQ ID NO: 2217520 - RNA, 16 nt, Human
cuuauaauuuaaaaua

SEQ ID NO: 2217521 - RNA, 17 nt, Human
cugagcagugcuugaau

SEQ ID NO: 2217522 - RNA, 15 nt, Human
uuaauuuguaguguu

SEQ ID NO: 2217523 - RNA, 15 nt, Human
aaauaauuuuuauau

SEQ ID NO: 2217524 - RNA, 16 nt, Human
uuauaauuuaaaauau

SEQ ID NO: 2217525 - RNA, 17 nt, Human
ccacugcagaagacagu

SEQ ID NO: 2217526 - RNA, 23 nt, Human
gagcucccaggaggggcuucugg

SEQ ID NO: 2217527 - RNA, 15 nt, Human
ggcaagcucuaucac

SEQ ID NO: 2217528 - RNA, 20 nt, Human
cuaaaugucaaucagccuag

SEQ ID NO: 2217529 - RNA, 21 nt, Human
uccauccugaggcuccacuug

SEQ ID NO: 2217530 - RNA, 19 nt, Human
auaaaagacaaggaaaaaa

SEQ ID NO: 2217531 - RNA, 14 nt, Human
ucccaacuauaaaa

SEQ ID NO: 2217532 - RNA, 21 nt, Human
acagugauuaccagggacuga

SEQ ID NO: 2217533 - RNA, 21 nt, Human
ugaacaaauuuacagagacag

SEQ ID NO: 2217534 - RNA, 17 nt, Human
gccccccagcccuccuu

SEQ ID NO: 2217535 - RNA, 22 nt, Human
aauaugccccauucaacaucua

SEQ ID NO: 2217536 - RNA, 21 nt, Human
augucauuugcuggagcucug

SEQ ID NO: 2217537 - RNA, 21 nt, Human
auuuuaguaagagauuccuga

SEQ ID NO: 2217538 - RNA, 18 nt, Human
uuuugugaagcaaaauuu

SEQ ID NO: 2217539 - RNA, 14 nt, Human
uaauccuaaacaua

SEQ ID NO: 2217540 - RNA, 16 nt, Human
cucagcccuggugggc

SEQ ID NO: 2217541 - RNA, 14 nt, Human
auacaaaaaaaaaa

SEQ ID NO: 2217542 - RNA, 15 nt, Human
uacuaauuuuaaaau

SEQ ID NO: 2217543 - RNA, 18 nt, Human
cagucucccucccuuggg

SEQ ID NO: 2217544 - RNA, 18 nt, Human
ugagcuaggggggucagc

SEQ ID NO: 2217545 - RNA, 13 nt, Human
uaaacauguuuau

SEQ ID NO: 2217546 - RNA, 16 nt, Human
agcuugaaaccuucac

SEQ ID NO: 2217547 - RNA, 19 nt, Human
cucacauuuauauuuuugu

SEQ ID NO: 2217548 - RNA, 13 nt, Human
uucuauaauuuaa

SEQ ID NO: 2217549 - RNA, 16 nt, Human
cccacuggacucaccu

SEQ ID NO: 2217550 - RNA, 18 nt, Human
uauuuucuauaauuuaaa

SEQ ID NO: 2217551 - RNA, 14 nt, Human
gucauucugccugc

SEQ ID NO: 2217552 - RNA, 18 nt, Human
uagugaaauauuauuuua

SEQ ID NO: 2217553 - RNA, 22 nt, Human
gauaaaagacagugaaagaaaa

SEQ ID NO: 2217554 - RNA, 15 nt, Human
cuacaagacacagug

SEQ ID NO: 2217555 - RNA, 23 nt, Human
gagguaccagccuuggauacucc

SEQ ID NO: 2217556 - RNA, 14 nt, Human
cucccuuggggccu

SEQ ID NO: 2217557 - RNA, 18 nt, Human
aaaaucuuauaauuuaaa

SEQ ID NO: 2217558 - RNA, 19 nt, Human
cuugccugcaggcaugagu

SEQ ID NO: 2217559 - RNA, 23 nt, Human
uuuauaugcuucuguuuuauaau

SEQ ID NO: 2217560 - RNA, 21 nt, Human
uuuguauaaaauaauuuuuau

SEQ ID NO: 2217561 - RNA, 23 nt, Human
guaauuccguagguuauuuucag

SEQ ID NO: 2217562 - RNA, 20 nt, Human
gcagagaugaggccgccaug

SEQ ID NO: 2217563 - RNA, 17 nt, Human
cuggagggaagccuugg

SEQ ID NO: 2217564 - RNA, 18 nt, Human
cccucuucugacacuaaa

SEQ ID NO: 2217565 - RNA, 18 nt, Human
agugucaaugcagccccc

SEQ ID NO: 2217566 - RNA, 14 nt, Human
augaacuuuuuguu

SEQ ID NO: 2217567 - RNA, 16 nt, Human
ucauucugccugcccu

SEQ ID NO: 2217568 - RNA, 19 nt, Human
augaaagcagggacuugaa

SEQ ID NO: 2217569 - RNA, 14 nt, Human
gauuaguacacacu

SEQ ID NO: 2217570 - RNA, 23 nt, Human
gcugccuccccagcucuauccca

SEQ ID NO: 2217571 - RNA, 16 nt, Human
ucaguuuuugugaaaa

SEQ ID NO: 2217572 - RNA, 15 nt, Human
ucauaauaaguugca

SEQ ID NO: 2217573 - RNA, 16 nt, Human
aagcuucacuguaaaa

SEQ ID NO: 2217574 - RNA, 14 nt, Human
accacaagacugca

SEQ ID NO: 2217575 - RNA, 15 nt, Human
cccugccccccagcc

SEQ ID NO: 2217576 - RNA, 14 nt, Human
cagaccgggguucc

SEQ ID NO: 2217577 - RNA, 19 nt, Human
agccugaucaccugcccug

SEQ ID NO: 2217578 - RNA, 20 nt, Human
uaagugaaauaagccagaca

SEQ ID NO: 2217579 - RNA, 21 nt, Human
gcacuguggguagacacacau

SEQ ID NO: 2217580 - RNA, 14 nt, Human
uaacuaauuuuaac

SEQ ID NO: 2217581 - RNA, 13 nt, Human
ggaaguagaggag

SEQ ID NO: 2217582 - RNA, 16 nt, Human
auugucuagugaaacu

SEQ ID NO: 2217583 - RNA, 13 nt, Human
aucuacacuccag

SEQ ID NO: 2217584 - RNA, 15 nt, Human
agucugaugagaacu

SEQ ID NO: 2217585 - RNA, 14 nt, Human
ugguauguuuucag

SEQ ID NO: 2217586 - RNA, 16 nt, Human
uauaugucacuuugcu

SEQ ID NO: 2217587 - RNA, 14 nt, Human
ggugcugcagcccc

SEQ ID NO: 2217588 - RNA, 19 nt, Human
auacuaauuauacccccug

SEQ ID NO: 2217589 - RNA, 21 nt, Human
aaacgaggauugggaaaaagu

SEQ ID NO: 2217590 - RNA, 17 nt, Human
gucaaagcugaaaugga

SEQ ID NO: 2217591 - RNA, 15 nt, Human
ugcaauuccacuuau

SEQ ID NO: 2217592 - RNA, 12 nt, Human
cauagaaguaaa

SEQ ID NO: 2217593 - RNA, 20 nt, Human
gcccauccugccccugagcc

SEQ ID NO: 2217594 - RNA, 16 nt, Human
uucacauuuaaauaaa

SEQ ID NO: 2217595 - RNA, 15 nt, Human
ccucauguccacugg

SEQ ID NO: 2217596 - RNA, 16 nt, Human
ugcacaucaaaauaug

SEQ ID NO: 2217597 - RNA, 18 nt, Human
auguuaaaacugggacag

SEQ ID NO: 2217598 - RNA, 21 nt, Human
ugcaggcagcuuuuucucucc

SEQ ID NO: 2217599 - RNA, 23 nt, Human
gccagguaccuucucaccuguga

SEQ ID NO: 2217600 - RNA, 16 nt, Human
uggggauagugaggca

SEQ ID NO: 2217601 - RNA, 16 nt, Human
cagcuuuccucaaaac

SEQ ID NO: 2217602 - RNA, 13 nt, Human
agggggaacauga

SEQ ID NO: 2217603 - RNA, 16 nt, Human
agggaggacgcucucu

SEQ ID NO: 2217604 - RNA, 17 nt, Human
uuauuuguacauuuuuu

SEQ ID NO: 2217605 - RNA, 15 nt, Human
uuagugaaauauuau

SEQ ID NO: 2217606 - RNA, 23 nt, Human
cuugauaaauggcuuccuggcaa

SEQ ID NO: 2217607 - RNA, 13 nt, Human
agaaaugaaagca

SEQ ID NO: 2217608 - RNA, 20 nt, Human
gcacccccagaaugaccugg

SEQ ID NO: 2217609 - RNA, 13 nt, Human
cugccuucucaac

SEQ ID NO: 2217610 - RNA, 14 nt, Human
ccucagucucccuc

SEQ ID NO: 2217611 - RNA, 22 nt, Human
cugaggcuccacuuggucugug

SEQ ID NO: 2217612 - RNA, 21 nt, Human
ucagccagcccucuucugaca

SEQ ID NO: 2217613 - RNA, 20 nt, Human
cuugccauaauuacuauguc

SEQ ID NO: 2217614 - RNA, 16 nt, Human
aagacugcacaucaaa

SEQ ID NO: 2217615 - RNA, 20 nt, Human
ggccaugggacagggaggac

SEQ ID NO: 2217616 - RNA, 13 nt, Human
ucauccugcaggc

SEQ ID NO: 2217617 - RNA, 14 nt, Human
auuuguauaaaaua

SEQ ID NO: 2217618 - RNA, 18 nt, Human
cccucuggcuccagcugg

SEQ ID NO: 2217619 - RNA, 23 nt, Human
ucuaccaaaaaucucaauauuuc

SEQ ID NO: 2217620 - RNA, 15 nt, Human
gacaguauggcagcu

SEQ ID NO: 2217621 - RNA, 16 nt, Human
ucaccugggcugaggc

SEQ ID NO: 2217622 - RNA, 15 nt, Human
aaaaauaacaaugaa

SEQ ID NO: 2217623 - RNA, 11 nt, Human
cgauaaaagac

SEQ ID NO: 2217624 - RNA, 20 nt, Human
aauaauuuuuauauuugaaa

SEQ ID NO: 2217625 - RNA, 18 nt, Human
aagaccucauuuugaagg

SEQ ID NO: 2217626 - RNA, 13 nt, Human
ucauucugccugc

SEQ ID NO: 2217627 - RNA, 12 nt, Human
cuuccucacacc

SEQ ID NO: 2217628 - RNA, 23 nt, Human
caacggggugaaacccugucucu

SEQ ID NO: 2217629 - RNA, 23 nt, Human
ggccuccauccugaggcuccacu

SEQ ID NO: 2217630 - RNA, 16 nt, Human
uucucaccugugagac

SEQ ID NO: 2217631 - RNA, 21 nt, Human
acaugggugcuauugggguug

SEQ ID NO: 2217632 - RNA, 18 nt, Human
cagggaggacgcucucug

SEQ ID NO: 2217633 - RNA, 21 nt, Human
aaguuuaugguuguauuauuu

SEQ ID NO: 2217634 - RNA, 17 nt, Human
guguccccuauccuacu

SEQ ID NO: 2217635 - RNA, 15 nt, Human
aaaagacaaggaaaa

SEQ ID NO: 2217636 - RNA, 16 nt, Human
gccaaggaugccccgu

SEQ ID NO: 2217637 - RNA, 22 nt, Human
ccccuuccuaauuccacagcug

SEQ ID NO: 2217638 - RNA, 18 nt, Human
aaggaugccccguccccc

SEQ ID NO: 2217639 - RNA, 20 nt, Human
acagcccuucuuuccacaga

SEQ ID NO: 2217640 - RNA, 16 nt, Human
ugugagaugcuagaac

SEQ ID NO: 2217641 - RNA, 18 nt, Human
cuucacuguaaaauaaua

SEQ ID NO: 2217642 - RNA, 16 nt, Human
guucugcacacagcac

SEQ ID NO: 2217643 - RNA, 14 nt, Human
aaugauuaugaauu

SEQ ID NO: 2217644 - RNA, 21 nt, Human
cagcucuaucccaaccucucc

SEQ ID NO: 2217645 - RNA, 19 nt, Human
auucccagccagcacagcc

SEQ ID NO: 2217646 - RNA, 21 nt, Human
cuccccagcucuaucccaacc

SEQ ID NO: 2217647 - RNA, 17 nt, Human
ccaaaaaucucaauauu

SEQ ID NO: 2217648 - RNA, 21 nt, Human
uccuucagccugaaagaggaa

SEQ ID NO: 2217649 - RNA, 18 nt, Human
agagaaugagagacacac

SEQ ID NO: 2217650 - RNA, 15 nt, Human
ccugagcggaccuuc

SEQ ID NO: 2217651 - RNA, 18 nt, Human
uuuucaauaaaacuuuuc

SEQ ID NO: 2217652 - RNA, 18 nt, Human
aacaaugcuguauuuuaa

SEQ ID NO: 2217653 - RNA, 18 nt, Human
cccaggcugagccucagu

SEQ ID NO: 2217654 - RNA, 15 nt, Human
aaugaauggcuaagc

SEQ ID NO: 2217655 - RNA, 14 nt, Human
gagcucagcccugg

SEQ ID NO: 2217656 - RNA, 20 nt, Human
auuacuguaagaaaauauca

SEQ ID NO: 2217657 - RNA, 23 nt, Human
uuagaugcaguucugaagaagau

SEQ ID NO: 2217658 - RNA, 14 nt, Human
caccucagcugccu

SEQ ID NO: 2217659 - RNA, 14 nt, Human
uugaaauuguauua

SEQ ID NO: 2217660 - RNA, 15 nt, Human
aaggaauuuaaaaau

SEQ ID NO: 2217661 - RNA, 23 nt, Human
uguugcccacagcuguaugauuc

SEQ ID NO: 2217662 - RNA, 20 nt, Human
aauuuuuucucuaggaaaua

SEQ ID NO: 2217663 - RNA, 14 nt, Human
gaaggcuuacaccc

SEQ ID NO: 2217664 - RNA, 13 nt, Human
acggggugaaacc

SEQ ID NO: 2217665 - RNA, 22 nt, Human
cagcacgggggccaaggaugcc

SEQ ID NO: 2217666 - RNA, 22 nt, Human
cauaaauguugacaugggacau

SEQ ID NO: 2217667 - RNA, 14 nt, Human
acuuggucugugag

SEQ ID NO: 2217668 - RNA, 13 nt, Human
gggggaggugagg

SEQ ID NO: 2217669 - RNA, 18 nt, Human
cuggaaacuucagcgguu

SEQ ID NO: 2217670 - RNA, 20 nt, Human
aaauaauuuuuauauuugaa

SEQ ID NO: 2217671 - RNA, 16 nt, Human
cagcucuaucccaacc

SEQ ID NO: 2217672 - RNA, 14 nt, Human
agucucccucccuu

SEQ ID NO: 2217673 - RNA, 12 nt, Human
uuuuuuuuaaaa

SEQ ID NO: 2217674 - RNA, 22 nt, Human
gucacaggaaguagaggaggcc

SEQ ID NO: 2217675 - RNA, 19 nt, Human
ccacuuggacaugggcccc

SEQ ID NO: 2217676 - RNA, 16 nt, Human
ggggcuucugggcaga

SEQ ID NO: 2217677 - RNA, 19 nt, Human
aauuuuuauauuugaaaua

SEQ ID NO: 2217678 - RNA, 19 nt, Human
gguuccuuccucugagccu

SEQ ID NO: 2217679 - RNA, 18 nt, Human
ucuucaacucccugcccc

SEQ ID NO: 2217680 - RNA, 12 nt, Human
cuaagaagugaa

SEQ ID NO: 2217681 - RNA, 22 nt, Human
ugaguuuuucuuuucauuuacc

SEQ ID NO: 2217682 - RNA, 14 nt, Human
aaauauuauuuuau

SEQ ID NO: 2217683 - RNA, 14 nt, Human
augggccauaugaa

SEQ ID NO: 2217684 - RNA, 15 nt, Human
accugggcugaggca

SEQ ID NO: 2217685 - RNA, 10 nt, Human
accugagccc

SEQ ID NO: 2217686 - RNA, 23 nt, Human
acgaggauugggaaaaaguaauu

SEQ ID NO: 2217687 - RNA, 13 nt, Human
aacaauaaaagac

SEQ ID NO: 2217688 - RNA, 18 nt, Human
auccugugggaccugggc

SEQ ID NO: 2217689 - RNA, 13 nt, Human
uuuugcuguggca

SEQ ID NO: 2217690 - RNA, 14 nt, Human
aaccugagccccaa

SEQ ID NO: 2217691 - RNA, 22 nt, Human
aauuuaaaaaaaaaccugagcc

SEQ ID NO: 2217692 - RNA, 16 nt, Human
uccucacaccaggcuu

SEQ ID NO: 2217693 - RNA, 12 nt, Human
auauaaauaaaa

SEQ ID NO: 2217694 - RNA, 17 nt, Human
gacgagaaaacaauaac

SEQ ID NO: 2217695 - RNA, 23 nt, Human
gaaaaucuuauaauuuaaaauau

SEQ ID NO: 2217696 - RNA, 19 nt, Human
aggggggucagccagcccu

SEQ ID NO: 2217697 - RNA, 12 nt, Human
gguauuuuaauc

SEQ ID NO: 2217698 - RNA, 15 nt, Human
auaaaguguuugaaa

SEQ ID NO: 2217699 - RNA, 18 nt, Human
aaauaacgauaaaagaca

SEQ ID NO: 2217700 - RNA, 13 nt, Human
ucuauaauuuaaa

SEQ ID NO: 2217701 - RNA, 20 nt, Human
agcuuauugucuagugaaac

SEQ ID NO: 2217702 - RNA, 14 nt, Human
ggaaacuccacauc

SEQ ID NO: 2217703 - RNA, 16 nt, Human
accucugccucagaaa

SEQ ID NO: 2217704 - RNA, 13 nt, Human
ugcauuucuaaag

SEQ ID NO: 2217705 - RNA, 17 nt, Human
cuggcaaggguucaccu

SEQ ID NO: 2217706 - RNA, 22 nt, Human
gaugcaguucugaagaagaugg

SEQ ID NO: 2217707 - RNA, 17 nt, Human
gauacuccauggggugg

SEQ ID NO: 2217708 - RNA, 18 nt, Human
cugagggcauagaaguaa

SEQ ID NO: 2217709 - RNA, 16 nt, Human
gcuugccugcaggcau

SEQ ID NO: 2217710 - RNA, 16 nt, Human
ccuacaugagguacug

SEQ ID NO: 2217711 - RNA, 17 nt, Human
auuauuuuuuaaaaaaa

SEQ ID NO: 2217712 - RNA, 19 nt, Human
uaucucauuuccaagcaag

SEQ ID NO: 2217713 - RNA, 12 nt, Human
agaucaagccug

SEQ ID NO: 2217714 - RNA, 23 nt, Human
ccucagcugccuccccagcucua

SEQ ID NO: 2217715 - RNA, 20 nt, Human
aacaaugcuguauuuuaaaa

SEQ ID NO: 2217716 - RNA, 16 nt, Human
uuaauaauuuuuaauu

SEQ ID NO: 2217717 - RNA, 15 nt, Human
auggugaaaugcaga

SEQ ID NO: 2217718 - RNA, 16 nt, Human
uaccuuuugcuguggc

SEQ ID NO: 2217719 - RNA, 14 nt, Human
acuggacucaccuc

SEQ ID NO: 2217720 - RNA, 15 nt, Human
ucaaaggacaccauu

SEQ ID NO: 2217721 - RNA, 22 nt, Human
agaaugagagacacacugaaga

SEQ ID NO: 2217722 - RNA, 22 nt, Human
uacaugagguacugagagugaa

SEQ ID NO: 2217723 - RNA, 12 nt, Human
cauucugccugc

SEQ ID NO: 2217724 - RNA, 17 nt, Human
ugguucccuugaugaag

SEQ ID NO: 2217725 - RNA, 22 nt, Human
aaguuguagguaauauugcaag

SEQ ID NO: 2217726 - RNA, 16 nt, Human
uaggauguugaaaaag

SEQ ID NO: 2217727 - RNA, 19 nt, Human
uggugaacuugguuuuaau

SEQ ID NO: 2217728 - RNA, 19 nt, Human
uuuauaucaauuuaaaaaa

SEQ ID NO: 2217729 - RNA, 15 nt, Human
cccucuucugacacu

SEQ ID NO: 2217730 - RNA, 13 nt, Human
uuaugcuaaguga

SEQ ID NO: 2217731 - RNA, 22 nt, Human
caucgcaauguaagacucggga

SEQ ID NO: 2217732 - RNA, 23 nt, Human
uccaacuaucucauuuccaagca

SEQ ID NO: 2217733 - RNA, 20 nt, Human
agccuuggggcugaugcagu

SEQ ID NO: 2217734 - RNA, 14 nt, Human
ugcuagaacucccu

SEQ ID NO: 2217735 - RNA, 15 nt, Human
cuagaauucacucca

SEQ ID NO: 2217736 - RNA, 22 nt, Human
ucuccagagggaauugcagagu

SEQ ID NO: 2217737 - RNA, 19 nt, Human
gcuaccuuuugcuguggca

SEQ ID NO: 2217738 - RNA, 19 nt, Human
auguuuacagauccccaag

SEQ ID NO: 2217739 - RNA, 15 nt, Human
gcaacccaaauguuc

SEQ ID NO: 2217740 - RNA, 18 nt, Human
uauuuucaguuauuauau

SEQ ID NO: 2217741 - RNA, 13 nt, Human
aacucuauaaugu

SEQ ID NO: 2217742 - RNA, 19 nt, Human
uauauuuuugugauuuugu

SEQ ID NO: 2217743 - RNA, 14 nt, Human
auaccaugaugcug

SEQ ID NO: 2217744 - RNA, 20 nt, Human
uaggaauugacccacaagaa

SEQ ID NO: 2217745 - RNA, 22 nt, Human
aauuacauuuguauaaaauaau

SEQ ID NO: 2217746 - RNA, 18 nt, Human
gaaauggugaaaugcaga

SEQ ID NO: 2217747 - RNA, 16 nt, Human
ugcuguauuuuaaaag

SEQ ID NO: 2217748 - RNA, 16 nt, Human
ugaaguccaagcauuu

SEQ ID NO: 2217749 - RNA, 19 nt, Human
gagccucagucucccuccc

SEQ ID NO: 2217750 - RNA, 16 nt, Human
ucuuggucucaguguc

SEQ ID NO: 2217751 - RNA, 17 nt, Human
uuauaucaauuuaaaaa

SEQ ID NO: 2217752 - RNA, 20 nt, Human
ccaaccucucccaacuauaa

SEQ ID NO: 2217753 - RNA, 20 nt, Human
agcccuggugggcagagagg

SEQ ID NO: 2217754 - RNA, 22 nt, Human
uugaaaaucuuauaauuuaaaa

SEQ ID NO: 2217755 - RNA, 23 nt, Human
cagccagcccucuucugacacua

SEQ ID NO: 2217756 - RNA, 21 nt, Human
ugcucaauaaaguacaagagc

SEQ ID NO: 2217757 - RNA, 21 nt, Human
gccugaucaccugcccugcug

SEQ ID NO: 2217758 - RNA, 20 nt, Human
aaggaugccccgucccccuc

SEQ ID NO: 2217759 - RNA, 16 nt, Human
agggagggaaggggga

SEQ ID NO: 2217760 - RNA, 20 nt, Human
augggccccagauaccauga

SEQ ID NO: 2217761 - RNA, 13 nt, Human
ggcuccugagaca

SEQ ID NO: 2217762 - RNA, 13 nt, Human
uguauauuuuaua

SEQ ID NO: 2217763 - RNA, 21 nt, Human
auaauuuuuauauuugaaaua

SEQ ID NO: 2217764 - RNA, 22 nt, Human
ggcauuuaggccaugggacagg

SEQ ID NO: 2217765 - RNA, 23 nt, Human
ggucucagugucaaugcagcccc

SEQ ID NO: 2217766 - RNA, 13 nt, Human
gguccacaacaca

SEQ ID NO: 2217767 - RNA, 19 nt, Human
cuuggacaugggccccaga

SEQ ID NO: 2217768 - RNA, 22 nt, Human
acauccuacaagacacagugac

SEQ ID NO: 2217769 - RNA, 13 nt, Human
uuaaaaaagaaac

SEQ ID NO: 2217770 - RNA, 17 nt, Human
cucguggaacaguuacc

SEQ ID NO: 2217771 - RNA, 17 nt, Human
ucuuauaauuuaaaaua

SEQ ID NO: 2217772 - RNA, 19 nt, Human
guccaggucuaccaaaaau

SEQ ID NO: 2217773 - RNA, 22 nt, Human
uagacacacaugaaguccaagc

SEQ ID NO: 2217774 - RNA, 13 nt, Human
cuugccugcaggc

SEQ ID NO: 2217775 - RNA, 20 nt, Human
aguuguuucuacuacaugga

SEQ ID NO: 2217776 - RNA, 15 nt, Human
ccgugugccugagcg

SEQ ID NO: 2217777 - RNA, 22 nt, Human
cagcucuaucccaaccucuccc

SEQ ID NO: 2217778 - RNA, 18 nt, Human
acagcuucucauccugca

SEQ ID NO: 2217779 - RNA, 21 nt, Human
auuuuccugaaaacccuugcc

SEQ ID NO: 2217780 - RNA, 15 nt, Human
cauccugcaggcagc

SEQ ID NO: 2217781 - RNA, 20 nt, Human
ccauacuaauuauacccccu

SEQ ID NO: 2217782 - RNA, 16 nt, Human
uaacaauaaaagacaa

SEQ ID NO: 2217783 - RNA, 13 nt, Human
uaugaaauauuau

SEQ ID NO: 2217784 - RNA, 22 nt, Human
ccacuuggacaugggccccaga

SEQ ID NO: 2217785 - RNA, 21 nt, Human
ccucuguucugcacacagcac

SEQ ID NO: 2217786 - RNA, 18 nt, Human
gaaacaaaaggauaauga

SEQ ID NO: 2217787 - RNA, 21 nt, Human
uagggugauauuaaccagggg

SEQ ID NO: 2217788 - RNA, 23 nt, Human
acguaaucguguccccuauccua

SEQ ID NO: 2217789 - RNA, 13 nt, Human
cacacugaagaag

SEQ ID NO: 2217790 - RNA, 23 nt, Human
ggcaaagacuauucccuucuaac

SEQ ID NO: 2217791 - RNA, 16 nt, Human
aguaagagauuccuga

SEQ ID NO: 2217792 - RNA, 19 nt, Human
caaggaugccccguccccc

SEQ ID NO: 2217793 - RNA, 13 nt, Human
cccaaaaggcaga

SEQ ID NO: 2217794 - RNA, 15 nt, Human
cauuccaagccucau

SEQ ID NO: 2217795 - RNA, 15 nt, Human
gcaagcucuaucacc

SEQ ID NO: 2217796 - RNA, 21 nt, Human
aauuuuuauauuugaaauauu

SEQ ID NO: 2217797 - RNA, 12 nt, Human
ucccaaccucuc

SEQ ID NO: 2217798 - RNA, 22 nt, Human
cuccagccugagcgacagugag

SEQ ID NO: 2217799 - RNA, 14 nt, Human
acacugaagaagca

SEQ ID NO: 2217800 - RNA, 16 nt, Human
ggugcugcagccccug

SEQ ID NO: 2217801 - RNA, 16 nt, Human
aauaaaguguuugaaa

SEQ ID NO: 2217802 - RNA, 15 nt, Human
caggaggaaggcuua

SEQ ID NO: 2217803 - RNA, 17 nt, Human
ugcacaucaaaauaugc

SEQ ID NO: 2217804 - RNA, 23 nt, Human
ggcuaagcuucacuguaaaauaa

SEQ ID NO: 2217805 - RNA, 16 nt, Human
agguugcagugagccg

SEQ ID NO: 2217806 - RNA, 17 nt, Human
cucagucucccucccuu

SEQ ID NO: 2217807 - RNA, 22 nt, Human
ggacaguaaaauccacagacca

SEQ ID NO: 2217808 - RNA, 23 nt, Human
ucggccuccauccugaggcucca

SEQ ID NO: 2217809 - RNA, 23 nt, Human
ccucuucugacacuaaaacaccu

SEQ ID NO: 2217810 - RNA, 14 nt, Human
cuaaacauaugaau

SEQ ID NO: 2217811 - RNA, 23 nt, Human
ugaauuauguuugcauguucacu

SEQ ID NO: 2217812 - RNA, 21 nt, Human
cacuugaacccgggaggcaga

SEQ ID NO: 2217813 - RNA, 15 nt, Human
ccaacuauaaaacua

SEQ ID NO: 2217814 - RNA, 18 nt, Human
cuuucacauuuaaauaaa

SEQ ID NO: 2217815 - RNA, 19 nt, Human
auuuacagagacagaaagc

SEQ ID NO: 2217816 - RNA, 16 nt, Human
cccaaccucucccaac

SEQ ID NO: 2217817 - RNA, 16 nt, Human
caauaacgauaaaaga

SEQ ID NO: 2217818 - RNA, 15 nt, Human
uuaauucugaaagca

SEQ ID NO: 2217819 - RNA, 21 nt, Human
uuuauauaagcuuguauuccu

SEQ ID NO: 2217820 - RNA, 14 nt, Human
aaucucaauauuuc

SEQ ID NO: 2217821 - RNA, 20 nt, Human
cugacacuaaaacaccucag

SEQ ID NO: 2217822 - RNA, 18 nt, Human
gagccucagucucccucc

SEQ ID NO: 2217823 - RNA, 21 nt, Human
aaagaaaauaacgauaaaaga

SEQ ID NO: 2217824 - RNA, 19 nt, Human
cuaguaucaaaagaaagaa

SEQ ID NO: 2217825 - RNA, 14 nt, Human
agcaaguauuagaa

SEQ ID NO: 2217826 - RNA, 14 nt, Human
uccagauccuggaa

SEQ ID NO: 2217827 - RNA, 14 nt, Human
aaauauaaauaaaa

SEQ ID NO: 2217828 - RNA, 18 nt, Human
cagaucaagccugccuca

SEQ ID NO: 2217829 - RNA, 14 nt, Human
auaaauaaaaauaa

SEQ ID NO: 2217830 - RNA, 18 nt, Human
ccaaccuggaguugaaaa

SEQ ID NO: 2217831 - RNA, 11 nt, Human
ggguugggggg

SEQ ID NO: 2217832 - RNA, 16 nt, Human
uucaauaaaacuuuuc

SEQ ID NO: 2217833 - RNA, 23 nt, Human
uagauaggucagugcaaauacuc

SEQ ID NO: 2217834 - RNA, 19 nt, Human
auccugugggaccugggcc

SEQ ID NO: 2217835 - RNA, 14 nt, Human
ggcuccagcuggcc

SEQ ID NO: 2217836 - RNA, 20 nt, Human
acaagacccaaaaggcagaa

SEQ ID NO: 2217837 - RNA, 15 nt, Human
gaagauguagaggag

SEQ ID NO: 2217838 - RNA, 23 nt, Human
acucuauguucuaagaagugaaa

SEQ ID NO: 2217839 - RNA, 19 nt, Human
uauuuuaauaauguuucaa

SEQ ID NO: 2217840 - RNA, 14 nt, Human
auuuucuauaauuu

SEQ ID NO: 2217841 - RNA, 20 nt, Human
ccugagcggaccuucccagc

SEQ ID NO: 2217842 - RNA, 16 nt, Human
gaaggcuuacacccac

SEQ ID NO: 2217843 - RNA, 20 nt, Human
accuucccagcuagaauuca

SEQ ID NO: 2217844 - RNA, 15 nt, Human
guuucuuccuuuuuu

SEQ ID NO: 2217845 - RNA, 15 nt, Human
caggcagcuuuuucu

SEQ ID NO: 2217846 - RNA, 13 nt, Human
cacaacuauauug

SEQ ID NO: 2217847 - RNA, 17 nt, Human
auguuuacagaucccca

SEQ ID NO: 2217848 - RNA, 14 nt, Human
cguguccccuaucc

SEQ ID NO: 2217849 - RNA, 15 nt, Human
ugaaacccugucucu

SEQ ID NO: 2217850 - RNA, 22 nt, Human
cuuccuaauuccacagcugcuc

SEQ ID NO: 2217851 - RNA, 15 nt, Human
accucccccaucucu

SEQ ID NO: 2217852 - RNA, 14 nt, Human
ucagucucccuccc

SEQ ID NO: 2217853 - RNA, 18 nt, Human
auggugaaaugcagaguc

SEQ ID NO: 2217854 - RNA, 16 nt, Human
cucucccaacuauaaa

SEQ ID NO: 2217855 - RNA, 16 nt, Human
ugaaguacucauacau

SEQ ID NO: 2217856 - RNA, 17 nt, Human
ccccaguuguuucuacu

SEQ ID NO: 2217857 - RNA, 14 nt, Human
agacaucaacagau

SEQ ID NO: 2217858 - RNA, 23 nt, Human
caccaaggagccaaacauccuac

SEQ ID NO: 2217859 - RNA, 18 nt, Human
ugaaaaaguucugcagau

SEQ ID NO: 2217860 - RNA, 15 nt, Human
ugccccgucccccuc

SEQ ID NO: 2217861 - RNA, 15 nt, Human
uaacgauaaaagaca

SEQ ID NO: 2217862 - RNA, 15 nt, Human
aggauggcaggaggc

SEQ ID NO: 2217863 - RNA, 13 nt, Human
caugggccccaga

SEQ ID NO: 2217864 - RNA, 13 nt, Human
ucagccagcccuc

SEQ ID NO: 2217865 - RNA, 22 nt, Human
caccucccccaucucuucuggg

SEQ ID NO: 2217866 - RNA, 18 nt, Human
uaauaauguuucaaacau

SEQ ID NO: 2217867 - RNA, 20 nt, Human
uuuccaaugacauuuuguug

SEQ ID NO: 2217868 - RNA, 15 nt, Human
cagccccugggacca

SEQ ID NO: 2217869 - RNA, 16 nt, Human
ccuccuuaucaaagga

SEQ ID NO: 2217870 - RNA, 14 nt, Human
caaaugcauuucua

SEQ ID NO: 2217871 - RNA, 16 nt, Human
gacauagaauuaacac

SEQ ID NO: 2217872 - RNA, 22 nt, Human
gaggcggauugagaaggagcuc

SEQ ID NO: 2217873 - RNA, 16 nt, Human
gacaagcucacagacc

SEQ ID NO: 2217874 - RNA, 22 nt, Human
acaugagguacugagagugaac

SEQ ID NO: 2217875 - RNA, 21 nt, Human
ugcagaguacuggcugaugga

SEQ ID NO: 2217876 - RNA, 19 nt, Human
cauccaaaggcuccugaga

SEQ ID NO: 2217877 - RNA, 23 nt, Human
cccagcccuccuuaucaaaggac

SEQ ID NO: 2217878 - RNA, 19 nt, Human
uccauccugaggcuccacu

SEQ ID NO: 2217879 - RNA, 21 nt, Human
auccccaagccuggcaaggga

SEQ ID NO: 2217880 - RNA, 17 nt, Human
uccagcuggccgggagc

SEQ ID NO: 2217881 - RNA, 14 nt, Human
agucugacuguuuc

SEQ ID NO: 2217882 - RNA, 22 nt, Human
ccucccuuggggccuaugcaga

SEQ ID NO: 2217883 - RNA, 16 nt, Human
ccccaucucuucuggg

SEQ ID NO: 2217884 - RNA, 15 nt, Human
ggugcugcagccccu

SEQ ID NO: 2217885 - RNA, 18 nt, Human
auagggagggaaggggga

SEQ ID NO: 2217886 - RNA, 20 nt, Human
uacaucccuuaccugggaaa

SEQ ID NO: 2217887 - RNA, 19 nt, Human
auuguaguccuguaaugga

SEQ ID NO: 2217888 - RNA, 16 nt, Human
uuuauauuugaaauau

SEQ ID NO: 2217889 - RNA, 16 nt, Human
cuuuaugcuaagugaa

SEQ ID NO: 2217890 - RNA, 11 nt, Human
ccgugugccug

SEQ ID NO: 2217891 - RNA, 17 nt, Human
augauuaaguaaugaua

SEQ ID NO: 2217892 - RNA, 14 nt, Human
uuauuauauuuaca

SEQ ID NO: 2217893 - RNA, 16 nt, Human
cagauccccaagccug

SEQ ID NO: 2217894 - RNA, 21 nt, Human
aacuuguaaaggaauuuaaaa

SEQ ID NO: 2217895 - RNA, 13 nt, Human
ugggaggcugaga

SEQ ID NO: 2217896 - RNA, 15 nt, Human
augguuguauuauuu

SEQ ID NO: 2217897 - RNA, 19 nt, Human
uuccucccuucucuucaca

SEQ ID NO: 2217898 - RNA, 12 nt, Human
uguuugaaagcu

SEQ ID NO: 2217899 - RNA, 22 nt, Human
aaaucaggguuaguauugucca

SEQ ID NO: 2217900 - RNA, 21 nt, Human
cuccagcuggccgggagccug

SEQ ID NO: 2217901 - RNA, 13 nt, Human
gaaccuaggguga

SEQ ID NO: 2217902 - RNA, 15 nt, Human
gccccauucaacauc

SEQ ID NO: 2217903 - RNA, 14 nt, Human
uuuguauaaaauaa

SEQ ID NO: 2217904 - RNA, 15 nt, Human
agugacaagcucaca

SEQ ID NO: 2217905 - RNA, 21 nt, Human
uaaaagacagugaaagaaaau

SEQ ID NO: 2217906 - RNA, 15 nt, Human
gcuguauuuuaaaag

SEQ ID NO: 2217907 - RNA, 17 nt, Human
cagacaucaacagauaa

SEQ ID NO: 2217908 - RNA, 16 nt, Human
cuccacauccuguggg

SEQ ID NO: 2217909 - RNA, 16 nt, Human
cagaagcaacccaaau

SEQ ID NO: 2217910 - RNA, 15 nt, Human
uggacgagaaaacaa

SEQ ID NO: 2217911 - RNA, 18 nt, Human
acauuuauauuuuuguga

SEQ ID NO: 2217912 - RNA, 19 nt, Human
cagauccccaagccuggca

SEQ ID NO: 2217913 - RNA, 19 nt, Human
cagcuuuuucucucccacu

SEQ ID NO: 2217914 - RNA, 18 nt, Human
ccaagccuggcaagggaa

SEQ ID NO: 2217915 - RNA, 15 nt, Human
aaggaaaaaauaaca

SEQ ID NO: 2217916 - RNA, 21 nt, Human
ccccugcaaagcccagcuuga

SEQ ID NO: 2217917 - RNA, 14 nt, Human
uucuaugaaauauu

SEQ ID NO: 2217918 - RNA, 22 nt, Human
ugggccccagauaccaugaugc

SEQ ID NO: 2217919 - RNA, 16 nt, Human
ggcagcuuuuucucuc

SEQ ID NO: 2217920 - RNA, 17 nt, Human
acuuccagauccuggaa

SEQ ID NO: 2217921 - RNA, 23 nt, Human
ggaugguucccuugaugaagaag

SEQ ID NO: 2217922 - RNA, 21 nt, Human
gcucccaggaggggcuucugg

SEQ ID NO: 2217923 - RNA, 12 nt, Human
caggacagcccu

SEQ ID NO: 2217924 - RNA, 13 nt, Human
acaagaaaugaaa

SEQ ID NO: 2217925 - RNA, 20 nt, Human
uguaaaggaauuuaaaaauc

SEQ ID NO: 2217926 - RNA, 12 nt, Human
cuggcuccagcu

SEQ ID NO: 2217927 - RNA, 22 nt, Human
gagcuaggggggucagccagcc

SEQ ID NO: 2217928 - RNA, 22 nt, Human
gaauuucuucaacucccugccc

SEQ ID NO: 2217929 - RNA, 16 nt, Human
ccucaaaacuucagac

SEQ ID NO: 2217930 - RNA, 11 nt, Human
acugggacagg

SEQ ID NO: 2217931 - RNA, 19 nt, Human
auagugaggagcuuugaaa

SEQ ID NO: 2217932 - RNA, 18 nt, Human
aaaaguucugcagauaaa

SEQ ID NO: 2217933 - RNA, 14 nt, Human
auugucuagugaaa

SEQ ID NO: 2217934 - RNA, 22 nt, Human
ggcagcuuuccucaaaacuuca

SEQ ID NO: 2217935 - RNA, 17 nt, Human
uaacugauuuguaacaa

SEQ ID NO: 2217936 - RNA, 17 nt, Human
cugaucaccugcccugc

SEQ ID NO: 2217937 - RNA, 21 nt, Human
cuucucacauuuauauuuuug

SEQ ID NO: 2217938 - RNA, 16 nt, Human
aauuuuuaauuauaug

SEQ ID NO: 2217939 - RNA, 12 nt, Human
ccaggcugagcc

SEQ ID NO: 2217940 - RNA, 14 nt, Human
caguucugaagaag

SEQ ID NO: 2217941 - RNA, 22 nt, Human
agaaagugacaagcucacagac

SEQ ID NO: 2217942 - RNA, 17 nt, Human
aggguguguaaguagau

SEQ ID NO: 2217943 - RNA, 16 nt, Human
cauuucuaaagccauu

SEQ ID NO: 2217944 - RNA, 17 nt, Human
gaacuuuccacauucag

SEQ ID NO: 2217945 - RNA, 19 nt, Human
ugcccugaaagucccagau

SEQ ID NO: 2217946 - RNA, 14 nt, Human
ccuugaugaagaag

SEQ ID NO: 2217947 - RNA, 16 nt, Human
gcuucacuguaaaaua

SEQ ID NO: 2217948 - RNA, 17 nt, Human
acucuggucaagaagca

SEQ ID NO: 2217949 - RNA, 14 nt, Human
agcucuaucaccaa

SEQ ID NO: 2217950 - RNA, 23 nt, Human
cucuacuaaaaauacaaaaaaaa

SEQ ID NO: 2217951 - RNA, 22 nt, Human
cuucagccugaaagaggaauga

SEQ ID NO: 2217952 - RNA, 21 nt, Human
gccuuuucccaacuccagaaa

SEQ ID NO: 2217953 - RNA, 19 nt, Human
cucuguucugcacacagca

SEQ ID NO: 2217954 - RNA, 12 nt, Human
ccccuugccaua

SEQ ID NO: 2217955 - RNA, 17 nt, Human
cucuggucaagaagcau

SEQ ID NO: 2217956 - RNA, 19 nt, Human
ccuucccagcuagaauuca

SEQ ID NO: 2217957 - RNA, 14 nt, Human
auauuuauuuuaau

SEQ ID NO: 2217958 - RNA, 22 nt, Human
uguucugauauuggacaguaaa

SEQ ID NO: 2217959 - RNA, 16 nt, Human
agagguccacaacaca

SEQ ID NO: 2217960 - RNA, 15 nt, Human
cuaagugcagccccg

SEQ ID NO: 2217961 - RNA, 21 nt, Human
aaaugucuugcuugauuguau

SEQ ID NO: 2217962 - RNA, 14 nt, Human
cuaucaauccaaga

SEQ ID NO: 2217963 - RNA, 15 nt, Human
ccagauccuggaaau

SEQ ID NO: 2217964 - RNA, 21 nt, Human
ugagcuaggggggucagccag

SEQ ID NO: 2217965 - RNA, 18 nt, Human
acaaaugcauuucuaaag

SEQ ID NO: 2217966 - RNA, 19 nt, Human
aauaaaacuuuuccaauga

SEQ ID NO: 2217967 - RNA, 14 nt, Human
auggcaggaggcau

SEQ ID NO: 2217968 - RNA, 20 nt, Human
ugagagugaacaaauuuaca

SEQ ID NO: 2217969 - RNA, 18 nt, Human
gcccuggugggcagagag

SEQ ID NO: 2217970 - RNA, 21 nt, Human
caccagucugacuguuuccau

SEQ ID NO: 2217971 - RNA, 14 nt, Human
gagguaccagccuu

SEQ ID NO: 2217972 - RNA, 17 nt, Human
uugccaaauauaaauaa

SEQ ID NO: 2217973 - RNA, 18 nt, Human
auaaaguguuugaaagcu

SEQ ID NO: 2217974 - RNA, 23 nt, Human
uccaaacugacucuuaagaagac

SEQ ID NO: 2217975 - RNA, 19 nt, Human
cauggaauuggagcucgug

SEQ ID NO: 2217976 - RNA, 12 nt, Human
cagauuuuccug

SEQ ID NO: 2217977 - RNA, 18 nt, Human
auucuugccaaauauaaa

SEQ ID NO: 2217978 - RNA, 11 nt, Human
caauaaaagac

SEQ ID NO: 2217979 - RNA, 20 nt, Human
agcuacuaauuuuaaaaugu

SEQ ID NO: 2217980 - RNA, 17 nt, Human
uggugaaaugcagaguc

SEQ ID NO: 2217981 - RNA, 12 nt, Human
agaaaacaauaa

SEQ ID NO: 2217982 - RNA, 18 nt, Human
acaagccuccuuuuaaag

SEQ ID NO: 2217983 - RNA, 12 nt, Human
auccugugggac

SEQ ID NO: 2217984 - RNA, 18 nt, Human
auuuauuacuguaagaaa

SEQ ID NO: 2217985 - RNA, 16 nt, Human
auuuuuagugaaauau

SEQ ID NO: 2217986 - RNA, 18 nt, Human
uggagggaagccuugggg

SEQ ID NO: 2217987 - RNA, 16 nt, Human
cugagcauuuaauaug

SEQ ID NO: 2217988 - RNA, 23 nt, Human
gaaugagagacacacugaagaag

SEQ ID NO: 2217989 - RNA, 15 nt, Human
uacaggauuugaaau

SEQ ID NO: 2217990 - RNA, 15 nt, Human
aagccagauuuuccu

SEQ ID NO: 2217991 - RNA, 15 nt, Human
gccuaagugcagccc

SEQ ID NO: 2217992 - RNA, 22 nt, Human
guguccccuauccuacuucccc

SEQ ID NO: 2217993 - RNA, 18 nt, Human
uucaauaucuuuuuuuua

SEQ ID NO: 2217994 - RNA, 19 nt, Human
uagugagcagucaggaaag

SEQ ID NO: 2217995 - RNA, 23 nt, Human
gcuuuggucuaucuuugagcgcc

SEQ ID NO: 2217996 - RNA, 13 nt, Human
ccaaggaugcccc

SEQ ID NO: 2217997 - RNA, 23 nt, Human
aacuuguaaaggaauuuaaaaau

SEQ ID NO: 2217998 - RNA, 14 nt, Human
ccucagcugccucc

SEQ ID NO: 2217999 - RNA, 18 nt, Human
auagucaaauugugugaa

SEQ ID NO: 2218000 - RNA, 20 nt, Human
augguuuagaaagcuugccc

SEQ ID NO: 2218001 - RNA, 20 nt, Human
aaucuuucacaggggacagg

SEQ ID NO: 2218002 - RNA, 17 nt, Human
cacuuggacaugggccc

SEQ ID NO: 2218003 - RNA, 15 nt, Human
cuguaaaauaauaac

SEQ ID NO: 2218004 - RNA, 13 nt, Human
uuuaaaaaaaaac

SEQ ID NO: 2218005 - RNA, 21 nt, Human
ccauccugccccugagcccau

SEQ ID NO: 2218006 - RNA, 19 nt, Human
ucaauucuugccaaauaua

SEQ ID NO: 2218007 - RNA, 14 nt, Human
ugagcuaggggggu

SEQ ID NO: 2218008 - RNA, 18 nt, Human
uauagcuacuaauuuuaa

SEQ ID NO: 2218009 - RNA, 17 nt, Human
uccauccugaggcucca

SEQ ID NO: 2218010 - RNA, 14 nt, Human
agcucguggaacag

SEQ ID NO: 2218011 - RNA, 20 nt, Human
uaaaacaagcacuaaacaaa

SEQ ID NO: 2218012 - RNA, 16 nt, Human
uauugggguugggggg

SEQ ID NO: 2218013 - RNA, 21 nt, Human
augcuacaggauuugaaauug

SEQ ID NO: 2218014 - RNA, 22 nt, Human
uucccagcuagaauucacucca

SEQ ID NO: 2218015 - RNA, 15 nt, Human
uauuuauuuuaauaa

SEQ ID NO: 2218016 - RNA, 16 nt, Human
cucauccugcaggcag

SEQ ID NO: 2218017 - RNA, 16 nt, Human
ucuucaacucccugcc

SEQ ID NO: 2218018 - RNA, 21 nt, Human
gaaaaaaagcuuuuuuugaau

SEQ ID NO: 2218019 - RNA, 15 nt, Human
ucagucucccucccu

SEQ ID NO: 2218020 - RNA, 21 nt, Human
uuuauagccagguaccuucuc

SEQ ID NO: 2218021 - RNA, 16 nt, Human
accaggcuugccugca

SEQ ID NO: 2218022 - RNA, 13 nt, Human
aggaaaaaauaac

SEQ ID NO: 2218023 - RNA, 15 nt, Human
accaaggcugauuaa

SEQ ID NO: 2218024 - RNA, 17 nt, Human
guauuauuuuuuaaaaa

SEQ ID NO: 2218025 - RNA, 22 nt, Human
ugagacucugucucaguccaug

SEQ ID NO: 2218026 - RNA, 21 nt, Human
cuauguucuaagaagugaaaa

SEQ ID NO: 2218027 - RNA, 17 nt, Human
cacuagacaaguccagc

SEQ ID NO: 2218028 - RNA, 17 nt, Human
gcuucucauccugcagg

SEQ ID NO: 2218029 - RNA, 22 nt, Human
gaaugaccuggccgcagugagg

SEQ ID NO: 2218030 - RNA, 16 nt, Human
uacaaaugggaaacaa

SEQ ID NO: 2218031 - RNA, 17 nt, Human
ccuacuuccccuuccua

SEQ ID NO: 2218032 - RNA, 18 nt, Human
ucucuaggaaauauuuau

SEQ ID NO: 2218033 - RNA, 12 nt, Human
gguuuauauaag

SEQ ID NO: 2218034 - RNA, 19 nt, Human
aaauaugccccauucaaca

SEQ ID NO: 2218035 - RNA, 15 nt, Human
uaauauugcaaggca

SEQ ID NO: 2218036 - RNA, 23 nt, Human
cucagucucccucccuuggggcc

SEQ ID NO: 2218037 - RNA, 15 nt, Human
cccaaccucucccaa

SEQ ID NO: 2218038 - RNA, 20 nt, Human
uauuuauuacuguaagaaaa

SEQ ID NO: 2218039 - RNA, 18 nt, Human
acauguuacaacacggac

SEQ ID NO: 2218040 - RNA, 22 nt, Human
caugaguaacugauuuguaaca

SEQ ID NO: 2218041 - RNA, 13 nt, Human
aggcuagauguau

SEQ ID NO: 2218042 - RNA, 22 nt, Human
augguuguauuauuuuuuaaaa

SEQ ID NO: 2218043 - RNA, 20 nt, Human
aguuuuuuuuuaaaaaagaa

SEQ ID NO: 2218044 - RNA, 22 nt, Human
ugguuguauuauuuuuuaaaaa

SEQ ID NO: 2218045 - RNA, 19 nt, Human
cagcuacuugggaggcuga

SEQ ID NO: 2218046 - RNA, 17 nt, Human
caagacccaaaaggcag

SEQ ID NO: 2218047 - RNA, 15 nt, Human
ccgucccccucuggc

SEQ ID NO: 2218048 - RNA, 22 nt, Human
uauuccuuuuucucuccucucc

SEQ ID NO: 2218049 - RNA, 21 nt, Human
cucuucuggguuccuuccucu

SEQ ID NO: 2218050 - RNA, 17 nt, Human
ccauagucauucugccu

SEQ ID NO: 2218051 - RNA, 14 nt, Human
ccacuggacucacc

SEQ ID NO: 2218052 - RNA, 22 nt, Human
aguauguuagugcaaauuguca

SEQ ID NO: 2218053 - RNA, 14 nt, Human
auuuaaauauaugc

SEQ ID NO: 2218054 - RNA, 19 nt, Human
uauauuuuuuguuaaauga

SEQ ID NO: 2218055 - RNA, 20 nt, Human
ucacaugaacuuguaaagga

SEQ ID NO: 2218056 - RNA, 14 nt, Human
cucaccccuugcca

SEQ ID NO: 2218057 - RNA, 15 nt, Human
guucugcagauaaac

SEQ ID NO: 2218058 - RNA, 18 nt, Human
ugagcucagcccuggugg

SEQ ID NO: 2218059 - RNA, 19 nt, Human
ggaaaaaauaacaaugaaa

SEQ ID NO: 2218060 - RNA, 16 nt, Human
aaaaauuccaagugau

SEQ ID NO: 2218061 - RNA, 11 nt, Human
gcaugguuuag

SEQ ID NO: 2218062 - RNA, 18 nt, Human
cccaagccuggcaaggga

SEQ ID NO: 2218063 - RNA, 14 nt, Human
ccaugggacaggga

SEQ ID NO: 2218064 - RNA, 18 nt, Human
cucuauguucuaagaagu

SEQ ID NO: 2218065 - RNA, 22 nt, Human
cccagaaugaccuggccgcagu

SEQ ID NO: 2218066 - RNA, 24 nt, Human
aacuauaaaacuaggugcugcagc

SEQ ID NO: 2218067 - RNA, 17 nt, Human
aaagcagggacuugaac

SEQ ID NO: 2218068 - RNA, 16 nt, Human
auccaaugaaaugagu

SEQ ID NO: 2218069 - RNA, 21 nt, Human
aggcauccaaaggcuccugag

SEQ ID NO: 2218070 - RNA, 15 nt, Human
auuucauucaauauc

SEQ ID NO: 2218071 - RNA, 14 nt, Human
auauuugaaauauu

SEQ ID NO: 2218072 - RNA, 18 nt, Human
agguccacaacacacaga

SEQ ID NO: 2218073 - RNA, 14 nt, Human
agcccucuucugac

SEQ ID NO: 2218074 - RNA, 23 nt, Human
gaggcauuuaggccaugggacag

SEQ ID NO: 2218075 - RNA, 16 nt, Human
ucuucugacacuaaaa

SEQ ID NO: 2218076 - RNA, 18 nt, Human
auccuucagccugaaaga

SEQ ID NO: 2218077 - RNA, 14 nt, Human
ucaaugcagccccc

SEQ ID NO: 2218078 - RNA, 19 nt, Human
aagcauuccaacuaucuca

SEQ ID NO: 2218079 - RNA, 20 nt, Human
agccuuuuuuugaaaaaaag

SEQ ID NO: 2218080 - RNA, 20 nt, Human
aaaaaccugagccccaaaag

SEQ ID NO: 2218081 - RNA, 14 nt, Human
ugagacucugucuc

SEQ ID NO: 2218082 - RNA, 17 nt, Human
ucaauccaagaacuuau

SEQ ID NO: 2218083 - RNA, 20 nt, Human
ccuccugccuaagugcagcc

SEQ ID NO: 2218084 - RNA, 22 nt, Human
auggaaauguuuacagaucccc

SEQ ID NO: 2218085 - RNA, 17 nt, Human
acuaggugcugcagccc

SEQ ID NO: 2218086 - RNA, 17 nt, Human
agaugggagaaucacuu

SEQ ID NO: 2218087 - RNA, 13 nt, Human
aacacaacuauau

SEQ ID NO: 2218088 - RNA, 23 nt, Human
ugaaaugaguuuuucuuuucauu

SEQ ID NO: 2218089 - RNA, 15 nt, Human
aguucuucaaagaua

SEQ ID NO: 2218090 - RNA, 20 nt, Human
aaaagacagugaaagaaaau

SEQ ID NO: 2218091 - RNA, 22 nt, Human
uugagaaggagcucccaggagg

SEQ ID NO: 2218092 - RNA, 23 nt, Human
cccacuggacucaccucccccau

SEQ ID NO: 2218093 - RNA, 14 nt, Human
cagucucccucccu

SEQ ID NO: 2218094 - RNA, 20 nt, Human
gaaacgaggauugggaaaaa

SEQ ID NO: 2218095 - RNA, 23 nt, Human
cucagcccuggugggcagagagg

SEQ ID NO: 2218096 - RNA, 18 nt, Human
uaguaucaaaagaaagaa

SEQ ID NO: 2218097 - RNA, 13 nt, Human
caauccaagaacu

SEQ ID NO: 2218098 - RNA, 18 nt, Human
ccacauucagagcuuacu

SEQ ID NO: 2218099 - RNA, 18 nt, Human
auuuuaacucuauaaugu

SEQ ID NO: 2218100 - RNA, 19 nt, Human
accauuuuggcaagcucua

SEQ ID NO: 2218101 - RNA, 22 nt, Human
agccaaacauccuacaagacac

SEQ ID NO: 2218102 - RNA, 16 nt, Human
cccuauccuacuuccc

SEQ ID NO: 2218103 - RNA, 18 nt, Human
cccacuagacccacugga

SEQ ID NO: 2218104 - RNA, 16 nt, Human
aaauaguuuaugauuc

SEQ ID NO: 2218105 - RNA, 22 nt, Human
gagucccaggcugagccucagu

SEQ ID NO: 2218106 - RNA, 15 nt, Human
gugaacuugguuuua

SEQ ID NO: 2218107 - RNA, 20 nt, Human
aaagacagugaaagaaaaua

SEQ ID NO: 2218108 - RNA, 17 nt, Human
auaauuuaaauauaugc

SEQ ID NO: 2218109 - RNA, 15 nt, Human
cuucaacucccugcc

SEQ ID NO: 2218110 - RNA, 22 nt, Human
aauugacccacaagaaaugaaa

SEQ ID NO: 2218111 - RNA, 15 nt, Human
acugaagaagcacca

SEQ ID NO: 2218112 - RNA, 13 nt, Human
cucaccuccccca

SEQ ID NO: 2218113 - RNA, 21 nt, Human
agcccuucuuuccacagaagc

SEQ ID NO: 2218114 - RNA, 14 nt, Human
caacuauaaaacua

SEQ ID NO: 2218115 - RNA, 14 nt, Human
cagccccugggacc

SEQ ID NO: 2218116 - RNA, 21 nt, Human
caccucagcugccuccccagc

SEQ ID NO: 2218117 - RNA, 21 nt, Human
aauucauucacucaacaaaca

SEQ ID NO: 2218118 - RNA, 21 nt, Human
gggagccugaucaccugcccu

SEQ ID NO: 2218119 - RNA, 20 nt, Human
gauaccaugaugcugagccc

SEQ ID NO: 2218120 - RNA, 23 nt, Human
ugauggguuucuccagagggaau

SEQ ID NO: 2218121 - RNA, 18 nt, Human
aaaagacaaggaaaaaau

SEQ ID NO: 2218122 - RNA, 22 nt, Human
gcagagagguagggauggggcu

SEQ ID NO: 2218123 - RNA, 20 nt, Human
gaacguaaucguguccccua

SEQ ID NO: 2218124 - RNA, 17 nt, Human
gacagugaaagaaaaua

SEQ ID NO: 2218125 - RNA, 16 nt, Human
uccugcaauuccacuu

SEQ ID NO: 2218126 - RNA, 19 nt, Human
uacaaaaaaaaaaaaaaau

SEQ ID NO: 2218127 - RNA, 14 nt, Human
acgagaaaacaaua

SEQ ID NO: 2218128 - RNA, 17 nt, Human
caauaacgauaaaagac

SEQ ID NO: 2218129 - RNA, 16 nt, Human
cccccagcccuccuua

SEQ ID NO: 2218130 - RNA, 21 nt, Human
ugaccauacuaauuauacccc

SEQ ID NO: 2218131 - RNA, 16 nt, Human
cauagaaguaaaaaca

SEQ ID NO: 2218132 - RNA, 20 nt, Human
uaaaagacagugaaagaaaa

SEQ ID NO: 2218133 - RNA, 23 nt, Human
agcucugcccauccugccccuga

SEQ ID NO: 2218134 - RNA, 19 nt, Human
ucaguuauuauauuuacaa

SEQ ID NO: 2218135 - RNA, 20 nt, Human
ggguuccuuccucugagccu

SEQ ID NO: 2218136 - RNA, 21 nt, Human
ugagcucagcccuggugggca

SEQ ID NO: 2218137 - RNA, 15 nt, Human
ucaguuuuugugaaa

SEQ ID NO: 2218138 - RNA, 15 nt, Human
gucccaggcugagcc

SEQ ID NO: 2218139 - RNA, 21 nt, Human
ugcccauccugccccugagcc

SEQ ID NO: 2218140 - RNA, 21 nt, Human
cagccccugggaccaggcacc

SEQ ID NO: 2218141 - RNA, 12 nt, Streptococcus pyogenes MGAS315
uuugguugauag

SEQ ID NO: 2218142 - RNA, 13 nt, Streptococcus pyogenes MGAS315
uuaggaaucacaa

SEQ ID NO: 2218143 - RNA, 19 nt, Streptococcus pyogenes MGAS315
uuacaucaaaaaaagcaau

SEQ ID NO: 2218144 - RNA, 22 nt, Streptococcus pyogenes MGAS315
ugagguaaucguaaugucuugu

SEQ ID NO: 2218145 - RNA, 16 nt, Streptococcus pyogenes MGAS315
ucaaaaauacuaccuu

SEQ ID NO: 2218146 - RNA, 18 nt, Streptococcus pyogenes MGAS315
uauuuuucauuugaaauu

SEQ ID NO: 2218147 - RNA, 19 nt, Streptococcus pyogenes MGAS315
ucaaugacuugaccaaaua

SEQ ID NO: 2218148 - RNA, 22 nt, Streptococcus pyogenes MGAS315
ucagcccccucuuuaccauuua

SEQ ID NO: 2218149 - RNA, 22 nt, Streptococcus pyogenes MGAS315
guguuuuuuaguguauuacuuc

SEQ ID NO: 2218150 - RNA, 17 nt, Streptococcus pyogenes MGAS315
uacuagaaaaagcaaug

SEQ ID NO: 2218151 - RNA, 21 nt, Streptococcus pyogenes MGAS315
uaaaauagcaccuacgauaaa

SEQ ID NO: 2218152 - RNA, 16 nt, Streptococcus pyogenes MGAS315
uaaacuacaccauuua

SEQ ID NO: 2218153 - RNA, 17 nt, Streptococcus pyogenes MGAS315
ggauuuuuuuaacuauu

SEQ ID NO: 2218154 - RNA, 23 nt, Streptococcus pyogenes MGAS315
aauauugggacuguucagucuuc

SEQ ID NO: 2218155 - RNA, 15 nt, Streptococcus pyogenes MGAS315
uggaaaguaaggguu

SEQ ID NO: 2218156 - RNA, 18 nt, Streptococcus pyogenes MGAS315
uuagcaauccaacuuuga

SEQ ID NO: 2218157 - RNA, 13 nt, Streptococcus pyogenes MGAS315
uuuggaucuucaa

SEQ ID NO: 2218158 - RNA, 23 nt, Streptococcus pyogenes MGAS315
uugucaaaaaguaaaaagcaaau

SEQ ID NO: 2218159 - RNA, 15 nt, Streptococcus pyogenes MGAS315
acaauuggugauuaa

SEQ ID NO: 2218160 - RNA, 16 nt, Streptococcus pyogenes MGAS315
ucugcauuaucaucug

SEQ ID NO: 2218161 - RNA, 21 nt, Streptococcus pyogenes MGAS315
uacucaauuaauguuaggagc

SEQ ID NO: 2218162 - RNA, 19 nt, Streptococcus pyogenes MGAS315
uaccaucaaugacuugacc

SEQ ID NO: 2218163 - RNA, 17 nt, Streptococcus pyogenes MGAS315
gugugaccagauacuuc

SEQ ID NO: 2218164 - RNA, 22 nt, Streptococcus pyogenes MGAS315
aaguuagggucugagugacuaa

SEQ ID NO: 2218165 - RNA, 19 nt, Streptococcus pyogenes MGAS315
guucgucaagcaccuugau

SEQ ID NO: 2218166 - RNA, 17 nt, Streptococcus pyogenes MGAS315
aguugguacuugauaau

SEQ ID NO: 2218167 - RNA, 14 nt, Streptococcus pyogenes MGAS315
auaaccgccaucua

SEQ ID NO: 2218168 - RNA, 17 nt, Streptococcus pyogenes MGAS315
auaaccagcugauaggu

SEQ ID NO: 2218169 - RNA, 19 nt, Streptococcus pyogenes MGAS315
auaggcagagaugauaggu

SEQ ID NO: 2218170 - RNA, 16 nt, Streptococcus pyogenes MGAS315
caagaacuccuggauu

SEQ ID NO: 2218171 - RNA, 24 nt, Streptococcus pyogenes MGAS315
auuuagccuauuaucugauaaggu

SEQ ID NO: 2218172 - RNA, 23 nt, Streptococcus pyogenes MGAS315
auuuuaaucuuuuugugauaugu

SEQ ID NO: 2218173 - RNA, 22 nt, Streptococcus pyogenes MGAS315
aucguaaacaaucuuaaugguu

SEQ ID NO: 2218174 - RNA, 16 nt, Streptococcus pyogenes MGAS315
auguaguuguaagguu

SEQ ID NO: 2218175 - RNA, 23 nt, Streptococcus pyogenes MGAS315
auuacugaaauauaugaugaggu

SEQ ID NO: 2218176 - RNA, 20 nt, Streptococcus pyogenes MGAS315
cugcuuaucucuugagaucu

SEQ ID NO: 2218177 - RNA, 15 nt, Streptococcus pyogenes MGAS315
cuuugccaauaucaa

SEQ ID NO: 2218178 - RNA, 20 nt, Streptococcus pyogenes MGAS315
cuuugaguuuggugucaauc

SEQ ID NO: 2218179 - RNA, 11 nt, Streptococcus pyogenes MGAS315
cuuaucaucau

SEQ ID NO: 2218180 - RNA, 17 nt, Streptococcus pyogenes MGAS315
cuucugcauuaucaucu

SEQ ID NO: 2218181 - RNA, 13 nt, Streptococcus pyogenes MGAS315
cuucuggcaauaa

SEQ ID NO: 2218182 - RNA, 11 nt, Streptococcus pyogenes MGAS315
cuugcaauaga

SEQ ID NO: 2218183 - RNA, 17 nt, Streptococcus pyogenes MGAS315
cugcuaguugugccuuu

SEQ ID NO: 2218184 - RNA, 17 nt, Streptococcus pyogenes MGAS315
aagacuauguugcuuaa

SEQ ID NO: 2218185 - RNA, 16 nt, Streptococcus pyogenes MGAS315
gagagcuuaucaaggu

SEQ ID NO: 2218186 - RNA, 18 nt, Streptococcus pyogenes MGAS315
ggacuguuuuuuaguuga

SEQ ID NO: 2218187 - RNA, 20 nt, Streptococcus pyogenes MGAS315
aagguuaaguaaaagcgaua

SEQ ID NO: 2218188 - RNA, 16 nt, Streptococcus pyogenes MGAS315
aagguugcaagugaca

SEQ ID NO: 2218189 - RNA, 22 nt, Streptococcus pyogenes MGAS315
aagcugacgauaagucaguuuu

SEQ ID NO: 2218190 - RNA, 14 nt, Streptococcus pyogenes MGAS315
cacguuuuucaaug

SEQ ID NO: 2218191 - RNA, 17 nt, Streptococcus pyogenes MGAS315
caagagucauuugacua

SEQ ID NO: 2218192 - RNA, 14 nt, Streptococcus pyogenes MGAS315
auucuuauccauua

SEQ ID NO: 2218193 - RNA, 23 nt, Streptococcus pyogenes MGAS315
aguucauaguugugcuagucuuu

SEQ ID NO: 2218194 - RNA, 22 nt, Streptococcus pyogenes MGAS315
agcaaucaucauuuagcugaua

SEQ ID NO: 2218195 - RNA, 14 nt, Streptococcus pyogenes MGAS315
acaaacucugccaa

SEQ ID NO: 2218196 - RNA, 18 nt, Streptococcus pyogenes MGAS315
aagauacugcccuugaug

SEQ ID NO: 2218197 - RNA, 17 nt, Streptococcus pyogenes MGAS315
aaucuuaaguuaggguc

SEQ ID NO: 2218198 - RNA, 18 nt, Streptococcus pyogenes MGAS315
aaucuaucucguaauccu

SEQ ID NO: 2218199 - RNA, 20 nt, Streptococcus pyogenes MGAS315
aaucuaucucguaauccuug

SEQ ID NO: 2218200 - RNA, 16 nt, Streptococcus pyogenes MGAS315
aaucagacucgucuuu

SEQ ID NO: 2218201 - RNA, 14 nt, Streptococcus pyogenes MGAS315
aaagcaaauugaaa

SEQ ID NO: 2218202 - RNA, 19 nt, Streptococcus pyogenes MGAS315
aacaaucuuaaugguuacu

SEQ ID NO: 2218203 - RNA, 15 nt, Streptococcus pyogenes MGAS315
aaaucuucuagaauc

SEQ ID NO: 2218204 - RNA, 14 nt, Streptococcus pyogenes MGAS315
uucuuuuuggcuga

SEQ ID NO: 2218205 - RNA, 17 nt, Streptococcus pyogenes MGAS315
ugcuuuuuucuaaccuc

SEQ ID NO: 2218206 - RNA, 18 nt, Streptococcus pyogenes MGAS315
uggguaguugguacuuga

SEQ ID NO: 2218207 - RNA, 21 nt, Streptococcus pyogenes MGAS315
uguccauucuuuauaaugguu

SEQ ID NO: 2218208 - RNA, 16 nt, Streptococcus pyogenes MGAS315
uucuaaaacgaugaga

SEQ ID NO: 2218209 - RNA, 18 nt, Streptococcus pyogenes MGAS315
ucuugccaucagcaucug

SEQ ID NO: 2218210 - RNA, 17 nt, Streptococcus pyogenes MGAS315
ugagauuaacugacaaa

SEQ ID NO: 2218211 - RNA, 16 nt, Streptococcus pyogenes MGAS315
uccaucauugaugaga

SEQ ID NO: 2218212 - RNA, 14 nt, Streptococcus pyogenes MGAS315
uauugcucaagacu

SEQ ID NO: 2218213 - RNA, 19 nt, Streptococcus pyogenes MGAS315
uauguaucaagagucauuu

SEQ ID NO: 2218214 - RNA, 16 nt, Streptococcus pyogenes MGAS315
uaguugguacuugaua

SEQ ID NO: 2218215 - RNA, 23 nt, Streptococcus pyogenes MGAS315
guuuaucauuuugguugauagaa

SEQ ID NO: 2218216 - RNA, 17 nt, Streptococcus pyogenes MGAS315
uaagcaaucaucauuua

SEQ ID NO: 2218217 - RNA, 18 nt, Streptococcus pyogenes MGAS315
uaauguaacggccguuaa

SEQ ID NO: 2218218 - RNA, 16 nt, Streptococcus pyogenes MGAS315
uaaaaugacugacaaa

SEQ ID NO: 2218219 - RNA, 22 nt, Streptococcus pyogenes MGAS315
guauuguucaaccgucacuauu

SEQ ID NO: 2218220 - RNA, 18 nt, Streptococcus pyogenes MGAS315
guaaacaaucuuaauggu

SEQ ID NO: 2218221 - RNA, 21 nt, Streptococcus pyogenes MGAS315
ugacaguuaaaaauaacuuua

SEQ ID NO: 2218222 - RNA, 20 nt, Streptococcus pyogenes MGAS315
ugaugaguaggcgaacuuua

SEQ ID NO: 2218223 - RNA, 12 nt, Streptococcus pyogenes MGAS315
uaucauacucuu

SEQ ID NO: 2218224 - RNA, 20 nt, Streptococcus pyogenes MGAS315
ucagaagcuuuaucauacuc

SEQ ID NO: 2218225 - RNA, 14 nt, Streptococcus pyogenes MGAS315
ucagcaucugaaaa

SEQ ID NO: 2218226 - RNA, 20 nt, Streptococcus pyogenes MGAS315
ucaucauuuagcugauaauc

SEQ ID NO: 2218227 - RNA, 19 nt, Streptococcus pyogenes MGAS315
uacaucaaaaaaagcaaug

SEQ ID NO: 2218228 - RNA, 16 nt, Streptococcus pyogenes MGAS315
guucauauaagcaauc

SEQ ID NO: 2218229 - RNA, 21 nt, Streptococcus pyogenes MGAS315
gugccaguaaggaaaucaauc

SEQ ID NO: 2218230 - RNA, 21 nt, Streptococcus pyogenes MGAS315
uguccuaaccuuuuggcugua

SEQ ID NO: 2218231 - RNA, 19 nt, Streptococcus pyogenes MGAS315
uuuucaaugcgcucaagca

SEQ ID NO: 2218232 - RNA, 17 nt, Streptococcus pyogenes MGAS315
uuuagcuuauaauuuga

SEQ ID NO: 2218233 - RNA, 16 nt, Streptococcus pyogenes MGAS315
uuucgacagacaucgu

SEQ ID NO: 2218234 - RNA, 18 nt, Streptococcus pyogenes MGAS315
caaucaucauuuagcuga

SEQ ID NO: 2218235 - RNA, 22 nt, Streptococcus pyogenes MGAS315
caauauuuuauuaauaaguauu

SEQ ID NO: 2218236 - RNA, 15 nt, Streptococcus pyogenes MGAS315
caacaacccuugauu

SEQ ID NO: 2218237 - RNA, 16 nt, Streptococcus pyogenes MGAS315
caacacgcuaucaaca

SEQ ID NO: 2218238 - RNA, 21 nt, Streptococcus pyogenes MGAS315
auuauuaguaaccauagaagc

SEQ ID NO: 2218239 - RNA, 21 nt, Streptococcus pyogenes MGAS315
auucaccguggacuugauggu

SEQ ID NO: 2218240 - RNA, 16 nt, Streptococcus pyogenes MGAS315
augcuuuuuaaucugu

SEQ ID NO: 2218241 - RNA, 15 nt, Streptococcus pyogenes MGAS315
aucuuguuuaaccuc

SEQ ID NO: 2218242 - RNA, 17 nt, Streptococcus pyogenes MGAS315
augaccuuugauaagau

SEQ ID NO: 2218243 - RNA, 22 nt, Streptococcus pyogenes MGAS315
agcgccagcauuugccauggca

SEQ ID NO: 2218244 - RNA, 23 nt, Streptococcus pyogenes MGAS315
aguauaucauuaucaacaaucuu

SEQ ID NO: 2218245 - RNA, 18 nt, Streptococcus pyogenes MGAS315
cauuuagcugauaaucuu

SEQ ID NO: 2218246 - RNA, 19 nt, Streptococcus pyogenes MGAS315
cagagacaauaaggucauu

SEQ ID NO: 2218247 - RNA, 15 nt, Streptococcus pyogenes MGAS315
gcaaauagcaauggu

SEQ ID NO: 2218248 - RNA, 17 nt, Streptococcus pyogenes MGAS315
gcaauaacaucuugauu

SEQ ID NO: 2218249 - RNA, 16 nt, Streptococcus pyogenes MGAS315
gcaaggcuaaagccua

SEQ ID NO: 2218250 - RNA, 23 nt, Streptococcus pyogenes MGAS315
gacuagucuaggcguauagguga

SEQ ID NO: 2218251 - RNA, 17 nt, Streptococcus pyogenes MGAS315
cuuguuuugguugauau

SEQ ID NO: 2218252 - RNA, 22 nt, Streptococcus pyogenes MGAS315
cuuuuuaaagagccucaggaca

SEQ ID NO: 2218253 - RNA, 16 nt, Streptococcus pyogenes MGAS315
aaaaugccuccgacaa

SEQ ID NO: 2218254 - RNA, 14 nt, Streptococcus pyogenes MGAS315
aaaaugacugacaa

SEQ ID NO: 2218255 - RNA, 15 nt, Streptococcus pyogenes MGAS315
aaaacaguuccaguu

SEQ ID NO: 2218256 - RNA, 23 nt, Streptococcus pyogenes MGAS315
aaaacgaugagauuaacugacaa

SEQ ID NO: 2218257 - RNA, 17 nt, Streptococcus pyogenes MGAS315
aaaaagcaaaaaagcca

SEQ ID NO: 2218258 - RNA, 14 nt, Streptococcus pyogenes MGAS315
aaaaauacuagaaa

SEQ ID NO: 2218259 - RNA, 15 nt, Streptococcus pyogenes MGAS315
aaaagggcugaccuu

SEQ ID NO: 2218260 - RNA, 20 nt, Streptococcus pyogenes MGAS315
aaaucgcccuggagcuguug

SEQ ID NO: 2218261 - RNA, 23 nt, Streptococcus pyogenes MGAS315
aaauaacgcgagcuauuggcagu

SEQ ID NO: 2218262 - RNA, 18 nt, Streptococcus pyogenes MGAS315
acaacauccauaccauca

SEQ ID NO: 2218263 - RNA, 18 nt, Streptococcus pyogenes MGAS315
aaugccaacuuuucaaug

SEQ ID NO: 2218264 - RNA, 19 nt, Streptococcus pyogenes MGAS315
aauaaagugcgcuuccaga

SEQ ID NO: 2218265 - RNA, 16 nt, Streptococcus pyogenes MGAS315
aaucaauaauggcaga

SEQ ID NO: 2218266 - RNA, 14 nt, Streptococcus pyogenes MGAS315
aacuauuuaacuua

SEQ ID NO: 2218267 - RNA, 22 nt, Streptococcus pyogenes MGAS315
aacuucuauauguguaauuucu

SEQ ID NO: 2218268 - RNA, 12 nt, Streptococcus pyogenes MGAS315
accaugccuaaa

SEQ ID NO: 2218269 - RNA, 17 nt, Streptococcus pyogenes MGAS315
gccaacuuuucaauggu

SEQ ID NO: 2218270 - RNA, 23 nt, Streptococcus pyogenes MGAS315
gcuugucuaugagauaccuucau

SEQ ID NO: 2218271 - RNA, 21 nt, Streptococcus pyogenes MGAS315
aagucguuuagcuuuuucaag

SEQ ID NO: 2218272 - RNA, 21 nt, Streptococcus pyogenes MGAS315
gucgcagaguacaaggcaauc

SEQ ID NO: 2218273 - RNA, 17 nt, Streptococcus pyogenes MGAS315
cggaaaacuuuugacuu

SEQ ID NO: 2218274 - RNA, 15 nt, Streptococcus pyogenes MGAS315
caguccaucaaucgu

SEQ ID NO: 2218275 - RNA, 15 nt, Streptococcus pyogenes MGAS315
cauagaagccaauua

SEQ ID NO: 2218276 - RNA, 19 nt, Streptococcus pyogenes MGAS315
caacuuuucaauggucacu

SEQ ID NO: 2218277 - RNA, 19 nt, Streptococcus pyogenes MGAS315
caauaauggcagagucauu

SEQ ID NO: 2218278 - RNA, 19 nt, Streptococcus pyogenes MGAS315
aucgacaacauccauacca

SEQ ID NO: 2218279 - RNA, 14 nt, Streptococcus pyogenes MGAS315
augagacuaaccug

SEQ ID NO: 2218280 - RNA, 23 nt, Streptococcus pyogenes MGAS315
caaagggagauucuuauccauua

SEQ ID NO: 2218281 - RNA, 17 nt, Streptococcus pyogenes MGAS315
caaauaguggcaaauga

SEQ ID NO: 2218282 - RNA, 23 nt, Streptococcus pyogenes MGAS315
aguuagcaaauuguuugauugau

SEQ ID NO: 2218283 - RNA, 16 nt, Streptococcus pyogenes MGAS315
auaauuccugugacaa

SEQ ID NO: 2218284 - RNA, 23 nt, Streptococcus pyogenes MGAS315
aucaaaccaagguauuuagccua

SEQ ID NO: 2218285 - RNA, 21 nt, Streptococcus pyogenes MGAS315
aggcaaagaaagccaagacua

SEQ ID NO: 2218286 - RNA, 18 nt, Streptococcus pyogenes MGAS315
agcuugauuauaaucuau

SEQ ID NO: 2218287 - RNA, 18 nt, Streptococcus pyogenes MGAS315
uuuuuuguauuacucaau

SEQ ID NO: 2218288 - RNA, 18 nt, Streptococcus pyogenes MGAS315
uuuuucauuugaaauucc

SEQ ID NO: 2218289 - RNA, 16 nt, Streptococcus pyogenes MGAS315
uuuuguaucucauaac

SEQ ID NO: 2218290 - RNA, 16 nt, Streptococcus pyogenes MGAS315
uuuugucuuauagaau

SEQ ID NO: 2218291 - RNA, 15 nt, Streptococcus pyogenes MGAS315
uuuugucuucuucuu

SEQ ID NO: 2218292 - RNA, 18 nt, Streptococcus pyogenes MGAS315
uuuuguuguauuaugagg

SEQ ID NO: 2218293 - RNA, 23 nt, Streptococcus pyogenes MGAS315
uuuuguugaguguuaugaugaug

SEQ ID NO: 2218294 - RNA, 18 nt, Streptococcus pyogenes MGAS315
uuuugguugauauaaaau

SEQ ID NO: 2218295 - RNA, 13 nt, Streptococcus pyogenes MGAS315
uuuuccuaucaga

SEQ ID NO: 2218296 - RNA, 17 nt, Streptococcus pyogenes MGAS315
uuuuccuaucagauacu

SEQ ID NO: 2218297 - RNA, 21 nt, Streptococcus pyogenes MGAS315
uuuucagagcacguuuucugg

SEQ ID NO: 2218298 - RNA, 16 nt, Streptococcus pyogenes MGAS315
uuuucuuuuggccuac

SEQ ID NO: 2218299 - RNA, 15 nt, Streptococcus pyogenes MGAS315
uuuucugguuuuaau

SEQ ID NO: 2218300 - RNA, 16 nt, Streptococcus pyogenes MGAS315
ucugacguaagcauca

SEQ ID NO: 2218301 - RNA, 14 nt, Streptococcus pyogenes MGAS315
ucucuuuggagaaa

SEQ ID NO: 2218302 - RNA, 19 nt, Streptococcus pyogenes MGAS315
ucucuuaauuuauauuuua

SEQ ID NO: 2218303 - RNA, 14 nt, Streptococcus pyogenes MGAS315
ucuccgacugcagu

SEQ ID NO: 2218304 - RNA, 19 nt, Streptococcus pyogenes MGAS315
ucugucgguauaguuugga

SEQ ID NO: 2218305 - RNA, 19 nt, Streptococcus pyogenes MGAS315
ucuucaauuuuugccaaaa

SEQ ID NO: 2218306 - RNA, 12 nt, Streptococcus pyogenes MGAS315
ucuucaucuguu

SEQ ID NO: 2218307 - RNA, 23 nt, Streptococcus pyogenes MGAS315
ugaaacguuauuaaagacaaaaa

SEQ ID NO: 2218308 - RNA, 16 nt, Streptococcus pyogenes MGAS315
ugaaaguuccuuagca

SEQ ID NO: 2218309 - RNA, 14 nt, Streptococcus pyogenes MGAS315
ugaaaauaucuuuu

SEQ ID NO: 2218310 - RNA, 13 nt, Streptococcus pyogenes MGAS315
ugaaaauaaaaua

SEQ ID NO: 2218311 - RNA, 23 nt, Streptococcus pyogenes MGAS315
ugaaaagaugcacacaaaucuuc

SEQ ID NO: 2218312 - RNA, 22 nt, Streptococcus pyogenes MGAS315
ugaaaagaugcacacaaaucuu

SEQ ID NO: 2218313 - RNA, 16 nt, Streptococcus pyogenes MGAS315
ugaaaacguguauucu

SEQ ID NO: 2218314 - RNA, 12 nt, Streptococcus pyogenes MGAS315
ugaaaugauugu

SEQ ID NO: 2218315 - RNA, 17 nt, Streptococcus pyogenes MGAS315
ugaaauuccuuaaauua

SEQ ID NO: 2218316 - RNA, 18 nt, Streptococcus pyogenes MGAS315
ugaaauuccuuaaauuau

SEQ ID NO: 2218317 - RNA, 14 nt, Streptococcus pyogenes MGAS315
ugaacaaaguuuca

SEQ ID NO: 2218318 - RNA, 23 nt, Streptococcus pyogenes MGAS315
ugaacgaagucaagggaauugcc

SEQ ID NO: 2218319 - RNA, 23 nt, Streptococcus pyogenes MGAS315
ucuuguuuaaccuccuaaacuaa

SEQ ID NO: 2218320 - RNA, 23 nt, Streptococcus pyogenes MGAS315
ucuuggauagacugauucaucuu

SEQ ID NO: 2218321 - RNA, 20 nt, Streptococcus pyogenes MGAS315
ucuuugcaggguaucugcuc

SEQ ID NO: 2218322 - RNA, 16 nt, Streptococcus pyogenes MGAS315
ucuuuguccauucuuu

SEQ ID NO: 2218323 - RNA, 13 nt, Streptococcus pyogenes MGAS315
ucuuuuuggcuga

SEQ ID NO: 2218324 - RNA, 17 nt, Streptococcus pyogenes MGAS315
ucuuuuuguugcuagcu

SEQ ID NO: 2218325 - RNA, 13 nt, Streptococcus pyogenes MGAS315
ucuuuuuuaccuu

SEQ ID NO: 2218326 - RNA, 17 nt, Streptococcus pyogenes MGAS315
ucuuuuuuacuuuuaaa

SEQ ID NO: 2218327 - RNA, 19 nt, Streptococcus pyogenes MGAS315
ucuuuuuuacuuuuaaaau

SEQ ID NO: 2218328 - RNA, 20 nt, Streptococcus pyogenes MGAS315
ucuuuuucguauacuuuaaa

SEQ ID NO: 2218329 - RNA, 14 nt, Streptococcus pyogenes MGAS315
ucggcuaauucuua

SEQ ID NO: 2218330 - RNA, 21 nt, Streptococcus pyogenes MGAS315
ucguaaugucuuguuuugguu

SEQ ID NO: 2218331 - RNA, 14 nt, Streptococcus pyogenes MGAS315
ucuaagcaaauagc

SEQ ID NO: 2218332 - RNA, 19 nt, Streptococcus pyogenes MGAS315
ucguuuuuugcuuuugaua

SEQ ID NO: 2218333 - RNA, 18 nt, Streptococcus pyogenes MGAS315
ucgaaauugguccucuga

SEQ ID NO: 2218334 - RNA, 13 nt, Streptococcus pyogenes MGAS315
ugaguugauuuau

SEQ ID NO: 2218335 - RNA, 19 nt, Streptococcus pyogenes MGAS315
ugaguuuggugucaaucau

SEQ ID NO: 2218336 - RNA, 23 nt, Streptococcus pyogenes MGAS315
ugauaaaaauaaaaaaacaccuu

SEQ ID NO: 2218337 - RNA, 14 nt, Streptococcus pyogenes MGAS315
ugauauaaaauugg

SEQ ID NO: 2218338 - RNA, 16 nt, Streptococcus pyogenes MGAS315
ugauauaaaaauggag

SEQ ID NO: 2218339 - RNA, 21 nt, Streptococcus pyogenes MGAS315
ugaugauaaaggccuguauuu

SEQ ID NO: 2218340 - RNA, 22 nt, Streptococcus pyogenes MGAS315
ugaugauauuuuucauuaguua

SEQ ID NO: 2218341 - RNA, 18 nt, Streptococcus pyogenes MGAS315
ugaucuguuuaaaaacaa

SEQ ID NO: 2218342 - RNA, 21 nt, Streptococcus pyogenes MGAS315
ugaucuguuuaaaaacaaauu

SEQ ID NO: 2218343 - RNA, 18 nt, Streptococcus pyogenes MGAS315
ugcaaaauuuuaaauguu

SEQ ID NO: 2218344 - RNA, 21 nt, Streptococcus pyogenes MGAS315
ugauuuaugaccauuuuuacu

SEQ ID NO: 2218345 - RNA, 18 nt, Streptococcus pyogenes MGAS315
ugauugauacaaagacuu

SEQ ID NO: 2218346 - RNA, 17 nt, Streptococcus pyogenes MGAS315
ugauugauuugucuucu

SEQ ID NO: 2218347 - RNA, 15 nt, Streptococcus pyogenes MGAS315
ugauugauuugucuu

SEQ ID NO: 2218348 - RNA, 18 nt, Streptococcus pyogenes MGAS315
ugauucaucuugccauca

SEQ ID NO: 2218349 - RNA, 22 nt, Streptococcus pyogenes MGAS315
ugauucaucuugccaucagcau

SEQ ID NO: 2218350 - RNA, 12 nt, Streptococcus pyogenes MGAS315
ugauuacugaua

SEQ ID NO: 2218351 - RNA, 20 nt, Streptococcus pyogenes MGAS315
ugacucugauccgaguuuug

SEQ ID NO: 2218352 - RNA, 14 nt, Streptococcus pyogenes MGAS315
ugacuaguuuauua

SEQ ID NO: 2218353 - RNA, 22 nt, Streptococcus pyogenes MGAS315
ugacuaaaccugucccuaacca

SEQ ID NO: 2218354 - RNA, 12 nt, Streptococcus pyogenes MGAS315
ugacuucaaaaa

SEQ ID NO: 2218355 - RNA, 16 nt, Streptococcus pyogenes MGAS315
ugagcaaggcaagagg

SEQ ID NO: 2218356 - RNA, 21 nt, Streptococcus pyogenes MGAS315
ugaccgaaaaaggcaaagaaa

SEQ ID NO: 2218357 - RNA, 23 nt, Streptococcus pyogenes MGAS315
ugaacguucuguuuaaaauauau

SEQ ID NO: 2218358 - RNA, 14 nt, Streptococcus pyogenes MGAS315
ugaagcaaaauaaa

SEQ ID NO: 2218359 - RNA, 21 nt, Streptococcus pyogenes MGAS315
ugaaguauaguuauguuauaa

SEQ ID NO: 2218360 - RNA, 15 nt, Streptococcus pyogenes MGAS315
ugcugaguucuuuuu

SEQ ID NO: 2218361 - RNA, 23 nt, Streptococcus pyogenes MGAS315
ugcuuuuuuugucguuuuuugcu

SEQ ID NO: 2218362 - RNA, 12 nt, Streptococcus pyogenes MGAS315
ugcuucuuucaa

SEQ ID NO: 2218363 - RNA, 18 nt, Streptococcus pyogenes MGAS315
ugcgcgacuaaaaucaug

SEQ ID NO: 2218364 - RNA, 13 nt, Streptococcus pyogenes MGAS315
ugcauuaucaucu

SEQ ID NO: 2218365 - RNA, 14 nt, Streptococcus pyogenes MGAS315
ugcaugaagugguu

SEQ ID NO: 2218366 - RNA, 17 nt, Streptococcus pyogenes MGAS315
ugccaauuguucauuaa

SEQ ID NO: 2218367 - RNA, 23 nt, Streptococcus pyogenes MGAS315
ugccaccucuaacaccaaaauca

SEQ ID NO: 2218368 - RNA, 15 nt, Streptococcus pyogenes MGAS315
ugccaguaaggaaau

SEQ ID NO: 2218369 - RNA, 22 nt, Streptococcus pyogenes MGAS315
ugccaucaggcuuaaacauauu

SEQ ID NO: 2218370 - RNA, 21 nt, Streptococcus pyogenes MGAS315
ugccaucugcuuggauuuccu

SEQ ID NO: 2218371 - RNA, 16 nt, Streptococcus pyogenes MGAS315
ugccauuaauaauauu

SEQ ID NO: 2218372 - RNA, 12 nt, Streptococcus pyogenes MGAS315
ugccauuaauaa

SEQ ID NO: 2218373 - RNA, 16 nt, Streptococcus pyogenes MGAS315
ugccauggguaaaaug

SEQ ID NO: 2218374 - RNA, 17 nt, Streptococcus pyogenes MGAS315
ugccauuuaaaagggca

SEQ ID NO: 2218375 - RNA, 12 nt, Streptococcus pyogenes MGAS315
uuacaucaaaaa

SEQ ID NO: 2218376 - RNA, 14 nt, Streptococcus pyogenes MGAS315
uuacaucaaaaaaa

SEQ ID NO: 2218377 - RNA, 17 nt, Streptococcus pyogenes MGAS315
uuacaucaaaaaaagca

SEQ ID NO: 2218378 - RNA, 16 nt, Streptococcus pyogenes MGAS315
uuaaugccaacuuuuc

SEQ ID NO: 2218379 - RNA, 21 nt, Streptococcus pyogenes MGAS315
uuaaucuuuuugugauauguu

SEQ ID NO: 2218380 - RNA, 19 nt, Streptococcus pyogenes MGAS315
uuaaugucauacaaaaaca

SEQ ID NO: 2218381 - RNA, 14 nt, Streptococcus pyogenes MGAS315
uuacuauggcuucu

SEQ ID NO: 2218382 - RNA, 15 nt, Streptococcus pyogenes MGAS315
uuacuaacuagcaag

SEQ ID NO: 2218383 - RNA, 15 nt, Streptococcus pyogenes MGAS315
uuaaagacaaaaaac

SEQ ID NO: 2218384 - RNA, 13 nt, Streptococcus pyogenes MGAS315
uuaaacauauuau

SEQ ID NO: 2218385 - RNA, 21 nt, Streptococcus pyogenes MGAS315
uuaaauuuggagagauaaaaa

SEQ ID NO: 2218386 - RNA, 24 nt, Streptococcus pyogenes MGAS315
uuaaauuuggagagauaaaaagua

SEQ ID NO: 2218387 - RNA, 13 nt, Streptococcus pyogenes MGAS315
uuaacaaaaauaa

SEQ ID NO: 2218388 - RNA, 17 nt, Streptococcus pyogenes MGAS315
uuaauaagacaaagacg

SEQ ID NO: 2218389 - RNA, 13 nt, Streptococcus pyogenes MGAS315
uuaauaaaagauu

SEQ ID NO: 2218390 - RNA, 18 nt, Streptococcus pyogenes MGAS315
uuaagcugaguaaaacaa

SEQ ID NO: 2218391 - RNA, 17 nt, Streptococcus pyogenes MGAS315
uuaagcuuuguugcauu

SEQ ID NO: 2218392 - RNA, 21 nt, Streptococcus pyogenes MGAS315
uuaagauuaaacuuacaaaaa

SEQ ID NO: 2218393 - RNA, 20 nt, Streptococcus pyogenes MGAS315
uuaagauaccaaaucaaaaa

SEQ ID NO: 2218394 - RNA, 17 nt, Streptococcus pyogenes MGAS315
uuaacuuaucauuuugg

SEQ ID NO: 2218395 - RNA, 18 nt, Streptococcus pyogenes MGAS315
uuaagagggccaaggucu

SEQ ID NO: 2218396 - RNA, 18 nt, Streptococcus pyogenes MGAS315
uuaaccggcucuaaaaua

SEQ ID NO: 2218397 - RNA, 18 nt, Streptococcus pyogenes MGAS315
uuaacguuaacaaaaaua

SEQ ID NO: 2218398 - RNA, 17 nt, Streptococcus pyogenes MGAS315
uuaacaaugaaacguua

SEQ ID NO: 2218399 - RNA, 20 nt, Streptococcus pyogenes MGAS315
uuaacaggugacauaguguu

SEQ ID NO: 2218400 - RNA, 19 nt, Streptococcus pyogenes MGAS315
uuauuaguaaccauagaag

SEQ ID NO: 2218401 - RNA, 17 nt, Streptococcus pyogenes MGAS315
uuauuaagauaccaaau

SEQ ID NO: 2218402 - RNA, 22 nt, Streptococcus pyogenes MGAS315
uuauuaaccaauuccucccuau

SEQ ID NO: 2218403 - RNA, 15 nt, Streptococcus pyogenes MGAS315
uuauuaauaaguauu

SEQ ID NO: 2218404 - RNA, 20 nt, Streptococcus pyogenes MGAS315
uuauuuucuagguuaaaaua

SEQ ID NO: 2218405 - RNA, 19 nt, Streptococcus pyogenes MGAS315
uucaaaaaagggaagaaga

SEQ ID NO: 2218406 - RNA, 18 nt, Streptococcus pyogenes MGAS315
uucaaagggagauucuua

SEQ ID NO: 2218407 - RNA, 17 nt, Streptococcus pyogenes MGAS315
uucaagagucaaaccag

SEQ ID NO: 2218408 - RNA, 18 nt, Streptococcus pyogenes MGAS315
uucaagagucaaaccagu

SEQ ID NO: 2218409 - RNA, 15 nt, Streptococcus pyogenes MGAS315
uuauccuuuacugua

SEQ ID NO: 2218410 - RNA, 17 nt, Streptococcus pyogenes MGAS315
uuauccuccuaaauaua

SEQ ID NO: 2218411 - RNA, 17 nt, Streptococcus pyogenes MGAS315
uuaucuucauagcuuaa

SEQ ID NO: 2218412 - RNA, 17 nt, Streptococcus pyogenes MGAS315
uuauuaaagacaaaaaa

SEQ ID NO: 2218413 - RNA, 16 nt, Streptococcus pyogenes MGAS315
uuauguuauaagagaa

SEQ ID NO: 2218414 - RNA, 14 nt, Streptococcus pyogenes MGAS315
uuaugauuugucaa

SEQ ID NO: 2218415 - RNA, 21 nt, Streptococcus pyogenes MGAS315
uuaugauuugucaaaaaguaa

SEQ ID NO: 2218416 - RNA, 13 nt, Streptococcus pyogenes MGAS315
uuauccauucuua

SEQ ID NO: 2218417 - RNA, 20 nt, Streptococcus pyogenes MGAS315
uuaucaacaaucuuaaaaua

SEQ ID NO: 2218418 - RNA, 22 nt, Streptococcus pyogenes MGAS315
uuaucaacaaucuuaaaauaau

SEQ ID NO: 2218419 - RNA, 23 nt, Streptococcus pyogenes MGAS315
uuauaaaguuuucucagagacaa

SEQ ID NO: 2218420 - RNA, 15 nt, Streptococcus pyogenes MGAS315
uuauaagagaaguaa

SEQ ID NO: 2218421 - RNA, 18 nt, Streptococcus pyogenes MGAS315
uuauaaagaaacaaaaau

SEQ ID NO: 2218422 - RNA, 15 nt, Streptococcus pyogenes MGAS315
uuagagucucuuaau

SEQ ID NO: 2218423 - RNA, 21 nt, Streptococcus pyogenes MGAS315
uuauaauuugacuucaaaaau

SEQ ID NO: 2218424 - RNA, 22 nt, Streptococcus pyogenes MGAS315
uuauaauuugacuucaaaaaua

SEQ ID NO: 2218425 - RNA, 14 nt, Streptococcus pyogenes MGAS315
uuauagcuccuaaa

SEQ ID NO: 2218426 - RNA, 14 nt, Streptococcus pyogenes MGAS315
ugucauacaaaaac

SEQ ID NO: 2218427 - RNA, 14 nt, Streptococcus pyogenes MGAS315
uguauucuuaaaaa

SEQ ID NO: 2218428 - RNA, 17 nt, Streptococcus pyogenes MGAS315
uguccuaaccuuuuggc

SEQ ID NO: 2218429 - RNA, 21 nt, Streptococcus pyogenes MGAS315
ugucguuuuuugcuuuugaua

SEQ ID NO: 2218430 - RNA, 16 nt, Streptococcus pyogenes MGAS315
ugucucacuauuuugu

SEQ ID NO: 2218431 - RNA, 21 nt, Streptococcus pyogenes MGAS315
ugucuuagccuuuuuuugucu

SEQ ID NO: 2218432 - RNA, 20 nt, Streptococcus pyogenes MGAS315
ugucuuaucuaaaggagcuu

SEQ ID NO: 2218433 - RNA, 18 nt, Streptococcus pyogenes MGAS315
ugucuuagccuuuuuuug

SEQ ID NO: 2218434 - RNA, 23 nt, Streptococcus pyogenes MGAS315
ugucuggaaacuggucaaaagcu

SEQ ID NO: 2218435 - RNA, 19 nt, Streptococcus pyogenes MGAS315
ugugacaauuggugauuaa

SEQ ID NO: 2218436 - RNA, 16 nt, Streptococcus pyogenes MGAS315
ugugauguaauugucu

SEQ ID NO: 2218437 - RNA, 20 nt, Streptococcus pyogenes MGAS315
ugugaugauauuuuucauua

SEQ ID NO: 2218438 - RNA, 17 nt, Streptococcus pyogenes MGAS315
uguucuuuauuuugaua

SEQ ID NO: 2218439 - RNA, 13 nt, Streptococcus pyogenes MGAS315
uguuaauauguaa

SEQ ID NO: 2218440 - RNA, 17 nt, Streptococcus pyogenes MGAS315
uguuaauauagucugca

SEQ ID NO: 2218441 - RNA, 20 nt, Streptococcus pyogenes MGAS315
uguaauguuguaaacuuccu

SEQ ID NO: 2218442 - RNA, 19 nt, Streptococcus pyogenes MGAS315
uguaauauuuccuuuuaaa

SEQ ID NO: 2218443 - RNA, 18 nt, Streptococcus pyogenes MGAS315
ugguugccugaaauauaa

SEQ ID NO: 2218444 - RNA, 18 nt, Streptococcus pyogenes MGAS315
ugguuaaaaagagagcuu

SEQ ID NO: 2218445 - RNA, 15 nt, Streptococcus pyogenes MGAS315
uggcuagccaaaucu

SEQ ID NO: 2218446 - RNA, 23 nt, Streptococcus pyogenes MGAS315
uggcuauaaauggacaaucuuaa

SEQ ID NO: 2218447 - RNA, 14 nt, Streptococcus pyogenes MGAS315
uucagguugcaaca

SEQ ID NO: 2218448 - RNA, 21 nt, Streptococcus pyogenes MGAS315
uucaugauguuauuaaauaau

SEQ ID NO: 2218449 - RNA, 19 nt, Streptococcus pyogenes MGAS315
uucaugacgccuccaaaua

SEQ ID NO: 2218450 - RNA, 13 nt, Streptococcus pyogenes MGAS315
uucauuaguuaau

SEQ ID NO: 2218451 - RNA, 14 nt, Streptococcus pyogenes MGAS315
uucaagugcuagau

SEQ ID NO: 2218452 - RNA, 19 nt, Streptococcus pyogenes MGAS315
uucaauaauaccauuuuua

SEQ ID NO: 2218453 - RNA, 19 nt, Streptococcus pyogenes MGAS315
uucagauaaaaccuucaaa

SEQ ID NO: 2218454 - RNA, 23 nt, Streptococcus pyogenes MGAS315
uucagauaaaaccuucaaaaaag

SEQ ID NO: 2218455 - RNA, 19 nt, Streptococcus pyogenes MGAS315
uucacuauaauuucaauaa

SEQ ID NO: 2218456 - RNA, 14 nt, Streptococcus pyogenes MGAS315
uucccauguuuuau

SEQ ID NO: 2218457 - RNA, 14 nt, Streptococcus pyogenes MGAS315
uucgauaaauucag

SEQ ID NO: 2218458 - RNA, 11 nt, Streptococcus pyogenes MGAS315
uucgcacagcg

SEQ ID NO: 2218459 - RNA, 20 nt, Streptococcus pyogenes MGAS315
uucgcacagcguaagccaaa

SEQ ID NO: 2218460 - RNA, 16 nt, Streptococcus pyogenes MGAS315
uuccuuguacaagagc

SEQ ID NO: 2218461 - RNA, 20 nt, Streptococcus pyogenes MGAS315
uugccaucagcaucugaaaa

SEQ ID NO: 2218462 - RNA, 18 nt, Streptococcus pyogenes MGAS315
uugccugaaauauaaccu

SEQ ID NO: 2218463 - RNA, 16 nt, Streptococcus pyogenes MGAS315
uuggaagaucuccaag

SEQ ID NO: 2218464 - RNA, 17 nt, Streptococcus pyogenes MGAS315
uuggauuuuuguauuug

SEQ ID NO: 2218465 - RNA, 14 nt, Streptococcus pyogenes MGAS315
uugguaaaaaggca

SEQ ID NO: 2218466 - RNA, 15 nt, Streptococcus pyogenes MGAS315
uuggugauuaacgcu

SEQ ID NO: 2218467 - RNA, 21 nt, Streptococcus pyogenes MGAS315
uuuaagauuaaacuuacaaaa

SEQ ID NO: 2218468 - RNA, 20 nt, Streptococcus pyogenes MGAS315
uuuaaauguucgaaaaaaua

SEQ ID NO: 2218469 - RNA, 16 nt, Streptococcus pyogenes MGAS315
uuuaaaaacaaauugu

SEQ ID NO: 2218470 - RNA, 14 nt, Streptococcus pyogenes MGAS315
uuuaagcugaguaa

SEQ ID NO: 2218471 - RNA, 19 nt, Streptococcus pyogenes MGAS315
uuuaagcugaguaaaacaa

SEQ ID NO: 2218472 - RNA, 20 nt, Streptococcus pyogenes MGAS315
uuguagggauuuuuuuaacu

SEQ ID NO: 2218473 - RNA, 22 nt, Streptococcus pyogenes MGAS315
uuguauuacucaauuaauguua

SEQ ID NO: 2218474 - RNA, 22 nt, Streptococcus pyogenes MGAS315
uuguaaccacagcaauuuguuc

SEQ ID NO: 2218475 - RNA, 16 nt, Streptococcus pyogenes MGAS315
uuguguugaagaaggu

SEQ ID NO: 2218476 - RNA, 17 nt, Streptococcus pyogenes MGAS315
uugaauugaaaaaagac

SEQ ID NO: 2218477 - RNA, 13 nt, Streptococcus pyogenes MGAS315
uugacaaagccau

SEQ ID NO: 2218478 - RNA, 21 nt, Streptococcus pyogenes MGAS315
uugacuugguucugaaaauaa

SEQ ID NO: 2218479 - RNA, 18 nt, Streptococcus pyogenes MGAS315
uugacuuguuacaaaaaa

SEQ ID NO: 2218480 - RNA, 19 nt, Streptococcus pyogenes MGAS315
uucuugugcuaaucuaucu

SEQ ID NO: 2218481 - RNA, 15 nt, Streptococcus pyogenes MGAS315
uugauauuuuuucuc

SEQ ID NO: 2218482 - RNA, 20 nt, Streptococcus pyogenes MGAS315
uugaugagcgguuuugucuu

SEQ ID NO: 2218483 - RNA, 16 nt, Streptococcus pyogenes MGAS315
uugaugagacuaaccu

SEQ ID NO: 2218484 - RNA, 22 nt, Streptococcus pyogenes MGAS315
uugcaauagagccaagauuuua

SEQ ID NO: 2218485 - RNA, 13 nt, Streptococcus pyogenes MGAS315
uugauuugccgcu

SEQ ID NO: 2218486 - RNA, 14 nt, Streptococcus pyogenes MGAS315
uugcaagucucuug

SEQ ID NO: 2218487 - RNA, 14 nt, Streptococcus pyogenes MGAS315
uucuggugcaaggc

SEQ ID NO: 2218488 - RNA, 23 nt, Streptococcus pyogenes MGAS315
uucugaaaauaaaauauuuuucc

SEQ ID NO: 2218489 - RNA, 20 nt, Streptococcus pyogenes MGAS315
uucuugaggugauucuuuuu

SEQ ID NO: 2218490 - RNA, 16 nt, Streptococcus pyogenes MGAS315
uucuugaggugauucu

SEQ ID NO: 2218491 - RNA, 18 nt, Streptococcus pyogenes MGAS315
uucuugaggugauucuuu

SEQ ID NO: 2218492 - RNA, 21 nt, Streptococcus pyogenes MGAS315
uucuagacccuagcauaaaag

SEQ ID NO: 2218493 - RNA, 19 nt, Streptococcus pyogenes MGAS315
uucguaaggguuauuauuu

SEQ ID NO: 2218494 - RNA, 14 nt, Streptococcus pyogenes MGAS315
gaauuuccuaaugu

SEQ ID NO: 2218495 - RNA, 14 nt, Streptococcus pyogenes MGAS315
gagucucuagucuu

SEQ ID NO: 2218496 - RNA, 19 nt, Streptococcus pyogenes MGAS315
gagucauuuaguuuagaua

SEQ ID NO: 2218497 - RNA, 14 nt, Streptococcus pyogenes MGAS315
gauaaaacaaauaa

SEQ ID NO: 2218498 - RNA, 22 nt, Streptococcus pyogenes MGAS315
gauaaaaccuucaaaaaaggga

SEQ ID NO: 2218499 - RNA, 15 nt, Streptococcus pyogenes MGAS315
gauaaaacaaauaau

SEQ ID NO: 2218500 - RNA, 19 nt, Streptococcus pyogenes MGAS315
gauaaaggccuguauuucu

SEQ ID NO: 2218501 - RNA, 21 nt, Streptococcus pyogenes MGAS315
gaguugaaccgcuaaaacagu

SEQ ID NO: 2218502 - RNA, 20 nt, Streptococcus pyogenes MGAS315
gauacuuugguauucuuuuu

SEQ ID NO: 2218503 - RNA, 20 nt, Streptococcus pyogenes MGAS315
gauacaguccaaacucaaac

SEQ ID NO: 2218504 - RNA, 13 nt, Streptococcus pyogenes MGAS315
gauaccuuuuuug

SEQ ID NO: 2218505 - RNA, 18 nt, Streptococcus pyogenes MGAS315
gauaccaaaucaaaaagc

SEQ ID NO: 2218506 - RNA, 15 nt, Streptococcus pyogenes MGAS315
gauaauuuauuuuuc

SEQ ID NO: 2218507 - RNA, 13 nt, Streptococcus pyogenes MGAS315
gauagcaccuaau

SEQ ID NO: 2218508 - RNA, 19 nt, Streptococcus pyogenes MGAS315
gauauggaauagguaaaga

SEQ ID NO: 2218509 - RNA, 21 nt, Streptococcus pyogenes MGAS315
gauauggaauagguaaagauu

SEQ ID NO: 2218510 - RNA, 22 nt, Streptococcus pyogenes MGAS315
gaugagauuaacugacaaaaaa

SEQ ID NO: 2218511 - RNA, 15 nt, Streptococcus pyogenes MGAS315
gaugcguuuauaaag

SEQ ID NO: 2218512 - RNA, 19 nt, Streptococcus pyogenes MGAS315
gauggacgucuucuuuuua

SEQ ID NO: 2218513 - RNA, 20 nt, Streptococcus pyogenes MGAS315
gauguaccaauuuaagguau

SEQ ID NO: 2218514 - RNA, 21 nt, Streptococcus pyogenes MGAS315
gaugguaauauugcucaagac

SEQ ID NO: 2218515 - RNA, 19 nt, Streptococcus pyogenes MGAS315
gauugagaccaaaugaccu

SEQ ID NO: 2218516 - RNA, 16 nt, Streptococcus pyogenes MGAS315
gauugauacaaagacu

SEQ ID NO: 2218517 - RNA, 18 nt, Streptococcus pyogenes MGAS315
gauuugccgcuacaccac

SEQ ID NO: 2218518 - RNA, 21 nt, Streptococcus pyogenes MGAS315
gauuugaccacaccuaauaaa

SEQ ID NO: 2218519 - RNA, 23 nt, Streptococcus pyogenes MGAS315
gcaaaaaagccagugcugcugaa

SEQ ID NO: 2218520 - RNA, 19 nt, Streptococcus pyogenes MGAS315
gcaaaaguuagauuuugga

SEQ ID NO: 2218521 - RNA, 16 nt, Streptococcus pyogenes MGAS315
gcaaugguuaaaaaga

SEQ ID NO: 2218522 - RNA, 17 nt, Streptococcus pyogenes MGAS315
gcaaugguuaaaaagag

SEQ ID NO: 2218523 - RNA, 19 nt, Streptococcus pyogenes MGAS315
gcaauucuuuuauuaaugu

SEQ ID NO: 2218524 - RNA, 15 nt, Streptococcus pyogenes MGAS315
gcaaauugaaaaaau

SEQ ID NO: 2218525 - RNA, 12 nt, Streptococcus pyogenes MGAS315
gcacguuuucug

SEQ ID NO: 2218526 - RNA, 17 nt, Streptococcus pyogenes MGAS315
gcaucgcaaacagaugc

SEQ ID NO: 2218527 - RNA, 23 nt, Streptococcus pyogenes MGAS315
gcaucuuugcaggguaucugcuc

SEQ ID NO: 2218528 - RNA, 15 nt, Streptococcus pyogenes MGAS315
gcauugacgacugcu

SEQ ID NO: 2218529 - RNA, 16 nt, Streptococcus pyogenes MGAS315
gcauuaucaucugguc

SEQ ID NO: 2218530 - RNA, 15 nt, Streptococcus pyogenes MGAS315
gccaaaucuggcuua

SEQ ID NO: 2218531 - RNA, 17 nt, Streptococcus pyogenes MGAS315
gccaauuguucauuaaa

SEQ ID NO: 2218532 - RNA, 20 nt, Streptococcus pyogenes MGAS315
gccaucugcuuggauuuccu

SEQ ID NO: 2218533 - RNA, 16 nt, Streptococcus pyogenes MGAS315
gccaucagcaucugaa

SEQ ID NO: 2218534 - RNA, 21 nt, Streptococcus pyogenes MGAS315
gcuauagaaacuuuuuauaag

SEQ ID NO: 2218535 - RNA, 20 nt, Streptococcus pyogenes MGAS315
gcugauaggucugcaauauc

SEQ ID NO: 2218536 - RNA, 16 nt, Streptococcus pyogenes MGAS315
gcugaauaaacaaaau

SEQ ID NO: 2218537 - RNA, 20 nt, Streptococcus pyogenes MGAS315
gcugaacugcucuggcuuuu

SEQ ID NO: 2218538 - RNA, 22 nt, Streptococcus pyogenes MGAS315
gcgcauguugacuauuuuucgc

SEQ ID NO: 2218539 - RNA, 16 nt, Streptococcus pyogenes MGAS315
gcugcuaaagcaauca

SEQ ID NO: 2218540 - RNA, 14 nt, Streptococcus pyogenes MGAS315
gcugcugaacugcu

SEQ ID NO: 2218541 - RNA, 13 nt, Streptococcus pyogenes MGAS315
gcuggauuuagaa

SEQ ID NO: 2218542 - RNA, 15 nt, Streptococcus pyogenes MGAS315
gcugcugcuaaagca

SEQ ID NO: 2218543 - RNA, 20 nt, Streptococcus pyogenes MGAS315
gcuuaaugucauacaaaaac

SEQ ID NO: 2218544 - RNA, 13 nt, Streptococcus pyogenes MGAS315
gcuuagcaacuau

SEQ ID NO: 2218545 - RNA, 23 nt, Streptococcus pyogenes MGAS315
gcuuaucucuugagaucuugugc

SEQ ID NO: 2218546 - RNA, 21 nt, Streptococcus pyogenes MGAS315
gcuugcuuuuuucuaaccucu

SEQ ID NO: 2218547 - RNA, 18 nt, Streptococcus pyogenes MGAS315
gcuuggauuuccucuaac

SEQ ID NO: 2218548 - RNA, 13 nt, Streptococcus pyogenes MGAS315
gcuugucuaugag

SEQ ID NO: 2218549 - RNA, 19 nt, Streptococcus pyogenes MGAS315
gcuuugauuuuucuuguuu

SEQ ID NO: 2218550 - RNA, 16 nt, Streptococcus pyogenes MGAS315
gcuuuugauaccuuuu

SEQ ID NO: 2218551 - RNA, 20 nt, Streptococcus pyogenes MGAS315
gcuuuuuacaucaaaaaaag

SEQ ID NO: 2218552 - RNA, 15 nt, Streptococcus pyogenes MGAS315
gcuuuuuuuguaucu

SEQ ID NO: 2218553 - RNA, 17 nt, Streptococcus pyogenes MGAS315
ggaaauuuuaaaugaca

SEQ ID NO: 2218554 - RNA, 11 nt, Streptococcus pyogenes MGAS315
ggaacacucau

SEQ ID NO: 2218555 - RNA, 19 nt, Streptococcus pyogenes MGAS315
ggaagaucuccaagaucug

SEQ ID NO: 2218556 - RNA, 19 nt, Streptococcus pyogenes MGAS315
ggagggacugucaaaaaau

SEQ ID NO: 2218557 - RNA, 18 nt, Streptococcus pyogenes MGAS315
ggcaaagaaagccaagac

SEQ ID NO: 2218558 - RNA, 15 nt, Streptococcus pyogenes MGAS315
uaaugauaaggcugc

SEQ ID NO: 2218559 - RNA, 20 nt, Streptococcus pyogenes MGAS315
uaaugagcaaggcaagagga

SEQ ID NO: 2218560 - RNA, 21 nt, Streptococcus pyogenes MGAS315
uaaucuuuuugugauauguuu

SEQ ID NO: 2218561 - RNA, 15 nt, Streptococcus pyogenes MGAS315
uaaugccaucaaaaa

SEQ ID NO: 2218562 - RNA, 15 nt, Streptococcus pyogenes MGAS315
uaauguuuuuacauu

SEQ ID NO: 2218563 - RNA, 17 nt, Streptococcus pyogenes MGAS315
uaauuaucugaauuauu

SEQ ID NO: 2218564 - RNA, 13 nt, Streptococcus pyogenes MGAS315
uaauuaucugaau

SEQ ID NO: 2218565 - RNA, 15 nt, Streptococcus pyogenes MGAS315
uaauauugcucaaga

SEQ ID NO: 2218566 - RNA, 16 nt, Streptococcus pyogenes MGAS315
uaauauugcucaagac

SEQ ID NO: 2218567 - RNA, 19 nt, Streptococcus pyogenes MGAS315
uacaagguuaaguaaaagc

SEQ ID NO: 2218568 - RNA, 18 nt, Streptococcus pyogenes MGAS315
uacaacuggcuagccaaa

SEQ ID NO: 2218569 - RNA, 15 nt, Streptococcus pyogenes MGAS315
uaauuuauauuuuag

SEQ ID NO: 2218570 - RNA, 14 nt, Streptococcus pyogenes MGAS315
uaauuucuugugcu

SEQ ID NO: 2218571 - RNA, 12 nt, Streptococcus pyogenes MGAS315
uacaaaaaacaa

SEQ ID NO: 2218572 - RNA, 11 nt, Streptococcus pyogenes MGAS315
uacaaaaaaca

SEQ ID NO: 2218573 - RNA, 13 nt, Streptococcus pyogenes MGAS315
uacaaaauaaccc

SEQ ID NO: 2218574 - RNA, 21 nt, Streptococcus pyogenes MGAS315
uacaaaacugucuggaaacug

SEQ ID NO: 2218575 - RNA, 17 nt, Streptococcus pyogenes MGAS315
uaccuuauuuucuaggu

SEQ ID NO: 2218576 - RNA, 16 nt, Streptococcus pyogenes MGAS315
uacgggauuuaguucu

SEQ ID NO: 2218577 - RNA, 17 nt, Streptococcus pyogenes MGAS315
uaccauuuuuaucugua

SEQ ID NO: 2218578 - RNA, 17 nt, Streptococcus pyogenes MGAS315
uacucaauauaauaaaa

SEQ ID NO: 2218579 - RNA, 17 nt, Streptococcus pyogenes MGAS315
uacucgugaauaauuuu

SEQ ID NO: 2218580 - RNA, 13 nt, Streptococcus pyogenes MGAS315
uacugaaauauau

SEQ ID NO: 2218581 - RNA, 20 nt, Streptococcus pyogenes MGAS315
uacugaaauauaugaugagg

SEQ ID NO: 2218582 - RNA, 15 nt, Streptococcus pyogenes MGAS315
uacugauaaacuuga

SEQ ID NO: 2218583 - RNA, 15 nt, Streptococcus pyogenes MGAS315
uacuucugauaaaaa

SEQ ID NO: 2218584 - RNA, 20 nt, Streptococcus pyogenes MGAS315
uacuucugauaaaaauaaaa

SEQ ID NO: 2218585 - RNA, 11 nt, Streptococcus pyogenes MGAS315
uacuucucaaa

SEQ ID NO: 2218586 - RNA, 22 nt, Streptococcus pyogenes MGAS315
uacuugcaucgcaaacagaugc

SEQ ID NO: 2218587 - RNA, 15 nt, Streptococcus pyogenes MGAS315
uagaaaaagcaauga

SEQ ID NO: 2218588 - RNA, 19 nt, Streptococcus pyogenes MGAS315
uacuuugguauucuuuuuc

SEQ ID NO: 2218589 - RNA, 16 nt, Streptococcus pyogenes MGAS315
uacuuugguauucuuu

SEQ ID NO: 2218590 - RNA, 22 nt, Streptococcus pyogenes MGAS315
uacuucaaggaaggcuuguucu

SEQ ID NO: 2218591 - RNA, 14 nt, Streptococcus pyogenes MGAS315
uacuguauaaacuu

SEQ ID NO: 2218592 - RNA, 20 nt, Streptococcus pyogenes MGAS315
uacugggucaacuccaaucu

SEQ ID NO: 2218593 - RNA, 16 nt, Streptococcus pyogenes MGAS315
uacuguauaaacuugu

SEQ ID NO: 2218594 - RNA, 18 nt, Streptococcus pyogenes MGAS315
uacuggucaauggaaauu

SEQ ID NO: 2218595 - RNA, 18 nt, Streptococcus pyogenes MGAS315
uaugcagguguuuaaaga

SEQ ID NO: 2218596 - RNA, 16 nt, Streptococcus pyogenes MGAS315
uaugacaaauucuuuu

SEQ ID NO: 2218597 - RNA, 13 nt, Streptococcus pyogenes MGAS315
uaugauauaaaaa

SEQ ID NO: 2218598 - RNA, 14 nt, Streptococcus pyogenes MGAS315
uaugauauaaaaau

SEQ ID NO: 2218599 - RNA, 16 nt, Streptococcus pyogenes MGAS315
uauguaaauauaaagu

SEQ ID NO: 2218600 - RNA, 21 nt, Streptococcus pyogenes MGAS315
uauaugucaucaaaagaccau

SEQ ID NO: 2218601 - RNA, 16 nt, Streptococcus pyogenes MGAS315
uauauguguaauuucu

SEQ ID NO: 2218602 - RNA, 23 nt, Streptococcus pyogenes MGAS315
uauauuuuggaucuucaacuacu

SEQ ID NO: 2218603 - RNA, 19 nt, Streptococcus pyogenes MGAS315
uaucaacuuguuaacaaua

SEQ ID NO: 2218604 - RNA, 13 nt, Streptococcus pyogenes MGAS315
uaucaagagucau

SEQ ID NO: 2218605 - RNA, 13 nt, Streptococcus pyogenes MGAS315
uauaguuauguua

SEQ ID NO: 2218606 - RNA, 15 nt, Streptococcus pyogenes MGAS315
uauccauuauaaauc

SEQ ID NO: 2218607 - RNA, 13 nt, Streptococcus pyogenes MGAS315
uauccauuauaaa

SEQ ID NO: 2218608 - RNA, 18 nt, Streptococcus pyogenes MGAS315
uauccaaugaaaacucca

SEQ ID NO: 2218609 - RNA, 16 nt, Streptococcus pyogenes MGAS315
uauccaaugaaaacuc

SEQ ID NO: 2218610 - RNA, 16 nt, Streptococcus pyogenes MGAS315
uaucgccaauaaaaaa

SEQ ID NO: 2218611 - RNA, 19 nt, Streptococcus pyogenes MGAS315
uauccuccuaaauauaaau

SEQ ID NO: 2218612 - RNA, 17 nt, Streptococcus pyogenes MGAS315
uaguuggauccuuuauc

SEQ ID NO: 2218613 - RNA, 18 nt, Streptococcus pyogenes MGAS315
uaguugauauuuuuuagg

SEQ ID NO: 2218614 - RNA, 14 nt, Streptococcus pyogenes MGAS315
uaguuuauuacaaa

SEQ ID NO: 2218615 - RNA, 21 nt, Streptococcus pyogenes MGAS315
uaguuuauuacaaaacugucu

SEQ ID NO: 2218616 - RNA, 22 nt, Streptococcus pyogenes MGAS315
uaguuuaggaaucacaacuucu

SEQ ID NO: 2218617 - RNA, 17 nt, Streptococcus pyogenes MGAS315
uaguugugccuuuucuu

SEQ ID NO: 2218618 - RNA, 20 nt, Streptococcus pyogenes MGAS315
uauaaacuuguugacucuga

SEQ ID NO: 2218619 - RNA, 15 nt, Streptococcus pyogenes MGAS315
uauaaagaaacaaaa

SEQ ID NO: 2218620 - RNA, 12 nt, Streptococcus pyogenes MGAS315
uauaagcaauca

SEQ ID NO: 2218621 - RNA, 20 nt, Streptococcus pyogenes MGAS315
uaggcuuuuuuuguaucuca

SEQ ID NO: 2218622 - RNA, 22 nt, Streptococcus pyogenes MGAS315
uaggucuaauuagcauauuuug

SEQ ID NO: 2218623 - RNA, 17 nt, Streptococcus pyogenes MGAS315
uaguaaagccuuaucca

SEQ ID NO: 2218624 - RNA, 17 nt, Streptococcus pyogenes MGAS315
uagcguaaagcaaggga

SEQ ID NO: 2218625 - RNA, 15 nt, Streptococcus pyogenes MGAS315
uagcgggaacacuca

SEQ ID NO: 2218626 - RNA, 16 nt, Streptococcus pyogenes MGAS315
uaggcagacaauuauu

SEQ ID NO: 2218627 - RNA, 13 nt, Streptococcus pyogenes MGAS315
uagcagacaaaag

SEQ ID NO: 2218628 - RNA, 14 nt, Streptococcus pyogenes MGAS315
uagaugauuauauu

SEQ ID NO: 2218629 - RNA, 18 nt, Streptococcus pyogenes MGAS315
uagauguuggaacuuugu

SEQ ID NO: 2218630 - RNA, 13 nt, Streptococcus pyogenes MGAS315
uagauuuuggaua

SEQ ID NO: 2218631 - RNA, 20 nt, Streptococcus pyogenes MGAS315
ucagcccccucuuuaccauu

SEQ ID NO: 2218632 - RNA, 13 nt, Streptococcus pyogenes MGAS315
ucagagcuuuuuu

SEQ ID NO: 2218633 - RNA, 12 nt, Streptococcus pyogenes MGAS315
ucagauacuagu

SEQ ID NO: 2218634 - RNA, 18 nt, Streptococcus pyogenes MGAS315
ucagauaaaaccuucaaa

SEQ ID NO: 2218635 - RNA, 23 nt, Streptococcus pyogenes MGAS315
ucagauaaaaccuucaaaaaagg

SEQ ID NO: 2218636 - RNA, 19 nt, Streptococcus pyogenes MGAS315
ucagaucauuaaauugauu

SEQ ID NO: 2218637 - RNA, 23 nt, Streptococcus pyogenes MGAS315
ucacuauaauuucaauaauacca

SEQ ID NO: 2218638 - RNA, 23 nt, Streptococcus pyogenes MGAS315
ucacuuuagccguccuuaaaaga

SEQ ID NO: 2218639 - RNA, 22 nt, Streptococcus pyogenes MGAS315
ucaauauuuuauuaauaaguau

SEQ ID NO: 2218640 - RNA, 12 nt, Streptococcus pyogenes MGAS315
ucaauaucauau

SEQ ID NO: 2218641 - RNA, 20 nt, Streptococcus pyogenes MGAS315
ucaauaacagaaauuaauaa

SEQ ID NO: 2218642 - RNA, 19 nt, Streptococcus pyogenes MGAS315
ucaauaacagaaauuaaua

SEQ ID NO: 2218643 - RNA, 22 nt, Streptococcus pyogenes MGAS315
ucaaugacuugaccaaauacag

SEQ ID NO: 2218644 - RNA, 12 nt, Streptococcus pyogenes MGAS315
ucaaucauuuuu

SEQ ID NO: 2218645 - RNA, 18 nt, Streptococcus pyogenes MGAS315
ucaauuuuguugaguguu

SEQ ID NO: 2218646 - RNA, 17 nt, Streptococcus pyogenes MGAS315
ucaauuuucauuuuugg

SEQ ID NO: 2218647 - RNA, 21 nt, Streptococcus pyogenes MGAS315
ucaauuaauguuaggagcaca

SEQ ID NO: 2218648 - RNA, 22 nt, Streptococcus pyogenes MGAS315
ucaauuaauguuaggagcacaa

SEQ ID NO: 2218649 - RNA, 19 nt, Streptococcus pyogenes MGAS315
ucaccguggacuugauggu

SEQ ID NO: 2218650 - RNA, 12 nt, Streptococcus pyogenes MGAS315
uauuauuuugcu

SEQ ID NO: 2218651 - RNA, 17 nt, Streptococcus pyogenes MGAS315
uauucaccguggacuug

SEQ ID NO: 2218652 - RNA, 16 nt, Streptococcus pyogenes MGAS315
uauucucuauuuuugg

SEQ ID NO: 2218653 - RNA, 16 nt, Streptococcus pyogenes MGAS315
uauucuuaaaaaaauc

SEQ ID NO: 2218654 - RNA, 20 nt, Streptococcus pyogenes MGAS315
uauuaaccggcucuaaaaua

SEQ ID NO: 2218655 - RNA, 22 nt, Streptococcus pyogenes MGAS315
uauuaaccggcucuaaaauaua

SEQ ID NO: 2218656 - RNA, 20 nt, Streptococcus pyogenes MGAS315
uauuaacguuaacaaaaaua

SEQ ID NO: 2218657 - RNA, 21 nt, Streptococcus pyogenes MGAS315
uauuaagauaccaaaucaaaa

SEQ ID NO: 2218658 - RNA, 20 nt, Streptococcus pyogenes MGAS315
uauuaauaaguauuuuaaaa

SEQ ID NO: 2218659 - RNA, 15 nt, Streptococcus pyogenes MGAS315
uauuaaccaauuccu

SEQ ID NO: 2218660 - RNA, 16 nt, Streptococcus pyogenes MGAS315
uauuacaaaacugucu

SEQ ID NO: 2218661 - RNA, 16 nt, Streptococcus pyogenes MGAS315
uauuaauguaaaaacc

SEQ ID NO: 2218662 - RNA, 17 nt, Streptococcus pyogenes MGAS315
uauuacuucuuuuuguu

SEQ ID NO: 2218663 - RNA, 13 nt, Streptococcus pyogenes MGAS315
uauuuuaaaauag

SEQ ID NO: 2218664 - RNA, 20 nt, Streptococcus pyogenes MGAS315
uauuuuaaaauccucuuuua

SEQ ID NO: 2218665 - RNA, 22 nt, Streptococcus pyogenes MGAS315
uauuuuaaaauccucuuuuaau

SEQ ID NO: 2218666 - RNA, 17 nt, Streptococcus pyogenes MGAS315
uauuugaaguaaaggau

SEQ ID NO: 2218667 - RNA, 23 nt, Streptococcus pyogenes MGAS315
uauuuaauagcauugucaaauaa

SEQ ID NO: 2218668 - RNA, 12 nt, Streptococcus pyogenes MGAS315
uauuuaauagca

SEQ ID NO: 2218669 - RNA, 15 nt, Streptococcus pyogenes MGAS315
uauuuacugggucaa

SEQ ID NO: 2218670 - RNA, 21 nt, Streptococcus pyogenes MGAS315
uauugguugccugaaauauaa

SEQ ID NO: 2218671 - RNA, 20 nt, Streptococcus pyogenes MGAS315
uauuggcaguccaucaaucg

SEQ ID NO: 2218672 - RNA, 16 nt, Streptococcus pyogenes MGAS315
ucaagagucaaaccag

SEQ ID NO: 2218673 - RNA, 18 nt, Streptococcus pyogenes MGAS315
ucaacggcgacucuauca

SEQ ID NO: 2218674 - RNA, 21 nt, Streptococcus pyogenes MGAS315
ucaacggcgacucuaucaacu

SEQ ID NO: 2218675 - RNA, 23 nt, Streptococcus pyogenes MGAS315
ucaaccugcucucauaauuugaa

SEQ ID NO: 2218676 - RNA, 21 nt, Streptococcus pyogenes MGAS315
ucaacagauagucaaaaagac

SEQ ID NO: 2218677 - RNA, 18 nt, Streptococcus pyogenes MGAS315
ucaacaguugcuugcuuu

SEQ ID NO: 2218678 - RNA, 19 nt, Streptococcus pyogenes MGAS315
uauuuugauauuuuuucuc

SEQ ID NO: 2218679 - RNA, 16 nt, Streptococcus pyogenes MGAS315
uauuuugauacgguua

SEQ ID NO: 2218680 - RNA, 15 nt, Streptococcus pyogenes MGAS315
uauuuugauauuuuu

SEQ ID NO: 2218681 - RNA, 14 nt, Streptococcus pyogenes MGAS315
uauuuuucgcacag

SEQ ID NO: 2218682 - RNA, 15 nt, Streptococcus pyogenes MGAS315
ucaaaaaucuuuuuc

SEQ ID NO: 2218683 - RNA, 23 nt, Streptococcus pyogenes MGAS315
ucaaaacuucggccacguuuuuc

SEQ ID NO: 2218684 - RNA, 13 nt, Streptococcus pyogenes MGAS315
ucaaaaaaagaca

SEQ ID NO: 2218685 - RNA, 13 nt, Streptococcus pyogenes MGAS315
ucaaaaaagggaa

SEQ ID NO: 2218686 - RNA, 14 nt, Streptococcus pyogenes MGAS315
ucaaaaaguaaaaa

SEQ ID NO: 2218687 - RNA, 19 nt, Streptococcus pyogenes MGAS315
ucaaaaaauuaagaaggaa

SEQ ID NO: 2218688 - RNA, 12 nt, Streptococcus pyogenes MGAS315
guuuauuuaguu

SEQ ID NO: 2218689 - RNA, 18 nt, Streptococcus pyogenes MGAS315
guuuagaacuuuucaggu

SEQ ID NO: 2218690 - RNA, 14 nt, Streptococcus pyogenes MGAS315
guuucaagugcuag

SEQ ID NO: 2218691 - RNA, 16 nt, Streptococcus pyogenes MGAS315
guuucaagugcuagau

SEQ ID NO: 2218692 - RNA, 16 nt, Streptococcus pyogenes MGAS315
guuuuauaucuaacgu

SEQ ID NO: 2218693 - RNA, 19 nt, Streptococcus pyogenes MGAS315
uaaaaccuucaaaaaaggg

SEQ ID NO: 2218694 - RNA, 13 nt, Streptococcus pyogenes MGAS315
uaaaauagcaccu

SEQ ID NO: 2218695 - RNA, 23 nt, Streptococcus pyogenes MGAS315
uaaaaucaugggaaaagcuaagu

SEQ ID NO: 2218696 - RNA, 19 nt, Streptococcus pyogenes MGAS315
uaaaaguuagccaagcaau

SEQ ID NO: 2218697 - RNA, 22 nt, Streptococcus pyogenes MGAS315
uaaaagaaaaucuaaucagacu

SEQ ID NO: 2218698 - RNA, 15 nt, Streptococcus pyogenes MGAS315
guuuuuugucuucuu

SEQ ID NO: 2218699 - RNA, 13 nt, Streptococcus pyogenes MGAS315
uaaaaaaaucccu

SEQ ID NO: 2218700 - RNA, 20 nt, Streptococcus pyogenes MGAS315
guuuuuuuagcgcuaaaugu

SEQ ID NO: 2218701 - RNA, 13 nt, Streptococcus pyogenes MGAS315
guuuugcaauuaa

SEQ ID NO: 2218702 - RNA, 17 nt, Streptococcus pyogenes MGAS315
guuuugauuaaaucuuc

SEQ ID NO: 2218703 - RNA, 16 nt, Streptococcus pyogenes MGAS315
guuuugucuuaucuaa

SEQ ID NO: 2218704 - RNA, 18 nt, Streptococcus pyogenes MGAS315
uaaccauagaagccaauu

SEQ ID NO: 2218705 - RNA, 14 nt, Streptococcus pyogenes MGAS315
uaaccauugccauu

SEQ ID NO: 2218706 - RNA, 22 nt, Streptococcus pyogenes MGAS315
uaacccgucuuacaauuaauag

SEQ ID NO: 2218707 - RNA, 16 nt, Streptococcus pyogenes MGAS315
uaacaucuugauugua

SEQ ID NO: 2218708 - RNA, 13 nt, Streptococcus pyogenes MGAS315
uaacaucuugauu

SEQ ID NO: 2218709 - RNA, 14 nt, Streptococcus pyogenes MGAS315
uaaccuuugccauu

SEQ ID NO: 2218710 - RNA, 17 nt, Streptococcus pyogenes MGAS315
uaaccuuuuggcuguau

SEQ ID NO: 2218711 - RNA, 18 nt, Streptococcus pyogenes MGAS315
uaacgcuuguuuaugaaa

SEQ ID NO: 2218712 - RNA, 22 nt, Streptococcus pyogenes MGAS315
uaaauugcgacacagauaagau

SEQ ID NO: 2218713 - RNA, 18 nt, Streptococcus pyogenes MGAS315
uaaauugauuauucucua

SEQ ID NO: 2218714 - RNA, 22 nt, Streptococcus pyogenes MGAS315
uaaauuauuaacguuaacaaaa

SEQ ID NO: 2218715 - RNA, 23 nt, Streptococcus pyogenes MGAS315
uaaauuuggagagauaaaaagua

SEQ ID NO: 2218716 - RNA, 21 nt, Streptococcus pyogenes MGAS315
uaaauuuggagagauaaaaag

SEQ ID NO: 2218717 - RNA, 23 nt, Streptococcus pyogenes MGAS315
uaacaaaaugaagcaaaauaaac

SEQ ID NO: 2218718 - RNA, 14 nt, Streptococcus pyogenes MGAS315
uaaacuaauaagau

SEQ ID NO: 2218719 - RNA, 16 nt, Streptococcus pyogenes MGAS315
uaaagccaaccccaag

SEQ ID NO: 2218720 - RNA, 15 nt, Streptococcus pyogenes MGAS315
uaaagaccucucaug

SEQ ID NO: 2218721 - RNA, 16 nt, Streptococcus pyogenes MGAS315
uaaauaaagauaauuu

SEQ ID NO: 2218722 - RNA, 20 nt, Streptococcus pyogenes MGAS315
uaaauaaagauaauuuauuu

SEQ ID NO: 2218723 - RNA, 14 nt, Streptococcus pyogenes MGAS315
uaaaugacaugaaa

SEQ ID NO: 2218724 - RNA, 15 nt, Streptococcus pyogenes MGAS315
uaaauguuggauuuu

SEQ ID NO: 2218725 - RNA, 19 nt, Streptococcus pyogenes MGAS315
uaaauaucuuaccauugua

SEQ ID NO: 2218726 - RNA, 18 nt, Streptococcus pyogenes MGAS315
gucugcgcgacuaaaauc

SEQ ID NO: 2218727 - RNA, 15 nt, Streptococcus pyogenes MGAS315
gucuuauagaauaac

SEQ ID NO: 2218728 - RNA, 22 nt, Streptococcus pyogenes MGAS315
gugaaaguaucuaggagggacu

SEQ ID NO: 2218729 - RNA, 15 nt, Streptococcus pyogenes MGAS315
gugagaacaugugaa

SEQ ID NO: 2218730 - RNA, 13 nt, Streptococcus pyogenes MGAS315
guuauuaaagaca

SEQ ID NO: 2218731 - RNA, 14 nt, Streptococcus pyogenes MGAS315
guuauuaaagacaa

SEQ ID NO: 2218732 - RNA, 19 nt, Streptococcus pyogenes MGAS315
guuauccucuuuuaguuca

SEQ ID NO: 2218733 - RNA, 14 nt, Streptococcus pyogenes MGAS315
guguauuacuucuu

SEQ ID NO: 2218734 - RNA, 17 nt, Streptococcus pyogenes MGAS315
guuaacugguaaaguau

SEQ ID NO: 2218735 - RNA, 19 nt, Streptococcus pyogenes MGAS315
guuaaugccaacuuuucaa

SEQ ID NO: 2218736 - RNA, 20 nt, Streptococcus pyogenes MGAS315
guuaacaaaaauaaguauag

SEQ ID NO: 2218737 - RNA, 16 nt, Streptococcus pyogenes MGAS315
gugggauauuuagaug

SEQ ID NO: 2218738 - RNA, 14 nt, Streptococcus pyogenes MGAS315
guaauagaauaaaa

SEQ ID NO: 2218739 - RNA, 19 nt, Streptococcus pyogenes MGAS315
guaauuugguggaagagua

SEQ ID NO: 2218740 - RNA, 15 nt, Streptococcus pyogenes MGAS315
guaauuucuugugcu

SEQ ID NO: 2218741 - RNA, 15 nt, Streptococcus pyogenes MGAS315
guacacgugauaaau

SEQ ID NO: 2218742 - RNA, 14 nt, Streptococcus pyogenes MGAS315
guauagcauaaaau

SEQ ID NO: 2218743 - RNA, 15 nt, Streptococcus pyogenes MGAS315
guauagcauaaaaua

SEQ ID NO: 2218744 - RNA, 16 nt, Streptococcus pyogenes MGAS315
guaucuaagcuauaga

SEQ ID NO: 2218745 - RNA, 14 nt, Streptococcus pyogenes MGAS315
guaucuaagcuaua

SEQ ID NO: 2218746 - RNA, 14 nt, Streptococcus pyogenes MGAS315
guauuguagaggac

SEQ ID NO: 2218747 - RNA, 20 nt, Streptococcus pyogenes MGAS315
gucgaaauugguccucugaa

SEQ ID NO: 2218748 - RNA, 16 nt, Streptococcus pyogenes MGAS315
gucgaccugcucaaaa

SEQ ID NO: 2218749 - RNA, 18 nt, Streptococcus pyogenes MGAS315
gucuaucugcagauuuua

SEQ ID NO: 2218750 - RNA, 21 nt, Streptococcus pyogenes MGAS315
gucguuuuuugcuuuugauac

SEQ ID NO: 2218751 - RNA, 13 nt, Streptococcus pyogenes MGAS315
gucguuuuuugcu

SEQ ID NO: 2218752 - RNA, 14 nt, Streptococcus pyogenes MGAS315
gucuaccgcuagga

SEQ ID NO: 2218753 - RNA, 13 nt, Streptococcus pyogenes MGAS315
gggacuaggaauc

SEQ ID NO: 2218754 - RNA, 17 nt, Streptococcus pyogenes MGAS315
ggguaaaaugacugaca

SEQ ID NO: 2218755 - RNA, 19 nt, Streptococcus pyogenes MGAS315
gggguaauuugguggaaga

SEQ ID NO: 2218756 - RNA, 14 nt, Streptococcus pyogenes MGAS315
ggucaacuccaauc

SEQ ID NO: 2218757 - RNA, 15 nt, Streptococcus pyogenes MGAS315
ggucauuagaauaag

SEQ ID NO: 2218758 - RNA, 20 nt, Streptococcus pyogenes MGAS315
ggugacacucccgcuuuuaa

SEQ ID NO: 2218759 - RNA, 20 nt, Streptococcus pyogenes MGAS315
gguuucgccuaggaauaaaa

SEQ ID NO: 2218760 - RNA, 13 nt, Streptococcus pyogenes MGAS315
guaaaaagcaaau

SEQ ID NO: 2218761 - RNA, 21 nt, Streptococcus pyogenes MGAS315
guaaaaauacuagaaaaagca

SEQ ID NO: 2218762 - RNA, 22 nt, Streptococcus pyogenes MGAS315
gguuacuggggaguuaccgugu

SEQ ID NO: 2218763 - RNA, 19 nt, Streptococcus pyogenes MGAS315
cucuaacaccaaaaucaua

SEQ ID NO: 2218764 - RNA, 21 nt, Streptococcus pyogenes MGAS315
cucuaacauguccaaaucgua

SEQ ID NO: 2218765 - RNA, 14 nt, Streptococcus pyogenes MGAS315
cucgugaauaauuu

SEQ ID NO: 2218766 - RNA, 21 nt, Streptococcus pyogenes MGAS315
cucgucuuuguccauucuuua

SEQ ID NO: 2218767 - RNA, 20 nt, Streptococcus pyogenes MGAS315
cucaaaaauauauucuaauu

SEQ ID NO: 2218768 - RNA, 21 nt, Streptococcus pyogenes MGAS315
cuauugaaucuuguuuaaccu

SEQ ID NO: 2218769 - RNA, 16 nt, Streptococcus pyogenes MGAS315
cuauugacuugguucu

SEQ ID NO: 2218770 - RNA, 15 nt, Streptococcus pyogenes MGAS315
cuauuguauuugaug

SEQ ID NO: 2218771 - RNA, 17 nt, Streptococcus pyogenes MGAS315
cuauuguauuugauggg

SEQ ID NO: 2218772 - RNA, 21 nt, Streptococcus pyogenes MGAS315
cuauuuaauaggcuuuuuuug

SEQ ID NO: 2218773 - RNA, 16 nt, Streptococcus pyogenes MGAS315
cuauagaaaguaaaaa

SEQ ID NO: 2218774 - RNA, 18 nt, Streptococcus pyogenes MGAS315
cuauagaaaguaaaaaua

SEQ ID NO: 2218775 - RNA, 21 nt, Streptococcus pyogenes MGAS315
cuauagaaaguuauaaagaaa

SEQ ID NO: 2218776 - RNA, 19 nt, Streptococcus pyogenes MGAS315
cuaucucguaauccuugau

SEQ ID NO: 2218777 - RNA, 15 nt, Streptococcus pyogenes MGAS315
cuauggcuucuaaaa

SEQ ID NO: 2218778 - RNA, 19 nt, Streptococcus pyogenes MGAS315
cuauucaauauuuuauuaa

SEQ ID NO: 2218779 - RNA, 17 nt, Streptococcus pyogenes MGAS315
cucaaagggauugcaaa

SEQ ID NO: 2218780 - RNA, 21 nt, Streptococcus pyogenes MGAS315
cuaguguguugucaaacauaa

SEQ ID NO: 2218781 - RNA, 15 nt, Streptococcus pyogenes MGAS315
cuagucuuuuuugug

SEQ ID NO: 2218782 - RNA, 21 nt, Streptococcus pyogenes MGAS315
cuagcuuuuuacaucaaaaaa

SEQ ID NO: 2218783 - RNA, 18 nt, Streptococcus pyogenes MGAS315
cuagcuuugucaacucga

SEQ ID NO: 2218784 - RNA, 14 nt, Streptococcus pyogenes MGAS315
cuagaaaaagcaau

SEQ ID NO: 2218785 - RNA, 12 nt, Streptococcus pyogenes MGAS315
cuagaaaaagca

SEQ ID NO: 2218786 - RNA, 13 nt, Streptococcus pyogenes MGAS315
cuagccaaaucug

SEQ ID NO: 2218787 - RNA, 19 nt, Streptococcus pyogenes MGAS315
cuagaacucuuauaauaaa

SEQ ID NO: 2218788 - RNA, 19 nt, Streptococcus pyogenes MGAS315
cguaccagguuggguauuc

SEQ ID NO: 2218789 - RNA, 19 nt, Streptococcus pyogenes MGAS315
cguauaggugaguuuuuuc

SEQ ID NO: 2218790 - RNA, 23 nt, Streptococcus pyogenes MGAS315
cguauaggugaguuuuuucuaaa

SEQ ID NO: 2218791 - RNA, 18 nt, Streptococcus pyogenes MGAS315
cguaggguguuuuuuagu

SEQ ID NO: 2218792 - RNA, 17 nt, Streptococcus pyogenes MGAS315
cgucuuuguccauucuu

SEQ ID NO: 2218793 - RNA, 15 nt, Streptococcus pyogenes MGAS315
cuaaccugcauaucu

SEQ ID NO: 2218794 - RNA, 23 nt, Streptococcus pyogenes MGAS315
cuaacguuuggggugcaguucau

SEQ ID NO: 2218795 - RNA, 21 nt, Streptococcus pyogenes MGAS315
cuaacaacaacaacccuugau

SEQ ID NO: 2218796 - RNA, 11 nt, Streptococcus pyogenes MGAS315
cuaauaaaaua

SEQ ID NO: 2218797 - RNA, 22 nt, Streptococcus pyogenes MGAS315
cuaaucagacucgucuuugucc

SEQ ID NO: 2218798 - RNA, 20 nt, Streptococcus pyogenes MGAS315
cuaaugcugcaaaauuuuaa

SEQ ID NO: 2218799 - RNA, 12 nt, Streptococcus pyogenes MGAS315
cuaaaaaauaac

SEQ ID NO: 2218800 - RNA, 17 nt, Streptococcus pyogenes MGAS315
cuaaaagcauaaaaaua

SEQ ID NO: 2218801 - RNA, 18 nt, Streptococcus pyogenes MGAS315
cuaaaagcauaaaaauau

SEQ ID NO: 2218802 - RNA, 16 nt, Streptococcus pyogenes MGAS315
cuaaaagcauaaaaau

SEQ ID NO: 2218803 - RNA, 22 nt, Streptococcus pyogenes MGAS315
cguuuggggugcaguucauagu

SEQ ID NO: 2218804 - RNA, 16 nt, Streptococcus pyogenes MGAS315
cguuuguacucgugaa

SEQ ID NO: 2218805 - RNA, 21 nt, Streptococcus pyogenes MGAS315
cguuuuacggcuucuacacaa

SEQ ID NO: 2218806 - RNA, 16 nt, Streptococcus pyogenes MGAS315
cguugauugccauuua

SEQ ID NO: 2218807 - RNA, 17 nt, Streptococcus pyogenes MGAS315
cguuauuaaagacaaaa

SEQ ID NO: 2218808 - RNA, 19 nt, Streptococcus pyogenes MGAS315
cguuauuaaagacaaaaaa

SEQ ID NO: 2218809 - RNA, 17 nt, Streptococcus pyogenes MGAS315
cguuagcagacaaaagg

SEQ ID NO: 2218810 - RNA, 19 nt, Streptococcus pyogenes MGAS315
cugacaaaaaaagcaagca

SEQ ID NO: 2218811 - RNA, 15 nt, Streptococcus pyogenes MGAS315
cugacaaaaaaagca

SEQ ID NO: 2218812 - RNA, 22 nt, Streptococcus pyogenes MGAS315
cugacgauaagucaguuuuuuc

SEQ ID NO: 2218813 - RNA, 12 nt, Streptococcus pyogenes MGAS315
cugacuuaaauu

SEQ ID NO: 2218814 - RNA, 20 nt, Streptococcus pyogenes MGAS315
cugauguacuuuguccuuga

SEQ ID NO: 2218815 - RNA, 20 nt, Streptococcus pyogenes MGAS315
cugagcuaaagccaacccca

SEQ ID NO: 2218816 - RNA, 14 nt, Streptococcus pyogenes MGAS315
cugaguaaaacaau

SEQ ID NO: 2218817 - RNA, 20 nt, Streptococcus pyogenes MGAS315
cugcuagucggguaagggug

SEQ ID NO: 2218818 - RNA, 18 nt, Streptococcus pyogenes MGAS315
cugcucuggcuuuuuccu

SEQ ID NO: 2218819 - RNA, 15 nt, Streptococcus pyogenes MGAS315
cugcuguuggauaca

SEQ ID NO: 2218820 - RNA, 16 nt, Streptococcus pyogenes MGAS315
cuggcuuagcagcacc

SEQ ID NO: 2218821 - RNA, 17 nt, Streptococcus pyogenes MGAS315
cuggcuuagcagcacca

SEQ ID NO: 2218822 - RNA, 15 nt, Streptococcus pyogenes MGAS315
cuguucagucuucug

SEQ ID NO: 2218823 - RNA, 16 nt, Streptococcus pyogenes MGAS315
cuguuugccguguucu

SEQ ID NO: 2218824 - RNA, 15 nt, Streptococcus pyogenes MGAS315
cuuacuaacuagcaa

SEQ ID NO: 2218825 - RNA, 19 nt, Streptococcus pyogenes MGAS315
cuuacaaaaagccuauuua

SEQ ID NO: 2218826 - RNA, 13 nt, Streptococcus pyogenes MGAS315
cuuacaaaaagcc

SEQ ID NO: 2218827 - RNA, 22 nt, Streptococcus pyogenes MGAS315
cuuaauaaacucuauacaaaaa

SEQ ID NO: 2218828 - RNA, 23 nt, Streptococcus pyogenes MGAS315
cuuaauaaacucuauacaaaaag

SEQ ID NO: 2218829 - RNA, 18 nt, Streptococcus pyogenes MGAS315
cuucaccuuaggcagaca

SEQ ID NO: 2218830 - RNA, 16 nt, Streptococcus pyogenes MGAS315
cuucaauuuuugccaa

SEQ ID NO: 2218831 - RNA, 14 nt, Streptococcus pyogenes MGAS315
aaacuuacaaaaag

SEQ ID NO: 2218832 - RNA, 19 nt, Streptococcus pyogenes MGAS315
cuguaaaucaguagugaug

SEQ ID NO: 2218833 - RNA, 20 nt, Streptococcus pyogenes MGAS315
aaacugcacugagccccaaa

SEQ ID NO: 2218834 - RNA, 16 nt, Streptococcus pyogenes MGAS315
aaacucuauacaaaaa

SEQ ID NO: 2218835 - RNA, 19 nt, Streptococcus pyogenes MGAS315
cugucaaaaaauuaagaag

SEQ ID NO: 2218836 - RNA, 21 nt, Streptococcus pyogenes MGAS315
cugucaaaaaauuaagaagga

SEQ ID NO: 2218837 - RNA, 13 nt, Streptococcus pyogenes MGAS315
cuguauaaacuug

SEQ ID NO: 2218838 - RNA, 14 nt, Streptococcus pyogenes MGAS315
cuguauauuuaaua

SEQ ID NO: 2218839 - RNA, 23 nt, Streptococcus pyogenes MGAS315
cuguagcguuuguguugaagaag

SEQ ID NO: 2218840 - RNA, 16 nt, Streptococcus pyogenes MGAS315
gaacuuuguucaucau

SEQ ID NO: 2218841 - RNA, 22 nt, Streptococcus pyogenes MGAS315
gaaggaacucuccaaaguucuu

SEQ ID NO: 2218842 - RNA, 13 nt, Streptococcus pyogenes MGAS315
aaagauauuuuaa

SEQ ID NO: 2218843 - RNA, 13 nt, Streptococcus pyogenes MGAS315
gaauaaaaugccu

SEQ ID NO: 2218844 - RNA, 17 nt, Streptococcus pyogenes MGAS315
gaauuauuaguaaccau

SEQ ID NO: 2218845 - RNA, 21 nt, Streptococcus pyogenes MGAS315
gacuaggaaucgcuuuaggaa

SEQ ID NO: 2218846 - RNA, 19 nt, Streptococcus pyogenes MGAS315
gacuaaccugcauaucugc

SEQ ID NO: 2218847 - RNA, 20 nt, Streptococcus pyogenes MGAS315
gacgauaagucaguuuuuuc

SEQ ID NO: 2218848 - RNA, 12 nt, Streptococcus pyogenes MGAS315
gaccccuuaguu

SEQ ID NO: 2218849 - RNA, 19 nt, Streptococcus pyogenes MGAS315
gaccccuuaguucaaugga

SEQ ID NO: 2218850 - RNA, 16 nt, Streptococcus pyogenes MGAS315
gacaguuaaaaauaac

SEQ ID NO: 2218851 - RNA, 20 nt, Streptococcus pyogenes MGAS315
gacagacaccaaaaaaagca

SEQ ID NO: 2218852 - RNA, 18 nt, Streptococcus pyogenes MGAS315
gacagacaccaaaaaaag

SEQ ID NO: 2218853 - RNA, 14 nt, Streptococcus pyogenes MGAS315
gaaaguaaaaauac

SEQ ID NO: 2218854 - RNA, 19 nt, Streptococcus pyogenes MGAS315
gaaacuaaaggcaauagca

SEQ ID NO: 2218855 - RNA, 21 nt, Streptococcus pyogenes MGAS315
gaaacguuuaggaucuguuaa

SEQ ID NO: 2218856 - RNA, 17 nt, Streptococcus pyogenes MGAS315
gaaacuggucaaaagcu

SEQ ID NO: 2218857 - RNA, 16 nt, Streptococcus pyogenes MGAS315
gaaauucaaauacuuc

SEQ ID NO: 2218858 - RNA, 16 nt, Streptococcus pyogenes MGAS315
gaaauuuuaaaugaca

SEQ ID NO: 2218859 - RNA, 16 nt, Streptococcus pyogenes MGAS315
gaaaugauagcaccua

SEQ ID NO: 2218860 - RNA, 12 nt, Streptococcus pyogenes MGAS315
gaacagcugcuu

SEQ ID NO: 2218861 - RNA, 17 nt, Streptococcus pyogenes MGAS315
gaacuccuggauuaaau

SEQ ID NO: 2218862 - RNA, 20 nt, Streptococcus pyogenes MGAS315
gaacguucuguuuaaaauau

SEQ ID NO: 2218863 - RNA, 19 nt, Streptococcus pyogenes MGAS315
gaacaugugaauucccauu

SEQ ID NO: 2218864 - RNA, 16 nt, Streptococcus pyogenes MGAS315
gaaccgcuaaaacagu

SEQ ID NO: 2218865 - RNA, 19 nt, Streptococcus pyogenes MGAS315
cuuuucguuuuauuuugau

SEQ ID NO: 2218866 - RNA, 19 nt, Streptococcus pyogenes MGAS315
aaagaccccccuagacugu

SEQ ID NO: 2218867 - RNA, 14 nt, Streptococcus pyogenes MGAS315
aaagaccucucaug

SEQ ID NO: 2218868 - RNA, 22 nt, Streptococcus pyogenes MGAS315
cuuuucaauggucacuccuucu

SEQ ID NO: 2218869 - RNA, 19 nt, Streptococcus pyogenes MGAS315
cuuuucagguugcaacaau

SEQ ID NO: 2218870 - RNA, 15 nt, Streptococcus pyogenes MGAS315
cuuuuccaacgugcu

SEQ ID NO: 2218871 - RNA, 13 nt, Streptococcus pyogenes MGAS315
cuuuuaaaaucug

SEQ ID NO: 2218872 - RNA, 12 nt, Streptococcus pyogenes MGAS315
cuuuuaaaaucu

SEQ ID NO: 2218873 - RNA, 20 nt, Streptococcus pyogenes MGAS315
cuuuuuuugucugacuuaaa

SEQ ID NO: 2218874 - RNA, 17 nt, Streptococcus pyogenes MGAS315
cuuuuuuacuuuuaaaa

SEQ ID NO: 2218875 - RNA, 20 nt, Streptococcus pyogenes MGAS315
gaaaagaugcacacaaaucu

SEQ ID NO: 2218876 - RNA, 21 nt, Streptococcus pyogenes MGAS315
gaaaacguguauucuuaaaaa

SEQ ID NO: 2218877 - RNA, 17 nt, Streptococcus pyogenes MGAS315
gaaaacguguauucuua

SEQ ID NO: 2218878 - RNA, 11 nt, Streptococcus pyogenes MGAS315
cuuuauugaug

SEQ ID NO: 2218879 - RNA, 19 nt, Streptococcus pyogenes MGAS315
cuuucaguuaucugauauu

SEQ ID NO: 2218880 - RNA, 17 nt, Streptococcus pyogenes MGAS315
cuuuauuaaucaaaaaa

SEQ ID NO: 2218881 - RNA, 23 nt, Streptococcus pyogenes MGAS315
cuuuaucaacuuguuaacaauaa

SEQ ID NO: 2218882 - RNA, 16 nt, Streptococcus pyogenes MGAS315
cuuuaggaucauuauc

SEQ ID NO: 2218883 - RNA, 13 nt, Streptococcus pyogenes MGAS315
cuuuguugcauug

SEQ ID NO: 2218884 - RNA, 19 nt, Streptococcus pyogenes MGAS315
cuuugacaaugucaauuga

SEQ ID NO: 2218885 - RNA, 14 nt, Streptococcus pyogenes MGAS315
cuuuccauucuugc

SEQ ID NO: 2218886 - RNA, 13 nt, Streptococcus pyogenes MGAS315
gauagugugugug

SEQ ID NO: 2218887 - RNA, 23 nt, Streptococcus pyogenes MGAS315
gauaggucugcaauauccauaga

SEQ ID NO: 2218888 - RNA, 17 nt, Streptococcus pyogenes MGAS315
gauagcaagugagaaca

SEQ ID NO: 2218889 - RNA, 14 nt, Streptococcus pyogenes MGAS315
gauaccuucauaga

SEQ ID NO: 2218890 - RNA, 22 nt, Streptococcus pyogenes MGAS315
gaucauuaaauugauuauucuc

SEQ ID NO: 2218891 - RNA, 15 nt, Streptococcus pyogenes MGAS315
gaucugcacacacuu

SEQ ID NO: 2218892 - RNA, 19 nt, Streptococcus pyogenes MGAS315
gaguaaggaccaagauuca

SEQ ID NO: 2218893 - RNA, 12 nt, Streptococcus pyogenes MGAS315
gagcucuuugag

SEQ ID NO: 2218894 - RNA, 13 nt, Streptococcus pyogenes MGAS315
gaguaugaacaaa

SEQ ID NO: 2218895 - RNA, 14 nt, Streptococcus pyogenes MGAS315
gagcuauuggcagu

SEQ ID NO: 2218896 - RNA, 18 nt, Streptococcus pyogenes MGAS315
gagcaaggcaagaggagg

SEQ ID NO: 2218897 - RNA, 12 nt, Streptococcus pyogenes MGAS315
gagcaaggcaag

SEQ ID NO: 2218898 - RNA, 19 nt, Streptococcus pyogenes MGAS315
gacucaauugaaagaggug

SEQ ID NO: 2218899 - RNA, 17 nt, Streptococcus pyogenes MGAS315
gaugagacuaaccugca

SEQ ID NO: 2218900 - RNA, 23 nt, Streptococcus pyogenes MGAS315
gaugacuuguaaaaugauacuuu

SEQ ID NO: 2218901 - RNA, 15 nt, Streptococcus pyogenes MGAS315
gaugauauuuuucau

SEQ ID NO: 2218902 - RNA, 23 nt, Streptococcus pyogenes MGAS315
aaagccuacaacagcagcaguug

SEQ ID NO: 2218903 - RNA, 15 nt, Streptococcus pyogenes MGAS315
gaugcacacaaaucu

SEQ ID NO: 2218904 - RNA, 16 nt, Streptococcus pyogenes MGAS315
gaugccauuuaaaagg

SEQ ID NO: 2218905 - RNA, 18 nt, Streptococcus pyogenes MGAS315
gaugccauuuaaaagggc

SEQ ID NO: 2218906 - RNA, 20 nt, Streptococcus pyogenes MGAS315
gaugcugcuuaucucuugag

SEQ ID NO: 2218907 - RNA, 14 nt, Streptococcus pyogenes MGAS315
gaugcuucuuucaa

SEQ ID NO: 2218908 - RNA, 16 nt, Streptococcus pyogenes MGAS315
gauuacaagcauuuug

SEQ ID NO: 2218909 - RNA, 13 nt, Streptococcus pyogenes MGAS315
gauucaauaugaa

SEQ ID NO: 2218910 - RNA, 22 nt, Streptococcus pyogenes MGAS315
gauuugaccacaccuaauaaaa

SEQ ID NO: 2218911 - RNA, 16 nt, Streptococcus pyogenes MGAS315
gauuugucaaaaagua

SEQ ID NO: 2218912 - RNA, 20 nt, Streptococcus pyogenes MGAS315
gauuucggaccaugccuaaa

SEQ ID NO: 2218913 - RNA, 17 nt, Streptococcus pyogenes MGAS315
gauuuccucuaacaugu

SEQ ID NO: 2218914 - RNA, 22 nt, Streptococcus pyogenes MGAS315
gauuuccucuaacauguccaaa

SEQ ID NO: 2218915 - RNA, 23 nt, Streptococcus pyogenes MGAS315
gauuuuuccuagcgggaacacuc

SEQ ID NO: 2218916 - RNA, 17 nt, Streptococcus pyogenes MGAS315
gcaaaaaagccagugcu

SEQ ID NO: 2218917 - RNA, 21 nt, Streptococcus pyogenes MGAS315
gcaaaaaagccagugcugcug

SEQ ID NO: 2218918 - RNA, 19 nt, Streptococcus pyogenes MGAS315
gcaaagaaagccaagacua

SEQ ID NO: 2218919 - RNA, 18 nt, Streptococcus pyogenes MGAS315
gcccccucuuuaccauuu

SEQ ID NO: 2218920 - RNA, 14 nt, Streptococcus pyogenes MGAS315
gccauuuaaaaggg

SEQ ID NO: 2218921 - RNA, 14 nt, Streptococcus pyogenes MGAS315
gccaucaaaaaaag

SEQ ID NO: 2218922 - RNA, 15 nt, Streptococcus pyogenes MGAS315
gcccagaaauaaucu

SEQ ID NO: 2218923 - RNA, 14 nt, Streptococcus pyogenes MGAS315
gcccuggagcuguu

SEQ ID NO: 2218924 - RNA, 21 nt, Streptococcus pyogenes MGAS315
gccaaaucuucugcauuauca

SEQ ID NO: 2218925 - RNA, 17 nt, Streptococcus pyogenes MGAS315
gcauuuugcaagucucu

SEQ ID NO: 2218926 - RNA, 17 nt, Streptococcus pyogenes MGAS315
gcauguccuaaccuuuu

SEQ ID NO: 2218927 - RNA, 15 nt, Streptococcus pyogenes MGAS315
gcaucuuugcagggu

SEQ ID NO: 2218928 - RNA, 17 nt, Streptococcus pyogenes MGAS315
gcaugauuuaguuuuua

SEQ ID NO: 2218929 - RNA, 19 nt, Streptococcus pyogenes MGAS315
gcaucuacguacgcuguaa

SEQ ID NO: 2218930 - RNA, 22 nt, Streptococcus pyogenes MGAS315
gcaucuacguacgcuguaaugu

SEQ ID NO: 2218931 - RNA, 15 nt, Streptococcus pyogenes MGAS315
gcaucgcaaacagau

SEQ ID NO: 2218932 - RNA, 13 nt, Streptococcus pyogenes MGAS315
gcaggcguuuugu

SEQ ID NO: 2218933 - RNA, 13 nt, Streptococcus pyogenes MGAS315
gcaguucgauuau

SEQ ID NO: 2218934 - RNA, 19 nt, Streptococcus pyogenes MGAS315
gcaguucgauuauuaacca

SEQ ID NO: 2218935 - RNA, 23 nt, Streptococcus pyogenes MGAS315
gcaguugcgaucauaaauaaaga

SEQ ID NO: 2218936 - RNA, 22 nt, Streptococcus pyogenes MGAS315
gcauaaaagauauuuuaaaaua

SEQ ID NO: 2218937 - RNA, 17 nt, Streptococcus pyogenes MGAS315
gcaggguaucugcucag

SEQ ID NO: 2218938 - RNA, 19 nt, Streptococcus pyogenes MGAS315
gccguccuuaaaagaaaau

SEQ ID NO: 2218939 - RNA, 14 nt, Streptococcus pyogenes MGAS315
gccuacaacagcag

SEQ ID NO: 2218940 - RNA, 15 nt, Streptococcus pyogenes MGAS315
aaauaacuuuaaaag

SEQ ID NO: 2218941 - RNA, 13 nt, Streptococcus pyogenes MGAS315
aaauaaucaaccu

SEQ ID NO: 2218942 - RNA, 16 nt, Streptococcus pyogenes MGAS315
ggcuucuaaaaaaguu

SEQ ID NO: 2218943 - RNA, 17 nt, Streptococcus pyogenes MGAS315
ggcuuuccauucuugca

SEQ ID NO: 2218944 - RNA, 12 nt, Streptococcus pyogenes MGAS315
gggcaaugccau

SEQ ID NO: 2218945 - RNA, 17 nt, Streptococcus pyogenes MGAS315
ggggugcaguucauagu

SEQ ID NO: 2218946 - RNA, 14 nt, Streptococcus pyogenes MGAS315
gguaaaaaggcagu

SEQ ID NO: 2218947 - RNA, 20 nt, Streptococcus pyogenes MGAS315
gguaaaaacucaaaaaauac

SEQ ID NO: 2218948 - RNA, 15 nt, Streptococcus pyogenes MGAS315
gguaaugcuuuuuaa

SEQ ID NO: 2218949 - RNA, 22 nt, Streptococcus pyogenes MGAS315
gguaagaagaaaauaucaguua

SEQ ID NO: 2218950 - RNA, 24 nt, Streptococcus pyogenes MGAS315
gguagaugauuauauuaggauaug

SEQ ID NO: 2218951 - RNA, 18 nt, Streptococcus pyogenes MGAS315
ggucauuauugucacuga

SEQ ID NO: 2218952 - RNA, 15 nt, Streptococcus pyogenes MGAS315
ggaacacucaucaua

SEQ ID NO: 2218953 - RNA, 13 nt, Streptococcus pyogenes MGAS315
aaagggaagaaga

SEQ ID NO: 2218954 - RNA, 22 nt, Streptococcus pyogenes MGAS315
ggacacuuugaaaguuccuuag

SEQ ID NO: 2218955 - RNA, 22 nt, Streptococcus pyogenes MGAS315
aaaguaauaaguagcguacaug

SEQ ID NO: 2218956 - RNA, 16 nt, Streptococcus pyogenes MGAS315
ggccaauaaaauaucu

SEQ ID NO: 2218957 - RNA, 13 nt, Streptococcus pyogenes MGAS315
gcuguuggauaca

SEQ ID NO: 2218958 - RNA, 14 nt, Streptococcus pyogenes MGAS315
gcuuguucuuuauu

SEQ ID NO: 2218959 - RNA, 14 nt, Streptococcus pyogenes MGAS315
gcugcgaugauuuu

SEQ ID NO: 2218960 - RNA, 14 nt, Streptococcus pyogenes MGAS315
gcugcaaaauuuua

SEQ ID NO: 2218961 - RNA, 15 nt, Streptococcus pyogenes MGAS315
gcugauaggucugca

SEQ ID NO: 2218962 - RNA, 18 nt, Streptococcus pyogenes MGAS315
gcugaucucccgucaaca

SEQ ID NO: 2218963 - RNA, 15 nt, Streptococcus pyogenes MGAS315
uaaacuuacaaaaag

SEQ ID NO: 2218964 - RNA, 12 nt, Streptococcus pyogenes MGAS315
uaaagacaaaaa

SEQ ID NO: 2218965 - RNA, 21 nt, Streptococcus pyogenes MGAS315
uaaacacuaccuuaaauguau

SEQ ID NO: 2218966 - RNA, 23 nt, Streptococcus pyogenes MGAS315
uaaacacuaccuuaaauguauga

SEQ ID NO: 2218967 - RNA, 22 nt, Streptococcus pyogenes MGAS315
guuuuucaaugcgcucaagcau

SEQ ID NO: 2218968 - RNA, 13 nt, Streptococcus pyogenes MGAS315
uaaagcaucagca

SEQ ID NO: 2218969 - RNA, 16 nt, Streptococcus pyogenes MGAS315
uaaagcaucagcauaa

SEQ ID NO: 2218970 - RNA, 14 nt, Streptococcus pyogenes MGAS315
uaaagauaauuuau

SEQ ID NO: 2218971 - RNA, 15 nt, Streptococcus pyogenes MGAS315
uaaaguaauaaguag

SEQ ID NO: 2218972 - RNA, 16 nt, Streptococcus pyogenes MGAS315
uaaauauaaauuauua

SEQ ID NO: 2218973 - RNA, 21 nt, Streptococcus pyogenes MGAS315
uaaauauccaaugaaaacucc

SEQ ID NO: 2218974 - RNA, 17 nt, Streptococcus pyogenes MGAS315
uaacagaaauuaauaaa

SEQ ID NO: 2218975 - RNA, 14 nt, Streptococcus pyogenes MGAS315
uaaccacagcaauu

SEQ ID NO: 2218976 - RNA, 15 nt, Streptococcus pyogenes MGAS315
uaacaaaaauaagua

SEQ ID NO: 2218977 - RNA, 13 nt, Streptococcus pyogenes MGAS315
uaacaaaaauaag

SEQ ID NO: 2218978 - RNA, 17 nt, Streptococcus pyogenes MGAS315
uaaauccuuuugaaaaa

SEQ ID NO: 2218979 - RNA, 15 nt, Streptococcus pyogenes MGAS315
uaauaacaaaaugaa

SEQ ID NO: 2218980 - RNA, 15 nt, Streptococcus pyogenes MGAS315
uaauaaacucuauac

SEQ ID NO: 2218981 - RNA, 18 nt, Streptococcus pyogenes MGAS315
uaaguaauguguuguaua

SEQ ID NO: 2218982 - RNA, 18 nt, Streptococcus pyogenes MGAS315
uaaguccuuuucguuuua

SEQ ID NO: 2218983 - RNA, 17 nt, Streptococcus pyogenes MGAS315
uaaguauuuuaaaaucc

SEQ ID NO: 2218984 - RNA, 13 nt, Streptococcus pyogenes MGAS315
uaaguaaaagcga

SEQ ID NO: 2218985 - RNA, 14 nt, Streptococcus pyogenes MGAS315
uaaguaagauggug

SEQ ID NO: 2218986 - RNA, 14 nt, Streptococcus pyogenes MGAS315
uaaguaauguguug

SEQ ID NO: 2218987 - RNA, 14 nt, Streptococcus pyogenes MGAS315
uaaggguuaacaau

SEQ ID NO: 2218988 - RNA, 15 nt, Streptococcus pyogenes MGAS315
uaagcauuuugagaa

SEQ ID NO: 2218989 - RNA, 21 nt, Streptococcus pyogenes MGAS315
uaagcaucauuauugacaaau

SEQ ID NO: 2218990 - RNA, 15 nt, Streptococcus pyogenes MGAS315
uaagcaaucaucauu

SEQ ID NO: 2218991 - RNA, 15 nt, Streptococcus pyogenes MGAS315
uaaggaccaagauuc

SEQ ID NO: 2218992 - RNA, 17 nt, Streptococcus pyogenes MGAS315
uaaggcugcgaugauuu

SEQ ID NO: 2218993 - RNA, 19 nt, Streptococcus pyogenes MGAS315
uaagcugaguaaaacaaua

SEQ ID NO: 2218994 - RNA, 22 nt, Streptococcus pyogenes MGAS315
uaagacaaagacguuuuacuua

SEQ ID NO: 2218995 - RNA, 21 nt, Streptococcus pyogenes MGAS315
uaagaagaaaauaucaguuaa

SEQ ID NO: 2218996 - RNA, 21 nt, Streptococcus pyogenes MGAS315
uaagagcguuagcuuuuuaaa

SEQ ID NO: 2218997 - RNA, 18 nt, Streptococcus pyogenes MGAS315
uaacugguccaucauuga

SEQ ID NO: 2218998 - RNA, 14 nt, Streptococcus pyogenes MGAS315
uaacguuuggggug

SEQ ID NO: 2218999 - RNA, 18 nt, Streptococcus pyogenes MGAS315
uaacguuuggggugcagu

SEQ ID NO: 2219000 - RNA, 20 nt, Streptococcus pyogenes MGAS315
uaacuauuuaacuuaucauu

SEQ ID NO: 2219001 - RNA, 21 nt, Streptococcus pyogenes MGAS315
uaacuauuuaacuuaucauuu

SEQ ID NO: 2219002 - RNA, 13 nt, Streptococcus pyogenes MGAS315
uaauagaauaaaa

SEQ ID NO: 2219003 - RNA, 15 nt, Streptococcus pyogenes MGAS315
uaauagaauaaaaaa

SEQ ID NO: 2219004 - RNA, 14 nt, Streptococcus pyogenes MGAS315
uaauaaguauuuua

SEQ ID NO: 2219005 - RNA, 19 nt, Streptococcus pyogenes MGAS315
uaauaaguauuuuaaaauc

SEQ ID NO: 2219006 - RNA, 20 nt, Streptococcus pyogenes MGAS315
uaauaaguauuuuaaaaucc

SEQ ID NO: 2219007 - RNA, 22 nt, Streptococcus pyogenes MGAS315
uaauaagauucaauaugaaaac

SEQ ID NO: 2219008 - RNA, 20 nt, Streptococcus pyogenes MGAS315
uaauaagauucaauaugaaa

SEQ ID NO: 2219009 - RNA, 12 nt, Streptococcus pyogenes MGAS315
uaauaagauuca

SEQ ID NO: 2219010 - RNA, 16 nt, Streptococcus pyogenes MGAS315
uaauccaacaacgcua

SEQ ID NO: 2219011 - RNA, 16 nt, Streptococcus pyogenes MGAS315
uaauauguaacgcuug

SEQ ID NO: 2219012 - RNA, 15 nt, Streptococcus pyogenes MGAS315
uaaugauucaauauc

SEQ ID NO: 2219013 - RNA, 18 nt, Streptococcus pyogenes MGAS315
uaaugauucaauaucaua

SEQ ID NO: 2219014 - RNA, 21 nt, Streptococcus pyogenes MGAS315
uaaugauucaauaucauauuu

SEQ ID NO: 2219015 - RNA, 16 nt, Streptococcus pyogenes MGAS315
uaaugucauacaaaaa

SEQ ID NO: 2219016 - RNA, 11 nt, Streptococcus pyogenes MGAS315
uaauuagcaua

SEQ ID NO: 2219017 - RNA, 19 nt, Streptococcus pyogenes MGAS315
uaauuccugugacaaccca

SEQ ID NO: 2219018 - RNA, 16 nt, Streptococcus pyogenes MGAS315
uaauguuuuuacauuu

SEQ ID NO: 2219019 - RNA, 23 nt, Streptococcus pyogenes MGAS315
uaauguuaggagcacaaaagagg

SEQ ID NO: 2219020 - RNA, 18 nt, Streptococcus pyogenes MGAS315
uacaagagcuuaaaaguu

SEQ ID NO: 2219021 - RNA, 15 nt, Streptococcus pyogenes MGAS315
uacaagagcuuaaaa

SEQ ID NO: 2219022 - RNA, 16 nt, Streptococcus pyogenes MGAS315
uacaagagcuuaaaag

SEQ ID NO: 2219023 - RNA, 15 nt, Streptococcus pyogenes MGAS315
uacaagcauuuugca

SEQ ID NO: 2219024 - RNA, 13 nt, Streptococcus pyogenes MGAS315
uacaacagcagca

SEQ ID NO: 2219025 - RNA, 19 nt, Streptococcus pyogenes MGAS315
uacaaaaaaccuuccugua

SEQ ID NO: 2219026 - RNA, 16 nt, Streptococcus pyogenes MGAS315
uacaguauguaaauau

SEQ ID NO: 2219027 - RNA, 14 nt, Streptococcus pyogenes MGAS315
uacaucaaaaaaag

SEQ ID NO: 2219028 - RNA, 17 nt, Streptococcus pyogenes MGAS315
uaccaaaucaaaaagcu

SEQ ID NO: 2219029 - RNA, 15 nt, Streptococcus pyogenes MGAS315
uaccaaaucaaaaag

SEQ ID NO: 2219030 - RNA, 23 nt, Streptococcus pyogenes MGAS315
uaccauuuaugaggccaauaaug

SEQ ID NO: 2219031 - RNA, 14 nt, Streptococcus pyogenes MGAS315
uaccaucaaugacu

SEQ ID NO: 2219032 - RNA, 15 nt, Streptococcus pyogenes MGAS315
uacccgagcaacaaa

SEQ ID NO: 2219033 - RNA, 12 nt, Streptococcus pyogenes MGAS315
uacugcccuuga

SEQ ID NO: 2219034 - RNA, 14 nt, Streptococcus pyogenes MGAS315
uacuucaaggaagg

SEQ ID NO: 2219035 - RNA, 18 nt, Streptococcus pyogenes MGAS315
uacuagcacaaaaucauu

SEQ ID NO: 2219036 - RNA, 16 nt, Streptococcus pyogenes MGAS315
uacuagaaaaagcaau

SEQ ID NO: 2219037 - RNA, 13 nt, Streptococcus pyogenes MGAS315
uacugauaaacuu

SEQ ID NO: 2219038 - RNA, 19 nt, Streptococcus pyogenes MGAS315
uacggcuucuacacaaaag

SEQ ID NO: 2219039 - RNA, 13 nt, Streptococcus pyogenes MGAS315
uacuaacaacaac

SEQ ID NO: 2219040 - RNA, 18 nt, Streptococcus pyogenes MGAS315
uacuaauauuauauuaau

SEQ ID NO: 2219041 - RNA, 22 nt, Streptococcus pyogenes MGAS315
uacuaauauuauauuaaugauu

SEQ ID NO: 2219042 - RNA, 15 nt, Streptococcus pyogenes MGAS315
uacuaauauuauauu

SEQ ID NO: 2219043 - RNA, 22 nt, Streptococcus pyogenes MGAS315
gucaucaaaagaccauaaaaaa

SEQ ID NO: 2219044 - RNA, 18 nt, Streptococcus pyogenes MGAS315
guccuaaccuuuuggcug

SEQ ID NO: 2219045 - RNA, 15 nt, Streptococcus pyogenes MGAS315
gucgaccugcucaaa

SEQ ID NO: 2219046 - RNA, 17 nt, Streptococcus pyogenes MGAS315
gucuggaaacuggucaa

SEQ ID NO: 2219047 - RNA, 14 nt, Streptococcus pyogenes MGAS315
gucugagugacuaa

SEQ ID NO: 2219048 - RNA, 17 nt, Streptococcus pyogenes MGAS315
gucugcaugaagugguu

SEQ ID NO: 2219049 - RNA, 18 nt, Streptococcus pyogenes MGAS315
gucuucuccgacugcagu

SEQ ID NO: 2219050 - RNA, 16 nt, Streptococcus pyogenes MGAS315
gucuuuguccauucuu

SEQ ID NO: 2219051 - RNA, 19 nt, Streptococcus pyogenes MGAS315
aaauagcaaugguuaaaaa

SEQ ID NO: 2219052 - RNA, 17 nt, Streptococcus pyogenes MGAS315
gugaggacuuauuuuuu

SEQ ID NO: 2219053 - RNA, 19 nt, Streptococcus pyogenes MGAS315
gugacacucccgcuuuuaa

SEQ ID NO: 2219054 - RNA, 21 nt, Streptococcus pyogenes MGAS315
aaaucaaaaagcuaacaccau

SEQ ID NO: 2219055 - RNA, 20 nt, Streptococcus pyogenes MGAS315
guuucggaaaacuuuugacu

SEQ ID NO: 2219056 - RNA, 13 nt, Streptococcus pyogenes MGAS315
guuuuauuuugau

SEQ ID NO: 2219057 - RNA, 15 nt, Streptococcus pyogenes MGAS315
guuguauuaugaggu

SEQ ID NO: 2219058 - RNA, 18 nt, Streptococcus pyogenes MGAS315
guuaacaaaaauaaguau

SEQ ID NO: 2219059 - RNA, 15 nt, Streptococcus pyogenes MGAS315
guuaacaauaaguau

SEQ ID NO: 2219060 - RNA, 12 nt, Streptococcus pyogenes MGAS315
guuaacagguga

SEQ ID NO: 2219061 - RNA, 16 nt, Streptococcus pyogenes MGAS315
guuaucugauauuuca

SEQ ID NO: 2219062 - RNA, 17 nt, Streptococcus pyogenes MGAS315
guuauagcuccuaaaac

SEQ ID NO: 2219063 - RNA, 19 nt, Streptococcus pyogenes MGAS315
guuaggagcacaaaagagg

SEQ ID NO: 2219064 - RNA, 19 nt, Streptococcus pyogenes MGAS315
guuaccguguucgauaaau

SEQ ID NO: 2219065 - RNA, 21 nt, Streptococcus pyogenes MGAS315
guuccuuagcaguuauaauua

SEQ ID NO: 2219066 - RNA, 19 nt, Streptococcus pyogenes MGAS315
guuauuggugcaauaaucg

SEQ ID NO: 2219067 - RNA, 14 nt, Streptococcus pyogenes MGAS315
aaauauauucuaau

SEQ ID NO: 2219068 - RNA, 14 nt, Streptococcus pyogenes MGAS315
aaauauauuuugga

SEQ ID NO: 2219069 - RNA, 11 nt, Streptococcus pyogenes MGAS315
guguuauccuc

SEQ ID NO: 2219070 - RNA, 17 nt, Streptococcus pyogenes MGAS315
aaauauaaauuauuaac

SEQ ID NO: 2219071 - RNA, 13 nt, Streptococcus pyogenes MGAS315
aaauauaaauuau

SEQ ID NO: 2219072 - RNA, 21 nt, Streptococcus pyogenes MGAS315
guggauacaagguuaaguaaa

SEQ ID NO: 2219073 - RNA, 20 nt, Streptococcus pyogenes MGAS315
ucagcauaaccuuugccauu

SEQ ID NO: 2219074 - RNA, 18 nt, Streptococcus pyogenes MGAS315
aaaucucagaagcuuuau

SEQ ID NO: 2219075 - RNA, 13 nt, Streptococcus pyogenes MGAS315
ucaguauacucag

SEQ ID NO: 2219076 - RNA, 14 nt, Streptococcus pyogenes MGAS315
ucaguauacucagu

SEQ ID NO: 2219077 - RNA, 23 nt, Streptococcus pyogenes MGAS315
aaaucuaaucagacucgucuuug

SEQ ID NO: 2219078 - RNA, 19 nt, Streptococcus pyogenes MGAS315
ucagauaaaaccuucaaaa

SEQ ID NO: 2219079 - RNA, 15 nt, Streptococcus pyogenes MGAS315
ucagagacaauaagg

SEQ ID NO: 2219080 - RNA, 19 nt, Streptococcus pyogenes MGAS315
ucagagaugcuucuuucaa

SEQ ID NO: 2219081 - RNA, 20 nt, Streptococcus pyogenes MGAS315
ucagagcuuuuuuuguuuug

SEQ ID NO: 2219082 - RNA, 21 nt, Streptococcus pyogenes MGAS315
ucacugcagcaucaaaaccaa

SEQ ID NO: 2219083 - RNA, 12 nt, Streptococcus pyogenes MGAS315
ucacuauaauuu

SEQ ID NO: 2219084 - RNA, 15 nt, Streptococcus pyogenes MGAS315
ucacuauaauuucaa

SEQ ID NO: 2219085 - RNA, 20 nt, Streptococcus pyogenes MGAS315
ucaaacuauauuguuaguuu

SEQ ID NO: 2219086 - RNA, 18 nt, Streptococcus pyogenes MGAS315
ucaaaagaccauaaaaaa

SEQ ID NO: 2219087 - RNA, 14 nt, Streptococcus pyogenes MGAS315
uauuuaauagcauu

SEQ ID NO: 2219088 - RNA, 15 nt, Streptococcus pyogenes MGAS315
ucaacaguugcuugc

SEQ ID NO: 2219089 - RNA, 21 nt, Streptococcus pyogenes MGAS315
ucaacaguugcuugcuuuuuu

SEQ ID NO: 2219090 - RNA, 17 nt, Streptococcus pyogenes MGAS315
ucaacaaucuuaaaaua

SEQ ID NO: 2219091 - RNA, 18 nt, Streptococcus pyogenes MGAS315
ucaacaaucuuaaaauaa

SEQ ID NO: 2219092 - RNA, 13 nt, Streptococcus pyogenes MGAS315
ucaaucauuuuua

SEQ ID NO: 2219093 - RNA, 17 nt, Streptococcus pyogenes MGAS315
ucaauaacagaaauuaa

SEQ ID NO: 2219094 - RNA, 14 nt, Streptococcus pyogenes MGAS315
ucaauauaauaaaa

SEQ ID NO: 2219095 - RNA, 13 nt, Streptococcus pyogenes MGAS315
ucaauagcugcug

SEQ ID NO: 2219096 - RNA, 17 nt, Streptococcus pyogenes MGAS315
ucaauauaauaaaaagc

SEQ ID NO: 2219097 - RNA, 15 nt, Streptococcus pyogenes MGAS315
ucaauaucauauuuu

SEQ ID NO: 2219098 - RNA, 15 nt, Streptococcus pyogenes MGAS315
uauuaaauaauacag

SEQ ID NO: 2219099 - RNA, 13 nt, Streptococcus pyogenes MGAS315
uauuaaagacaaa

SEQ ID NO: 2219100 - RNA, 15 nt, Streptococcus pyogenes MGAS315
uauuaaagacaaaaa

SEQ ID NO: 2219101 - RNA, 16 nt, Streptococcus pyogenes MGAS315
uauuaaugauucaaua

SEQ ID NO: 2219102 - RNA, 15 nt, Streptococcus pyogenes MGAS315
uauuaaucaaaaaac

SEQ ID NO: 2219103 - RNA, 19 nt, Streptococcus pyogenes MGAS315
uauuaauaaguauuuuaaa

SEQ ID NO: 2219104 - RNA, 13 nt, Streptococcus pyogenes MGAS315
uauuacaaauaac

SEQ ID NO: 2219105 - RNA, 19 nt, Streptococcus pyogenes MGAS315
uauguaacgcuuguuuaug

SEQ ID NO: 2219106 - RNA, 22 nt, Streptococcus pyogenes MGAS315
uauguaacgcuuguuuaugaaa

SEQ ID NO: 2219107 - RNA, 16 nt, Streptococcus pyogenes MGAS315
uauguuauaagagaag

SEQ ID NO: 2219108 - RNA, 20 nt, Streptococcus pyogenes MGAS315
uauguugcuuaaugaccuuu

SEQ ID NO: 2219109 - RNA, 15 nt, Streptococcus pyogenes MGAS315
uauuguuaauauagu

SEQ ID NO: 2219110 - RNA, 14 nt, Streptococcus pyogenes MGAS315
uauuguuaguuuua

SEQ ID NO: 2219111 - RNA, 14 nt, Streptococcus pyogenes MGAS315
uaucucguaauccu

SEQ ID NO: 2219112 - RNA, 18 nt, Streptococcus pyogenes MGAS315
uaucucauaacaaauuua

SEQ ID NO: 2219113 - RNA, 18 nt, Streptococcus pyogenes MGAS315
uaucugauaagguuuuuu

SEQ ID NO: 2219114 - RNA, 14 nt, Streptococcus pyogenes MGAS315
uaucuagaacagcu

SEQ ID NO: 2219115 - RNA, 18 nt, Streptococcus pyogenes MGAS315
uaucuagaacagcugcuu

SEQ ID NO: 2219116 - RNA, 23 nt, Streptococcus pyogenes MGAS315
uaugauuugucaaaaaguaaaaa

SEQ ID NO: 2219117 - RNA, 18 nt, Streptococcus pyogenes MGAS315
uauggcuucuaaaaaagu

SEQ ID NO: 2219118 - RNA, 16 nt, Streptococcus pyogenes MGAS315
uauggcuauaaaugga

SEQ ID NO: 2219119 - RNA, 14 nt, Streptococcus pyogenes MGAS315
uauccuccuaaaua

SEQ ID NO: 2219120 - RNA, 20 nt, Streptococcus pyogenes MGAS315
uauccuccuaaauauaaauu

SEQ ID NO: 2219121 - RNA, 17 nt, Streptococcus pyogenes MGAS315
uauccucuuuuaguuca

SEQ ID NO: 2219122 - RNA, 14 nt, Streptococcus pyogenes MGAS315
uaucagauacuagu

SEQ ID NO: 2219123 - RNA, 20 nt, Streptococcus pyogenes MGAS315
uauauuuuaguugauauuuu

SEQ ID NO: 2219124 - RNA, 23 nt, Streptococcus pyogenes MGAS315
uauaguaaccauugccauuaaua

SEQ ID NO: 2219125 - RNA, 18 nt, Streptococcus pyogenes MGAS315
uauaaugguuuuuugucu

SEQ ID NO: 2219126 - RNA, 13 nt, Streptococcus pyogenes MGAS315
uaguugauauuuu

SEQ ID NO: 2219127 - RNA, 20 nt, Streptococcus pyogenes MGAS315
uauaaccucuagcuugugag

SEQ ID NO: 2219128 - RNA, 20 nt, Streptococcus pyogenes MGAS315
uagucagaucauuaaauuga

SEQ ID NO: 2219129 - RNA, 15 nt, Streptococcus pyogenes MGAS315
uaguaaccauugcca

SEQ ID NO: 2219130 - RNA, 17 nt, Streptococcus pyogenes MGAS315
uaguaaccauugccauu

SEQ ID NO: 2219131 - RNA, 14 nt, Streptococcus pyogenes MGAS315
uagguuaaaauaga

SEQ ID NO: 2219132 - RNA, 14 nt, Streptococcus pyogenes MGAS315
uaguuaauaagaca

SEQ ID NO: 2219133 - RNA, 21 nt, Streptococcus pyogenes MGAS315
uagucuuuuuugugaucuguu

SEQ ID NO: 2219134 - RNA, 20 nt, Streptococcus pyogenes MGAS315
uagucuaggcguauagguga

SEQ ID NO: 2219135 - RNA, 22 nt, Streptococcus pyogenes MGAS315
uccuuguacaagagcuuaaaag

SEQ ID NO: 2219136 - RNA, 17 nt, Streptococcus pyogenes MGAS315
uccuuuacuguaauauu

SEQ ID NO: 2219137 - RNA, 14 nt, Streptococcus pyogenes MGAS315
uccuuuuaaagaca

SEQ ID NO: 2219138 - RNA, 13 nt, Streptococcus pyogenes MGAS315
uccuuugaccaca

SEQ ID NO: 2219139 - RNA, 17 nt, Streptococcus pyogenes MGAS315
ucgcagaguacaaggca

SEQ ID NO: 2219140 - RNA, 21 nt, Streptococcus pyogenes MGAS315
uccggcaggggucauuauugu

SEQ ID NO: 2219141 - RNA, 16 nt, Streptococcus pyogenes MGAS315
uccuaaaaccauaccu

SEQ ID NO: 2219142 - RNA, 12 nt, Streptococcus pyogenes MGAS315
uccguuugagau

SEQ ID NO: 2219143 - RNA, 18 nt, Streptococcus pyogenes MGAS315
uccuaaccuuuuggcugu

SEQ ID NO: 2219144 - RNA, 16 nt, Streptococcus pyogenes MGAS315
uccuaaacuaauaaga

SEQ ID NO: 2219145 - RNA, 16 nt, Streptococcus pyogenes MGAS315
uccuaucagauacuag

SEQ ID NO: 2219146 - RNA, 13 nt, Streptococcus pyogenes MGAS315
uccucugaaaagu

SEQ ID NO: 2219147 - RNA, 15 nt, Streptococcus pyogenes MGAS315
uccuccuaaauauaa

SEQ ID NO: 2219148 - RNA, 12 nt, Streptococcus pyogenes MGAS315
ucccauguuuua

SEQ ID NO: 2219149 - RNA, 18 nt, Streptococcus pyogenes MGAS315
uccccuccuugcaauaga

SEQ ID NO: 2219150 - RNA, 18 nt, Streptococcus pyogenes MGAS315
aaaucuggcuuagcagca

SEQ ID NO: 2219151 - RNA, 15 nt, Streptococcus pyogenes MGAS315
uccauuauaaaucuu

SEQ ID NO: 2219152 - RNA, 17 nt, Streptococcus pyogenes MGAS315
uccaucugcacaugcuu

SEQ ID NO: 2219153 - RNA, 20 nt, Streptococcus pyogenes MGAS315
uccaucaaucgugauugauu

SEQ ID NO: 2219154 - RNA, 22 nt, Streptococcus pyogenes MGAS315
uccaguucuguuucuaagcaaa

SEQ ID NO: 2219155 - RNA, 17 nt, Streptococcus pyogenes MGAS315
uccaagaucugcacaca

SEQ ID NO: 2219156 - RNA, 19 nt, Streptococcus pyogenes MGAS315
uccaagaucugcacacacu

SEQ ID NO: 2219157 - RNA, 17 nt, Streptococcus pyogenes MGAS315
uccaaugaaaacuccag

SEQ ID NO: 2219158 - RNA, 11 nt, Streptococcus pyogenes MGAS315
ucauuuugguu

SEQ ID NO: 2219159 - RNA, 16 nt, Streptococcus pyogenes MGAS315
ucauuagaauaagaaa

SEQ ID NO: 2219160 - RNA, 19 nt, Streptococcus pyogenes MGAS315
ucauuagaauaagaaaacc

SEQ ID NO: 2219161 - RNA, 22 nt, Streptococcus pyogenes MGAS315
ucauuagaauaagaaaaccuua

SEQ ID NO: 2219162 - RNA, 16 nt, Streptococcus pyogenes MGAS315
ucauuaguuaauaaga

SEQ ID NO: 2219163 - RNA, 20 nt, Streptococcus pyogenes MGAS315
ucauuaguuaauaagacaaa

SEQ ID NO: 2219164 - RNA, 20 nt, Streptococcus pyogenes MGAS315
ucauuaucaacaaucuuaaa

SEQ ID NO: 2219165 - RNA, 15 nt, Streptococcus pyogenes MGAS315
ugaugagacuaaccu

SEQ ID NO: 2219166 - RNA, 21 nt, Streptococcus pyogenes MGAS315
ugaugaguaggcgaacuuuau

SEQ ID NO: 2219167 - RNA, 12 nt, Streptococcus pyogenes MGAS315
ugaugauggagu

SEQ ID NO: 2219168 - RNA, 20 nt, Streptococcus pyogenes MGAS315
ugauuuuaacguuuugaacu

SEQ ID NO: 2219169 - RNA, 13 nt, Streptococcus pyogenes MGAS315
ugauugccauuua

SEQ ID NO: 2219170 - RNA, 21 nt, Streptococcus pyogenes MGAS315
ugcaaauaguggcaaaugaca

SEQ ID NO: 2219171 - RNA, 17 nt, Streptococcus pyogenes MGAS315
ugcaauauccauagaaa

SEQ ID NO: 2219172 - RNA, 20 nt, Streptococcus pyogenes MGAS315
ugcaauauccauagaaauug

SEQ ID NO: 2219173 - RNA, 20 nt, Streptococcus pyogenes MGAS315
ugcacacaaaucuucuagaa

SEQ ID NO: 2219174 - RNA, 18 nt, Streptococcus pyogenes MGAS315
ugcaguucauaguugugc

SEQ ID NO: 2219175 - RNA, 19 nt, Streptococcus pyogenes MGAS315
ugagauaccuucauagaca

SEQ ID NO: 2219176 - RNA, 18 nt, Streptococcus pyogenes MGAS315
ugaguuuuuucuaaaaga

SEQ ID NO: 2219177 - RNA, 20 nt, Streptococcus pyogenes MGAS315
ugaguuuuuucuaaaagaga

SEQ ID NO: 2219178 - RNA, 23 nt, Streptococcus pyogenes MGAS315
ugagucuuuaucguaaacaaucu

SEQ ID NO: 2219179 - RNA, 15 nt, Streptococcus pyogenes MGAS315
ugaggugacacuccc

SEQ ID NO: 2219180 - RNA, 16 nt, Streptococcus pyogenes MGAS315
ugaggugauucuuuuu

SEQ ID NO: 2219181 - RNA, 14 nt, Streptococcus pyogenes MGAS315
ugaggcucugcuga

SEQ ID NO: 2219182 - RNA, 13 nt, Streptococcus pyogenes MGAS315
ugauauaaaauug

SEQ ID NO: 2219183 - RNA, 13 nt, Streptococcus pyogenes MGAS315
ugauauaaaaaug

SEQ ID NO: 2219184 - RNA, 14 nt, Streptococcus pyogenes MGAS315
ugauauaaaaaugg

SEQ ID NO: 2219185 - RNA, 18 nt, Streptococcus pyogenes MGAS315
ugauaagguuuuuuuaag

SEQ ID NO: 2219186 - RNA, 16 nt, Streptococcus pyogenes MGAS315
ugaucuguuuaaaaac

SEQ ID NO: 2219187 - RNA, 17 nt, Streptococcus pyogenes MGAS315
ugaucuguuaugugaug

SEQ ID NO: 2219188 - RNA, 18 nt, Streptococcus pyogenes MGAS315
ugagaacaugugaauucc

SEQ ID NO: 2219189 - RNA, 22 nt, Streptococcus pyogenes MGAS315
ugacucugauccgaguuuugcu

SEQ ID NO: 2219190 - RNA, 14 nt, Streptococcus pyogenes MGAS315
ugaccagauacuuc

SEQ ID NO: 2219191 - RNA, 23 nt, Streptococcus pyogenes MGAS315
ugacauuucgugucuaaaauaau

SEQ ID NO: 2219192 - RNA, 12 nt, Streptococcus pyogenes MGAS315
ucugaauuauua

SEQ ID NO: 2219193 - RNA, 12 nt, Streptococcus pyogenes MGAS315
ucugcugauuga

SEQ ID NO: 2219194 - RNA, 16 nt, Streptococcus pyogenes MGAS315
ucugcugauugagacc

SEQ ID NO: 2219195 - RNA, 20 nt, Streptococcus pyogenes MGAS315
ucuggaaacuggucaaaagc

SEQ ID NO: 2219196 - RNA, 19 nt, Streptococcus pyogenes MGAS315
ucuucauagcuuaauguca

SEQ ID NO: 2219197 - RNA, 16 nt, Streptococcus pyogenes MGAS315
ucuuaauuuauauuuu

SEQ ID NO: 2219198 - RNA, 16 nt, Streptococcus pyogenes MGAS315
ucuguuucuaagcaaa

SEQ ID NO: 2219199 - RNA, 14 nt, Streptococcus pyogenes MGAS315
ucuuaaaauaauca

SEQ ID NO: 2219200 - RNA, 19 nt, Streptococcus pyogenes MGAS315
ucuuaaaauaaucaaccug

SEQ ID NO: 2219201 - RNA, 14 nt, Streptococcus pyogenes MGAS315
ucuucuaaacguuu

SEQ ID NO: 2219202 - RNA, 22 nt, Streptococcus pyogenes MGAS315
ucuucuaaaacgaugagauuaa

SEQ ID NO: 2219203 - RNA, 19 nt, Streptococcus pyogenes MGAS315
ucuucuuuuuauuauacuc

SEQ ID NO: 2219204 - RNA, 23 nt, Streptococcus pyogenes MGAS315
ucuucuuuuuauuauacucaaua

SEQ ID NO: 2219205 - RNA, 13 nt, Streptococcus pyogenes MGAS315
ucuugcauuaccu

SEQ ID NO: 2219206 - RNA, 23 nt, Streptococcus pyogenes MGAS315
ucuuuauuuugauauuuuuucuc

SEQ ID NO: 2219207 - RNA, 14 nt, Streptococcus pyogenes MGAS315
ucuuuaccauuuau

SEQ ID NO: 2219208 - RNA, 20 nt, Streptococcus pyogenes MGAS315
ucuuguuuugguugauauaa

SEQ ID NO: 2219209 - RNA, 13 nt, Streptococcus pyogenes MGAS315
ucuuguuuugguu

SEQ ID NO: 2219210 - RNA, 22 nt, Streptococcus pyogenes MGAS315
ucuugugccuacuccucucaca

SEQ ID NO: 2219211 - RNA, 23 nt, Streptococcus pyogenes MGAS315
ucuuguuuugguugauauaaaau

SEQ ID NO: 2219212 - RNA, 15 nt, Streptococcus pyogenes MGAS315
ucuuugacaauguca

SEQ ID NO: 2219213 - RNA, 18 nt, Streptococcus pyogenes MGAS315
ucuuuggagaaauucaaa

SEQ ID NO: 2219214 - RNA, 19 nt, Streptococcus pyogenes MGAS315
ucuuucaguuguuuuaacu

SEQ ID NO: 2219215 - RNA, 12 nt, Streptococcus pyogenes MGAS315
ucuuuuauuaau

SEQ ID NO: 2219216 - RNA, 16 nt, Streptococcus pyogenes MGAS315
ucuuuuauuaauguaa

SEQ ID NO: 2219217 - RNA, 13 nt, Streptococcus pyogenes MGAS315
ucuuuuaguucag

SEQ ID NO: 2219218 - RNA, 17 nt, Streptococcus pyogenes MGAS315
ucuuuguccauucuuua

SEQ ID NO: 2219219 - RNA, 14 nt, Streptococcus pyogenes MGAS315
ugaaccgcuaaaac

SEQ ID NO: 2219220 - RNA, 16 nt, Streptococcus pyogenes MGAS315
ugaaaaagccuuuaca

SEQ ID NO: 2219221 - RNA, 18 nt, Streptococcus pyogenes MGAS315
ugaaaaaaucgcccugga

SEQ ID NO: 2219222 - RNA, 17 nt, Streptococcus pyogenes MGAS315
ugaaaacguguauucuu

SEQ ID NO: 2219223 - RNA, 17 nt, Streptococcus pyogenes MGAS315
ugaaaauaucuuuuuua

SEQ ID NO: 2219224 - RNA, 21 nt, Streptococcus pyogenes MGAS315
ugaaaauaucuuuuuuacuuu

SEQ ID NO: 2219225 - RNA, 19 nt, Streptococcus pyogenes MGAS315
aaaugucuagcuuaucuuc

SEQ ID NO: 2219226 - RNA, 16 nt, Streptococcus pyogenes MGAS315
ugcuguuugucauacu

SEQ ID NO: 2219227 - RNA, 17 nt, Streptococcus pyogenes MGAS315
ugcuguuugucauacuc

SEQ ID NO: 2219228 - RNA, 23 nt, Streptococcus pyogenes MGAS315
ugcuguuugucauacucaauagc

SEQ ID NO: 2219229 - RNA, 19 nt, Streptococcus pyogenes MGAS315
ugcuguuggauacagucca

SEQ ID NO: 2219230 - RNA, 13 nt, Streptococcus pyogenes MGAS315
ugcuucuuaucac

SEQ ID NO: 2219231 - RNA, 12 nt, Streptococcus pyogenes MGAS315
ugcuuuaaaaag

SEQ ID NO: 2219232 - RNA, 13 nt, Streptococcus pyogenes MGAS315
ugcuuuaaaaagu

SEQ ID NO: 2219233 - RNA, 13 nt, Streptococcus pyogenes MGAS315
ugcuuuuuuuguc

SEQ ID NO: 2219234 - RNA, 21 nt, Streptococcus pyogenes MGAS315
uggacgaaggcucuuaucuuu

SEQ ID NO: 2219235 - RNA, 12 nt, Streptococcus pyogenes MGAS315
uggacgaaggcu

SEQ ID NO: 2219236 - RNA, 19 nt, Streptococcus pyogenes MGAS315
uggacaaucuuaaguuagg

SEQ ID NO: 2219237 - RNA, 14 nt, Streptococcus pyogenes MGAS315
ugcuagucuuuuuu

SEQ ID NO: 2219238 - RNA, 14 nt, Streptococcus pyogenes MGAS315
ugcucaaaacuucg

SEQ ID NO: 2219239 - RNA, 13 nt, Streptococcus pyogenes MGAS315
ugcguuuauaaag

SEQ ID NO: 2219240 - RNA, 21 nt, Streptococcus pyogenes MGAS315
ugcgacacagauaagauacug

SEQ ID NO: 2219241 - RNA, 18 nt, Streptococcus pyogenes MGAS315
uguaaauauaaagucaga

SEQ ID NO: 2219242 - RNA, 19 nt, Streptococcus pyogenes MGAS315
uguaaaucaguagugauga

SEQ ID NO: 2219243 - RNA, 13 nt, Streptococcus pyogenes MGAS315
ugguuuuaauauu

SEQ ID NO: 2219244 - RNA, 17 nt, Streptococcus pyogenes MGAS315
uguaauguuguaaacuu

SEQ ID NO: 2219245 - RNA, 23 nt, Streptococcus pyogenes MGAS315
uguaauaacaaaaugaagcaaaa

SEQ ID NO: 2219246 - RNA, 23 nt, Streptococcus pyogenes MGAS315
uggucuaccgcuaggauuuuucc

SEQ ID NO: 2219247 - RNA, 16 nt, Streptococcus pyogenes MGAS315
uggugcuacugaugua

SEQ ID NO: 2219248 - RNA, 12 nt, Streptococcus pyogenes MGAS315
ugguuaaaaaga

SEQ ID NO: 2219249 - RNA, 20 nt, Streptococcus pyogenes MGAS315
ugguguuauccucuuuuagu

SEQ ID NO: 2219250 - RNA, 13 nt, Streptococcus pyogenes MGAS315
ugguuaaaaagag

SEQ ID NO: 2219251 - RNA, 14 nt, Streptococcus pyogenes MGAS315
ugguuaaaaagaga

SEQ ID NO: 2219252 - RNA, 15 nt, Streptococcus pyogenes MGAS315
uguauuucuuuagua

SEQ ID NO: 2219253 - RNA, 15 nt, Streptococcus pyogenes MGAS315
uguauucuuaaaaaa

SEQ ID NO: 2219254 - RNA, 17 nt, Streptococcus pyogenes MGAS315
ugucaggggaauuuccu

SEQ ID NO: 2219255 - RNA, 20 nt, Streptococcus pyogenes MGAS315
uguccuaaccuuuuggcugu

SEQ ID NO: 2219256 - RNA, 18 nt, Streptococcus pyogenes MGAS315
uguccuaaccuuuuggcu

SEQ ID NO: 2219257 - RNA, 14 nt, Streptococcus pyogenes MGAS315
uguccuaaccuuuu

SEQ ID NO: 2219258 - RNA, 16 nt, Streptococcus pyogenes MGAS315
ugucguuuuuugcuuu

SEQ ID NO: 2219259 - RNA, 19 nt, Streptococcus pyogenes MGAS315
ugucuucuccgacugcagu

SEQ ID NO: 2219260 - RNA, 14 nt, Streptococcus pyogenes MGAS315
uggguaaaaugacu

SEQ ID NO: 2219261 - RNA, 16 nt, Streptococcus pyogenes MGAS315
uggagagauaaaaagu

SEQ ID NO: 2219262 - RNA, 21 nt, Streptococcus pyogenes MGAS315
uggagagauuucguugacaaa

SEQ ID NO: 2219263 - RNA, 15 nt, Streptococcus pyogenes MGAS315
uggaucguuuugcaa

SEQ ID NO: 2219264 - RNA, 20 nt, Streptococcus pyogenes MGAS315
uggauauaacaacucccucc

SEQ ID NO: 2219265 - RNA, 14 nt, Streptococcus pyogenes MGAS315
uuaaccuccuaaac

SEQ ID NO: 2219266 - RNA, 15 nt, Streptococcus pyogenes MGAS315
uuaacuauuuaacuu

SEQ ID NO: 2219267 - RNA, 22 nt, Streptococcus pyogenes MGAS315
uuaacuauuuaacuuaucauuu

SEQ ID NO: 2219268 - RNA, 23 nt, Streptococcus pyogenes MGAS315
uuaagacaacauacuuuauuaau

SEQ ID NO: 2219269 - RNA, 12 nt, Streptococcus pyogenes MGAS315
uuaaucaaaaaa

SEQ ID NO: 2219270 - RNA, 23 nt, Streptococcus pyogenes MGAS315
uuaauagcauugucaaauaaaau

SEQ ID NO: 2219271 - RNA, 22 nt, Streptococcus pyogenes MGAS315
uuaauaggcuuuuuuuguaucu

SEQ ID NO: 2219272 - RNA, 20 nt, Streptococcus pyogenes MGAS315
uuaauagcauugucaaauaa

SEQ ID NO: 2219273 - RNA, 15 nt, Streptococcus pyogenes MGAS315
uuaaucaaaaaacug

SEQ ID NO: 2219274 - RNA, 18 nt, Streptococcus pyogenes MGAS315
uuaauaaguauuuuaaaa

SEQ ID NO: 2219275 - RNA, 15 nt, Streptococcus pyogenes MGAS315
uuaaugucauacaaa

SEQ ID NO: 2219276 - RNA, 21 nt, Streptococcus pyogenes MGAS315
uuaguaccguuagcagacaaa

SEQ ID NO: 2219277 - RNA, 16 nt, Streptococcus pyogenes MGAS315
uuaguguagauaaacu

SEQ ID NO: 2219278 - RNA, 15 nt, Streptococcus pyogenes MGAS315
uuaguuaauaagaca

SEQ ID NO: 2219279 - RNA, 23 nt, Streptococcus pyogenes MGAS315
uuauaauuugacuucaaaaauac

SEQ ID NO: 2219280 - RNA, 18 nt, Streptococcus pyogenes MGAS315
uuacucaauuaauguuag

SEQ ID NO: 2219281 - RNA, 13 nt, Streptococcus pyogenes MGAS315
uuacuuuuaaaau

SEQ ID NO: 2219282 - RNA, 19 nt, Streptococcus pyogenes MGAS315
uuagcugauaaucuucaau

SEQ ID NO: 2219283 - RNA, 15 nt, Streptococcus pyogenes MGAS315
uuagcuuuuuaaaga

SEQ ID NO: 2219284 - RNA, 21 nt, Streptococcus pyogenes MGAS315
uuaggaauauuacuucucaaa

SEQ ID NO: 2219285 - RNA, 13 nt, Streptococcus pyogenes MGAS315
uuagaauaagaaa

SEQ ID NO: 2219286 - RNA, 14 nt, Streptococcus pyogenes MGAS315
uuagaauaagaaaa

SEQ ID NO: 2219287 - RNA, 17 nt, Streptococcus pyogenes MGAS315
uuagcagacaaaaggga

SEQ ID NO: 2219288 - RNA, 20 nt, Streptococcus pyogenes MGAS315
uuagagucucuuaauuuaua

SEQ ID NO: 2219289 - RNA, 16 nt, Streptococcus pyogenes MGAS315
uucaaacggaguucuc

SEQ ID NO: 2219290 - RNA, 14 nt, Streptococcus pyogenes MGAS315
uuauuuuugagaua

SEQ ID NO: 2219291 - RNA, 17 nt, Streptococcus pyogenes MGAS315
uucaaaaauacuaccuu

SEQ ID NO: 2219292 - RNA, 19 nt, Streptococcus pyogenes MGAS315
uucaauauuuuauuaauaa

SEQ ID NO: 2219293 - RNA, 21 nt, Streptococcus pyogenes MGAS315
uucaauauuuuauuaauaagu

SEQ ID NO: 2219294 - RNA, 18 nt, Streptococcus pyogenes MGAS315
uucaauaugaaaacgugu

SEQ ID NO: 2219295 - RNA, 15 nt, Streptococcus pyogenes MGAS315
uucaauauuuuauua

SEQ ID NO: 2219296 - RNA, 17 nt, Streptococcus pyogenes MGAS315
uucaccguggacuugau

SEQ ID NO: 2219297 - RNA, 23 nt, Streptococcus pyogenes MGAS315
uucagagcacguuuucugguuuu

SEQ ID NO: 2219298 - RNA, 21 nt, Streptococcus pyogenes MGAS315
uucacuauaauuucaauaaua

SEQ ID NO: 2219299 - RNA, 20 nt, Streptococcus pyogenes MGAS315
uuauguuauaagagaaguaa

SEQ ID NO: 2219300 - RNA, 20 nt, Streptococcus pyogenes MGAS315
uuauuaacguuaacaaaaau

SEQ ID NO: 2219301 - RNA, 23 nt, Streptococcus pyogenes MGAS315
uuauuaaccaauuccucccuauu

SEQ ID NO: 2219302 - RNA, 18 nt, Streptococcus pyogenes MGAS315
uuauuaaccaauuccucc

SEQ ID NO: 2219303 - RNA, 18 nt, Streptococcus pyogenes MGAS315
uuauuaacguuaacaaaa

SEQ ID NO: 2219304 - RNA, 18 nt, Streptococcus pyogenes MGAS315
uuaucugauauuucaucu

SEQ ID NO: 2219305 - RNA, 17 nt, Streptococcus pyogenes MGAS315
uuaucuaaaggagcuuu

SEQ ID NO: 2219306 - RNA, 15 nt, Streptococcus pyogenes MGAS315
uuaucaaaccaaggu

SEQ ID NO: 2219307 - RNA, 20 nt, Streptococcus pyogenes MGAS315
uuauaugucaucaaaagacc

SEQ ID NO: 2219308 - RNA, 12 nt, Streptococcus pyogenes MGAS315
uuaucaguauac

SEQ ID NO: 2219309 - RNA, 14 nt, Streptococcus pyogenes MGAS315
uucuauuaccuaua

SEQ ID NO: 2219310 - RNA, 19 nt, Streptococcus pyogenes MGAS315
uucuagguuaaaauagaag

SEQ ID NO: 2219311 - RNA, 17 nt, Streptococcus pyogenes MGAS315
uucgucaagcaccuuga

SEQ ID NO: 2219312 - RNA, 14 nt, Streptococcus pyogenes MGAS315
uuccuuuuccaacg

SEQ ID NO: 2219313 - RNA, 18 nt, Streptococcus pyogenes MGAS315
uucgccuaggaauaaaau

SEQ ID NO: 2219314 - RNA, 21 nt, Streptococcus pyogenes MGAS315
uucgccuaggaauaaaaugcc

SEQ ID NO: 2219315 - RNA, 20 nt, Streptococcus pyogenes MGAS315
uucgccuaggaauaaaaugc

SEQ ID NO: 2219316 - RNA, 16 nt, Streptococcus pyogenes MGAS315
uuccagaacaugggag

SEQ ID NO: 2219317 - RNA, 21 nt, Streptococcus pyogenes MGAS315
uuccagaacaugggagcgcac

SEQ ID NO: 2219318 - RNA, 13 nt, Streptococcus pyogenes MGAS315
uuccuacaaaaua

SEQ ID NO: 2219319 - RNA, 14 nt, Streptococcus pyogenes MGAS315
uuccuacaaaauaa

SEQ ID NO: 2219320 - RNA, 19 nt, Streptococcus pyogenes MGAS315
uucccaaugccccaaagua

SEQ ID NO: 2219321 - RNA, 20 nt, Streptococcus pyogenes MGAS315
uugauuuuucuuguuuuggu

SEQ ID NO: 2219322 - RNA, 18 nt, Streptococcus pyogenes MGAS315
uugauugccauuuaauug

SEQ ID NO: 2219323 - RNA, 22 nt, Streptococcus pyogenes MGAS315
uugcaaauaguggcaaaugaca

SEQ ID NO: 2219324 - RNA, 18 nt, Streptococcus pyogenes MGAS315
uugauauuuuuucucaaa

SEQ ID NO: 2219325 - RNA, 22 nt, Streptococcus pyogenes MGAS315
uugauauuuuuucucaaaaaua

SEQ ID NO: 2219326 - RNA, 23 nt, Streptococcus pyogenes MGAS315
uugauauuuuuucucaaaaauau

SEQ ID NO: 2219327 - RNA, 18 nt, Streptococcus pyogenes MGAS315
uugaaagaggugcaacug

SEQ ID NO: 2219328 - RNA, 13 nt, Streptococcus pyogenes MGAS315
uucuuuuuccguu

SEQ ID NO: 2219329 - RNA, 16 nt, Streptococcus pyogenes MGAS315
uucuuuuucguauacu

SEQ ID NO: 2219330 - RNA, 13 nt, Streptococcus pyogenes MGAS315
uucuuuucagaga

SEQ ID NO: 2219331 - RNA, 12 nt, Streptococcus pyogenes MGAS315
uucuuuuuuacc

SEQ ID NO: 2219332 - RNA, 23 nt, Streptococcus pyogenes MGAS315
uucuuuauuuugauauuuuuucu

SEQ ID NO: 2219333 - RNA, 12 nt, Streptococcus pyogenes MGAS315
uucugcauuauc

SEQ ID NO: 2219334 - RNA, 14 nt, Streptococcus pyogenes MGAS315
uugaauguuguauu

SEQ ID NO: 2219335 - RNA, 21 nt, Streptococcus pyogenes MGAS315
uugaauaucgccaauaaaaaa

SEQ ID NO: 2219336 - RNA, 24 nt, Streptococcus pyogenes MGAS315
uugaccacaccuaauaaaauagca

SEQ ID NO: 2219337 - RNA, 13 nt, Streptococcus pyogenes MGAS315
uugaccacaccua

SEQ ID NO: 2219338 - RNA, 22 nt, Streptococcus pyogenes MGAS315
uugacagacaccaaaaaaagca

SEQ ID NO: 2219339 - RNA, 18 nt, Streptococcus pyogenes MGAS315
uugacagacaccaaaaaa

SEQ ID NO: 2219340 - RNA, 16 nt, Streptococcus pyogenes MGAS315
uugacaguuaaaaaua

SEQ ID NO: 2219341 - RNA, 14 nt, Streptococcus pyogenes MGAS315
uugacuauuuuucg

SEQ ID NO: 2219342 - RNA, 18 nt, Streptococcus pyogenes MGAS315
uuuaacuauuuaacuuau

SEQ ID NO: 2219343 - RNA, 21 nt, Streptococcus pyogenes MGAS315
uuuagcuuauaauuugacuuc

SEQ ID NO: 2219344 - RNA, 15 nt, Streptococcus pyogenes MGAS315
uuuagccguccuuaa

SEQ ID NO: 2219345 - RNA, 21 nt, Streptococcus pyogenes MGAS315
uuuacuauggcuucuaaaaaa

SEQ ID NO: 2219346 - RNA, 13 nt, Streptococcus pyogenes MGAS315
uuuaggucuaauu

SEQ ID NO: 2219347 - RNA, 19 nt, Streptococcus pyogenes MGAS315
uuguuaguuuuauccccua

SEQ ID NO: 2219348 - RNA, 17 nt, Streptococcus pyogenes MGAS315
uuuaaaagggcugaccu

SEQ ID NO: 2219349 - RNA, 17 nt, Streptococcus pyogenes MGAS315
uuguuuaaccuccuaaa

SEQ ID NO: 2219350 - RNA, 15 nt, Streptococcus pyogenes MGAS315
uuuaacaugauguac

SEQ ID NO: 2219351 - RNA, 19 nt, Streptococcus pyogenes MGAS315
uuuaaccuccuaaacuaau

SEQ ID NO: 2219352 - RNA, 19 nt, Streptococcus pyogenes MGAS315
uuuaaacacuaccuuaaau

SEQ ID NO: 2219353 - RNA, 21 nt, Streptococcus pyogenes MGAS315
uuuaaaauccucuuuuaauuu

SEQ ID NO: 2219354 - RNA, 20 nt, Streptococcus pyogenes MGAS315
uuucaauaauaccauuuuua

SEQ ID NO: 2219355 - RNA, 23 nt, Streptococcus pyogenes MGAS315
uuuauuuugauauuuuuucucaa

SEQ ID NO: 2219356 - RNA, 16 nt, Streptococcus pyogenes MGAS315
uuuauuuugauauuuu

SEQ ID NO: 2219357 - RNA, 18 nt, Streptococcus pyogenes MGAS315
uuuauacgguaaaaacuc

SEQ ID NO: 2219358 - RNA, 17 nt, Streptococcus pyogenes MGAS315
uuucauuugaaauuccu

SEQ ID NO: 2219359 - RNA, 20 nt, Streptococcus pyogenes MGAS315
uuugcugaaauaucuuucag

SEQ ID NO: 2219360 - RNA, 14 nt, Streptococcus pyogenes MGAS315
uuucuuguuuuggu

SEQ ID NO: 2219361 - RNA, 16 nt, Streptococcus pyogenes MGAS315
uuugacuucaaaaaua

SEQ ID NO: 2219362 - RNA, 21 nt, Streptococcus pyogenes MGAS315
uuugagauaguuagcaaauug

SEQ ID NO: 2219363 - RNA, 23 nt, Streptococcus pyogenes MGAS315
uuugaccgaaaaaggcaaagaaa

SEQ ID NO: 2219364 - RNA, 14 nt, Streptococcus pyogenes MGAS315
uuuccuacaaaaua

SEQ ID NO: 2219365 - RNA, 18 nt, Streptococcus pyogenes MGAS315
uuuccuagcgggaacacu

SEQ ID NO: 2219366 - RNA, 21 nt, Streptococcus pyogenes MGAS315
uuucggaaaacuuuugacuug

SEQ ID NO: 2219367 - RNA, 16 nt, Streptococcus pyogenes MGAS315
uuucggacuguuuuuu

SEQ ID NO: 2219368 - RNA, 15 nt, Streptococcus pyogenes MGAS315
uuucgugucuaaaau

SEQ ID NO: 2219369 - RNA, 20 nt, Streptococcus pyogenes MGAS315
uuucucagagacaauaaggu

SEQ ID NO: 2219370 - RNA, 17 nt, Streptococcus pyogenes MGAS315
uuuucagagaugcuucu

SEQ ID NO: 2219371 - RNA, 18 nt, Streptococcus pyogenes MGAS315
uuuucaaagggagauucu

SEQ ID NO: 2219372 - RNA, 15 nt, Streptococcus pyogenes MGAS315
uuuucccaucaauag

SEQ ID NO: 2219373 - RNA, 19 nt, Streptococcus pyogenes MGAS315
uuuuauagcugauuuguuu

SEQ ID NO: 2219374 - RNA, 19 nt, Streptococcus pyogenes MGAS315
uuuuaguugauauuuuuua

SEQ ID NO: 2219375 - RNA, 13 nt, Streptococcus pyogenes MGAS315
uuuuacuuuuaaa

SEQ ID NO: 2219376 - RNA, 18 nt, Streptococcus pyogenes MGAS315
uuuuaugauuugucaaaa

SEQ ID NO: 2219377 - RNA, 16 nt, Streptococcus pyogenes MGAS315
uuuuauuauacucaau

SEQ ID NO: 2219378 - RNA, 23 nt, Streptococcus pyogenes MGAS315
uuuuauuaauaaguauuuuaaaa

SEQ ID NO: 2219379 - RNA, 22 nt, Streptococcus pyogenes MGAS315
uuugucuucuucuuuucagaga

SEQ ID NO: 2219380 - RNA, 15 nt, Streptococcus pyogenes MGAS315
uuugucaaaaaguaa

SEQ ID NO: 2219381 - RNA, 21 nt, Streptococcus pyogenes MGAS315
uuugucaaaaaguaaaaagca

SEQ ID NO: 2219382 - RNA, 17 nt, Streptococcus pyogenes MGAS315
uuuguaucucauaacaa

SEQ ID NO: 2219383 - RNA, 18 nt, Streptococcus pyogenes MGAS315
uuugcugagcuaaagcca

SEQ ID NO: 2219384 - RNA, 15 nt, Streptococcus pyogenes MGAS315
uuuggagagaccuug

SEQ ID NO: 2219385 - RNA, 15 nt, Streptococcus pyogenes MGAS315
uuugggaaaaacacc

SEQ ID NO: 2219386 - RNA, 19 nt, Streptococcus pyogenes MGAS315
uuuggccuacuagcacaaa

SEQ ID NO: 2219387 - RNA, 22 nt, Streptococcus pyogenes MGAS315
uuuggccuacuagcacaaaauc

SEQ ID NO: 2219388 - RNA, 21 nt, Streptococcus pyogenes MGAS315
uuugguguuauccucuuuuag

SEQ ID NO: 2219389 - RNA, 22 nt, Streptococcus pyogenes MGAS315
uuuuaagauuaaacuuacaaaa

SEQ ID NO: 2219390 - RNA, 14 nt, Streptococcus pyogenes MGAS315
uuuguuuucuuuag

SEQ ID NO: 2219391 - RNA, 19 nt, Streptococcus pyogenes MGAS315
uuuuaaauaucuuaccauu

SEQ ID NO: 2219392 - RNA, 21 nt, Streptococcus pyogenes MGAS315
uuuuaaaauccucuuuuaauu

SEQ ID NO: 2219393 - RNA, 16 nt, Streptococcus pyogenes MGAS315
uuuugauuuucucagu

SEQ ID NO: 2219394 - RNA, 20 nt, Streptococcus pyogenes MGAS315
uuuuuagcgcuaaaugucua

SEQ ID NO: 2219395 - RNA, 12 nt, Streptococcus pyogenes MGAS315
uuuuuaucugua

SEQ ID NO: 2219396 - RNA, 16 nt, Streptococcus pyogenes MGAS315
uuuugguugauauaaa

SEQ ID NO: 2219397 - RNA, 14 nt, Streptococcus pyogenes MGAS315
uuuugguuaucagu

SEQ ID NO: 2219398 - RNA, 17 nt, Streptococcus pyogenes MGAS315
uuuugucguuuuuugcu

SEQ ID NO: 2219399 - RNA, 17 nt, Streptococcus pyogenes MGAS315
uuuugucugacuuaaau

SEQ ID NO: 2219400 - RNA, 15 nt, Streptococcus pyogenes MGAS315
uuuugugauauguuu

SEQ ID NO: 2219401 - RNA, 14 nt, Streptococcus pyogenes MGAS315
uuuuuuauacggua

SEQ ID NO: 2219402 - RNA, 15 nt, Streptococcus pyogenes MGAS315
aaaugugguaagaag

SEQ ID NO: 2219403 - RNA, 19 nt, Streptococcus pyogenes MGAS315
aaaugugguaagaagaaaa

SEQ ID NO: 2219404 - RNA, 19 nt, Streptococcus pyogenes MGAS315
aaauguucgaaaaaauacu

SEQ ID NO: 2219405 - RNA, 15 nt, Streptococcus pyogenes MGAS315
aaauuaagaaggaac

SEQ ID NO: 2219406 - RNA, 23 nt, Streptococcus pyogenes MGAS315
uuuuucucaaaaauauauucuaa

SEQ ID NO: 2219407 - RNA, 14 nt, Streptococcus pyogenes MGAS315
uuuuuguauuacuc

SEQ ID NO: 2219408 - RNA, 15 nt, Streptococcus pyogenes MGAS315
uuuuuguauuacuca

SEQ ID NO: 2219409 - RNA, 19 nt, Streptococcus pyogenes MGAS315
aaauuccuuaaauuauauu

SEQ ID NO: 2219410 - RNA, 13 nt, Streptococcus pyogenes MGAS315
aaauucaaauacu

SEQ ID NO: 2219411 - RNA, 17 nt, Streptococcus pyogenes MGAS315
aaauuauuauuuugcuu

SEQ ID NO: 2219412 - RNA, 23 nt, Streptococcus pyogenes MGAS315
aaauuauauuauacuaauauuau

SEQ ID NO: 2219413 - RNA, 13 nt, Streptococcus pyogenes MGAS315
aauaccauuuuua

SEQ ID NO: 2219414 - RNA, 14 nt, Streptococcus pyogenes MGAS315
aauaccauuuuuau

SEQ ID NO: 2219415 - RNA, 20 nt, Streptococcus pyogenes MGAS315
aauaguucccuuaauaaacu

SEQ ID NO: 2219416 - RNA, 19 nt, Streptococcus pyogenes MGAS315
aauagcugcugcuaaagca

SEQ ID NO: 2219417 - RNA, 16 nt, Streptococcus pyogenes MGAS315
aauagcugcugcuaaa

SEQ ID NO: 2219418 - RNA, 18 nt, Streptococcus pyogenes MGAS315
aauaucgccaauaaaaaa

SEQ ID NO: 2219419 - RNA, 16 nt, Streptococcus pyogenes MGAS315
aauauaauaaaaagca

SEQ ID NO: 2219420 - RNA, 21 nt, Streptococcus pyogenes MGAS315
aauauuauauuaaugauucaa

SEQ ID NO: 2219421 - RNA, 20 nt, Streptococcus pyogenes MGAS315
aaucaacauggcuaaugaua

SEQ ID NO: 2219422 - RNA, 16 nt, Streptococcus pyogenes MGAS315
aauauuuccuuuuaaa

SEQ ID NO: 2219423 - RNA, 20 nt, Streptococcus pyogenes MGAS315
aauauuuccuuuuaaagaca

SEQ ID NO: 2219424 - RNA, 12 nt, Streptococcus pyogenes MGAS315
aaucaaaaaacu

SEQ ID NO: 2219425 - RNA, 16 nt, Streptococcus pyogenes MGAS315
aaucaauaauggcaga

SEQ ID NO: 2219426 - RNA, 20 nt, Streptococcus pyogenes MGAS315
aaucuucugcauuaucaucu

SEQ ID NO: 2219427 - RNA, 14 nt, Streptococcus pyogenes MGAS315
aaucuuguuuaacc

SEQ ID NO: 2219428 - RNA, 18 nt, Streptococcus pyogenes MGAS315
aaugauaguaaacgaaaa

SEQ ID NO: 2219429 - RNA, 15 nt, Streptococcus pyogenes MGAS315
aaugauagcaccuaa

SEQ ID NO: 2219430 - RNA, 13 nt, Streptococcus pyogenes MGAS315
aaucgaaaugaua

SEQ ID NO: 2219431 - RNA, 22 nt, Streptococcus pyogenes MGAS315
aaucgugauugauugauacaaa

SEQ ID NO: 2219432 - RNA, 22 nt, Streptococcus pyogenes MGAS315
aaucuaagaauuggggcggcac

SEQ ID NO: 2219433 - RNA, 16 nt, Streptococcus pyogenes MGAS315
aauuaauaaauuuuug

SEQ ID NO: 2219434 - RNA, 22 nt, Streptococcus pyogenes MGAS315
aauuacuuaucaucaugacaac

SEQ ID NO: 2219435 - RNA, 16 nt, Streptococcus pyogenes MGAS315
aauguucgaaaaaaua

SEQ ID NO: 2219436 - RNA, 18 nt, Streptococcus pyogenes MGAS315
aaugugguaagaagaaaa

SEQ ID NO: 2219437 - RNA, 12 nt, Streptococcus pyogenes MGAS315
aaugucuuguuu

SEQ ID NO: 2219438 - RNA, 17 nt, Streptococcus pyogenes MGAS315
aauuaaaaagcaaaaaa

SEQ ID NO: 2219439 - RNA, 17 nt, Streptococcus pyogenes MGAS315
aaugccaucaaaaaaag

SEQ ID NO: 2219440 - RNA, 14 nt, Streptococcus pyogenes MGAS315
aaugccaucaaaaa

SEQ ID NO: 2219441 - RNA, 16 nt, Streptococcus pyogenes MGAS315
aaugcugcaaaauuuu

SEQ ID NO: 2219442 - RNA, 19 nt, Streptococcus pyogenes MGAS315
aaugcugcaaaauuuuaaa

SEQ ID NO: 2219443 - RNA, 15 nt, Streptococcus pyogenes MGAS315
aauguaugauuuuaa

SEQ ID NO: 2219444 - RNA, 21 nt, Streptococcus pyogenes MGAS315
aaugugacaauuggugauuaa

SEQ ID NO: 2219445 - RNA, 13 nt, Streptococcus pyogenes MGAS315
aagacaaaaaacu

SEQ ID NO: 2219446 - RNA, 16 nt, Streptococcus pyogenes MGAS315
aagacaaaaaacugga

SEQ ID NO: 2219447 - RNA, 14 nt, Streptococcus pyogenes MGAS315
aagacacacaacac

SEQ ID NO: 2219448 - RNA, 23 nt, Streptococcus pyogenes MGAS315
aagagagguugguaaaaaggcag

SEQ ID NO: 2219449 - RNA, 16 nt, Streptococcus pyogenes MGAS315
aagagagguugguaaa

SEQ ID NO: 2219450 - RNA, 16 nt, Streptococcus pyogenes MGAS315
aagagaaguaauguuu

SEQ ID NO: 2219451 - RNA, 17 nt, Streptococcus pyogenes MGAS315
aagagaaguaauguuuu

SEQ ID NO: 2219452 - RNA, 14 nt, Streptococcus pyogenes MGAS315
aagacuaaagcauu

SEQ ID NO: 2219453 - RNA, 18 nt, Streptococcus pyogenes MGAS315
aagacuauguugcuuaau

SEQ ID NO: 2219454 - RNA, 22 nt, Streptococcus pyogenes MGAS315
aagagcuuaaaaguuagccaag

SEQ ID NO: 2219455 - RNA, 19 nt, Streptococcus pyogenes MGAS315
aagagucauuugacuacua

SEQ ID NO: 2219456 - RNA, 17 nt, Streptococcus pyogenes MGAS315
aagagucaaaccaguug

SEQ ID NO: 2219457 - RNA, 13 nt, Streptococcus pyogenes MGAS315
aagcaaucuaaga

SEQ ID NO: 2219458 - RNA, 17 nt, Streptococcus pyogenes MGAS315
aagcaaucuaagaauug

SEQ ID NO: 2219459 - RNA, 12 nt, Streptococcus pyogenes MGAS315
aagcauuuugag

SEQ ID NO: 2219460 - RNA, 16 nt, Streptococcus pyogenes MGAS315
aagcaugggcuaagua

SEQ ID NO: 2219461 - RNA, 17 nt, Streptococcus pyogenes MGAS315
aagauaccaaaucaaaa

SEQ ID NO: 2219462 - RNA, 19 nt, Streptococcus pyogenes MGAS315
aagaucugcacacacuuuu

SEQ ID NO: 2219463 - RNA, 16 nt, Streptococcus pyogenes MGAS315
aagauccuacaagagg

SEQ ID NO: 2219464 - RNA, 18 nt, Streptococcus pyogenes MGAS315
aagauuaaacuuacaaaa

SEQ ID NO: 2219465 - RNA, 18 nt, Streptococcus pyogenes MGAS315
aagaugguuuugauuaaa

SEQ ID NO: 2219466 - RNA, 14 nt, Streptococcus pyogenes MGAS315
aauaaaauagcacc

SEQ ID NO: 2219467 - RNA, 18 nt, Streptococcus pyogenes MGAS315
aaguuccuuagcaguuau

SEQ ID NO: 2219468 - RNA, 17 nt, Streptococcus pyogenes MGAS315
aaguuuagaacuuuuca

SEQ ID NO: 2219469 - RNA, 19 nt, Streptococcus pyogenes MGAS315
aagguuuuuuuaagcauga

SEQ ID NO: 2219470 - RNA, 24 nt, Streptococcus pyogenes MGAS315
aaguaauaaguagcguacauggau

SEQ ID NO: 2219471 - RNA, 20 nt, Streptococcus pyogenes MGAS315
aagucagacucaauugaaag

SEQ ID NO: 2219472 - RNA, 11 nt, Streptococcus pyogenes MGAS315
aaguggauaca

SEQ ID NO: 2219473 - RNA, 18 nt, Streptococcus pyogenes MGAS315
aagugccaguaaggaaau

SEQ ID NO: 2219474 - RNA, 17 nt, Streptococcus pyogenes MGAS315
aagcuaucauacaacug

SEQ ID NO: 2219475 - RNA, 19 nt, Streptococcus pyogenes MGAS315
aagcuaucauacaacuggc

SEQ ID NO: 2219476 - RNA, 13 nt, Streptococcus pyogenes MGAS315
aaggaguuuuaua

SEQ ID NO: 2219477 - RNA, 18 nt, Streptococcus pyogenes MGAS315
aaggaguuuuauagcuga

SEQ ID NO: 2219478 - RNA, 21 nt, Streptococcus pyogenes MGAS315
aaggaaggcuuguucuuuauu

SEQ ID NO: 2219479 - RNA, 18 nt, Streptococcus pyogenes MGAS315
aagcuuuuuuauaacugu

SEQ ID NO: 2219480 - RNA, 13 nt, Streptococcus pyogenes MGAS315
aaggcaaagaaag

SEQ ID NO: 2219481 - RNA, 17 nt, Streptococcus pyogenes MGAS315
acaaauacagaaaaaag

SEQ ID NO: 2219482 - RNA, 20 nt, Streptococcus pyogenes MGAS315
acaaauacagaaaaaagcuu

SEQ ID NO: 2219483 - RNA, 18 nt, Streptococcus pyogenes MGAS315
acaaaguuucaagugcua

SEQ ID NO: 2219484 - RNA, 20 nt, Streptococcus pyogenes MGAS315
acaaaguuucaagugcuaga

SEQ ID NO: 2219485 - RNA, 14 nt, Streptococcus pyogenes MGAS315
acaagagcuuaaaa

SEQ ID NO: 2219486 - RNA, 20 nt, Streptococcus pyogenes MGAS315
acaacuggcuagccaaaucu

SEQ ID NO: 2219487 - RNA, 13 nt, Streptococcus pyogenes MGAS315
acaaccuuaaaga

SEQ ID NO: 2219488 - RNA, 13 nt, Streptococcus pyogenes MGAS315
acaacauccauac

SEQ ID NO: 2219489 - RNA, 13 nt, Streptococcus pyogenes MGAS315
aauuuuguugagu

SEQ ID NO: 2219490 - RNA, 13 nt, Streptococcus pyogenes MGAS315
acaaaagggaaga

SEQ ID NO: 2219491 - RNA, 17 nt, Streptococcus pyogenes MGAS315
aauuugguggaagagua

SEQ ID NO: 2219492 - RNA, 21 nt, Streptococcus pyogenes MGAS315
aauuuggagagauaaaaagua

SEQ ID NO: 2219493 - RNA, 14 nt, Streptococcus pyogenes MGAS315
aauuuuaaaugaca

SEQ ID NO: 2219494 - RNA, 17 nt, Streptococcus pyogenes MGAS315
acaauuauuuugcaggu

SEQ ID NO: 2219495 - RNA, 19 nt, Streptococcus pyogenes MGAS315
acacagauaagauacugcc

SEQ ID NO: 2219496 - RNA, 15 nt, Streptococcus pyogenes MGAS315
acacagaagccucuu

SEQ ID NO: 2219497 - RNA, 14 nt, Streptococcus pyogenes MGAS315
acaaggcaauccaa

SEQ ID NO: 2219498 - RNA, 19 nt, Streptococcus pyogenes MGAS315
acaauacaaaaaaccuucc

SEQ ID NO: 2219499 - RNA, 14 nt, Streptococcus pyogenes MGAS315
acaaucuuaaaaua

SEQ ID NO: 2219500 - RNA, 20 nt, Streptococcus pyogenes MGAS315
acaaucuuaaguuagggucu

SEQ ID NO: 2219501 - RNA, 21 nt, Streptococcus pyogenes MGAS315
acaaucgaaaugauagcaccu

SEQ ID NO: 2219502 - RNA, 14 nt, Streptococcus pyogenes MGAS315
acaccuaauaaaau

SEQ ID NO: 2219503 - RNA, 15 nt, Streptococcus pyogenes MGAS315
acaccaaaaaaagca

SEQ ID NO: 2219504 - RNA, 16 nt, Streptococcus pyogenes MGAS315
acagaagccucuucug

SEQ ID NO: 2219505 - RNA, 13 nt, Streptococcus pyogenes MGAS315
acauaguguuuug

SEQ ID NO: 2219506 - RNA, 12 nt, Streptococcus pyogenes MGAS315
accaagauucau

SEQ ID NO: 2219507 - RNA, 16 nt, Streptococcus pyogenes MGAS315
acccgagcaacaaaag

SEQ ID NO: 2219508 - RNA, 19 nt, Streptococcus pyogenes MGAS315
accgaaaaaggcaaagaaa

SEQ ID NO: 2219509 - RNA, 17 nt, Streptococcus pyogenes MGAS315
accgcuaggauuuuucc

SEQ ID NO: 2219510 - RNA, 20 nt, Streptococcus pyogenes MGAS315
acguguauucuuaaaaaaau

SEQ ID NO: 2219511 - RNA, 18 nt, Streptococcus pyogenes MGAS315
acguguauucuuaaaaaa

SEQ ID NO: 2219512 - RNA, 17 nt, Streptococcus pyogenes MGAS315
acuagcacaaaaucauu

SEQ ID NO: 2219513 - RNA, 19 nt, Streptococcus pyogenes MGAS315
acuacuagagcuuugccaa

SEQ ID NO: 2219514 - RNA, 14 nt, Streptococcus pyogenes MGAS315
acuauaauuucaau

SEQ ID NO: 2219515 - RNA, 23 nt, Streptococcus pyogenes MGAS315
acuaggauugccgucgaccugcu

SEQ ID NO: 2219516 - RNA, 19 nt, Streptococcus pyogenes MGAS315
acuaggaaucgcuuuagga

SEQ ID NO: 2219517 - RNA, 16 nt, Streptococcus pyogenes MGAS315
acuaaguccuuuucgu

SEQ ID NO: 2219518 - RNA, 16 nt, Streptococcus pyogenes MGAS315
acuaagguacggucau

SEQ ID NO: 2219519 - RNA, 14 nt, Streptococcus pyogenes MGAS315
acuaauauuauauu

SEQ ID NO: 2219520 - RNA, 16 nt, Streptococcus pyogenes MGAS315
acucagucacugcagc

SEQ ID NO: 2219521 - RNA, 18 nt, Streptococcus pyogenes MGAS315
acgcauccguauuuuuua

SEQ ID NO: 2219522 - RNA, 18 nt, Streptococcus pyogenes MGAS315
acggcuucuacacaaaag

SEQ ID NO: 2219523 - RNA, 21 nt, Streptococcus pyogenes MGAS315
acgcgagcuauuggcagucca

SEQ ID NO: 2219524 - RNA, 21 nt, Streptococcus pyogenes MGAS315
agaaugauaguaaacgaaaau

SEQ ID NO: 2219525 - RNA, 15 nt, Streptococcus pyogenes MGAS315
agaaauuaauaaauu

SEQ ID NO: 2219526 - RNA, 14 nt, Streptococcus pyogenes MGAS315
agaaauuaauaaau

SEQ ID NO: 2219527 - RNA, 17 nt, Streptococcus pyogenes MGAS315
agaagauccuacaagag

SEQ ID NO: 2219528 - RNA, 23 nt, Streptococcus pyogenes MGAS315
agaagauccuacaagaggaguug

SEQ ID NO: 2219529 - RNA, 14 nt, Streptococcus pyogenes MGAS315
agaagccucuucug

SEQ ID NO: 2219530 - RNA, 14 nt, Streptococcus pyogenes MGAS315
agacaccaaaaaaa

SEQ ID NO: 2219531 - RNA, 19 nt, Streptococcus pyogenes MGAS315
agacaggagcuuguagcuu

SEQ ID NO: 2219532 - RNA, 19 nt, Streptococcus pyogenes MGAS315
agagaaugauaguaaacga

SEQ ID NO: 2219533 - RNA, 15 nt, Streptococcus pyogenes MGAS315
agagaaguaauguuu

SEQ ID NO: 2219534 - RNA, 19 nt, Streptococcus pyogenes MGAS315
agaguacaaggcaauccaa

SEQ ID NO: 2219535 - RNA, 14 nt, Streptococcus pyogenes MGAS315
agaguacaaggcaa

SEQ ID NO: 2219536 - RNA, 21 nt, Streptococcus pyogenes MGAS315
agagguugguaaaaaggcagu

SEQ ID NO: 2219537 - RNA, 17 nt, Streptococcus pyogenes MGAS315
agagguucgucaagcac

SEQ ID NO: 2219538 - RNA, 16 nt, Streptococcus pyogenes MGAS315
agauaaacuacaccau

SEQ ID NO: 2219539 - RNA, 22 nt, Streptococcus pyogenes MGAS315
agauaaaaccuucaaaaaaggg

SEQ ID NO: 2219540 - RNA, 23 nt, Streptococcus pyogenes MGAS315
agauaaaaccuucaaaaaaggga

SEQ ID NO: 2219541 - RNA, 20 nt, Streptococcus pyogenes MGAS315
acuuguuaacaauaaguaua

SEQ ID NO: 2219542 - RNA, 22 nt, Streptococcus pyogenes MGAS315
acuuucaguuaucugauauuuc

SEQ ID NO: 2219543 - RNA, 17 nt, Streptococcus pyogenes MGAS315
acuuuauugaugauaaa

SEQ ID NO: 2219544 - RNA, 22 nt, Streptococcus pyogenes MGAS315
acuuuauugaugauaaaggccu

SEQ ID NO: 2219545 - RNA, 15 nt, Streptococcus pyogenes MGAS315
acuuauuuuuuuaag

SEQ ID NO: 2219546 - RNA, 22 nt, Streptococcus pyogenes MGAS315
acuguaauauuuccuuuuaaag

SEQ ID NO: 2219547 - RNA, 21 nt, Streptococcus pyogenes MGAS315
acuucucaaagggauugcaaa

SEQ ID NO: 2219548 - RNA, 14 nt, Streptococcus pyogenes MGAS315
acuuguaaaaugau

SEQ ID NO: 2219549 - RNA, 17 nt, Streptococcus pyogenes MGAS315
acuugguucugaaaaua

SEQ ID NO: 2219550 - RNA, 16 nt, Streptococcus pyogenes MGAS315
agcauuugccauggca

SEQ ID NO: 2219551 - RNA, 22 nt, Streptococcus pyogenes MGAS315
agccaaaucuggcuuagcagca

SEQ ID NO: 2219552 - RNA, 18 nt, Streptococcus pyogenes MGAS315
agcaugauuuaguuuuua

SEQ ID NO: 2219553 - RNA, 15 nt, Streptococcus pyogenes MGAS315
agcaucugaaaaaau

SEQ ID NO: 2219554 - RNA, 22 nt, Streptococcus pyogenes MGAS315
agcaucuacguacgcuguaaug

SEQ ID NO: 2219555 - RNA, 23 nt, Streptococcus pyogenes MGAS315
agcaguugcgaucauaaauaaag

SEQ ID NO: 2219556 - RNA, 17 nt, Streptococcus pyogenes MGAS315
agcaguuauaauuagua

SEQ ID NO: 2219557 - RNA, 15 nt, Streptococcus pyogenes MGAS315
agcaggcguuuuguu

SEQ ID NO: 2219558 - RNA, 15 nt, Streptococcus pyogenes MGAS315
agcacaaaagaggca

SEQ ID NO: 2219559 - RNA, 18 nt, Streptococcus pyogenes MGAS315
agcaccuacgauaaaaca

SEQ ID NO: 2219560 - RNA, 23 nt, Streptococcus pyogenes MGAS315
agcagacaaaagggaagagagaa

SEQ ID NO: 2219561 - RNA, 14 nt, Streptococcus pyogenes MGAS315
agauuuuaagacaa

SEQ ID NO: 2219562 - RNA, 21 nt, Streptococcus pyogenes MGAS315
agcaaauagcaaugguuaaaa

SEQ ID NO: 2219563 - RNA, 18 nt, Streptococcus pyogenes MGAS315
agcaaaaaagccagugcu

SEQ ID NO: 2219564 - RNA, 13 nt, Streptococcus pyogenes MGAS315
agcaaauugaaaa

SEQ ID NO: 2219565 - RNA, 16 nt, Streptococcus pyogenes MGAS315
agcaaauugaaaaaau

SEQ ID NO: 2219566 - RNA, 19 nt, Streptococcus pyogenes MGAS315
agcaacacgcuaucaacag

SEQ ID NO: 2219567 - RNA, 18 nt, Streptococcus pyogenes MGAS315
agcaaugguuaaaaagag

SEQ ID NO: 2219568 - RNA, 23 nt, Streptococcus pyogenes MGAS315
agcaaugacuauagaaaguaaaa

SEQ ID NO: 2219569 - RNA, 21 nt, Streptococcus pyogenes MGAS315
agcaagugugacuaguuuauu

SEQ ID NO: 2219570 - RNA, 16 nt, Streptococcus pyogenes MGAS315
agcaagugagaacaug

SEQ ID NO: 2219571 - RNA, 17 nt, Streptococcus pyogenes MGAS315
agcaagugagaacaugu

SEQ ID NO: 2219572 - RNA, 19 nt, Streptococcus pyogenes MGAS315
agcaagugagaacauguga

SEQ ID NO: 2219573 - RNA, 17 nt, Streptococcus pyogenes MGAS315
agcaaggaugaaaugau

SEQ ID NO: 2219574 - RNA, 15 nt, Streptococcus pyogenes MGAS315
agcugauaggucugc

SEQ ID NO: 2219575 - RNA, 22 nt, Streptococcus pyogenes MGAS315
agcguugacaguuaaaaauaac

SEQ ID NO: 2219576 - RNA, 23 nt, Streptococcus pyogenes MGAS315
agcgccagcaauuuucccaucaa

SEQ ID NO: 2219577 - RNA, 20 nt, Streptococcus pyogenes MGAS315
agcgccagcaauuuucccau

SEQ ID NO: 2219578 - RNA, 22 nt, Streptococcus pyogenes MGAS315
agcccuuuuugccuuuaacaug

SEQ ID NO: 2219579 - RNA, 13 nt, Streptococcus pyogenes MGAS315
agccuuauccauu

SEQ ID NO: 2219580 - RNA, 17 nt, Streptococcus pyogenes MGAS315
agccuacaacagcagca

SEQ ID NO: 2219581 - RNA, 16 nt, Streptococcus pyogenes MGAS315
agccuauuuaauaggc

SEQ ID NO: 2219582 - RNA, 13 nt, Streptococcus pyogenes MGAS315
aguagauacuuug

SEQ ID NO: 2219583 - RNA, 16 nt, Streptococcus pyogenes MGAS315
aguauacucagucacu

SEQ ID NO: 2219584 - RNA, 23 nt, Streptococcus pyogenes MGAS315
aguauacucagucacugcagcau

SEQ ID NO: 2219585 - RNA, 20 nt, Streptococcus pyogenes MGAS315
aguagugaugaguaggcgaa

SEQ ID NO: 2219586 - RNA, 14 nt, Streptococcus pyogenes MGAS315
agucagaucauuaa

SEQ ID NO: 2219587 - RNA, 12 nt, Streptococcus pyogenes MGAS315
aguauuuuaaaa

SEQ ID NO: 2219588 - RNA, 16 nt, Streptococcus pyogenes MGAS315
aguauuuuaaaauccu

SEQ ID NO: 2219589 - RNA, 18 nt, Streptococcus pyogenes MGAS315
aguauauuguaauaacaa

SEQ ID NO: 2219590 - RNA, 13 nt, Streptococcus pyogenes MGAS315
agugcugccauug

SEQ ID NO: 2219591 - RNA, 15 nt, Streptococcus pyogenes MGAS315
agugcgcuuccagaa

SEQ ID NO: 2219592 - RNA, 15 nt, Streptococcus pyogenes MGAS315
auaacaaauuuaucc

SEQ ID NO: 2219593 - RNA, 23 nt, Streptococcus pyogenes MGAS315
auaaaaucguuauuaauuguuuu

SEQ ID NO: 2219594 - RNA, 16 nt, Streptococcus pyogenes MGAS315
auaaaauauuuuucca

SEQ ID NO: 2219595 - RNA, 14 nt, Streptococcus pyogenes MGAS315
auaaaagauauuuu

SEQ ID NO: 2219596 - RNA, 16 nt, Streptococcus pyogenes MGAS315
auaaaaccuucaaaaa

SEQ ID NO: 2219597 - RNA, 18 nt, Streptococcus pyogenes MGAS315
auaaaaccuucaaaaaag

SEQ ID NO: 2219598 - RNA, 15 nt, Streptococcus pyogenes MGAS315
auaaaacaaauaauu

SEQ ID NO: 2219599 - RNA, 14 nt, Streptococcus pyogenes MGAS315
auaaaacaaauaau

SEQ ID NO: 2219600 - RNA, 17 nt, Streptococcus pyogenes MGAS315
aguuaucacuaaggcug

SEQ ID NO: 2219601 - RNA, 14 nt, Streptococcus pyogenes MGAS315
aguuaauaagacaa

SEQ ID NO: 2219602 - RNA, 16 nt, Streptococcus pyogenes MGAS315
aguuaaugccaacuuu

SEQ ID NO: 2219603 - RNA, 19 nt, Streptococcus pyogenes MGAS315
aguuaaugccaacuuuuca

SEQ ID NO: 2219604 - RNA, 14 nt, Streptococcus pyogenes MGAS315
aguucuucuaaacg

SEQ ID NO: 2219605 - RNA, 15 nt, Streptococcus pyogenes MGAS315
aguugugccuuuucu

SEQ ID NO: 2219606 - RNA, 18 nt, Streptococcus pyogenes MGAS315
aguuuuuucuaaaagaga

SEQ ID NO: 2219607 - RNA, 18 nt, Streptococcus pyogenes MGAS315
auaaaaaagaagcaaaau

SEQ ID NO: 2219608 - RNA, 14 nt, Streptococcus pyogenes MGAS315
auagaauaaccagc

SEQ ID NO: 2219609 - RNA, 14 nt, Streptococcus pyogenes MGAS315
auagaaaguaaaaa

SEQ ID NO: 2219610 - RNA, 15 nt, Streptococcus pyogenes MGAS315
auagaaaguaaaaau

SEQ ID NO: 2219611 - RNA, 18 nt, Streptococcus pyogenes MGAS315
auagaagacaaggugaau

SEQ ID NO: 2219612 - RNA, 14 nt, Streptococcus pyogenes MGAS315
auagacaagcuuuu

SEQ ID NO: 2219613 - RNA, 22 nt, Streptococcus pyogenes MGAS315
auagaccccuuaguucaaugga

SEQ ID NO: 2219614 - RNA, 18 nt, Streptococcus pyogenes MGAS315
auagcauugucaaauaaa

SEQ ID NO: 2219615 - RNA, 16 nt, Streptococcus pyogenes MGAS315
auagcauaaaauaguu

SEQ ID NO: 2219616 - RNA, 15 nt, Streptococcus pyogenes MGAS315
auacuaauauuauau

SEQ ID NO: 2219617 - RNA, 23 nt, Streptococcus pyogenes MGAS315
auacguuuauuuaguuauuuuug

SEQ ID NO: 2219618 - RNA, 14 nt, Streptococcus pyogenes MGAS315
auaccuaaaaaaua

SEQ ID NO: 2219619 - RNA, 16 nt, Streptococcus pyogenes MGAS315
auaccaucaaugacuu

SEQ ID NO: 2219620 - RNA, 19 nt, Streptococcus pyogenes MGAS315
auaccaaaucaaaaagcua

SEQ ID NO: 2219621 - RNA, 15 nt, Streptococcus pyogenes MGAS315
auaauuuauuuuuca

SEQ ID NO: 2219622 - RNA, 22 nt, Streptococcus pyogenes MGAS315
auaauuugacuucaaaaauacu

SEQ ID NO: 2219623 - RNA, 21 nt, Streptococcus pyogenes MGAS315
auaauuaguauauuguaauaa

SEQ ID NO: 2219624 - RNA, 21 nt, Streptococcus pyogenes MGAS315
auaauuccugugacaacccaa

SEQ ID NO: 2219625 - RNA, 16 nt, Streptococcus pyogenes MGAS315
auaaugccaucaaaaa

SEQ ID NO: 2219626 - RNA, 16 nt, Streptococcus pyogenes MGAS315
auaaugagcaaggcaa

SEQ ID NO: 2219627 - RNA, 19 nt, Streptococcus pyogenes MGAS315
auacaagguuaaguaaaag

SEQ ID NO: 2219628 - RNA, 14 nt, Streptococcus pyogenes MGAS315
auacagcauacauc

SEQ ID NO: 2219629 - RNA, 23 nt, Streptococcus pyogenes MGAS315
auacaguccaaacucaaaccaaa

SEQ ID NO: 2219630 - RNA, 15 nt, Streptococcus pyogenes MGAS315
aucaauaauggcaga

SEQ ID NO: 2219631 - RNA, 18 nt, Streptococcus pyogenes MGAS315
aucaacaaucuuaaaaua

SEQ ID NO: 2219632 - RNA, 22 nt, Streptococcus pyogenes MGAS315
auauugguugccugaaauauaa

SEQ ID NO: 2219633 - RNA, 23 nt, Streptococcus pyogenes MGAS315
auauuauaguaaccauugccauu

SEQ ID NO: 2219634 - RNA, 14 nt, Streptococcus pyogenes MGAS315
auaugucaucaaaa

SEQ ID NO: 2219635 - RNA, 17 nt, Streptococcus pyogenes MGAS315
auauuagcaaaaugcug

SEQ ID NO: 2219636 - RNA, 21 nt, Streptococcus pyogenes MGAS315
auauuaaccggcucuaaaaua

SEQ ID NO: 2219637 - RNA, 19 nt, Streptococcus pyogenes MGAS315
auauaagcaaucaucauuu

SEQ ID NO: 2219638 - RNA, 13 nt, Streptococcus pyogenes MGAS315
auauaauaaaaag

SEQ ID NO: 2219639 - RNA, 19 nt, Streptococcus pyogenes MGAS315
auagcgccagcaauuuucc

SEQ ID NO: 2219640 - RNA, 18 nt, Streptococcus pyogenes MGAS315
auauaaagucagacucaa

SEQ ID NO: 2219641 - RNA, 19 nt, Streptococcus pyogenes MGAS315
auauccccuccuugcaaua

SEQ ID NO: 2219642 - RNA, 20 nt, Streptococcus pyogenes MGAS315
auauccauagaaauuguaac

SEQ ID NO: 2219643 - RNA, 19 nt, Streptococcus pyogenes MGAS315
aucuucaauuuuugccaaa

SEQ ID NO: 2219644 - RNA, 18 nt, Streptococcus pyogenes MGAS315
aucuucacgggcugccau

SEQ ID NO: 2219645 - RNA, 20 nt, Streptococcus pyogenes MGAS315
aucuucacgggcugccauuu

SEQ ID NO: 2219646 - RNA, 16 nt, Streptococcus pyogenes MGAS315
aucuguuuaaaaacaa

SEQ ID NO: 2219647 - RNA, 15 nt, Streptococcus pyogenes MGAS315
aucuguuaugugaug

SEQ ID NO: 2219648 - RNA, 23 nt, Streptococcus pyogenes MGAS315
aucuguuaauuuauguugaucac

SEQ ID NO: 2219649 - RNA, 14 nt, Streptococcus pyogenes MGAS315
aucuugugccuacu

SEQ ID NO: 2219650 - RNA, 14 nt, Streptococcus pyogenes MGAS315
augaaaacguguau

SEQ ID NO: 2219651 - RNA, 23 nt, Streptococcus pyogenes MGAS315
augaaaacguguauucuuaaaaa

SEQ ID NO: 2219652 - RNA, 14 nt, Streptococcus pyogenes MGAS315
aucuuugacaaugu

SEQ ID NO: 2219653 - RNA, 16 nt, Streptococcus pyogenes MGAS315
augacgguaaauaaag

SEQ ID NO: 2219654 - RNA, 18 nt, Streptococcus pyogenes MGAS315
augacugacaaaacuuca

SEQ ID NO: 2219655 - RNA, 22 nt, Streptococcus pyogenes MGAS315
augacuauagaaaguaaaaaua

SEQ ID NO: 2219656 - RNA, 18 nt, Streptococcus pyogenes MGAS315
augacuauagaaaguaaa

SEQ ID NO: 2219657 - RNA, 14 nt, Streptococcus pyogenes MGAS315
augauauaaaaaug

SEQ ID NO: 2219658 - RNA, 19 nt, Streptococcus pyogenes MGAS315
augauagccuuuaucaacu

SEQ ID NO: 2219659 - RNA, 22 nt, Streptococcus pyogenes MGAS315
augaugccauuuaaaagggcaa

SEQ ID NO: 2219660 - RNA, 16 nt, Streptococcus pyogenes MGAS315
augaucuguuuaaaaa

SEQ ID NO: 2219661 - RNA, 18 nt, Streptococcus pyogenes MGAS315
augauuauauuaggauau

SEQ ID NO: 2219662 - RNA, 16 nt, Streptococcus pyogenes MGAS315
auggguaaaaugacug

SEQ ID NO: 2219663 - RNA, 14 nt, Streptococcus pyogenes MGAS315
auggucacuccuuc

SEQ ID NO: 2219664 - RNA, 23 nt, Streptococcus pyogenes MGAS315
auguaccaauuuaagguauuguu

SEQ ID NO: 2219665 - RNA, 14 nt, Streptococcus pyogenes MGAS315
auguaauugucucu

SEQ ID NO: 2219666 - RNA, 17 nt, Streptococcus pyogenes MGAS315
auguucgaaaaaauacu

SEQ ID NO: 2219667 - RNA, 18 nt, Streptococcus pyogenes MGAS315
auguucgaaaaaauacuu

SEQ ID NO: 2219668 - RNA, 16 nt, Streptococcus pyogenes MGAS315
auguuauuaaauaaua

SEQ ID NO: 2219669 - RNA, 20 nt, Streptococcus pyogenes MGAS315
auguuaggagcacaaaagag

SEQ ID NO: 2219670 - RNA, 21 nt, Streptococcus pyogenes MGAS315
auggacgucuucuuuuuauua

SEQ ID NO: 2219671 - RNA, 22 nt, Streptococcus pyogenes MGAS315
auggaugcuccuccaccaaaac

SEQ ID NO: 2219672 - RNA, 20 nt, Streptococcus pyogenes MGAS315
auggaaauuuuaaaugacau

SEQ ID NO: 2219673 - RNA, 16 nt, Streptococcus pyogenes MGAS315
augcugaguucuuuuu

SEQ ID NO: 2219674 - RNA, 16 nt, Streptococcus pyogenes MGAS315
augcugcaaaauuuua

SEQ ID NO: 2219675 - RNA, 15 nt, Streptococcus pyogenes MGAS315
augcugaguucuuuu

SEQ ID NO: 2219676 - RNA, 19 nt, Streptococcus pyogenes MGAS315
augcuugaguagcuacugc

SEQ ID NO: 2219677 - RNA, 22 nt, Streptococcus pyogenes MGAS315
augcuccuccaccaaaaccaag

SEQ ID NO: 2219678 - RNA, 15 nt, Streptococcus pyogenes MGAS315
augcucucauaaaca

SEQ ID NO: 2219679 - RNA, 18 nt, Streptococcus pyogenes MGAS315
augcgcucaagcauuuug

SEQ ID NO: 2219680 - RNA, 14 nt, Streptococcus pyogenes MGAS315
aucaguagugauga

SEQ ID NO: 2219681 - RNA, 22 nt, Streptococcus pyogenes MGAS315
aucaguuaaugccaacuuuuca

SEQ ID NO: 2219682 - RNA, 19 nt, Streptococcus pyogenes MGAS315
aucauaaguuuagaacuuu

SEQ ID NO: 2219683 - RNA, 22 nt, Streptococcus pyogenes MGAS315
aucauaaguuuagaacuuuuca

SEQ ID NO: 2219684 - RNA, 16 nt, Streptococcus pyogenes MGAS315
aucauagacaggagcu

SEQ ID NO: 2219685 - RNA, 21 nt, Streptococcus pyogenes MGAS315
aucaucaaguggauacaaggu

SEQ ID NO: 2219686 - RNA, 13 nt, Streptococcus pyogenes MGAS315
aucauauuuuaau

SEQ ID NO: 2219687 - RNA, 13 nt, Streptococcus pyogenes MGAS315
aucauuauccuuu

SEQ ID NO: 2219688 - RNA, 17 nt, Streptococcus pyogenes MGAS315
aucauuuuuaagacagu

SEQ ID NO: 2219689 - RNA, 20 nt, Streptococcus pyogenes MGAS315
aucauuuugggacuaggaau

SEQ ID NO: 2219690 - RNA, 16 nt, Streptococcus pyogenes MGAS315
auccauuauaaaucuu

SEQ ID NO: 2219691 - RNA, 18 nt, Streptococcus pyogenes MGAS315
auccccucauuuaaaugu

SEQ ID NO: 2219692 - RNA, 21 nt, Streptococcus pyogenes MGAS315
aucccuucauuuuacuauggc

SEQ ID NO: 2219693 - RNA, 11 nt, Streptococcus pyogenes MGAS315
auccuacugac

SEQ ID NO: 2219694 - RNA, 12 nt, Streptococcus pyogenes MGAS315
auccucuuuuaa

SEQ ID NO: 2219695 - RNA, 17 nt, Streptococcus pyogenes MGAS315
aucguaggguguuuuuu

SEQ ID NO: 2219696 - RNA, 16 nt, Streptococcus pyogenes MGAS315
aucgccaauaaaaaag

SEQ ID NO: 2219697 - RNA, 20 nt, Streptococcus pyogenes MGAS315
auccuuuaucuuauuuuaag

SEQ ID NO: 2219698 - RNA, 22 nt, Streptococcus pyogenes MGAS315
caauuaaaaagcaaaaaagcca

SEQ ID NO: 2219699 - RNA, 20 nt, Streptococcus pyogenes MGAS315
caauuaauguuaggagcaca

SEQ ID NO: 2219700 - RNA, 17 nt, Streptococcus pyogenes MGAS315
caauuuucauuuuugga

SEQ ID NO: 2219701 - RNA, 17 nt, Streptococcus pyogenes MGAS315
cacacaaaucuucuaga

SEQ ID NO: 2219702 - RNA, 21 nt, Streptococcus pyogenes MGAS315
cacauacuggucaauggaaau

SEQ ID NO: 2219703 - RNA, 11 nt, Streptococcus pyogenes MGAS315
cacagcaauuu

SEQ ID NO: 2219704 - RNA, 13 nt, Streptococcus pyogenes MGAS315
caccaagugcugc

SEQ ID NO: 2219705 - RNA, 21 nt, Streptococcus pyogenes MGAS315
caccaaaaucauagacaggag

SEQ ID NO: 2219706 - RNA, 13 nt, Streptococcus pyogenes MGAS315
caccaccaauaau

SEQ ID NO: 2219707 - RNA, 15 nt, Streptococcus pyogenes MGAS315
caccagccacuacaa

SEQ ID NO: 2219708 - RNA, 15 nt, Streptococcus pyogenes MGAS315
caccuacuaacaaca

SEQ ID NO: 2219709 - RNA, 19 nt, Streptococcus pyogenes MGAS315
cacgcucaacuggcacaaa

SEQ ID NO: 2219710 - RNA, 20 nt, Streptococcus pyogenes MGAS315
auucuagacccuagcauaaa

SEQ ID NO: 2219711 - RNA, 12 nt, Streptococcus pyogenes MGAS315
auucaucuugcc

SEQ ID NO: 2219712 - RNA, 19 nt, Streptococcus pyogenes MGAS315
auucaugacgccuccaaau

SEQ ID NO: 2219713 - RNA, 16 nt, Streptococcus pyogenes MGAS315
auuccggcagggguca

SEQ ID NO: 2219714 - RNA, 15 nt, Streptococcus pyogenes MGAS315
auuccuuaaauuaua

SEQ ID NO: 2219715 - RNA, 16 nt, Streptococcus pyogenes MGAS315
auuccuuaaauuauau

SEQ ID NO: 2219716 - RNA, 20 nt, Streptococcus pyogenes MGAS315
auuuccucuaacauguccaa

SEQ ID NO: 2219717 - RNA, 16 nt, Streptococcus pyogenes MGAS315
auuuccuacaaaauaa

SEQ ID NO: 2219718 - RNA, 18 nt, Streptococcus pyogenes MGAS315
auuuaagguauuguucaa

SEQ ID NO: 2219719 - RNA, 14 nt, Streptococcus pyogenes MGAS315
auuuacagauguau

SEQ ID NO: 2219720 - RNA, 18 nt, Streptococcus pyogenes MGAS315
auuuuaaucuuuuuguga

SEQ ID NO: 2219721 - RNA, 14 nt, Streptococcus pyogenes MGAS315
auuuuaaaauaguu

SEQ ID NO: 2219722 - RNA, 19 nt, Streptococcus pyogenes MGAS315
auuugccauggcaagagca

SEQ ID NO: 2219723 - RNA, 20 nt, Streptococcus pyogenes MGAS315
auuugacuuguuacaaaaaa

SEQ ID NO: 2219724 - RNA, 19 nt, Streptococcus pyogenes MGAS315
auuugacuuguuacaaaaa

SEQ ID NO: 2219725 - RNA, 20 nt, Streptococcus pyogenes MGAS315
auuugagcacccaagauacg

SEQ ID NO: 2219726 - RNA, 11 nt, Streptococcus pyogenes MGAS315
auuuugguuga

SEQ ID NO: 2219727 - RNA, 18 nt, Streptococcus pyogenes MGAS315
auuuugcagguaauuauc

SEQ ID NO: 2219728 - RNA, 22 nt, Streptococcus pyogenes MGAS315
auuuucuagguuaaaauagaag

SEQ ID NO: 2219729 - RNA, 13 nt, Streptococcus pyogenes MGAS315
caacucccuccua

SEQ ID NO: 2219730 - RNA, 17 nt, Streptococcus pyogenes MGAS315
caacgugcuauaagagg

SEQ ID NO: 2219731 - RNA, 18 nt, Streptococcus pyogenes MGAS315
caacauccauaccaucaa

SEQ ID NO: 2219732 - RNA, 20 nt, Streptococcus pyogenes MGAS315
caagagcaccgcgaauauga

SEQ ID NO: 2219733 - RNA, 21 nt, Streptococcus pyogenes MGAS315
caagagguucgucaagcaccu

SEQ ID NO: 2219734 - RNA, 15 nt, Streptococcus pyogenes MGAS315
caagaggaguugaac

SEQ ID NO: 2219735 - RNA, 23 nt, Streptococcus pyogenes MGAS315
caagaggaggcaacuguggguua

SEQ ID NO: 2219736 - RNA, 19 nt, Streptococcus pyogenes MGAS315
caagagcuuaaaaguuagc

SEQ ID NO: 2219737 - RNA, 13 nt, Streptococcus pyogenes MGAS315
caagagcuuaaaa

SEQ ID NO: 2219738 - RNA, 15 nt, Streptococcus pyogenes MGAS315
caagagcuuaaaagu

SEQ ID NO: 2219739 - RNA, 18 nt, Streptococcus pyogenes MGAS315
caauauaauaaaaagcag

SEQ ID NO: 2219740 - RNA, 19 nt, Streptococcus pyogenes MGAS315
caauaaugccaucaaaaaa

SEQ ID NO: 2219741 - RNA, 20 nt, Streptococcus pyogenes MGAS315
caauaaugccaucaaaaaaa

SEQ ID NO: 2219742 - RNA, 22 nt, Streptococcus pyogenes MGAS315
caagugacaaccuuaaagaccc

SEQ ID NO: 2219743 - RNA, 18 nt, Streptococcus pyogenes MGAS315
caagugccaguaaggaaa

SEQ ID NO: 2219744 - RNA, 23 nt, Streptococcus pyogenes MGAS315
caagugccaguaaggaaaucaau

SEQ ID NO: 2219745 - RNA, 20 nt, Streptococcus pyogenes MGAS315
caaguccugcuuuugaugca

SEQ ID NO: 2219746 - RNA, 20 nt, Streptococcus pyogenes MGAS315
caagucguuuagcuuuuuca

SEQ ID NO: 2219747 - RNA, 16 nt, Streptococcus pyogenes MGAS315
caaguggauacaaggu

SEQ ID NO: 2219748 - RNA, 19 nt, Streptococcus pyogenes MGAS315
caagugcuagauguuggaa

SEQ ID NO: 2219749 - RNA, 14 nt, Streptococcus pyogenes MGAS315
caagugcugccauu

SEQ ID NO: 2219750 - RNA, 14 nt, Streptococcus pyogenes MGAS315
caaggcaagaggag

SEQ ID NO: 2219751 - RNA, 14 nt, Streptococcus pyogenes MGAS315
caacauacuuuauu

SEQ ID NO: 2219752 - RNA, 19 nt, Streptococcus pyogenes MGAS315
caacaaguguuuugucuua

SEQ ID NO: 2219753 - RNA, 17 nt, Streptococcus pyogenes MGAS315
caaaucuucugcauuau

SEQ ID NO: 2219754 - RNA, 24 nt, Streptococcus pyogenes MGAS315
caaaucaacauggcuaaugauaag

SEQ ID NO: 2219755 - RNA, 14 nt, Streptococcus pyogenes MGAS315
caaaucaacauggc

SEQ ID NO: 2219756 - RNA, 15 nt, Streptococcus pyogenes MGAS315
caaagacguuuuacu

SEQ ID NO: 2219757 - RNA, 15 nt, Streptococcus pyogenes MGAS315
caaacuauauuguua

SEQ ID NO: 2219758 - RNA, 14 nt, Streptococcus pyogenes MGAS315
caaacuauauuguu

SEQ ID NO: 2219759 - RNA, 14 nt, Streptococcus pyogenes MGAS315
caaacucaaaccaa

SEQ ID NO: 2219760 - RNA, 20 nt, Streptococcus pyogenes MGAS315
caaacucugccaauuguuca

SEQ ID NO: 2219761 - RNA, 21 nt, Streptococcus pyogenes MGAS315
caaaaucauagacaggagcuu

SEQ ID NO: 2219762 - RNA, 19 nt, Streptococcus pyogenes MGAS315
caaaauuauuauuuugcuu

SEQ ID NO: 2219763 - RNA, 11 nt, Streptococcus pyogenes MGAS315
caaaauuauua

SEQ ID NO: 2219764 - RNA, 19 nt, Streptococcus pyogenes MGAS315
caucaaaggguguuuuuua

SEQ ID NO: 2219765 - RNA, 12 nt, Streptococcus pyogenes MGAS315
cauacaaaaaca

SEQ ID NO: 2219766 - RNA, 20 nt, Streptococcus pyogenes MGAS315
cauacaaaaacaccccaaac

SEQ ID NO: 2219767 - RNA, 19 nt, Streptococcus pyogenes MGAS315
cauaguugugcuagucuuu

SEQ ID NO: 2219768 - RNA, 17 nt, Streptococcus pyogenes MGAS315
cauuaccuuauuuucua

SEQ ID NO: 2219769 - RNA, 21 nt, Streptococcus pyogenes MGAS315
cauugccauuaauaauauuaa

SEQ ID NO: 2219770 - RNA, 15 nt, Streptococcus pyogenes MGAS315
cauugucaaauaaaa

SEQ ID NO: 2219771 - RNA, 16 nt, Streptococcus pyogenes MGAS315
cauuuccuacaaaaua

SEQ ID NO: 2219772 - RNA, 15 nt, Streptococcus pyogenes MGAS315
cauuuccuacaaaau

SEQ ID NO: 2219773 - RNA, 19 nt, Streptococcus pyogenes MGAS315
cauuucggacuguuuuuua

SEQ ID NO: 2219774 - RNA, 22 nt, Streptococcus pyogenes MGAS315
caugaaguauaguuauguuaua

SEQ ID NO: 2219775 - RNA, 20 nt, Streptococcus pyogenes MGAS315
caugaaguauaguuauguua

SEQ ID NO: 2219776 - RNA, 21 nt, Streptococcus pyogenes MGAS315
caugaugccauuuaaaagggc

SEQ ID NO: 2219777 - RNA, 19 nt, Streptococcus pyogenes MGAS315
caugaugccauuuaaaagg

SEQ ID NO: 2219778 - RNA, 18 nt, Streptococcus pyogenes MGAS315
caugauguuauuaaauaa

SEQ ID NO: 2219779 - RNA, 21 nt, Streptococcus pyogenes MGAS315
cauggcuaaugauaaggcugc

SEQ ID NO: 2219780 - RNA, 23 nt, Streptococcus pyogenes MGAS315
cagcuucuacgggauuuaguucu

SEQ ID NO: 2219781 - RNA, 18 nt, Streptococcus pyogenes MGAS315
cauaaaagauauuuuaaa

SEQ ID NO: 2219782 - RNA, 12 nt, Streptococcus pyogenes MGAS315
caguuuuuucug

SEQ ID NO: 2219783 - RNA, 23 nt, Streptococcus pyogenes MGAS315
caguuucccauguuuuauuacca

SEQ ID NO: 2219784 - RNA, 21 nt, Streptococcus pyogenes MGAS315
caguuucccauguuuuauuac

SEQ ID NO: 2219785 - RNA, 21 nt, Streptococcus pyogenes MGAS315
cauaaauaaagauaauuuauu

SEQ ID NO: 2219786 - RNA, 14 nt, Streptococcus pyogenes MGAS315
cagguguuuaaaga

SEQ ID NO: 2219787 - RNA, 13 nt, Streptococcus pyogenes MGAS315
cagguugcaacaa

SEQ ID NO: 2219788 - RNA, 20 nt, Streptococcus pyogenes MGAS315
caguauguaaauauaaaguc

SEQ ID NO: 2219789 - RNA, 20 nt, Streptococcus pyogenes MGAS315
cauuucgugucuaaaauaau

SEQ ID NO: 2219790 - RNA, 17 nt, Streptococcus pyogenes MGAS315
ccaaauuucagauaaaa

SEQ ID NO: 2219791 - RNA, 20 nt, Streptococcus pyogenes MGAS315
ccaaauuucagauaaaaccu

SEQ ID NO: 2219792 - RNA, 22 nt, Streptococcus pyogenes MGAS315
ccaaggucugcgcgacuaaaau

SEQ ID NO: 2219793 - RNA, 16 nt, Streptococcus pyogenes MGAS315
ccaagugccaguaagg

SEQ ID NO: 2219794 - RNA, 13 nt, Streptococcus pyogenes MGAS315
ccaaugacuaagg

SEQ ID NO: 2219795 - RNA, 15 nt, Streptococcus pyogenes MGAS315
ccaauuguugaauaa

SEQ ID NO: 2219796 - RNA, 15 nt, Streptococcus pyogenes MGAS315
ccacaccuaauaaaa

SEQ ID NO: 2219797 - RNA, 18 nt, Streptococcus pyogenes MGAS315
ccacaccuacuaacaaca

SEQ ID NO: 2219798 - RNA, 16 nt, Streptococcus pyogenes MGAS315
ccaucugcacaugcuu

SEQ ID NO: 2219799 - RNA, 18 nt, Streptococcus pyogenes MGAS315
ccccuauucaauauuuua

SEQ ID NO: 2219800 - RNA, 15 nt, Streptococcus pyogenes MGAS315
ccauuauaaaucuua

SEQ ID NO: 2219801 - RNA, 15 nt, Streptococcus pyogenes MGAS315
ccauuaauaauauua

SEQ ID NO: 2219802 - RNA, 15 nt, Streptococcus pyogenes MGAS315
ccaugcucauaggca

SEQ ID NO: 2219803 - RNA, 20 nt, Streptococcus pyogenes MGAS315
cgaauugugucauuucuuga

SEQ ID NO: 2219804 - RNA, 16 nt, Streptococcus pyogenes MGAS315
cgaauaugauauaaaa

SEQ ID NO: 2219805 - RNA, 21 nt, Streptococcus pyogenes MGAS315
ccuugcaauagagccaagauu

SEQ ID NO: 2219806 - RNA, 21 nt, Streptococcus pyogenes MGAS315
ccuugauuaauagcgccagca

SEQ ID NO: 2219807 - RNA, 22 nt, Streptococcus pyogenes MGAS315
ccuuguacaagagcuuaaaagu

SEQ ID NO: 2219808 - RNA, 14 nt, Streptococcus pyogenes MGAS315
ccuuuaucuuauuu

SEQ ID NO: 2219809 - RNA, 20 nt, Streptococcus pyogenes MGAS315
ccuuuuugccuuuaacauga

SEQ ID NO: 2219810 - RNA, 19 nt, Streptococcus pyogenes MGAS315
ccuuuuuagcuuauaauuu

SEQ ID NO: 2219811 - RNA, 16 nt, Streptococcus pyogenes MGAS315
cgcagaguacaaggca

SEQ ID NO: 2219812 - RNA, 20 nt, Streptococcus pyogenes MGAS315
cgcagauggggugucagggg

SEQ ID NO: 2219813 - RNA, 21 nt, Streptococcus pyogenes MGAS315
cgccaaaucuuguggguuuug

SEQ ID NO: 2219814 - RNA, 21 nt, Streptococcus pyogenes MGAS315
cgauaauaaagugcgcuucca

SEQ ID NO: 2219815 - RNA, 18 nt, Streptococcus pyogenes MGAS315
cgauaaucuuugacaaug

SEQ ID NO: 2219816 - RNA, 22 nt, Streptococcus pyogenes MGAS315
cgagcuauuggcaguccaucaa

SEQ ID NO: 2219817 - RNA, 20 nt, Streptococcus pyogenes MGAS315
ccuaaugcugcaaaauuuua

SEQ ID NO: 2219818 - RNA, 18 nt, Streptococcus pyogenes MGAS315
ccgugaggacuuauuuuu

SEQ ID NO: 2219819 - RNA, 13 nt, Streptococcus pyogenes MGAS315
ccuccaccaaaac

SEQ ID NO: 2219820 - RNA, 15 nt, Streptococcus pyogenes MGAS315
ccucauuugccgaaa

SEQ ID NO: 2219821 - RNA, 21 nt, Streptococcus pyogenes MGAS315
ccucauuugccgaaacaguuu

SEQ ID NO: 2219822 - RNA, 23 nt, Streptococcus pyogenes MGAS315
ccuccuaaacuaauaagauucaa

SEQ ID NO: 2219823 - RNA, 19 nt, Streptococcus pyogenes MGAS315
ccucucacaaauacagaaa

SEQ ID NO: 2219824 - RNA, 11 nt, Streptococcus pyogenes MGAS315
ccugcauaucu

SEQ ID NO: 2219825 - RNA, 13 nt, Streptococcus pyogenes MGAS315
ccgaguuuugcug

SEQ ID NO: 2219826 - RNA, 15 nt, Streptococcus pyogenes MGAS315
cguaagcauuuugag

SEQ ID NO: 2219827 - RNA, 21 nt, Streptococcus pyogenes MGAS315
cggucucuuuuuguuuugccu

SEQ ID NO: 2219828 - RNA, 16 nt, Streptococcus pyogenes MGAS315
cgcuuuuaagcugagu

SEQ ID NO: 2219829 - RNA, 13 nt, Streptococcus pyogenes MGAS315
cgcuuccagaaca

SEQ ID NO: 2219830 - RNA, 19 nt, Streptococcus pyogenes MGAS315
cgcuauaccuaaaaaauaa

SEQ ID NO: 2219831 - RNA, 17 nt, Streptococcus pyogenes MGAS315
cuaaguagauacuuugg

SEQ ID NO: 2219832 - RNA, 23 nt, Streptococcus pyogenes MGAS315
cuaagcuauagaaacuuuuuaua

SEQ ID NO: 2219833 - RNA, 21 nt, Streptococcus pyogenes MGAS315
cuaaagcaucagcauaaccuu

SEQ ID NO: 2219834 - RNA, 12 nt, Streptococcus pyogenes MGAS315
cuaacaacaaca

SEQ ID NO: 2219835 - RNA, 20 nt, Streptococcus pyogenes MGAS315
cuaaaccugucccuaaccac

SEQ ID NO: 2219836 - RNA, 13 nt, Streptococcus pyogenes MGAS315
cguuuuuuuagcg

SEQ ID NO: 2219837 - RNA, 21 nt, Streptococcus pyogenes MGAS315
cguuuguacucgugaauaauu

SEQ ID NO: 2219838 - RNA, 12 nt, Streptococcus pyogenes MGAS315
cguuagcuuuuu

SEQ ID NO: 2219839 - RNA, 14 nt, Streptococcus pyogenes MGAS315
cguuauuaaagaca

SEQ ID NO: 2219840 - RNA, 13 nt, Streptococcus pyogenes MGAS315
cguuaacaaaaau

SEQ ID NO: 2219841 - RNA, 22 nt, Streptococcus pyogenes MGAS315
cuccuaaggaguaguugcuggu

SEQ ID NO: 2219842 - RNA, 20 nt, Streptococcus pyogenes MGAS315
cuccuaaauauaaauuauua

SEQ ID NO: 2219843 - RNA, 22 nt, Streptococcus pyogenes MGAS315
cuccuaaugcugcaaaauuuua

SEQ ID NO: 2219844 - RNA, 21 nt, Streptococcus pyogenes MGAS315
cucccgcuuuuaagcugagua

SEQ ID NO: 2219845 - RNA, 22 nt, Streptococcus pyogenes MGAS315
cucuacgcauccguauuuuuua

SEQ ID NO: 2219846 - RNA, 12 nt, Streptococcus pyogenes MGAS315
cucaaaaaauac

SEQ ID NO: 2219847 - RNA, 16 nt, Streptococcus pyogenes MGAS315
cuauuaccuauagaaa

SEQ ID NO: 2219848 - RNA, 16 nt, Streptococcus pyogenes MGAS315
cuauuuaacuuaucau

SEQ ID NO: 2219849 - RNA, 22 nt, Streptococcus pyogenes MGAS315
cucagagcuuuuuuuguuuugg

SEQ ID NO: 2219850 - RNA, 22 nt, Streptococcus pyogenes MGAS315
cucagucacugcagcaucaaaa

SEQ ID NO: 2219851 - RNA, 13 nt, Streptococcus pyogenes MGAS315
cucaguaaucuaa

SEQ ID NO: 2219852 - RNA, 20 nt, Streptococcus pyogenes MGAS315
cuagaacucuuauaauaaau

SEQ ID NO: 2219853 - RNA, 22 nt, Streptococcus pyogenes MGAS315
cuaucugcagauuuuaagacaa

SEQ ID NO: 2219854 - RNA, 20 nt, Streptococcus pyogenes MGAS315
cuaugauagccuuuaucaac

SEQ ID NO: 2219855 - RNA, 17 nt, Streptococcus pyogenes MGAS315
cuauggcuucuaaaaaa

SEQ ID NO: 2219856 - RNA, 16 nt, Streptococcus pyogenes MGAS315
cuaugaucuguuuaaa

SEQ ID NO: 2219857 - RNA, 20 nt, Streptococcus pyogenes MGAS315
cuaugaucuguuuaaaaaca

SEQ ID NO: 2219858 - RNA, 15 nt, Streptococcus pyogenes MGAS315
cuauaccuaaaaaau

SEQ ID NO: 2219859 - RNA, 14 nt, Streptococcus pyogenes MGAS315
cuauaccuaaaaaa

SEQ ID NO: 2219860 - RNA, 14 nt, Streptococcus pyogenes MGAS315
cuaggaauaaaaug

SEQ ID NO: 2219861 - RNA, 21 nt, Streptococcus pyogenes MGAS315
cuaggagggacugucaaaaaa

SEQ ID NO: 2219862 - RNA, 14 nt, Streptococcus pyogenes MGAS315
cugauaaaaauaaa

SEQ ID NO: 2219863 - RNA, 19 nt, Streptococcus pyogenes MGAS315
cugauaagguuuuuuuaag

SEQ ID NO: 2219864 - RNA, 16 nt, Streptococcus pyogenes MGAS315
cugaucccuucauuuu

SEQ ID NO: 2219865 - RNA, 18 nt, Streptococcus pyogenes MGAS315
cugaucccuucauuuuac

SEQ ID NO: 2219866 - RNA, 14 nt, Streptococcus pyogenes MGAS315
cugaguucuuuuuc

SEQ ID NO: 2219867 - RNA, 15 nt, Streptococcus pyogenes MGAS315
cugaguucuuuuucg

SEQ ID NO: 2219868 - RNA, 16 nt, Streptococcus pyogenes MGAS315
cucuauuugaaguaaa

SEQ ID NO: 2219869 - RNA, 22 nt, Streptococcus pyogenes MGAS315
cugcaauauccauagaaauugu

SEQ ID NO: 2219870 - RNA, 15 nt, Streptococcus pyogenes MGAS315
cugcaauauccauag

SEQ ID NO: 2219871 - RNA, 18 nt, Streptococcus pyogenes MGAS315
cugcaauauccauagaaa

SEQ ID NO: 2219872 - RNA, 18 nt, Streptococcus pyogenes MGAS315
cugcacugagccccaaaa

SEQ ID NO: 2219873 - RNA, 14 nt, Streptococcus pyogenes MGAS315
cugauuacugaaau

SEQ ID NO: 2219874 - RNA, 14 nt, Streptococcus pyogenes MGAS315
cugcaaaauuuuaa

SEQ ID NO: 2219875 - RNA, 17 nt, Streptococcus pyogenes MGAS315
cuguaauguuguaaacu

SEQ ID NO: 2219876 - RNA, 21 nt, Streptococcus pyogenes MGAS315
cugguacguugauugccauuu

SEQ ID NO: 2219877 - RNA, 18 nt, Streptococcus pyogenes MGAS315
cuggaccauuaucaauaa

SEQ ID NO: 2219878 - RNA, 14 nt, Streptococcus pyogenes MGAS315
cuggcacaaacucu

SEQ ID NO: 2219879 - RNA, 13 nt, Streptococcus pyogenes MGAS315
cuucuucuuuuca

SEQ ID NO: 2219880 - RNA, 19 nt, Streptococcus pyogenes MGAS315
cuucugaugcguuuauaaa

SEQ ID NO: 2219881 - RNA, 15 nt, Streptococcus pyogenes MGAS315
cuucuggcaauaagu

SEQ ID NO: 2219882 - RNA, 17 nt, Streptococcus pyogenes MGAS315
cuugaggugauucuuuu

SEQ ID NO: 2219883 - RNA, 19 nt, Streptococcus pyogenes MGAS315
cuugcguagacagcaagga

SEQ ID NO: 2219884 - RNA, 15 nt, Streptococcus pyogenes MGAS315
cuuuaacaugaugua

SEQ ID NO: 2219885 - RNA, 22 nt, Streptococcus pyogenes MGAS315
cuuuaaaaaguuucugaguuga

SEQ ID NO: 2219886 - RNA, 20 nt, Streptococcus pyogenes MGAS315
cuuuaaaaaguuucugaguu

SEQ ID NO: 2219887 - RNA, 22 nt, Streptococcus pyogenes MGAS315
cuuguuuugguugauauaaaau

SEQ ID NO: 2219888 - RNA, 17 nt, Streptococcus pyogenes MGAS315
cuuguucuuuauuuuga

SEQ ID NO: 2219889 - RNA, 21 nt, Streptococcus pyogenes MGAS315
cuuggacgaaggcucuuaucu

SEQ ID NO: 2219890 - RNA, 19 nt, Streptococcus pyogenes MGAS315
cuuguaaaaugauacuuuc

SEQ ID NO: 2219891 - RNA, 21 nt, Streptococcus pyogenes MGAS315
cuuauaauuugacuucaaaaa

SEQ ID NO: 2219892 - RNA, 12 nt, Streptococcus pyogenes MGAS315
cuuauaauaaau

SEQ ID NO: 2219893 - RNA, 17 nt, Streptococcus pyogenes MGAS315
cuuaucacgguucagcu

SEQ ID NO: 2219894 - RNA, 21 nt, Streptococcus pyogenes MGAS315
cuuacaaaaagccuauuuaau

SEQ ID NO: 2219895 - RNA, 14 nt, Streptococcus pyogenes MGAS315
cuuacaaaaagccu

SEQ ID NO: 2219896 - RNA, 15 nt, Streptococcus pyogenes MGAS315
cuuaauuuauauuuu

SEQ ID NO: 2219897 - RNA, 17 nt, Streptococcus pyogenes MGAS315
cuuaauuuauauuuuag

SEQ ID NO: 2219898 - RNA, 21 nt, Streptococcus pyogenes MGAS315
cuguuggauacaguccaaacu

SEQ ID NO: 2219899 - RNA, 20 nt, Streptococcus pyogenes MGAS315
cuguuuaaaauauauuuugg

SEQ ID NO: 2219900 - RNA, 22 nt, Streptococcus pyogenes MGAS315
cugucuggaaacuggucaaaag

SEQ ID NO: 2219901 - RNA, 13 nt, Streptococcus pyogenes MGAS315
cuguucucuuugg

SEQ ID NO: 2219902 - RNA, 22 nt, Streptococcus pyogenes MGAS315
cuguucucuuuggagaaauuca

SEQ ID NO: 2219903 - RNA, 15 nt, Streptococcus pyogenes MGAS315
cuuaaacauauuaua

SEQ ID NO: 2219904 - RNA, 22 nt, Streptococcus pyogenes MGAS315
gaauagguaaagauuuuaaaua

SEQ ID NO: 2219905 - RNA, 13 nt, Streptococcus pyogenes MGAS315
gaauaagaaaacc

SEQ ID NO: 2219906 - RNA, 15 nt, Streptococcus pyogenes MGAS315
gaaggcuuguucuuu

SEQ ID NO: 2219907 - RNA, 23 nt, Streptococcus pyogenes MGAS315
gaaucgcuuuaggaauaucauga

SEQ ID NO: 2219908 - RNA, 17 nt, Streptococcus pyogenes MGAS315
gaauucccauugacaua

SEQ ID NO: 2219909 - RNA, 19 nt, Streptococcus pyogenes MGAS315
gaacgaagucaagggaauu

SEQ ID NO: 2219910 - RNA, 12 nt, Streptococcus pyogenes MGAS315
gaacuuguccug

SEQ ID NO: 2219911 - RNA, 19 nt, Streptococcus pyogenes MGAS315
gaagaaggucaugaugcca

SEQ ID NO: 2219912 - RNA, 15 nt, Streptococcus pyogenes MGAS315
gaaaugauagcaccu

SEQ ID NO: 2219913 - RNA, 20 nt, Streptococcus pyogenes MGAS315
gaaauuguaaccacagcaau

SEQ ID NO: 2219914 - RNA, 19 nt, Streptococcus pyogenes MGAS315
gaaccaacuuggacgaagg

SEQ ID NO: 2219915 - RNA, 21 nt, Streptococcus pyogenes MGAS315
gaaccaacuuggacgaaggcu

SEQ ID NO: 2219916 - RNA, 23 nt, Streptococcus pyogenes MGAS315
gaaauaucuuucaguuguuuuaa

SEQ ID NO: 2219917 - RNA, 23 nt, Streptococcus pyogenes MGAS315
gaaaguuauagcuccuaaaacca

SEQ ID NO: 2219918 - RNA, 20 nt, Streptococcus pyogenes MGAS315
gaaacguuauuaaagacaaa

SEQ ID NO: 2219919 - RNA, 13 nt, Streptococcus pyogenes MGAS315
gaaacuaaaggca

SEQ ID NO: 2219920 - RNA, 16 nt, Streptococcus pyogenes MGAS315
gaaacugcacugagcc

SEQ ID NO: 2219921 - RNA, 14 nt, Streptococcus pyogenes MGAS315
cuuuuuucuaaccu

SEQ ID NO: 2219922 - RNA, 19 nt, Streptococcus pyogenes MGAS315
cuuuuuuugucguuuuuug

SEQ ID NO: 2219923 - RNA, 14 nt, Streptococcus pyogenes MGAS315
gaaaaagcaaugau

SEQ ID NO: 2219924 - RNA, 16 nt, Streptococcus pyogenes MGAS315
gaaaaguugauauccc

SEQ ID NO: 2219925 - RNA, 13 nt, Streptococcus pyogenes MGAS315
gaaaauaaaauau

SEQ ID NO: 2219926 - RNA, 18 nt, Streptococcus pyogenes MGAS315
cuuuuugccuuuaacaug

SEQ ID NO: 2219927 - RNA, 13 nt, Streptococcus pyogenes MGAS315
cuuuuucuuuucu

SEQ ID NO: 2219928 - RNA, 17 nt, Streptococcus pyogenes MGAS315
cuuuuuccguuugagau

SEQ ID NO: 2219929 - RNA, 22 nt, Streptococcus pyogenes MGAS315
cuuuuuacaucaaaaaaagcaa

SEQ ID NO: 2219930 - RNA, 18 nt, Streptococcus pyogenes MGAS315
cuuuugauaccuuuuuug

SEQ ID NO: 2219931 - RNA, 22 nt, Streptococcus pyogenes MGAS315
cuuuuggccuacuagcacaaaa

SEQ ID NO: 2219932 - RNA, 14 nt, Streptococcus pyogenes MGAS315
cuuuuaauuuggag

SEQ ID NO: 2219933 - RNA, 15 nt, Streptococcus pyogenes MGAS315
aaaaacaaauuguag

SEQ ID NO: 2219934 - RNA, 20 nt, Streptococcus pyogenes MGAS315
aaaaacaaauuguagggauu

SEQ ID NO: 2219935 - RNA, 13 nt, Streptococcus pyogenes MGAS315
aaaaaagccagug

SEQ ID NO: 2219936 - RNA, 12 nt, Streptococcus pyogenes MGAS315
aaaaaaagcaau

SEQ ID NO: 2219937 - RNA, 21 nt, Streptococcus pyogenes MGAS315
aaaaaaccgcccagaaauaau

SEQ ID NO: 2219938 - RNA, 22 nt, Streptococcus pyogenes MGAS315
aaaaaaccgcccagaaauaauc

SEQ ID NO: 2219939 - RNA, 22 nt, Streptococcus pyogenes MGAS315
aaaaaagaagcaaaauuauuau

SEQ ID NO: 2219940 - RNA, 13 nt, Streptococcus pyogenes MGAS315
aaaaaagacccaa

SEQ ID NO: 2219941 - RNA, 19 nt, Streptococcus pyogenes MGAS315
aaaaccgcccagaaauaau

SEQ ID NO: 2219942 - RNA, 18 nt, Streptococcus pyogenes MGAS315
aaaaacucaaaaaauaca

SEQ ID NO: 2219943 - RNA, 19 nt, Streptococcus pyogenes MGAS315
aaaaacgaucaaaaaucuu

SEQ ID NO: 2219944 - RNA, 21 nt, Streptococcus pyogenes MGAS315
aaaaacgccacgcucaacugg

SEQ ID NO: 2219945 - RNA, 18 nt, Streptococcus pyogenes MGAS315
aaaaacaccccaaacguu

SEQ ID NO: 2219946 - RNA, 18 nt, Streptococcus pyogenes MGAS315
aaaaacgaucaaaaaucu

SEQ ID NO: 2219947 - RNA, 13 nt, Streptococcus pyogenes MGAS315
aaaaacucaaaaa

SEQ ID NO: 2219948 - RNA, 23 nt, Streptococcus pyogenes MGAS315
aaaaagccuauuuaauaggcuuu

SEQ ID NO: 2219949 - RNA, 13 nt, Streptococcus pyogenes MGAS315
aaaaagccuauuu

SEQ ID NO: 2219950 - RNA, 14 nt, Streptococcus pyogenes MGAS315
aaaaagccuuuaca

SEQ ID NO: 2219951 - RNA, 16 nt, Streptococcus pyogenes MGAS315
aaaaaggcaaagaaag

SEQ ID NO: 2219952 - RNA, 12 nt, Streptococcus pyogenes MGAS315
aaaaagcaagca

SEQ ID NO: 2219953 - RNA, 15 nt, Streptococcus pyogenes MGAS315
aaaaucauagacagg

SEQ ID NO: 2219954 - RNA, 23 nt, Streptococcus pyogenes MGAS315
aaaauauauucuaauuugugaaa

SEQ ID NO: 2219955 - RNA, 20 nt, Streptococcus pyogenes MGAS315
aaaauacaauaaagcguuga

SEQ ID NO: 2219956 - RNA, 19 nt, Streptococcus pyogenes MGAS315
aaaauaucuuuuuuacuuu

SEQ ID NO: 2219957 - RNA, 15 nt, Streptococcus pyogenes MGAS315
aaaaugacugacaaa

SEQ ID NO: 2219958 - RNA, 13 nt, Streptococcus pyogenes MGAS315
aaaaugaagcaaa

SEQ ID NO: 2219959 - RNA, 14 nt, Streptococcus pyogenes MGAS315
aaaaguaaaaagca

SEQ ID NO: 2219960 - RNA, 15 nt, Streptococcus pyogenes MGAS315
aaaaguaaaaagcaa

SEQ ID NO: 2219961 - RNA, 19 nt, Streptococcus pyogenes MGAS315
aaaauaaacuuucaguuau

SEQ ID NO: 2219962 - RNA, 21 nt, Streptococcus pyogenes MGAS315
aaaaguugauauccccuccuu

SEQ ID NO: 2219963 - RNA, 14 nt, Streptococcus pyogenes MGAS315
aaaagcuaacacca

SEQ ID NO: 2219964 - RNA, 18 nt, Streptococcus pyogenes MGAS315
aaaagcuaaguaaacuuc

SEQ ID NO: 2219965 - RNA, 21 nt, Streptococcus pyogenes MGAS315
aaaacgccacgcucaacuggc

SEQ ID NO: 2219966 - RNA, 20 nt, Streptococcus pyogenes MGAS315
aaacagaugcucaaacuaua

SEQ ID NO: 2219967 - RNA, 21 nt, Streptococcus pyogenes MGAS315
aaacacuaccuuaaauguaug

SEQ ID NO: 2219968 - RNA, 18 nt, Streptococcus pyogenes MGAS315
aaacaagucuaucugcag

SEQ ID NO: 2219969 - RNA, 14 nt, Streptococcus pyogenes MGAS315
aacaaauaauuccu

SEQ ID NO: 2219970 - RNA, 23 nt, Streptococcus pyogenes MGAS315
aaauucuuuuugaauugaaaaaa

SEQ ID NO: 2219971 - RNA, 14 nt, Streptococcus pyogenes MGAS315
aaauucuuuuugaa

SEQ ID NO: 2219972 - RNA, 14 nt, Streptococcus pyogenes MGAS315
aaauugauuauucu

SEQ ID NO: 2219973 - RNA, 22 nt, Streptococcus pyogenes MGAS315
aaauugguccucugaaaaguug

SEQ ID NO: 2219974 - RNA, 17 nt, Streptococcus pyogenes MGAS315
aaauuguaaccacagca

SEQ ID NO: 2219975 - RNA, 21 nt, Streptococcus pyogenes MGAS315
aaauccuugcguagacagcaa

SEQ ID NO: 2219976 - RNA, 20 nt, Streptococcus pyogenes MGAS315
aaauccuuuugaaaaauuau

SEQ ID NO: 2219977 - RNA, 13 nt, Streptococcus pyogenes MGAS315
aaaucuucuagaa

SEQ ID NO: 2219978 - RNA, 22 nt, Streptococcus pyogenes MGAS315
aaaucuggcuuagcagcaccag

SEQ ID NO: 2219979 - RNA, 15 nt, Streptococcus pyogenes MGAS315
aaaucucgauuguaa

SEQ ID NO: 2219980 - RNA, 18 nt, Streptococcus pyogenes MGAS315
aaauguaugauuuuaacg

SEQ ID NO: 2219981 - RNA, 17 nt, Streptococcus pyogenes MGAS315
aaauguaugauuuuaac

SEQ ID NO: 2219982 - RNA, 13 nt, Streptococcus pyogenes MGAS315
aaaugucuagcuu

SEQ ID NO: 2219983 - RNA, 18 nt, Streptococcus pyogenes MGAS315
aaauguagagaauuugaa

SEQ ID NO: 2219984 - RNA, 16 nt, Streptococcus pyogenes MGAS315
aaauuaauaaauuuuu

SEQ ID NO: 2219985 - RNA, 21 nt, Streptococcus pyogenes MGAS315
aaaaagcaaauugaaaaaauc

SEQ ID NO: 2219986 - RNA, 15 nt, Streptococcus pyogenes MGAS315
aaaaagcaaauugaa

SEQ ID NO: 2219987 - RNA, 16 nt, Streptococcus pyogenes MGAS315
aaaguuuucucagaga

SEQ ID NO: 2219988 - RNA, 20 nt, Streptococcus pyogenes MGAS315
aaaguuuucucagagacaau

SEQ ID NO: 2219989 - RNA, 11 nt, Streptococcus pyogenes MGAS315
aaaguuuucuc

SEQ ID NO: 2219990 - RNA, 15 nt, Streptococcus pyogenes MGAS315
aaaguuggcuacucu

SEQ ID NO: 2219991 - RNA, 22 nt, Streptococcus pyogenes MGAS315
aaaguuggcuacucuauuugaa

SEQ ID NO: 2219992 - RNA, 17 nt, Streptococcus pyogenes MGAS315
aaaguucuucuaaacgu

SEQ ID NO: 2219993 - RNA, 15 nt, Streptococcus pyogenes MGAS315
aaaguuauaaagaaa

SEQ ID NO: 2219994 - RNA, 15 nt, Streptococcus pyogenes MGAS315
aaauaucuuaccauu

SEQ ID NO: 2219995 - RNA, 12 nt, Streptococcus pyogenes MGAS315
aaauaucuagaa

SEQ ID NO: 2219996 - RNA, 21 nt, Streptococcus pyogenes MGAS315
aaauauauucuaauuugugaa

SEQ ID NO: 2219997 - RNA, 11 nt, Streptococcus pyogenes MGAS315
aaauauauuuu

SEQ ID NO: 2219998 - RNA, 18 nt, Streptococcus pyogenes MGAS315
aaauauaaccucuagcuu

SEQ ID NO: 2219999 - RNA, 21 nt, Streptococcus pyogenes MGAS315
aaauagcaaugguuaaaaaga

SEQ ID NO: 2220000 - RNA, 23 nt, Streptococcus pyogenes MGAS315
aaagcaagcaacacgcuaucaac

SEQ ID NO: 2220001 - RNA, 19 nt, Streptococcus pyogenes MGAS315
aaagcaagggaaacaccac

SEQ ID NO: 2220002 - RNA, 23 nt, Streptococcus pyogenes MGAS315
aaaggcuuuuuuguauuacucaa

SEQ ID NO: 2220003 - RNA, 17 nt, Streptococcus pyogenes MGAS315
aaagccuacaacagcag

SEQ ID NO: 2220004 - RNA, 16 nt, Streptococcus pyogenes MGAS315
aaagcauaaaaauauu

SEQ ID NO: 2220005 - RNA, 12 nt, Streptococcus pyogenes MGAS315
aacauaacaauc

SEQ ID NO: 2220006 - RNA, 19 nt, Streptococcus pyogenes MGAS315
aaccacagcaauuuguucc

SEQ ID NO: 2220007 - RNA, 17 nt, Streptococcus pyogenes MGAS315
aaccacagcaauuuguu

SEQ ID NO: 2220008 - RNA, 17 nt, Streptococcus pyogenes MGAS315
aaccauagaagccaauu

SEQ ID NO: 2220009 - RNA, 13 nt, Streptococcus pyogenes MGAS315
aaccuuugccauu

SEQ ID NO: 2220010 - RNA, 16 nt, Streptococcus pyogenes MGAS315
aaccugcauaucugcc

SEQ ID NO: 2220011 - RNA, 17 nt, Streptococcus pyogenes MGAS315
aaccugcauaucugccc

SEQ ID NO: 2220012 - RNA, 22 nt, Streptococcus pyogenes MGAS315
aacgcuaugcucguaggacacu

SEQ ID NO: 2220013 - RNA, 16 nt, Streptococcus pyogenes MGAS315
aacuuucuauuaccua

SEQ ID NO: 2220014 - RNA, 15 nt, Streptococcus pyogenes MGAS315
aacuuguuaacaaua

SEQ ID NO: 2220015 - RNA, 13 nt, Streptococcus pyogenes MGAS315
aacuuuucagguu

SEQ ID NO: 2220016 - RNA, 15 nt, Streptococcus pyogenes MGAS315
aacucgauaaaaacg

SEQ ID NO: 2220017 - RNA, 19 nt, Streptococcus pyogenes MGAS315
aacucgauaaaaacgauca

SEQ ID NO: 2220018 - RNA, 18 nt, Streptococcus pyogenes MGAS315
aacuauucuagacccuag

SEQ ID NO: 2220019 - RNA, 20 nt, Streptococcus pyogenes MGAS315
aacuauauuguuaguuuuau

SEQ ID NO: 2220020 - RNA, 21 nt, Streptococcus pyogenes MGAS315
aacuauauuguuaguuuuauc

SEQ ID NO: 2220021 - RNA, 15 nt, Streptococcus pyogenes MGAS315
aagacuagagucucu

SEQ ID NO: 2220022 - RNA, 14 nt, Streptococcus pyogenes MGAS315
aagaccauaaaaaa

SEQ ID NO: 2220023 - RNA, 22 nt, Streptococcus pyogenes MGAS315
aagaauuggggcggcacuucca

SEQ ID NO: 2220024 - RNA, 17 nt, Streptococcus pyogenes MGAS315
aagauauuuuaaaauag

SEQ ID NO: 2220025 - RNA, 20 nt, Streptococcus pyogenes MGAS315
aagauaccaaaucaaaaagc

SEQ ID NO: 2220026 - RNA, 21 nt, Streptococcus pyogenes MGAS315
aagauaccggguuguuuuuuc

SEQ ID NO: 2220027 - RNA, 15 nt, Streptococcus pyogenes MGAS315
aagagagcuugguuu

SEQ ID NO: 2220028 - RNA, 19 nt, Streptococcus pyogenes MGAS315
aagagcguuagcuuuuuaa

SEQ ID NO: 2220029 - RNA, 20 nt, Streptococcus pyogenes MGAS315
aauaacaucuugauuguaag

SEQ ID NO: 2220030 - RNA, 23 nt, Streptococcus pyogenes MGAS315
aauaaguauagcauaaaauaguu

SEQ ID NO: 2220031 - RNA, 21 nt, Streptococcus pyogenes MGAS315
aauaaguauagcauaaaauag

SEQ ID NO: 2220032 - RNA, 15 nt, Streptococcus pyogenes MGAS315
aauaaguauuuuaaa

SEQ ID NO: 2220033 - RNA, 18 nt, Streptococcus pyogenes MGAS315
aauaaguauuuuaaaauc

SEQ ID NO: 2220034 - RNA, 15 nt, Streptococcus pyogenes MGAS315
aaaaauaacuuuaaa

SEQ ID NO: 2220035 - RNA, 22 nt, Streptococcus pyogenes MGAS315
aauaaugccaucaaaaaaagac

SEQ ID NO: 2220036 - RNA, 15 nt, Streptococcus pyogenes MGAS315
aauacagaaaaaagc

SEQ ID NO: 2220037 - RNA, 21 nt, Streptococcus pyogenes MGAS315
aauagcguaaagcaagggaaa

SEQ ID NO: 2220038 - RNA, 24 nt, Streptococcus pyogenes MGAS315
aauagcgccagcaauuuucccauc

SEQ ID NO: 2220039 - RNA, 17 nt, Streptococcus pyogenes MGAS315
aauagcaaugguuaaaa

SEQ ID NO: 2220040 - RNA, 20 nt, Streptococcus pyogenes MGAS315
aauagcaaugguuaaaaaga

SEQ ID NO: 2220041 - RNA, 21 nt, Streptococcus pyogenes MGAS315
aauagcaaugguuaaaaagag

SEQ ID NO: 2220042 - RNA, 16 nt, Streptococcus pyogenes MGAS315
aauagaauaaaaaaga

SEQ ID NO: 2220043 - RNA, 18 nt, Streptococcus pyogenes MGAS315
aauagguaaagauuuuaa

SEQ ID NO: 2220044 - RNA, 16 nt, Streptococcus pyogenes MGAS315
aauagguaaagauuuu

SEQ ID NO: 2220045 - RNA, 17 nt, Streptococcus pyogenes MGAS315
aauaguggcaaaugaca

SEQ ID NO: 2220046 - RNA, 14 nt, Streptococcus pyogenes MGAS315
aauauagucugcau

SEQ ID NO: 2220047 - RNA, 13 nt, Streptococcus pyogenes MGAS315
aauauaauaaaaa

SEQ ID NO: 2220048 - RNA, 24 nt, Streptococcus pyogenes MGAS315
aauaugaaaacguguauucuuaaa

SEQ ID NO: 2220049 - RNA, 13 nt, Streptococcus pyogenes MGAS315
aauaucuuaccau

SEQ ID NO: 2220050 - RNA, 20 nt, Streptococcus pyogenes MGAS315
aauaucgccaauaaaaaaga

SEQ ID NO: 2220051 - RNA, 17 nt, Streptococcus pyogenes MGAS315
aauaucgccaauaaaaa

SEQ ID NO: 2220052 - RNA, 14 nt, Streptococcus pyogenes MGAS315
aauaucaugaagua

SEQ ID NO: 2220053 - RNA, 14 nt, Streptococcus pyogenes MGAS315
aaguagauacuuug

SEQ ID NO: 2220054 - RNA, 18 nt, Streptococcus pyogenes MGAS315
aaguaauguuuuuacauu

SEQ ID NO: 2220055 - RNA, 23 nt, Streptococcus pyogenes MGAS315
aagggaagaagauccuacaagag

SEQ ID NO: 2220056 - RNA, 23 nt, Streptococcus pyogenes MGAS315
aaguauuuuaaaauccucuuuua

SEQ ID NO: 2220057 - RNA, 19 nt, Streptococcus pyogenes MGAS315
aaguagcguacauggaugc

SEQ ID NO: 2220058 - RNA, 18 nt, Streptococcus pyogenes MGAS315
aagucuaucugcagauuu

SEQ ID NO: 2220059 - RNA, 22 nt, Streptococcus pyogenes MGAS315
aagucuaucugcagauuuuaag

SEQ ID NO: 2220060 - RNA, 13 nt, Streptococcus pyogenes MGAS315
aagucucuugcaa

SEQ ID NO: 2220061 - RNA, 15 nt, Streptococcus pyogenes MGAS315
aaguguuuugucuua

SEQ ID NO: 2220062 - RNA, 22 nt, Streptococcus pyogenes MGAS315
aaguguuuugucuuauagaaua

SEQ ID NO: 2220063 - RNA, 22 nt, Streptococcus pyogenes MGAS315
aagugccaguaaggaaaucaau

SEQ ID NO: 2220064 - RNA, 16 nt, Streptococcus pyogenes MGAS315
aaggcugcgaugauuu

SEQ ID NO: 2220065 - RNA, 22 nt, Streptococcus pyogenes MGAS315
aaggcuuguucuuuauuuugau

SEQ ID NO: 2220066 - RNA, 21 nt, Streptococcus pyogenes MGAS315
aaggcaauccaaaucaacaug

SEQ ID NO: 2220067 - RNA, 18 nt, Streptococcus pyogenes MGAS315
aaggcaauccaaaucaac

SEQ ID NO: 2220068 - RNA, 21 nt, Streptococcus pyogenes MGAS315
aaggcagucgcagaguacaag

SEQ ID NO: 2220069 - RNA, 15 nt, Streptococcus pyogenes MGAS315
aaggaugaaaugauu

SEQ ID NO: 2220070 - RNA, 18 nt, Streptococcus pyogenes MGAS315
aaggaccaagauucauga

SEQ ID NO: 2220071 - RNA, 22 nt, Streptococcus pyogenes MGAS315
aagcuuggauugccgccaugcu

SEQ ID NO: 2220072 - RNA, 15 nt, Streptococcus pyogenes MGAS315
aagcuuuaagcuuug

SEQ ID NO: 2220073 - RNA, 22 nt, Streptococcus pyogenes MGAS315
aagcuugucuaugagauaccuu

SEQ ID NO: 2220074 - RNA, 14 nt, Streptococcus pyogenes MGAS315
aauuuuugccaaaa

SEQ ID NO: 2220075 - RNA, 16 nt, Streptococcus pyogenes MGAS315
acaacgcuauuuuuaa

SEQ ID NO: 2220076 - RNA, 13 nt, Streptococcus pyogenes MGAS315
acaauaacacaga

SEQ ID NO: 2220077 - RNA, 18 nt, Streptococcus pyogenes MGAS315
acaagcaucuuugcaggg

SEQ ID NO: 2220078 - RNA, 19 nt, Streptococcus pyogenes MGAS315
acaagcaucuuugcagggu

SEQ ID NO: 2220079 - RNA, 15 nt, Streptococcus pyogenes MGAS315
acaagagcuuaaaag

SEQ ID NO: 2220080 - RNA, 18 nt, Streptococcus pyogenes MGAS315
acaagagcuuaaaaguua

SEQ ID NO: 2220081 - RNA, 14 nt, Streptococcus pyogenes MGAS315
acaaugaaacguua

SEQ ID NO: 2220082 - RNA, 15 nt, Streptococcus pyogenes MGAS315
acaauuaaaaagcaa

SEQ ID NO: 2220083 - RNA, 16 nt, Streptococcus pyogenes MGAS315
acaauuaaaaagcaaa

SEQ ID NO: 2220084 - RNA, 19 nt, Streptococcus pyogenes MGAS315
acagcguaagccaaaucuu

SEQ ID NO: 2220085 - RNA, 15 nt, Streptococcus pyogenes MGAS315
acagcguaagccaaa

SEQ ID NO: 2220086 - RNA, 17 nt, Streptococcus pyogenes MGAS315
acagauagucaaaaaga

SEQ ID NO: 2220087 - RNA, 23 nt, Streptococcus pyogenes MGAS315
acagagucuuaguuuaggaauca

SEQ ID NO: 2220088 - RNA, 11 nt, Streptococcus pyogenes MGAS315
acagagucuua

SEQ ID NO: 2220089 - RNA, 14 nt, Streptococcus pyogenes MGAS315
acagacaccaaaaa

SEQ ID NO: 2220090 - RNA, 18 nt, Streptococcus pyogenes MGAS315
acagacaucgucgugcca

SEQ ID NO: 2220091 - RNA, 14 nt, Streptococcus pyogenes MGAS315
acaucaaaaaaagc

SEQ ID NO: 2220092 - RNA, 13 nt, Streptococcus pyogenes MGAS315
acaucaaaaaaag

SEQ ID NO: 2220093 - RNA, 20 nt, Streptococcus pyogenes MGAS315
acaucaaaggcuuuuuugua

SEQ ID NO: 2220094 - RNA, 21 nt, Streptococcus pyogenes MGAS315
acauacuuuauuaaucaaaaa

SEQ ID NO: 2220095 - RNA, 19 nt, Streptococcus pyogenes MGAS315
acauuucgugucuaaaaua

SEQ ID NO: 2220096 - RNA, 15 nt, Streptococcus pyogenes MGAS315
accaagugcugccau

SEQ ID NO: 2220097 - RNA, 18 nt, Streptococcus pyogenes MGAS315
accaauaaugagcaaggc

SEQ ID NO: 2220098 - RNA, 17 nt, Streptococcus pyogenes MGAS315
accaauuuaagguauug

SEQ ID NO: 2220099 - RNA, 20 nt, Streptococcus pyogenes MGAS315
accacacgauuaaccguucc

SEQ ID NO: 2220100 - RNA, 15 nt, Streptococcus pyogenes MGAS315
accacaccuaauaaa

SEQ ID NO: 2220101 - RNA, 18 nt, Streptococcus pyogenes MGAS315
accacaccuaauaaaaua

SEQ ID NO: 2220102 - RNA, 16 nt, Streptococcus pyogenes MGAS315
aauuucagauaaaacc

SEQ ID NO: 2220103 - RNA, 19 nt, Streptococcus pyogenes MGAS315
aauuuauuuuucauuugaa

SEQ ID NO: 2220104 - RNA, 21 nt, Streptococcus pyogenes MGAS315
aauuuacgccguaagccgcaa

SEQ ID NO: 2220105 - RNA, 21 nt, Streptococcus pyogenes MGAS315
aauuuuauugcaauucuuuua

SEQ ID NO: 2220106 - RNA, 13 nt, Streptococcus pyogenes MGAS315
aauuuucauuuuu

SEQ ID NO: 2220107 - RNA, 15 nt, Streptococcus pyogenes MGAS315
aauuuucauuuuugg

SEQ ID NO: 2220108 - RNA, 17 nt, Streptococcus pyogenes MGAS315
aauuuuaaaugacauga

SEQ ID NO: 2220109 - RNA, 15 nt, Streptococcus pyogenes MGAS315
aauuaguauauugua

SEQ ID NO: 2220110 - RNA, 16 nt, Streptococcus pyogenes MGAS315
aauuacuuaucaucau

SEQ ID NO: 2220111 - RNA, 19 nt, Streptococcus pyogenes MGAS315
aauuagcauauuuugauua

SEQ ID NO: 2220112 - RNA, 16 nt, Streptococcus pyogenes MGAS315
aauguaugauuuuaac

SEQ ID NO: 2220113 - RNA, 17 nt, Streptococcus pyogenes MGAS315
aauuccucccuauuuac

SEQ ID NO: 2220114 - RNA, 22 nt, Streptococcus pyogenes MGAS315
aaucuuguggguuuugaacgaa

SEQ ID NO: 2220115 - RNA, 14 nt, Streptococcus pyogenes MGAS315
aaugauaaggcugc

SEQ ID NO: 2220116 - RNA, 21 nt, Streptococcus pyogenes MGAS315
aaugacuauagaaaguaaaaa

SEQ ID NO: 2220117 - RNA, 15 nt, Streptococcus pyogenes MGAS315
aaugaccuuugauaa

SEQ ID NO: 2220118 - RNA, 19 nt, Streptococcus pyogenes MGAS315
aaugacaucaaaggguguu

SEQ ID NO: 2220119 - RNA, 18 nt, Streptococcus pyogenes MGAS315
aaucgcuuuaggaauauc

SEQ ID NO: 2220120 - RNA, 17 nt, Streptococcus pyogenes MGAS315
aauccuuuugaaaaauu

SEQ ID NO: 2220121 - RNA, 12 nt, Streptococcus pyogenes MGAS315
aaaaauuaagaa

SEQ ID NO: 2220122 - RNA, 14 nt, Streptococcus pyogenes MGAS315
acucaaaaaauaca

SEQ ID NO: 2220123 - RNA, 16 nt, Streptococcus pyogenes MGAS315
acucaaaaaauacaau

SEQ ID NO: 2220124 - RNA, 15 nt, Streptococcus pyogenes MGAS315
acucuucgguacuga

SEQ ID NO: 2220125 - RNA, 15 nt, Streptococcus pyogenes MGAS315
acucuccaaaguucu

SEQ ID NO: 2220126 - RNA, 20 nt, Streptococcus pyogenes MGAS315
acuucuuccuuguacaagag

SEQ ID NO: 2220127 - RNA, 16 nt, Streptococcus pyogenes MGAS315
acuucaaggaaggcuu

SEQ ID NO: 2220128 - RNA, 21 nt, Streptococcus pyogenes MGAS315
acuucaaggaaggcuuguucu

SEQ ID NO: 2220129 - RNA, 16 nt, Streptococcus pyogenes MGAS315
acuuauuuuuuuaaga

SEQ ID NO: 2220130 - RNA, 14 nt, Streptococcus pyogenes MGAS315
acuucaaaaauacu

SEQ ID NO: 2220131 - RNA, 15 nt, Streptococcus pyogenes MGAS315
acuggcacaaacucu

SEQ ID NO: 2220132 - RNA, 15 nt, Streptococcus pyogenes MGAS315
acuuacaaaaagccu

SEQ ID NO: 2220133 - RNA, 22 nt, Streptococcus pyogenes MGAS315
acuauauuguuaguuuuauccc

SEQ ID NO: 2220134 - RNA, 20 nt, Streptococcus pyogenes MGAS315
acuauugaaucuuguuuaac

SEQ ID NO: 2220135 - RNA, 17 nt, Streptococcus pyogenes MGAS315
acuagagcuuugccaau

SEQ ID NO: 2220136 - RNA, 17 nt, Streptococcus pyogenes MGAS315
acgugcuauaagaggau

SEQ ID NO: 2220137 - RNA, 17 nt, Streptococcus pyogenes MGAS315
acguucuguuuaaaaua

SEQ ID NO: 2220138 - RNA, 12 nt, Streptococcus pyogenes MGAS315
acuaaaaucaug

SEQ ID NO: 2220139 - RNA, 12 nt, Streptococcus pyogenes MGAS315
acgggcugccau

SEQ ID NO: 2220140 - RNA, 17 nt, Streptococcus pyogenes MGAS315
accuccuaaacuaauaa

SEQ ID NO: 2220141 - RNA, 20 nt, Streptococcus pyogenes MGAS315
accuccuaaugcugcaaaau

SEQ ID NO: 2220142 - RNA, 19 nt, Streptococcus pyogenes MGAS315
accuccuaaacuaauaaga

SEQ ID NO: 2220143 - RNA, 20 nt, Streptococcus pyogenes MGAS315
accuuaugcagguguuuaaa

SEQ ID NO: 2220144 - RNA, 21 nt, Streptococcus pyogenes MGAS315
accuuaggcagacaauuauuu

SEQ ID NO: 2220145 - RNA, 18 nt, Streptococcus pyogenes MGAS315
accuuagugguuugcaaa

SEQ ID NO: 2220146 - RNA, 19 nt, Streptococcus pyogenes MGAS315
accuugaugcugcuuaucu

SEQ ID NO: 2220147 - RNA, 16 nt, Streptococcus pyogenes MGAS315
acgcauuucuuuuuug

SEQ ID NO: 2220148 - RNA, 19 nt, Streptococcus pyogenes MGAS315
acccgucuuacaauuaaua

SEQ ID NO: 2220149 - RNA, 15 nt, Streptococcus pyogenes MGAS315
acccgucuuacaauu

SEQ ID NO: 2220150 - RNA, 21 nt, Streptococcus pyogenes MGAS315
accauuuaugaggccaauaau

SEQ ID NO: 2220151 - RNA, 21 nt, Streptococcus pyogenes MGAS315
accaucaaugacuugaccaaa

SEQ ID NO: 2220152 - RNA, 21 nt, Streptococcus pyogenes MGAS315
acuugaugguaauauugcuca

SEQ ID NO: 2220153 - RNA, 14 nt, Streptococcus pyogenes MGAS315
agaaaaagcaauga

SEQ ID NO: 2220154 - RNA, 15 nt, Streptococcus pyogenes MGAS315
agaaaaagcaaugau

SEQ ID NO: 2220155 - RNA, 12 nt, Streptococcus pyogenes MGAS315
agaaaaagcaau

SEQ ID NO: 2220156 - RNA, 20 nt, Streptococcus pyogenes MGAS315
agaagauccuacaagaggag

SEQ ID NO: 2220157 - RNA, 14 nt, Streptococcus pyogenes MGAS315
agaagcaaaauuau

SEQ ID NO: 2220158 - RNA, 17 nt, Streptococcus pyogenes MGAS315
agaacucuuauaauaaa

SEQ ID NO: 2220159 - RNA, 13 nt, Streptococcus pyogenes MGAS315
aaaacaccccaaa

SEQ ID NO: 2220160 - RNA, 15 nt, Streptococcus pyogenes MGAS315
agacaccaaaaaaag

SEQ ID NO: 2220161 - RNA, 23 nt, Streptococcus pyogenes MGAS315
agacaucgucgugccaccucuaa

SEQ ID NO: 2220162 - RNA, 19 nt, Streptococcus pyogenes MGAS315
agagguugguaaaaaggca

SEQ ID NO: 2220163 - RNA, 15 nt, Streptococcus pyogenes MGAS315
agagguugguaaaaa

SEQ ID NO: 2220164 - RNA, 16 nt, Streptococcus pyogenes MGAS315
agaggugcaacugcua

SEQ ID NO: 2220165 - RNA, 14 nt, Streptococcus pyogenes MGAS315
agauccuacaagag

SEQ ID NO: 2220166 - RNA, 13 nt, Streptococcus pyogenes MGAS315
agauacuucugau

SEQ ID NO: 2220167 - RNA, 18 nt, Streptococcus pyogenes MGAS315
agauaagugccaucaggc

SEQ ID NO: 2220168 - RNA, 15 nt, Streptococcus pyogenes MGAS315
agaguacaaggcaau

SEQ ID NO: 2220169 - RNA, 16 nt, Streptococcus pyogenes MGAS315
agaguacaaggcaauc

SEQ ID NO: 2220170 - RNA, 18 nt, Streptococcus pyogenes MGAS315
aaaaccauaccuacugcc

SEQ ID NO: 2220171 - RNA, 16 nt, Streptococcus pyogenes MGAS315
agauucaauaugaaaa

SEQ ID NO: 2220172 - RNA, 13 nt, Streptococcus pyogenes MGAS315
agauuuuaaauau

SEQ ID NO: 2220173 - RNA, 22 nt, Streptococcus pyogenes MGAS315
agcaaauagcaaugguuaaaaa

SEQ ID NO: 2220174 - RNA, 16 nt, Streptococcus pyogenes MGAS315
agcaaaaugcuguuug

SEQ ID NO: 2220175 - RNA, 12 nt, Streptococcus pyogenes MGAS315
agccaagcaauc

SEQ ID NO: 2220176 - RNA, 23 nt, Streptococcus pyogenes MGAS315
agccagauggugcuacugaugua

SEQ ID NO: 2220177 - RNA, 13 nt, Streptococcus pyogenes MGAS315
agccagugcugcu

SEQ ID NO: 2220178 - RNA, 22 nt, Streptococcus pyogenes MGAS315
agcagcaccaguaaaggcagga

SEQ ID NO: 2220179 - RNA, 15 nt, Streptococcus pyogenes MGAS315
agcaguuauaauuag

SEQ ID NO: 2220180 - RNA, 17 nt, Streptococcus pyogenes MGAS315
agcguaagccaaaucuu

SEQ ID NO: 2220181 - RNA, 17 nt, Streptococcus pyogenes MGAS315
agcguuagcuuuuuaaa

SEQ ID NO: 2220182 - RNA, 14 nt, Streptococcus pyogenes MGAS315
agcuauagaaacuu

SEQ ID NO: 2220183 - RNA, 18 nt, Streptococcus pyogenes MGAS315
agcguugacaguuaaaaa

SEQ ID NO: 2220184 - RNA, 17 nt, Streptococcus pyogenes MGAS315
agcuaaaagcauaaaaa

SEQ ID NO: 2220185 - RNA, 22 nt, Streptococcus pyogenes MGAS315
aguaaaaauacuagaaaaagca

SEQ ID NO: 2220186 - RNA, 13 nt, Streptococcus pyogenes MGAS315
aguaaaacaauaa

SEQ ID NO: 2220187 - RNA, 16 nt, Streptococcus pyogenes MGAS315
aguaaaaucuuauuuu

SEQ ID NO: 2220188 - RNA, 21 nt, Streptococcus pyogenes MGAS315
aguaucuaggagggacuguca

SEQ ID NO: 2220189 - RNA, 12 nt, Streptococcus pyogenes MGAS315
aguaugaacaaa

SEQ ID NO: 2220190 - RNA, 20 nt, Streptococcus pyogenes MGAS315
aguauauuguaauaacaaaa

SEQ ID NO: 2220191 - RNA, 20 nt, Streptococcus pyogenes MGAS315
agguaauagcguaaagcaag

SEQ ID NO: 2220192 - RNA, 15 nt, Streptococcus pyogenes MGAS315
aggccuguauuucuu

SEQ ID NO: 2220193 - RNA, 23 nt, Streptococcus pyogenes MGAS315
aggccuagcuuuuuacaucaaaa

SEQ ID NO: 2220194 - RNA, 20 nt, Streptococcus pyogenes MGAS315
agcugcugcuaaagcaauca

SEQ ID NO: 2220195 - RNA, 15 nt, Streptococcus pyogenes MGAS315
agcuuaucaagguug

SEQ ID NO: 2220196 - RNA, 20 nt, Streptococcus pyogenes MGAS315
agcuuaaugucauacaaaaa

SEQ ID NO: 2220197 - RNA, 15 nt, Streptococcus pyogenes MGAS315
agcuuguagcuuagc

SEQ ID NO: 2220198 - RNA, 12 nt, Streptococcus pyogenes MGAS315
auaaaaugccuc

SEQ ID NO: 2220199 - RNA, 18 nt, Streptococcus pyogenes MGAS315
auaaaaucguuauuaauu

SEQ ID NO: 2220200 - RNA, 13 nt, Streptococcus pyogenes MGAS315
auaauaaagugcg

SEQ ID NO: 2220201 - RNA, 18 nt, Streptococcus pyogenes MGAS315
auaaucgaugauaauagu

SEQ ID NO: 2220202 - RNA, 16 nt, Streptococcus pyogenes MGAS315
auacaaaaaaccuucc

SEQ ID NO: 2220203 - RNA, 18 nt, Streptococcus pyogenes MGAS315
auaauuugacuucaaaaa

SEQ ID NO: 2220204 - RNA, 21 nt, Streptococcus pyogenes MGAS315
auaauuugacuucaaaaauac

SEQ ID NO: 2220205 - RNA, 16 nt, Streptococcus pyogenes MGAS315
auaauuuauuuuucau

SEQ ID NO: 2220206 - RNA, 15 nt, Streptococcus pyogenes MGAS315
auaauuucaauaaua

SEQ ID NO: 2220207 - RNA, 22 nt, Streptococcus pyogenes MGAS315
auacaacuggcuagccaaaucu

SEQ ID NO: 2220208 - RNA, 23 nt, Streptococcus pyogenes MGAS315
auacaacuggcuagccaaaucug

SEQ ID NO: 2220209 - RNA, 12 nt, Streptococcus pyogenes MGAS315
auacagaaaaaa

SEQ ID NO: 2220210 - RNA, 18 nt, Streptococcus pyogenes MGAS315
auacagaaaaaagcuugu

SEQ ID NO: 2220211 - RNA, 23 nt, Streptococcus pyogenes MGAS315
agucuuuggcaccaagugcugcc

SEQ ID NO: 2220212 - RNA, 20 nt, Streptococcus pyogenes MGAS315
agucaaaaagacuucuuccu

SEQ ID NO: 2220213 - RNA, 12 nt, Streptococcus pyogenes MGAS315
agucaaaccagu

SEQ ID NO: 2220214 - RNA, 21 nt, Streptococcus pyogenes MGAS315
agucaaaccaguugauaccau

SEQ ID NO: 2220215 - RNA, 16 nt, Streptococcus pyogenes MGAS315
aguugugccuuuucuu

SEQ ID NO: 2220216 - RNA, 21 nt, Streptococcus pyogenes MGAS315
aguugcgaucauaaauaaaga

SEQ ID NO: 2220217 - RNA, 23 nt, Streptococcus pyogenes MGAS315
aguuugguuuuuugguguugcaa

SEQ ID NO: 2220218 - RNA, 21 nt, Streptococcus pyogenes MGAS315
aguuauguuauaagagaagua

SEQ ID NO: 2220219 - RNA, 22 nt, Streptococcus pyogenes MGAS315
aguuaccguguucgauaaauuc

SEQ ID NO: 2220220 - RNA, 17 nt, Streptococcus pyogenes MGAS315
aguguauuacuucuuuu

SEQ ID NO: 2220221 - RNA, 18 nt, Streptococcus pyogenes MGAS315
augaaaacguguauucuu

SEQ ID NO: 2220222 - RNA, 19 nt, Streptococcus pyogenes MGAS315
augacuauagaaaguaaaa

SEQ ID NO: 2220223 - RNA, 13 nt, Streptococcus pyogenes MGAS315
augauauaaaaau

SEQ ID NO: 2220224 - RNA, 21 nt, Streptococcus pyogenes MGAS315
aucucaguuuuuuugauuuuc

SEQ ID NO: 2220225 - RNA, 21 nt, Streptococcus pyogenes MGAS315
aucuccaagaucugcacacac

SEQ ID NO: 2220226 - RNA, 15 nt, Streptococcus pyogenes MGAS315
aucuguuuaaaaaca

SEQ ID NO: 2220227 - RNA, 17 nt, Streptococcus pyogenes MGAS315
aucuguuuaaaaacaaa

SEQ ID NO: 2220228 - RNA, 21 nt, Streptococcus pyogenes MGAS315
aucuguauauuuaauagcauu

SEQ ID NO: 2220229 - RNA, 18 nt, Streptococcus pyogenes MGAS315
aucuuaaaauaaucaacc

SEQ ID NO: 2220230 - RNA, 13 nt, Streptococcus pyogenes MGAS315
aucugaauuauua

SEQ ID NO: 2220231 - RNA, 13 nt, Streptococcus pyogenes MGAS315
aucuuauuuuaag

SEQ ID NO: 2220232 - RNA, 17 nt, Streptococcus pyogenes MGAS315
aaaagaaaaucuaauca

SEQ ID NO: 2220233 - RNA, 16 nt, Streptococcus pyogenes MGAS315
aaaacuucaaauuuca

SEQ ID NO: 2220234 - RNA, 22 nt, Streptococcus pyogenes MGAS315
aaaacuuuugacuugguuuaau

SEQ ID NO: 2220235 - RNA, 15 nt, Streptococcus pyogenes MGAS315
auaccuucauagaca

SEQ ID NO: 2220236 - RNA, 22 nt, Streptococcus pyogenes MGAS315
auacuggucaauggaaauuuua

SEQ ID NO: 2220237 - RNA, 14 nt, Streptococcus pyogenes MGAS315
auacuagaaaaagc

SEQ ID NO: 2220238 - RNA, 16 nt, Streptococcus pyogenes MGAS315
auacuagaaaaagcaa

SEQ ID NO: 2220239 - RNA, 17 nt, Streptococcus pyogenes MGAS315
auacuagucuuuggcac

SEQ ID NO: 2220240 - RNA, 18 nt, Streptococcus pyogenes MGAS315
auacucaauauaauaaaa

SEQ ID NO: 2220241 - RNA, 21 nt, Streptococcus pyogenes MGAS315
auacucaauauaauaaaaagc

SEQ ID NO: 2220242 - RNA, 13 nt, Streptococcus pyogenes MGAS315
auacucagucacu

SEQ ID NO: 2220243 - RNA, 17 nt, Streptococcus pyogenes MGAS315
auagcaaugguuaaaaa

SEQ ID NO: 2220244 - RNA, 19 nt, Streptococcus pyogenes MGAS315
auagcaaugguuaaaaaga

SEQ ID NO: 2220245 - RNA, 13 nt, Streptococcus pyogenes MGAS315
auagcauaaaaua

SEQ ID NO: 2220246 - RNA, 19 nt, Streptococcus pyogenes MGAS315
auagcguaaagcaagggaa

SEQ ID NO: 2220247 - RNA, 15 nt, Streptococcus pyogenes MGAS315
auagccuuuaucaac

SEQ ID NO: 2220248 - RNA, 23 nt, Streptococcus pyogenes MGAS315
auagccuuuaucaacuuguuaac

SEQ ID NO: 2220249 - RNA, 21 nt, Streptococcus pyogenes MGAS315
auagcugcugcuaaagcaauc

SEQ ID NO: 2220250 - RNA, 13 nt, Streptococcus pyogenes MGAS315
auaguucccuuaa

SEQ ID NO: 2220251 - RNA, 15 nt, Streptococcus pyogenes MGAS315
auaguucccuuaaua

SEQ ID NO: 2220252 - RNA, 15 nt, Streptococcus pyogenes MGAS315
auagcugauuuguuu

SEQ ID NO: 2220253 - RNA, 15 nt, Streptococcus pyogenes MGAS315
auauaagcaaucauc

SEQ ID NO: 2220254 - RNA, 23 nt, Streptococcus pyogenes MGAS315
auauaagcaaucaucauuuagcu

SEQ ID NO: 2220255 - RNA, 15 nt, Streptococcus pyogenes MGAS315
auaucauauuuuaau

SEQ ID NO: 2220256 - RNA, 19 nt, Streptococcus pyogenes MGAS315
auauccauagaaauuguaa

SEQ ID NO: 2220257 - RNA, 18 nt, Streptococcus pyogenes MGAS315
aucauauuguuaauaugu

SEQ ID NO: 2220258 - RNA, 17 nt, Streptococcus pyogenes MGAS315
aucaucaggguugcaug

SEQ ID NO: 2220259 - RNA, 14 nt, Streptococcus pyogenes MGAS315
aaaacgaucaaaaa

SEQ ID NO: 2220260 - RNA, 18 nt, Streptococcus pyogenes MGAS315
aucaaaccaagguauuua

SEQ ID NO: 2220261 - RNA, 19 nt, Streptococcus pyogenes MGAS315
aucaaaagaccauaaaaaa

SEQ ID NO: 2220262 - RNA, 18 nt, Streptococcus pyogenes MGAS315
aucaacuuguuaacaaua

SEQ ID NO: 2220263 - RNA, 19 nt, Streptococcus pyogenes MGAS315
aucaauaacagaaauuaau

SEQ ID NO: 2220264 - RNA, 14 nt, Streptococcus pyogenes MGAS315
auauuguuaauaua

SEQ ID NO: 2220265 - RNA, 23 nt, Streptococcus pyogenes MGAS315
auauuguuaauauagucugcaug

SEQ ID NO: 2220266 - RNA, 15 nt, Streptococcus pyogenes MGAS315
aucaaaagaccauaa

SEQ ID NO: 2220267 - RNA, 18 nt, Streptococcus pyogenes MGAS315
aucaaaagaccauaaaaa

SEQ ID NO: 2220268 - RNA, 23 nt, Streptococcus pyogenes MGAS315
auauuuuggaucuucaacuacua

SEQ ID NO: 2220269 - RNA, 13 nt, Streptococcus pyogenes MGAS315
auauuuuauuaau

SEQ ID NO: 2220270 - RNA, 22 nt, Streptococcus pyogenes MGAS315
auauuuuaguugauauuuuuua

SEQ ID NO: 2220271 - RNA, 13 nt, Streptococcus pyogenes MGAS315
auauugcucaaga

SEQ ID NO: 2220272 - RNA, 14 nt, Streptococcus pyogenes MGAS315
auauugcucaagac

SEQ ID NO: 2220273 - RNA, 17 nt, Streptococcus pyogenes MGAS315
auuacaagcauuuugca

SEQ ID NO: 2220274 - RNA, 22 nt, Streptococcus pyogenes MGAS315
auuaaucaaaaaacugagacaa

SEQ ID NO: 2220275 - RNA, 14 nt, Streptococcus pyogenes MGAS315
auuaguaaccauag

SEQ ID NO: 2220276 - RNA, 17 nt, Streptococcus pyogenes MGAS315
auuagcgccagcauuug

SEQ ID NO: 2220277 - RNA, 23 nt, Streptococcus pyogenes MGAS315
auuaucugaauuauuaguaacca

SEQ ID NO: 2220278 - RNA, 17 nt, Streptococcus pyogenes MGAS315
auuaucugaauuauuag

SEQ ID NO: 2220279 - RNA, 19 nt, Streptococcus pyogenes MGAS315
auuaucugaauuauuagua

SEQ ID NO: 2220280 - RNA, 13 nt, Streptococcus pyogenes MGAS315
auggguaugccug

SEQ ID NO: 2220281 - RNA, 15 nt, Streptococcus pyogenes MGAS315
auggcuuuccauucu

SEQ ID NO: 2220282 - RNA, 18 nt, Streptococcus pyogenes MGAS315
aaaagcaaauugaaaaaa

SEQ ID NO: 2220283 - RNA, 15 nt, Streptococcus pyogenes MGAS315
augucauacaaaaac

SEQ ID NO: 2220284 - RNA, 16 nt, Streptococcus pyogenes MGAS315
aaaagagagaaugaua

SEQ ID NO: 2220285 - RNA, 17 nt, Streptococcus pyogenes MGAS315
augcucauaggcagaga

SEQ ID NO: 2220286 - RNA, 19 nt, Streptococcus pyogenes MGAS315
augccccaaaguaauccaa

SEQ ID NO: 2220287 - RNA, 14 nt, Streptococcus pyogenes MGAS315
auuuagaaauuuua

SEQ ID NO: 2220288 - RNA, 17 nt, Streptococcus pyogenes MGAS315
auuuaagguauuguuca

SEQ ID NO: 2220289 - RNA, 18 nt, Streptococcus pyogenes MGAS315
auuguuuuaguaaagccu

SEQ ID NO: 2220290 - RNA, 17 nt, Streptococcus pyogenes MGAS315
auugucacugaaaaagc

SEQ ID NO: 2220291 - RNA, 15 nt, Streptococcus pyogenes MGAS315
auugucaaauaaaau

SEQ ID NO: 2220292 - RNA, 13 nt, Streptococcus pyogenes MGAS315
auuguauuugaug

SEQ ID NO: 2220293 - RNA, 18 nt, Streptococcus pyogenes MGAS315
aaaaguaaaaagcaaauu

SEQ ID NO: 2220294 - RNA, 16 nt, Streptococcus pyogenes MGAS315
auugauacaaagacuu

SEQ ID NO: 2220295 - RNA, 17 nt, Streptococcus pyogenes MGAS315
auugauuauucucuauu

SEQ ID NO: 2220296 - RNA, 21 nt, Streptococcus pyogenes MGAS315
auugacaaauccaaugacuaa

SEQ ID NO: 2220297 - RNA, 19 nt, Streptococcus pyogenes MGAS315
auuuugcagguaauuaucu

SEQ ID NO: 2220298 - RNA, 17 nt, Streptococcus pyogenes MGAS315
auuuugguugauagaag

SEQ ID NO: 2220299 - RNA, 19 nt, Streptococcus pyogenes MGAS315
caaaaaguaaaaagcaaau

SEQ ID NO: 2220300 - RNA, 18 nt, Streptococcus pyogenes MGAS315
caaaaaggcuaagaugga

SEQ ID NO: 2220301 - RNA, 17 nt, Streptococcus pyogenes MGAS315
caaaaauaaguauagca

SEQ ID NO: 2220302 - RNA, 11 nt, Streptococcus pyogenes MGAS315
caaaaaagcca

SEQ ID NO: 2220303 - RNA, 22 nt, Streptococcus pyogenes MGAS315
auuugaccacaccuaauaaaau

SEQ ID NO: 2220304 - RNA, 16 nt, Streptococcus pyogenes MGAS315
auuugacuacuagcau

SEQ ID NO: 2220305 - RNA, 13 nt, Streptococcus pyogenes MGAS315
auuuggaggugaa

SEQ ID NO: 2220306 - RNA, 17 nt, Streptococcus pyogenes MGAS315
auuuguuaacaggugac

SEQ ID NO: 2220307 - RNA, 22 nt, Streptococcus pyogenes MGAS315
auuugucuauuguauuugaugg

SEQ ID NO: 2220308 - RNA, 23 nt, Streptococcus pyogenes MGAS315
auuugucaaaaaguaaaaagcaa

SEQ ID NO: 2220309 - RNA, 16 nt, Streptococcus pyogenes MGAS315
auuuaguuauuuuuga

SEQ ID NO: 2220310 - RNA, 23 nt, Streptococcus pyogenes MGAS315
auuuagguacucguaagcauuuu

SEQ ID NO: 2220311 - RNA, 21 nt, Streptococcus pyogenes MGAS315
auuucaauaauaccauuuuua

SEQ ID NO: 2220312 - RNA, 18 nt, Streptococcus pyogenes MGAS315
auuucaauaauaccauuu

SEQ ID NO: 2220313 - RNA, 16 nt, Streptococcus pyogenes MGAS315
auuucaauaauaccau

SEQ ID NO: 2220314 - RNA, 17 nt, Streptococcus pyogenes MGAS315
auuucaauaauaccauu

SEQ ID NO: 2220315 - RNA, 16 nt, Streptococcus pyogenes MGAS315
auuucagauaaaaccu

SEQ ID NO: 2220316 - RNA, 18 nt, Streptococcus pyogenes MGAS315
auuucagauaaaaccuuc

SEQ ID NO: 2220317 - RNA, 21 nt, Streptococcus pyogenes MGAS315
cacaaauacagaaaaaagcuu

SEQ ID NO: 2220318 - RNA, 13 nt, Streptococcus pyogenes MGAS315
cacacaaaucuuc

SEQ ID NO: 2220319 - RNA, 23 nt, Streptococcus pyogenes MGAS315
caauuaauguuaggagcacaaaa

SEQ ID NO: 2220320 - RNA, 16 nt, Streptococcus pyogenes MGAS315
caauuaaaaagcaaaa

SEQ ID NO: 2220321 - RNA, 22 nt, Streptococcus pyogenes MGAS315
caccaauaaugagcaaggcaag

SEQ ID NO: 2220322 - RNA, 14 nt, Streptococcus pyogenes MGAS315
caccaagugcugcc

SEQ ID NO: 2220323 - RNA, 14 nt, Streptococcus pyogenes MGAS315
aaaauaacuuuaaa

SEQ ID NO: 2220324 - RNA, 13 nt, Streptococcus pyogenes MGAS315
caaaguaauccaa

SEQ ID NO: 2220325 - RNA, 13 nt, Streptococcus pyogenes MGAS315
caaauucuuuuug

SEQ ID NO: 2220326 - RNA, 22 nt, Streptococcus pyogenes MGAS315
caacaaguguuuugucuuauag

SEQ ID NO: 2220327 - RNA, 16 nt, Streptococcus pyogenes MGAS315
caaucaucaggguugc

SEQ ID NO: 2220328 - RNA, 13 nt, Streptococcus pyogenes MGAS315
caaucauuuuuaa

SEQ ID NO: 2220329 - RNA, 15 nt, Streptococcus pyogenes MGAS315
caauaacacagaagc

SEQ ID NO: 2220330 - RNA, 17 nt, Streptococcus pyogenes MGAS315
caauaacagaaauuaau

SEQ ID NO: 2220331 - RNA, 20 nt, Streptococcus pyogenes MGAS315
caauagcugcugcuaaagca

SEQ ID NO: 2220332 - RNA, 19 nt, Streptococcus pyogenes MGAS315
caauacucccuucucuagu

SEQ ID NO: 2220333 - RNA, 23 nt, Streptococcus pyogenes MGAS315
caauagcaaguccugcuuuugau

SEQ ID NO: 2220334 - RNA, 15 nt, Streptococcus pyogenes MGAS315
caaggcuaaagccua

SEQ ID NO: 2220335 - RNA, 19 nt, Streptococcus pyogenes MGAS315
caagguuaaguaaaagcga

SEQ ID NO: 2220336 - RNA, 22 nt, Streptococcus pyogenes MGAS315
caagaggaggcaacuguggguu

SEQ ID NO: 2220337 - RNA, 16 nt, Streptococcus pyogenes MGAS315
caagagucaaaccagu

SEQ ID NO: 2220338 - RNA, 19 nt, Streptococcus pyogenes MGAS315
caagagguucgucaagcac

SEQ ID NO: 2220339 - RNA, 20 nt, Streptococcus pyogenes MGAS315
caacuuguuaacaauaagua

SEQ ID NO: 2220340 - RNA, 16 nt, Streptococcus pyogenes MGAS315
caagacuaaagcauuu

SEQ ID NO: 2220341 - RNA, 19 nt, Streptococcus pyogenes MGAS315
caagacuaaagcauuuauu

SEQ ID NO: 2220342 - RNA, 16 nt, Streptococcus pyogenes MGAS315
caagacuaggauugcc

SEQ ID NO: 2220343 - RNA, 16 nt, Streptococcus pyogenes MGAS315
caacucgauaaaaacg

SEQ ID NO: 2220344 - RNA, 20 nt, Streptococcus pyogenes MGAS315
cagcaguugcgaucauaaau

SEQ ID NO: 2220345 - RNA, 12 nt, Streptococcus pyogenes MGAS315
cagcaauuuguu

SEQ ID NO: 2220346 - RNA, 17 nt, Streptococcus pyogenes MGAS315
aaaaugcuguuugucau

SEQ ID NO: 2220347 - RNA, 14 nt, Streptococcus pyogenes MGAS315
aaaaucucgauugu

SEQ ID NO: 2220348 - RNA, 19 nt, Streptococcus pyogenes MGAS315
aaaaucaugggaaaagcua

SEQ ID NO: 2220349 - RNA, 21 nt, Streptococcus pyogenes MGAS315
cagaaauuaauaaauuuuugu

SEQ ID NO: 2220350 - RNA, 22 nt, Streptococcus pyogenes MGAS315
cagaaauuaauaaauuuuuguc

SEQ ID NO: 2220351 - RNA, 12 nt, Streptococcus pyogenes MGAS315
cagaaauaaucu

SEQ ID NO: 2220352 - RNA, 23 nt, Streptococcus pyogenes MGAS315
cagguuuuugguuaucaguauac

SEQ ID NO: 2220353 - RNA, 16 nt, Streptococcus pyogenes MGAS315
caguaaggaaaucaau

SEQ ID NO: 2220354 - RNA, 17 nt, Streptococcus pyogenes MGAS315
cauuuuuaucuguauau

SEQ ID NO: 2220355 - RNA, 15 nt, Streptococcus pyogenes MGAS315
ccaaacucaaaccaa

SEQ ID NO: 2220356 - RNA, 21 nt, Streptococcus pyogenes MGAS315
ccaaaucuuguggguuuugaa

SEQ ID NO: 2220357 - RNA, 20 nt, Streptococcus pyogenes MGAS315
ccaaggucugcgcgacuaaa

SEQ ID NO: 2220358 - RNA, 16 nt, Streptococcus pyogenes MGAS315
ccaauaaugagcaagg

SEQ ID NO: 2220359 - RNA, 19 nt, Streptococcus pyogenes MGAS315
ccacaccuacuaacaacaa

SEQ ID NO: 2220360 - RNA, 15 nt, Streptococcus pyogenes MGAS315
ccagcauuugccaug

SEQ ID NO: 2220361 - RNA, 16 nt, Streptococcus pyogenes MGAS315
ccagccacuacaagca

SEQ ID NO: 2220362 - RNA, 21 nt, Streptococcus pyogenes MGAS315
ccagauacuucugauaaaaau

SEQ ID NO: 2220363 - RNA, 19 nt, Streptococcus pyogenes MGAS315
cauacucuugucgcugaau

SEQ ID NO: 2220364 - RNA, 21 nt, Streptococcus pyogenes MGAS315
cauacuuuauuaaucaaaaaa

SEQ ID NO: 2220365 - RNA, 21 nt, Streptococcus pyogenes MGAS315
cauagacaagcuuuuuuauaa

SEQ ID NO: 2220366 - RNA, 16 nt, Streptococcus pyogenes MGAS315
caucaaaaaaagcaau

SEQ ID NO: 2220367 - RNA, 17 nt, Streptococcus pyogenes MGAS315
caucaaaaaaagcaaug

SEQ ID NO: 2220368 - RNA, 14 nt, Streptococcus pyogenes MGAS315
caucaaaaaaagca

SEQ ID NO: 2220369 - RNA, 21 nt, Streptococcus pyogenes MGAS315
caucaaaggcuuuuuuguauu

SEQ ID NO: 2220370 - RNA, 21 nt, Streptococcus pyogenes MGAS315
caucaaguggauacaagguua

SEQ ID NO: 2220371 - RNA, 18 nt, Streptococcus pyogenes MGAS315
caucaauuuucauuuuug

SEQ ID NO: 2220372 - RNA, 16 nt, Streptococcus pyogenes MGAS315
caucagcaucugaaaa

SEQ ID NO: 2220373 - RNA, 18 nt, Streptococcus pyogenes MGAS315
caucuugccaucagcauc

SEQ ID NO: 2220374 - RNA, 15 nt, Streptococcus pyogenes MGAS315
caugaagugguucaa

SEQ ID NO: 2220375 - RNA, 16 nt, Streptococcus pyogenes MGAS315
cauggguaaaaugacu

SEQ ID NO: 2220376 - RNA, 21 nt, Streptococcus pyogenes MGAS315
cauuauugacaaauccaauga

SEQ ID NO: 2220377 - RNA, 14 nt, Streptococcus pyogenes MGAS315
cauuauugacaaau

SEQ ID NO: 2220378 - RNA, 20 nt, Streptococcus pyogenes MGAS315
cauuaucaacaaucuuaaaa

SEQ ID NO: 2220379 - RNA, 12 nt, Streptococcus pyogenes MGAS315
cauucuugcaga

SEQ ID NO: 2220380 - RNA, 17 nt, Streptococcus pyogenes MGAS315
ccuucaaaaaagggaag

SEQ ID NO: 2220381 - RNA, 22 nt, Streptococcus pyogenes MGAS315
ccuucaaaaaagggaagaagau

SEQ ID NO: 2220382 - RNA, 14 nt, Streptococcus pyogenes MGAS315
ccuucaaaaaaggg

SEQ ID NO: 2220383 - RNA, 13 nt, Streptococcus pyogenes MGAS315
ccuuaucucaguu

SEQ ID NO: 2220384 - RNA, 14 nt, Streptococcus pyogenes MGAS315
ccuuaauaaacucu

SEQ ID NO: 2220385 - RNA, 21 nt, Streptococcus pyogenes MGAS315
ccuucuuggauagcaagugag

SEQ ID NO: 2220386 - RNA, 19 nt, Streptococcus pyogenes MGAS315
ccuuuaucuuauuuuaaga

SEQ ID NO: 2220387 - RNA, 21 nt, Streptococcus pyogenes MGAS315
cgaccugcucaaaacuucggc

SEQ ID NO: 2220388 - RNA, 20 nt, Streptococcus pyogenes MGAS315
cgaauaugauauaaaaaugg

SEQ ID NO: 2220389 - RNA, 20 nt, Streptococcus pyogenes MGAS315
ccuacuagcacaaaaucauu

SEQ ID NO: 2220390 - RNA, 19 nt, Streptococcus pyogenes MGAS315
ccuacgauaaaacaaauaa

SEQ ID NO: 2220391 - RNA, 20 nt, Streptococcus pyogenes MGAS315
ccuacgauaaaacaaauaau

SEQ ID NO: 2220392 - RNA, 22 nt, Streptococcus pyogenes MGAS315
ccuauuugacuuguuacaaaaa

SEQ ID NO: 2220393 - RNA, 17 nt, Streptococcus pyogenes MGAS315
ccuccuugcaauagagc

SEQ ID NO: 2220394 - RNA, 19 nt, Streptococcus pyogenes MGAS315
ccuaauaaaauagcaccua

SEQ ID NO: 2220395 - RNA, 21 nt, Streptococcus pyogenes MGAS315
ccguuugagauaacucuucgg

SEQ ID NO: 2220396 - RNA, 13 nt, Streptococcus pyogenes MGAS315
ccggcagggguca

SEQ ID NO: 2220397 - RNA, 13 nt, Streptococcus pyogenes MGAS315
aaacauauuauag

SEQ ID NO: 2220398 - RNA, 12 nt, Streptococcus pyogenes MGAS315
aaacaccccaaa

SEQ ID NO: 2220399 - RNA, 21 nt, Streptococcus pyogenes MGAS315
aaaccaguugauaccaugugc

SEQ ID NO: 2220400 - RNA, 20 nt, Streptococcus pyogenes MGAS315
aaacaccaccaauaaugagc

SEQ ID NO: 2220401 - RNA, 16 nt, Streptococcus pyogenes MGAS315
ccauuauaaaucuuac

SEQ ID NO: 2220402 - RNA, 13 nt, Streptococcus pyogenes MGAS315
cgcccagaaauaa

SEQ ID NO: 2220403 - RNA, 19 nt, Streptococcus pyogenes MGAS315
aaacguaacguaauagaau

SEQ ID NO: 2220404 - RNA, 18 nt, Streptococcus pyogenes MGAS315
cgauuaaccguuccuguc

SEQ ID NO: 2220405 - RNA, 21 nt, Streptococcus pyogenes MGAS315
cgcucaacuggcacaaacucu

SEQ ID NO: 2220406 - RNA, 23 nt, Streptococcus pyogenes MGAS315
cgcuguaauguuguaaacuuccu

SEQ ID NO: 2220407 - RNA, 22 nt, Streptococcus pyogenes MGAS315
uuuuuuaagacuauguugcuua

SEQ ID NO: 2220408 - RNA, 14 nt, Streptococcus pyogenes MGAS315
uuuuuguuuugccu

SEQ ID NO: 2220409 - RNA, 20 nt, Streptococcus pyogenes MGAS315
uuuugaugcagcuaaaagca

SEQ ID NO: 2220410 - RNA, 17 nt, Streptococcus pyogenes MGAS315
uuuuuggugucagcaua

SEQ ID NO: 2220411 - RNA, 18 nt, Streptococcus pyogenes MGAS315
uuuuuggugucagcauaa

SEQ ID NO: 2220412 - RNA, 23 nt, Streptococcus pyogenes MGAS315
uuuuugguuaucaguauacucag

SEQ ID NO: 2220413 - RNA, 21 nt, Streptococcus pyogenes MGAS315
uuugucugacuuaaauuugga

SEQ ID NO: 2220414 - RNA, 19 nt, Streptococcus pyogenes MGAS315
uuugucuucuucuuuucag

SEQ ID NO: 2220415 - RNA, 15 nt, Streptococcus pyogenes MGAS315
uuuguuaacagguga

SEQ ID NO: 2220416 - RNA, 13 nt, Streptococcus pyogenes MGAS315
uuuguuaacaggu

SEQ ID NO: 2220417 - RNA, 21 nt, Streptococcus pyogenes MGAS315
uuuguguugaagaaggucaug

SEQ ID NO: 2220418 - RNA, 17 nt, Streptococcus pyogenes MGAS315
uuuguuccaucugcaca

SEQ ID NO: 2220419 - RNA, 16 nt, Streptococcus pyogenes MGAS315
uuuuaacuauuuaacu

SEQ ID NO: 2220420 - RNA, 15 nt, Streptococcus pyogenes MGAS315
uuuuaacguuuugaa

SEQ ID NO: 2220421 - RNA, 19 nt, Streptococcus pyogenes MGAS315
uuuggccaauaaaauaucu

SEQ ID NO: 2220422 - RNA, 17 nt, Streptococcus pyogenes MGAS315
uuuggccuacuagcaca

SEQ ID NO: 2220423 - RNA, 16 nt, Streptococcus pyogenes MGAS315
uuugguggaagaguaa

SEQ ID NO: 2220424 - RNA, 14 nt, Streptococcus pyogenes MGAS315
uuugguuaucagua

SEQ ID NO: 2220425 - RNA, 21 nt, Streptococcus pyogenes MGAS315
uuugucaacucgauaaaaacg

SEQ ID NO: 2220426 - RNA, 19 nt, Streptococcus pyogenes MGAS315
uuuguaucucauaacaaau

SEQ ID NO: 2220427 - RNA, 18 nt, Streptococcus pyogenes MGAS315
uuugcguuguagguaaua

SEQ ID NO: 2220428 - RNA, 20 nt, Streptococcus pyogenes MGAS315
uuuggaggugaaaauaucuu

SEQ ID NO: 2220429 - RNA, 14 nt, Streptococcus pyogenes MGAS315
uuuucuuuuuggcu

SEQ ID NO: 2220430 - RNA, 23 nt, Streptococcus pyogenes MGAS315
uuuucucaaaaauauauucuaau

SEQ ID NO: 2220431 - RNA, 14 nt, Streptococcus pyogenes MGAS315
uuuuacuuuuaaaa

SEQ ID NO: 2220432 - RNA, 19 nt, Streptococcus pyogenes MGAS315
uuuuacaucaaaaaaagca

SEQ ID NO: 2220433 - RNA, 13 nt, Streptococcus pyogenes MGAS315
uuuuacaucaaaa

SEQ ID NO: 2220434 - RNA, 13 nt, Streptococcus pyogenes MGAS315
uuuuacauuuuua

SEQ ID NO: 2220435 - RNA, 17 nt, Streptococcus pyogenes MGAS315
uuuuacauuuuuacaau

SEQ ID NO: 2220436 - RNA, 18 nt, Streptococcus pyogenes MGAS315
uuuuauccccuauucaau

SEQ ID NO: 2220437 - RNA, 22 nt, Streptococcus pyogenes MGAS315
uuuuauccccuauucaauauuu

SEQ ID NO: 2220438 - RNA, 18 nt, Streptococcus pyogenes MGAS315
uuuuauaugucaucaaaa

SEQ ID NO: 2220439 - RNA, 22 nt, Streptococcus pyogenes MGAS315
uuuuaguaaagccuuauccauu

SEQ ID NO: 2220440 - RNA, 19 nt, Streptococcus pyogenes MGAS315
uuuuaguaaagccuuaucc

SEQ ID NO: 2220441 - RNA, 19 nt, Streptococcus pyogenes MGAS315
uugaaucuuguuuaaccuc

SEQ ID NO: 2220442 - RNA, 15 nt, Streptococcus pyogenes MGAS315
uugaccacaccuaau

SEQ ID NO: 2220443 - RNA, 19 nt, Streptococcus pyogenes MGAS315
uugaaaagaugcacacaaa

SEQ ID NO: 2220444 - RNA, 19 nt, Streptococcus pyogenes MGAS315
uugaaaugugguaagaaga

SEQ ID NO: 2220445 - RNA, 18 nt, Streptococcus pyogenes MGAS315
uucuucuuuucagagaug

SEQ ID NO: 2220446 - RNA, 19 nt, Streptococcus pyogenes MGAS315
uugagauaacucuucggua

SEQ ID NO: 2220447 - RNA, 15 nt, Streptococcus pyogenes MGAS315
uugacuucaaaaaua

SEQ ID NO: 2220448 - RNA, 13 nt, Streptococcus pyogenes MGAS315
uugauauaaaauu

SEQ ID NO: 2220449 - RNA, 17 nt, Streptococcus pyogenes MGAS315
uugauuacugauaaacu

SEQ ID NO: 2220450 - RNA, 22 nt, Streptococcus pyogenes MGAS315
uucuuaacgaucuauugacuug

SEQ ID NO: 2220451 - RNA, 16 nt, Streptococcus pyogenes MGAS315
uucuguuuaaaauaua

SEQ ID NO: 2220452 - RNA, 23 nt, Streptococcus pyogenes MGAS315
uucuguuuaaaauauauuuugga

SEQ ID NO: 2220453 - RNA, 21 nt, Streptococcus pyogenes MGAS315
uucuguauuguagaggacuaa

SEQ ID NO: 2220454 - RNA, 16 nt, Streptococcus pyogenes MGAS315
uucugaaaauaaaaua

SEQ ID NO: 2220455 - RNA, 23 nt, Streptococcus pyogenes MGAS315
uucucucguuuuuuuagcgcuaa

SEQ ID NO: 2220456 - RNA, 12 nt, Streptococcus pyogenes MGAS315
uucucaaaaaua

SEQ ID NO: 2220457 - RNA, 18 nt, Streptococcus pyogenes MGAS315
uucucaaaaauauauucu

SEQ ID NO: 2220458 - RNA, 16 nt, Streptococcus pyogenes MGAS315
uucuaaaacgaugaga

SEQ ID NO: 2220459 - RNA, 14 nt, Streptococcus pyogenes MGAS315
uuguuacaaaaaac

SEQ ID NO: 2220460 - RNA, 16 nt, Streptococcus pyogenes MGAS315
uuguuacaaaaaacaa

SEQ ID NO: 2220461 - RNA, 13 nt, Streptococcus pyogenes MGAS315
uuguuacaaaaaa

SEQ ID NO: 2220462 - RNA, 22 nt, Streptococcus pyogenes MGAS315
uugugcuaaucuaucucguaau

SEQ ID NO: 2220463 - RNA, 12 nt, Streptococcus pyogenes MGAS315
uuguauagguag

SEQ ID NO: 2220464 - RNA, 16 nt, Streptococcus pyogenes MGAS315
uuuaauacguuuauuu

SEQ ID NO: 2220465 - RNA, 23 nt, Streptococcus pyogenes MGAS315
uuuaaaauaguucccuuaauaaa

SEQ ID NO: 2220466 - RNA, 20 nt, Streptococcus pyogenes MGAS315
uuuaacaugauguaccaauu

SEQ ID NO: 2220467 - RNA, 13 nt, Streptococcus pyogenes MGAS315
uuguuguauuaug

SEQ ID NO: 2220468 - RNA, 23 nt, Streptococcus pyogenes MGAS315
uuguuuuuucaaagggagauucu

SEQ ID NO: 2220469 - RNA, 22 nt, Streptococcus pyogenes MGAS315
uuguuuuggccaauaaaauauc

SEQ ID NO: 2220470 - RNA, 17 nt, Streptococcus pyogenes MGAS315
uugcuuuuuucuaaccu

SEQ ID NO: 2220471 - RNA, 13 nt, Streptococcus pyogenes MGAS315
uugcuuaaugacc

SEQ ID NO: 2220472 - RNA, 15 nt, Streptococcus pyogenes MGAS315
uugguggaagaguaa

SEQ ID NO: 2220473 - RNA, 14 nt, Streptococcus pyogenes MGAS315
uugccuuuaacaug

SEQ ID NO: 2220474 - RNA, 11 nt, Streptococcus pyogenes MGAS315
uuucucaguaa

SEQ ID NO: 2220475 - RNA, 13 nt, Streptococcus pyogenes MGAS315
uuucguuuuauuu

SEQ ID NO: 2220476 - RNA, 19 nt, Streptococcus pyogenes MGAS315
uuugccauggcaagagcac

SEQ ID NO: 2220477 - RNA, 23 nt, Streptococcus pyogenes MGAS315
uuugccaauaucaagccccucua

SEQ ID NO: 2220478 - RNA, 22 nt, Streptococcus pyogenes MGAS315
uuugaggugaugcucucauaaa

SEQ ID NO: 2220479 - RNA, 13 nt, Streptococcus pyogenes MGAS315
uuugagaacgaau

SEQ ID NO: 2220480 - RNA, 21 nt, Streptococcus pyogenes MGAS315
uuugauugauuugucuucucc

SEQ ID NO: 2220481 - RNA, 19 nt, Streptococcus pyogenes MGAS315
uuugauauuuuuucucaaa

SEQ ID NO: 2220482 - RNA, 20 nt, Streptococcus pyogenes MGAS315
uuugauauuuuuucucaaaa

SEQ ID NO: 2220483 - RNA, 13 nt, Streptococcus pyogenes MGAS315
uuugaccgaaaaa

SEQ ID NO: 2220484 - RNA, 21 nt, Streptococcus pyogenes MGAS315
uuugacuuguuacaaaaaaca

SEQ ID NO: 2220485 - RNA, 19 nt, Streptococcus pyogenes MGAS315
uuugacagacaccaaaaaa

SEQ ID NO: 2220486 - RNA, 12 nt, Streptococcus pyogenes MGAS315
uuugaauguugu

SEQ ID NO: 2220487 - RNA, 22 nt, Streptococcus pyogenes MGAS315
uuugaaccgaaacguaacguaa

SEQ ID NO: 2220488 - RNA, 15 nt, Streptococcus pyogenes MGAS315
uuugaaguaaaggau

SEQ ID NO: 2220489 - RNA, 18 nt, Streptococcus pyogenes MGAS315
uuucugguuuuaauauug

SEQ ID NO: 2220490 - RNA, 15 nt, Streptococcus pyogenes MGAS315
uuucaguuguuuuaa

SEQ ID NO: 2220491 - RNA, 22 nt, Streptococcus pyogenes MGAS315
uuucagauaaaaccuucaaaaa

SEQ ID NO: 2220492 - RNA, 21 nt, Streptococcus pyogenes MGAS315
uuucauuaguuaauaagacaa

SEQ ID NO: 2220493 - RNA, 22 nt, Streptococcus pyogenes MGAS315
uuucauuaguuaauaagacaaa

SEQ ID NO: 2220494 - RNA, 19 nt, Streptococcus pyogenes MGAS315
uuuaugaccauuuuuacug

SEQ ID NO: 2220495 - RNA, 16 nt, Streptococcus pyogenes MGAS315
uuuauuaaucaaaaaa

SEQ ID NO: 2220496 - RNA, 17 nt, Streptococcus pyogenes MGAS315
uuuagguacucguaagc

SEQ ID NO: 2220497 - RNA, 18 nt, Streptococcus pyogenes MGAS315
uuuacuauggcuucuaaa

SEQ ID NO: 2220498 - RNA, 19 nt, Streptococcus pyogenes MGAS315
uuuacggcuucuacacaaa

SEQ ID NO: 2220499 - RNA, 18 nt, Streptococcus pyogenes MGAS315
uuuacaucaaaaaaagca

SEQ ID NO: 2220500 - RNA, 22 nt, Streptococcus pyogenes MGAS315
uuuacaucaaaaaaagcaauga

SEQ ID NO: 2220501 - RNA, 11 nt, Streptococcus pyogenes MGAS315
ucaggccacua

SEQ ID NO: 2220502 - RNA, 23 nt, Streptococcus pyogenes MGAS315
ucaguaaucuaaagcaucagcau

SEQ ID NO: 2220503 - RNA, 16 nt, Streptococcus pyogenes MGAS315
ucaguagugaugagua

SEQ ID NO: 2220504 - RNA, 15 nt, Streptococcus pyogenes MGAS315
ucaguuuuuuugauu

SEQ ID NO: 2220505 - RNA, 21 nt, Streptococcus pyogenes MGAS315
ucauaaacaaugagucaccug

SEQ ID NO: 2220506 - RNA, 21 nt, Streptococcus pyogenes MGAS315
ucaguuaaugccaacuuuuca

SEQ ID NO: 2220507 - RNA, 14 nt, Streptococcus pyogenes MGAS315
ucauauuuuaaucu

SEQ ID NO: 2220508 - RNA, 21 nt, Streptococcus pyogenes MGAS315
ucauauaagcaaucaucauuu

SEQ ID NO: 2220509 - RNA, 19 nt, Streptococcus pyogenes MGAS315
ucauacucaauagcugcug

SEQ ID NO: 2220510 - RNA, 18 nt, Streptococcus pyogenes MGAS315
ucaucuugccaucagcau

SEQ ID NO: 2220511 - RNA, 20 nt, Streptococcus pyogenes MGAS315
ucaucuugccaucagcaucu

SEQ ID NO: 2220512 - RNA, 20 nt, Streptococcus pyogenes MGAS315
ucaugacgccuccaaauacu

SEQ ID NO: 2220513 - RNA, 23 nt, Streptococcus pyogenes MGAS315
ucauuaucaacaaucuuaaaaua

SEQ ID NO: 2220514 - RNA, 17 nt, Streptococcus pyogenes MGAS315
ucauuagaauaagaaaa

SEQ ID NO: 2220515 - RNA, 21 nt, Streptococcus pyogenes MGAS315
ucaugggaaaagcuaaguaaa

SEQ ID NO: 2220516 - RNA, 18 nt, Streptococcus pyogenes MGAS315
uccaacaacgcuauuuuu

SEQ ID NO: 2220517 - RNA, 12 nt, Streptococcus pyogenes MGAS315
uccaacaacgcu

SEQ ID NO: 2220518 - RNA, 17 nt, Streptococcus pyogenes MGAS315
uccaaaguucuucuaaa

SEQ ID NO: 2220519 - RNA, 20 nt, Streptococcus pyogenes MGAS315
uccaacgugcuauaagagga

SEQ ID NO: 2220520 - RNA, 14 nt, Streptococcus pyogenes MGAS315
ucauuuugguugau

SEQ ID NO: 2220521 - RNA, 18 nt, Streptococcus pyogenes MGAS315
ucauugcuuuuuaugauu

SEQ ID NO: 2220522 - RNA, 13 nt, Streptococcus pyogenes MGAS315
uccaaugacuaag

SEQ ID NO: 2220523 - RNA, 15 nt, Streptococcus pyogenes MGAS315
ucccauguuuuauua

SEQ ID NO: 2220524 - RNA, 18 nt, Streptococcus pyogenes MGAS315
ucccauuuuucgacagac

SEQ ID NO: 2220525 - RNA, 13 nt, Streptococcus pyogenes MGAS315
uccauuauaaauc

SEQ ID NO: 2220526 - RNA, 18 nt, Streptococcus pyogenes MGAS315
uccauuauaaaucuuacu

SEQ ID NO: 2220527 - RNA, 23 nt, Streptococcus pyogenes MGAS315
uccauuauaaaucuuacuaacua

SEQ ID NO: 2220528 - RNA, 15 nt, Streptococcus pyogenes MGAS315
uccauucuuuauaau

SEQ ID NO: 2220529 - RNA, 16 nt, Streptococcus pyogenes MGAS315
ucccuucauuuuacua

SEQ ID NO: 2220530 - RNA, 15 nt, Streptococcus pyogenes MGAS315
uccuuaaauuauauu

SEQ ID NO: 2220531 - RNA, 14 nt, Streptococcus pyogenes MGAS315
ucgauuauuaacca

SEQ ID NO: 2220532 - RNA, 14 nt, Streptococcus pyogenes MGAS315
uccucugaaaaguu

SEQ ID NO: 2220533 - RNA, 23 nt, Streptococcus pyogenes MGAS315
uccucuuuuaauuuggaggugaa

SEQ ID NO: 2220534 - RNA, 17 nt, Streptococcus pyogenes MGAS315
uccucuaacauguccaa

SEQ ID NO: 2220535 - RNA, 18 nt, Streptococcus pyogenes MGAS315
uccuaaugcugcaaaauu

SEQ ID NO: 2220536 - RNA, 16 nt, Streptococcus pyogenes MGAS315
ucucauaacaaauuua

SEQ ID NO: 2220537 - RNA, 14 nt, Streptococcus pyogenes MGAS315
ucucauaacaaauu

SEQ ID NO: 2220538 - RNA, 15 nt, Streptococcus pyogenes MGAS315
ucucauaaacaauga

SEQ ID NO: 2220539 - RNA, 11 nt, Streptococcus pyogenes MGAS315
ucuauuguauu

SEQ ID NO: 2220540 - RNA, 16 nt, Streptococcus pyogenes MGAS315
ucuauuuuugguguua

SEQ ID NO: 2220541 - RNA, 12 nt, Streptococcus pyogenes MGAS315
ucucaaaaauau

SEQ ID NO: 2220542 - RNA, 15 nt, Streptococcus pyogenes MGAS315
ucucagagacaauaa

SEQ ID NO: 2220543 - RNA, 21 nt, Streptococcus pyogenes MGAS315
ucucagagacaauaaggucau

SEQ ID NO: 2220544 - RNA, 18 nt, Streptococcus pyogenes MGAS315
ucuauauguguaauuucu

SEQ ID NO: 2220545 - RNA, 23 nt, Streptococcus pyogenes MGAS315
ucuagacccuagcauaaaagaua

SEQ ID NO: 2220546 - RNA, 23 nt, Streptococcus pyogenes MGAS315
ucuaggagggacugucaaaaaau

SEQ ID NO: 2220547 - RNA, 13 nt, Streptococcus pyogenes MGAS315
ucuauacaaaaag

SEQ ID NO: 2220548 - RNA, 15 nt, Streptococcus pyogenes MGAS315
ucuauacaaaaaggc

SEQ ID NO: 2220549 - RNA, 14 nt, Streptococcus pyogenes MGAS315
ucuaaaauauauug

SEQ ID NO: 2220550 - RNA, 11 nt, Streptococcus pyogenes MGAS315
ucuaaaauaua

SEQ ID NO: 2220551 - RNA, 21 nt, Streptococcus pyogenes MGAS315
ucguuuuacggcuucuacaca

SEQ ID NO: 2220552 - RNA, 19 nt, Streptococcus pyogenes MGAS315
ucggcaucgguaaugcuuu

SEQ ID NO: 2220553 - RNA, 14 nt, Streptococcus pyogenes MGAS315
ucuuacaauuaaua

SEQ ID NO: 2220554 - RNA, 21 nt, Streptococcus pyogenes MGAS315
ucuucauagcuuaaugucaua

SEQ ID NO: 2220555 - RNA, 17 nt, Streptococcus pyogenes MGAS315
ucuugcauuaccuuauu

SEQ ID NO: 2220556 - RNA, 19 nt, Streptococcus pyogenes MGAS315
ucuugucgcugaauaaaca

SEQ ID NO: 2220557 - RNA, 22 nt, Streptococcus pyogenes MGAS315
ucuugaggugauucuuuuuuac

SEQ ID NO: 2220558 - RNA, 15 nt, Streptococcus pyogenes MGAS315
ucuucugcauuauca

SEQ ID NO: 2220559 - RNA, 22 nt, Streptococcus pyogenes MGAS315
ucuucugaugcguuuauaaagu

SEQ ID NO: 2220560 - RNA, 20 nt, Streptococcus pyogenes MGAS315
ucugaugcguuuauaaaguu

SEQ ID NO: 2220561 - RNA, 22 nt, Streptococcus pyogenes MGAS315
ucugaugcguuuauaaaguuuu

SEQ ID NO: 2220562 - RNA, 15 nt, Streptococcus pyogenes MGAS315
ucugcauuaucaucu

SEQ ID NO: 2220563 - RNA, 11 nt, Streptococcus pyogenes MGAS315
ucuuaaaauaa

SEQ ID NO: 2220564 - RNA, 15 nt, Streptococcus pyogenes MGAS315
ucuggucccacaccu

SEQ ID NO: 2220565 - RNA, 20 nt, Streptococcus pyogenes MGAS315
uggguauucaccguggacuu

SEQ ID NO: 2220566 - RNA, 20 nt, Streptococcus pyogenes MGAS315
ugucaaacauaacaauccua

SEQ ID NO: 2220567 - RNA, 20 nt, Streptococcus pyogenes MGAS315
uguaucucauaacaaauuua

SEQ ID NO: 2220568 - RNA, 16 nt, Streptococcus pyogenes MGAS315
uguauuacucaauuaa

SEQ ID NO: 2220569 - RNA, 16 nt, Streptococcus pyogenes MGAS315
uguauuaugaggugac

SEQ ID NO: 2220570 - RNA, 21 nt, Streptococcus pyogenes MGAS315
uguaucaagagucauuugacu

SEQ ID NO: 2220571 - RNA, 13 nt, Streptococcus pyogenes MGAS315
uguauagguagau

SEQ ID NO: 2220572 - RNA, 23 nt, Streptococcus pyogenes MGAS315
ugguucaagagguucgucaagca

SEQ ID NO: 2220573 - RNA, 19 nt, Streptococcus pyogenes MGAS315
uguaacgcuuguuuaugaa

SEQ ID NO: 2220574 - RNA, 12 nt, Streptococcus pyogenes MGAS315
uguaauaacaaa

SEQ ID NO: 2220575 - RNA, 13 nt, Streptococcus pyogenes MGAS315
uguaauugucucu

SEQ ID NO: 2220576 - RNA, 21 nt, Streptococcus pyogenes MGAS315
uggccaauaaaauaucuagaa

SEQ ID NO: 2220577 - RNA, 19 nt, Streptococcus pyogenes MGAS315
uggacuugaugguaauauu

SEQ ID NO: 2220578 - RNA, 20 nt, Streptococcus pyogenes MGAS315
uggacgucuucuuuuuauua

SEQ ID NO: 2220579 - RNA, 21 nt, Streptococcus pyogenes MGAS315
uggacgucuucuuuuuauuau

SEQ ID NO: 2220580 - RNA, 23 nt, Streptococcus pyogenes MGAS315
uggauuaaaugcccaagaugggu

SEQ ID NO: 2220581 - RNA, 22 nt, Streptococcus pyogenes MGAS315
uggauuaaaugcccaagauggg

SEQ ID NO: 2220582 - RNA, 13 nt, Streptococcus pyogenes MGAS315
uggauagacugau

SEQ ID NO: 2220583 - RNA, 20 nt, Streptococcus pyogenes MGAS315
uggcaccaagugcugccauu

SEQ ID NO: 2220584 - RNA, 20 nt, Streptococcus pyogenes MGAS315
uguuuuaguaaagccuuauc

SEQ ID NO: 2220585 - RNA, 15 nt, Streptococcus pyogenes MGAS315
uguuuaaaauauauu

SEQ ID NO: 2220586 - RNA, 12 nt, Streptococcus pyogenes MGAS315
uuaaaagaaaau

SEQ ID NO: 2220587 - RNA, 15 nt, Streptococcus pyogenes MGAS315
uguuuuuuaguguau

SEQ ID NO: 2220588 - RNA, 22 nt, Streptococcus pyogenes MGAS315
uguuuuggccaauaaaauaucu

SEQ ID NO: 2220589 - RNA, 14 nt, Streptococcus pyogenes MGAS315
uuaaaaagcaaaaa

SEQ ID NO: 2220590 - RNA, 15 nt, Streptococcus pyogenes MGAS315
uguugucaaacauaa

SEQ ID NO: 2220591 - RNA, 16 nt, Streptococcus pyogenes MGAS315
uguuguauuaugaggu

SEQ ID NO: 2220592 - RNA, 17 nt, Streptococcus pyogenes MGAS315
ugugaccagauacuucu

SEQ ID NO: 2220593 - RNA, 18 nt, Streptococcus pyogenes MGAS315
ugucagcauaaaggguaa

SEQ ID NO: 2220594 - RNA, 22 nt, Streptococcus pyogenes MGAS315
ugugacuaguuuauuacaaaac

SEQ ID NO: 2220595 - RNA, 14 nt, Streptococcus pyogenes MGAS315
uuaccuuauuuucu

SEQ ID NO: 2220596 - RNA, 14 nt, Streptococcus pyogenes MGAS315
uuaauaauauuaac

SEQ ID NO: 2220597 - RNA, 18 nt, Streptococcus pyogenes MGAS315
uuaauagagaacagauaa

SEQ ID NO: 2220598 - RNA, 21 nt, Streptococcus pyogenes MGAS315
uuaauagcauugucaaauaaa

SEQ ID NO: 2220599 - RNA, 17 nt, Streptococcus pyogenes MGAS315
uuaauauagucugcaug

SEQ ID NO: 2220600 - RNA, 17 nt, Streptococcus pyogenes MGAS315
uuaacugguaaaguauu

SEQ ID NO: 2220601 - RNA, 15 nt, Streptococcus pyogenes MGAS315
uuaacugguaaagua

SEQ ID NO: 2220602 - RNA, 20 nt, Streptococcus pyogenes MGAS315
uuaagaaggaacucuccaaa

SEQ ID NO: 2220603 - RNA, 15 nt, Streptococcus pyogenes MGAS315
uuaacugacaaaaaa

SEQ ID NO: 2220604 - RNA, 19 nt, Streptococcus pyogenes MGAS315
uuaagacuauguugcuuaa

SEQ ID NO: 2220605 - RNA, 22 nt, Streptococcus pyogenes MGAS315
uuaagggcaaugccaucugcuu

SEQ ID NO: 2220606 - RNA, 20 nt, Streptococcus pyogenes MGAS315
uuaggaucuguuaauuuaug

SEQ ID NO: 2220607 - RNA, 19 nt, Streptococcus pyogenes MGAS315
uuagcgccagcauuugcca

SEQ ID NO: 2220608 - RNA, 17 nt, Streptococcus pyogenes MGAS315
uuagccguccuuaaaag

SEQ ID NO: 2220609 - RNA, 19 nt, Streptococcus pyogenes MGAS315
uuagcaaaaugcuguuugu

SEQ ID NO: 2220610 - RNA, 15 nt, Streptococcus pyogenes MGAS315
uuagcagacaaaagg

SEQ ID NO: 2220611 - RNA, 14 nt, Streptococcus pyogenes MGAS315
uuagcauauuuuga

SEQ ID NO: 2220612 - RNA, 12 nt, Streptococcus pyogenes MGAS315
uuagaacuuuuc

SEQ ID NO: 2220613 - RNA, 12 nt, Streptococcus pyogenes MGAS315
uuaguuuuuaaa

SEQ ID NO: 2220614 - RNA, 19 nt, Streptococcus pyogenes MGAS315
uuaguuuaggaaucacaac

SEQ ID NO: 2220615 - RNA, 21 nt, Streptococcus pyogenes MGAS315
uuaguauauuguaauaacaaa

SEQ ID NO: 2220616 - RNA, 21 nt, Streptococcus pyogenes MGAS315
uuaguaaagccuuauccauuc

SEQ ID NO: 2220617 - RNA, 13 nt, Streptococcus pyogenes MGAS315
ugcuucuagucag

SEQ ID NO: 2220618 - RNA, 21 nt, Streptococcus pyogenes MGAS315
ugcuuuugaugcagcuaaaag

SEQ ID NO: 2220619 - RNA, 14 nt, Streptococcus pyogenes MGAS315
uggaaauuuuaaau

SEQ ID NO: 2220620 - RNA, 18 nt, Streptococcus pyogenes MGAS315
uggaaauuuuaaaugaca

SEQ ID NO: 2220621 - RNA, 22 nt, Streptococcus pyogenes MGAS315
uggaaacugcacugagccccaa

SEQ ID NO: 2220622 - RNA, 21 nt, Streptococcus pyogenes MGAS315
ugcuuuuuaugauuugucaaa

SEQ ID NO: 2220623 - RNA, 17 nt, Streptococcus pyogenes MGAS315
uggaauagguaaagauu

SEQ ID NO: 2220624 - RNA, 21 nt, Streptococcus pyogenes MGAS315
uggaauagguaaagauuuuaa

SEQ ID NO: 2220625 - RNA, 15 nt, Streptococcus pyogenes MGAS315
ugcucuggcuuuuuc

SEQ ID NO: 2220626 - RNA, 17 nt, Streptococcus pyogenes MGAS315
ugcucuggcuuuuuccu

SEQ ID NO: 2220627 - RNA, 21 nt, Streptococcus pyogenes MGAS315
ugcucaaaacuucggccacgu

SEQ ID NO: 2220628 - RNA, 18 nt, Streptococcus pyogenes MGAS315
ugccaucaaaaaaagaca

SEQ ID NO: 2220629 - RNA, 14 nt, Streptococcus pyogenes MGAS315
ugccuuuucuuuuu

SEQ ID NO: 2220630 - RNA, 21 nt, Streptococcus pyogenes MGAS315
ucuuuauuuugauauuuuuuc

SEQ ID NO: 2220631 - RNA, 22 nt, Streptococcus pyogenes MGAS315
ucuuuauaaugguuuuuugucu

SEQ ID NO: 2220632 - RNA, 17 nt, Streptococcus pyogenes MGAS315
ugaauuauuaguaacca

SEQ ID NO: 2220633 - RNA, 13 nt, Streptococcus pyogenes MGAS315
ugaauuauuagua

SEQ ID NO: 2220634 - RNA, 16 nt, Streptococcus pyogenes MGAS315
ugacaguuaaaaauaa

SEQ ID NO: 2220635 - RNA, 20 nt, Streptococcus pyogenes MGAS315
ugaccacaccuaauaaaaua

SEQ ID NO: 2220636 - RNA, 17 nt, Streptococcus pyogenes MGAS315
ugaccauuuuuacugua

SEQ ID NO: 2220637 - RNA, 16 nt, Streptococcus pyogenes MGAS315
ugagauaccuucauag

SEQ ID NO: 2220638 - RNA, 15 nt, Streptococcus pyogenes MGAS315
ugaguaaaacaauaa

SEQ ID NO: 2220639 - RNA, 21 nt, Streptococcus pyogenes MGAS315
ugcacacaaaucuucuagaau

SEQ ID NO: 2220640 - RNA, 20 nt, Streptococcus pyogenes MGAS315
ugauauuucaucuugcauua

SEQ ID NO: 2220641 - RNA, 16 nt, Streptococcus pyogenes MGAS315
ugauauuccuuuucca

SEQ ID NO: 2220642 - RNA, 23 nt, Streptococcus pyogenes MGAS315
ugauauuuuuucucaaaaauaua

SEQ ID NO: 2220643 - RNA, 22 nt, Streptococcus pyogenes MGAS315
ugaugagacuaaccugcauauc

SEQ ID NO: 2220644 - RNA, 15 nt, Streptococcus pyogenes MGAS315
ugaugcguuuauaaa

SEQ ID NO: 2220645 - RNA, 23 nt, Streptococcus pyogenes MGAS315
ugauuuuucuuguuuugguugau

SEQ ID NO: 2220646 - RNA, 15 nt, Streptococcus pyogenes MGAS315
ugauuauuacaaaua

SEQ ID NO: 2220647 - RNA, 15 nt, Streptococcus pyogenes MGAS315
ugauguuauuaaaua

SEQ ID NO: 2220648 - RNA, 16 nt, Streptococcus pyogenes MGAS315
ugauguaccaauuuaa

SEQ ID NO: 2220649 - RNA, 17 nt, Streptococcus pyogenes MGAS315
ugauggcuuuccauucu

SEQ ID NO: 2220650 - RNA, 14 nt, Streptococcus pyogenes MGAS315
gaccauuaucaaua

SEQ ID NO: 2220651 - RNA, 23 nt, Streptococcus pyogenes MGAS315
gaccuuauuggucgcccuuuuua

SEQ ID NO: 2220652 - RNA, 14 nt, Streptococcus pyogenes MGAS315
gaccuuugauaaga

SEQ ID NO: 2220653 - RNA, 15 nt, Streptococcus pyogenes MGAS315
gacacagauaagaua

SEQ ID NO: 2220654 - RNA, 23 nt, Streptococcus pyogenes MGAS315
gacagacaccaaaaaaagcaugg

SEQ ID NO: 2220655 - RNA, 17 nt, Streptococcus pyogenes MGAS315
gacagcaaggaugaaau

SEQ ID NO: 2220656 - RNA, 23 nt, Streptococcus pyogenes MGAS315
gacaaucgaaaugauagcaccua

SEQ ID NO: 2220657 - RNA, 13 nt, Streptococcus pyogenes MGAS315
gacaaugugacaa

SEQ ID NO: 2220658 - RNA, 19 nt, Streptococcus pyogenes MGAS315
gacaauuauuuugcaggua

SEQ ID NO: 2220659 - RNA, 20 nt, Streptococcus pyogenes MGAS315
gacaauaaggucauuagaau

SEQ ID NO: 2220660 - RNA, 14 nt, Streptococcus pyogenes MGAS315
gacaacccaacgca

SEQ ID NO: 2220661 - RNA, 20 nt, Streptococcus pyogenes MGAS315
gacauuucgugucuaaaaua

SEQ ID NO: 2220662 - RNA, 15 nt, Streptococcus pyogenes MGAS315
gacaguuaaaaauaa

SEQ ID NO: 2220663 - RNA, 21 nt, Streptococcus pyogenes MGAS315
gacaucaaaggguguuuuuua

SEQ ID NO: 2220664 - RNA, 22 nt, Streptococcus pyogenes MGAS315
gacuguauccguaguaggcuga

SEQ ID NO: 2220665 - RNA, 17 nt, Streptococcus pyogenes MGAS315
gacuguauguaucaaga

SEQ ID NO: 2220666 - RNA, 14 nt, Streptococcus pyogenes MGAS315
gacuucaaaaauac

SEQ ID NO: 2220667 - RNA, 21 nt, Streptococcus pyogenes MGAS315
gacuugguucugaaaauaaaa

SEQ ID NO: 2220668 - RNA, 23 nt, Streptococcus pyogenes MGAS315
gacuugguucugaaaauaaaaua

SEQ ID NO: 2220669 - RNA, 21 nt, Streptococcus pyogenes MGAS315
gacuuguuacaaaaaacaagu

SEQ ID NO: 2220670 - RNA, 23 nt, Streptococcus pyogenes MGAS315
gagaaacuaaaggcaauagcaag

SEQ ID NO: 2220671 - RNA, 13 nt, Streptococcus pyogenes MGAS315
gagaacaugugaa

SEQ ID NO: 2220672 - RNA, 14 nt, Streptococcus pyogenes MGAS315
gagagguugguaaa

SEQ ID NO: 2220673 - RNA, 18 nt, Streptococcus pyogenes MGAS315
gagaccuuguagucuucg

SEQ ID NO: 2220674 - RNA, 22 nt, Streptococcus pyogenes MGAS315
gagacaaguugccuuaucucag

SEQ ID NO: 2220675 - RNA, 17 nt, Streptococcus pyogenes MGAS315
gagaaguaauguuuuua

SEQ ID NO: 2220676 - RNA, 22 nt, Streptococcus pyogenes MGAS315
gagaaguaauguuuuuacauuu

SEQ ID NO: 2220677 - RNA, 19 nt, Streptococcus pyogenes MGAS315
gacugacaaaacuucaaau

SEQ ID NO: 2220678 - RNA, 22 nt, Streptococcus pyogenes MGAS315
gacugcaguagcaugacuguau

SEQ ID NO: 2220679 - RNA, 20 nt, Streptococcus pyogenes MGAS315
gacuauagaaaguaaaaaua

SEQ ID NO: 2220680 - RNA, 13 nt, Streptococcus pyogenes MGAS315
gacuaaguccuuu

SEQ ID NO: 2220681 - RNA, 21 nt, Streptococcus pyogenes MGAS315
gaggaguugaaccgcuaaaac

SEQ ID NO: 2220682 - RNA, 19 nt, Streptococcus pyogenes MGAS315
gagcuuuuuuuguuuuggc

SEQ ID NO: 2220683 - RNA, 21 nt, Streptococcus pyogenes MGAS315
gagcuuuaccuccuaaugcug

SEQ ID NO: 2220684 - RNA, 17 nt, Streptococcus pyogenes MGAS315
gagcaaggcaagaggag

SEQ ID NO: 2220685 - RNA, 19 nt, Streptococcus pyogenes MGAS315
gagcaaggcaagaggaggc

SEQ ID NO: 2220686 - RNA, 17 nt, Streptococcus pyogenes MGAS315
gagaugacgguaaauaa

SEQ ID NO: 2220687 - RNA, 21 nt, Streptococcus pyogenes MGAS315
gagagguugguaaaaaggcag

SEQ ID NO: 2220688 - RNA, 22 nt, Streptococcus pyogenes MGAS315
gauucaucuugccaucagcauc

SEQ ID NO: 2220689 - RNA, 20 nt, Streptococcus pyogenes MGAS315
gauuuuaaauaucuuaccau

SEQ ID NO: 2220690 - RNA, 20 nt, Streptococcus pyogenes MGAS315
gauuugcugagcuaaagcca

SEQ ID NO: 2220691 - RNA, 19 nt, Streptococcus pyogenes MGAS315
gauugccauuuaauuggua

SEQ ID NO: 2220692 - RNA, 15 nt, Streptococcus pyogenes MGAS315
gauuuagaaauuuua

SEQ ID NO: 2220693 - RNA, 18 nt, Streptococcus pyogenes MGAS315
gaugaaaugauuguuauu

SEQ ID NO: 2220694 - RNA, 14 nt, Streptococcus pyogenes MGAS315
gaugaaaugauugu

SEQ ID NO: 2220695 - RNA, 18 nt, Streptococcus pyogenes MGAS315
gauagucaaaaagacuuc

SEQ ID NO: 2220696 - RNA, 20 nt, Streptococcus pyogenes MGAS315
gauagucaaaaagacuucuu

SEQ ID NO: 2220697 - RNA, 13 nt, Streptococcus pyogenes MGAS315
gauauaaaauugg

SEQ ID NO: 2220698 - RNA, 14 nt, Streptococcus pyogenes MGAS315
gauaagugccauca

SEQ ID NO: 2220699 - RNA, 19 nt, Streptococcus pyogenes MGAS315
gaucaaaaaucuuuuucuu

SEQ ID NO: 2220700 - RNA, 14 nt, Streptococcus pyogenes MGAS315
gaguacaaggcaau

SEQ ID NO: 2220701 - RNA, 18 nt, Streptococcus pyogenes MGAS315
gagguugguaaaaaggca

SEQ ID NO: 2220702 - RNA, 17 nt, Streptococcus pyogenes MGAS315
gagguugguaaaaaggc

SEQ ID NO: 2220703 - RNA, 22 nt, Streptococcus pyogenes MGAS315
gaggugauacccgagcaacaaa

SEQ ID NO: 2220704 - RNA, 20 nt, Streptococcus pyogenes MGAS315
gauaagauacugcccuugau

SEQ ID NO: 2220705 - RNA, 15 nt, Streptococcus pyogenes MGAS315
gauaaacuacaccau

SEQ ID NO: 2220706 - RNA, 22 nt, Streptococcus pyogenes MGAS315
gagucuuuaucguaaacaaucu

SEQ ID NO: 2220707 - RNA, 22 nt, Streptococcus pyogenes MGAS315
gaguagcuacugccucauuugc

SEQ ID NO: 2220708 - RNA, 20 nt, Streptococcus pyogenes MGAS315
gcagguaauuaucugaauua

SEQ ID NO: 2220709 - RNA, 15 nt, Streptococcus pyogenes MGAS315
gcaggguaucugcuc

SEQ ID NO: 2220710 - RNA, 19 nt, Streptococcus pyogenes MGAS315
gcaguuauaauuaguauau

SEQ ID NO: 2220711 - RNA, 22 nt, Streptococcus pyogenes MGAS315
gcacaaacucugccaauuguuc

SEQ ID NO: 2220712 - RNA, 15 nt, Streptococcus pyogenes MGAS315
gcaccaagugcugcc

SEQ ID NO: 2220713 - RNA, 19 nt, Streptococcus pyogenes MGAS315
gcaauaaucgaugauaaua

SEQ ID NO: 2220714 - RNA, 20 nt, Streptococcus pyogenes MGAS315
gcaauaacaucuugauugua

SEQ ID NO: 2220715 - RNA, 14 nt, Streptococcus pyogenes MGAS315
gcaauccaaaucaa

SEQ ID NO: 2220716 - RNA, 15 nt, Streptococcus pyogenes MGAS315
gcaauccaaaucaac

SEQ ID NO: 2220717 - RNA, 21 nt, Streptococcus pyogenes MGAS315
gcaaccuuaccuacugcugga

SEQ ID NO: 2220718 - RNA, 20 nt, Streptococcus pyogenes MGAS315
gccuacaacagcagcaguug

SEQ ID NO: 2220719 - RNA, 23 nt, Streptococcus pyogenes MGAS315
gccucuucugaugcguuuauaaa

SEQ ID NO: 2220720 - RNA, 20 nt, Streptococcus pyogenes MGAS315
gccugauauuccuuuuccaa

SEQ ID NO: 2220721 - RNA, 15 nt, Streptococcus pyogenes MGAS315
gcguaagccaaaucu

SEQ ID NO: 2220722 - RNA, 23 nt, Streptococcus pyogenes MGAS315
gcguagacagcaaggaugaaaug

SEQ ID NO: 2220723 - RNA, 18 nt, Streptococcus pyogenes MGAS315
gcuaaguagauacuuugg

SEQ ID NO: 2220724 - RNA, 18 nt, Streptococcus pyogenes MGAS315
gcuaaaacaguuccaguu

SEQ ID NO: 2220725 - RNA, 21 nt, Streptococcus pyogenes MGAS315
gcguauaggugaguuuuuucu

SEQ ID NO: 2220726 - RNA, 12 nt, Streptococcus pyogenes MGAS315
gcguuagcuuuu

SEQ ID NO: 2220727 - RNA, 20 nt, Streptococcus pyogenes MGAS315
gcguuaucuccacagagucu

SEQ ID NO: 2220728 - RNA, 20 nt, Streptococcus pyogenes MGAS315
gcgcgacuaaaaucauggga

SEQ ID NO: 2220729 - RNA, 14 nt, Streptococcus pyogenes MGAS315
gugcuacugaugua

SEQ ID NO: 2220730 - RNA, 21 nt, Streptococcus pyogenes MGAS315
gugccuuuucuuuuuggcuga

SEQ ID NO: 2220731 - RNA, 21 nt, Streptococcus pyogenes MGAS315
gugaugaguaggcgaacuuua

SEQ ID NO: 2220732 - RNA, 20 nt, Streptococcus pyogenes MGAS315
gugauugauugauacaaaga

SEQ ID NO: 2220733 - RNA, 20 nt, Streptococcus pyogenes MGAS315
guguuuaaagaccucucaug

SEQ ID NO: 2220734 - RNA, 14 nt, Streptococcus pyogenes MGAS315
guuaaaauagaaga

SEQ ID NO: 2220735 - RNA, 20 nt, Streptococcus pyogenes MGAS315
guguaauccccucauuuaaa

SEQ ID NO: 2220736 - RNA, 22 nt, Streptococcus pyogenes MGAS315
guuaauauagucugcaugaagu

SEQ ID NO: 2220737 - RNA, 15 nt, Streptococcus pyogenes MGAS315
guuaauauagucugc

SEQ ID NO: 2220738 - RNA, 13 nt, Streptococcus pyogenes MGAS315
gugguaagaagaa

SEQ ID NO: 2220739 - RNA, 13 nt, Streptococcus pyogenes MGAS315
guugauauuuuuu

SEQ ID NO: 2220740 - RNA, 15 nt, Streptococcus pyogenes MGAS315
guuggaacuuuguuc

SEQ ID NO: 2220741 - RNA, 19 nt, Streptococcus pyogenes MGAS315
guugcuacaauuuuuucaa

SEQ ID NO: 2220742 - RNA, 20 nt, Streptococcus pyogenes MGAS315
uaaaaacgaucaaaaaucuu

SEQ ID NO: 2220743 - RNA, 18 nt, Streptococcus pyogenes MGAS315
guuugauugauuugucuu

SEQ ID NO: 2220744 - RNA, 22 nt, Streptococcus pyogenes MGAS315
guuugauugauuugucuucucc

SEQ ID NO: 2220745 - RNA, 21 nt, Streptococcus pyogenes MGAS315
uaaaaaguuucugaguugauu

SEQ ID NO: 2220746 - RNA, 16 nt, Streptococcus pyogenes MGAS315
uaaaaaguaaaaucuu

SEQ ID NO: 2220747 - RNA, 17 nt, Streptococcus pyogenes MGAS315
uaaaaauacuagaaaaa

SEQ ID NO: 2220748 - RNA, 20 nt, Streptococcus pyogenes MGAS315
uaaaaauacuagaaaaagca

SEQ ID NO: 2220749 - RNA, 20 nt, Streptococcus pyogenes MGAS315
uaaaaagcaaauugaaaaaa

SEQ ID NO: 2220750 - RNA, 18 nt, Streptococcus pyogenes MGAS315
uaaaaagcaaaaaagcca

SEQ ID NO: 2220751 - RNA, 20 nt, Streptococcus pyogenes MGAS315
uaaaaagcaaaaaagccagu

SEQ ID NO: 2220752 - RNA, 18 nt, Streptococcus pyogenes MGAS315
uaaaaagcaaauugaaaa

SEQ ID NO: 2220753 - RNA, 20 nt, Streptococcus pyogenes MGAS315
uaaaagauauuuuaaaauag

SEQ ID NO: 2220754 - RNA, 18 nt, Streptococcus pyogenes MGAS315
uaaaagagagaaugauag

SEQ ID NO: 2220755 - RNA, 20 nt, Streptococcus pyogenes MGAS315
uaaaacaauaacacagaagc

SEQ ID NO: 2220756 - RNA, 20 nt, Streptococcus pyogenes MGAS315
uaaacaaugagucaccugua

SEQ ID NO: 2220757 - RNA, 23 nt, Streptococcus pyogenes MGAS315
uaaaauaucuagaacagcugcuu

SEQ ID NO: 2220758 - RNA, 14 nt, Streptococcus pyogenes MGAS315
uaaaauaucuagaa

SEQ ID NO: 2220759 - RNA, 16 nt, Streptococcus pyogenes MGAS315
uaaaauauauuuugga

SEQ ID NO: 2220760 - RNA, 14 nt, Streptococcus pyogenes MGAS315
uaaauauaaauuau

SEQ ID NO: 2220761 - RNA, 15 nt, Streptococcus pyogenes MGAS315
uaaauauaaauuauu

SEQ ID NO: 2220762 - RNA, 16 nt, Streptococcus pyogenes MGAS315
uaaacucuauacaaaa

SEQ ID NO: 2220763 - RNA, 17 nt, Streptococcus pyogenes MGAS315
uaaacucuauacaaaaa

SEQ ID NO: 2220764 - RNA, 19 nt, Streptococcus pyogenes MGAS315
uaaacucuauacaaaaagg

SEQ ID NO: 2220765 - RNA, 22 nt, Streptococcus pyogenes MGAS315
uaaagcuaucauacaacuggcu

SEQ ID NO: 2220766 - RNA, 16 nt, Streptococcus pyogenes MGAS315
uaaagcuaucauacaa

SEQ ID NO: 2220767 - RNA, 13 nt, Streptococcus pyogenes MGAS315
uaaagauuuuaaa

SEQ ID NO: 2220768 - RNA, 16 nt, Streptococcus pyogenes MGAS315
uaaagauuuuaaauau

SEQ ID NO: 2220769 - RNA, 11 nt, Streptococcus pyogenes MGAS315
uaaaggagcuu

SEQ ID NO: 2220770 - RNA, 15 nt, Streptococcus pyogenes MGAS315
uaaagauaauuuauu

SEQ ID NO: 2220771 - RNA, 14 nt, Streptococcus pyogenes MGAS315
uaaacuuacaaaaa

SEQ ID NO: 2220772 - RNA, 12 nt, Streptococcus pyogenes MGAS315
uaacaaauuuau

SEQ ID NO: 2220773 - RNA, 15 nt, Streptococcus pyogenes MGAS315
uaaaugucuagcuua

SEQ ID NO: 2220774 - RNA, 20 nt, Streptococcus pyogenes MGAS315
uaacagaaauuaauaaauuu

SEQ ID NO: 2220775 - RNA, 16 nt, Streptococcus pyogenes MGAS315
uaacugguaaaguauu

SEQ ID NO: 2220776 - RNA, 12 nt, Streptococcus pyogenes MGAS315
uaagccaaaucu

SEQ ID NO: 2220777 - RNA, 13 nt, Streptococcus pyogenes MGAS315
uaagccaaaucuu

SEQ ID NO: 2220778 - RNA, 13 nt, Streptococcus pyogenes MGAS315
uaagcauuuugag

SEQ ID NO: 2220779 - RNA, 16 nt, Streptococcus pyogenes MGAS315
uaagauggugcuuuaa

SEQ ID NO: 2220780 - RNA, 13 nt, Streptococcus pyogenes MGAS315
uaagauucaauau

SEQ ID NO: 2220781 - RNA, 20 nt, Streptococcus pyogenes MGAS315
uaagauuaaacuuacaaaaa

SEQ ID NO: 2220782 - RNA, 20 nt, Streptococcus pyogenes MGAS315
uaagauuugaccacaccuaa

SEQ ID NO: 2220783 - RNA, 18 nt, Streptococcus pyogenes MGAS315
uaagcugacgauaaguca

SEQ ID NO: 2220784 - RNA, 13 nt, Streptococcus pyogenes MGAS315
uaacuuucuauua

SEQ ID NO: 2220785 - RNA, 20 nt, Streptococcus pyogenes MGAS315
uaacuuuaaaagggcugacc

SEQ ID NO: 2220786 - RNA, 14 nt, Streptococcus pyogenes MGAS315
uaacuguugucuca

SEQ ID NO: 2220787 - RNA, 17 nt, Streptococcus pyogenes MGAS315
uaagacuauguugcuua

SEQ ID NO: 2220788 - RNA, 19 nt, Streptococcus pyogenes MGAS315
uaagacagucgccaaaucu

SEQ ID NO: 2220789 - RNA, 12 nt, Streptococcus pyogenes MGAS315
uaagacaaagac

SEQ ID NO: 2220790 - RNA, 22 nt, Streptococcus pyogenes MGAS315
uaagagagguugguaaaaaggc

SEQ ID NO: 2220791 - RNA, 23 nt, Streptococcus pyogenes MGAS315
uaagagagguugguaaaaaggca

SEQ ID NO: 2220792 - RNA, 12 nt, Streptococcus pyogenes MGAS315
uauagaaaguaa

SEQ ID NO: 2220793 - RNA, 22 nt, Streptococcus pyogenes MGAS315
uauacgguaaaaacucaaaaaa

SEQ ID NO: 2220794 - RNA, 21 nt, Streptococcus pyogenes MGAS315
uauacgguaaaaacucaaaaa

SEQ ID NO: 2220795 - RNA, 13 nt, Streptococcus pyogenes MGAS315
uauaaugguuuuu

SEQ ID NO: 2220796 - RNA, 23 nt, Streptococcus pyogenes MGAS315
uauaaauuauuaacguuaacaaa

SEQ ID NO: 2220797 - RNA, 14 nt, Streptococcus pyogenes MGAS315
uauaauuucaauaa

SEQ ID NO: 2220798 - RNA, 17 nt, Streptococcus pyogenes MGAS315
uauaauuugacuucaaa

SEQ ID NO: 2220799 - RNA, 18 nt, Streptococcus pyogenes MGAS315
uauaauuugacuucaaaa

SEQ ID NO: 2220800 - RNA, 19 nt, Streptococcus pyogenes MGAS315
uauaauuugacuucaaaaa

SEQ ID NO: 2220801 - RNA, 21 nt, Streptococcus pyogenes MGAS315
uauaauuugacuucaaaaaua

SEQ ID NO: 2220802 - RNA, 23 nt, Streptococcus pyogenes MGAS315
uagguacucguaagcauuuugag

SEQ ID NO: 2220803 - RNA, 17 nt, Streptococcus pyogenes MGAS315
uagugugugugauguaa

SEQ ID NO: 2220804 - RNA, 19 nt, Streptococcus pyogenes MGAS315
uauaaaucuuacuaacuag

SEQ ID NO: 2220805 - RNA, 18 nt, Streptococcus pyogenes MGAS315
uaguuauguuauaagaga

SEQ ID NO: 2220806 - RNA, 16 nt, Streptococcus pyogenes MGAS315
uaguuauuuuugagau

SEQ ID NO: 2220807 - RNA, 20 nt, Streptococcus pyogenes MGAS315
uaucaggccacuagaacucu

SEQ ID NO: 2220808 - RNA, 18 nt, Streptococcus pyogenes MGAS315
uauauuguaauaacaaaa

SEQ ID NO: 2220809 - RNA, 20 nt, Streptococcus pyogenes MGAS315
uaucaauaacagaaauuaau

SEQ ID NO: 2220810 - RNA, 16 nt, Streptococcus pyogenes MGAS315
uauaggugaguuuuuu

SEQ ID NO: 2220811 - RNA, 23 nt, Streptococcus pyogenes MGAS315
uaucugcagauuuuaagacaaca

SEQ ID NO: 2220812 - RNA, 16 nt, Streptococcus pyogenes MGAS315
uaucuaaaggagcuuu

SEQ ID NO: 2220813 - RNA, 17 nt, Streptococcus pyogenes MGAS315
uaucuaagcuauagaaa

SEQ ID NO: 2220814 - RNA, 19 nt, Streptococcus pyogenes MGAS315
uagcaguuauaauuaguau

SEQ ID NO: 2220815 - RNA, 14 nt, Streptococcus pyogenes MGAS315
uagcauauuuugau

SEQ ID NO: 2220816 - RNA, 16 nt, Streptococcus pyogenes MGAS315
uagcauaaaagauauu

SEQ ID NO: 2220817 - RNA, 21 nt, Streptococcus pyogenes MGAS315
uagcaaguccugcuuuugaug

SEQ ID NO: 2220818 - RNA, 17 nt, Streptococcus pyogenes MGAS315
uagcaaugguuaaaaag

SEQ ID NO: 2220819 - RNA, 19 nt, Streptococcus pyogenes MGAS315
uagcaaugguuaaaaagag

SEQ ID NO: 2220820 - RNA, 22 nt, Streptococcus pyogenes MGAS315
uagguaaagauuuuaaauaucu

SEQ ID NO: 2220821 - RNA, 21 nt, Streptococcus pyogenes MGAS315
uaggauauggaauagguaaag

SEQ ID NO: 2220822 - RNA, 18 nt, Streptococcus pyogenes MGAS315
uaggaauaucaugaagua

SEQ ID NO: 2220823 - RNA, 16 nt, Streptococcus pyogenes MGAS315
uaggaaucacaacuuc

SEQ ID NO: 2220824 - RNA, 13 nt, Streptococcus pyogenes MGAS315
uaggaauaaaaug

SEQ ID NO: 2220825 - RNA, 19 nt, Streptococcus pyogenes MGAS315
uagacugauucaucuugcc

SEQ ID NO: 2220826 - RNA, 21 nt, Streptococcus pyogenes MGAS315
uagaaauuguaaccacagcaa

SEQ ID NO: 2220827 - RNA, 19 nt, Streptococcus pyogenes MGAS315
uacuagaaaaagcaaugau

SEQ ID NO: 2220828 - RNA, 24 nt, Streptococcus pyogenes MGAS315
uacuaguguguugucaaacauaac

SEQ ID NO: 2220829 - RNA, 18 nt, Streptococcus pyogenes MGAS315
uacuauggcuucuaaaaa

SEQ ID NO: 2220830 - RNA, 13 nt, Streptococcus pyogenes MGAS315
uagaauaaaaaag

SEQ ID NO: 2220831 - RNA, 21 nt, Streptococcus pyogenes MGAS315
uacagaaaaaagcuugucuau

SEQ ID NO: 2220832 - RNA, 12 nt, Streptococcus pyogenes MGAS315
uacaacagcagc

SEQ ID NO: 2220833 - RNA, 17 nt, Streptococcus pyogenes MGAS315
uacaacagcagcaguug

SEQ ID NO: 2220834 - RNA, 13 nt, Streptococcus pyogenes MGAS315
uacaucaaaaaaa

SEQ ID NO: 2220835 - RNA, 16 nt, Streptococcus pyogenes MGAS315
uacaucaaaaaaagca

SEQ ID NO: 2220836 - RNA, 19 nt, Streptococcus pyogenes MGAS315
uacaucaaaaaaagcaaug

SEQ ID NO: 2220837 - RNA, 20 nt, Streptococcus pyogenes MGAS315
uacaucaaaaaaagcaauga

SEQ ID NO: 2220838 - RNA, 21 nt, Streptococcus pyogenes MGAS315
uacaucaaaaaaagcaaugac

SEQ ID NO: 2220839 - RNA, 17 nt, Streptococcus pyogenes MGAS315
uaccuaaaaaauaacuu

SEQ ID NO: 2220840 - RNA, 16 nt, Streptococcus pyogenes MGAS315
uacgaguaugaacaaa

SEQ ID NO: 2220841 - RNA, 19 nt, Streptococcus pyogenes MGAS315
uaauacguuuauuuaguua

SEQ ID NO: 2220842 - RNA, 17 nt, Streptococcus pyogenes MGAS315
uaauaaguauuuuaaaa

SEQ ID NO: 2220843 - RNA, 21 nt, Streptococcus pyogenes MGAS315
uaauaaguauuuuaaaauccu

SEQ ID NO: 2220844 - RNA, 18 nt, Streptococcus pyogenes MGAS315
uaauaagauucaauauga

SEQ ID NO: 2220845 - RNA, 19 nt, Streptococcus pyogenes MGAS315
uaauaaacucuauacaaaa

SEQ ID NO: 2220846 - RNA, 19 nt, Streptococcus pyogenes MGAS315
uaaguauaucauuaucaac

SEQ ID NO: 2220847 - RNA, 15 nt, Streptococcus pyogenes MGAS315
uaaguauuuuaaaau

SEQ ID NO: 2220848 - RNA, 17 nt, Streptococcus pyogenes MGAS315
uaagugagcgcccuaaa

SEQ ID NO: 2220849 - RNA, 20 nt, Streptococcus pyogenes MGAS315
uaaucaaaaaacugagacaa

SEQ ID NO: 2220850 - RNA, 13 nt, Streptococcus pyogenes MGAS315
uaaucaaaaaacu

SEQ ID NO: 2220851 - RNA, 18 nt, Streptococcus pyogenes MGAS315
uaaucgagagauuauucu

SEQ ID NO: 2220852 - RNA, 14 nt, Streptococcus pyogenes MGAS315
uaaucgaugauaau

SEQ ID NO: 2220853 - RNA, 15 nt, Streptococcus pyogenes MGAS315
uaaucguaaugucuu

SEQ ID NO: 2220854 - RNA, 18 nt, Streptococcus pyogenes MGAS315
uaaucguaaugucuuguu

SEQ ID NO: 2220855 - RNA, 18 nt, Streptococcus pyogenes MGAS315
uaaugucuuguuuugguu

SEQ ID NO: 2220856 - RNA, 18 nt, Streptococcus pyogenes MGAS315
uaaucuuugacaauguca

SEQ ID NO: 2220857 - RNA, 15 nt, Streptococcus pyogenes MGAS315
uaauuagcauauuuu

SEQ ID NO: 2220858 - RNA, 15 nt, Streptococcus pyogenes MGAS315
ggcuucuaaaaaagu

SEQ ID NO: 2220859 - RNA, 13 nt, Streptococcus pyogenes MGAS315
ggcuuaaacauau

SEQ ID NO: 2220860 - RNA, 18 nt, Streptococcus pyogenes MGAS315
ggcugccauuugagcacc

SEQ ID NO: 2220861 - RNA, 19 nt, Streptococcus pyogenes MGAS315
gguagguuugaaacauaug

SEQ ID NO: 2220862 - RNA, 22 nt, Streptococcus pyogenes MGAS315
gguaaucccauuuuucgacaga

SEQ ID NO: 2220863 - RNA, 16 nt, Streptococcus pyogenes MGAS315
gguaaagauuuuaaau

SEQ ID NO: 2220864 - RNA, 19 nt, Streptococcus pyogenes MGAS315
ggugaguuuuuucuaaaag

SEQ ID NO: 2220865 - RNA, 12 nt, Streptococcus pyogenes MGAS315
ggugucagcaua

SEQ ID NO: 2220866 - RNA, 13 nt, Streptococcus pyogenes MGAS315
guaagccaaaucu

SEQ ID NO: 2220867 - RNA, 18 nt, Streptococcus pyogenes MGAS315
guaauauuuccuuuuaaa

SEQ ID NO: 2220868 - RNA, 15 nt, Streptococcus pyogenes MGAS315
guaauauugcucaag

SEQ ID NO: 2220869 - RNA, 21 nt, Streptococcus pyogenes MGAS315
guaauauugcucaagacuagg

SEQ ID NO: 2220870 - RNA, 19 nt, Streptococcus pyogenes MGAS315
guaacgcuuguuuaugaaa

SEQ ID NO: 2220871 - RNA, 21 nt, Streptococcus pyogenes MGAS315
guaaaggauuuaguucuguau

SEQ ID NO: 2220872 - RNA, 19 nt, Streptococcus pyogenes MGAS315
guaaaggauuuaguucugu

SEQ ID NO: 2220873 - RNA, 20 nt, Streptococcus pyogenes MGAS315
guaaacaaucuuaaugguua

SEQ ID NO: 2220874 - RNA, 18 nt, Streptococcus pyogenes MGAS315
guaaugucuuguuuuggu

SEQ ID NO: 2220875 - RNA, 21 nt, Streptococcus pyogenes MGAS315
guaaugucuuguuuugguuua

SEQ ID NO: 2220876 - RNA, 14 nt, Streptococcus pyogenes MGAS315
guaauguuguaaac

SEQ ID NO: 2220877 - RNA, 17 nt, Streptococcus pyogenes MGAS315
guacggucauuaauaaa

SEQ ID NO: 2220878 - RNA, 22 nt, Streptococcus pyogenes MGAS315
guagcguuuguguugaagaagg

SEQ ID NO: 2220879 - RNA, 18 nt, Streptococcus pyogenes MGAS315
guccuuaaaagaaaaucu

SEQ ID NO: 2220880 - RNA, 17 nt, Streptococcus pyogenes MGAS315
gucgcagaguacaaggc

SEQ ID NO: 2220881 - RNA, 15 nt, Streptococcus pyogenes MGAS315
gucgccaaaucuugu

SEQ ID NO: 2220882 - RNA, 19 nt, Streptococcus pyogenes MGAS315
guccuaaccuuuuggcugu

SEQ ID NO: 2220883 - RNA, 21 nt, Streptococcus pyogenes MGAS315
guccuaaccuuuuggcuguau

SEQ ID NO: 2220884 - RNA, 17 nt, Streptococcus pyogenes MGAS315
guccaucauugaugaga

SEQ ID NO: 2220885 - RNA, 17 nt, Streptococcus pyogenes MGAS315
gucaaaagcuaaacuag

SEQ ID NO: 2220886 - RNA, 22 nt, Streptococcus pyogenes MGAS315
gucaaaaaauuaagaaggaacu

SEQ ID NO: 2220887 - RNA, 18 nt, Streptococcus pyogenes MGAS315
gucaaaaaguaaaaagca

SEQ ID NO: 2220888 - RNA, 19 nt, Streptococcus pyogenes MGAS315
gucaaaaaauuaagaagga

SEQ ID NO: 2220889 - RNA, 13 nt, Streptococcus pyogenes MGAS315
guauuuuuuagag

SEQ ID NO: 2220890 - RNA, 15 nt, Streptococcus pyogenes MGAS315
gucaacgaagauaau

SEQ ID NO: 2220891 - RNA, 13 nt, Streptococcus pyogenes MGAS315
gucaacuccaauc

SEQ ID NO: 2220892 - RNA, 17 nt, Streptococcus pyogenes MGAS315
gucacugcagcaucaaa

SEQ ID NO: 2220893 - RNA, 22 nt, Streptococcus pyogenes MGAS315
gucaugaugccauuuaaaaggg

SEQ ID NO: 2220894 - RNA, 23 nt, Streptococcus pyogenes MGAS315
gucaggggaauuuccuaauguaa

SEQ ID NO: 2220895 - RNA, 13 nt, Streptococcus pyogenes MGAS315
ggaccaagauuca

SEQ ID NO: 2220896 - RNA, 16 nt, Streptococcus pyogenes MGAS315
ggcaaugccaucugcu

SEQ ID NO: 2220897 - RNA, 16 nt, Streptococcus pyogenes MGAS315
ggcaauccaaaucaac

SEQ ID NO: 2220898 - RNA, 12 nt, Streptococcus pyogenes MGAS315
cucuuaauuuau

SEQ ID NO: 2220899 - RNA, 14 nt, Streptococcus pyogenes MGAS315
cucuuauaauaaau

SEQ ID NO: 2220900 - RNA, 20 nt, Streptococcus pyogenes MGAS315
cugaaaauaaaauauuuuuc

SEQ ID NO: 2220901 - RNA, 12 nt, Streptococcus pyogenes MGAS315
cugaaaauaaaa

SEQ ID NO: 2220902 - RNA, 21 nt, Streptococcus pyogenes MGAS315
cugaacugcucuggcuuuuuc

SEQ ID NO: 2220903 - RNA, 22 nt, Streptococcus pyogenes MGAS315
cugaacugcucuggcuuuuucc

SEQ ID NO: 2220904 - RNA, 15 nt, Streptococcus pyogenes MGAS315
cugauauuccuuuuc

SEQ ID NO: 2220905 - RNA, 16 nt, Streptococcus pyogenes MGAS315
cugauauuccuuuucc

SEQ ID NO: 2220906 - RNA, 17 nt, Streptococcus pyogenes MGAS315
cugauauuccuuuucca

SEQ ID NO: 2220907 - RNA, 18 nt, Streptococcus pyogenes MGAS315
cugaucucccgucaacaa

SEQ ID NO: 2220908 - RNA, 21 nt, Streptococcus pyogenes MGAS315
cuggaaacuggucaaaagcua

SEQ ID NO: 2220909 - RNA, 14 nt, Streptococcus pyogenes MGAS315
cugcugcuaaagca

SEQ ID NO: 2220910 - RNA, 21 nt, Streptococcus pyogenes MGAS315
cugcuggauuuagaaauuuua

SEQ ID NO: 2220911 - RNA, 18 nt, Streptococcus pyogenes MGAS315
aaacucaaaaaauacaau

SEQ ID NO: 2220912 - RNA, 21 nt, Streptococcus pyogenes MGAS315
aaacucaaaaaauacaauaaa

SEQ ID NO: 2220913 - RNA, 17 nt, Streptococcus pyogenes MGAS315
cugcaguagcaugacug

SEQ ID NO: 2220914 - RNA, 23 nt, Streptococcus pyogenes MGAS315
cugcaauauccauagaaauugua

SEQ ID NO: 2220915 - RNA, 16 nt, Streptococcus pyogenes MGAS315
cugccccaaaaacgcc

SEQ ID NO: 2220916 - RNA, 14 nt, Streptococcus pyogenes MGAS315
cuagcuuaucuuca

SEQ ID NO: 2220917 - RNA, 16 nt, Streptococcus pyogenes MGAS315
cuagcuuaucuucaua

SEQ ID NO: 2220918 - RNA, 12 nt, Streptococcus pyogenes MGAS315
cuagcacaaaau

SEQ ID NO: 2220919 - RNA, 16 nt, Streptococcus pyogenes MGAS315
cuagauguuggaacuu

SEQ ID NO: 2220920 - RNA, 15 nt, Streptococcus pyogenes MGAS315
cuagguuaaaauaga

SEQ ID NO: 2220921 - RNA, 17 nt, Streptococcus pyogenes MGAS315
cuagguuaaaauagaag

SEQ ID NO: 2220922 - RNA, 15 nt, Streptococcus pyogenes MGAS315
cuauaauuucaauaa

SEQ ID NO: 2220923 - RNA, 20 nt, Streptococcus pyogenes MGAS315
cuauguugcuuaaugaccuu

SEQ ID NO: 2220924 - RNA, 13 nt, Streptococcus pyogenes MGAS315
cuaucagauacua

SEQ ID NO: 2220925 - RNA, 14 nt, Streptococcus pyogenes MGAS315
cucaauagcugcug

SEQ ID NO: 2220926 - RNA, 24 nt, Streptococcus pyogenes MGAS315
cucacuaggccuagcuuuuuacau

SEQ ID NO: 2220927 - RNA, 15 nt, Streptococcus pyogenes MGAS315
cucauaacaaauuua

SEQ ID NO: 2220928 - RNA, 19 nt, Streptococcus pyogenes MGAS315
cucauaacaaauuuauccu

SEQ ID NO: 2220929 - RNA, 14 nt, Streptococcus pyogenes MGAS315
cucagagacaauaa

SEQ ID NO: 2220930 - RNA, 14 nt, Streptococcus pyogenes MGAS315
cucuauacaaaaag

SEQ ID NO: 2220931 - RNA, 20 nt, Streptococcus pyogenes MGAS315
cucucauaaacaaugaguca

SEQ ID NO: 2220932 - RNA, 20 nt, Streptococcus pyogenes MGAS315
cguaaggguuauuauuuagg

SEQ ID NO: 2220933 - RNA, 13 nt, Streptococcus pyogenes MGAS315
cguauacuuuaaa

SEQ ID NO: 2220934 - RNA, 12 nt, Streptococcus pyogenes MGAS315
cguaagccaaau

SEQ ID NO: 2220935 - RNA, 17 nt, Streptococcus pyogenes MGAS315
cgucuuacaauuaauag

SEQ ID NO: 2220936 - RNA, 14 nt, Streptococcus pyogenes MGAS315
cgugacaaugugac

SEQ ID NO: 2220937 - RNA, 16 nt, Streptococcus pyogenes MGAS315
cguucuguuuaaaaua

SEQ ID NO: 2220938 - RNA, 15 nt, Streptococcus pyogenes MGAS315
cguuuagcuuuuuca

SEQ ID NO: 2220939 - RNA, 16 nt, Streptococcus pyogenes MGAS315
cguuuagcuuuuucaa

SEQ ID NO: 2220940 - RNA, 20 nt, Streptococcus pyogenes MGAS315
cuaaauccuuuugaaaaauu

SEQ ID NO: 2220941 - RNA, 20 nt, Streptococcus pyogenes MGAS315
cuaaaugucuagcuuaucuu

SEQ ID NO: 2220942 - RNA, 12 nt, Streptococcus pyogenes MGAS315
cuaaaggagcuu

SEQ ID NO: 2220943 - RNA, 13 nt, Streptococcus pyogenes MGAS315
cgguaaaaacuca

SEQ ID NO: 2220944 - RNA, 12 nt, Streptococcus pyogenes MGAS315
cgggcugccauu

SEQ ID NO: 2220945 - RNA, 16 nt, Streptococcus pyogenes MGAS315
cuucugcauuaucauc

SEQ ID NO: 2220946 - RNA, 15 nt, Streptococcus pyogenes MGAS315
cuucuaaaaaaguua

SEQ ID NO: 2220947 - RNA, 15 nt, Streptococcus pyogenes MGAS315
cuucuacacaaaagc

SEQ ID NO: 2220948 - RNA, 19 nt, Streptococcus pyogenes MGAS315
cuucuagguagguuugaaa

SEQ ID NO: 2220949 - RNA, 22 nt, Streptococcus pyogenes MGAS315
cuucuuuucagagaugcuucuu

SEQ ID NO: 2220950 - RNA, 22 nt, Streptococcus pyogenes MGAS315
cuugaauaucgccaauaaaaaa

SEQ ID NO: 2220951 - RNA, 20 nt, Streptococcus pyogenes MGAS315
cuugaugucuuggauagacu

SEQ ID NO: 2220952 - RNA, 16 nt, Streptococcus pyogenes MGAS315
aaacuuucaguuaucu

SEQ ID NO: 2220953 - RNA, 22 nt, Streptococcus pyogenes MGAS315
cuguuaucccuggaccauuauc

SEQ ID NO: 2220954 - RNA, 19 nt, Streptococcus pyogenes MGAS315
cuguuuaaaauauauuuug

SEQ ID NO: 2220955 - RNA, 19 nt, Streptococcus pyogenes MGAS315
cuuaaugucauacaaaaac

SEQ ID NO: 2220956 - RNA, 17 nt, Streptococcus pyogenes MGAS315
cuuacgaguaugaacaa

SEQ ID NO: 2220957 - RNA, 18 nt, Streptococcus pyogenes MGAS315
cuuaucaagguugcaagu

SEQ ID NO: 2220958 - RNA, 21 nt, Streptococcus pyogenes MGAS315
cuuguuuugguuuaucauuuu

SEQ ID NO: 2220959 - RNA, 14 nt, Streptococcus pyogenes MGAS315
cuuguuuugguuga

SEQ ID NO: 2220960 - RNA, 21 nt, Streptococcus pyogenes MGAS315
cuuguuuugguugauauaaaa

SEQ ID NO: 2220961 - RNA, 11 nt, Streptococcus pyogenes MGAS315
cuuuaaaaagu

SEQ ID NO: 2220962 - RNA, 16 nt, Streptococcus pyogenes MGAS315
cuuguccuguaaauca

SEQ ID NO: 2220963 - RNA, 20 nt, Streptococcus pyogenes MGAS315
cuugucgcugaauaaacaaa

SEQ ID NO: 2220964 - RNA, 13 nt, Streptococcus pyogenes MGAS315
cuuguuacaaaaa

SEQ ID NO: 2220965 - RNA, 14 nt, Streptococcus pyogenes MGAS315
cuuguuacaaaaaa

SEQ ID NO: 2220966 - RNA, 15 nt, Streptococcus pyogenes MGAS315
cuuggauagcaagug

SEQ ID NO: 2220967 - RNA, 18 nt, Streptococcus pyogenes MGAS315
cuugguucugaaaauaaa

SEQ ID NO: 2220968 - RNA, 19 nt, Streptococcus pyogenes MGAS315
cuugguucugaaaauaaaa

SEQ ID NO: 2220969 - RNA, 22 nt, Streptococcus pyogenes MGAS315
cuuuuaagcugaguaaaacaau

SEQ ID NO: 2220970 - RNA, 15 nt, Streptococcus pyogenes MGAS315
cuuugguauucuuuu

SEQ ID NO: 2220971 - RNA, 22 nt, Streptococcus pyogenes MGAS315
cuuucguaaggguuauuauuua

SEQ ID NO: 2220972 - RNA, 17 nt, Streptococcus pyogenes MGAS315
aaagacacacaacaccg

SEQ ID NO: 2220973 - RNA, 14 nt, Streptococcus pyogenes MGAS315
aaagacaaaaaacu

SEQ ID NO: 2220974 - RNA, 18 nt, Streptococcus pyogenes MGAS315
cuuuauaaugguuuuuug

SEQ ID NO: 2220975 - RNA, 19 nt, Streptococcus pyogenes MGAS315
cuuuaucuuauuuuaagaa

SEQ ID NO: 2220976 - RNA, 18 nt, Streptococcus pyogenes MGAS315
cuuuauuuugauauuuuu

SEQ ID NO: 2220977 - RNA, 13 nt, Streptococcus pyogenes MGAS315
gaaacaccaccaa

SEQ ID NO: 2220978 - RNA, 19 nt, Streptococcus pyogenes MGAS315
gaaacaccaccaauaauga

SEQ ID NO: 2220979 - RNA, 19 nt, Streptococcus pyogenes MGAS315
gaaacaguuugguuuuuug

SEQ ID NO: 2220980 - RNA, 17 nt, Streptococcus pyogenes MGAS315
cuuuuuggugucagcau

SEQ ID NO: 2220981 - RNA, 17 nt, Streptococcus pyogenes MGAS315
cuuuugacuugguuuaa

SEQ ID NO: 2220982 - RNA, 15 nt, Streptococcus pyogenes MGAS315
cuuuugauaccuuuu

SEQ ID NO: 2220983 - RNA, 19 nt, Streptococcus pyogenes MGAS315
cuuuuggccuacuagcaca

SEQ ID NO: 2220984 - RNA, 17 nt, Streptococcus pyogenes MGAS315
gaaauuguaaccacagc

SEQ ID NO: 2220985 - RNA, 18 nt, Streptococcus pyogenes MGAS315
gaaauuguaaccacagca

SEQ ID NO: 2220986 - RNA, 22 nt, Streptococcus pyogenes MGAS315
gaaaugugguaagaagaaaaua

SEQ ID NO: 2220987 - RNA, 18 nt, Streptococcus pyogenes MGAS315
gaaagaggugcaacugcu

SEQ ID NO: 2220988 - RNA, 15 nt, Streptococcus pyogenes MGAS315
gaagagagaagcugu

SEQ ID NO: 2220989 - RNA, 15 nt, Streptococcus pyogenes MGAS315
gaagcuguucucuuu

SEQ ID NO: 2220990 - RNA, 16 nt, Streptococcus pyogenes MGAS315
gaaggcucuuaucuuu

SEQ ID NO: 2220991 - RNA, 19 nt, Streptococcus pyogenes MGAS315
gaauaugauauaaaaaugg

SEQ ID NO: 2220992 - RNA, 20 nt, Streptococcus pyogenes MGAS315
gacacucccgcuuuuaagcu

SEQ ID NO: 2220993 - RNA, 21 nt, Streptococcus pyogenes MGAS315
gaccucucaugggcaaauaaa

SEQ ID NO: 2220994 - RNA, 21 nt, Streptococcus pyogenes MGAS315
gacuuguaaaaugauacuuuc

SEQ ID NO: 2220995 - RNA, 20 nt, Streptococcus pyogenes MGAS315
gacuugguucugaaaauaaa

SEQ ID NO: 2220996 - RNA, 18 nt, Streptococcus pyogenes MGAS315
gacuucggucucuuuuug

SEQ ID NO: 2220997 - RNA, 18 nt, Streptococcus pyogenes MGAS315
aaagcaaauugaaaaaau

SEQ ID NO: 2220998 - RNA, 15 nt, Streptococcus pyogenes MGAS315
aaagcaaaaaagcca

SEQ ID NO: 2220999 - RNA, 22 nt, Streptococcus pyogenes MGAS315
aaagcaaaaaagccagugcugc

SEQ ID NO: 2221000 - RNA, 16 nt, Streptococcus pyogenes MGAS315
gagaacaugugaauuc

SEQ ID NO: 2221001 - RNA, 14 nt, Streptococcus pyogenes MGAS315
aaagauuuuaaaua

SEQ ID NO: 2221002 - RNA, 14 nt, Streptococcus pyogenes MGAS315
gagacaauaagguc

SEQ ID NO: 2221003 - RNA, 19 nt, Streptococcus pyogenes MGAS315
gagauaccuucauagacaa

SEQ ID NO: 2221004 - RNA, 18 nt, Streptococcus pyogenes MGAS315
gagcacguuuucugguuu

SEQ ID NO: 2221005 - RNA, 21 nt, Streptococcus pyogenes MGAS315
aaagccaagacuaaagcauuu

SEQ ID NO: 2221006 - RNA, 21 nt, Streptococcus pyogenes MGAS315
gauaauuuauuuuucauuuga

SEQ ID NO: 2221007 - RNA, 23 nt, Streptococcus pyogenes MGAS315
gauauuuuuucucaaaaauauau

SEQ ID NO: 2221008 - RNA, 21 nt, Streptococcus pyogenes MGAS315
gaguaaaacaauaacacagaa

SEQ ID NO: 2221009 - RNA, 11 nt, Streptococcus pyogenes MGAS315
gaguuuugcug

SEQ ID NO: 2221010 - RNA, 12 nt, Streptococcus pyogenes MGAS315
gauaaaggccug

SEQ ID NO: 2221011 - RNA, 12 nt, Streptococcus pyogenes MGAS315
gauaaaaaguaa

SEQ ID NO: 2221012 - RNA, 18 nt, Streptococcus pyogenes MGAS315
gauaaaaccuucaaaaaa

SEQ ID NO: 2221013 - RNA, 21 nt, Streptococcus pyogenes MGAS315
gauaaaaccuucaaaaaaggg

SEQ ID NO: 2221014 - RNA, 17 nt, Streptococcus pyogenes MGAS315
gagggacugucaaaaaa

SEQ ID NO: 2221015 - RNA, 17 nt, Streptococcus pyogenes MGAS315
aaagugcgcuuccagaa

SEQ ID NO: 2221016 - RNA, 16 nt, Streptococcus pyogenes MGAS315
aaaguuagauuuugga

SEQ ID NO: 2221017 - RNA, 23 nt, Streptococcus pyogenes MGAS315
aaaguuuucucagagacaauaag

SEQ ID NO: 2221018 - RNA, 14 nt, Streptococcus pyogenes MGAS315
aaauaaaauauuuu

SEQ ID NO: 2221019 - RNA, 17 nt, Streptococcus pyogenes MGAS315
ggccuguauuucuuuag

SEQ ID NO: 2221020 - RNA, 13 nt, Streptococcus pyogenes MGAS315
aaauaaacuuuca

SEQ ID NO: 2221021 - RNA, 13 nt, Streptococcus pyogenes MGAS315
aaauaaagauaau

SEQ ID NO: 2221022 - RNA, 17 nt, Streptococcus pyogenes MGAS315
aaauacuagaaaaagca

SEQ ID NO: 2221023 - RNA, 16 nt, Streptococcus pyogenes MGAS315
aaauacuagaaaaagc

SEQ ID NO: 2221024 - RNA, 16 nt, Streptococcus pyogenes MGAS315
aaauacagaaaaaagc

SEQ ID NO: 2221025 - RNA, 19 nt, Streptococcus pyogenes MGAS315
aaauacagaaaaaagcuug

SEQ ID NO: 2221026 - RNA, 19 nt, Streptococcus pyogenes MGAS315
ggcuacucuauuugaagua

SEQ ID NO: 2221027 - RNA, 18 nt, Streptococcus pyogenes MGAS315
ggcaccaagugcugccau

SEQ ID NO: 2221028 - RNA, 23 nt, Streptococcus pyogenes MGAS315
ggcaaccuuaccuacugcuggau

SEQ ID NO: 2221029 - RNA, 20 nt, Streptococcus pyogenes MGAS315
aaagggauugcaaaaguuag

SEQ ID NO: 2221030 - RNA, 20 nt, Streptococcus pyogenes MGAS315
ggaccaugccuaaagcccau

SEQ ID NO: 2221031 - RNA, 14 nt, Streptococcus pyogenes MGAS315
aaaguaaaaagcaa

SEQ ID NO: 2221032 - RNA, 15 nt, Streptococcus pyogenes MGAS315
aaaguaaaaagcaaa

SEQ ID NO: 2221033 - RNA, 22 nt, Streptococcus pyogenes MGAS315
aaaguaaaaagcaaauugaaaa

SEQ ID NO: 2221034 - RNA, 12 nt, Streptococcus pyogenes MGAS315
aaaguaaaaaua

SEQ ID NO: 2221035 - RNA, 23 nt, Streptococcus pyogenes MGAS315
aaaguaaaaauacuagaaaaagc

SEQ ID NO: 2221036 - RNA, 23 nt, Streptococcus pyogenes MGAS315
ggauauaacaacucccuccuaag

SEQ ID NO: 2221037 - RNA, 14 nt, Streptococcus pyogenes MGAS315
gcuuuuggcaaccu

SEQ ID NO: 2221038 - RNA, 21 nt, Streptococcus pyogenes MGAS315
gcuuuuggcaaccuuaccuac

SEQ ID NO: 2221039 - RNA, 18 nt, Streptococcus pyogenes MGAS315
gcuuuugauaccuuuuuu

SEQ ID NO: 2221040 - RNA, 16 nt, Streptococcus pyogenes MGAS315
gcuaaaagcauaaaaa

SEQ ID NO: 2221041 - RNA, 15 nt, Streptococcus pyogenes MGAS315
gcuaaaacaguucca

SEQ ID NO: 2221042 - RNA, 20 nt, Streptococcus pyogenes MGAS315
gcucaacuggcacaaacucu

SEQ ID NO: 2221043 - RNA, 16 nt, Streptococcus pyogenes MGAS315
gcuauaagaggauaau

SEQ ID NO: 2221044 - RNA, 21 nt, Streptococcus pyogenes MGAS315
gcuauaagaggauaaucauaa

SEQ ID NO: 2221045 - RNA, 17 nt, Streptococcus pyogenes MGAS315
gcuagaccucugcucac

SEQ ID NO: 2221046 - RNA, 12 nt, Streptococcus pyogenes MGAS315
gcuagucuuuuu

SEQ ID NO: 2221047 - RNA, 23 nt, Streptococcus pyogenes MGAS315
gcugaugacuuguaaaaugauac

SEQ ID NO: 2221048 - RNA, 17 nt, Streptococcus pyogenes MGAS315
gcugaugacuuguaaaa

SEQ ID NO: 2221049 - RNA, 15 nt, Streptococcus pyogenes MGAS315
gcaauagagccaaga

SEQ ID NO: 2221050 - RNA, 17 nt, Streptococcus pyogenes MGAS315
gcaagugagaacaugug

SEQ ID NO: 2221051 - RNA, 16 nt, Streptococcus pyogenes MGAS315
gcaaggcuaaagccua

SEQ ID NO: 2221052 - RNA, 22 nt, Streptococcus pyogenes MGAS315
gcaacugcuaguugugccuuuu

SEQ ID NO: 2221053 - RNA, 18 nt, Streptococcus pyogenes MGAS315
gcaaugguuaaaaagaga

SEQ ID NO: 2221054 - RNA, 23 nt, Streptococcus pyogenes MGAS315
gcaauucuuuuauuaauguaaaa

SEQ ID NO: 2221055 - RNA, 20 nt, Streptococcus pyogenes MGAS315
gcagauggggugucagggga

SEQ ID NO: 2221056 - RNA, 22 nt, Streptococcus pyogenes MGAS315
gcagauggggugucaggggaau

SEQ ID NO: 2221057 - RNA, 14 nt, Streptococcus pyogenes MGAS315
gcagcaccaguaaa

SEQ ID NO: 2221058 - RNA, 16 nt, Streptococcus pyogenes MGAS315
gcauugucaaauaaaa

SEQ ID NO: 2221059 - RNA, 15 nt, Streptococcus pyogenes MGAS315
gcauugucaaauaaa

SEQ ID NO: 2221060 - RNA, 18 nt, Streptococcus pyogenes MGAS315
gccaagacuaaagcauuu

SEQ ID NO: 2221061 - RNA, 17 nt, Streptococcus pyogenes MGAS315
gccaguaaggaaaucaa

SEQ ID NO: 2221062 - RNA, 21 nt, Streptococcus pyogenes MGAS315
gccaucaaaaaaagacacaca

SEQ ID NO: 2221063 - RNA, 19 nt, Streptococcus pyogenes MGAS315
gccaucuaagcuuggauug

SEQ ID NO: 2221064 - RNA, 17 nt, Streptococcus pyogenes MGAS315
aaagcuaaguaaacuuc

SEQ ID NO: 2221065 - RNA, 20 nt, Streptococcus pyogenes MGAS315
aaagcguugacaguuaaaaa

SEQ ID NO: 2221066 - RNA, 13 nt, Streptococcus pyogenes MGAS315
gcgauaauaaagu

SEQ ID NO: 2221067 - RNA, 22 nt, Streptococcus pyogenes MGAS315
gcgaauaugauauaaaaaugga

SEQ ID NO: 2221068 - RNA, 20 nt, Streptococcus pyogenes MGAS315
gccuuuaacaugauguacca

SEQ ID NO: 2221069 - RNA, 19 nt, Streptococcus pyogenes MGAS315
gccuaaagcccauagagga

SEQ ID NO: 2221070 - RNA, 20 nt, Streptococcus pyogenes MGAS315
gguucagcugauuacugaaa

SEQ ID NO: 2221071 - RNA, 20 nt, Streptococcus pyogenes MGAS315
gguuaucaggccacuagaac

SEQ ID NO: 2221072 - RNA, 13 nt, Streptococcus pyogenes MGAS315
gguuaaaaagaga

SEQ ID NO: 2221073 - RNA, 11 nt, Streptococcus pyogenes MGAS315
guaaaaacuca

SEQ ID NO: 2221074 - RNA, 17 nt, Streptococcus pyogenes MGAS315
guaaaaacucaaaaaau

SEQ ID NO: 2221075 - RNA, 14 nt, Streptococcus pyogenes MGAS315
gguuuguugaaaug

SEQ ID NO: 2221076 - RNA, 17 nt, Streptococcus pyogenes MGAS315
ggcucauauuagcaaaa

SEQ ID NO: 2221077 - RNA, 19 nt, Streptococcus pyogenes MGAS315
guaauccccucauuuaaau

SEQ ID NO: 2221078 - RNA, 20 nt, Streptococcus pyogenes MGAS315
guaaugucuuguuuugguuu

SEQ ID NO: 2221079 - RNA, 17 nt, Streptococcus pyogenes MGAS315
guaacgcuuguuuauga

SEQ ID NO: 2221080 - RNA, 20 nt, Streptococcus pyogenes MGAS315
guaacguaauagaauaaaaa

SEQ ID NO: 2221081 - RNA, 18 nt, Streptococcus pyogenes MGAS315
guaauagcguaaagcaag

SEQ ID NO: 2221082 - RNA, 17 nt, Streptococcus pyogenes MGAS315
guaauagcguaaagcaa

SEQ ID NO: 2221083 - RNA, 20 nt, Streptococcus pyogenes MGAS315
guaaggaaaucaauccugua

SEQ ID NO: 2221084 - RNA, 18 nt, Streptococcus pyogenes MGAS315
guaagccaaaucuucugc

SEQ ID NO: 2221085 - RNA, 21 nt, Streptococcus pyogenes MGAS315
guaagguuuguugaaaugugg

SEQ ID NO: 2221086 - RNA, 16 nt, Streptococcus pyogenes MGAS315
guaaagcaagggaaac

SEQ ID NO: 2221087 - RNA, 20 nt, Streptococcus pyogenes MGAS315
guaaagauuuuaaauaucuu

SEQ ID NO: 2221088 - RNA, 11 nt, Streptococcus pyogenes MGAS315
guaaaaugacu

SEQ ID NO: 2221089 - RNA, 20 nt, Streptococcus pyogenes MGAS315
guaaccauagaagccaauua

SEQ ID NO: 2221090 - RNA, 14 nt, Streptococcus pyogenes MGAS315
guagcguacaugga

SEQ ID NO: 2221091 - RNA, 16 nt, Streptococcus pyogenes MGAS315
guauagcauaaaauag

SEQ ID NO: 2221092 - RNA, 17 nt, Streptococcus pyogenes MGAS315
guaucuaagcuauagaa

SEQ ID NO: 2221093 - RNA, 20 nt, Streptococcus pyogenes MGAS315
guaucuaagcuauagaaacu

SEQ ID NO: 2221094 - RNA, 13 nt, Streptococcus pyogenes MGAS315
guauguaaauaua

SEQ ID NO: 2221095 - RNA, 19 nt, Streptococcus pyogenes MGAS315
guauuacuucuuuuuguug

SEQ ID NO: 2221096 - RNA, 14 nt, Streptococcus pyogenes MGAS315
guauucuuaaaaaa

SEQ ID NO: 2221097 - RNA, 23 nt, Streptococcus pyogenes MGAS315
guauucuuuuuccguuugagaua

SEQ ID NO: 2221098 - RNA, 20 nt, Streptococcus pyogenes MGAS315
guauuuacugggucaacucc

SEQ ID NO: 2221099 - RNA, 20 nt, Streptococcus pyogenes MGAS315
guauuguagaggacuaaguc

SEQ ID NO: 2221100 - RNA, 17 nt, Streptococcus pyogenes MGAS315
guccuuaaaagaaaauc

SEQ ID NO: 2221101 - RNA, 12 nt, Streptococcus pyogenes MGAS315
gucgacuucaac

SEQ ID NO: 2221102 - RNA, 14 nt, Streptococcus pyogenes MGAS315
gucguuuuuugcuu

SEQ ID NO: 2221103 - RNA, 16 nt, Streptococcus pyogenes MGAS315
gucguuuagcuuuuuc

SEQ ID NO: 2221104 - RNA, 17 nt, Streptococcus pyogenes MGAS315
gucguuuagcuuuuuca

SEQ ID NO: 2221105 - RNA, 20 nt, Streptococcus pyogenes MGAS315
gucauacucaauagcugcug

SEQ ID NO: 2221106 - RNA, 19 nt, Streptococcus pyogenes MGAS315
gucccacaccuacuaacaa

SEQ ID NO: 2221107 - RNA, 19 nt, Streptococcus pyogenes MGAS315
gugcaacugcuaguugugc

SEQ ID NO: 2221108 - RNA, 22 nt, Streptococcus pyogenes MGAS315
gugcaacugcuaguugugccuu

SEQ ID NO: 2221109 - RNA, 20 nt, Streptococcus pyogenes MGAS315
gugaugcucucauaaacaau

SEQ ID NO: 2221110 - RNA, 20 nt, Streptococcus pyogenes MGAS315
gucuagcuuaucuucauagc

SEQ ID NO: 2221111 - RNA, 20 nt, Streptococcus pyogenes MGAS315
gugccaguaaggaaaucaau

SEQ ID NO: 2221112 - RNA, 22 nt, Streptococcus pyogenes MGAS315
gugcuagauguuggaacuuugu

SEQ ID NO: 2221113 - RNA, 21 nt, Streptococcus pyogenes MGAS315
guguaauccccucauuuaaau

SEQ ID NO: 2221114 - RNA, 18 nt, Streptococcus pyogenes MGAS315
guguauucuuaaaaaaau

SEQ ID NO: 2221115 - RNA, 14 nt, Streptococcus pyogenes MGAS315
guuauguuauaaga

SEQ ID NO: 2221116 - RNA, 19 nt, Streptococcus pyogenes MGAS315
guuauuaaagacaaaaaac

SEQ ID NO: 2221117 - RNA, 22 nt, Streptococcus pyogenes MGAS315
guuaguuuuauccccuauucaa

SEQ ID NO: 2221118 - RNA, 16 nt, Streptococcus pyogenes MGAS315
guguugucaaacauaa

SEQ ID NO: 2221119 - RNA, 14 nt, Streptococcus pyogenes MGAS315
guucauaguugugc

SEQ ID NO: 2221120 - RNA, 16 nt, Streptococcus pyogenes MGAS315
guucaauacucccuuc

SEQ ID NO: 2221121 - RNA, 19 nt, Streptococcus pyogenes MGAS315
guucaauggauauaacaac

SEQ ID NO: 2221122 - RNA, 23 nt, Streptococcus pyogenes MGAS315
guucuguuucuaagcaaauagca

SEQ ID NO: 2221123 - RNA, 16 nt, Streptococcus pyogenes MGAS315
guucuguuuaaaauau

SEQ ID NO: 2221124 - RNA, 21 nt, Streptococcus pyogenes MGAS315
guucugaaaauaaaauauuuu

SEQ ID NO: 2221125 - RNA, 15 nt, Streptococcus pyogenes MGAS315
guucugaaaauaaaa

SEQ ID NO: 2221126 - RNA, 14 nt, Streptococcus pyogenes MGAS315
guucugaaaauaaa

SEQ ID NO: 2221127 - RNA, 14 nt, Streptococcus pyogenes MGAS315
guugaaauguggua

SEQ ID NO: 2221128 - RNA, 14 nt, Streptococcus pyogenes MGAS315
guugauauaaaauu

SEQ ID NO: 2221129 - RNA, 17 nt, Streptococcus pyogenes MGAS315
guugcaagugacaaccu

SEQ ID NO: 2221130 - RNA, 18 nt, Streptococcus pyogenes MGAS315
guugacaguuaaaaauaa

SEQ ID NO: 2221131 - RNA, 20 nt, Streptococcus pyogenes MGAS315
guuuaggaaucacaacuucu

SEQ ID NO: 2221132 - RNA, 19 nt, Streptococcus pyogenes MGAS315
guuuagcuuuuucaagagu

SEQ ID NO: 2221133 - RNA, 13 nt, Streptococcus pyogenes MGAS315
guugguaaaaagg

SEQ ID NO: 2221134 - RNA, 13 nt, Streptococcus pyogenes MGAS315
guugugccuuuuc

SEQ ID NO: 2221135 - RNA, 15 nt, Streptococcus pyogenes MGAS315
guugugccuuuucuu

SEQ ID NO: 2221136 - RNA, 22 nt, Streptococcus pyogenes MGAS315
guuggauuuuuguauuugucua

SEQ ID NO: 2221137 - RNA, 19 nt, Streptococcus pyogenes MGAS315
uaaaaagcaaaaaagccag

SEQ ID NO: 2221138 - RNA, 18 nt, Streptococcus pyogenes MGAS315
uaaaaauacuagaaaaag

SEQ ID NO: 2221139 - RNA, 15 nt, Streptococcus pyogenes MGAS315
uaaaaaguaaaaucu

SEQ ID NO: 2221140 - RNA, 17 nt, Streptococcus pyogenes MGAS315
uaaaaacucaaaaaaua

SEQ ID NO: 2221141 - RNA, 17 nt, Streptococcus pyogenes MGAS315
uaaaaacgaucaaaaau

SEQ ID NO: 2221142 - RNA, 21 nt, Streptococcus pyogenes MGAS315
uaaaaaagaagcaaaauuauu

SEQ ID NO: 2221143 - RNA, 18 nt, Streptococcus pyogenes MGAS315
uaaaaaaccuuaucaaac

SEQ ID NO: 2221144 - RNA, 17 nt, Streptococcus pyogenes MGAS315
uaaaaaaguuaucacua

SEQ ID NO: 2221145 - RNA, 22 nt, Streptococcus pyogenes MGAS315
guuuuuacauuuuuacaauacg

SEQ ID NO: 2221146 - RNA, 16 nt, Streptococcus pyogenes MGAS315
guuugauugauuuguc

SEQ ID NO: 2221147 - RNA, 22 nt, Streptococcus pyogenes MGAS315
guuuggugucaaucauuuuuaa

SEQ ID NO: 2221148 - RNA, 18 nt, Streptococcus pyogenes MGAS315
guuuucucagagacaaua

SEQ ID NO: 2221149 - RNA, 20 nt, Streptococcus pyogenes MGAS315
guuuucucagagacaauaag

SEQ ID NO: 2221150 - RNA, 14 nt, Streptococcus pyogenes MGAS315
uaaaaccauaccua

SEQ ID NO: 2221151 - RNA, 17 nt, Streptococcus pyogenes MGAS315
uaaaacaauaacacaga

SEQ ID NO: 2221152 - RNA, 18 nt, Streptococcus pyogenes MGAS315
uaaaagauauuuuaaaau

SEQ ID NO: 2221153 - RNA, 18 nt, Streptococcus pyogenes MGAS315
uaaaaguuagccaagcaa

SEQ ID NO: 2221154 - RNA, 12 nt, Streptococcus pyogenes MGAS315
uaaaauauauuu

SEQ ID NO: 2221155 - RNA, 18 nt, Streptococcus pyogenes MGAS315
uaaaauaaucaaccugcu

SEQ ID NO: 2221156 - RNA, 15 nt, Streptococcus pyogenes MGAS315
uaaaaugacugacaa

SEQ ID NO: 2221157 - RNA, 16 nt, Streptococcus pyogenes MGAS315
uaaaaucguuauuaau

SEQ ID NO: 2221158 - RNA, 18 nt, Streptococcus pyogenes MGAS315
uaaaauccucuuuuaauu

SEQ ID NO: 2221159 - RNA, 19 nt, Streptococcus pyogenes MGAS315
uaaaauccucuuuuaauuu

SEQ ID NO: 2221160 - RNA, 21 nt, Streptococcus pyogenes MGAS315
uaaaauaucuagaacagcugc

SEQ ID NO: 2221161 - RNA, 22 nt, Streptococcus pyogenes MGAS315
uaaaauaucuagaacagcugcu

SEQ ID NO: 2221162 - RNA, 16 nt, Streptococcus pyogenes MGAS315
uaaaauauuuuuccau

SEQ ID NO: 2221163 - RNA, 23 nt, Streptococcus pyogenes MGAS315
uaaagcguugacaguuaaaaaua

SEQ ID NO: 2221164 - RNA, 19 nt, Streptococcus pyogenes MGAS315
uaaaggccuguauuucuuu

SEQ ID NO: 2221165 - RNA, 23 nt, Streptococcus pyogenes MGAS315
uaaaggccuguauuucuuuagua

SEQ ID NO: 2221166 - RNA, 17 nt, Streptococcus pyogenes MGAS315
uaaaggccuguauuucu

SEQ ID NO: 2221167 - RNA, 18 nt, Streptococcus pyogenes MGAS315
uaaagauuuuaaauaucu

SEQ ID NO: 2221168 - RNA, 13 nt, Streptococcus pyogenes MGAS315
uaaagcaagggaa

SEQ ID NO: 2221169 - RNA, 14 nt, Streptococcus pyogenes MGAS315
uaaagcaagggaaa

SEQ ID NO: 2221170 - RNA, 16 nt, Streptococcus pyogenes MGAS315
uaaagccuuauccauu

SEQ ID NO: 2221171 - RNA, 17 nt, Streptococcus pyogenes MGAS315
uaaagccuacaacagca

SEQ ID NO: 2221172 - RNA, 15 nt, Streptococcus pyogenes MGAS315
uaaagagccucagga

SEQ ID NO: 2221173 - RNA, 19 nt, Streptococcus pyogenes MGAS315
uaaauaaagauaauuuauu

SEQ ID NO: 2221174 - RNA, 11 nt, Streptococcus pyogenes MGAS315
uaaacaaucuu

SEQ ID NO: 2221175 - RNA, 20 nt, Streptococcus pyogenes MGAS315
uaaacauauuauaguaacca

SEQ ID NO: 2221176 - RNA, 23 nt, Streptococcus pyogenes MGAS315
uaaacauauuauaguaaccauug

SEQ ID NO: 2221177 - RNA, 18 nt, Streptococcus pyogenes MGAS315
uaaagaaacaaaaaugaa

SEQ ID NO: 2221178 - RNA, 15 nt, Streptococcus pyogenes MGAS315
uaaacuacaccauuu

SEQ ID NO: 2221179 - RNA, 22 nt, Streptococcus pyogenes MGAS315
uaaccauugccauuaauaauau

SEQ ID NO: 2221180 - RNA, 17 nt, Streptococcus pyogenes MGAS315
uaaccaauuccucccua

SEQ ID NO: 2221181 - RNA, 17 nt, Streptococcus pyogenes MGAS315
uaaccugcauaucugcc

SEQ ID NO: 2221182 - RNA, 23 nt, Streptococcus pyogenes MGAS315
uaaccucuuaguuggagagacua

SEQ ID NO: 2221183 - RNA, 15 nt, Streptococcus pyogenes MGAS315
uaaccuccuaaacua

SEQ ID NO: 2221184 - RNA, 14 nt, Streptococcus pyogenes MGAS315
uaaauuauauuaua

SEQ ID NO: 2221185 - RNA, 19 nt, Streptococcus pyogenes MGAS315
uaacaacaacaacccuuga

SEQ ID NO: 2221186 - RNA, 18 nt, Streptococcus pyogenes MGAS315
uagggauuuuuuuaacua

SEQ ID NO: 2221187 - RNA, 15 nt, Streptococcus pyogenes MGAS315
uagucaaaaagacuu

SEQ ID NO: 2221188 - RNA, 15 nt, Streptococcus pyogenes MGAS315
uaguuuauuacaaaa

SEQ ID NO: 2221189 - RNA, 13 nt, Streptococcus pyogenes MGAS315
uaguugugcuagu

SEQ ID NO: 2221190 - RNA, 15 nt, Streptococcus pyogenes MGAS315
uaguugugcuagucu

SEQ ID NO: 2221191 - RNA, 14 nt, Streptococcus pyogenes MGAS315
uaguguauuacuuc

SEQ ID NO: 2221192 - RNA, 17 nt, Streptococcus pyogenes MGAS315
uauaaagaaacaaaaau

SEQ ID NO: 2221193 - RNA, 14 nt, Streptococcus pyogenes MGAS315
uauaacaacucccu

SEQ ID NO: 2221194 - RNA, 14 nt, Streptococcus pyogenes MGAS315
uauaaagaaacaaa

SEQ ID NO: 2221195 - RNA, 16 nt, Streptococcus pyogenes MGAS315
uauccauagaaauugu

SEQ ID NO: 2221196 - RNA, 15 nt, Streptococcus pyogenes MGAS315
uaucaguuaaugcca

SEQ ID NO: 2221197 - RNA, 18 nt, Streptococcus pyogenes MGAS315
uaucaguuaaugccaacu

SEQ ID NO: 2221198 - RNA, 19 nt, Streptococcus pyogenes MGAS315
uaucaugaaguauaguuau

SEQ ID NO: 2221199 - RNA, 22 nt, Streptococcus pyogenes MGAS315
uaucauuaucaacaaucuuaaa

SEQ ID NO: 2221200 - RNA, 16 nt, Streptococcus pyogenes MGAS315
uaucaguauacucagu

SEQ ID NO: 2221201 - RNA, 22 nt, Streptococcus pyogenes MGAS315
uaucaauaacagaaauuaauaa

SEQ ID NO: 2221202 - RNA, 13 nt, Streptococcus pyogenes MGAS315
uauauuuuggauc

SEQ ID NO: 2221203 - RNA, 19 nt, Streptococcus pyogenes MGAS315
uauauuuuggaucuucaac

SEQ ID NO: 2221204 - RNA, 23 nt, Streptococcus pyogenes MGAS315
uauagcuccuaaaaccauaccua

SEQ ID NO: 2221205 - RNA, 13 nt, Streptococcus pyogenes MGAS315
uauagcauaaaau

SEQ ID NO: 2221206 - RNA, 14 nt, Streptococcus pyogenes MGAS315
uauagaaaguaaaa

SEQ ID NO: 2221207 - RNA, 14 nt, Streptococcus pyogenes MGAS315
uauacuuuaaacac

SEQ ID NO: 2221208 - RNA, 15 nt, Streptococcus pyogenes MGAS315
uauaccuaaaaaaua

SEQ ID NO: 2221209 - RNA, 20 nt, Streptococcus pyogenes MGAS315
uagcugcugcuaaagcaauc

SEQ ID NO: 2221210 - RNA, 19 nt, Streptococcus pyogenes MGAS315
uagcuuuuuacaucaaaaa

SEQ ID NO: 2221211 - RNA, 23 nt, Streptococcus pyogenes MGAS315
uagcuuuuuacaucaaaaaaagc

SEQ ID NO: 2221212 - RNA, 15 nt, Streptococcus pyogenes MGAS315
uagcuuuuuaaagag

SEQ ID NO: 2221213 - RNA, 16 nt, Streptococcus pyogenes MGAS315
uaggaauaucaugaag

SEQ ID NO: 2221214 - RNA, 21 nt, Streptococcus pyogenes MGAS315
uagccagauggugcuacugau

SEQ ID NO: 2221215 - RNA, 18 nt, Streptococcus pyogenes MGAS315
uagccaagcaaucuaaga

SEQ ID NO: 2221216 - RNA, 20 nt, Streptococcus pyogenes MGAS315
uagcauugucaaauaaaauc

SEQ ID NO: 2221217 - RNA, 12 nt, Streptococcus pyogenes MGAS315
uagcauaaaaua

SEQ ID NO: 2221218 - RNA, 17 nt, Streptococcus pyogenes MGAS315
uagcaaguccugcuuuu

SEQ ID NO: 2221219 - RNA, 15 nt, Streptococcus pyogenes MGAS315
uagauaaacugguua

SEQ ID NO: 2221220 - RNA, 15 nt, Streptococcus pyogenes MGAS315
uagagucucuagucu

SEQ ID NO: 2221221 - RNA, 18 nt, Streptococcus pyogenes MGAS315
uagagucucuuaauuuau

SEQ ID NO: 2221222 - RNA, 21 nt, Streptococcus pyogenes MGAS315
uaccuauagaaaguuauaaag

SEQ ID NO: 2221223 - RNA, 14 nt, Streptococcus pyogenes MGAS315
uacguuuugguggg

SEQ ID NO: 2221224 - RNA, 14 nt, Streptococcus pyogenes MGAS315
uacguuuauuuagu

SEQ ID NO: 2221225 - RNA, 23 nt, Streptococcus pyogenes MGAS315
uacgguaaaaacucaaaaaauac

SEQ ID NO: 2221226 - RNA, 16 nt, Streptococcus pyogenes MGAS315
uacgguaaaaacucaa

SEQ ID NO: 2221227 - RNA, 12 nt, Streptococcus pyogenes MGAS315
uagaacuuuuca

SEQ ID NO: 2221228 - RNA, 13 nt, Streptococcus pyogenes MGAS315
uagaacuuuucag

SEQ ID NO: 2221229 - RNA, 16 nt, Streptococcus pyogenes MGAS315
uagaaauuguaaccac

SEQ ID NO: 2221230 - RNA, 14 nt, Streptococcus pyogenes MGAS315
uagaauaaaaaaga

SEQ ID NO: 2221231 - RNA, 15 nt, Streptococcus pyogenes MGAS315
uagaauaaaaaagac

SEQ ID NO: 2221232 - RNA, 16 nt, Streptococcus pyogenes MGAS315
uagaauaaaaaagacu

SEQ ID NO: 2221233 - RNA, 20 nt, Streptococcus pyogenes MGAS315
uagagaacagauaagugcca

SEQ ID NO: 2221234 - RNA, 14 nt, Streptococcus pyogenes MGAS315
uagacaggagcuug

SEQ ID NO: 2221235 - RNA, 18 nt, Streptococcus pyogenes MGAS315
uagaaacuuuuuauaagc

SEQ ID NO: 2221236 - RNA, 15 nt, Streptococcus pyogenes MGAS315
uagaaaguuauaaag

SEQ ID NO: 2221237 - RNA, 21 nt, Streptococcus pyogenes MGAS315
uacuuugguauucuuuuuccg

SEQ ID NO: 2221238 - RNA, 12 nt, Streptococcus pyogenes MGAS315
uacuuuuaaaau

SEQ ID NO: 2221239 - RNA, 19 nt, Streptococcus pyogenes MGAS315
uacuccucucacaaauaca

SEQ ID NO: 2221240 - RNA, 20 nt, Streptococcus pyogenes MGAS315
uacuguaauauuuccuuuua

SEQ ID NO: 2221241 - RNA, 11 nt, Streptococcus pyogenes MGAS315
uaauuaucuga

SEQ ID NO: 2221242 - RNA, 15 nt, Streptococcus pyogenes MGAS315
uaauuaguauauugu

SEQ ID NO: 2221243 - RNA, 19 nt, Streptococcus pyogenes MGAS315
uaaugccaucaaaaaaaga

SEQ ID NO: 2221244 - RNA, 17 nt, Streptococcus pyogenes MGAS315
uaaugccaucaaaaaaa

SEQ ID NO: 2221245 - RNA, 15 nt, Streptococcus pyogenes MGAS315
uaaugaccuuugaua

SEQ ID NO: 2221246 - RNA, 15 nt, Streptococcus pyogenes MGAS315
uaaucuaaagcauca

SEQ ID NO: 2221247 - RNA, 16 nt, Streptococcus pyogenes MGAS315
uaaucguaacuggucc

SEQ ID NO: 2221248 - RNA, 16 nt, Streptococcus pyogenes MGAS315
uacaccauuuauuaag

SEQ ID NO: 2221249 - RNA, 23 nt, Streptococcus pyogenes MGAS315
uauuugacuuguuacaaaaaaca

SEQ ID NO: 2221250 - RNA, 15 nt, Streptococcus pyogenes MGAS315
uauuuuauuaauaag

SEQ ID NO: 2221251 - RNA, 13 nt, Streptococcus pyogenes MGAS315
uauuuugcuucua

SEQ ID NO: 2221252 - RNA, 22 nt, Streptococcus pyogenes MGAS315
uauuuugauacgguuauuggug

SEQ ID NO: 2221253 - RNA, 21 nt, Streptococcus pyogenes MGAS315
ucaaaggguguuuuuuauaug

SEQ ID NO: 2221254 - RNA, 22 nt, Streptococcus pyogenes MGAS315
ucaaauaaaaucguuauuaauu

SEQ ID NO: 2221255 - RNA, 17 nt, Streptococcus pyogenes MGAS315
uauuuuuucucaaaaau

SEQ ID NO: 2221256 - RNA, 12 nt, Streptococcus pyogenes MGAS315
ucaaaaaaagac

SEQ ID NO: 2221257 - RNA, 17 nt, Streptococcus pyogenes MGAS315
ucaaaaaaagacacaca

SEQ ID NO: 2221258 - RNA, 17 nt, Streptococcus pyogenes MGAS315
ucaaaaaauuaagaagg

SEQ ID NO: 2221259 - RNA, 11 nt, Streptococcus pyogenes MGAS315
ucaaaaccaag

SEQ ID NO: 2221260 - RNA, 15 nt, Streptococcus pyogenes MGAS315
ucaaaaccaagucgu

SEQ ID NO: 2221261 - RNA, 15 nt, Streptococcus pyogenes MGAS315
ucaaaaauauauucu

SEQ ID NO: 2221262 - RNA, 22 nt, Streptococcus pyogenes MGAS315
uauuuacugggucaacuccaau

SEQ ID NO: 2221263 - RNA, 11 nt, Streptococcus pyogenes MGAS315
uauuacuucuu

SEQ ID NO: 2221264 - RNA, 22 nt, Streptococcus pyogenes MGAS315
uauuauacucaauauaauaaaa

SEQ ID NO: 2221265 - RNA, 15 nt, Streptococcus pyogenes MGAS315
uauuagcaaaaugcu

SEQ ID NO: 2221266 - RNA, 18 nt, Streptococcus pyogenes MGAS315
ucaacuggcacaaacucu

SEQ ID NO: 2221267 - RNA, 19 nt, Streptococcus pyogenes MGAS315
ucaacggcgacucuaucaa

SEQ ID NO: 2221268 - RNA, 23 nt, Streptococcus pyogenes MGAS315
ucaaggaaggcuuguucuuuauu

SEQ ID NO: 2221269 - RNA, 21 nt, Streptococcus pyogenes MGAS315
ucaauauuuuauuaauaagua

SEQ ID NO: 2221270 - RNA, 18 nt, Streptococcus pyogenes MGAS315
ucaagugcuagauguugg

SEQ ID NO: 2221271 - RNA, 20 nt, Streptococcus pyogenes MGAS315
ucaauggaaauuuuaaauga

SEQ ID NO: 2221272 - RNA, 14 nt, Streptococcus pyogenes MGAS315
ucacaacuucuaua

SEQ ID NO: 2221273 - RNA, 15 nt, Streptococcus pyogenes MGAS315
ucaauuuucauuuuu

SEQ ID NO: 2221274 - RNA, 18 nt, Streptococcus pyogenes MGAS315
ucaauuuuugccaaaauc

SEQ ID NO: 2221275 - RNA, 19 nt, Streptococcus pyogenes MGAS315
ucaccuuaggcagacaauu

SEQ ID NO: 2221276 - RNA, 21 nt, Streptococcus pyogenes MGAS315
ucaccuuaggcagacaauuau

SEQ ID NO: 2221277 - RNA, 13 nt, Streptococcus pyogenes MGAS315
ucauacaaaaaca

SEQ ID NO: 2221278 - RNA, 21 nt, Streptococcus pyogenes MGAS315
ucauacucaauagcugcugcu

SEQ ID NO: 2221279 - RNA, 16 nt, Streptococcus pyogenes MGAS315
ucaucaaaagaccaua

SEQ ID NO: 2221280 - RNA, 21 nt, Streptococcus pyogenes MGAS315
ucaucaaaagaccauaaaaaa

SEQ ID NO: 2221281 - RNA, 15 nt, Streptococcus pyogenes MGAS315
ucauaacuugucaag

SEQ ID NO: 2221282 - RNA, 20 nt, Streptococcus pyogenes MGAS315
ucauaaguuuagaacuuuuc

SEQ ID NO: 2221283 - RNA, 16 nt, Streptococcus pyogenes MGAS315
ucauaaacaaugaguc

SEQ ID NO: 2221284 - RNA, 15 nt, Streptococcus pyogenes MGAS315
ucauaaauaaagaua

SEQ ID NO: 2221285 - RNA, 18 nt, Streptococcus pyogenes MGAS315
ucaguuuuuuugauuuuc

SEQ ID NO: 2221286 - RNA, 17 nt, Streptococcus pyogenes MGAS315
ucagguugcaacaauua

SEQ ID NO: 2221287 - RNA, 19 nt, Streptococcus pyogenes MGAS315
ucagguugcaacaauuaaa

SEQ ID NO: 2221288 - RNA, 14 nt, Streptococcus pyogenes MGAS315
ucauugcuuuuuau

SEQ ID NO: 2221289 - RNA, 21 nt, Streptococcus pyogenes MGAS315
ucauuuuuggagagaccuugu

SEQ ID NO: 2221290 - RNA, 18 nt, Streptococcus pyogenes MGAS315
ucauuaaagcuaucauac

SEQ ID NO: 2221291 - RNA, 21 nt, Streptococcus pyogenes MGAS315
ucaugauguuauuaaauaaua

SEQ ID NO: 2221292 - RNA, 22 nt, Streptococcus pyogenes MGAS315
ucaugacgccuccaaauacugg

SEQ ID NO: 2221293 - RNA, 17 nt, Streptococcus pyogenes MGAS315
ugcaggguaucugcuca

SEQ ID NO: 2221294 - RNA, 13 nt, Streptococcus pyogenes MGAS315
ugcagguaauuau

SEQ ID NO: 2221295 - RNA, 12 nt, Streptococcus pyogenes MGAS315
ugccaacuuuuc

SEQ ID NO: 2221296 - RNA, 14 nt, Streptococcus pyogenes MGAS315
ugcauuaccuuauu

SEQ ID NO: 2221297 - RNA, 16 nt, Streptococcus pyogenes MGAS315
ugccauuuaaaagggc

SEQ ID NO: 2221298 - RNA, 18 nt, Streptococcus pyogenes MGAS315
ugccauuuccuacaaaau

SEQ ID NO: 2221299 - RNA, 14 nt, Streptococcus pyogenes MGAS315
ugccauuugagcac

SEQ ID NO: 2221300 - RNA, 17 nt, Streptococcus pyogenes MGAS315
ugccauggguaaaauga

SEQ ID NO: 2221301 - RNA, 19 nt, Streptococcus pyogenes MGAS315
ugccauggguaaaaugacu

SEQ ID NO: 2221302 - RNA, 22 nt, Streptococcus pyogenes MGAS315
ugccaguaaggaaaucaauccu

SEQ ID NO: 2221303 - RNA, 20 nt, Streptococcus pyogenes MGAS315
ugcgcauguugacuauuuuu

SEQ ID NO: 2221304 - RNA, 16 nt, Streptococcus pyogenes MGAS315
ugagccccaaaaguug

SEQ ID NO: 2221305 - RNA, 18 nt, Streptococcus pyogenes MGAS315
ugagccccaaaaguuggc

SEQ ID NO: 2221306 - RNA, 21 nt, Streptococcus pyogenes MGAS315
ugagauuaacugacaaaaaaa

SEQ ID NO: 2221307 - RNA, 14 nt, Streptococcus pyogenes MGAS315
ugagauuaacugac

SEQ ID NO: 2221308 - RNA, 16 nt, Streptococcus pyogenes MGAS315
ugagauuaacugacaa

SEQ ID NO: 2221309 - RNA, 19 nt, Streptococcus pyogenes MGAS315
ugacuuguuacaaaaaaca

SEQ ID NO: 2221310 - RNA, 15 nt, Streptococcus pyogenes MGAS315
ugagacaaguugccu

SEQ ID NO: 2221311 - RNA, 21 nt, Streptococcus pyogenes MGAS315
ugacuugguucugaaaauaaa

SEQ ID NO: 2221312 - RNA, 15 nt, Streptococcus pyogenes MGAS315
ugacuugguuuaaua

SEQ ID NO: 2221313 - RNA, 16 nt, Streptococcus pyogenes MGAS315
ugacuuguuacaaaaa

SEQ ID NO: 2221314 - RNA, 17 nt, Streptococcus pyogenes MGAS315
ugauaaaugucguugua

SEQ ID NO: 2221315 - RNA, 19 nt, Streptococcus pyogenes MGAS315
ugauaaaugucguuguaag

SEQ ID NO: 2221316 - RNA, 21 nt, Streptococcus pyogenes MGAS315
ugauaaucccuugcuuugauu

SEQ ID NO: 2221317 - RNA, 20 nt, Streptococcus pyogenes MGAS315
ugauaaaggccuguauuucu

SEQ ID NO: 2221318 - RNA, 18 nt, Streptococcus pyogenes MGAS315
ugaugcucucauaaacaa

SEQ ID NO: 2221319 - RNA, 12 nt, Streptococcus pyogenes MGAS315
ugauucuuuuuu

SEQ ID NO: 2221320 - RNA, 17 nt, Streptococcus pyogenes MGAS315
ugauuauucucuauuuu

SEQ ID NO: 2221321 - RNA, 19 nt, Streptococcus pyogenes MGAS315
ugauuacugauaaacuuga

SEQ ID NO: 2221322 - RNA, 14 nt, Streptococcus pyogenes MGAS315
ugauguuauuaaau

SEQ ID NO: 2221323 - RNA, 17 nt, Streptococcus pyogenes MGAS315
ugacaaccuuaaagacc

SEQ ID NO: 2221324 - RNA, 15 nt, Streptococcus pyogenes MGAS315
ugacaaauucuuuuu

SEQ ID NO: 2221325 - RNA, 11 nt, Streptococcus pyogenes MGAS315
ugacaauguga

SEQ ID NO: 2221326 - RNA, 17 nt, Streptococcus pyogenes MGAS315
ugacaauuggugauuaa

SEQ ID NO: 2221327 - RNA, 20 nt, Streptococcus pyogenes MGAS315
ugacagacaccaaaaaaagc

SEQ ID NO: 2221328 - RNA, 19 nt, Streptococcus pyogenes MGAS315
ugacagacaccaaaaaaag

SEQ ID NO: 2221329 - RNA, 18 nt, Streptococcus pyogenes MGAS315
ugacacucccgcuuuuaa

SEQ ID NO: 2221330 - RNA, 13 nt, Streptococcus pyogenes MGAS315
ugacauaguguuu

SEQ ID NO: 2221331 - RNA, 17 nt, Streptococcus pyogenes MGAS315
ugacaguuaaaaauaac

SEQ ID NO: 2221332 - RNA, 22 nt, Streptococcus pyogenes MGAS315
ugacauaucuucacgggcugcc

SEQ ID NO: 2221333 - RNA, 15 nt, Streptococcus pyogenes MGAS315
ugaauugaaaaaaga

SEQ ID NO: 2221334 - RNA, 13 nt, Streptococcus pyogenes MGAS315
ugaauaauuuuca

SEQ ID NO: 2221335 - RNA, 19 nt, Streptococcus pyogenes MGAS315
ugaacaaaguuucaagugc

SEQ ID NO: 2221336 - RNA, 20 nt, Streptococcus pyogenes MGAS315
ugaaauuccuuaaauuauau

SEQ ID NO: 2221337 - RNA, 21 nt, Streptococcus pyogenes MGAS315
ugaaauuccuuaaauuauauu

SEQ ID NO: 2221338 - RNA, 20 nt, Streptococcus pyogenes MGAS315
ugaaaugugguaagaagaaa

SEQ ID NO: 2221339 - RNA, 15 nt, Streptococcus pyogenes MGAS315
ugaaaguaucuagga

SEQ ID NO: 2221340 - RNA, 15 nt, Streptococcus pyogenes MGAS315
ucgccaauaaaaaag

SEQ ID NO: 2221341 - RNA, 22 nt, Streptococcus pyogenes MGAS315
ucgcccuuuuuagcuuauaauu

SEQ ID NO: 2221342 - RNA, 17 nt, Streptococcus pyogenes MGAS315
ucgccuaggaauaaaau

SEQ ID NO: 2221343 - RNA, 20 nt, Streptococcus pyogenes MGAS315
ucgcguuuaggcucauauua

SEQ ID NO: 2221344 - RNA, 14 nt, Streptococcus pyogenes MGAS315
ucggcaucgguaau

SEQ ID NO: 2221345 - RNA, 19 nt, Streptococcus pyogenes MGAS315
ucguuacuccuuugaccac

SEQ ID NO: 2221346 - RNA, 19 nt, Streptococcus pyogenes MGAS315
ucgucuuuguccauucuuu

SEQ ID NO: 2221347 - RNA, 20 nt, Streptococcus pyogenes MGAS315
ucgucgugccaccucuaaca

SEQ ID NO: 2221348 - RNA, 15 nt, Streptococcus pyogenes MGAS315
ucguauacuuuaaac

SEQ ID NO: 2221349 - RNA, 17 nt, Streptococcus pyogenes MGAS315
ucggccacguuuuucaa

SEQ ID NO: 2221350 - RNA, 21 nt, Streptococcus pyogenes MGAS315
ucuccaaaguucuucuaaacg

SEQ ID NO: 2221351 - RNA, 15 nt, Streptococcus pyogenes MGAS315
ucucgauuguaauca

SEQ ID NO: 2221352 - RNA, 14 nt, Streptococcus pyogenes MGAS315
ucugaaaauaaaau

SEQ ID NO: 2221353 - RNA, 23 nt, Streptococcus pyogenes MGAS315
ucugaaaauaaaauauuuuucca

SEQ ID NO: 2221354 - RNA, 19 nt, Streptococcus pyogenes MGAS315
ucugaaaauaaaauauuuu

SEQ ID NO: 2221355 - RNA, 19 nt, Streptococcus pyogenes MGAS315
ucugcaauauccauagaaa

SEQ ID NO: 2221356 - RNA, 18 nt, Streptococcus pyogenes MGAS315
ucugcagauuuuaagaca

SEQ ID NO: 2221357 - RNA, 20 nt, Streptococcus pyogenes MGAS315
ucucuugcaaggugcuuuuu

SEQ ID NO: 2221358 - RNA, 20 nt, Streptococcus pyogenes MGAS315
aaauggacaaucuuaaguua

SEQ ID NO: 2221359 - RNA, 18 nt, Streptococcus pyogenes MGAS315
ucuguuuaaaauauauuu

SEQ ID NO: 2221360 - RNA, 19 nt, Streptococcus pyogenes MGAS315
ucuguuuaaaauauauuuu

SEQ ID NO: 2221361 - RNA, 17 nt, Streptococcus pyogenes MGAS315
ucuuauagaauaaccag

SEQ ID NO: 2221362 - RNA, 16 nt, Streptococcus pyogenes MGAS315
ucugguuuuaauauug

SEQ ID NO: 2221363 - RNA, 21 nt, Streptococcus pyogenes MGAS315
ucuggcuuuuuccuaucagau

SEQ ID NO: 2221364 - RNA, 13 nt, Streptococcus pyogenes MGAS315
ucuggcaauaagu

SEQ ID NO: 2221365 - RNA, 18 nt, Streptococcus pyogenes MGAS315
ucguuuugcaauuaagua

SEQ ID NO: 2221366 - RNA, 18 nt, Streptococcus pyogenes MGAS315
ucguuuuuugcuuuugau

SEQ ID NO: 2221367 - RNA, 19 nt, Streptococcus pyogenes MGAS315
aaaugaagcaaaauaaacu

SEQ ID NO: 2221368 - RNA, 20 nt, Streptococcus pyogenes MGAS315
aaaucuucugcauuaucauc

SEQ ID NO: 2221369 - RNA, 21 nt, Streptococcus pyogenes MGAS315
aaaucuucugcauuaucaucu

SEQ ID NO: 2221370 - RNA, 17 nt, Streptococcus pyogenes MGAS315
aaaucuuacuaacuagc

SEQ ID NO: 2221371 - RNA, 15 nt, Streptococcus pyogenes MGAS315
aaaugacaugaaagu

SEQ ID NO: 2221372 - RNA, 14 nt, Streptococcus pyogenes MGAS315
aaaugacaucaaag

SEQ ID NO: 2221373 - RNA, 15 nt, Streptococcus pyogenes MGAS315
ucuacacaaaagcuu

SEQ ID NO: 2221374 - RNA, 19 nt, Streptococcus pyogenes MGAS315
ucuaauuagcauauuuuga

SEQ ID NO: 2221375 - RNA, 14 nt, Streptococcus pyogenes MGAS315
ucuaauuugugaaa

SEQ ID NO: 2221376 - RNA, 20 nt, Streptococcus pyogenes MGAS315
ucucaaaaauauauucuaau

SEQ ID NO: 2221377 - RNA, 22 nt, Streptococcus pyogenes MGAS315
ucuauuugaaguaaaggauuua

SEQ ID NO: 2221378 - RNA, 15 nt, Streptococcus pyogenes MGAS315
ucuauuguauuugau

SEQ ID NO: 2221379 - RNA, 20 nt, Streptococcus pyogenes MGAS315
aaaugccuccgacaaucgaa

SEQ ID NO: 2221380 - RNA, 15 nt, Streptococcus pyogenes MGAS315
ucucacaaauacaga

SEQ ID NO: 2221381 - RNA, 19 nt, Streptococcus pyogenes MGAS315
ucucacaaauacagaaaaa

SEQ ID NO: 2221382 - RNA, 20 nt, Streptococcus pyogenes MGAS315
ucucacaaauacagaaaaaa

SEQ ID NO: 2221383 - RNA, 14 nt, Streptococcus pyogenes MGAS315
ucuagcuugugagg

SEQ ID NO: 2221384 - RNA, 20 nt, Streptococcus pyogenes MGAS315
ucuagucagaucauuaaauu

SEQ ID NO: 2221385 - RNA, 20 nt, Streptococcus pyogenes MGAS315
ucuagacccuagcauaaaag

SEQ ID NO: 2221386 - RNA, 16 nt, Streptococcus pyogenes MGAS315
ucuagaacagcugcuu

SEQ ID NO: 2221387 - RNA, 13 nt, Streptococcus pyogenes MGAS315
aaaugauagcacc

SEQ ID NO: 2221388 - RNA, 13 nt, Streptococcus pyogenes MGAS315
aaaugauacuuuc

SEQ ID NO: 2221389 - RNA, 12 nt, Streptococcus pyogenes MGAS315
ucuaucugcaga

SEQ ID NO: 2221390 - RNA, 20 nt, Streptococcus pyogenes MGAS315
uuaauaaacucuauacaaaa

SEQ ID NO: 2221391 - RNA, 19 nt, Streptococcus pyogenes MGAS315
uuaauauagucugcaugaa

SEQ ID NO: 2221392 - RNA, 19 nt, Streptococcus pyogenes MGAS315
uuacuguauaaacuuguug

SEQ ID NO: 2221393 - RNA, 14 nt, Streptococcus pyogenes MGAS315
uuacuuaucaucau

SEQ ID NO: 2221394 - RNA, 12 nt, Streptococcus pyogenes MGAS315
uuagccuuuuuu

SEQ ID NO: 2221395 - RNA, 18 nt, Streptococcus pyogenes MGAS315
uuacaucaaaaaaagcaa

SEQ ID NO: 2221396 - RNA, 23 nt, Streptococcus pyogenes MGAS315
uuaaugaccuuugauaagauauu

SEQ ID NO: 2221397 - RNA, 22 nt, Streptococcus pyogenes MGAS315
uuaaucugucgguauaguuugg

SEQ ID NO: 2221398 - RNA, 22 nt, Streptococcus pyogenes MGAS315
uguuuugccugauauuccuuuu

SEQ ID NO: 2221399 - RNA, 16 nt, Streptococcus pyogenes MGAS315
uguuuucacuauaauu

SEQ ID NO: 2221400 - RNA, 12 nt, Streptococcus pyogenes MGAS315
uguuuaugaaag

SEQ ID NO: 2221401 - RNA, 20 nt, Streptococcus pyogenes MGAS315
uuaaagacaaaaaacuggaa

SEQ ID NO: 2221402 - RNA, 14 nt, Streptococcus pyogenes MGAS315
uuaaagacaaaaaa

SEQ ID NO: 2221403 - RNA, 13 nt, Streptococcus pyogenes MGAS315
uuaaaaauaacuu

SEQ ID NO: 2221404 - RNA, 15 nt, Streptococcus pyogenes MGAS315
uuaaaauagaagaca

SEQ ID NO: 2221405 - RNA, 16 nt, Streptococcus pyogenes MGAS315
uuaaaauauauuuugg

SEQ ID NO: 2221406 - RNA, 21 nt, Streptococcus pyogenes MGAS315
uguuaucccuggaccauuauc

SEQ ID NO: 2221407 - RNA, 22 nt, Streptococcus pyogenes MGAS315
uguuauuggaaaguaaggguua

SEQ ID NO: 2221408 - RNA, 22 nt, Streptococcus pyogenes MGAS315
uguucaaccgucacuauugaau

SEQ ID NO: 2221409 - RNA, 15 nt, Streptococcus pyogenes MGAS315
uguucgauaaauuca

SEQ ID NO: 2221410 - RNA, 19 nt, Streptococcus pyogenes MGAS315
uguucgauaaauucagguu

SEQ ID NO: 2221411 - RNA, 15 nt, Streptococcus pyogenes MGAS315
uguuccaucugcaca

SEQ ID NO: 2221412 - RNA, 20 nt, Streptococcus pyogenes MGAS315
uguugacucugauccgaguu

SEQ ID NO: 2221413 - RNA, 16 nt, Streptococcus pyogenes MGAS315
uguucuuuauuuugau

SEQ ID NO: 2221414 - RNA, 19 nt, Streptococcus pyogenes MGAS315
uguugcaaggcuaaagccu

SEQ ID NO: 2221415 - RNA, 21 nt, Streptococcus pyogenes MGAS315
uguuuaaaauauauuuuggau

SEQ ID NO: 2221416 - RNA, 22 nt, Streptococcus pyogenes MGAS315
uguuuaaaauauauuuuggauc

SEQ ID NO: 2221417 - RNA, 13 nt, Streptococcus pyogenes MGAS315
uguacaagagcuu

SEQ ID NO: 2221418 - RNA, 12 nt, Streptococcus pyogenes MGAS315
uguaauccccuc

SEQ ID NO: 2221419 - RNA, 23 nt, Streptococcus pyogenes MGAS315
uguaauccccucauuuaaauguu

SEQ ID NO: 2221420 - RNA, 24 nt, Streptococcus pyogenes MGAS315
uguaauuucuugugcuaaucuauc

SEQ ID NO: 2221421 - RNA, 21 nt, Streptococcus pyogenes MGAS315
uguaacuguagcguuuguguu

SEQ ID NO: 2221422 - RNA, 20 nt, Streptococcus pyogenes MGAS315
uguaacgcuuguuuaugaaa

SEQ ID NO: 2221423 - RNA, 12 nt, Streptococcus pyogenes MGAS315
uguaaaaugaua

SEQ ID NO: 2221424 - RNA, 18 nt, Streptococcus pyogenes MGAS315
ugguuuuuugucuucuuc

SEQ ID NO: 2221425 - RNA, 12 nt, Streptococcus pyogenes MGAS315
ugguuuaucauu

SEQ ID NO: 2221426 - RNA, 21 nt, Streptococcus pyogenes MGAS315
uguauauuuaauagcauuguc

SEQ ID NO: 2221427 - RNA, 19 nt, Streptococcus pyogenes MGAS315
uguagggauuuuuuuaacu

SEQ ID NO: 2221428 - RNA, 14 nt, Streptococcus pyogenes MGAS315
ugucaaauaaaauc

SEQ ID NO: 2221429 - RNA, 15 nt, Streptococcus pyogenes MGAS315
ugucaaaaaguaaaa

SEQ ID NO: 2221430 - RNA, 23 nt, Streptococcus pyogenes MGAS315
ugucaagccauagccagauggug

SEQ ID NO: 2221431 - RNA, 13 nt, Streptococcus pyogenes MGAS315
uguauuacuucuu

SEQ ID NO: 2221432 - RNA, 17 nt, Streptococcus pyogenes MGAS315
ugucauacucaauagcu

SEQ ID NO: 2221433 - RNA, 14 nt, Streptococcus pyogenes MGAS315
ugucauuucuugag

SEQ ID NO: 2221434 - RNA, 22 nt, Streptococcus pyogenes MGAS315
ugugccuuuucuuuuuggcuga

SEQ ID NO: 2221435 - RNA, 20 nt, Streptococcus pyogenes MGAS315
ugugccuacuccucucacaa

SEQ ID NO: 2221436 - RNA, 12 nt, Streptococcus pyogenes MGAS315
ugugugugaugu

SEQ ID NO: 2221437 - RNA, 22 nt, Streptococcus pyogenes MGAS315
uggcuucuagguagguuugaaa

SEQ ID NO: 2221438 - RNA, 18 nt, Streptococcus pyogenes MGAS315
ugggauauuuagauggua

SEQ ID NO: 2221439 - RNA, 23 nt, Streptococcus pyogenes MGAS315
uggucaauggaaauuuuaaauga

SEQ ID NO: 2221440 - RNA, 13 nt, Streptococcus pyogenes MGAS315
ugguaaaaaggca

SEQ ID NO: 2221441 - RNA, 13 nt, Streptococcus pyogenes MGAS315
ugguauucuuuuu

SEQ ID NO: 2221442 - RNA, 13 nt, Streptococcus pyogenes MGAS315
uggauuuccucua

SEQ ID NO: 2221443 - RNA, 17 nt, Streptococcus pyogenes MGAS315
uggcaccaagugcugcc

SEQ ID NO: 2221444 - RNA, 21 nt, Streptococcus pyogenes MGAS315
uuauuuugcagguaauuaucu

SEQ ID NO: 2221445 - RNA, 15 nt, Streptococcus pyogenes MGAS315
uuaggaucuguuaau

SEQ ID NO: 2221446 - RNA, 20 nt, Streptococcus pyogenes MGAS315
uuaggauauggaauagguaa

SEQ ID NO: 2221447 - RNA, 23 nt, Streptococcus pyogenes MGAS315
uucaaugcgcucaagcauuuugu

SEQ ID NO: 2221448 - RNA, 19 nt, Streptococcus pyogenes MGAS315
uucauauaagcaaucauca

SEQ ID NO: 2221449 - RNA, 13 nt, Streptococcus pyogenes MGAS315
uucauagcuuaau

SEQ ID NO: 2221450 - RNA, 15 nt, Streptococcus pyogenes MGAS315
uucaucuugcauuac

SEQ ID NO: 2221451 - RNA, 19 nt, Streptococcus pyogenes MGAS315
uucaugauguuauuaaaua

SEQ ID NO: 2221452 - RNA, 22 nt, Streptococcus pyogenes MGAS315
uucccuuaauaaacucuauaca

SEQ ID NO: 2221453 - RNA, 18 nt, Streptococcus pyogenes MGAS315
uucguugacaaagccauu

SEQ ID NO: 2221454 - RNA, 14 nt, Streptococcus pyogenes MGAS315
uucuuauccauuau

SEQ ID NO: 2221455 - RNA, 19 nt, Streptococcus pyogenes MGAS315
uucucuuuggagaaauuca

SEQ ID NO: 2221456 - RNA, 23 nt, Streptococcus pyogenes MGAS315
uucuagacccuagcauaaaagau

SEQ ID NO: 2221457 - RNA, 13 nt, Streptococcus pyogenes MGAS315
uugugaucuguua

SEQ ID NO: 2221458 - RNA, 13 nt, Streptococcus pyogenes MGAS315
uugugauauguuu

SEQ ID NO: 2221459 - RNA, 20 nt, Streptococcus pyogenes MGAS315
uugucuuaucuaaaggagcu

SEQ ID NO: 2221460 - RNA, 14 nt, Streptococcus pyogenes MGAS315
uugucuuauagaau

SEQ ID NO: 2221461 - RNA, 19 nt, Streptococcus pyogenes MGAS315
uuguucauuaaagcuauca

SEQ ID NO: 2221462 - RNA, 19 nt, Streptococcus pyogenes MGAS315
uuguuuuaguaaagccuua

SEQ ID NO: 2221463 - RNA, 19 nt, Streptococcus pyogenes MGAS315
uuguaauaacaaaaugaag

SEQ ID NO: 2221464 - RNA, 21 nt, Streptococcus pyogenes MGAS315
uuguagaguuugaggugaugc

SEQ ID NO: 2221465 - RNA, 22 nt, Streptococcus pyogenes MGAS315
uuguacaagagcuuaaaaguua

SEQ ID NO: 2221466 - RNA, 20 nt, Streptococcus pyogenes MGAS315
uugucaaaaaguaaaaagca

SEQ ID NO: 2221467 - RNA, 22 nt, Streptococcus pyogenes MGAS315
uuguauuaugaggugacacucc

SEQ ID NO: 2221468 - RNA, 20 nt, Streptococcus pyogenes MGAS315
uuuaagguauuguucaaccg

SEQ ID NO: 2221469 - RNA, 15 nt, Streptococcus pyogenes MGAS315
uuuaagcugaguaaa

SEQ ID NO: 2221470 - RNA, 14 nt, Streptococcus pyogenes MGAS315
uuuaagacaacaua

SEQ ID NO: 2221471 - RNA, 22 nt, Streptococcus pyogenes MGAS315
uuuaauagcauugucaaauaaa

SEQ ID NO: 2221472 - RNA, 15 nt, Streptococcus pyogenes MGAS315
uuuacaucaaaaaaa

SEQ ID NO: 2221473 - RNA, 20 nt, Streptococcus pyogenes MGAS315
uuuacuauggcuucuaaaaa

SEQ ID NO: 2221474 - RNA, 15 nt, Streptococcus pyogenes MGAS315
uuuacuuuuaaaauc

SEQ ID NO: 2221475 - RNA, 18 nt, Streptococcus pyogenes MGAS315
uuuagaacuuuucagguu

SEQ ID NO: 2221476 - RNA, 18 nt, Streptococcus pyogenes MGAS315
uuuauuaauaaguauuuu

SEQ ID NO: 2221477 - RNA, 14 nt, Streptococcus pyogenes MGAS315
uuuaugaaagguau

SEQ ID NO: 2221478 - RNA, 15 nt, Streptococcus pyogenes MGAS315
uugauaccaugugca

SEQ ID NO: 2221479 - RNA, 20 nt, Streptococcus pyogenes MGAS315
uugcagguaauuaucugaau

SEQ ID NO: 2221480 - RNA, 16 nt, Streptococcus pyogenes MGAS315
uugcaucgcaaacaga

SEQ ID NO: 2221481 - RNA, 17 nt, Streptococcus pyogenes MGAS315
uugcauggguaugccug

SEQ ID NO: 2221482 - RNA, 22 nt, Streptococcus pyogenes MGAS315
uugccauuaauaauauuaaccg

SEQ ID NO: 2221483 - RNA, 13 nt, Streptococcus pyogenes MGAS315
uugccauuuaauu

SEQ ID NO: 2221484 - RNA, 17 nt, Streptococcus pyogenes MGAS315
uugccauuaauaauauu

SEQ ID NO: 2221485 - RNA, 13 nt, Streptococcus pyogenes MGAS315
uuggaucuucaac

SEQ ID NO: 2221486 - RNA, 12 nt, Streptococcus pyogenes MGAS315
uuggauccuuua

SEQ ID NO: 2221487 - RNA, 14 nt, Streptococcus pyogenes MGAS315
uugcuuuugauacc

SEQ ID NO: 2221488 - RNA, 18 nt, Streptococcus pyogenes MGAS315
uugcuuuugauaccuuuu

SEQ ID NO: 2221489 - RNA, 15 nt, Streptococcus pyogenes MGAS315
uugcuuaaugaccuu

SEQ ID NO: 2221490 - RNA, 20 nt, Streptococcus pyogenes MGAS315
uugcuuaaugaccuuugaua

SEQ ID NO: 2221491 - RNA, 23 nt, Streptococcus pyogenes MGAS315
uuggccaauaaaauaucuagaac

SEQ ID NO: 2221492 - RNA, 20 nt, Streptococcus pyogenes MGAS315
uuggccuacuagcacaaaau

SEQ ID NO: 2221493 - RNA, 22 nt, Streptococcus pyogenes MGAS315
uugguggaagaguaaggaccaa

SEQ ID NO: 2221494 - RNA, 16 nt, Streptococcus pyogenes MGAS315
uugguggaagaguaag

SEQ ID NO: 2221495 - RNA, 19 nt, Streptococcus pyogenes MGAS315
aauaaugccaucaaaaaaa

SEQ ID NO: 2221496 - RNA, 16 nt, Streptococcus pyogenes MGAS315
aauaaugccaucaaaa

SEQ ID NO: 2221497 - RNA, 20 nt, Streptococcus pyogenes MGAS315
aauaauggcagagucauuua

SEQ ID NO: 2221498 - RNA, 15 nt, Streptococcus pyogenes MGAS315
aauaaucugagcggu

SEQ ID NO: 2221499 - RNA, 19 nt, Streptococcus pyogenes MGAS315
aauaauacagcauacauca

SEQ ID NO: 2221500 - RNA, 24 nt, Streptococcus pyogenes MGAS315
aauaacccgucuuacaauuaauag

SEQ ID NO: 2221501 - RNA, 22 nt, Streptococcus pyogenes MGAS315
aauaacagaaauuaauaaauuu

SEQ ID NO: 2221502 - RNA, 11 nt, Streptococcus pyogenes MGAS315
aauaagauuca

SEQ ID NO: 2221503 - RNA, 19 nt, Streptococcus pyogenes MGAS315
aauaagauucaauaugaaa

SEQ ID NO: 2221504 - RNA, 13 nt, Streptococcus pyogenes MGAS315
aauaacuuuaaaa

SEQ ID NO: 2221505 - RNA, 15 nt, Streptococcus pyogenes MGAS315
aauaacuuuaaaagg

SEQ ID NO: 2221506 - RNA, 13 nt, Streptococcus pyogenes MGAS315
aauaagaaaaccu

SEQ ID NO: 2221507 - RNA, 15 nt, Streptococcus pyogenes MGAS315
aauaucauauuuuaa

SEQ ID NO: 2221508 - RNA, 23 nt, Streptococcus pyogenes MGAS315
aauaucuuaccauuguagaguuu

SEQ ID NO: 2221509 - RNA, 23 nt, Streptococcus pyogenes MGAS315
aauagguaaagauuuuaaauauc

SEQ ID NO: 2221510 - RNA, 16 nt, Streptococcus pyogenes MGAS315
aauagcaaugguuaaa

SEQ ID NO: 2221511 - RNA, 21 nt, Streptococcus pyogenes MGAS315
aauagcauugucaaauaaaau

SEQ ID NO: 2221512 - RNA, 22 nt, Streptococcus pyogenes MGAS315
aauagcauugucaaauaaaauc

SEQ ID NO: 2221513 - RNA, 22 nt, Streptococcus pyogenes MGAS315
aagccgugaggacuuauuuuuu

SEQ ID NO: 2221514 - RNA, 16 nt, Streptococcus pyogenes MGAS315
aagccuacaacagcag

SEQ ID NO: 2221515 - RNA, 14 nt, Streptococcus pyogenes MGAS315
aagaaggucaugau

SEQ ID NO: 2221516 - RNA, 15 nt, Streptococcus pyogenes MGAS315
aagaaggucaugaug

SEQ ID NO: 2221517 - RNA, 21 nt, Streptococcus pyogenes MGAS315
aagcguugacaguuaaaaaua

SEQ ID NO: 2221518 - RNA, 14 nt, Streptococcus pyogenes MGAS315
aagucucuugcaag

SEQ ID NO: 2221519 - RNA, 16 nt, Streptococcus pyogenes MGAS315
aagugagaacauguga

SEQ ID NO: 2221520 - RNA, 21 nt, Streptococcus pyogenes MGAS315
aagugugacuaguuuauuaca

SEQ ID NO: 2221521 - RNA, 20 nt, Streptococcus pyogenes MGAS315
aaguuauaaagaaacaaaaa

SEQ ID NO: 2221522 - RNA, 22 nt, Streptococcus pyogenes MGAS315
aagucaguuuuuucugccauau

SEQ ID NO: 2221523 - RNA, 17 nt, Streptococcus pyogenes MGAS315
aaguauagcauaaaaua

SEQ ID NO: 2221524 - RNA, 18 nt, Streptococcus pyogenes MGAS315
aaguauuuuaugacaaau

SEQ ID NO: 2221525 - RNA, 14 nt, Streptococcus pyogenes MGAS315
aagguauuguucaa

SEQ ID NO: 2221526 - RNA, 21 nt, Streptococcus pyogenes MGAS315
aagggugaaucguuacuccuu

SEQ ID NO: 2221527 - RNA, 20 nt, Streptococcus pyogenes MGAS315
aaguaaaaagcaaauugaaa

SEQ ID NO: 2221528 - RNA, 13 nt, Streptococcus pyogenes MGAS315
aaguaaaaagcaa

SEQ ID NO: 2221529 - RNA, 17 nt, Streptococcus pyogenes MGAS315
aaggucauuagaauaag

SEQ ID NO: 2221530 - RNA, 14 nt, Streptococcus pyogenes MGAS315
aagggaagaagauc

SEQ ID NO: 2221531 - RNA, 17 nt, Streptococcus pyogenes MGAS315
aauugccaucaauuuuc

SEQ ID NO: 2221532 - RNA, 19 nt, Streptococcus pyogenes MGAS315
aauucuuuuauuaauguaa

SEQ ID NO: 2221533 - RNA, 20 nt, Streptococcus pyogenes MGAS315
aauucuuuuauuaauguaaa

SEQ ID NO: 2221534 - RNA, 18 nt, Streptococcus pyogenes MGAS315
aauuucaauaauaccauu

SEQ ID NO: 2221535 - RNA, 17 nt, Streptococcus pyogenes MGAS315
aauuucaauaauaccau

SEQ ID NO: 2221536 - RNA, 20 nt, Streptococcus pyogenes MGAS315
aauuuauuuuucauuugaaa

SEQ ID NO: 2221537 - RNA, 19 nt, Streptococcus pyogenes MGAS315
aauuguuuuaguaaagccu

SEQ ID NO: 2221538 - RNA, 14 nt, Streptococcus pyogenes MGAS315
aauugugucauuuc

SEQ ID NO: 2221539 - RNA, 23 nt, Streptococcus pyogenes MGAS315
aauuguagggauuuuuuuaacua

SEQ ID NO: 2221540 - RNA, 22 nt, Streptococcus pyogenes MGAS315
aauuauuaacguuaacaaaaau

SEQ ID NO: 2221541 - RNA, 14 nt, Streptococcus pyogenes MGAS315
aauuauuaguaacc

SEQ ID NO: 2221542 - RNA, 14 nt, Streptococcus pyogenes MGAS315
aauucagguuuuug

SEQ ID NO: 2221543 - RNA, 21 nt, Streptococcus pyogenes MGAS315
aaugcuuuuuaaucugucggu

SEQ ID NO: 2221544 - RNA, 18 nt, Streptococcus pyogenes MGAS315
aaugcuguuugucauacu

SEQ ID NO: 2221545 - RNA, 24 nt, Streptococcus pyogenes MGAS315
aaugcuguuugucauacucaauag

SEQ ID NO: 2221546 - RNA, 20 nt, Streptococcus pyogenes MGAS315
aaugcgcucaagcauuuugu

SEQ ID NO: 2221547 - RNA, 20 nt, Streptococcus pyogenes MGAS315
aaugaccugauuauuacaaa

SEQ ID NO: 2221548 - RNA, 13 nt, Streptococcus pyogenes MGAS315
aaugagcaaggca

SEQ ID NO: 2221549 - RNA, 20 nt, Streptococcus pyogenes MGAS315
aaugagcaaggcaagaggag

SEQ ID NO: 2221550 - RNA, 23 nt, Streptococcus pyogenes MGAS315
aaugaaacguuauuaaagacaaa

SEQ ID NO: 2221551 - RNA, 21 nt, Streptococcus pyogenes MGAS315
aaccuuccuguaucaggaggg

SEQ ID NO: 2221552 - RNA, 14 nt, Streptococcus pyogenes MGAS315
aaccuucaaaaaag

SEQ ID NO: 2221553 - RNA, 22 nt, Streptococcus pyogenes MGAS315
aaccuuuuggcuguauuuacug

SEQ ID NO: 2221554 - RNA, 22 nt, Streptococcus pyogenes MGAS315
aaccguuccugucgcagauggg

SEQ ID NO: 2221555 - RNA, 14 nt, Streptococcus pyogenes MGAS315
aacgaucaaaaauc

SEQ ID NO: 2221556 - RNA, 21 nt, Streptococcus pyogenes MGAS315
aacgaugagauuaacugacaa

SEQ ID NO: 2221557 - RNA, 20 nt, Streptococcus pyogenes MGAS315
aacguguauucuuaaaaaaa

SEQ ID NO: 2221558 - RNA, 19 nt, Streptococcus pyogenes MGAS315
aacguucuguuuaaaauau

SEQ ID NO: 2221559 - RNA, 22 nt, Streptococcus pyogenes MGAS315
aacguucuguuuaaaauauauu

SEQ ID NO: 2221560 - RNA, 19 nt, Streptococcus pyogenes MGAS315
aacuauuuaacuuaucauu

SEQ ID NO: 2221561 - RNA, 17 nt, Streptococcus pyogenes MGAS315
aacucaaaccaaacaag

SEQ ID NO: 2221562 - RNA, 22 nt, Streptococcus pyogenes MGAS315
aacucugccaauuguucauuaa

SEQ ID NO: 2221563 - RNA, 19 nt, Streptococcus pyogenes MGAS315
aacucuccaaaguucuucu

SEQ ID NO: 2221564 - RNA, 18 nt, Streptococcus pyogenes MGAS315
aacugcacugagccccaa

SEQ ID NO: 2221565 - RNA, 13 nt, Streptococcus pyogenes MGAS315
aacuuucaguuau

SEQ ID NO: 2221566 - RNA, 22 nt, Streptococcus pyogenes MGAS315
aacuugaauaucgccaauaaaa

SEQ ID NO: 2221567 - RNA, 22 nt, Streptococcus pyogenes MGAS315
aacuuguuaacaauaaguauau

SEQ ID NO: 2221568 - RNA, 15 nt, Streptococcus pyogenes MGAS315
aagaaagccaagacu

SEQ ID NO: 2221569 - RNA, 14 nt, Streptococcus pyogenes MGAS315
aaauuguuugauug

SEQ ID NO: 2221570 - RNA, 23 nt, Streptococcus pyogenes MGAS315
aaauuguagggauuuuuuuaacu

SEQ ID NO: 2221571 - RNA, 12 nt, Streptococcus pyogenes MGAS315
aaauuuuaaaug

SEQ ID NO: 2221572 - RNA, 23 nt, Streptococcus pyogenes MGAS315
aaauuucaugauguuauuaaaua

SEQ ID NO: 2221573 - RNA, 18 nt, Streptococcus pyogenes MGAS315
aaauuucagauaaaaccu

SEQ ID NO: 2221574 - RNA, 14 nt, Streptococcus pyogenes MGAS315
aacaaaaugaagca

SEQ ID NO: 2221575 - RNA, 15 nt, Streptococcus pyogenes MGAS315
aacaauuaaaaagca

SEQ ID NO: 2221576 - RNA, 14 nt, Streptococcus pyogenes MGAS315
aacaaugaaacguu

SEQ ID NO: 2221577 - RNA, 15 nt, Streptococcus pyogenes MGAS315
aacaaucuuaaaaua

SEQ ID NO: 2221578 - RNA, 18 nt, Streptococcus pyogenes MGAS315
aacaauaacacagaagcc

SEQ ID NO: 2221579 - RNA, 22 nt, Streptococcus pyogenes MGAS315
aacaccguucauauaagcaauc

SEQ ID NO: 2221580 - RNA, 20 nt, Streptococcus pyogenes MGAS315
aacaccaccaauaaugagca

SEQ ID NO: 2221581 - RNA, 18 nt, Streptococcus pyogenes MGAS315
aacagauagucaaaaaga

SEQ ID NO: 2221582 - RNA, 19 nt, Streptococcus pyogenes MGAS315
aacagauagucaaaaagac

SEQ ID NO: 2221583 - RNA, 22 nt, Streptococcus pyogenes MGAS315
aacagauaagugccaucaggcu

SEQ ID NO: 2221584 - RNA, 22 nt, Streptococcus pyogenes MGAS315
aacagcugcuugaaaagaugca

SEQ ID NO: 2221585 - RNA, 12 nt, Streptococcus pyogenes MGAS315
aacaguuccagu

SEQ ID NO: 2221586 - RNA, 17 nt, Streptococcus pyogenes MGAS315
aacaguuccaguucugu

SEQ ID NO: 2221587 - RNA, 22 nt, Streptococcus pyogenes MGAS315
aaccaagugccaguaaggaaau

SEQ ID NO: 2221588 - RNA, 15 nt, Streptococcus pyogenes MGAS315
aacaucuugauugua

SEQ ID NO: 2221589 - RNA, 15 nt, Streptococcus pyogenes MGAS315
aaccgcuaaaacagu

SEQ ID NO: 2221590 - RNA, 14 nt, Streptococcus pyogenes MGAS315
aaccauagaagcca

SEQ ID NO: 2221591 - RNA, 19 nt, Streptococcus pyogenes MGAS315
aaccaguugauaccaugug

SEQ ID NO: 2221592 - RNA, 13 nt, Streptococcus pyogenes MGAS315
aaccauugccauu

SEQ ID NO: 2221593 - RNA, 15 nt, Streptococcus pyogenes MGAS315
accgcgaauaugaua

SEQ ID NO: 2221594 - RNA, 22 nt, Streptococcus pyogenes MGAS315
accuacgauaaaacaaauaauu

SEQ ID NO: 2221595 - RNA, 21 nt, Streptococcus pyogenes MGAS315
accuauagaaaguuauaaaga

SEQ ID NO: 2221596 - RNA, 20 nt, Streptococcus pyogenes MGAS315
accguucguauuagcgccag

SEQ ID NO: 2221597 - RNA, 20 nt, Streptococcus pyogenes MGAS315
accguucauauaagcaauca

SEQ ID NO: 2221598 - RNA, 23 nt, Streptococcus pyogenes MGAS315
accguguucgauaaauucagguu

SEQ ID NO: 2221599 - RNA, 15 nt, Streptococcus pyogenes MGAS315
accgucacuauugaa

SEQ ID NO: 2221600 - RNA, 19 nt, Streptococcus pyogenes MGAS315
accucucaugggcaaauaa

SEQ ID NO: 2221601 - RNA, 17 nt, Streptococcus pyogenes MGAS315
accucuaacaccaaaau

SEQ ID NO: 2221602 - RNA, 22 nt, Streptococcus pyogenes MGAS315
accuuaggcagacaauuauuuu

SEQ ID NO: 2221603 - RNA, 20 nt, Streptococcus pyogenes MGAS315
accuuacgaguaugaacaaa

SEQ ID NO: 2221604 - RNA, 13 nt, Streptococcus pyogenes MGAS315
accuuugccauuu

SEQ ID NO: 2221605 - RNA, 23 nt, Streptococcus pyogenes MGAS315
accuuugauaagauauuguuaau

SEQ ID NO: 2221606 - RNA, 16 nt, Streptococcus pyogenes MGAS315
acgaguaugaacaaag

SEQ ID NO: 2221607 - RNA, 21 nt, Streptococcus pyogenes MGAS315
acgaugagauuaacugacaaa

SEQ ID NO: 2221608 - RNA, 18 nt, Streptococcus pyogenes MGAS315
accaaaucaaaaagcuaa

SEQ ID NO: 2221609 - RNA, 15 nt, Streptococcus pyogenes MGAS315
accaaaaccaagugc

SEQ ID NO: 2221610 - RNA, 16 nt, Streptococcus pyogenes MGAS315
accaauuguugaauaa

SEQ ID NO: 2221611 - RNA, 21 nt, Streptococcus pyogenes MGAS315
accaauuuaagguauuguuca

SEQ ID NO: 2221612 - RNA, 19 nt, Streptococcus pyogenes MGAS315
accaagucguuuagcuuuu

SEQ ID NO: 2221613 - RNA, 20 nt, Streptococcus pyogenes MGAS315
accaagugcugccauuguga

SEQ ID NO: 2221614 - RNA, 18 nt, Streptococcus pyogenes MGAS315
accaacuuggacgaaggc

SEQ ID NO: 2221615 - RNA, 14 nt, Streptococcus pyogenes MGAS315
accagccacuacaa

SEQ ID NO: 2221616 - RNA, 22 nt, Streptococcus pyogenes MGAS315
accauugccauuaauaauauua

SEQ ID NO: 2221617 - RNA, 12 nt, Streptococcus pyogenes MGAS315
accauugccauu

SEQ ID NO: 2221618 - RNA, 13 nt, Streptococcus pyogenes MGAS315
accauugccauua

SEQ ID NO: 2221619 - RNA, 15 nt, Streptococcus pyogenes MGAS315
accauuguagaguuu

SEQ ID NO: 2221620 - RNA, 18 nt, Streptococcus pyogenes MGAS315
acagcguaagccaaaucu

SEQ ID NO: 2221621 - RNA, 20 nt, Streptococcus pyogenes MGAS315
acagaugcucaaacuauauu

SEQ ID NO: 2221622 - RNA, 17 nt, Streptococcus pyogenes MGAS315
aauuucagauaaaaccu

SEQ ID NO: 2221623 - RNA, 15 nt, Streptococcus pyogenes MGAS315
acaucaaaaaaagca

SEQ ID NO: 2221624 - RNA, 16 nt, Streptococcus pyogenes MGAS315
acaucaaaaaaagcaa

SEQ ID NO: 2221625 - RNA, 19 nt, Streptococcus pyogenes MGAS315
acaucaaaaaaagcaauga

SEQ ID NO: 2221626 - RNA, 20 nt, Streptococcus pyogenes MGAS315
acaucaaaaaaagcaaugac

SEQ ID NO: 2221627 - RNA, 21 nt, Streptococcus pyogenes MGAS315
acaucaaaggcuuuuuuguau

SEQ ID NO: 2221628 - RNA, 15 nt, Streptococcus pyogenes MGAS315
acaucacguaaccaa

SEQ ID NO: 2221629 - RNA, 15 nt, Streptococcus pyogenes MGAS315
acaguuaaaaauaac

SEQ ID NO: 2221630 - RNA, 16 nt, Streptococcus pyogenes MGAS315
acaguauguaaauaua

SEQ ID NO: 2221631 - RNA, 19 nt, Streptococcus pyogenes MGAS315
agaagacaaggugaauaua

SEQ ID NO: 2221632 - RNA, 14 nt, Streptococcus pyogenes MGAS315
agaagccaauuacu

SEQ ID NO: 2221633 - RNA, 17 nt, Streptococcus pyogenes MGAS315
agacaaggugaauauaa

SEQ ID NO: 2221634 - RNA, 19 nt, Streptococcus pyogenes MGAS315
agacaaggugaauauaaga

SEQ ID NO: 2221635 - RNA, 21 nt, Streptococcus pyogenes MGAS315
agaauuggggcggcacuucca

SEQ ID NO: 2221636 - RNA, 20 nt, Streptococcus pyogenes MGAS315
agacaucacgauuugcugag

SEQ ID NO: 2221637 - RNA, 21 nt, Streptococcus pyogenes MGAS315
agaaauuguaaccacagcaau

SEQ ID NO: 2221638 - RNA, 17 nt, Streptococcus pyogenes MGAS315
agaacagcugcuugaaa

SEQ ID NO: 2221639 - RNA, 13 nt, Streptococcus pyogenes MGAS315
agaaaaagcaaug

SEQ ID NO: 2221640 - RNA, 22 nt, Streptococcus pyogenes MGAS315
agaaaguaaaaauacuagaaaa

SEQ ID NO: 2221641 - RNA, 15 nt, Streptococcus pyogenes MGAS315
agaaacuaaaggcaa

SEQ ID NO: 2221642 - RNA, 21 nt, Streptococcus pyogenes MGAS315
agaaagccaagacuaaagcau

SEQ ID NO: 2221643 - RNA, 20 nt, Streptococcus pyogenes MGAS315
agagagaagcuguucucuuu

SEQ ID NO: 2221644 - RNA, 22 nt, Streptococcus pyogenes MGAS315
agagagguugguaaaaaggcag

SEQ ID NO: 2221645 - RNA, 16 nt, Streptococcus pyogenes MGAS315
agagaugauagguuuu

SEQ ID NO: 2221646 - RNA, 18 nt, Streptococcus pyogenes MGAS315
agagucauuuaguuuaga

SEQ ID NO: 2221647 - RNA, 15 nt, Streptococcus pyogenes MGAS315
agagucauuugacua

SEQ ID NO: 2221648 - RNA, 13 nt, Streptococcus pyogenes MGAS315
agagucaaaccag

SEQ ID NO: 2221649 - RNA, 15 nt, Streptococcus pyogenes MGAS315
agagucaaaccaguu

SEQ ID NO: 2221650 - RNA, 21 nt, Streptococcus pyogenes MGAS315
agauacuuugguauucuuuuu

SEQ ID NO: 2221651 - RNA, 23 nt, Streptococcus pyogenes MGAS315
agauacuuugguauucuuuuucc

SEQ ID NO: 2221652 - RNA, 16 nt, Streptococcus pyogenes MGAS315
agauacgcuagcaucu

SEQ ID NO: 2221653 - RNA, 20 nt, Streptococcus pyogenes MGAS315
agauauuguuaauauagucu

SEQ ID NO: 2221654 - RNA, 15 nt, Streptococcus pyogenes MGAS315
agaugacgguaaaua

SEQ ID NO: 2221655 - RNA, 18 nt, Streptococcus pyogenes MGAS315
agaugacgguaaauaaag

SEQ ID NO: 2221656 - RNA, 15 nt, Streptococcus pyogenes MGAS315
agaucugcacacacu

SEQ ID NO: 2221657 - RNA, 17 nt, Streptococcus pyogenes MGAS315
agaucauuaaauugauu

SEQ ID NO: 2221658 - RNA, 17 nt, Streptococcus pyogenes MGAS315
agauggggugucagggg

SEQ ID NO: 2221659 - RNA, 17 nt, Streptococcus pyogenes MGAS315
agauggguuagcucugu

SEQ ID NO: 2221660 - RNA, 18 nt, Streptococcus pyogenes MGAS315
agaugguuuugauuaaau

SEQ ID NO: 2221661 - RNA, 17 nt, Streptococcus pyogenes MGAS315
agauuaaacuuacaaaa

SEQ ID NO: 2221662 - RNA, 18 nt, Streptococcus pyogenes MGAS315
agauuaaacuuacaaaaa

SEQ ID NO: 2221663 - RNA, 19 nt, Streptococcus pyogenes MGAS315
agauuaaacuuacaaaaag

SEQ ID NO: 2221664 - RNA, 14 nt, Streptococcus pyogenes MGAS315
acuccucucacaaa

SEQ ID NO: 2221665 - RNA, 18 nt, Streptococcus pyogenes MGAS315
acuccucucacaaauaca

SEQ ID NO: 2221666 - RNA, 20 nt, Streptococcus pyogenes MGAS315
acucaauauaauaaaaagca

SEQ ID NO: 2221667 - RNA, 16 nt, Streptococcus pyogenes MGAS315
acugagccuuuuuuug

SEQ ID NO: 2221668 - RNA, 18 nt, Streptococcus pyogenes MGAS315
acugagccccaaaaguug

SEQ ID NO: 2221669 - RNA, 19 nt, Streptococcus pyogenes MGAS315
acugccauggguaaaauga

SEQ ID NO: 2221670 - RNA, 21 nt, Streptococcus pyogenes MGAS315
acugcuggauuuagaaauuuu

SEQ ID NO: 2221671 - RNA, 22 nt, Streptococcus pyogenes MGAS315
acugcuggauuuagaaauuuua

SEQ ID NO: 2221672 - RNA, 22 nt, Streptococcus pyogenes MGAS315
acugcucuggcuuuuuccuauc

SEQ ID NO: 2221673 - RNA, 23 nt, Streptococcus pyogenes MGAS315
acuuccaucaucaaguggauaca

SEQ ID NO: 2221674 - RNA, 23 nt, Streptococcus pyogenes MGAS315
acuuaucauuuugggacuaggaa

SEQ ID NO: 2221675 - RNA, 13 nt, Streptococcus pyogenes MGAS315
acuagaaaaagca

SEQ ID NO: 2221676 - RNA, 15 nt, Streptococcus pyogenes MGAS315
acuagaaaaagcaau

SEQ ID NO: 2221677 - RNA, 19 nt, Streptococcus pyogenes MGAS315
acuagaaaaagcaaugauu

SEQ ID NO: 2221678 - RNA, 16 nt, Streptococcus pyogenes MGAS315
acuagaaaaagcaaug

SEQ ID NO: 2221679 - RNA, 19 nt, Streptococcus pyogenes MGAS315
acuaguuuauuacaaaacu

SEQ ID NO: 2221680 - RNA, 11 nt, Streptococcus pyogenes MGAS315
acuaaagcauu

SEQ ID NO: 2221681 - RNA, 19 nt, Streptococcus pyogenes MGAS315
acuauggcuucuaaaaaag

SEQ ID NO: 2221682 - RNA, 23 nt, Streptococcus pyogenes MGAS315
acuauggcuucuaaaaaaguuau

SEQ ID NO: 2221683 - RNA, 12 nt, Streptococcus pyogenes MGAS315
acuauuuuguga

SEQ ID NO: 2221684 - RNA, 13 nt, Streptococcus pyogenes MGAS315
acuauuuugugac

SEQ ID NO: 2221685 - RNA, 22 nt, Streptococcus pyogenes MGAS315
acggucauuaauaaaagauuuc

SEQ ID NO: 2221686 - RNA, 16 nt, Streptococcus pyogenes MGAS315
acguaaccaauuguug

SEQ ID NO: 2221687 - RNA, 14 nt, Streptococcus pyogenes MGAS315
acgcuguaauguug

SEQ ID NO: 2221688 - RNA, 16 nt, Streptococcus pyogenes MGAS315
aggugauugacuugug

SEQ ID NO: 2221689 - RNA, 18 nt, Streptococcus pyogenes MGAS315
aggugaguuuuuucuaaa

SEQ ID NO: 2221690 - RNA, 22 nt, Streptococcus pyogenes MGAS315
aggugaguuuuuucuaaaagag

SEQ ID NO: 2221691 - RNA, 21 nt, Streptococcus pyogenes MGAS315
agguagaugauuauauuagga

SEQ ID NO: 2221692 - RNA, 13 nt, Streptococcus pyogenes MGAS315
aggguuauuauuu

SEQ ID NO: 2221693 - RNA, 21 nt, Streptococcus pyogenes MGAS315
aggguaucugcucagagcuuu

SEQ ID NO: 2221694 - RNA, 18 nt, Streptococcus pyogenes MGAS315
aguaaaggauuuaguucu

SEQ ID NO: 2221695 - RNA, 18 nt, Streptococcus pyogenes MGAS315
aguaaagccuuauccauu

SEQ ID NO: 2221696 - RNA, 16 nt, Streptococcus pyogenes MGAS315
aguaaaacaauaacac

SEQ ID NO: 2221697 - RNA, 20 nt, Streptococcus pyogenes MGAS315
agguugguaaaaaggcaguc

SEQ ID NO: 2221698 - RNA, 21 nt, Streptococcus pyogenes MGAS315
aguaaugugggauauuuagau

SEQ ID NO: 2221699 - RNA, 16 nt, Streptococcus pyogenes MGAS315
aguacaaggcaaucca

SEQ ID NO: 2221700 - RNA, 15 nt, Streptococcus pyogenes MGAS315
aguaaggaaaucaau

SEQ ID NO: 2221701 - RNA, 23 nt, Streptococcus pyogenes MGAS315
aguaagauggugcuuuaaaaagu

SEQ ID NO: 2221702 - RNA, 13 nt, Streptococcus pyogenes MGAS315
aggcucauauuag

SEQ ID NO: 2221703 - RNA, 21 nt, Streptococcus pyogenes MGAS315
aggcuuguucuuuauuuugau

SEQ ID NO: 2221704 - RNA, 20 nt, Streptococcus pyogenes MGAS315
agggaaacaccaccaauaau

SEQ ID NO: 2221705 - RNA, 21 nt, Streptococcus pyogenes MGAS315
agcgggaacacucaucauauu

SEQ ID NO: 2221706 - RNA, 22 nt, Streptococcus pyogenes MGAS315
agcuuaaaaguuagccaagcaa

SEQ ID NO: 2221707 - RNA, 19 nt, Streptococcus pyogenes MGAS315
agcuuaaugucauacaaaa

SEQ ID NO: 2221708 - RNA, 13 nt, Streptococcus pyogenes MGAS315
agcuuaucaaggu

SEQ ID NO: 2221709 - RNA, 22 nt, Streptococcus pyogenes MGAS315
agcuuauaauuugacuucaaaa

SEQ ID NO: 2221710 - RNA, 14 nt, Streptococcus pyogenes MGAS315
agcuuaucaagguu

SEQ ID NO: 2221711 - RNA, 23 nt, Streptococcus pyogenes MGAS315
agcuuuaccuccuaaugcugcaa

SEQ ID NO: 2221712 - RNA, 19 nt, Streptococcus pyogenes MGAS315
agcuuguagcuuagcaacu

SEQ ID NO: 2221713 - RNA, 14 nt, Streptococcus pyogenes MGAS315
aggaggcaacugug

SEQ ID NO: 2221714 - RNA, 13 nt, Streptococcus pyogenes MGAS315
aggauauggaaua

SEQ ID NO: 2221715 - RNA, 23 nt, Streptococcus pyogenes MGAS315
aggauauggaauagguaaagauu

SEQ ID NO: 2221716 - RNA, 15 nt, Streptococcus pyogenes MGAS315
aggacgguuucccuu

SEQ ID NO: 2221717 - RNA, 23 nt, Streptococcus pyogenes MGAS315
agcuuuuuuuguuuuggccaaua

SEQ ID NO: 2221718 - RNA, 19 nt, Streptococcus pyogenes MGAS315
aggaauaucaugaaguaua

SEQ ID NO: 2221719 - RNA, 11 nt, Streptococcus pyogenes MGAS315
aggaauaaaau

SEQ ID NO: 2221720 - RNA, 13 nt, Streptococcus pyogenes MGAS315
aggaauaaaaugc

SEQ ID NO: 2221721 - RNA, 16 nt, Streptococcus pyogenes MGAS315
aggaaggcuuguucuu

SEQ ID NO: 2221722 - RNA, 15 nt, Streptococcus pyogenes MGAS315
aggcaaagaaagcca

SEQ ID NO: 2221723 - RNA, 17 nt, Streptococcus pyogenes MGAS315
aggcagacaauuauuuu

SEQ ID NO: 2221724 - RNA, 23 nt, Streptococcus pyogenes MGAS315
aggcaacuguggguuaagagagg

SEQ ID NO: 2221725 - RNA, 20 nt, Streptococcus pyogenes MGAS315
aggcaauccaaaucaacaug

SEQ ID NO: 2221726 - RNA, 23 nt, Streptococcus pyogenes MGAS315
auaagagaaguaauguuuuuaca

SEQ ID NO: 2221727 - RNA, 21 nt, Streptococcus pyogenes MGAS315
auaaguagcguacauggaugc

SEQ ID NO: 2221728 - RNA, 21 nt, Streptococcus pyogenes MGAS315
auaaguauagcauaaaauagu

SEQ ID NO: 2221729 - RNA, 20 nt, Streptococcus pyogenes MGAS315
auaaguauaucauuaucaac

SEQ ID NO: 2221730 - RNA, 15 nt, Streptococcus pyogenes MGAS315
auaaguauuuuaaaa

SEQ ID NO: 2221731 - RNA, 20 nt, Streptococcus pyogenes MGAS315
auaaggcugcgaugauuuug

SEQ ID NO: 2221732 - RNA, 12 nt, Streptococcus pyogenes MGAS315
auaauaaaaagc

SEQ ID NO: 2221733 - RNA, 22 nt, Streptococcus pyogenes MGAS315
auaaguuuagaacuuuucaggu

SEQ ID NO: 2221734 - RNA, 17 nt, Streptococcus pyogenes MGAS315
auaaucguaacuggucc

SEQ ID NO: 2221735 - RNA, 22 nt, Streptococcus pyogenes MGAS315
auaaagcguugacaguuaaaaa

SEQ ID NO: 2221736 - RNA, 13 nt, Streptococcus pyogenes MGAS315
auaaacuacacca

SEQ ID NO: 2221737 - RNA, 19 nt, Streptococcus pyogenes MGAS315
auaaacucuauacaaaaag

SEQ ID NO: 2221738 - RNA, 15 nt, Streptococcus pyogenes MGAS315
auaacuguugucuca

SEQ ID NO: 2221739 - RNA, 18 nt, Streptococcus pyogenes MGAS315
agucuuuaucguaaacaa

SEQ ID NO: 2221740 - RNA, 17 nt, Streptococcus pyogenes MGAS315
agucuuuuuugugaucu

SEQ ID NO: 2221741 - RNA, 15 nt, Streptococcus pyogenes MGAS315
agucugcaugaagug

SEQ ID NO: 2221742 - RNA, 19 nt, Streptococcus pyogenes MGAS315
agucuaggcguauagguga

SEQ ID NO: 2221743 - RNA, 16 nt, Streptococcus pyogenes MGAS315
aguucaauggauauaa

SEQ ID NO: 2221744 - RNA, 19 nt, Streptococcus pyogenes MGAS315
aguucaauggauauaacaa

SEQ ID NO: 2221745 - RNA, 23 nt, Streptococcus pyogenes MGAS315
aguuauaaagaaacaaaaaugaa

SEQ ID NO: 2221746 - RNA, 20 nt, Streptococcus pyogenes MGAS315
aguuauagcuccuaaaacca

SEQ ID NO: 2221747 - RNA, 23 nt, Streptococcus pyogenes MGAS315
aguguguugucaaacauaacaau

SEQ ID NO: 2221748 - RNA, 13 nt, Streptococcus pyogenes MGAS315
aguguuuugaaug

SEQ ID NO: 2221749 - RNA, 23 nt, Streptococcus pyogenes MGAS315
aguuagccaagcaaucuaagaau

SEQ ID NO: 2221750 - RNA, 14 nt, Streptococcus pyogenes MGAS315
aguuagauuuugga

SEQ ID NO: 2221751 - RNA, 23 nt, Streptococcus pyogenes MGAS315
aguuuucucagagacaauaaggu

SEQ ID NO: 2221752 - RNA, 21 nt, Streptococcus pyogenes MGAS315
aucagcauaaccuuugccauu

SEQ ID NO: 2221753 - RNA, 18 nt, Streptococcus pyogenes MGAS315
aucaacauggcuaaugau

SEQ ID NO: 2221754 - RNA, 14 nt, Streptococcus pyogenes MGAS315
auaugauauaaaaa

SEQ ID NO: 2221755 - RNA, 16 nt, Streptococcus pyogenes MGAS315
auaugaugaggugaua

SEQ ID NO: 2221756 - RNA, 12 nt, Streptococcus pyogenes MGAS315
auaugauauaaa

SEQ ID NO: 2221757 - RNA, 16 nt, Streptococcus pyogenes MGAS315
auauuuuuucucaaaa

SEQ ID NO: 2221758 - RNA, 14 nt, Streptococcus pyogenes MGAS315
auauuuuuuaggaa

SEQ ID NO: 2221759 - RNA, 16 nt, Streptococcus pyogenes MGAS315
auauuuuuuaggaaua

SEQ ID NO: 2221760 - RNA, 20 nt, Streptococcus pyogenes MGAS315
auauuuuuucucaaaaauau

SEQ ID NO: 2221761 - RNA, 18 nt, Streptococcus pyogenes MGAS315
aucaaaaaaagcaaugac

SEQ ID NO: 2221762 - RNA, 14 nt, Streptococcus pyogenes MGAS315
aucaaaaaaagcaa

SEQ ID NO: 2221763 - RNA, 19 nt, Streptococcus pyogenes MGAS315
aucaaaaaaagacacacaa

SEQ ID NO: 2221764 - RNA, 15 nt, Streptococcus pyogenes MGAS315
auauuuuaaaauagu

SEQ ID NO: 2221765 - RNA, 23 nt, Streptococcus pyogenes MGAS315
auacugguacguugauugccauu

SEQ ID NO: 2221766 - RNA, 14 nt, Streptococcus pyogenes MGAS315
auacgguaaaaacu

SEQ ID NO: 2221767 - RNA, 22 nt, Streptococcus pyogenes MGAS315
auacuuugguauucuuuuuccg

SEQ ID NO: 2221768 - RNA, 16 nt, Streptococcus pyogenes MGAS315
auacuuugguauucuu

SEQ ID NO: 2221769 - RNA, 21 nt, Streptococcus pyogenes MGAS315
auacuuuaaacacuaccuuaa

SEQ ID NO: 2221770 - RNA, 20 nt, Streptococcus pyogenes MGAS315
auagagccaagauuuuaagg

SEQ ID NO: 2221771 - RNA, 12 nt, Streptococcus pyogenes MGAS315
auagcugcugcu

SEQ ID NO: 2221772 - RNA, 20 nt, Streptococcus pyogenes MGAS315
auagcguaaagcaagggaaa

SEQ ID NO: 2221773 - RNA, 21 nt, Streptococcus pyogenes MGAS315
auagcaccuacgauaaaacaa

SEQ ID NO: 2221774 - RNA, 16 nt, Streptococcus pyogenes MGAS315
auaucuuaccauugua

SEQ ID NO: 2221775 - RNA, 16 nt, Streptococcus pyogenes MGAS315
auaucuagaacagcug

SEQ ID NO: 2221776 - RNA, 18 nt, Streptococcus pyogenes MGAS315
auaucuagaacagcugcu

SEQ ID NO: 2221777 - RNA, 19 nt, Streptococcus pyogenes MGAS315
auaucuagaacagcugcuu

SEQ ID NO: 2221778 - RNA, 21 nt, Streptococcus pyogenes MGAS315
auaucuuuuuuacuuuuaaaa

SEQ ID NO: 2221779 - RNA, 20 nt, Streptococcus pyogenes MGAS315
auaucuuucaguuguuuuaa

SEQ ID NO: 2221780 - RNA, 17 nt, Streptococcus pyogenes MGAS315
auaucgccaauaaaaaa

SEQ ID NO: 2221781 - RNA, 12 nt, Streptococcus pyogenes MGAS315
auaucuagaaca

SEQ ID NO: 2221782 - RNA, 12 nt, Streptococcus pyogenes MGAS315
auaggcuuuuuu

SEQ ID NO: 2221783 - RNA, 10 nt, Streptococcus pyogenes MGAS315
auauaaaauu

SEQ ID NO: 2221784 - RNA, 17 nt, Streptococcus pyogenes MGAS315
auuaucaauaacagaaa

SEQ ID NO: 2221785 - RNA, 13 nt, Streptococcus pyogenes MGAS315
auuaucaauaaca

SEQ ID NO: 2221786 - RNA, 22 nt, Streptococcus pyogenes MGAS315
auuaucaacaaucuuaaaauaa

SEQ ID NO: 2221787 - RNA, 15 nt, Streptococcus pyogenes MGAS315
auuaucugauaaggu

SEQ ID NO: 2221788 - RNA, 20 nt, Streptococcus pyogenes MGAS315
auuaugaaggugauugacuu

SEQ ID NO: 2221789 - RNA, 13 nt, Streptococcus pyogenes MGAS315
auuaugaggugac

SEQ ID NO: 2221790 - RNA, 16 nt, Streptococcus pyogenes MGAS315
auuaugaggugacacu

SEQ ID NO: 2221791 - RNA, 22 nt, Streptococcus pyogenes MGAS315
auuauuaaccaauuccucccua

SEQ ID NO: 2221792 - RNA, 19 nt, Streptococcus pyogenes MGAS315
auuaugccaaauuucagau

SEQ ID NO: 2221793 - RNA, 13 nt, Streptococcus pyogenes MGAS315
auuauuuugcuuc

SEQ ID NO: 2221794 - RNA, 17 nt, Streptococcus pyogenes MGAS315
auucaauauuuuauuaa

SEQ ID NO: 2221795 - RNA, 14 nt, Streptococcus pyogenes MGAS315
auuaauuguuuuag

SEQ ID NO: 2221796 - RNA, 14 nt, Streptococcus pyogenes MGAS315
auuacucaauuaau

SEQ ID NO: 2221797 - RNA, 19 nt, Streptococcus pyogenes MGAS315
auuauacucaauauaauaa

SEQ ID NO: 2221798 - RNA, 16 nt, Streptococcus pyogenes MGAS315
auuauacuaauauuau

SEQ ID NO: 2221799 - RNA, 18 nt, Streptococcus pyogenes MGAS315
auuauauuaaugauucaa

SEQ ID NO: 2221800 - RNA, 13 nt, Streptococcus pyogenes MGAS315
auuauauuaggau

SEQ ID NO: 2221801 - RNA, 14 nt, Streptococcus pyogenes MGAS315
auuauauuaggaua

SEQ ID NO: 2221802 - RNA, 16 nt, Streptococcus pyogenes MGAS315
auuagaauaagaaaac

SEQ ID NO: 2221803 - RNA, 15 nt, Streptococcus pyogenes MGAS315
auuagcaaaaugcug

SEQ ID NO: 2221804 - RNA, 13 nt, Streptococcus pyogenes MGAS315
auguuggauuuuu

SEQ ID NO: 2221805 - RNA, 23 nt, Streptococcus pyogenes MGAS315
auuaaauaauacagcauacauca

SEQ ID NO: 2221806 - RNA, 17 nt, Streptococcus pyogenes MGAS315
auuaaacuuacaaaaag

SEQ ID NO: 2221807 - RNA, 12 nt, Streptococcus pyogenes MGAS315
auuaauaaauuu

SEQ ID NO: 2221808 - RNA, 15 nt, Streptococcus pyogenes MGAS315
auuaauaaauuuuug

SEQ ID NO: 2221809 - RNA, 19 nt, Streptococcus pyogenes MGAS315
auuaauaaguauuuuaaaa

SEQ ID NO: 2221810 - RNA, 13 nt, Streptococcus pyogenes MGAS315
auuaaucaaaaaa

SEQ ID NO: 2221811 - RNA, 16 nt, Streptococcus pyogenes MGAS315
auuaaccguuccuguc

SEQ ID NO: 2221812 - RNA, 17 nt, Streptococcus pyogenes MGAS315
augguuaaaaagagagc

SEQ ID NO: 2221813 - RNA, 16 nt, Streptococcus pyogenes MGAS315
aucucccgucaacaag

SEQ ID NO: 2221814 - RNA, 16 nt, Streptococcus pyogenes MGAS315
aucuagaacagcugcu

SEQ ID NO: 2221815 - RNA, 22 nt, Streptococcus pyogenes MGAS315
aucgaaaugauagcaccuaauu

SEQ ID NO: 2221816 - RNA, 16 nt, Streptococcus pyogenes MGAS315
auccuuuugaaaaauu

SEQ ID NO: 2221817 - RNA, 14 nt, Streptococcus pyogenes MGAS315
augacuugaccaaa

SEQ ID NO: 2221818 - RNA, 14 nt, Streptococcus pyogenes MGAS315
augacuguauguau

SEQ ID NO: 2221819 - RNA, 22 nt, Streptococcus pyogenes MGAS315
augacgccuccaaauacuggua

SEQ ID NO: 2221820 - RNA, 20 nt, Streptococcus pyogenes MGAS315
augagauuaacugacaaaaa

SEQ ID NO: 2221821 - RNA, 23 nt, Streptococcus pyogenes MGAS315
augagauaccuucauagacaagc

SEQ ID NO: 2221822 - RNA, 20 nt, Streptococcus pyogenes MGAS315
augcagguguuuaaagaccu

SEQ ID NO: 2221823 - RNA, 23 nt, Streptococcus pyogenes MGAS315
augccaagauaccggguuguuuu

SEQ ID NO: 2221824 - RNA, 18 nt, Streptococcus pyogenes MGAS315
auucuuaaaaaaaucccu

SEQ ID NO: 2221825 - RNA, 13 nt, Streptococcus pyogenes MGAS315
auucuuuuuuacc

SEQ ID NO: 2221826 - RNA, 14 nt, Streptococcus pyogenes MGAS315
auucuuuuuuaccu

SEQ ID NO: 2221827 - RNA, 17 nt, Streptococcus pyogenes MGAS315
auucuuauccauuauaa

SEQ ID NO: 2221828 - RNA, 18 nt, Streptococcus pyogenes MGAS315
auugagaccaaaugaccu

SEQ ID NO: 2221829 - RNA, 23 nt, Streptococcus pyogenes MGAS315
auugacuugguucugaaaauaaa

SEQ ID NO: 2221830 - RNA, 16 nt, Streptococcus pyogenes MGAS315
auugaaucuuguuuaa

SEQ ID NO: 2221831 - RNA, 18 nt, Streptococcus pyogenes MGAS315
auuggggcggcacuucca

SEQ ID NO: 2221832 - RNA, 22 nt, Streptococcus pyogenes MGAS315
auugagguaaucguaaugucuu

SEQ ID NO: 2221833 - RNA, 22 nt, Streptococcus pyogenes MGAS315
auuucaauaauaccauuuuuau

SEQ ID NO: 2221834 - RNA, 14 nt, Streptococcus pyogenes MGAS315
auuuaguucuaagu

SEQ ID NO: 2221835 - RNA, 15 nt, Streptococcus pyogenes MGAS315
auuuagaaauuuuau

SEQ ID NO: 2221836 - RNA, 17 nt, Streptococcus pyogenes MGAS315
auuuagaaauuuuauug

SEQ ID NO: 2221837 - RNA, 20 nt, Streptococcus pyogenes MGAS315
auuguaauaacaaaaugaag

SEQ ID NO: 2221838 - RNA, 23 nt, Streptococcus pyogenes MGAS315
auuguaaccacagcaauuuguuc

SEQ ID NO: 2221839 - RNA, 14 nt, Streptococcus pyogenes MGAS315
auugucaaauaaaa

SEQ ID NO: 2221840 - RNA, 21 nt, Streptococcus pyogenes MGAS315
auuguagggauuuuuuuaacu

SEQ ID NO: 2221841 - RNA, 16 nt, Streptococcus pyogenes MGAS315
auuuuacuauggcuuc

SEQ ID NO: 2221842 - RNA, 13 nt, Streptococcus pyogenes MGAS315
auuuuaagacaac

SEQ ID NO: 2221843 - RNA, 20 nt, Streptococcus pyogenes MGAS315
auuuuaaauaucuuaccauu

SEQ ID NO: 2221844 - RNA, 18 nt, Streptococcus pyogenes MGAS315
auuuugcaagucucuugc

SEQ ID NO: 2221845 - RNA, 15 nt, Streptococcus pyogenes MGAS315
auuucguugacaaag

SEQ ID NO: 2221846 - RNA, 16 nt, Streptococcus pyogenes MGAS315
auuucguugacaaagc

SEQ ID NO: 2221847 - RNA, 14 nt, Streptococcus pyogenes MGAS315
auuucguuuuacgg

SEQ ID NO: 2221848 - RNA, 19 nt, Streptococcus pyogenes MGAS315
auuucuugaggugauucuu

SEQ ID NO: 2221849 - RNA, 21 nt, Streptococcus pyogenes MGAS315
auuugaacguucuguuuaaaa

SEQ ID NO: 2221850 - RNA, 23 nt, Streptococcus pyogenes MGAS315
auuugaacguucuguuuaaaaua

SEQ ID NO: 2221851 - RNA, 16 nt, Streptococcus pyogenes MGAS315
caaaacuucaaauuuc

SEQ ID NO: 2221852 - RNA, 20 nt, Streptococcus pyogenes MGAS315
caaaaaauuaagaaggaacu

SEQ ID NO: 2221853 - RNA, 16 nt, Streptococcus pyogenes MGAS315
caaaaacaccccaaac

SEQ ID NO: 2221854 - RNA, 20 nt, Streptococcus pyogenes MGAS315
caaaaacaccccaaacguua

SEQ ID NO: 2221855 - RNA, 22 nt, Streptococcus pyogenes MGAS315
caaaaacgccacgcucaacugg

SEQ ID NO: 2221856 - RNA, 17 nt, Streptococcus pyogenes MGAS315
caaaaaggcuaagaugg

SEQ ID NO: 2221857 - RNA, 15 nt, Streptococcus pyogenes MGAS315
caaaaaguaaaaagc

SEQ ID NO: 2221858 - RNA, 16 nt, Streptococcus pyogenes MGAS315
caaaaaguaaaaagca

SEQ ID NO: 2221859 - RNA, 17 nt, Streptococcus pyogenes MGAS315
caaaaaguaaaaagcaa

SEQ ID NO: 2221860 - RNA, 23 nt, Streptococcus pyogenes MGAS315
caaaaauauauucuaauuuguga

SEQ ID NO: 2221861 - RNA, 17 nt, Streptococcus pyogenes MGAS315
caaaaaaagcaaugacu

SEQ ID NO: 2221862 - RNA, 16 nt, Streptococcus pyogenes MGAS315
caaaaaaagacacaca

SEQ ID NO: 2221863 - RNA, 12 nt, Streptococcus pyogenes MGAS315
caaaaaaagaca

SEQ ID NO: 2221864 - RNA, 22 nt, Streptococcus pyogenes MGAS315
caaaaaacaagucuaucugcag

SEQ ID NO: 2221865 - RNA, 16 nt, Streptococcus pyogenes MGAS315
auuuuuucucaaaaau

SEQ ID NO: 2221866 - RNA, 20 nt, Streptococcus pyogenes MGAS315
auuuuuuaccguaacguuug

SEQ ID NO: 2221867 - RNA, 15 nt, Streptococcus pyogenes MGAS315
auuuuuguauuuguc

SEQ ID NO: 2221868 - RNA, 14 nt, Streptococcus pyogenes MGAS315
auuuuugccaaaau

SEQ ID NO: 2221869 - RNA, 22 nt, Streptococcus pyogenes MGAS315
caaucaucauuuagcugauaau

SEQ ID NO: 2221870 - RNA, 14 nt, Streptococcus pyogenes MGAS315
caaucuuaaaauaa

SEQ ID NO: 2221871 - RNA, 17 nt, Streptococcus pyogenes MGAS315
caaucuuaaaauaauca

SEQ ID NO: 2221872 - RNA, 19 nt, Streptococcus pyogenes MGAS315
caaucuuaaguuagggucu

SEQ ID NO: 2221873 - RNA, 13 nt, Streptococcus pyogenes MGAS315
caauggaaauuuu

SEQ ID NO: 2221874 - RNA, 14 nt, Streptococcus pyogenes MGAS315
caaugcgcucaagc

SEQ ID NO: 2221875 - RNA, 13 nt, Streptococcus pyogenes MGAS315
caaugccaucugc

SEQ ID NO: 2221876 - RNA, 23 nt, Streptococcus pyogenes MGAS315
caauaaaauaucuagaacagcug

SEQ ID NO: 2221877 - RNA, 22 nt, Streptococcus pyogenes MGAS315
caauacaaaaaaccuuccugua

SEQ ID NO: 2221878 - RNA, 16 nt, Streptococcus pyogenes MGAS315
caauacucccuucucu

SEQ ID NO: 2221879 - RNA, 15 nt, Streptococcus pyogenes MGAS315
caauagcugcugcua

SEQ ID NO: 2221880 - RNA, 15 nt, Streptococcus pyogenes MGAS315
caauauccauagaaa

SEQ ID NO: 2221881 - RNA, 16 nt, Streptococcus pyogenes MGAS315
caauauccauagaaau

SEQ ID NO: 2221882 - RNA, 16 nt, Streptococcus pyogenes MGAS315
caacuucuauaugugu

SEQ ID NO: 2221883 - RNA, 19 nt, Streptococcus pyogenes MGAS315
caacuucuauauguguaau

SEQ ID NO: 2221884 - RNA, 16 nt, Streptococcus pyogenes MGAS315
caaauagcaaugguua

SEQ ID NO: 2221885 - RNA, 18 nt, Streptococcus pyogenes MGAS315
caaauacagaaaaaagcu

SEQ ID NO: 2221886 - RNA, 13 nt, Streptococcus pyogenes MGAS315
caaaagcuaaacu

SEQ ID NO: 2221887 - RNA, 14 nt, Streptococcus pyogenes MGAS315
caaauucuuuuuga

SEQ ID NO: 2221888 - RNA, 14 nt, Streptococcus pyogenes MGAS315
caaauugaaaaaau

SEQ ID NO: 2221889 - RNA, 14 nt, Streptococcus pyogenes MGAS315
caaauuguuugauu

SEQ ID NO: 2221890 - RNA, 23 nt, Streptococcus pyogenes MGAS315
caaauuguuugauugauuugucu

SEQ ID NO: 2221891 - RNA, 14 nt, Streptococcus pyogenes MGAS315
caaauuuauccuga

SEQ ID NO: 2221892 - RNA, 17 nt, Streptococcus pyogenes MGAS315
caacaaucuuaaaauaa

SEQ ID NO: 2221893 - RNA, 14 nt, Streptococcus pyogenes MGAS315
caacuggcacaaac

SEQ ID NO: 2221894 - RNA, 20 nt, Streptococcus pyogenes MGAS315
caacuguggguuaagagagg

SEQ ID NO: 2221895 - RNA, 21 nt, Streptococcus pyogenes MGAS315
caacgcauuucuuuuuugguc

SEQ ID NO: 2221896 - RNA, 14 nt, Streptococcus pyogenes MGAS315
cagcaucaaaacca

SEQ ID NO: 2221897 - RNA, 16 nt, Streptococcus pyogenes MGAS315
cagcaucaaaaccaag

SEQ ID NO: 2221898 - RNA, 23 nt, Streptococcus pyogenes MGAS315
cagauacuucugauaaaaauaaa

SEQ ID NO: 2221899 - RNA, 19 nt, Streptococcus pyogenes MGAS315
cagaucauuaaauugauua

SEQ ID NO: 2221900 - RNA, 15 nt, Streptococcus pyogenes MGAS315
cagaguacaaggcaa

SEQ ID NO: 2221901 - RNA, 20 nt, Streptococcus pyogenes MGAS315
cagauaaaaccuucaaaaaa

SEQ ID NO: 2221902 - RNA, 16 nt, Streptococcus pyogenes MGAS315
cagacucgucuuuguc

SEQ ID NO: 2221903 - RNA, 15 nt, Streptococcus pyogenes MGAS315
cagacaccaaaaaaa

SEQ ID NO: 2221904 - RNA, 15 nt, Streptococcus pyogenes MGAS315
cagaaaaaagcuugu

SEQ ID NO: 2221905 - RNA, 17 nt, Streptococcus pyogenes MGAS315
cacuuccaucaucaagu

SEQ ID NO: 2221906 - RNA, 16 nt, Streptococcus pyogenes MGAS315
cagcugcuugaaaaga

SEQ ID NO: 2221907 - RNA, 23 nt, Streptococcus pyogenes MGAS315
caggaggguuuuucuuuuggccu

SEQ ID NO: 2221908 - RNA, 11 nt, Streptococcus pyogenes MGAS315
cagugcugcug

SEQ ID NO: 2221909 - RNA, 21 nt, Streptococcus pyogenes MGAS315
caguauaaccgccaucuaagc

SEQ ID NO: 2221910 - RNA, 20 nt, Streptococcus pyogenes MGAS315
cauaaaaaaccuuaucaaac

SEQ ID NO: 2221911 - RNA, 19 nt, Streptococcus pyogenes MGAS315
caguuaaaaauaacuuuaa

SEQ ID NO: 2221912 - RNA, 21 nt, Streptococcus pyogenes MGAS315
caguucuguuucuaagcaaau

SEQ ID NO: 2221913 - RNA, 18 nt, Streptococcus pyogenes MGAS315
caguugcuugcuuuuuuc

SEQ ID NO: 2221914 - RNA, 14 nt, Streptococcus pyogenes MGAS315
cauaccaucaauga

SEQ ID NO: 2221915 - RNA, 18 nt, Streptococcus pyogenes MGAS315
cauacucaauagcugcug

SEQ ID NO: 2221916 - RNA, 22 nt, Streptococcus pyogenes MGAS315
cauacuuuauuaaucaaaaaac

SEQ ID NO: 2221917 - RNA, 23 nt, Streptococcus pyogenes MGAS315
cauggcaagagcaccgcgaauau

SEQ ID NO: 2221918 - RNA, 22 nt, Streptococcus pyogenes MGAS315
caugaaaguuauagcuccuaaa

SEQ ID NO: 2221919 - RNA, 16 nt, Streptococcus pyogenes MGAS315
cauguugacuauuuuu

SEQ ID NO: 2221920 - RNA, 20 nt, Streptococcus pyogenes MGAS315
cauuagaauaagaaaaccuu

SEQ ID NO: 2221921 - RNA, 22 nt, Streptococcus pyogenes MGAS315
cauuuugcaagucucuugcaag

SEQ ID NO: 2221922 - RNA, 14 nt, Streptococcus pyogenes MGAS315
cauuugccauggca

SEQ ID NO: 2221923 - RNA, 21 nt, Streptococcus pyogenes MGAS315
cauuuaaauguucgaaaaaau

SEQ ID NO: 2221924 - RNA, 21 nt, Streptococcus pyogenes MGAS315
cauuugacuacuagcaugucc

SEQ ID NO: 2221925 - RNA, 22 nt, Streptococcus pyogenes MGAS315
cauuucuugaggugauucuuuu

SEQ ID NO: 2221926 - RNA, 23 nt, Streptococcus pyogenes MGAS315
cauuucuugaggugauucuuuuu

SEQ ID NO: 2221927 - RNA, 16 nt, Streptococcus pyogenes MGAS315
cauuaucaucuggucc

SEQ ID NO: 2221928 - RNA, 21 nt, Streptococcus pyogenes MGAS315
cauugaugagacuaaccugca

SEQ ID NO: 2221929 - RNA, 22 nt, Streptococcus pyogenes MGAS315
cauaugauggaucguuuugcaa

SEQ ID NO: 2221930 - RNA, 17 nt, Streptococcus pyogenes MGAS315
caucaaaagaccauaaa

SEQ ID NO: 2221931 - RNA, 14 nt, Streptococcus pyogenes MGAS315
caucaaaaccaagu

SEQ ID NO: 2221932 - RNA, 15 nt, Streptococcus pyogenes MGAS315
caucaaaaaaagcaa

SEQ ID NO: 2221933 - RNA, 15 nt, Streptococcus pyogenes MGAS315
caucaaaaaaagaca

SEQ ID NO: 2221934 - RNA, 23 nt, Streptococcus pyogenes MGAS315
cauauuuuaaucuuuuugugaua

SEQ ID NO: 2221935 - RNA, 13 nt, Streptococcus pyogenes MGAS315
caucauauuguua

SEQ ID NO: 2221936 - RNA, 15 nt, Streptococcus pyogenes MGAS315
caucaggguugcaug

SEQ ID NO: 2221937 - RNA, 17 nt, Streptococcus pyogenes MGAS315
caucaggcuuaaacaua

SEQ ID NO: 2221938 - RNA, 13 nt, Streptococcus pyogenes MGAS315
caucugaaaaaau

SEQ ID NO: 2221939 - RNA, 17 nt, Streptococcus pyogenes MGAS315
caucuugccaucagcau

SEQ ID NO: 2221940 - RNA, 19 nt, Streptococcus pyogenes MGAS315
caucuugccaucagcaucu

SEQ ID NO: 2221941 - RNA, 14 nt, Streptococcus pyogenes MGAS315
ccguuaagagggcc

SEQ ID NO: 2221942 - RNA, 14 nt, Streptococcus pyogenes MGAS315
ccuaaaaaauaacu

SEQ ID NO: 2221943 - RNA, 20 nt, Streptococcus pyogenes MGAS315
ccuaaagcccauagaggacu

SEQ ID NO: 2221944 - RNA, 22 nt, Streptococcus pyogenes MGAS315
ccuaaauccuuuugaaaaauua

SEQ ID NO: 2221945 - RNA, 21 nt, Streptococcus pyogenes MGAS315
ccuauagaaaguuauaaagaa

SEQ ID NO: 2221946 - RNA, 16 nt, Streptococcus pyogenes MGAS315
ccuaugaucuguuuaa

SEQ ID NO: 2221947 - RNA, 16 nt, Streptococcus pyogenes MGAS315
ccuacuagcacaaaau

SEQ ID NO: 2221948 - RNA, 21 nt, Streptococcus pyogenes MGAS315
ccuacuaacaacaacaacccu

SEQ ID NO: 2221949 - RNA, 13 nt, Streptococcus pyogenes MGAS315
ccuaggaauaaaa

SEQ ID NO: 2221950 - RNA, 17 nt, Streptococcus pyogenes MGAS315
ccguaagccgcaaaauc

SEQ ID NO: 2221951 - RNA, 18 nt, Streptococcus pyogenes MGAS315
ccuuaugcagguguuuaa

SEQ ID NO: 2221952 - RNA, 19 nt, Streptococcus pyogenes MGAS315
ccugauauuccuuuuccaa

SEQ ID NO: 2221953 - RNA, 20 nt, Streptococcus pyogenes MGAS315
ccgcgaauaugauauaaaaa

SEQ ID NO: 2221954 - RNA, 15 nt, Streptococcus pyogenes MGAS315
ccacgcucaacuggc

SEQ ID NO: 2221955 - RNA, 13 nt, Streptococcus pyogenes MGAS315
ccagauacuucug

SEQ ID NO: 2221956 - RNA, 14 nt, Streptococcus pyogenes MGAS315
ccagauacuucuga

SEQ ID NO: 2221957 - RNA, 19 nt, Streptococcus pyogenes MGAS315
ccaucaggcuuaaacauau

SEQ ID NO: 2221958 - RNA, 16 nt, Streptococcus pyogenes MGAS315
ccauuuccuacaaaau

SEQ ID NO: 2221959 - RNA, 18 nt, Streptococcus pyogenes MGAS315
cccgucuuacaauuaaua

SEQ ID NO: 2221960 - RNA, 17 nt, Streptococcus pyogenes MGAS315
cguaaagcaagggaaac

SEQ ID NO: 2221961 - RNA, 15 nt, Streptococcus pyogenes MGAS315
cguauaggugaguuu

SEQ ID NO: 2221962 - RNA, 13 nt, Streptococcus pyogenes MGAS315
cguauuuuuuaga

SEQ ID NO: 2221963 - RNA, 16 nt, Streptococcus pyogenes MGAS315
cguaacguaauagaau

SEQ ID NO: 2221964 - RNA, 15 nt, Streptococcus pyogenes MGAS315
cgcuguaauguugua

SEQ ID NO: 2221965 - RNA, 16 nt, Streptococcus pyogenes MGAS315
cgaugagauuaacuga

SEQ ID NO: 2221966 - RNA, 20 nt, Streptococcus pyogenes MGAS315
cgaugagauuaacugacaaa

SEQ ID NO: 2221967 - RNA, 19 nt, Streptococcus pyogenes MGAS315
cgauaaaaacgaucaaaaa

SEQ ID NO: 2221968 - RNA, 18 nt, Streptococcus pyogenes MGAS315
cgccuaggaauaaaaugc

SEQ ID NO: 2221969 - RNA, 13 nt, Streptococcus pyogenes MGAS315
cuucuuuuuauua

SEQ ID NO: 2221970 - RNA, 19 nt, Streptococcus pyogenes MGAS315
cuucuuuuuguugcuagcu

SEQ ID NO: 2221971 - RNA, 16 nt, Streptococcus pyogenes MGAS315
cuugccaucagcaucu

SEQ ID NO: 2221972 - RNA, 21 nt, Streptococcus pyogenes MGAS315
cuugguucugaaaauaaaaua

SEQ ID NO: 2221973 - RNA, 12 nt, Streptococcus pyogenes MGAS315
cuuuauuuugau

SEQ ID NO: 2221974 - RNA, 13 nt, Streptococcus pyogenes MGAS315
cuuucaaacggag

SEQ ID NO: 2221975 - RNA, 13 nt, Streptococcus pyogenes MGAS315
cuuuauugaugau

SEQ ID NO: 2221976 - RNA, 17 nt, Streptococcus pyogenes MGAS315
cuuuacuguaauauuuc

SEQ ID NO: 2221977 - RNA, 14 nt, Streptococcus pyogenes MGAS315
cuugucuaugagau

SEQ ID NO: 2221978 - RNA, 19 nt, Streptococcus pyogenes MGAS315
cuuugcaggguaucugcuc

SEQ ID NO: 2221979 - RNA, 15 nt, Streptococcus pyogenes MGAS315
cuuuggcaccaagug

SEQ ID NO: 2221980 - RNA, 17 nt, Streptococcus pyogenes MGAS315
cuuuggcaccaagugcu

SEQ ID NO: 2221981 - RNA, 20 nt, Streptococcus pyogenes MGAS315
cuuuggcaccaagugcugcc

SEQ ID NO: 2221982 - RNA, 21 nt, Streptococcus pyogenes MGAS315
cuuugacagacaccaaaaaaa

SEQ ID NO: 2221983 - RNA, 15 nt, Streptococcus pyogenes MGAS315
cuuagugguuugcaa

SEQ ID NO: 2221984 - RNA, 17 nt, Streptococcus pyogenes MGAS315
cuuaguguagauaaacu

SEQ ID NO: 2221985 - RNA, 19 nt, Streptococcus pyogenes MGAS315
cuuaggcagacaauuauuu

SEQ ID NO: 2221986 - RNA, 21 nt, Streptococcus pyogenes MGAS315
cuuaggcagacaauuauuuug

SEQ ID NO: 2221987 - RNA, 22 nt, Streptococcus pyogenes MGAS315
cuuagcgauagggguaauuugg

SEQ ID NO: 2221988 - RNA, 23 nt, Streptococcus pyogenes MGAS315
cuuaaauuauauuauacuaauau

SEQ ID NO: 2221989 - RNA, 21 nt, Streptococcus pyogenes MGAS315
cuucaaaaauacuaccuuuag

SEQ ID NO: 2221990 - RNA, 12 nt, Streptococcus pyogenes MGAS315
cuucaaaaauac

SEQ ID NO: 2221991 - RNA, 15 nt, Streptococcus pyogenes MGAS315
cuuauuuuaagaagc

SEQ ID NO: 2221992 - RNA, 11 nt, Streptococcus pyogenes MGAS315
cuuauuuuuuu

SEQ ID NO: 2221993 - RNA, 20 nt, Streptococcus pyogenes MGAS315
cuucaaggaaggcuuguucu

SEQ ID NO: 2221994 - RNA, 15 nt, Streptococcus pyogenes MGAS315
cugaugcguuuauaa

SEQ ID NO: 2221995 - RNA, 16 nt, Streptococcus pyogenes MGAS315
cugaugacuuguaaaa

SEQ ID NO: 2221996 - RNA, 14 nt, Streptococcus pyogenes MGAS315
cugcauaucugccc

SEQ ID NO: 2221997 - RNA, 12 nt, Streptococcus pyogenes MGAS315
cuggcuuuuucc

SEQ ID NO: 2221998 - RNA, 22 nt, Streptococcus pyogenes MGAS315
cuggcuuuuuccuaucagauac

SEQ ID NO: 2221999 - RNA, 18 nt, Streptococcus pyogenes MGAS315
cuggauuuagaaauuuua

SEQ ID NO: 2222000 - RNA, 19 nt, Streptococcus pyogenes MGAS315
cugguuuuaauauugggac

SEQ ID NO: 2222001 - RNA, 18 nt, Streptococcus pyogenes MGAS315
cuguucagucuucuguaa

SEQ ID NO: 2222002 - RNA, 12 nt, Streptococcus pyogenes MGAS315
cuguuaauuuau

SEQ ID NO: 2222003 - RNA, 14 nt, Streptococcus pyogenes MGAS315
cuguggguuaagag

SEQ ID NO: 2222004 - RNA, 13 nt, Streptococcus pyogenes MGAS315
cuccuccaccaaa

SEQ ID NO: 2222005 - RNA, 20 nt, Streptococcus pyogenes MGAS315
cuccuugcaauagagccaag

SEQ ID NO: 2222006 - RNA, 17 nt, Streptococcus pyogenes MGAS315
cucuaacauguccaaau

SEQ ID NO: 2222007 - RNA, 13 nt, Streptococcus pyogenes MGAS315
cucucacaaauac

SEQ ID NO: 2222008 - RNA, 13 nt, Streptococcus pyogenes MGAS315
cucucguuuuuuu

SEQ ID NO: 2222009 - RNA, 19 nt, Streptococcus pyogenes MGAS315
cucuggucuaccgcuagga

SEQ ID NO: 2222010 - RNA, 23 nt, Streptococcus pyogenes MGAS315
cugacaaaacuucaaauuucaug

SEQ ID NO: 2222011 - RNA, 17 nt, Streptococcus pyogenes MGAS315
cugacuuaaauuuggag

SEQ ID NO: 2222012 - RNA, 15 nt, Streptococcus pyogenes MGAS315
cugaaauauaaccuc

SEQ ID NO: 2222013 - RNA, 14 nt, Streptococcus pyogenes MGAS315
cugaaaauaaaaua

SEQ ID NO: 2222014 - RNA, 23 nt, Streptococcus pyogenes MGAS315
cucuucgguacugaacuuguccu

SEQ ID NO: 2222015 - RNA, 22 nt, Streptococcus pyogenes MGAS315
cucuugcaaggugcuuuuuuug

SEQ ID NO: 2222016 - RNA, 13 nt, Streptococcus pyogenes MGAS315
cucuuauaauaaa

SEQ ID NO: 2222017 - RNA, 23 nt, Streptococcus pyogenes MGAS315
cuacugcuggauuuagaaauuuu

SEQ ID NO: 2222018 - RNA, 16 nt, Streptococcus pyogenes MGAS315
cuagaaaaagcaauga

SEQ ID NO: 2222019 - RNA, 16 nt, Streptococcus pyogenes MGAS315
cuagacugugaaagua

SEQ ID NO: 2222020 - RNA, 20 nt, Streptococcus pyogenes MGAS315
cuagacccuagcauaaaaga

SEQ ID NO: 2222021 - RNA, 13 nt, Streptococcus pyogenes MGAS315
cuagucuuuuuau

SEQ ID NO: 2222022 - RNA, 22 nt, Streptococcus pyogenes MGAS315
cuagucgaaauugguccucuga

SEQ ID NO: 2222023 - RNA, 20 nt, Streptococcus pyogenes MGAS315
cuaggcguauaggugaguuu

SEQ ID NO: 2222024 - RNA, 16 nt, Streptococcus pyogenes MGAS315
cuaucauacaacuggc

SEQ ID NO: 2222025 - RNA, 18 nt, Streptococcus pyogenes MGAS315
cuauugaaucuuguuuaa

SEQ ID NO: 2222026 - RNA, 13 nt, Streptococcus pyogenes MGAS315
cucaauauaauaa

SEQ ID NO: 2222027 - RNA, 16 nt, Streptococcus pyogenes MGAS315
cucacaaauacagaaa

SEQ ID NO: 2222028 - RNA, 20 nt, Streptococcus pyogenes MGAS315
cucacuaggccuagcuuuuu

SEQ ID NO: 2222029 - RNA, 16 nt, Streptococcus pyogenes MGAS315
cuccaaaguucuucua

SEQ ID NO: 2222030 - RNA, 20 nt, Streptococcus pyogenes MGAS315
cucauuuaaauguucgaaaa

SEQ ID NO: 2222031 - RNA, 23 nt, Streptococcus pyogenes MGAS315
cuacagcuugauuauaaucuaug

SEQ ID NO: 2222032 - RNA, 16 nt, Streptococcus pyogenes MGAS315
cuaauugugagaaacu

SEQ ID NO: 2222033 - RNA, 12 nt, Streptococcus pyogenes MGAS315
cuacaaaauaac

SEQ ID NO: 2222034 - RNA, 14 nt, Streptococcus pyogenes MGAS315
cuacacaaaagcuu

SEQ ID NO: 2222035 - RNA, 22 nt, Streptococcus pyogenes MGAS315
cuaaugcugcaaaauuuuaaau

SEQ ID NO: 2222036 - RNA, 14 nt, Streptococcus pyogenes MGAS315
cuaaauauaaauua

SEQ ID NO: 2222037 - RNA, 21 nt, Streptococcus pyogenes MGAS315
cuaaauccuuuugaaaaauua

SEQ ID NO: 2222038 - RNA, 23 nt, Streptococcus pyogenes MGAS315
cuaaauccuuuugaaaaauuaug

SEQ ID NO: 2222039 - RNA, 18 nt, Streptococcus pyogenes MGAS315
cuaauaaaauagcaccua

SEQ ID NO: 2222040 - RNA, 12 nt, Streptococcus pyogenes MGAS315
cuaauaagauuc

SEQ ID NO: 2222041 - RNA, 22 nt, Streptococcus pyogenes MGAS315
cuaagguacggucauuaauaaa

SEQ ID NO: 2222042 - RNA, 21 nt, Streptococcus pyogenes MGAS315
cuaagaugguuuugauuaaau

SEQ ID NO: 2222043 - RNA, 23 nt, Streptococcus pyogenes MGAS315
cuaagaugguuuugauuaaaucu

SEQ ID NO: 2222044 - RNA, 19 nt, Streptococcus pyogenes MGAS315
cguuuuguuguauuaugag

SEQ ID NO: 2222045 - RNA, 19 nt, Streptococcus pyogenes MGAS315
cguuuauuuaguuauuuuu

SEQ ID NO: 2222046 - RNA, 23 nt, Streptococcus pyogenes MGAS315
cuaaaaucaugggaaaagcuaag

SEQ ID NO: 2222047 - RNA, 15 nt, Streptococcus pyogenes MGAS315
cuaaaauauauuggu

SEQ ID NO: 2222048 - RNA, 17 nt, Streptococcus pyogenes MGAS315
cguucauauaagcaauc

SEQ ID NO: 2222049 - RNA, 19 nt, Streptococcus pyogenes MGAS315
cguuaucuccacagagucu

SEQ ID NO: 2222050 - RNA, 14 nt, Streptococcus pyogenes MGAS315
aaaaaaagcaauga

SEQ ID NO: 2222051 - RNA, 11 nt, Streptococcus pyogenes MGAS315
aaaaaaccuuc

SEQ ID NO: 2222052 - RNA, 14 nt, Streptococcus pyogenes MGAS315
aaaaaauuaagaag

SEQ ID NO: 2222053 - RNA, 19 nt, Streptococcus pyogenes MGAS315
aaaauuuuuagacacaaaa

SEQ ID NO: 2222054 - RNA, 18 nt, Streptococcus pyogenes MGAS315
aaaauccucuuuuaauuu

SEQ ID NO: 2222055 - RNA, 23 nt, Streptococcus pyogenes MGAS315
aaaauacuugcaucgcaaacaga

SEQ ID NO: 2222056 - RNA, 15 nt, Streptococcus pyogenes MGAS315
aaaauaaaauauuuu

SEQ ID NO: 2222057 - RNA, 15 nt, Streptococcus pyogenes MGAS315
aaaagugugaccaga

SEQ ID NO: 2222058 - RNA, 20 nt, Streptococcus pyogenes MGAS315
aaaagccuauuuaauaggcu

SEQ ID NO: 2222059 - RNA, 13 nt, Streptococcus pyogenes MGAS315
aaaagcaugggcu

SEQ ID NO: 2222060 - RNA, 15 nt, Streptococcus pyogenes MGAS315
aaaacuccagcugga

SEQ ID NO: 2222061 - RNA, 12 nt, Streptococcus pyogenes MGAS315
aaaacucaaaaa

SEQ ID NO: 2222062 - RNA, 16 nt, Streptococcus pyogenes MGAS315
aaaagcaaauugaaaa

SEQ ID NO: 2222063 - RNA, 12 nt, Streptococcus pyogenes MGAS315
aaaagcaaugac

SEQ ID NO: 2222064 - RNA, 19 nt, Streptococcus pyogenes MGAS315
aaaagaugcacacaaaucu

SEQ ID NO: 2222065 - RNA, 15 nt, Streptococcus pyogenes MGAS315
aaaagauauuuuaaa

SEQ ID NO: 2222066 - RNA, 20 nt, Streptococcus pyogenes MGAS315
aaaacaauaacacagaagcc

SEQ ID NO: 2222067 - RNA, 13 nt, Streptococcus pyogenes MGAS315
aaaaauauauucu

SEQ ID NO: 2222068 - RNA, 18 nt, Streptococcus pyogenes MGAS315
aaaaauauauucuaauuu

SEQ ID NO: 2222069 - RNA, 21 nt, Streptococcus pyogenes MGAS315
aaaaaucccuaugaucuguuu

SEQ ID NO: 2222070 - RNA, 23 nt, Streptococcus pyogenes MGAS315
aaaaauacuagaaaaagcaauga

SEQ ID NO: 2222071 - RNA, 18 nt, Streptococcus pyogenes MGAS315
aaaaauacuagaaaaagc

SEQ ID NO: 2222072 - RNA, 22 nt, Streptococcus pyogenes MGAS315
aaaaauaaguauagcauaaaau

SEQ ID NO: 2222073 - RNA, 16 nt, Streptococcus pyogenes MGAS315
aaacgccacgcucaac

SEQ ID NO: 2222074 - RNA, 22 nt, Streptococcus pyogenes MGAS315
aaacguuauuaaagacaaaaaa

SEQ ID NO: 2222075 - RNA, 21 nt, Streptococcus pyogenes MGAS315
aaacguuaggguuuuauaucu

SEQ ID NO: 2222076 - RNA, 20 nt, Streptococcus pyogenes MGAS315
aaacguguauucuuaaaaaa

SEQ ID NO: 2222077 - RNA, 22 nt, Streptococcus pyogenes MGAS315
aaacguguauucuuaaaaaaau

SEQ ID NO: 2222078 - RNA, 20 nt, Streptococcus pyogenes MGAS315
aaacgcuauaccuaaaaaau

SEQ ID NO: 2222079 - RNA, 19 nt, Streptococcus pyogenes MGAS315
aaacucaaaccaaacaagc

SEQ ID NO: 2222080 - RNA, 13 nt, Streptococcus pyogenes MGAS315
aaacuauauuguu

SEQ ID NO: 2222081 - RNA, 12 nt, Streptococcus pyogenes MGAS315
aaacucugccaa

SEQ ID NO: 2222082 - RNA, 17 nt, Streptococcus pyogenes MGAS315
aaacucuauacaaaaag

SEQ ID NO: 2222083 - RNA, 14 nt, Streptococcus pyogenes MGAS315
aaacugagacaagu

SEQ ID NO: 2222084 - RNA, 16 nt, Streptococcus pyogenes MGAS315
aaacuggucaaaagcu

SEQ ID NO: 2222085 - RNA, 14 nt, Streptococcus pyogenes MGAS315
aaagacuucuuccu

SEQ ID NO: 2222086 - RNA, 13 nt, Streptococcus pyogenes MGAS315
aaacuuuugacuu

SEQ ID NO: 2222087 - RNA, 18 nt, Streptococcus pyogenes MGAS315
aaagccagugcugcugaa

SEQ ID NO: 2222088 - RNA, 17 nt, Streptococcus pyogenes MGAS315
aaagcaaauugaaaaaa

SEQ ID NO: 2222089 - RNA, 16 nt, Streptococcus pyogenes MGAS315
aaagauauuuuaaaau

SEQ ID NO: 2222090 - RNA, 14 nt, Streptococcus pyogenes MGAS315
aaagauauuuuaaa

SEQ ID NO: 2222091 - RNA, 20 nt, Streptococcus pyogenes MGAS315
aaagauauuuuaaaauaguu

SEQ ID NO: 2222092 - RNA, 15 nt, Streptococcus pyogenes MGAS315
aaagcuaaacuaggc

SEQ ID NO: 2222093 - RNA, 12 nt, Streptococcus pyogenes MGAS315
aaaguaaaaucu

SEQ ID NO: 2222094 - RNA, 17 nt, Streptococcus pyogenes MGAS315
aaaguaaaaucuuauuu

SEQ ID NO: 2222095 - RNA, 21 nt, Streptococcus pyogenes MGAS315
aaauaucuuuuuuacuuuuaa

SEQ ID NO: 2222096 - RNA, 23 nt, Streptococcus pyogenes MGAS315
aaauaucuuuuuuacuuuuaaaa

SEQ ID NO: 2222097 - RNA, 18 nt, Streptococcus pyogenes MGAS315
aaauaucuuuuuuacuuu

SEQ ID NO: 2222098 - RNA, 19 nt, Streptococcus pyogenes MGAS315
aaaucaguagugaugagua

SEQ ID NO: 2222099 - RNA, 18 nt, Streptococcus pyogenes MGAS315
aaauacuagaaaaagcaa

SEQ ID NO: 2222100 - RNA, 19 nt, Streptococcus pyogenes MGAS315
aaauacuagaaaaagcaau

SEQ ID NO: 2222101 - RNA, 14 nt, Streptococcus pyogenes MGAS315
aaauaacuuuaaaa

SEQ ID NO: 2222102 - RNA, 13 nt, Streptococcus pyogenes MGAS315
aaauaaaaucguu

SEQ ID NO: 2222103 - RNA, 15 nt, Streptococcus pyogenes MGAS315
aaauuccuuaaauua

SEQ ID NO: 2222104 - RNA, 21 nt, Streptococcus pyogenes MGAS315
aaauuauuaacguuaacaaaa

SEQ ID NO: 2222105 - RNA, 14 nt, Streptococcus pyogenes MGAS315
aaaaaggcaaagaa

SEQ ID NO: 2222106 - RNA, 17 nt, Streptococcus pyogenes MGAS315
aaaaaggcaaagaaagc

SEQ ID NO: 2222107 - RNA, 21 nt, Streptococcus pyogenes MGAS315
aaauggacaaucuuaaguuag

SEQ ID NO: 2222108 - RNA, 22 nt, Streptococcus pyogenes MGAS315
aaaucuuacuaacuagcaagug

SEQ ID NO: 2222109 - RNA, 21 nt, Streptococcus pyogenes MGAS315
aaaucaugggaaaagcuaagu

SEQ ID NO: 2222110 - RNA, 21 nt, Streptococcus pyogenes MGAS315
aaguuuucucagagacaauaa

SEQ ID NO: 2222111 - RNA, 20 nt, Streptococcus pyogenes MGAS315
aaguuuucucagagacaaua

SEQ ID NO: 2222112 - RNA, 19 nt, Streptococcus pyogenes MGAS315
aauaaaaucguuauuaauu

SEQ ID NO: 2222113 - RNA, 15 nt, Streptococcus pyogenes MGAS315
aauaaaauagcaccu

SEQ ID NO: 2222114 - RNA, 22 nt, Streptococcus pyogenes MGAS315
aauaaagcguugacaguuaaaa

SEQ ID NO: 2222115 - RNA, 17 nt, Streptococcus pyogenes MGAS315
aauaaagugcgcuucca

SEQ ID NO: 2222116 - RNA, 18 nt, Streptococcus pyogenes MGAS315
aauaacagaaauuaauaa

SEQ ID NO: 2222117 - RNA, 16 nt, Streptococcus pyogenes MGAS315
aaguaagauggugcuu

SEQ ID NO: 2222118 - RNA, 19 nt, Streptococcus pyogenes MGAS315
aaguuggcuacucuauuug

SEQ ID NO: 2222119 - RNA, 20 nt, Streptococcus pyogenes MGAS315
aaguugccuuaucucaguuu

SEQ ID NO: 2222120 - RNA, 16 nt, Streptococcus pyogenes MGAS315
aaguuauaaagaaaca

SEQ ID NO: 2222121 - RNA, 23 nt, Streptococcus pyogenes MGAS315
aaguuagggucugagugacuaaa

SEQ ID NO: 2222122 - RNA, 23 nt, Streptococcus pyogenes MGAS315
aagugugacuaguuuauuacaaa

SEQ ID NO: 2222123 - RNA, 17 nt, Streptococcus pyogenes MGAS315
aaaaauacuagaaaaag

SEQ ID NO: 2222124 - RNA, 19 nt, Streptococcus pyogenes MGAS315
aaaaauacaauaaagcguu

SEQ ID NO: 2222125 - RNA, 20 nt, Streptococcus pyogenes MGAS315
aauacuagaaaaagcaauga

SEQ ID NO: 2222126 - RNA, 19 nt, Streptococcus pyogenes MGAS315
aauacuagaaaaagcaaug

SEQ ID NO: 2222127 - RNA, 21 nt, Streptococcus pyogenes MGAS315
aauacuagaaaaagcaaugau

SEQ ID NO: 2222128 - RNA, 17 nt, Streptococcus pyogenes MGAS315
aauacuagaaaaagcaa

SEQ ID NO: 2222129 - RNA, 17 nt, Streptococcus pyogenes MGAS315
aauagaagacaagguga

SEQ ID NO: 2222130 - RNA, 19 nt, Streptococcus pyogenes MGAS315
aagauuaaacuuacaaaaa

SEQ ID NO: 2222131 - RNA, 15 nt, Streptococcus pyogenes MGAS315
aagcaaaaaagccag

SEQ ID NO: 2222132 - RNA, 20 nt, Streptococcus pyogenes MGAS315
aagcaaaaaagccagugcug

SEQ ID NO: 2222133 - RNA, 20 nt, Streptococcus pyogenes MGAS315
aagcaaaauuauuauuuugc

SEQ ID NO: 2222134 - RNA, 13 nt, Streptococcus pyogenes MGAS315
aagcauaaaaaua

SEQ ID NO: 2222135 - RNA, 15 nt, Streptococcus pyogenes MGAS315
aagcauaaaaauauu

SEQ ID NO: 2222136 - RNA, 21 nt, Streptococcus pyogenes MGAS315
aagcaguuucccauguuuuau

SEQ ID NO: 2222137 - RNA, 14 nt, Streptococcus pyogenes MGAS315
aagccagugcugcu

SEQ ID NO: 2222138 - RNA, 13 nt, Streptococcus pyogenes MGAS315
aaggauuuaguuc

SEQ ID NO: 2222139 - RNA, 15 nt, Streptococcus pyogenes MGAS315
aaggcaaagaaagcc

SEQ ID NO: 2222140 - RNA, 17 nt, Streptococcus pyogenes MGAS315
aagcugaguaaaacaau

SEQ ID NO: 2222141 - RNA, 17 nt, Streptococcus pyogenes MGAS315
aaggagcuuuaccuccu

SEQ ID NO: 2222142 - RNA, 19 nt, Streptococcus pyogenes MGAS315
aaggagcuuuaccuccuaa

SEQ ID NO: 2222143 - RNA, 15 nt, Streptococcus pyogenes MGAS315
aacguuaacaaaaau

SEQ ID NO: 2222144 - RNA, 17 nt, Streptococcus pyogenes MGAS315
aacguaauagaauaaaa

SEQ ID NO: 2222145 - RNA, 14 nt, Streptococcus pyogenes MGAS315
aacuauuuaacuua

SEQ ID NO: 2222146 - RNA, 19 nt, Streptococcus pyogenes MGAS315
aacuggcacaaacucugcc

SEQ ID NO: 2222147 - RNA, 21 nt, Streptococcus pyogenes MGAS315
aacuggcacaaacucugccaa

SEQ ID NO: 2222148 - RNA, 18 nt, Streptococcus pyogenes MGAS315
aacuggcuagccaaaucu

SEQ ID NO: 2222149 - RNA, 23 nt, Streptococcus pyogenes MGAS315
aacugcucuggcuuuuuccuauc

SEQ ID NO: 2222150 - RNA, 18 nt, Streptococcus pyogenes MGAS315
aacucaaaaaauacaaua

SEQ ID NO: 2222151 - RNA, 15 nt, Streptococcus pyogenes MGAS315
aacucaaaccaaaca

SEQ ID NO: 2222152 - RNA, 14 nt, Streptococcus pyogenes MGAS315
aacuuacaaaaagc

SEQ ID NO: 2222153 - RNA, 17 nt, Streptococcus pyogenes MGAS315
aacuucaaauuucauga

SEQ ID NO: 2222154 - RNA, 16 nt, Streptococcus pyogenes MGAS315
aacuugucaagccaua

SEQ ID NO: 2222155 - RNA, 12 nt, Streptococcus pyogenes MGAS315
aagaagaaaaua

SEQ ID NO: 2222156 - RNA, 22 nt, Streptococcus pyogenes MGAS315
aagaaggaacucuccaaaguuc

SEQ ID NO: 2222157 - RNA, 19 nt, Streptococcus pyogenes MGAS315
aaccaauuguugaauaagu

SEQ ID NO: 2222158 - RNA, 12 nt, Streptococcus pyogenes MGAS315
aaccaagugcca

SEQ ID NO: 2222159 - RNA, 20 nt, Streptococcus pyogenes MGAS315
aacauauuauaguaaccauu

SEQ ID NO: 2222160 - RNA, 17 nt, Streptococcus pyogenes MGAS315
aacaucuugauuguaag

SEQ ID NO: 2222161 - RNA, 16 nt, Streptococcus pyogenes MGAS315
aaccgcucauuugaug

SEQ ID NO: 2222162 - RNA, 17 nt, Streptococcus pyogenes MGAS315
aacaaucuuaaaauaau

SEQ ID NO: 2222163 - RNA, 18 nt, Streptococcus pyogenes MGAS315
aacaaucuuaaaauaauc

SEQ ID NO: 2222164 - RNA, 16 nt, Streptococcus pyogenes MGAS315
aaaaagggaagaagau

SEQ ID NO: 2222165 - RNA, 15 nt, Streptococcus pyogenes MGAS315
aaaaaguaaaaagca

SEQ ID NO: 2222166 - RNA, 15 nt, Streptococcus pyogenes MGAS315
aaaaaguaaaaucuu

SEQ ID NO: 2222167 - RNA, 12 nt, Streptococcus pyogenes MGAS315
aaaaaguaaaaa

SEQ ID NO: 2222168 - RNA, 18 nt, Streptococcus pyogenes MGAS315
aaaaaguaaaaucuuauu

SEQ ID NO: 2222169 - RNA, 14 nt, Streptococcus pyogenes MGAS315
aaaaaguaaaaagc

SEQ ID NO: 2222170 - RNA, 18 nt, Streptococcus pyogenes MGAS315
aacacucaucauauuguu

SEQ ID NO: 2222171 - RNA, 13 nt, Streptococcus pyogenes MGAS315
aacacucaucaua

SEQ ID NO: 2222172 - RNA, 14 nt, Streptococcus pyogenes MGAS315
aaugcgcucaagca

SEQ ID NO: 2222173 - RNA, 20 nt, Streptococcus pyogenes MGAS315
aauggaaauuuuaaaugaca

SEQ ID NO: 2222174 - RNA, 23 nt, Streptococcus pyogenes MGAS315
aauggaaauuuuaaaugacauga

SEQ ID NO: 2222175 - RNA, 23 nt, Streptococcus pyogenes MGAS315
aaugcccaagauggguuagcucu

SEQ ID NO: 2222176 - RNA, 17 nt, Streptococcus pyogenes MGAS315
aaucuucugcauuauca

SEQ ID NO: 2222177 - RNA, 23 nt, Streptococcus pyogenes MGAS315
aaugucuagcuuaucuucauagc

SEQ ID NO: 2222178 - RNA, 16 nt, Streptococcus pyogenes MGAS315
aaugucauacaaaaac

SEQ ID NO: 2222179 - RNA, 17 nt, Streptococcus pyogenes MGAS315
aaugucauacaaaaaca

SEQ ID NO: 2222180 - RNA, 18 nt, Streptococcus pyogenes MGAS315
aaugucauacaaaaacac

SEQ ID NO: 2222181 - RNA, 15 nt, Streptococcus pyogenes MGAS315
aauguucgaaaaaau

SEQ ID NO: 2222182 - RNA, 21 nt, Streptococcus pyogenes MGAS315
aauguuuuuacauuuuuacaa

SEQ ID NO: 2222183 - RNA, 23 nt, Streptococcus pyogenes MGAS315
aauguuuuuacauuuuuacaaua

SEQ ID NO: 2222184 - RNA, 17 nt, Streptococcus pyogenes MGAS315
aauuguaaccacagcaa

SEQ ID NO: 2222185 - RNA, 18 nt, Streptococcus pyogenes MGAS315
aauuguucauuaaagcua

SEQ ID NO: 2222186 - RNA, 13 nt, Streptococcus pyogenes MGAS315
aauuguugaauaa

SEQ ID NO: 2222187 - RNA, 16 nt, Streptococcus pyogenes MGAS315
aaaacaauaacacaga

SEQ ID NO: 2222188 - RNA, 11 nt, Streptococcus pyogenes MGAS315
aaaacaauaac

SEQ ID NO: 2222189 - RNA, 17 nt, Streptococcus pyogenes MGAS315
aaaacaauaacacagaa

SEQ ID NO: 2222190 - RNA, 12 nt, Streptococcus pyogenes MGAS315
aauugaaaaaau

SEQ ID NO: 2222191 - RNA, 20 nt, Streptococcus pyogenes MGAS315
aaucaaaaagcuaacaccau

SEQ ID NO: 2222192 - RNA, 22 nt, Streptococcus pyogenes MGAS315
aaucaaaaagcuaacaccauaa

SEQ ID NO: 2222193 - RNA, 17 nt, Streptococcus pyogenes MGAS315
aauaugauauaaaaaug

SEQ ID NO: 2222194 - RNA, 15 nt, Streptococcus pyogenes MGAS315
aauaugauauaaaaa

SEQ ID NO: 2222195 - RNA, 12 nt, Streptococcus pyogenes MGAS315
aauaugauauaa

SEQ ID NO: 2222196 - RNA, 14 nt, Streptococcus pyogenes MGAS315
aauauuuuauuaau

SEQ ID NO: 2222197 - RNA, 12 nt, Streptococcus pyogenes MGAS315
aauauuuccuuu

SEQ ID NO: 2222198 - RNA, 14 nt, Streptococcus pyogenes MGAS315
aaucuggcuuagca

SEQ ID NO: 2222199 - RNA, 20 nt, Streptococcus pyogenes MGAS315
aaucguuacuccuuugacca

SEQ ID NO: 2222200 - RNA, 21 nt, Streptococcus pyogenes MGAS315
aaucccuugcuuugauuuuuc

SEQ ID NO: 2222201 - RNA, 20 nt, Streptococcus pyogenes MGAS315
acaaggcaauccaaaucaac

SEQ ID NO: 2222202 - RNA, 21 nt, Streptococcus pyogenes MGAS315
acaccuaauaaaauagcaccu

SEQ ID NO: 2222203 - RNA, 14 nt, Streptococcus pyogenes MGAS315
acaccaaaaaaagc

SEQ ID NO: 2222204 - RNA, 19 nt, Streptococcus pyogenes MGAS315
acaaaaugaagcaaaauaa

SEQ ID NO: 2222205 - RNA, 20 nt, Streptococcus pyogenes MGAS315
acaaaaugaagcaaaauaaa

SEQ ID NO: 2222206 - RNA, 13 nt, Streptococcus pyogenes MGAS315
acaaauucuuuuu

SEQ ID NO: 2222207 - RNA, 16 nt, Streptococcus pyogenes MGAS315
accaaaucaaaaagcu

SEQ ID NO: 2222208 - RNA, 16 nt, Streptococcus pyogenes MGAS315
acaguauaaccgccau

SEQ ID NO: 2222209 - RNA, 14 nt, Streptococcus pyogenes MGAS315
acaguuaaaaauaa

SEQ ID NO: 2222210 - RNA, 22 nt, Streptococcus pyogenes MGAS315
agacuucuuccuuguacaagag

SEQ ID NO: 2222211 - RNA, 14 nt, Streptococcus pyogenes MGAS315
agacugauucaucu

SEQ ID NO: 2222212 - RNA, 19 nt, Streptococcus pyogenes MGAS315
agacucaauugaaagaggu

SEQ ID NO: 2222213 - RNA, 23 nt, Streptococcus pyogenes MGAS315
agagaauuugaaacguuuaggau

SEQ ID NO: 2222214 - RNA, 22 nt, Streptococcus pyogenes MGAS315
agagacaauaaggucauuagaa

SEQ ID NO: 2222215 - RNA, 17 nt, Streptococcus pyogenes MGAS315
agagagguugguaaaaa

SEQ ID NO: 2222216 - RNA, 18 nt, Streptococcus pyogenes MGAS315
agagauaaaaaguaaaau

SEQ ID NO: 2222217 - RNA, 21 nt, Streptococcus pyogenes MGAS315
agagagaaugauaguaaacga

SEQ ID NO: 2222218 - RNA, 17 nt, Streptococcus pyogenes MGAS315
agauuaacugacaaaaa

SEQ ID NO: 2222219 - RNA, 21 nt, Streptococcus pyogenes MGAS315
agagucuuaguuuaggaauca

SEQ ID NO: 2222220 - RNA, 16 nt, Streptococcus pyogenes MGAS315
agauagucaaaaagac

SEQ ID NO: 2222221 - RNA, 17 nt, Streptococcus pyogenes MGAS315
agauaccaaaucaaaaa

SEQ ID NO: 2222222 - RNA, 22 nt, Streptococcus pyogenes MGAS315
agaacgaauugugucauuucuu

SEQ ID NO: 2222223 - RNA, 16 nt, Streptococcus pyogenes MGAS315
agaauaaccagcugau

SEQ ID NO: 2222224 - RNA, 15 nt, Streptococcus pyogenes MGAS315
acuuugguauucuuu

SEQ ID NO: 2222225 - RNA, 16 nt, Streptococcus pyogenes MGAS315
acuuugguauucuuuu

SEQ ID NO: 2222226 - RNA, 12 nt, Streptococcus pyogenes MGAS315
acuuuuaaaauc

SEQ ID NO: 2222227 - RNA, 19 nt, Streptococcus pyogenes MGAS315
acuuugacagacaccaaaa

SEQ ID NO: 2222228 - RNA, 21 nt, Streptococcus pyogenes MGAS315
acuuugacagacaccaaaaaa

SEQ ID NO: 2222229 - RNA, 21 nt, Streptococcus pyogenes MGAS315
acuuuaaacacuaccuuaaau

SEQ ID NO: 2222230 - RNA, 15 nt, Streptococcus pyogenes MGAS315
acuuuaaacacuacc

SEQ ID NO: 2222231 - RNA, 22 nt, Streptococcus pyogenes MGAS315
acuugcaucgcaaacagaugcu

SEQ ID NO: 2222232 - RNA, 17 nt, Streptococcus pyogenes MGAS315
acuugcaucgcaaacag

SEQ ID NO: 2222233 - RNA, 19 nt, Streptococcus pyogenes MGAS315
acuuguuacaaaaaacaag

SEQ ID NO: 2222234 - RNA, 18 nt, Streptococcus pyogenes MGAS315
acuuguuacaaaaaacaa

SEQ ID NO: 2222235 - RNA, 16 nt, Streptococcus pyogenes MGAS315
acuuguuacaaaaaac

SEQ ID NO: 2222236 - RNA, 21 nt, Streptococcus pyogenes MGAS315
acuugguucugaaaauaaaau

SEQ ID NO: 2222237 - RNA, 15 nt, Streptococcus pyogenes MGAS315
agccuuuaucaacuu

SEQ ID NO: 2222238 - RNA, 21 nt, Streptococcus pyogenes MGAS315
agcgcacuuuauuaugccaaa

SEQ ID NO: 2222239 - RNA, 23 nt, Streptococcus pyogenes MGAS315
agcauaaaagauauuuuaaaaua

SEQ ID NO: 2222240 - RNA, 15 nt, Streptococcus pyogenes MGAS315
agcaucaaaaccaag

SEQ ID NO: 2222241 - RNA, 18 nt, Streptococcus pyogenes MGAS315
agcauaaccuuugccauu

SEQ ID NO: 2222242 - RNA, 15 nt, Streptococcus pyogenes MGAS315
aaaaccuucaaaaaa

SEQ ID NO: 2222243 - RNA, 14 nt, Streptococcus pyogenes MGAS315
agccaaauccaccu

SEQ ID NO: 2222244 - RNA, 12 nt, Streptococcus pyogenes MGAS315
agccaauuacuu

SEQ ID NO: 2222245 - RNA, 17 nt, Streptococcus pyogenes MGAS315
agcauuuugagaacgaa

SEQ ID NO: 2222246 - RNA, 19 nt, Streptococcus pyogenes MGAS315
agcaaugguuaaaaagaga

SEQ ID NO: 2222247 - RNA, 17 nt, Streptococcus pyogenes MGAS315
agcaaugguuaaaaaga

SEQ ID NO: 2222248 - RNA, 22 nt, Streptococcus pyogenes MGAS315
agcaaucauacccgcguuaucu

SEQ ID NO: 2222249 - RNA, 17 nt, Streptococcus pyogenes MGAS315
acucaauagcugcugcu

SEQ ID NO: 2222250 - RNA, 14 nt, Streptococcus pyogenes MGAS315
acucaauugaaaga

SEQ ID NO: 2222251 - RNA, 17 nt, Streptococcus pyogenes MGAS315
acuagaaaaagcaauga

SEQ ID NO: 2222252 - RNA, 14 nt, Streptococcus pyogenes MGAS315
acuagaaaaagcaa

SEQ ID NO: 2222253 - RNA, 20 nt, Streptococcus pyogenes MGAS315
acuaggaaucgcuuuaggaa

SEQ ID NO: 2222254 - RNA, 21 nt, Streptococcus pyogenes MGAS315
acuaguuuauuacaaaacugu

SEQ ID NO: 2222255 - RNA, 18 nt, Streptococcus pyogenes MGAS315
acucaucauauuguuaau

SEQ ID NO: 2222256 - RNA, 22 nt, Streptococcus pyogenes MGAS315
acuccagcuggaguuuuuuuau

SEQ ID NO: 2222257 - RNA, 14 nt, Streptococcus pyogenes MGAS315
acugcuagucgggu

SEQ ID NO: 2222258 - RNA, 13 nt, Streptococcus pyogenes MGAS315
acucguaagcauu

SEQ ID NO: 2222259 - RNA, 21 nt, Streptococcus pyogenes MGAS315
acucuaucaacucgacuccaa

SEQ ID NO: 2222260 - RNA, 13 nt, Streptococcus pyogenes MGAS315
acuggucaaaagc

SEQ ID NO: 2222261 - RNA, 21 nt, Streptococcus pyogenes MGAS315
acugggucaacuccaaucuca

SEQ ID NO: 2222262 - RNA, 17 nt, Streptococcus pyogenes MGAS315
acuggcuagccaaaucu

SEQ ID NO: 2222263 - RNA, 18 nt, Streptococcus pyogenes MGAS315
acuggcauagaaauaguu

SEQ ID NO: 2222264 - RNA, 13 nt, Streptococcus pyogenes MGAS315
acuguaauauuuc

SEQ ID NO: 2222265 - RNA, 20 nt, Streptococcus pyogenes MGAS315
acgggcugccauuugagcac

SEQ ID NO: 2222266 - RNA, 19 nt, Streptococcus pyogenes MGAS315
acguguauucuuaaaaaaa

SEQ ID NO: 2222267 - RNA, 16 nt, Streptococcus pyogenes MGAS315
acgccuccaaauacug

SEQ ID NO: 2222268 - RNA, 13 nt, Streptococcus pyogenes MGAS315
accuucauagaca

SEQ ID NO: 2222269 - RNA, 12 nt, Streptococcus pyogenes MGAS315
accuuugccauu

SEQ ID NO: 2222270 - RNA, 18 nt, Streptococcus pyogenes MGAS315
accguuccugucgcagau

SEQ ID NO: 2222271 - RNA, 22 nt, Streptococcus pyogenes MGAS315
accguguucgauaaauucaggu

SEQ ID NO: 2222272 - RNA, 23 nt, Streptococcus pyogenes MGAS315
accuacugccauggguaaaauga

SEQ ID NO: 2222273 - RNA, 16 nt, Streptococcus pyogenes MGAS315
accuacgauaaaacaa

SEQ ID NO: 2222274 - RNA, 19 nt, Streptococcus pyogenes MGAS315
accuaauugugagaaacua

SEQ ID NO: 2222275 - RNA, 13 nt, Streptococcus pyogenes MGAS315
accuaauaaaaua

SEQ ID NO: 2222276 - RNA, 14 nt, Streptococcus pyogenes MGAS315
accgcuaaaacagu

SEQ ID NO: 2222277 - RNA, 15 nt, Streptococcus pyogenes MGAS315
accgcucauuugaug

SEQ ID NO: 2222278 - RNA, 18 nt, Streptococcus pyogenes MGAS315
accgcucauuugaugagc

SEQ ID NO: 2222279 - RNA, 18 nt, Streptococcus pyogenes MGAS315
agcugaguaaaacaauaa

SEQ ID NO: 2222280 - RNA, 16 nt, Streptococcus pyogenes MGAS315
agcucugucagcaaua

SEQ ID NO: 2222281 - RNA, 14 nt, Streptococcus pyogenes MGAS315
agcuccuaaaacca

SEQ ID NO: 2222282 - RNA, 16 nt, Streptococcus pyogenes MGAS315
agcuuuuuaaagagcc

SEQ ID NO: 2222283 - RNA, 14 nt, Streptococcus pyogenes MGAS315
agcuggaguuuuuu

SEQ ID NO: 2222284 - RNA, 13 nt, Streptococcus pyogenes MGAS315
agcugauuacuga

SEQ ID NO: 2222285 - RNA, 16 nt, Streptococcus pyogenes MGAS315
aggaucauuauccuuu

SEQ ID NO: 2222286 - RNA, 19 nt, Streptococcus pyogenes MGAS315
aggcaggacgguuucccuu

SEQ ID NO: 2222287 - RNA, 14 nt, Streptococcus pyogenes MGAS315
aggcaggacgguuu

SEQ ID NO: 2222288 - RNA, 17 nt, Streptococcus pyogenes MGAS315
aggcaguucgauuauua

SEQ ID NO: 2222289 - RNA, 17 nt, Streptococcus pyogenes MGAS315
aggcaauccaaaucaac

SEQ ID NO: 2222290 - RNA, 15 nt, Streptococcus pyogenes MGAS315
aggcguauaggugag

SEQ ID NO: 2222291 - RNA, 13 nt, Streptococcus pyogenes MGAS315
aggcuaaagccua

SEQ ID NO: 2222292 - RNA, 13 nt, Streptococcus pyogenes MGAS315
aggcucugcugau

SEQ ID NO: 2222293 - RNA, 23 nt, Streptococcus pyogenes MGAS315
agggguaauuugguggaagagua

SEQ ID NO: 2222294 - RNA, 19 nt, Streptococcus pyogenes MGAS315
aggguguuuuuuauauguc

SEQ ID NO: 2222295 - RNA, 13 nt, Streptococcus pyogenes MGAS315
aguaaaaagcaaa

SEQ ID NO: 2222296 - RNA, 16 nt, Streptococcus pyogenes MGAS315
agguuuguugaaaugu

SEQ ID NO: 2222297 - RNA, 19 nt, Streptococcus pyogenes MGAS315
aguaaggaaaucaauccug

SEQ ID NO: 2222298 - RNA, 16 nt, Streptococcus pyogenes MGAS315
aguaaggaccaagauu

SEQ ID NO: 2222299 - RNA, 15 nt, Streptococcus pyogenes MGAS315
agguuaaguaaaagc

SEQ ID NO: 2222300 - RNA, 23 nt, Streptococcus pyogenes MGAS315
aggugaguuuuuucuaaaagaga

SEQ ID NO: 2222301 - RNA, 16 nt, Streptococcus pyogenes MGAS315
agguaaagauuuuaaa

SEQ ID NO: 2222302 - RNA, 23 nt, Streptococcus pyogenes MGAS315
aggucugcgcgacuaaaaucaug

SEQ ID NO: 2222303 - RNA, 22 nt, Streptococcus pyogenes MGAS315
aggucugcaauauccauagaaa

SEQ ID NO: 2222304 - RNA, 23 nt, Streptococcus pyogenes MGAS315
aggugaaaauaucuuuuuuacuu

SEQ ID NO: 2222305 - RNA, 22 nt, Streptococcus pyogenes MGAS315
agucagaucauuaaauugauua

SEQ ID NO: 2222306 - RNA, 22 nt, Streptococcus pyogenes MGAS315
agucacugcagcaucaaaacca

SEQ ID NO: 2222307 - RNA, 16 nt, Streptococcus pyogenes MGAS315
aguccaaacucaaacc

SEQ ID NO: 2222308 - RNA, 23 nt, Streptococcus pyogenes MGAS315
agucuaggcguauaggugaguuu

SEQ ID NO: 2222309 - RNA, 16 nt, Streptococcus pyogenes MGAS315
aguguagauaaacugg

SEQ ID NO: 2222310 - RNA, 20 nt, Streptococcus pyogenes MGAS315
aguuaaaaauaacuuuaaaa

SEQ ID NO: 2222311 - RNA, 16 nt, Streptococcus pyogenes MGAS315
agugguuugcaaauag

SEQ ID NO: 2222312 - RNA, 18 nt, Streptococcus pyogenes MGAS315
aguucgauuauuaaccaa

SEQ ID NO: 2222313 - RNA, 14 nt, Streptococcus pyogenes MGAS315
aguucgauuauuaa

SEQ ID NO: 2222314 - RNA, 12 nt, Streptococcus pyogenes MGAS315
aguuauuuuuga

SEQ ID NO: 2222315 - RNA, 13 nt, Streptococcus pyogenes MGAS315
aguuaauaagaca

SEQ ID NO: 2222316 - RNA, 16 nt, Streptococcus pyogenes MGAS315
aguuaauaagacaaag

SEQ ID NO: 2222317 - RNA, 20 nt, Streptococcus pyogenes MGAS315
aguuauaaagaaacaaaaau

SEQ ID NO: 2222318 - RNA, 15 nt, Streptococcus pyogenes MGAS315
auaaucccuugcuuu

SEQ ID NO: 2222319 - RNA, 18 nt, Streptococcus pyogenes MGAS315
auaaugccaucaaaaaaa

SEQ ID NO: 2222320 - RNA, 19 nt, Streptococcus pyogenes MGAS315
auaaugccaucaaaaaaag

SEQ ID NO: 2222321 - RNA, 19 nt, Streptococcus pyogenes MGAS315
auaaguauuuuaaaauccu

SEQ ID NO: 2222322 - RNA, 12 nt, Streptococcus pyogenes MGAS315
auaagguuuuuu

SEQ ID NO: 2222323 - RNA, 13 nt, Streptococcus pyogenes MGAS315
auaagguuuuuuu

SEQ ID NO: 2222324 - RNA, 23 nt, Streptococcus pyogenes MGAS315
auaaaaacgaucaaaaaucuuuu

SEQ ID NO: 2222325 - RNA, 22 nt, Streptococcus pyogenes MGAS315
auaaaaauauucccaaugcccc

SEQ ID NO: 2222326 - RNA, 17 nt, Streptococcus pyogenes MGAS315
auaaaaccuucaaaaaa

SEQ ID NO: 2222327 - RNA, 14 nt, Streptococcus pyogenes MGAS315
auaaaaccuucaaa

SEQ ID NO: 2222328 - RNA, 15 nt, Streptococcus pyogenes MGAS315
auaaaaccuucaaaa

SEQ ID NO: 2222329 - RNA, 18 nt, Streptococcus pyogenes MGAS315
auaaaagauauuuuaaaa

SEQ ID NO: 2222330 - RNA, 20 nt, Streptococcus pyogenes MGAS315
auaaaagauauuuuaaaaua

SEQ ID NO: 2222331 - RNA, 22 nt, Streptococcus pyogenes MGAS315
auaaaaaaccuuaucaaaccaa

SEQ ID NO: 2222332 - RNA, 22 nt, Streptococcus pyogenes MGAS315
aguuguaagguuuguugaaaug

SEQ ID NO: 2222333 - RNA, 18 nt, Streptococcus pyogenes MGAS315
auaaagaaacaaaaauga

SEQ ID NO: 2222334 - RNA, 16 nt, Streptococcus pyogenes MGAS315
auaaagauaauuuauu

SEQ ID NO: 2222335 - RNA, 23 nt, Streptococcus pyogenes MGAS315
auaaagcguugacaguuaaaaau

SEQ ID NO: 2222336 - RNA, 16 nt, Streptococcus pyogenes MGAS315
auaaaucuuacuaacu

SEQ ID NO: 2222337 - RNA, 14 nt, Streptococcus pyogenes MGAS315
aaaacucaaaaaau

SEQ ID NO: 2222338 - RNA, 22 nt, Streptococcus pyogenes MGAS315
aucauacaacuggcuagccaaa

SEQ ID NO: 2222339 - RNA, 22 nt, Streptococcus pyogenes MGAS315
aaaacguguauucuuaaaaaaa

SEQ ID NO: 2222340 - RNA, 20 nt, Streptococcus pyogenes MGAS315
aaaagaagcaaaauuauuau

SEQ ID NO: 2222341 - RNA, 13 nt, Streptococcus pyogenes MGAS315
auccguauuuuuu

SEQ ID NO: 2222342 - RNA, 22 nt, Streptococcus pyogenes MGAS315
auccuuuacuguaauauuuccu

SEQ ID NO: 2222343 - RNA, 15 nt, Streptococcus pyogenes MGAS315
auccuccuaaauaua

SEQ ID NO: 2222344 - RNA, 16 nt, Streptococcus pyogenes MGAS315
aucuaaagcaucagca

SEQ ID NO: 2222345 - RNA, 13 nt, Streptococcus pyogenes MGAS315
aucguuuugcaau

SEQ ID NO: 2222346 - RNA, 14 nt, Streptococcus pyogenes MGAS315
aucgugauugauug

SEQ ID NO: 2222347 - RNA, 14 nt, Streptococcus pyogenes MGAS315
aucuggucccacac

SEQ ID NO: 2222348 - RNA, 21 nt, Streptococcus pyogenes MGAS315
aucugcagauuuuaagacaac

SEQ ID NO: 2222349 - RNA, 16 nt, Streptococcus pyogenes MGAS315
aucugcacaugcuuga

SEQ ID NO: 2222350 - RNA, 14 nt, Streptococcus pyogenes MGAS315
aucugcagauuuua

SEQ ID NO: 2222351 - RNA, 15 nt, Streptococcus pyogenes MGAS315
aucucuugagaucuu

SEQ ID NO: 2222352 - RNA, 19 nt, Streptococcus pyogenes MGAS315
aucucguaauccuugauuu

SEQ ID NO: 2222353 - RNA, 18 nt, Streptococcus pyogenes MGAS315
augacgccuccaaauacu

SEQ ID NO: 2222354 - RNA, 20 nt, Streptococcus pyogenes MGAS315
augaccuuugauaagauauu

SEQ ID NO: 2222355 - RNA, 17 nt, Streptococcus pyogenes MGAS315
augaagcaaaauaaacu

SEQ ID NO: 2222356 - RNA, 21 nt, Streptococcus pyogenes MGAS315
aucuuguggguuuugaacgaa

SEQ ID NO: 2222357 - RNA, 12 nt, Streptococcus pyogenes MGAS315
auacgguaaaaa

SEQ ID NO: 2222358 - RNA, 15 nt, Streptococcus pyogenes MGAS315
auagaauaaaaaaga

SEQ ID NO: 2222359 - RNA, 14 nt, Streptococcus pyogenes MGAS315
auagacaggagcuu

SEQ ID NO: 2222360 - RNA, 17 nt, Streptococcus pyogenes MGAS315
auagaagacaaggugaa

SEQ ID NO: 2222361 - RNA, 20 nt, Streptococcus pyogenes MGAS315
auagaaacuuuuuauaagca

SEQ ID NO: 2222362 - RNA, 20 nt, Streptococcus pyogenes MGAS315
auaccaaaucaaaaagcuaa

SEQ ID NO: 2222363 - RNA, 18 nt, Streptococcus pyogenes MGAS315
auaccaaaucaaaaagcu

SEQ ID NO: 2222364 - RNA, 15 nt, Streptococcus pyogenes MGAS315
auaccaaaucaaaaa

SEQ ID NO: 2222365 - RNA, 17 nt, Streptococcus pyogenes MGAS315
auaccaaaucaaaaagc

SEQ ID NO: 2222366 - RNA, 19 nt, Streptococcus pyogenes MGAS315
auaggaaucguaggguguu

SEQ ID NO: 2222367 - RNA, 22 nt, Streptococcus pyogenes MGAS315
auagcuuaaugucauacaaaaa

SEQ ID NO: 2222368 - RNA, 17 nt, Streptococcus pyogenes MGAS315
auagguaaagauuuuaa

SEQ ID NO: 2222369 - RNA, 13 nt, Streptococcus pyogenes MGAS315
auagggguaauuu

SEQ ID NO: 2222370 - RNA, 14 nt, Streptococcus pyogenes MGAS315
auaguaaacgaaaa

SEQ ID NO: 2222371 - RNA, 15 nt, Streptococcus pyogenes MGAS315
auaguaaacgaaaau

SEQ ID NO: 2222372 - RNA, 18 nt, Streptococcus pyogenes MGAS315
auaguaaccauugccauu

SEQ ID NO: 2222373 - RNA, 21 nt, Streptococcus pyogenes MGAS315
auaguuaacugguaaaguauu

SEQ ID NO: 2222374 - RNA, 19 nt, Streptococcus pyogenes MGAS315
auaguuagcaaauuguuug

SEQ ID NO: 2222375 - RNA, 13 nt, Streptococcus pyogenes MGAS315
auauaaauuauua

SEQ ID NO: 2222376 - RNA, 17 nt, Streptococcus pyogenes MGAS315
aucaaaaaaagcaauga

SEQ ID NO: 2222377 - RNA, 16 nt, Streptococcus pyogenes MGAS315
aucaaaaaaagcaaug

SEQ ID NO: 2222378 - RNA, 20 nt, Streptococcus pyogenes MGAS315
aucaaaaaaagcaaugacua

SEQ ID NO: 2222379 - RNA, 18 nt, Streptococcus pyogenes MGAS315
auauuuuuucucaaaaau

SEQ ID NO: 2222380 - RNA, 15 nt, Streptococcus pyogenes MGAS315
aucaaaaaaagcaau

SEQ ID NO: 2222381 - RNA, 17 nt, Streptococcus pyogenes MGAS315
aucaacucgacuccaau

SEQ ID NO: 2222382 - RNA, 18 nt, Streptococcus pyogenes MGAS315
aucaaaggguguuuuuua

SEQ ID NO: 2222383 - RNA, 14 nt, Streptococcus pyogenes MGAS315
auauuagcaaaaug

SEQ ID NO: 2222384 - RNA, 15 nt, Streptococcus pyogenes MGAS315
auauuagcaaaaugc

SEQ ID NO: 2222385 - RNA, 18 nt, Streptococcus pyogenes MGAS315
auauuaggauauggaaua

SEQ ID NO: 2222386 - RNA, 17 nt, Streptococcus pyogenes MGAS315
aucaggcuuaaacauau

SEQ ID NO: 2222387 - RNA, 16 nt, Streptococcus pyogenes MGAS315
caagugagaacaugug

SEQ ID NO: 2222388 - RNA, 22 nt, Streptococcus pyogenes MGAS315
caaguguuuugucuuauagaau

SEQ ID NO: 2222389 - RNA, 17 nt, Streptococcus pyogenes MGAS315
caauaaaaaagaagcaa

SEQ ID NO: 2222390 - RNA, 17 nt, Streptococcus pyogenes MGAS315
caauaauaccauuuuua

SEQ ID NO: 2222391 - RNA, 20 nt, Streptococcus pyogenes MGAS315
caaucgaaaugauagcaccu

SEQ ID NO: 2222392 - RNA, 13 nt, Streptococcus pyogenes MGAS315
caaucgaaaugau

SEQ ID NO: 2222393 - RNA, 17 nt, Streptococcus pyogenes MGAS315
caaucgaaaugauagca

SEQ ID NO: 2222394 - RNA, 21 nt, Streptococcus pyogenes MGAS315
caaucauacccgcguuaucuc

SEQ ID NO: 2222395 - RNA, 12 nt, Streptococcus pyogenes MGAS315
caauauccauag

SEQ ID NO: 2222396 - RNA, 23 nt, Streptococcus pyogenes MGAS315
caagcauuuugcaagucucuugc

SEQ ID NO: 2222397 - RNA, 17 nt, Streptococcus pyogenes MGAS315
caagaucugcacacacu

SEQ ID NO: 2222398 - RNA, 15 nt, Streptococcus pyogenes MGAS315
caacugcuaguugug

SEQ ID NO: 2222399 - RNA, 15 nt, Streptococcus pyogenes MGAS315
caaauuuauccugau

SEQ ID NO: 2222400 - RNA, 17 nt, Streptococcus pyogenes MGAS315
caacauggcuaaugaua

SEQ ID NO: 2222401 - RNA, 23 nt, Streptococcus pyogenes MGAS315
caacaguugcuugcuuuuuucua

SEQ ID NO: 2222402 - RNA, 15 nt, Streptococcus pyogenes MGAS315
caacagcagcaguug

SEQ ID NO: 2222403 - RNA, 18 nt, Streptococcus pyogenes MGAS315
caaaauuauuauuuugcu

SEQ ID NO: 2222404 - RNA, 16 nt, Streptococcus pyogenes MGAS315
caaaagugugaccaga

SEQ ID NO: 2222405 - RNA, 18 nt, Streptococcus pyogenes MGAS315
caaaaagccuauuuaaua

SEQ ID NO: 2222406 - RNA, 18 nt, Streptococcus pyogenes MGAS315
caaaagaccauaaaaaac

SEQ ID NO: 2222407 - RNA, 13 nt, Streptococcus pyogenes MGAS315
caaaggcuuuuuu

SEQ ID NO: 2222408 - RNA, 23 nt, Streptococcus pyogenes MGAS315
caccuacgauaaaacaaauaauu

SEQ ID NO: 2222409 - RNA, 18 nt, Streptococcus pyogenes MGAS315
aaaauaaacuuucaguua

SEQ ID NO: 2222410 - RNA, 15 nt, Streptococcus pyogenes MGAS315
aaaauacuagaaaaa

SEQ ID NO: 2222411 - RNA, 16 nt, Streptococcus pyogenes MGAS315
aaaauacuagaaaaag

SEQ ID NO: 2222412 - RNA, 19 nt, Streptococcus pyogenes MGAS315
aaaauacuagaaaaagcaa

SEQ ID NO: 2222413 - RNA, 20 nt, Streptococcus pyogenes MGAS315
caccuuagugguuugcaaau

SEQ ID NO: 2222414 - RNA, 21 nt, Streptococcus pyogenes MGAS315
caccuuaggcagacaauuauu

SEQ ID NO: 2222415 - RNA, 14 nt, Streptococcus pyogenes MGAS315
caccaaaaaaagca

SEQ ID NO: 2222416 - RNA, 10 nt, Streptococcus pyogenes MGAS315
caccaccaau

SEQ ID NO: 2222417 - RNA, 16 nt, Streptococcus pyogenes MGAS315
caauggauauaacaac

SEQ ID NO: 2222418 - RNA, 15 nt, Streptococcus pyogenes MGAS315
caaugguuaaaaaga

SEQ ID NO: 2222419 - RNA, 15 nt, Streptococcus pyogenes MGAS315
caauggaaauuuuaa

SEQ ID NO: 2222420 - RNA, 21 nt, Streptococcus pyogenes MGAS315
caauggaaauuuuaaaugaca

SEQ ID NO: 2222421 - RNA, 21 nt, Streptococcus pyogenes MGAS315
cacagcaauuuguuccaucug

SEQ ID NO: 2222422 - RNA, 23 nt, Streptococcus pyogenes MGAS315
augcacacaaaucuucuagaauc

SEQ ID NO: 2222423 - RNA, 15 nt, Streptococcus pyogenes MGAS315
augcacacaaaucuu

SEQ ID NO: 2222424 - RNA, 15 nt, Streptococcus pyogenes MGAS315
augauuugucaaaaa

SEQ ID NO: 2222425 - RNA, 20 nt, Streptococcus pyogenes MGAS315
augauuugucaaaaaguaaa

SEQ ID NO: 2222426 - RNA, 21 nt, Streptococcus pyogenes MGAS315
augauuugucaaaaaguaaaa

SEQ ID NO: 2222427 - RNA, 23 nt, Streptococcus pyogenes MGAS315
augauuugucaaaaaguaaaaag

SEQ ID NO: 2222428 - RNA, 16 nt, Streptococcus pyogenes MGAS315
augauuuuaacguuuu

SEQ ID NO: 2222429 - RNA, 17 nt, Streptococcus pyogenes MGAS315
augauuuaguuuuuaaa

SEQ ID NO: 2222430 - RNA, 17 nt, Streptococcus pyogenes MGAS315
augaucuguuuaaaaac

SEQ ID NO: 2222431 - RNA, 21 nt, Streptococcus pyogenes MGAS315
augaucuguuuaaaaacaaau

SEQ ID NO: 2222432 - RNA, 14 nt, Streptococcus pyogenes MGAS315
augagcaaggcaag

SEQ ID NO: 2222433 - RNA, 13 nt, Streptococcus pyogenes MGAS315
augagcaaggcaa

SEQ ID NO: 2222434 - RNA, 21 nt, Streptococcus pyogenes MGAS315
auggauauaacaacucccucc

SEQ ID NO: 2222435 - RNA, 19 nt, Streptococcus pyogenes MGAS315
auggcagagucauuuaguu

SEQ ID NO: 2222436 - RNA, 18 nt, Streptococcus pyogenes MGAS315
augcuucuuucaaacgga

SEQ ID NO: 2222437 - RNA, 18 nt, Streptococcus pyogenes MGAS315
augcucucauaaacaaug

SEQ ID NO: 2222438 - RNA, 14 nt, Streptococcus pyogenes MGAS315
augcugcaaaauuu

SEQ ID NO: 2222439 - RNA, 23 nt, Streptococcus pyogenes MGAS315
auuaagauuugaccacaccuaau

SEQ ID NO: 2222440 - RNA, 21 nt, Streptococcus pyogenes MGAS315
auuaagaaggaacucuccaaa

SEQ ID NO: 2222441 - RNA, 14 nt, Streptococcus pyogenes MGAS315
auuaauaauauuaa

SEQ ID NO: 2222442 - RNA, 18 nt, Streptococcus pyogenes MGAS315
auuaacguuaacaaaaau

SEQ ID NO: 2222443 - RNA, 13 nt, Streptococcus pyogenes MGAS315
auguuuuauuacc

SEQ ID NO: 2222444 - RNA, 18 nt, Streptococcus pyogenes MGAS315
auuauuaaccaauuccuc

SEQ ID NO: 2222445 - RNA, 18 nt, Streptococcus pyogenes MGAS315
auuauugucacugaaaaa

SEQ ID NO: 2222446 - RNA, 21 nt, Streptococcus pyogenes MGAS315
auuauuaacguuaacaaaaau

SEQ ID NO: 2222447 - RNA, 19 nt, Streptococcus pyogenes MGAS315
aaaagcgauaauaaagugc

SEQ ID NO: 2222448 - RNA, 10 nt, Streptococcus pyogenes MGAS315
auucuugcag

SEQ ID NO: 2222449 - RNA, 12 nt, Streptococcus pyogenes MGAS315
auucuuuuuccg

SEQ ID NO: 2222450 - RNA, 15 nt, Streptococcus pyogenes MGAS315
auucuuuauaauggu

SEQ ID NO: 2222451 - RNA, 22 nt, Streptococcus pyogenes MGAS315
auucuuuuuccguuugagauaa

SEQ ID NO: 2222452 - RNA, 22 nt, Streptococcus pyogenes MGAS315
auuguucauuaaagcuaucaua

SEQ ID NO: 2222453 - RNA, 15 nt, Streptococcus pyogenes MGAS315
auuguagggauuuuu

SEQ ID NO: 2222454 - RNA, 23 nt, Streptococcus pyogenes MGAS315
auuguaauaacaaaaugaagcaa

SEQ ID NO: 2222455 - RNA, 15 nt, Streptococcus pyogenes MGAS315
auuguaaccacagca

SEQ ID NO: 2222456 - RNA, 13 nt, Streptococcus pyogenes MGAS315
caaaaaagggaag

SEQ ID NO: 2222457 - RNA, 18 nt, Streptococcus pyogenes MGAS315
caaaaaaagcaagcaaca

SEQ ID NO: 2222458 - RNA, 13 nt, Streptococcus pyogenes MGAS315
caaaaaaagcaau

SEQ ID NO: 2222459 - RNA, 14 nt, Streptococcus pyogenes MGAS315
auuuguuuucuuua

SEQ ID NO: 2222460 - RNA, 21 nt, Streptococcus pyogenes MGAS315
auuuuaaaauccucuuuuaau

SEQ ID NO: 2222461 - RNA, 22 nt, Streptococcus pyogenes MGAS315
auuuuacuauggcuucuaaaaa

SEQ ID NO: 2222462 - RNA, 23 nt, Streptococcus pyogenes MGAS315
auuuuacuauggcuucuaaaaaa

SEQ ID NO: 2222463 - RNA, 19 nt, Streptococcus pyogenes MGAS315
auuuuaaucuuuuugugau

SEQ ID NO: 2222464 - RNA, 23 nt, Streptococcus pyogenes MGAS315
auuuuaguugauauuuuuuagga

SEQ ID NO: 2222465 - RNA, 20 nt, Streptococcus pyogenes MGAS315
auuucuugaggugauucuuu

SEQ ID NO: 2222466 - RNA, 12 nt, Streptococcus pyogenes MGAS315
auuugaaguaaa

SEQ ID NO: 2222467 - RNA, 14 nt, Streptococcus pyogenes MGAS315
auuucguugacaaa

SEQ ID NO: 2222468 - RNA, 24 nt, Streptococcus pyogenes MGAS315
auuuaugaggccaauaaugccauc

SEQ ID NO: 2222469 - RNA, 19 nt, Streptococcus pyogenes MGAS315
auuuauuaagauaccaaau

SEQ ID NO: 2222470 - RNA, 20 nt, Streptococcus pyogenes MGAS315
auuucaaaaaauuuuuagac

SEQ ID NO: 2222471 - RNA, 15 nt, Streptococcus pyogenes MGAS315
cagcugcuugaaaag

SEQ ID NO: 2222472 - RNA, 13 nt, Streptococcus pyogenes MGAS315
cagcuaaaagcau

SEQ ID NO: 2222473 - RNA, 15 nt, Streptococcus pyogenes MGAS315
cacugcagcaucaaa

SEQ ID NO: 2222474 - RNA, 19 nt, Streptococcus pyogenes MGAS315
cacugcagcaucaaaacca

SEQ ID NO: 2222475 - RNA, 14 nt, Streptococcus pyogenes MGAS315
cacuaccuuaaaug

SEQ ID NO: 2222476 - RNA, 20 nt, Streptococcus pyogenes MGAS315
cacuaggccuagcuuuuuac

SEQ ID NO: 2222477 - RNA, 13 nt, Streptococcus pyogenes MGAS315
cacuagaacucuu

SEQ ID NO: 2222478 - RNA, 15 nt, Streptococcus pyogenes MGAS315
cacuauuuugugacu

SEQ ID NO: 2222479 - RNA, 23 nt, Streptococcus pyogenes MGAS315
cagacaaaagggaagagagaagc

SEQ ID NO: 2222480 - RNA, 13 nt, Streptococcus pyogenes MGAS315
cagacucgucuuu

SEQ ID NO: 2222481 - RNA, 17 nt, Streptococcus pyogenes MGAS315
cagauaaaaccuucaaa

SEQ ID NO: 2222482 - RNA, 17 nt, Streptococcus pyogenes MGAS315
cagugcugcugaacugc

SEQ ID NO: 2222483 - RNA, 14 nt, Streptococcus pyogenes MGAS315
caguuaaaaauaac

SEQ ID NO: 2222484 - RNA, 20 nt, Streptococcus pyogenes MGAS315
caguuaaugccaacuuuuca

SEQ ID NO: 2222485 - RNA, 16 nt, Streptococcus pyogenes MGAS315
caguugauaccaugug

SEQ ID NO: 2222486 - RNA, 16 nt, Streptococcus pyogenes MGAS315
caguuucccauguuuu

SEQ ID NO: 2222487 - RNA, 20 nt, Streptococcus pyogenes MGAS315
cauacaacuggcuagccaaa

SEQ ID NO: 2222488 - RNA, 21 nt, Streptococcus pyogenes MGAS315
cauacaacuggcuagccaaau

SEQ ID NO: 2222489 - RNA, 22 nt, Streptococcus pyogenes MGAS315
cauacccgcguuaucuccacag

SEQ ID NO: 2222490 - RNA, 14 nt, Streptococcus pyogenes MGAS315
cauaacaaauuuau

SEQ ID NO: 2222491 - RNA, 16 nt, Streptococcus pyogenes MGAS315
cauaaccuuugccauu

SEQ ID NO: 2222492 - RNA, 21 nt, Streptococcus pyogenes MGAS315
caucaaaagaccauaaaaaac

SEQ ID NO: 2222493 - RNA, 20 nt, Streptococcus pyogenes MGAS315
caucaaaagaccauaaaaaa

SEQ ID NO: 2222494 - RNA, 12 nt, Streptococcus pyogenes MGAS315
caucaaaaccaa

SEQ ID NO: 2222495 - RNA, 19 nt, Streptococcus pyogenes MGAS315
cauauuagcaaaaugcugu

SEQ ID NO: 2222496 - RNA, 22 nt, Streptococcus pyogenes MGAS315
cauaucuucacgggcugccauu

SEQ ID NO: 2222497 - RNA, 18 nt, Streptococcus pyogenes MGAS315
caucaggcuuaaacauau

SEQ ID NO: 2222498 - RNA, 12 nt, Streptococcus pyogenes MGAS315
caucauauuguu

SEQ ID NO: 2222499 - RNA, 20 nt, Streptococcus pyogenes MGAS315
ccaagacuaaagcauuuauu

SEQ ID NO: 2222500 - RNA, 20 nt, Streptococcus pyogenes MGAS315
ccaagugccaguaaggaaau

SEQ ID NO: 2222501 - RNA, 14 nt, Streptococcus pyogenes MGAS315
caugggaaaagcua

SEQ ID NO: 2222502 - RNA, 12 nt, Streptococcus pyogenes MGAS315
cauggguaugcc

SEQ ID NO: 2222503 - RNA, 15 nt, Streptococcus pyogenes MGAS315
cauuaauaauauuaa

SEQ ID NO: 2222504 - RNA, 16 nt, Streptococcus pyogenes MGAS315
caugugaauucccauu

SEQ ID NO: 2222505 - RNA, 15 nt, Streptococcus pyogenes MGAS315
cauugccauuaauaa

SEQ ID NO: 2222506 - RNA, 13 nt, Streptococcus pyogenes MGAS315
cauugcuuuuuau

SEQ ID NO: 2222507 - RNA, 17 nt, Streptococcus pyogenes MGAS315
cauugucaaauaaaauc

SEQ ID NO: 2222508 - RNA, 13 nt, Streptococcus pyogenes MGAS315
cauuucuugaggu

SEQ ID NO: 2222509 - RNA, 12 nt, Streptococcus pyogenes MGAS315
cauuugaugagc

SEQ ID NO: 2222510 - RNA, 23 nt, Streptococcus pyogenes MGAS315
cauuuuacuauggcuucuaaaaa

SEQ ID NO: 2222511 - RNA, 14 nt, Streptococcus pyogenes MGAS315
ccaucaauuuucau

SEQ ID NO: 2222512 - RNA, 13 nt, Streptococcus pyogenes MGAS315
ccaucaaaaaaag

SEQ ID NO: 2222513 - RNA, 11 nt, Streptococcus pyogenes MGAS315
ccauagaagcc

SEQ ID NO: 2222514 - RNA, 21 nt, Streptococcus pyogenes MGAS315
ccauagaaauuguaaccacag

SEQ ID NO: 2222515 - RNA, 15 nt, Streptococcus pyogenes MGAS315
ccauagaagccaauu

SEQ ID NO: 2222516 - RNA, 18 nt, Streptococcus pyogenes MGAS315
aaacacuaccuuaaaugu

SEQ ID NO: 2222517 - RNA, 23 nt, Streptococcus pyogenes MGAS315
aaaccaagugccaguaaggaaau

SEQ ID NO: 2222518 - RNA, 23 nt, Streptococcus pyogenes MGAS315
aaaccaagucguuuagcuuuuuc

SEQ ID NO: 2222519 - RNA, 22 nt, Streptococcus pyogenes MGAS315
aaaccaagugccaguaaggaaa

SEQ ID NO: 2222520 - RNA, 22 nt, Streptococcus pyogenes MGAS315
ccuguagcccuuuuugccuuua

SEQ ID NO: 2222521 - RNA, 20 nt, Streptococcus pyogenes MGAS315
ccuuaggcagacaauuauuu

SEQ ID NO: 2222522 - RNA, 17 nt, Streptococcus pyogenes MGAS315
ccuucauagacaagcuu

SEQ ID NO: 2222523 - RNA, 22 nt, Streptococcus pyogenes MGAS315
ccuuuuuggugucagcauaaag

SEQ ID NO: 2222524 - RNA, 17 nt, Streptococcus pyogenes MGAS315
ccuuuuugccuuuaaca

SEQ ID NO: 2222525 - RNA, 18 nt, Streptococcus pyogenes MGAS315
ccuuuuuggugucagcau

SEQ ID NO: 2222526 - RNA, 17 nt, Streptococcus pyogenes MGAS315
ccuuugaccacacgauu

SEQ ID NO: 2222527 - RNA, 17 nt, Streptococcus pyogenes MGAS315
ccugaucccuucauuuu

SEQ ID NO: 2222528 - RNA, 12 nt, Streptococcus pyogenes MGAS315
ccgugaggacuu

SEQ ID NO: 2222529 - RNA, 13 nt, Streptococcus pyogenes MGAS315
ccucuaacaccaa

SEQ ID NO: 2222530 - RNA, 17 nt, Streptococcus pyogenes MGAS315
ccgcuaaaacaguucca

SEQ ID NO: 2222531 - RNA, 15 nt, Streptococcus pyogenes MGAS315
ccggcucuaaaauau

SEQ ID NO: 2222532 - RNA, 16 nt, Streptococcus pyogenes MGAS315
aaaccuucaaaaaagg

SEQ ID NO: 2222533 - RNA, 18 nt, Streptococcus pyogenes MGAS315
aaacguguauucuuaaaa

SEQ ID NO: 2222534 - RNA, 21 nt, Streptococcus pyogenes MGAS315
cgauuugcugagcuaaagcca

SEQ ID NO: 2222535 - RNA, 17 nt, Streptococcus pyogenes MGAS315
cgauaaucuuugacaau

SEQ ID NO: 2222536 - RNA, 14 nt, Streptococcus pyogenes MGAS315
cgauaaaacaaaua

SEQ ID NO: 2222537 - RNA, 14 nt, Streptococcus pyogenes MGAS315
cgcuaaaacaguuc

SEQ ID NO: 2222538 - RNA, 10 nt, Human
uaaaauggug

SEQ ID NO: 2222539 - RNA, 20 nt, Human
uauauuuacaaaugggaaac

SEQ ID NO: 2222540 - RNA, 16 nt, Human
ucauggaauuggagcu

SEQ ID NO: 2222541 - RNA, 12 nt, Human
ugauaugccuuu

SEQ ID NO: 2222542 - RNA, 15 nt, Human
cgaggauugggaaaa

SEQ ID NO: 2222543 - RNA, 16 nt, Human
uucucaacuccaaacu

SEQ ID NO: 2222544 - RNA, 14 nt, Human
gaaagcagggacuu

SEQ ID NO: 2222545 - RNA, 14 nt, Human
gaaacacaacuaua

SEQ ID NO: 2222546 - RNA, 21 nt, Human
gauuuuccugaaaacccuugc

SEQ ID NO: 2222547 - RNA, 14 nt, Human
gcagauaaacagua

SEQ ID NO: 2222548 - RNA, 19 nt, Human
aagggaauuucuucaacuc

SEQ ID NO: 2222549 - RNA, 15 nt, Human
aagugaaaaucuaca

SEQ ID NO: 2222550 - RNA, 15 nt, Human
aacaauaacgauaaa

SEQ ID NO: 2222551 - RNA, 22 nt, Human
aagaagcaccaaucaugaauua

SEQ ID NO: 2222552 - RNA, 16 nt, Human
accuagggugauauua

SEQ ID NO: 2222553 - RNA, 16 nt, Human
acacuuaaaaaugguu

SEQ ID NO: 2222554 - RNA, 22 nt, Human
acaauaacgauaaaagacagug

SEQ ID NO: 2222555 - RNA, 16 nt, Human
agugccuguaaucaca

SEQ ID NO: 2222556 - RNA, 16 nt, Human
agaacucccuuucaac

SEQ ID NO: 2222557 - RNA, 16 nt, Human
cacaauacaucccuua

SEQ ID NO: 2222558 - RNA, 20 nt, Human
caauaacgauaaaagacagu

SEQ ID NO: 2222559 - RNA, 22 nt, Human
cauauuuguacaccaauauuca

SEQ ID NO: 2222560 - RNA, 18 nt, Human
caugauccugcaauucca

SEQ ID NO: 2222561 - RNA, 15 nt, Human
ccuuaccugggaaag

SEQ ID NO: 2222562 - RNA, 14 nt, Human
cgauaaaagacagu

SEQ ID NO: 2222563 - RNA, 16 nt, Human
uaagcuucacuguaaa

SEQ ID NO: 2222564 - RNA, 21 nt, Human
uaacgaaguauccuucagccu

SEQ ID NO: 2222565 - RNA, 13 nt, Human
uaaaguacaagag

SEQ ID NO: 2222566 - RNA, 16 nt, Human
uccagauccuggaaau

SEQ ID NO: 2222567 - RNA, 14 nt, Human
ugagaugcuagaac

SEQ ID NO: 2222568 - RNA, 16 nt, Human
uuuguaguguuggaga

SEQ ID NO: 2222569 - RNA, 14 nt, Human
ucugcacacagcac

SEQ ID NO: 2222570 - RNA, 14 nt, Human
uaauuccacagcug

SEQ ID NO: 2222571 - RNA, 18 nt, Human
gucaauaaaauccauaca

SEQ ID NO: 2222572 - RNA, 16 nt, Human
gucacauuccaagccu

SEQ ID NO: 2222573 - RNA, 17 nt, Human
guacuucaaauccuuga

SEQ ID NO: 2222574 - RNA, 19 nt, Human
aaagaaugauuaugaauua

SEQ ID NO: 2222575 - RNA, 14 nt, Human
aauaaaguacaaga

SEQ ID NO: 2222576 - RNA, 16 nt, Human
acacagauuugagcuc

SEQ ID NO: 2222577 - RNA, 19 nt, Human
acaaauuuacagagacaga

SEQ ID NO: 2222578 - RNA, 16 nt, Human
aaugauaacuggaaac

SEQ ID NO: 2222579 - RNA, 18 nt, Human
aaugccacuaaauugaca

SEQ ID NO: 2222580 - RNA, 19 nt, Human
aauuccacuuauaggaauu

SEQ ID NO: 2222581 - RNA, 14 nt, Human
aaaauaacgauaaa

SEQ ID NO: 2222582 - RNA, 16 nt, Human
aaacaaggaugaauua

SEQ ID NO: 2222583 - RNA, 15 nt, Human
aaacauccuacaaga

SEQ ID NO: 2222584 - RNA, 13 nt, Human
aaugaauggcuaa

SEQ ID NO: 2222585 - RNA, 11 nt, Human
aggauggcuag

SEQ ID NO: 2222586 - RNA, 15 nt, Human
aguuuagcuggaaaa

SEQ ID NO: 2222587 - RNA, 13 nt, Human
auaaaagacagug

SEQ ID NO: 2222588 - RNA, 14 nt, Human
acauccuacaagac

SEQ ID NO: 2222589 - RNA, 15 nt, Human
agcauuccaacuauc

SEQ ID NO: 2222590 - RNA, 15 nt, Human
aggacacugauaugg

SEQ ID NO: 2222591 - RNA, 11 nt, Human
aguugauaugc

SEQ ID NO: 2222592 - RNA, 19 nt, Human
aucaugaauuaguuuuaua

SEQ ID NO: 2222593 - RNA, 15 nt, Human
auaugggucuugaua

SEQ ID NO: 2222594 - RNA, 20 nt, Human
aguuguaccgcaaugugacu

SEQ ID NO: 2222595 - RNA, 15 nt, Human
augaagaaguugaua

SEQ ID NO: 2222596 - RNA, 13 nt, Human
augggaagugacg

SEQ ID NO: 2222597 - RNA, 20 nt, Human
cccagaaugaccuggccgca

SEQ ID NO: 2222598 - RNA, 20 nt, Human
cccagaucaagccugccuca

SEQ ID NO: 2222599 - RNA, 17 nt, Human
cagucugacuguuucca

SEQ ID NO: 2222600 - RNA, 15 nt, Human
caaacugacucuuaa

SEQ ID NO: 2222601 - RNA, 14 nt, Human
cagauccuggaaau

SEQ ID NO: 2222602 - RNA, 17 nt, Human
cagauuuuccugaaaac

SEQ ID NO: 2222603 - RNA, 14 nt, Human
cacagccucuuaga

SEQ ID NO: 2222604 - RNA, 12 nt, Human
caguuguugccc

SEQ ID NO: 2222605 - RNA, 12 nt, Human
gcacuccagccu

SEQ ID NO: 2222606 - RNA, 13 nt, Human
gcagaagacagua

SEQ ID NO: 2222607 - RNA, 18 nt, Human
gcuccacuuggucuguga

SEQ ID NO: 2222608 - RNA, 15 nt, Human
ggccuccauccugag

SEQ ID NO: 2222609 - RNA, 18 nt, Human
ucuucaacucccugcccc

SEQ ID NO: 2222610 - RNA, 22 nt, Human
ugguuguauuauuuuuuaaaaa

SEQ ID NO: 2222611 - RNA, 14 nt, Human
ggaaacuccacauc

SEQ ID NO: 2222612 - RNA, 22 nt, Human
gucucuacuaaaaauacaaaaa

SEQ ID NO: 2222613 - RNA, 18 nt, Human
gaaacaaaaggauaauga

SEQ ID NO: 2222614 - RNA, 23 nt, Human
uccagguagaggguguguaagua

SEQ ID NO: 2222615 - RNA, 21 nt, Human
cucuaucccaaccucucccaa

SEQ ID NO: 2222616 - RNA, 13 nt, Human
aaauccuugaaga

SEQ ID NO: 2222617 - RNA, 14 nt, Human
uaauccuaaacaua

SEQ ID NO: 2222618 - RNA, 23 nt, Human
agucccagaucaagccugccuca

SEQ ID NO: 2222619 - RNA, 15 nt, Human
cucguggaacaguua

SEQ ID NO: 2222620 - RNA, 15 nt, Human
agacaaggaaaaaau

SEQ ID NO: 2222621 - RNA, 15 nt, Human
ugauuucauucaaua

SEQ ID NO: 2222622 - RNA, 18 nt, Human
cugagggcauagaaguaa

SEQ ID NO: 2222623 - RNA, 21 nt, Human
auccugugggaccugggccau

SEQ ID NO: 2222624 - RNA, 18 nt, Human
auagggagggaaggggga

SEQ ID NO: 2222625 - RNA, 21 nt, Human
gaaaugaguuuuucuuuucau

SEQ ID NO: 2222626 - RNA, 19 nt, Human
ccucagcugccuccccagc

SEQ ID NO: 2222627 - RNA, 23 nt, Human
cucauguccacugguucuucuug

SEQ ID NO: 2222628 - RNA, 21 nt, Human
aaauaauuuuuauauuugaaa

SEQ ID NO: 2222629 - RNA, 17 nt, Human
gcuucucauccugcagg

SEQ ID NO: 2222630 - RNA, 20 nt, Human
uccagccugagcgacaguga

SEQ ID NO: 2222631 - RNA, 13 nt, Human
cagucugaugaga

SEQ ID NO: 2222632 - RNA, 17 nt, Human
auuauuuuuuaaaaaaa

SEQ ID NO: 2222633 - RNA, 18 nt, Human
cagauuugagcucagccc

SEQ ID NO: 2222634 - RNA, 21 nt, Human
ugaugcuacaggauuugaaau

SEQ ID NO: 2222635 - RNA, 14 nt, Human
aacaccucagcugc

SEQ ID NO: 2222636 - RNA, 14 nt, Human
cagugaaagaaaau

SEQ ID NO: 2222637 - RNA, 12 nt, Human
ccccugggacca

SEQ ID NO: 2222638 - RNA, 18 nt, Human
agagaaugagagacacac

SEQ ID NO: 2222639 - RNA, 21 nt, Human
aaaauuuuuucucuaggaaau

SEQ ID NO: 2222640 - RNA, 20 nt, Human
acggacgaaccuugaaaacu

SEQ ID NO: 2222641 - RNA, 14 nt, Human
uauguauauuuuau

SEQ ID NO: 2222642 - RNA, 17 nt, Human
gccuccuuuuaaaguaa

SEQ ID NO: 2222643 - RNA, 15 nt, Human
caagcucacagaccu

SEQ ID NO: 2222644 - RNA, 23 nt, Human
ccuuuguugcuaucaauccaaga

SEQ ID NO: 2222645 - RNA, 21 nt, Human
uuuauagccagguaccuucuc

SEQ ID NO: 2222646 - RNA, 22 nt, Human
agaaugagagacacacugaaga

SEQ ID NO: 2222647 - RNA, 16 nt, Human
cugcugagucccaggc

SEQ ID NO: 2222648 - RNA, 19 nt, Human
cagcuuuuucucucccacu

SEQ ID NO: 2222649 - RNA, 18 nt, Human
gcacuccagccugagcga

SEQ ID NO: 2222650 - RNA, 20 nt, Human
gccgggcgugguggugagug

SEQ ID NO: 2222651 - RNA, 21 nt, Human
auccccaagccuggcaaggga

SEQ ID NO: 2222652 - RNA, 13 nt, Human
agaaaugaaagca

SEQ ID NO: 2222653 - RNA, 17 nt, Human
uugccaaauauaaauaa

SEQ ID NO: 2222654 - RNA, 23 nt, Human
gauagauaggucagugcaaauac

SEQ ID NO: 2222655 - RNA, 13 nt, Human
caacucccugccc

SEQ ID NO: 2222656 - RNA, 21 nt, Human
aggguuaugauuaaguaauga

SEQ ID NO: 2222657 - RNA, 16 nt, Human
ccuccuuaucaaagga

SEQ ID NO: 2222658 - RNA, 14 nt, Human
auauuuauuuuaau

SEQ ID NO: 2222659 - RNA, 16 nt, Human
aucaagccugccucaa

SEQ ID NO: 2222660 - RNA, 15 nt, Human
uaucaauuuaaaaaa

SEQ ID NO: 2222661 - RNA, 16 nt, Human
gcuucacuguaaaaua

SEQ ID NO: 2222662 - RNA, 11 nt, Human
cgauaaaagac

SEQ ID NO: 2222663 - RNA, 14 nt, Human
aaaauacaaaaaaa

SEQ ID NO: 2222664 - RNA, 22 nt, Human
agaccaaauugagcuagggggg

SEQ ID NO: 2222665 - RNA, 19 nt, Human
guacaagagcuuaacagug

SEQ ID NO: 2222666 - RNA, 13 nt, Human
agguaccagccuu

SEQ ID NO: 2222667 - RNA, 18 nt, Human
uaaugaauacuuuauaaa

SEQ ID NO: 2222668 - RNA, 19 nt, Human
gccauagucauucugccug

SEQ ID NO: 2222669 - RNA, 17 nt, Human
agccuuggauacuccau

SEQ ID NO: 2222670 - RNA, 20 nt, Human
accuuuugcuguggcaaaug

SEQ ID NO: 2222671 - RNA, 21 nt, Human
cagcucuaucccaaccucucc

SEQ ID NO: 2222672 - RNA, 12 nt, Human
ucaauaaaacuu

SEQ ID NO: 2222673 - RNA, 22 nt, Human
gugucuggcguuguggggauga

SEQ ID NO: 2222674 - RNA, 14 nt, Human
ugcucauggaauug

SEQ ID NO: 2222675 - RNA, 16 nt, Human
guuuuguuucuuccuu

SEQ ID NO: 2222676 - RNA, 19 nt, Human
ccugccuaagugcagcccc

SEQ ID NO: 2222677 - RNA, 14 nt, Human
aaauauuauuuuau

SEQ ID NO: 2222678 - RNA, 13 nt, Human
acuguaaaauaau

SEQ ID NO: 2222679 - RNA, 12 nt, Human
ucaccccuugcc

SEQ ID NO: 2222680 - RNA, 17 nt, Human
uuuccacauucagagcu

SEQ ID NO: 2222681 - RNA, 20 nt, Human
ugagagugaacaaauuuaca

SEQ ID NO: 2222682 - RNA, 18 nt, Human
cugcucaauaaaguacaa

SEQ ID NO: 2222683 - RNA, 13 nt, Human
cuugccugcaggc

SEQ ID NO: 2222684 - RNA, 23 nt, Human
auaauguguucauucuggaauaa

SEQ ID NO: 2222685 - RNA, 20 nt, Human
aaggaugccccgucccccuc

SEQ ID NO: 2222686 - RNA, 13 nt, Human
ccuccuuuuaaag

SEQ ID NO: 2222687 - RNA, 19 nt, Human
cagcuacuugggaggcuga

SEQ ID NO: 2222688 - RNA, 12 nt, Human
aauuuaaauaua

SEQ ID NO: 2222689 - RNA, 20 nt, Human
acagcccuucuuuccacaga

SEQ ID NO: 2222690 - RNA, 17 nt, Human
aaauauaaauaaaaaua

SEQ ID NO: 2222691 - RNA, 15 nt, Human
ggauacuccaugggg

SEQ ID NO: 2222692 - RNA, 15 nt, Human
uugacccacaagaaa

SEQ ID NO: 2222693 - RNA, 12 nt, Human
cuugguuuuaau

SEQ ID NO: 2222694 - RNA, 17 nt, Human
agcucuaucccaaccuc

SEQ ID NO: 2222695 - RNA, 16 nt, Human
acuaaacaaagaguga

SEQ ID NO: 2222696 - RNA, 17 nt, Human
agagacagaaagcagaa

SEQ ID NO: 2222697 - RNA, 18 nt, Human
guauuauuuuuuaaaaaa

SEQ ID NO: 2222698 - RNA, 14 nt, Human
uuaugauuaaguaa

SEQ ID NO: 2222699 - RNA, 11 nt, Human
auuuuugaagc

SEQ ID NO: 2222700 - RNA, 15 nt, Human
cugcacuccagccug

SEQ ID NO: 2222701 - RNA, 23 nt, Human
uuuccaucaaggguacacugccu

SEQ ID NO: 2222702 - RNA, 21 nt, Human
gaagugaaaaucuacacucca

SEQ ID NO: 2222703 - RNA, 17 nt, Human
aggguguguaaguagau

SEQ ID NO: 2222704 - RNA, 20 nt, Human
cccugccccccagcccuccu

SEQ ID NO: 2222705 - RNA, 14 nt, Human
auccaaugaaauga

SEQ ID NO: 2222706 - RNA, 20 nt, Human
uaugaaaaggcuaagcuuca

SEQ ID NO: 2222707 - RNA, 12 nt, Human
aguguuugaaag

SEQ ID NO: 2222708 - RNA, 17 nt, Human
aagcuuuuuuugaauca

SEQ ID NO: 2222709 - RNA, 15 nt, Human
aaugaauggcuaagc

SEQ ID NO: 2222710 - RNA, 19 nt, Human
aaauggugaaaugcagagu

SEQ ID NO: 2222711 - RNA, 13 nt, Human
acagcccuucuuu

SEQ ID NO: 2222712 - RNA, 14 nt, Human
gaaugauuaugaau

SEQ ID NO: 2222713 - RNA, 22 nt, Human
aaccuacacgagauacagaauu

SEQ ID NO: 2222714 - RNA, 20 nt, Human
uuguagguaauauugcaagg

SEQ ID NO: 2222715 - RNA, 16 nt, Human
cagaucaagccugccu

SEQ ID NO: 2222716 - RNA, 19 nt, Human
ucccagaucaagccugccu

SEQ ID NO: 2222717 - RNA, 22 nt, Human
aauaugccccauucaacaucua

SEQ ID NO: 2222718 - RNA, 12 nt, Human
acaugagguacu

SEQ ID NO: 2222719 - RNA, 22 nt, Human
ccccuuccuaauuccacagcug

SEQ ID NO: 2222720 - RNA, 19 nt, Human
ucaguuauuauauuuacaa

SEQ ID NO: 2222721 - RNA, 14 nt, Human
ggccuucggccucc

SEQ ID NO: 2222722 - RNA, 16 nt, Human
gacaaggaaaaaauaa

SEQ ID NO: 2222723 - RNA, 22 nt, Human
cugagcggaccuucccagcuag

SEQ ID NO: 2222724 - RNA, 22 nt, Human
gcuucucauccugcaggcagcu

SEQ ID NO: 2222725 - RNA, 20 nt, Human
aauuaaguuuuuuuuuaaaa

SEQ ID NO: 2222726 - RNA, 20 nt, Human
caaacauccuacaagacaca

SEQ ID NO: 2222727 - RNA, 19 nt, Human
cuuccagauccuggaaauc

SEQ ID NO: 2222728 - RNA, 21 nt, Human
auuuacaaaugggaaacaaaa

SEQ ID NO: 2222729 - RNA, 15 nt, Human
aagaagugaaaaucu

SEQ ID NO: 2222730 - RNA, 23 nt, Human
uugccugcaggcaugagucaguc

SEQ ID NO: 2222731 - RNA, 15 nt, Human
agaauaccacaggaa

SEQ ID NO: 2222732 - RNA, 14 nt, Human
ugcuguauuuuaaa

SEQ ID NO: 2222733 - RNA, 13 nt, Human
caauccaagaacu

SEQ ID NO: 2222734 - RNA, 23 nt, Human
cuucaacucccugccccccagcc

SEQ ID NO: 2222735 - RNA, 19 nt, Human
acagucaccucauggaauu

SEQ ID NO: 2222736 - RNA, 16 nt, Human
cagcuuuccucaaaac

SEQ ID NO: 2222737 - RNA, 16 nt, Human
caugggacagggagga

SEQ ID NO: 2222738 - RNA, 22 nt, Human
uuugaaacgaggauugggaaaa

SEQ ID NO: 2222739 - RNA, 20 nt, Human
cuacuuccccuuccuaauuc

SEQ ID NO: 2222740 - RNA, 16 nt, Human
cuagaaccaccugccu

SEQ ID NO: 2222741 - RNA, 23 nt, Human
gaaaaucuuauaauuuaaaauau

SEQ ID NO: 2222742 - RNA, 15 nt, Human
aucaaaggacaccau

SEQ ID NO: 2222743 - RNA, 15 nt, Human
acagugaaagaaaau

SEQ ID NO: 2222744 - RNA, 23 nt, Human
aggcacccccagaaugaccuggc

SEQ ID NO: 2222745 - RNA, 15 nt, Human
aaaaaagaaacauuu

SEQ ID NO: 2222746 - RNA, 12 nt, Human
aaugcagccccc

SEQ ID NO: 2222747 - RNA, 20 nt, Human
uuuaguaagagauuccugag

SEQ ID NO: 2222748 - RNA, 21 nt, Human
aggauggcaggaggcauccaa

SEQ ID NO: 2222749 - RNA, 16 nt, Human
ucaaaagaaagaaaau

SEQ ID NO: 2222750 - RNA, 22 nt, Human
ucuccagagggaauugcagagu

SEQ ID NO: 2222751 - RNA, 15 nt, Human
acaggguuuauguuu

SEQ ID NO: 2222752 - RNA, 16 nt, Human
agggaggacgcucucu

SEQ ID NO: 2222753 - RNA, 20 nt, Human
agcuuauugucuagugaaac

SEQ ID NO: 2222754 - RNA, 14 nt, Human
gugagcuacaaaug

SEQ ID NO: 2222755 - RNA, 20 nt, Human
aaaaaccugagccccaaaag

SEQ ID NO: 2222756 - RNA, 15 nt, Human
gccucagucucccuc

SEQ ID NO: 2222757 - RNA, 22 nt, Human
caaggaugccccgucccccucu

SEQ ID NO: 2222758 - RNA, 15 nt, Human
acaagacccaaaagg

SEQ ID NO: 2222759 - RNA, 21 nt, Human
cuuguuggacgagaaaacaau

SEQ ID NO: 2222760 - RNA, 16 nt, Human
ugacaagcucacagac

SEQ ID NO: 2222761 - RNA, 12 nt, Human
acacuuaaaaau

SEQ ID NO: 2222762 - RNA, 20 nt, Human
cacagcacgggggccaagga

SEQ ID NO: 2222763 - RNA, 13 nt, Human
aucaaugaaugaa

SEQ ID NO: 2222764 - RNA, 15 nt, Human
aguucugaagaagau

SEQ ID NO: 2222765 - RNA, 20 nt, Human
acuucuuaggguuaugauua

SEQ ID NO: 2222766 - RNA, 16 nt, Human
cuugccugcaggcaug

SEQ ID NO: 2222767 - RNA, 23 nt, Human
cagccagcccucuucugacacua

SEQ ID NO: 2222768 - RNA, 12 nt, Human
gaagaccucauu

SEQ ID NO: 2222769 - RNA, 18 nt, Human
agcugccuccccagcucu

SEQ ID NO: 2222770 - RNA, 21 nt, Human
gucucagugucaaugcagccc

SEQ ID NO: 2222771 - RNA, 19 nt, Human
cgcccacuagacccacugg

SEQ ID NO: 2222772 - RNA, 21 nt, Human
auauaugcuaagucuuauaua

SEQ ID NO: 2222773 - RNA, 17 nt, Human
ugaaggauuuauguuua

SEQ ID NO: 2222774 - RNA, 21 nt, Human
auguuuacagauccccaagcc

SEQ ID NO: 2222775 - RNA, 20 nt, Human
auaagccagacaucaacaga

SEQ ID NO: 2222776 - RNA, 18 nt, Human
gcugagcccggaaacucc

SEQ ID NO: 2222777 - RNA, 13 nt, Human
auaacgauaaaag

SEQ ID NO: 2222778 - RNA, 22 nt, Human
accccugagcuugcagagauga

SEQ ID NO: 2222779 - RNA, 19 nt, Human
uggugaacuugguuuuaau

SEQ ID NO: 2222780 - RNA, 21 nt, Human
ucaagucuuucacauuuaaau

SEQ ID NO: 2222781 - RNA, 14 nt, Human
guauuuuaaaagaa

SEQ ID NO: 2222782 - RNA, 21 nt, Human
ugaccauacuaauuauacccc

SEQ ID NO: 2222783 - RNA, 13 nt, Human
cccuccuuaucaa

SEQ ID NO: 2222784 - RNA, 14 nt, Human
cuggaaaucagggu

SEQ ID NO: 2222785 - RNA, 22 nt, Human
ccacuuggacaugggccccaga

SEQ ID NO: 2222786 - RNA, 12 nt, Human
auccugugggac

SEQ ID NO: 2222787 - RNA, 20 nt, Human
uccaagccucauguccacug

SEQ ID NO: 2222788 - RNA, 15 nt, Human
ccccagaaugaccug

SEQ ID NO: 2222789 - RNA, 18 nt, Human
uggagggaagccuugggg

SEQ ID NO: 2222790 - RNA, 13 nt, Human
uaacaauaaaaga

SEQ ID NO: 2222791 - RNA, 23 nt, Human
acgaggauugggaaaaaguaauu

SEQ ID NO: 2222792 - RNA, 19 nt, Human
cucugccucagaaaacaag

SEQ ID NO: 2222793 - RNA, 21 nt, Human
augcuacaggauuugaaauug

SEQ ID NO: 2222794 - RNA, 20 nt, Human
acaugagguacugagaguga

SEQ ID NO: 2222795 - RNA, 15 nt, Human
uccuacaagacacag

SEQ ID NO: 2222796 - RNA, 23 nt, Human
ucuuagaugcaguucugaagaag

SEQ ID NO: 2222797 - RNA, 16 nt, Human
cauagucauucugccu

SEQ ID NO: 2222798 - RNA, 21 nt, Human
aaaauaugccccauucaacau

SEQ ID NO: 2222799 - RNA, 21 nt, Human
gacagucaccucauggaauug

SEQ ID NO: 2222800 - RNA, 21 nt, Human
caagacccaaaaggcagaagc

SEQ ID NO: 2222801 - RNA, 20 nt, Human
uuaacacaugauccugcaau

SEQ ID NO: 2222802 - RNA, 23 nt, Human
aauauuuauuuuaauaauguuuc

SEQ ID NO: 2222803 - RNA, 20 nt, Human
acuccagugagacagcucug

SEQ ID NO: 2222804 - RNA, 24 nt, Human
aacuauaaaacuaggugcugcagc

SEQ ID NO: 2222805 - RNA, 13 nt, Human
aacuauaaaacua

SEQ ID NO: 2222806 - RNA, 13 nt, Human
uaacgauaaaaga

SEQ ID NO: 2222807 - RNA, 11 nt, Human
ucaccugcccu

SEQ ID NO: 2222808 - RNA, 18 nt, Human
uaaauugacacuuaaaaa

SEQ ID NO: 2222809 - RNA, 17 nt, Human
gaagaccucauuuugaa

SEQ ID NO: 2222810 - RNA, 23 nt, Human
aauauugcaaggcaaagacuauu

SEQ ID NO: 2222811 - RNA, 17 nt, Human
uccaaaggcuccugaga

SEQ ID NO: 2222812 - RNA, 13 nt, Human
ucuaagaagugaa

SEQ ID NO: 2222813 - RNA, 15 nt, Human
aaaauaacaaugaaa

SEQ ID NO: 2222814 - RNA, 23 nt, Human
aacuuguaaaggaauuuaaaaau

SEQ ID NO: 2222815 - RNA, 19 nt, Human
uccauccugaggcuccacu

SEQ ID NO: 2222816 - RNA, 14 nt, Human
uugccaugugcuag

SEQ ID NO: 2222817 - RNA, 16 nt, Human
gacauagaauuaacac

SEQ ID NO: 2222818 - RNA, 19 nt, Human
agcagcuuauucacaagac

SEQ ID NO: 2222819 - RNA, 20 nt, Human
agcccuggugggcagagagg

SEQ ID NO: 2222820 - RNA, 16 nt, Human
ugcuguauuuuaaaag

SEQ ID NO: 2222821 - RNA, 23 nt, Human
ggccuccauccugaggcuccacu

SEQ ID NO: 2222822 - RNA, 15 nt, Human
aggauggcaggaggc

SEQ ID NO: 2222823 - RNA, 13 nt, Human
ucagccagcccuc

SEQ ID NO: 2222824 - RNA, 22 nt, Human
ugccugagcggaccuucccagc

SEQ ID NO: 2222825 - RNA, 17 nt, Human
cuaucucauuuccaagc

SEQ ID NO: 2222826 - RNA, 21 nt, Human
auaauuuuuauauuugaaaua

SEQ ID NO: 2222827 - RNA, 18 nt, Human
acugccuucucaacucca

SEQ ID NO: 2222828 - RNA, 15 nt, Human
aauacuuuauaaagg

SEQ ID NO: 2222829 - RNA, 13 nt, Human
ugggaggcugaga

SEQ ID NO: 2222830 - RNA, 15 nt, Human
uggacgagaaaacaa

SEQ ID NO: 2222831 - RNA, 16 nt, Human
auccaaugaaaugagu

SEQ ID NO: 2222832 - RNA, 13 nt, Human
ccucccccaucuc

SEQ ID NO: 2222833 - RNA, 14 nt, Human
gaaggcuuacaccc

SEQ ID NO: 2222834 - RNA, 22 nt, Human
uugaaaaucuuauaauuuaaaa

SEQ ID NO: 2222835 - RNA, 17 nt, Human
ucucuggccuucggccu

SEQ ID NO: 2222836 - RNA, 16 nt, Human
uucuauaauuuaaaua

SEQ ID NO: 2222837 - RNA, 13 nt, Human
aaauaaaaauaau

SEQ ID NO: 2222838 - RNA, 17 nt, Human
ucauauuuauagccagg

SEQ ID NO: 2222839 - RNA, 14 nt, Human
ugaaagucccagau

SEQ ID NO: 2222840 - RNA, 16 nt, Human
caaaaggauaaugaau

SEQ ID NO: 2222841 - RNA, 17 nt, Human
gccuaagugcagccccg

SEQ ID NO: 2222842 - RNA, 23 nt, Human
cccacuggacucaccucccccau

SEQ ID NO: 2222843 - RNA, 22 nt, Human
caugaguaacugauuuguaaca

SEQ ID NO: 2222844 - RNA, 20 nt, Human
cagugaaagaaaauaacgau

SEQ ID NO: 2222845 - RNA, 22 nt, Human
caccucccccaucucuucuggg

SEQ ID NO: 2222846 - RNA, 15 nt, Human
aaggaaaaaauaaca

SEQ ID NO: 2222847 - RNA, 17 nt, Human
uaacugauuuguaacaa

SEQ ID NO: 2222848 - RNA, 20 nt, Human
auaacaaugcuguauuuuaa

SEQ ID NO: 2222849 - RNA, 19 nt, Human
cacauccugugggaccugg

SEQ ID NO: 2222850 - RNA, 22 nt, Human
gaggcggauugagaaggagcuc

SEQ ID NO: 2222851 - RNA, 22 nt, Human
uauagccagguaccuucucacc

SEQ ID NO: 2222852 - RNA, 15 nt, Human
agucaccucauggaa

SEQ ID NO: 2222853 - RNA, 14 nt, Human
accacaagacugca

SEQ ID NO: 2222854 - RNA, 14 nt, Human
cuggagcucugccc

SEQ ID NO: 2222855 - RNA, 23 nt, Human
auguuaaaacugggacaggggag

SEQ ID NO: 2222856 - RNA, 19 nt, Human
gacagucaccucauggaau

SEQ ID NO: 2222857 - RNA, 19 nt, Human
cuugccugcaggcaugagu

SEQ ID NO: 2222858 - RNA, 13 nt, Human
uuuugaaucauca

SEQ ID NO: 2222859 - RNA, 17 nt, Human
uaacgauaaaagacagu

SEQ ID NO: 2222860 - RNA, 18 nt, Human
uuuugugaagcaaaauuu

SEQ ID NO: 2222861 - RNA, 14 nt, Human
uacuaauuuuaaaa

SEQ ID NO: 2222862 - RNA, 15 nt, Human
uaacgauaaaagaca

SEQ ID NO: 2222863 - RNA, 13 nt, Human
gacaaggaaaaaa

SEQ ID NO: 2222864 - RNA, 13 nt, Human
ucauccugcaggc

SEQ ID NO: 2222865 - RNA, 14 nt, Human
augaacuuuuuguu

SEQ ID NO: 2222866 - RNA, 14 nt, Human
cugucucaguccau

SEQ ID NO: 2222867 - RNA, 23 nt, Human
gucucccucccuuggggccuaug

SEQ ID NO: 2222868 - RNA, 21 nt, Human
ugaacaaauuuacagagacag

SEQ ID NO: 2222869 - RNA, 18 nt, Human
cccucuucugacacuaaa

SEQ ID NO: 2222870 - RNA, 15 nt, Human
gugaccacugcagaa

SEQ ID NO: 2222871 - RNA, 19 nt, Human
cccacuggacucaccuccc

SEQ ID NO: 2222872 - RNA, 13 nt, Human
auugauuauaugu

SEQ ID NO: 2222873 - RNA, 23 nt, Human
gggaaacaaaaggauaaugaaua

SEQ ID NO: 2222874 - RNA, 15 nt, Human
aucuuauaauuuaaa

SEQ ID NO: 2222875 - RNA, 19 nt, Human
ugcccugaaagucccagau

SEQ ID NO: 2222876 - RNA, 14 nt, Human
cugcugagucccag

SEQ ID NO: 2222877 - RNA, 20 nt, Human
uuugcaagccagauuuuccu

SEQ ID NO: 2222878 - RNA, 14 nt, Human
ccacauccuguggg

SEQ ID NO: 2222879 - RNA, 19 nt, Human
cuggacucaccucccccau

SEQ ID NO: 2222880 - RNA, 22 nt, Human
gaacuuuccacauucagagcuu

SEQ ID NO: 2222881 - RNA, 18 nt, Human
auuuuuagugaaauauua

SEQ ID NO: 2222882 - RNA, 15 nt, Human
aaauaauuuuuauau

SEQ ID NO: 2222883 - RNA, 20 nt, Human
uguaaaggaauuuaaaaauc

SEQ ID NO: 2222884 - RNA, 22 nt, Human
aaacauccuacaagacacagug

SEQ ID NO: 2222885 - RNA, 16 nt, Human
agcuugaaaccuucac

SEQ ID NO: 2222886 - RNA, 14 nt, Human
auacaaaaaaaaaa

SEQ ID NO: 2222887 - RNA, 18 nt, Human
cuucucacauuuauauuu

SEQ ID NO: 2222888 - RNA, 15 nt, Human
guuuuucuuuucauu

SEQ ID NO: 2222889 - RNA, 19 nt, Human
ggagccugaucaccugccc

SEQ ID NO: 2222890 - RNA, 19 nt, Human
auacuaauuauacccccug

SEQ ID NO: 2222891 - RNA, 15 nt, Human
ccucagucucccucc

SEQ ID NO: 2222892 - RNA, 18 nt, Human
cuuugagcgcccacuaga

SEQ ID NO: 2222893 - RNA, 16 nt, Human
cuuuaugcuaagugaa

SEQ ID NO: 2222894 - RNA, 21 nt, Human
auuuuaguaagagauuccuga

SEQ ID NO: 2222895 - RNA, 14 nt, Human
uucuaugaaauauu

SEQ ID NO: 2222896 - RNA, 21 nt, Human
acagugauuaccagggacuga

SEQ ID NO: 2222897 - RNA, 18 nt, Human
ucuaugaaauauuauguu

SEQ ID NO: 2222898 - RNA, 22 nt, Human
aucaccaaggcugauuaaacca

SEQ ID NO: 2222899 - RNA, 13 nt, Human
uauuuauuuuaau

SEQ ID NO: 2222900 - RNA, 15 nt, Human
uacuaauuuuaaaau

SEQ ID NO: 2222901 - RNA, 12 nt, Human
auucugaaagca

SEQ ID NO: 2222902 - RNA, 13 nt, Human
acuauaaaacuag

SEQ ID NO: 2222903 - RNA, 14 nt, Human
ucuaucccaaccuc

SEQ ID NO: 2222904 - RNA, 19 nt, Human
agucaaugaacuuuccaca

SEQ ID NO: 2222905 - RNA, 12 nt, Human
gaauuggagcuc

SEQ ID NO: 2222906 - RNA, 21 nt, Human
aacuuguaaaggaauuuaaaa

SEQ ID NO: 2222907 - RNA, 16 nt, Human
gacaagcucacagacc

SEQ ID NO: 2222908 - RNA, 19 nt, Human
gccugaucaccugcccugc

SEQ ID NO: 2222909 - RNA, 21 nt, Human
cuaagcuucacuguaaaauaa

SEQ ID NO: 2222910 - RNA, 17 nt, Human
cugagcagugcuugaau

SEQ ID NO: 2222911 - RNA, 14 nt, Human
agaguacuggcuga

SEQ ID NO: 2222912 - RNA, 17 nt, Human
aagacaaggaaaaaaua

SEQ ID NO: 2222913 - RNA, 13 nt, Human
aauuuuuauauuu

SEQ ID NO: 2222914 - RNA, 21 nt, Human
ugagcuaggggggucagccag

SEQ ID NO: 2222915 - RNA, 14 nt, Human
cagugucaggagga

SEQ ID NO: 2222916 - RNA, 14 nt, Human
agaugcuagaacuc

SEQ ID NO: 2222917 - RNA, 16 nt, Human
uggggauagugaggca

SEQ ID NO: 2222918 - RNA, 16 nt, Human
gaagauguagaggaga

SEQ ID NO: 2222919 - RNA, 16 nt, Human
ugcuaagucuuauaua

SEQ ID NO: 2222920 - RNA, 18 nt, Human
gaagcaaaauuuuuucuc

SEQ ID NO: 2222921 - RNA, 20 nt, Human
ccagaaugaccuggccgcag

SEQ ID NO: 2222922 - RNA, 18 nt, Human
uccugugggaccugggcc

SEQ ID NO: 2222923 - RNA, 21 nt, Human
ucccaggaggggcuucugggc

SEQ ID NO: 2222924 - RNA, 23 nt, Human
ggucuaucuuugagcgcccacua

SEQ ID NO: 2222925 - RNA, 20 nt, Human
aaaacaagcacuaaacaaag

SEQ ID NO: 2222926 - RNA, 12 nt, Human
gaugcugagccc

SEQ ID NO: 2222927 - RNA, 16 nt, Human
uuuauauuugaaauau

SEQ ID NO: 2222928 - RNA, 16 nt, Human
aaaauaacaauaaaag

SEQ ID NO: 2222929 - RNA, 14 nt, Human
acauauauaacaau

SEQ ID NO: 2222930 - RNA, 15 nt, Human
gacaguauggcagcu

SEQ ID NO: 2222931 - RNA, 17 nt, Human
aaauaacaauaaaagac

SEQ ID NO: 2222932 - RNA, 15 nt, Human
uagggugauauuaac

SEQ ID NO: 2222933 - RNA, 13 nt, Human
agaaguaaaaaca

SEQ ID NO: 2222934 - RNA, 22 nt, Human
gaaauaagccagacaucaacag

SEQ ID NO: 2222935 - RNA, 20 nt, Human
augguuuagaaagcuugccc

SEQ ID NO: 2222936 - RNA, 14 nt, Human
ugagaugcuagaac

SEQ ID NO: 2222937 - RNA, 14 nt, Human
uaaauaguuuauga

SEQ ID NO: 2222938 - RNA, 16 nt, Human
aauaaaguguuugaaa

SEQ ID NO: 2222939 - RNA, 23 nt, Human
agaguuuagcuggaaaaguaugu

SEQ ID NO: 2222940 - RNA, 14 nt, Human
cuccugagacacau

SEQ ID NO: 2222941 - RNA, 21 nt, Human
ucuuaggguuaugauuaagua

SEQ ID NO: 2222942 - RNA, 17 nt, Human
augauuaaguaaugaua

SEQ ID NO: 2222943 - RNA, 21 nt, Human
aaugugacuuaaugccacuaa

SEQ ID NO: 2222944 - RNA, 14 nt, Human
uucacauuuaaaua

SEQ ID NO: 2222945 - RNA, 19 nt, Human
cucacauuuauauuuuugu

SEQ ID NO: 2222946 - RNA, 22 nt, Human
cauuuaaauaaaguguuugaaa

SEQ ID NO: 2222947 - RNA, 21 nt, Human
aaguuuaugguuguauuauuu

SEQ ID NO: 2222948 - RNA, 12 nt, Human
acaagaaaugaa

SEQ ID NO: 2222949 - RNA, 13 nt, Human
cugcacuccagcc

SEQ ID NO: 2222950 - RNA, 20 nt, Human
cuaaaugucaaucagccuag

SEQ ID NO: 2222951 - RNA, 14 nt, Human
ggugcugcagcccc

SEQ ID NO: 2222952 - RNA, 22 nt, Human
cugcucaauaaaguacaagagc

SEQ ID NO: 2222953 - RNA, 19 nt, Human
uauuuuaauaauguuucaa

SEQ ID NO: 2222954 - RNA, 21 nt, Human
cuggccuucggccuccauccu

SEQ ID NO: 2222955 - RNA, 15 nt, Human
uucacauuuaaauaa

SEQ ID NO: 2222956 - RNA, 16 nt, Human
cugagcuugcagagau

SEQ ID NO: 2222957 - RNA, 14 nt, Human
cuucugacacuaaa

SEQ ID NO: 2222958 - RNA, 17 nt, Human
agugauuaccagggacu

SEQ ID NO: 2222959 - RNA, 21 nt, Human
auuauauggcuugaguuuaaa

SEQ ID NO: 2222960 - RNA, 19 nt, Human
agacucgggauuaguacac

SEQ ID NO: 2222961 - RNA, 23 nt, Human
gcuuuggucuaucuuugagcgcc

SEQ ID NO: 2222962 - RNA, 13 nt, Human
gggggaggugagg

SEQ ID NO: 2222963 - RNA, 20 nt, Human
aaggagccaaacauccuaca

SEQ ID NO: 2222964 - RNA, 12 nt, Human
gcucagcccugg

SEQ ID NO: 2222965 - RNA, 22 nt, Human
ugaccauacuaauuauaccccc

SEQ ID NO: 2222966 - RNA, 22 nt, Human
ugaauggcuaagcaaaauguga

SEQ ID NO: 2222967 - RNA, 19 nt, Human
cugagcccggaaacuccac

SEQ ID NO: 2222968 - RNA, 12 nt, Human
gacgagaaaaca

SEQ ID NO: 2222969 - RNA, 19 nt, Human
ugggccauagucauucugc

SEQ ID NO: 2222970 - RNA, 16 nt, Human
ugcacaucaaaauaug

SEQ ID NO: 2222971 - RNA, 17 nt, Human
agcuacuaauuuuaaaa

SEQ ID NO: 2222972 - RNA, 21 nt, Human
gagaaggagcucccaggaggg

SEQ ID NO: 2222973 - RNA, 19 nt, Human
aagucuuucacauuuaaau

SEQ ID NO: 2222974 - RNA, 15 nt, Human
cagugucaggaggaa

SEQ ID NO: 2222975 - RNA, 14 nt, Human
gagcucagcccugg

SEQ ID NO: 2222976 - RNA, 20 nt, Human
acaguggaaagacagcuucu

SEQ ID NO: 2222977 - RNA, 15 nt, Human
auauugacuuuuuau

SEQ ID NO: 2222978 - RNA, 17 nt, Human
auaauuuaaauauaugc

SEQ ID NO: 2222979 - RNA, 17 nt, Human
ccaaggaugccccgucc

SEQ ID NO: 2222980 - RNA, 17 nt, Human
acacuaagagagaauga

SEQ ID NO: 2222981 - RNA, 22 nt, Human
ugauaguuguaccgcaauguga

SEQ ID NO: 2222982 - RNA, 22 nt, Human
cccagcccuccuuaucaaagga

SEQ ID NO: 2222983 - RNA, 17 nt, Human
ccaugaugcugagcccg

SEQ ID NO: 2222984 - RNA, 18 nt, Human
caugaauuaguuuuauau

SEQ ID NO: 2222985 - RNA, 18 nt, Human
uggucaauuuuguuaugu

SEQ ID NO: 2222986 - RNA, 15 nt, Human
cuguaaaauaauaac

SEQ ID NO: 2222987 - RNA, 20 nt, Human
gacauuugcucauggaauug

SEQ ID NO: 2222988 - RNA, 19 nt, Human
aauuuuuauauuugaaaua

SEQ ID NO: 2222989 - RNA, 17 nt, Human
ccccagaaugaccuggc

SEQ ID NO: 2222990 - RNA, 22 nt, Human
gcacagccucuuagaugcaguu

SEQ ID NO: 2222991 - RNA, 16 nt, Human
uauguucuaagaagug

SEQ ID NO: 2222992 - RNA, 19 nt, Human
caugaguaacugauuugua

SEQ ID NO: 2222993 - RNA, 14 nt, Human
aagcaacccaaaug

SEQ ID NO: 2222994 - RNA, 13 nt, Human
acaaggaaaaaau

SEQ ID NO: 2222995 - RNA, 20 nt, Human
ugaggcuccacuuggucugu

SEQ ID NO: 2222996 - RNA, 19 nt, Human
auuuucaguuauuauauuu

SEQ ID NO: 2222997 - RNA, 15 nt, Human
aucaauuuaaaaaaa

SEQ ID NO: 2222998 - RNA, 18 nt, Human
cccaagccuggcaaggga

SEQ ID NO: 2222999 - RNA, 18 nt, Human
gcuaucaauccaagaacu

SEQ ID NO: 2223000 - RNA, 16 nt, Human
cuucugggcagacucu

SEQ ID NO: 2223001 - RNA, 14 nt, Human
aauggcuaagcaaa

SEQ ID NO: 2223002 - RNA, 14 nt, Human
auugucuagugaaa

SEQ ID NO: 2223003 - RNA, 18 nt, Human
uaaaagacagugaaagaa

SEQ ID NO: 2223004 - RNA, 20 nt, Human
augggccccagauaccauga

SEQ ID NO: 2223005 - RNA, 17 nt, Human
agcgacagugagacucu

SEQ ID NO: 2223006 - RNA, 22 nt, Human
aauaauccuaaacauaugaauu

SEQ ID NO: 2223007 - RNA, 21 nt, Human
aggguucaccugggcugaggc

SEQ ID NO: 2223008 - RNA, 14 nt, Human
cucuggcuccagcu

SEQ ID NO: 2223009 - RNA, 18 nt, Human
cccagaaugaccuggccg

SEQ ID NO: 2223010 - RNA, 22 nt, Human
gcucuaucccaaccucucccaa

SEQ ID NO: 2223011 - RNA, 19 nt, Human
uuuauaucaauuuaaaaaa

SEQ ID NO: 2223012 - RNA, 17 nt, Human
ccagguaccuucucacc

SEQ ID NO: 2223013 - RNA, 21 nt, Human
gaaaaguauguuagugcaaau

SEQ ID NO: 2223014 - RNA, 15 nt, Human
ugccccgucccccuc

SEQ ID NO: 2223015 - RNA, 21 nt, Human
aagcuccauuuuuagugaaau

SEQ ID NO: 2223016 - RNA, 22 nt, Human
agacucugucucaguccaugaa

SEQ ID NO: 2223017 - RNA, 20 nt, Human
uaggaauugacccacaagaa

SEQ ID NO: 2223018 - RNA, 21 nt, Human
cugggaccaggcacccccaga

SEQ ID NO: 2223019 - RNA, 18 nt, Human
ccugcaaagcccagcuug

SEQ ID NO: 2223020 - RNA, 20 nt, Human
aaagacagugaaagaaaaua

SEQ ID NO: 2223021 - RNA, 21 nt, Human
gcaaaauuuuuucucuaggaa

SEQ ID NO: 2223022 - RNA, 22 nt, Human
aggacaccauuuuggcaagcuc

SEQ ID NO: 2223023 - RNA, 15 nt, Human
ugguuuagaaagcuu

SEQ ID NO: 2223024 - RNA, 15 nt, Human
agggcucacagaauu

SEQ ID NO: 2223025 - RNA, 21 nt, Human
cugcccugcugagucccaggc

SEQ ID NO: 2223026 - RNA, 15 nt, Human
aaaauacaaaaaaaa

SEQ ID NO: 2223027 - RNA, 16 nt, Human
auacauguuacaacac

SEQ ID NO: 2223028 - RNA, 14 nt, Human
cagucucccucccu

SEQ ID NO: 2223029 - RNA, 22 nt, Human
cacagauuugagcucagcccug

SEQ ID NO: 2223030 - RNA, 19 nt, Human
cuucuggguuccuuccucu

SEQ ID NO: 2223031 - RNA, 18 nt, Human
gaggcuccacuuggucug

SEQ ID NO: 2223032 - RNA, 15 nt, Human
cucgugggacaguca

SEQ ID NO: 2223033 - RNA, 15 nt, Human
aaucucaauauuuca

SEQ ID NO: 2223034 - RNA, 18 nt, Human
aaauaacgauaaaagaca

SEQ ID NO: 2223035 - RNA, 22 nt, Human
uguauacugugugcuaaaacaa

SEQ ID NO: 2223036 - RNA, 15 nt, Human
cgggagccugaucac

SEQ ID NO: 2223037 - RNA, 19 nt, Human
uacaaaaaaaaaaaaaaau

SEQ ID NO: 2223038 - RNA, 19 nt, Human
uggaaauguuuacagaucc

SEQ ID NO: 2223039 - RNA, 14 nt, Human
acuggacucaccuc

SEQ ID NO: 2223040 - RNA, 22 nt, Human
aggaugccccgucccccucugg

SEQ ID NO: 2223041 - RNA, 15 nt, Human
cagucucccucccuu

SEQ ID NO: 2223042 - RNA, 22 nt, Human
gaugcaguucugaagaagaugg

SEQ ID NO: 2223043 - RNA, 19 nt, Human
aaacaccucagcugccucc

SEQ ID NO: 2223044 - RNA, 22 nt, Human
aagagccuuuuuuugaaaaaaa

SEQ ID NO: 2223045 - RNA, 14 nt, Human
aaaacuucagacau

SEQ ID NO: 2223046 - RNA, 17 nt, Human
guuuaauaauuuuuaau

SEQ ID NO: 2223047 - RNA, 13 nt, Human
gagacagcucugc

SEQ ID NO: 2223048 - RNA, 23 nt, Human
caccaaggagccaaacauccuac

SEQ ID NO: 2223049 - RNA, 15 nt, Human
agagacagaaagcag

SEQ ID NO: 2223050 - RNA, 15 nt, Human
auuucauucaauauc

SEQ ID NO: 2223051 - RNA, 16 nt, Human
uggauacuccaugggg

SEQ ID NO: 2223052 - RNA, 20 nt, Human
augcaguuguugcccacagc

SEQ ID NO: 2223053 - RNA, 18 nt, Human
auccuucagccugaaaga

SEQ ID NO: 2223054 - RNA, 21 nt, Human
aaucaccaaggcugauuaaac

SEQ ID NO: 2223055 - RNA, 17 nt, Human
gacacaugggugcuauu

SEQ ID NO: 2223056 - RNA, 14 nt, Human
auauuugaaauauu

SEQ ID NO: 2223057 - RNA, 13 nt, Human
cacaacacacaga

SEQ ID NO: 2223058 - RNA, 16 nt, Human
uaggauguugaaaaag

SEQ ID NO: 2223059 - RNA, 14 nt, Human
ccccagaaugaccu

SEQ ID NO: 2223060 - RNA, 13 nt, Human
gauggcaggaggc

SEQ ID NO: 2223061 - RNA, 20 nt, Human
auagucauucugccugcccu

SEQ ID NO: 2223062 - RNA, 21 nt, Human
cuccacuuggacaugggcccc

SEQ ID NO: 2223063 - RNA, 13 nt, Human
auuuuuuaaaaaa

SEQ ID NO: 2223064 - RNA, 16 nt, Human
cauuuguauaaaauaa

SEQ ID NO: 2223065 - RNA, 15 nt, Human
cugggaccaggcacc

SEQ ID NO: 2223066 - RNA, 17 nt, Human
uugggguugggggggag

SEQ ID NO: 2223067 - RNA, 15 nt, Human
accuucccagcuaga

SEQ ID NO: 2223068 - RNA, 21 nt, Human
cuauaaaacuaggugcugcag

SEQ ID NO: 2223069 - RNA, 21 nt, Human
gacagugaaagaaaauaacaa

SEQ ID NO: 2223070 - RNA, 21 nt, Human
augaauacuuuauaaaggauu

SEQ ID NO: 2223071 - RNA, 16 nt, Human
ucucuaggaaauauuu

SEQ ID NO: 2223072 - RNA, 22 nt, Human
agaaaacaauaacgauaaaaga

SEQ ID NO: 2223073 - RNA, 15 nt, Human
uguauuuuaaaagaa

SEQ ID NO: 2223074 - RNA, 20 nt, Human
accugauuucugagcauuua

SEQ ID NO: 2223075 - RNA, 17 nt, Human
cccaggcugagccucag

SEQ ID NO: 2223076 - RNA, 14 nt, Human
ccucuucugacacu

SEQ ID NO: 2223077 - RNA, 12 nt, Human
ucuacacuccag

SEQ ID NO: 2223078 - RNA, 22 nt, Human
agccaaacauccuacaagacac

SEQ ID NO: 2223079 - RNA, 20 nt, Human
aaagacaaggaaaaaauaac

SEQ ID NO: 2223080 - RNA, 15 nt, Human
gaaaacaaggaugaa

SEQ ID NO: 2223081 - RNA, 12 nt, Human
ggugcugcagcc

SEQ ID NO: 2223082 - RNA, 14 nt, Human
aauauaaauaaaaa

SEQ ID NO: 2223083 - RNA, 20 nt, Human
cuuuuuuaguucuucaaaga

SEQ ID NO: 2223084 - RNA, 15 nt, Human
gacagggaggacgcu

SEQ ID NO: 2223085 - RNA, 22 nt, Human
auaucuuuuuuuuaauaaacca

SEQ ID NO: 2223086 - RNA, 16 nt, Human
gaaucacuugaacccg

SEQ ID NO: 2223087 - RNA, 17 nt, Human
gaagcaccaaucaugaa

SEQ ID NO: 2223088 - RNA, 23 nt, Human
auaucuuuuuuuuaauaaaccau

SEQ ID NO: 2223089 - RNA, 16 nt, Human
cagucucccucccuug

SEQ ID NO: 2223090 - RNA, 15 nt, Human
auauuuuuuguuaaa

SEQ ID NO: 2223091 - RNA, 13 nt, Human
caagccugccuca

SEQ ID NO: 2223092 - RNA, 21 nt, Human
ucauucacucaacaaacauaa

SEQ ID NO: 2223093 - RNA, 18 nt, Human
acaggauggcaggaggca

SEQ ID NO: 2223094 - RNA, 16 nt, Human
cccccagcccuccuua

SEQ ID NO: 2223095 - RNA, 21 nt, Human
uauaaaauaauuuuuauauuu

SEQ ID NO: 2223096 - RNA, 18 nt, Human
auuauuuuuuaaaaaaau

SEQ ID NO: 2223097 - RNA, 20 nt, Human
aaaaucuuauaauuuaaaau

SEQ ID NO: 2223098 - RNA, 14 nt, Human
uaaaauccauacau

SEQ ID NO: 2223099 - RNA, 19 nt, Human
aauguuuacagauccccaa

SEQ ID NO: 2223100 - RNA, 23 nt, Human
augaauuaaguuuuuuuuuaaaa

SEQ ID NO: 2223101 - RNA, 20 nt, Human
uugauaaguacaugauaagc

SEQ ID NO: 2223102 - RNA, 23 nt, Human
caauccaagaacuuauuuguaca

SEQ ID NO: 2223103 - RNA, 17 nt, Human
caagaaaugaaagcagg

SEQ ID NO: 2223104 - RNA, 17 nt, Human
agacacacugaagaagc

SEQ ID NO: 2223105 - RNA, 14 nt, Human
accugugagaccaa

SEQ ID NO: 2223106 - RNA, 20 nt, Human
aaucuuucacaggggacagg

SEQ ID NO: 2223107 - RNA, 14 nt, Human
cucugccucagaaa

SEQ ID NO: 2223108 - RNA, 19 nt, Human
uggcaagcucuaucaccaa

SEQ ID NO: 2223109 - RNA, 13 nt, Human
agguaccuucuca

SEQ ID NO: 2223110 - RNA, 21 nt, Human
gaaaacaauaacgauaaaaga

SEQ ID NO: 2223111 - RNA, 15 nt, Human
aaagaaagaaaauca

SEQ ID NO: 2223112 - RNA, 19 nt, Human
uaucacuugucaauaaaau

SEQ ID NO: 2223113 - RNA, 15 nt, Human
caggcacccccagaa

SEQ ID NO: 2223114 - RNA, 23 nt, Human
uagauguauagguugaugguggu

SEQ ID NO: 2223115 - RNA, 23 nt, Human
ccacuuggacaugggccccagau

SEQ ID NO: 2223116 - RNA, 17 nt, Human
auccugugggaccuggg

SEQ ID NO: 2223117 - RNA, 19 nt, Human
aaaauaacgauaaaagaca

SEQ ID NO: 2223118 - RNA, 14 nt, Human
ucaagccugccuca

SEQ ID NO: 2223119 - RNA, 16 nt, Human
aaauaguuuaugauuc

SEQ ID NO: 2223120 - RNA, 15 nt, Human
ccaaggagccaaaca

SEQ ID NO: 2223121 - RNA, 18 nt, Human
cagaucaagccugccuca

SEQ ID NO: 2223122 - RNA, 18 nt, Human
ccaaccuggaguugaaaa

SEQ ID NO: 2223123 - RNA, 17 nt, Human
aaagaaacauuugguaa

SEQ ID NO: 2223124 - RNA, 12 nt, Human
acucccugcccc

SEQ ID NO: 2223125 - RNA, 23 nt, Human
aaagcccagcuugaaaccuucac

SEQ ID NO: 2223126 - RNA, 14 nt, Human
uaaaggaauuuaaa

SEQ ID NO: 2223127 - RNA, 15 nt, Human
uccauccugaggcuc

SEQ ID NO: 2223128 - RNA, 22 nt, Human
augguuguauuauuuuuuaaaa

SEQ ID NO: 2223129 - RNA, 21 nt, Human
cuauguucuaagaagugaaaa

SEQ ID NO: 2223130 - RNA, 17 nt, Human
cagacaucaacagauaa

SEQ ID NO: 2223131 - RNA, 19 nt, Human
cuagaguuuagcuggaaaa

SEQ ID NO: 2223132 - RNA, 21 nt, Human
caauuuuguuauguauauuuu

SEQ ID NO: 2223133 - RNA, 17 nt, Human
auguuuacagaucccca

SEQ ID NO: 2223134 - RNA, 16 nt, Human
uucccaacuccagaaa

SEQ ID NO: 2223135 - RNA, 21 nt, Human
cagugagacagcucugcauac

SEQ ID NO: 2223136 - RNA, 21 nt, Human
auguuuaauucugaaagcaac

SEQ ID NO: 2223137 - RNA, 22 nt, Human
uacugagagugaacaaauuuac

SEQ ID NO: 2223138 - RNA, 22 nt, Human
cuuuccacagaagcuccaggua

SEQ ID NO: 2223139 - RNA, 16 nt, Human
caauccaagaacuuau

SEQ ID NO: 2223140 - RNA, 20 nt, Human
ucgugucuggcguugugggg

SEQ ID NO: 2223141 - RNA, 16 nt, Human
cuucaacucccugccc

SEQ ID NO: 2223142 - RNA, 21 nt, Human
cccccucuggcuccagcuggc

SEQ ID NO: 2223143 - RNA, 22 nt, Human
accauuucuugagguaaaagca

SEQ ID NO: 2223144 - RNA, 21 nt, Human
guauacugugugcuaaaacaa

SEQ ID NO: 2223145 - RNA, 14 nt, Human
ugagcucagcccug

SEQ ID NO: 2223146 - RNA, 23 nt, Human
auuuuauagcuacuaauuuuaaa

SEQ ID NO: 2223147 - RNA, 22 nt, Human
cugaggcuccacuuggucugug

SEQ ID NO: 2223148 - RNA, 13 nt, Human
ccucuggcuccag

SEQ ID NO: 2223149 - RNA, 13 nt, Human
agagauuccugag

SEQ ID NO: 2223150 - RNA, 14 nt, Human
uauuugaaauauug

SEQ ID NO: 2223151 - RNA, 16 nt, Human
agaucaagccugccuc

SEQ ID NO: 2223152 - RNA, 21 nt, Human
ccugaucaccugcccugcuga

SEQ ID NO: 2223153 - RNA, 14 nt, Human
cuguaaucacagcu

SEQ ID NO: 2223154 - RNA, 22 nt, Human
gauaaaagacagugaaagaaaa

SEQ ID NO: 2223155 - RNA, 21 nt, Human
gcacuguggguagacacacau

SEQ ID NO: 2223156 - RNA, 21 nt, Human
cucccaggaggggcuucuggg

SEQ ID NO: 2223157 - RNA, 20 nt, Human
ccagcuggccgggagccuga

SEQ ID NO: 2223158 - RNA, 15 nt, Human
cuaguaauuggaaag

SEQ ID NO: 2223159 - RNA, 17 nt, Human
cagugaaagaaaauaac

SEQ ID NO: 2223160 - RNA, 15 nt, Human
cacaggacagcccuu

SEQ ID NO: 2223161 - RNA, 19 nt, Human
auaauuuuuauauuugaaa

SEQ ID NO: 2223162 - RNA, 22 nt, Human
aucucuucuggguuccuuccuc

SEQ ID NO: 2223163 - RNA, 16 nt, Human
ggcagcuuuuucucuc

SEQ ID NO: 2223164 - RNA, 22 nt, Human
caguauggcagcuuuccucaaa

SEQ ID NO: 2223165 - RNA, 15 nt, Human
agugacaagcucaca

SEQ ID NO: 2223166 - RNA, 19 nt, Human
auaaaagacaaggaaaaaa

SEQ ID NO: 2223167 - RNA, 15 nt, Human
auaauuuugugaagc

SEQ ID NO: 2223168 - RNA, 14 nt, Human
guaacuaauuuuaa

SEQ ID NO: 2223169 - RNA, 17 nt, Human
ccugccccccagcccuc

SEQ ID NO: 2223170 - RNA, 15 nt, Human
cuaagcaaaauguga

SEQ ID NO: 2223171 - RNA, 18 nt, Human
ucugaugagaacucugag

SEQ ID NO: 2223172 - RNA, 23 nt, Human
cucuacuaaaaauacaaaaaaaa

SEQ ID NO: 2223173 - RNA, 24 nt, Human
uaauuuaaaauaugcucuaaacau

SEQ ID NO: 2223174 - RNA, 17 nt, Human
ccugagcggaccuuccc

SEQ ID NO: 2223175 - RNA, 18 nt, Human
agugucaaugcagccccc

SEQ ID NO: 2223176 - RNA, 21 nt, Human
gcucccaggaggggcuucugg

SEQ ID NO: 2223177 - RNA, 12 nt, Human
cauuauauuuau

SEQ ID NO: 2223178 - RNA, 19 nt, Human
acauuuguauaaaauaauu

SEQ ID NO: 2223179 - RNA, 15 nt, Human
ggggcuucugggcag

SEQ ID NO: 2223180 - RNA, 23 nt, Human
ucugacacuaaaacaccucagcu

SEQ ID NO: 2223181 - RNA, 11 nt, Human
gagguaaaagc

SEQ ID NO: 2223182 - RNA, 17 nt, Human
gacaaggaaaaaauaac

SEQ ID NO: 2223183 - RNA, 14 nt, Human
ggacucaccucccc

SEQ ID NO: 2223184 - RNA, 20 nt, Human
gaccauacuaauuauacccc

SEQ ID NO: 2223185 - RNA, 14 nt, Human
ucccaacuauaaaa

SEQ ID NO: 2223186 - RNA, 19 nt, Human
cccagcuagaauucacucc

SEQ ID NO: 2223187 - RNA, 16 nt, Human
ggugcugcagccccug

SEQ ID NO: 2223188 - RNA, 18 nt, Human
ugugaccacugcagaaga

SEQ ID NO: 2223189 - RNA, 18 nt, Human
cuaucccaaccucuccca

SEQ ID NO: 2223190 - RNA, 13 nt, Human
auuuuaaaagaau

SEQ ID NO: 2223191 - RNA, 15 nt, Human
aggagcucccaggag

SEQ ID NO: 2223192 - RNA, 21 nt, Human
ucagccagcccucuucugaca

SEQ ID NO: 2223193 - RNA, 12 nt, Human
gacagugaaaga

SEQ ID NO: 2223194 - RNA, 16 nt, Human
caggcuugccugcagg

SEQ ID NO: 2223195 - RNA, 20 nt, Human
uacaucccuuaccugggaaa

SEQ ID NO: 2223196 - RNA, 15 nt, Human
uuaauuuguaguguu

SEQ ID NO: 2223197 - RNA, 23 nt, Human
cacuggacucaccucccccaucu

SEQ ID NO: 2223198 - RNA, 18 nt, Human
aucuacacuccagugaga

SEQ ID NO: 2223199 - RNA, 15 nt, Human
ccagauccuggaaau

SEQ ID NO: 2223200 - RNA, 21 nt, Human
uuccuaauuccacagcugcuc

SEQ ID NO: 2223201 - RNA, 13 nt, Human
ggaaguagaggag

SEQ ID NO: 2223202 - RNA, 18 nt, Human
aggaaggcuuacacccac

SEQ ID NO: 2223203 - RNA, 12 nt, Human
cauagaaguaaa

SEQ ID NO: 2223204 - RNA, 16 nt, Human
aaaauaauccucaguu

SEQ ID NO: 2223205 - RNA, 20 nt, Human
uuuccaaugacauuuuguug

SEQ ID NO: 2223206 - RNA, 16 nt, Human
uucucaccugugagac

SEQ ID NO: 2223207 - RNA, 14 nt, Human
agcaaguauuagaa

SEQ ID NO: 2223208 - RNA, 18 nt, Human
agaucaagccugccucaa

SEQ ID NO: 2223209 - RNA, 18 nt, Human
aaaaguucugcagauaaa

SEQ ID NO: 2223210 - RNA, 20 nt, Human
agcuacuaauuuuaaaaugu

SEQ ID NO: 2223211 - RNA, 19 nt, Human
uccagaaagugacaagcuc

SEQ ID NO: 2223212 - RNA, 23 nt, Human
uuguaacaagccuccuuuuaaag

SEQ ID NO: 2223213 - RNA, 22 nt, Human
cuccagccugagcgacagugag

SEQ ID NO: 2223214 - RNA, 13 nt, Human
cauuuguauaaaa

SEQ ID NO: 2223215 - RNA, 20 nt, Human
aagggcuguuauaaucuuuc

SEQ ID NO: 2223216 - RNA, 16 nt, Human
uaaaggaauuuaaaaa

SEQ ID NO: 2223217 - RNA, 22 nt, Human
agacucgggauuaguacacacu

SEQ ID NO: 2223218 - RNA, 17 nt, Human
ucuggcguuguggggau

SEQ ID NO: 2223219 - RNA, 17 nt, Human
augcagagguccacaac

SEQ ID NO: 2223220 - RNA, 20 nt, Human
cagguaccuucucaccugug

SEQ ID NO: 2223221 - RNA, 20 nt, Human
uccaaaggcuccugagacac

SEQ ID NO: 2223222 - RNA, 12 nt, Human
caacccaaaugu

SEQ ID NO: 2223223 - RNA, 16 nt, Human
uauaucaauuuaaaaa

SEQ ID NO: 2223224 - RNA, 13 nt, Human
ugaaaugcagagu

SEQ ID NO: 2223225 - RNA, 15 nt, Human
uaaaagacaaggaaa

SEQ ID NO: 2223226 - RNA, 22 nt, Human
cuaagcuucacuguaaaauaau

SEQ ID NO: 2223227 - RNA, 12 nt, Human
ccccuugccaua

SEQ ID NO: 2223228 - RNA, 15 nt, Human
uacaaaugcauuucu

SEQ ID NO: 2223229 - RNA, 22 nt, Human
aggauggcuaguaucaaaagaa

SEQ ID NO: 2223230 - RNA, 18 nt, Human
uuuucaauaaaacuuuuc

SEQ ID NO: 2223231 - RNA, 21 nt, Human
guggggaugaacuuuuuguuu

SEQ ID NO: 2223232 - RNA, 17 nt, Human
ccugugggaccugggcc

SEQ ID NO: 2223233 - RNA, 22 nt, Human
cagcuagaauucacuccacuug

SEQ ID NO: 2223234 - RNA, 16 nt, Human
cucagcccuggugggc

SEQ ID NO: 2223235 - RNA, 14 nt, Human
ccugccccccagcc

SEQ ID NO: 2223236 - RNA, 21 nt, Human
cgaaguauccuucagccugaa

SEQ ID NO: 2223237 - RNA, 15 nt, Human
gccccugcacuccag

SEQ ID NO: 2223238 - RNA, 23 nt, Human
cuugauaaauggcuuccuggcaa

SEQ ID NO: 2223239 - RNA, 22 nt, Human
ggacagcccuucuuuccacaga

SEQ ID NO: 2223240 - RNA, 20 nt, Human
aauuuuuucucuaggaaaua

SEQ ID NO: 2223241 - RNA, 21 nt, Human
ccccugcaaagcccagcuuga

SEQ ID NO: 2223242 - RNA, 19 nt, Human
aaacaaaaggauaaugaau

SEQ ID NO: 2223243 - RNA, 19 nt, Human
agaugcuagaacucccuuu

SEQ ID NO: 2223244 - RNA, 16 nt, Human
uagcuacuaauuuuaa

SEQ ID NO: 2223245 - RNA, 14 nt, Human
ggccgcagugaggc

SEQ ID NO: 2223246 - RNA, 22 nt, Human
aaauaacaaugaaaguugauaa

SEQ ID NO: 2223247 - RNA, 13 nt, Human
auugcaaggcaaa

SEQ ID NO: 2223248 - RNA, 11 nt, Human
ccgugugccug

SEQ ID NO: 2223249 - RNA, 19 nt, Human
ucaccaaggcugauuaaac

SEQ ID NO: 2223250 - RNA, 24 nt, Human
gccugcccugaaagucccagauca

SEQ ID NO: 2223251 - RNA, 20 nt, Human
cucccugccccccagcccuc

SEQ ID NO: 2223252 - RNA, 16 nt, Human
ucaguuuuugugaaaa

SEQ ID NO: 2223253 - RNA, 19 nt, Human
uguauacugugugcuaaaa

SEQ ID NO: 2223254 - RNA, 19 nt, Human
cucuguucugcacacagca

SEQ ID NO: 2223255 - RNA, 17 nt, Human
ccuauccuacuuccccu

SEQ ID NO: 2223256 - RNA, 17 nt, Human
acucuggucaagaagca

SEQ ID NO: 2223257 - RNA, 20 nt, Human
ccagugagacagcucugcau

SEQ ID NO: 2223258 - RNA, 19 nt, Human
ucugagcauuuaauaugga

SEQ ID NO: 2223259 - RNA, 18 nt, Human
gagcgacagugagacucu

SEQ ID NO: 2223260 - RNA, 14 nt, Human
cuaaacauaugaau

SEQ ID NO: 2223261 - RNA, 22 nt, Human
auagccagguaccuucucaccu

SEQ ID NO: 2223262 - RNA, 19 nt, Human
agcuucucauccugcaggc

SEQ ID NO: 2223263 - RNA, 13 nt, Human
cacauuuaaauaa

SEQ ID NO: 2223264 - RNA, 23 nt, Human
gcugccuccccagcucuauccca

SEQ ID NO: 2223265 - RNA, 19 nt, Human
cuuccuaauuccacagcug

SEQ ID NO: 2223266 - RNA, 21 nt, Human
uaaaagacagugaaagaaaau

SEQ ID NO: 2223267 - RNA, 16 nt, Human
acaaauccaaugaaau

SEQ ID NO: 2223268 - RNA, 20 nt, Human
agugaggcggauugagaagg

SEQ ID NO: 2223269 - RNA, 16 nt, Human
acugauggguuucucc

SEQ ID NO: 2223270 - RNA, 19 nt, Human
agauuugagcucagcccug

SEQ ID NO: 2223271 - RNA, 18 nt, Human
gccugagcgacagugaga

SEQ ID NO: 2223272 - RNA, 14 nt, Human
uauaauuuaaauau

SEQ ID NO: 2223273 - RNA, 18 nt, Human
ugagaaggagcucccagg

SEQ ID NO: 2223274 - RNA, 15 nt, Human
cagccagcacagccu

SEQ ID NO: 2223275 - RNA, 19 nt, Human
auagugaggagcuuugaaa

SEQ ID NO: 2223276 - RNA, 18 nt, Human
uuuuaaaaaagaaacauu

SEQ ID NO: 2223277 - RNA, 15 nt, Human
ugcuguauuuuaaaa

SEQ ID NO: 2223278 - RNA, 19 nt, Human
acuggacucaccuccccca

SEQ ID NO: 2223279 - RNA, 20 nt, Human
cagccugagcgacagugaga

SEQ ID NO: 2223280 - RNA, 16 nt, Human
ucaccugggcugaggc

SEQ ID NO: 2223281 - RNA, 12 nt, Human
caggacagcccu

SEQ ID NO: 2223282 - RNA, 14 nt, Human
gagguaccagccuu

SEQ ID NO: 2223283 - RNA, 17 nt, Human
cucuggucaagaagcau

SEQ ID NO: 2223284 - RNA, 15 nt, Human
aauugacccacaaga

SEQ ID NO: 2223285 - RNA, 21 nt, Human
uauuacuguaagaaaauauca

SEQ ID NO: 2223286 - RNA, 22 nt, Human
auauaaauaaaaauaauccuca

SEQ ID NO: 2223287 - RNA, 16 nt, Human
cuuauaauuuaaaaua

SEQ ID NO: 2223288 - RNA, 18 nt, Human
uuauuacuguaagaaaau

SEQ ID NO: 2223289 - RNA, 18 nt, Human
aucuuauaauuuaaaaua

SEQ ID NO: 2223290 - RNA, 13 nt, Human
uuuugcuguggca

SEQ ID NO: 2223291 - RNA, 18 nt, Human
auuuaggccaugggacag

SEQ ID NO: 2223292 - RNA, 12 nt, Human
cuaagaagugaa

SEQ ID NO: 2223293 - RNA, 17 nt, Human
ccugagcuugcagagau

SEQ ID NO: 2223294 - RNA, 16 nt, Human
uguaguccuguaaugg

SEQ ID NO: 2223295 - RNA, 22 nt, Human
auauaugcuaagucuuauauau

SEQ ID NO: 2223296 - RNA, 19 nt, Human
ugggccccagauaccauga

SEQ ID NO: 2223297 - RNA, 16 nt, Human
agagguccacaacaca

SEQ ID NO: 2223298 - RNA, 23 nt, Human
agcaugucgucaaagcugaaaug

SEQ ID NO: 2223299 - RNA, 23 nt, Human
cagagguugcagugagccgagau

SEQ ID NO: 2223300 - RNA, 13 nt, Human
aacaagccuccuu

SEQ ID NO: 2223301 - RNA, 17 nt, Human
ccaaaaaucucaauauu

SEQ ID NO: 2223302 - RNA, 19 nt, Human
uccccuauccuacuucccc

SEQ ID NO: 2223303 - RNA, 13 nt, Human
uuuaaaaaaaaac

SEQ ID NO: 2223304 - RNA, 13 nt, Human
aucucaauauuuc

SEQ ID NO: 2223305 - RNA, 19 nt, Human
acuagacaaguccagccug

SEQ ID NO: 2223306 - RNA, 16 nt, Human
augcuaagugaaauaa

SEQ ID NO: 2223307 - RNA, 15 nt, Human
ccaacuauaaaacua

SEQ ID NO: 2223308 - RNA, 22 nt, Human
aucaucaagucuuucacauuua

SEQ ID NO: 2223309 - RNA, 17 nt, Human
auggcuaguaucaaaag

SEQ ID NO: 2223310 - RNA, 15 nt, Human
auaucaauuuaaaaa

SEQ ID NO: 2223311 - RNA, 23 nt, Human
uguagguagaucuggucuuuaga

SEQ ID NO: 2223312 - RNA, 17 nt, Human
accugagccccaaaagg

SEQ ID NO: 2223313 - RNA, 19 nt, Human
uugugccccugcacuccag

SEQ ID NO: 2223314 - RNA, 22 nt, Human
gaauuucuucaacucccugccc

SEQ ID NO: 2223315 - RNA, 17 nt, Human
gccccccagcccuccuu

SEQ ID NO: 2223316 - RNA, 21 nt, Human
acaugggugcuauugggguug

SEQ ID NO: 2223317 - RNA, 17 nt, Human
ccacugcagaagacagu

SEQ ID NO: 2223318 - RNA, 15 nt, Human
caaggaaaaaauaac

SEQ ID NO: 2223319 - RNA, 22 nt, Human
uuuaauaauguuucaaacauau

SEQ ID NO: 2223320 - RNA, 21 nt, Human
ggguucccgugugccugagcg

SEQ ID NO: 2223321 - RNA, 12 nt, Human
cagauuuuccug

SEQ ID NO: 2223322 - RNA, 14 nt, Human
caccucagcugccu

SEQ ID NO: 2223323 - RNA, 11 nt, Human
ggguugggggg

SEQ ID NO: 2223324 - RNA, 15 nt, Human
cccaaccucucccaa

SEQ ID NO: 2223325 - RNA, 14 nt, Human
ccacuggacucacc

SEQ ID NO: 2223326 - RNA, 23 nt, Human
gccccugcacuccagccugagcg

SEQ ID NO: 2223327 - RNA, 22 nt, Human
agaauuuuaugcggcauuuucu

SEQ ID NO: 2223328 - RNA, 19 nt, Human
accucagcugccuccccag

SEQ ID NO: 2223329 - RNA, 14 nt, Human
ucagucucccuccc

SEQ ID NO: 2223330 - RNA, 15 nt, Human
gcagagguugcagug

SEQ ID NO: 2223331 - RNA, 16 nt, Human
ccccugcacuccagcc

SEQ ID NO: 2223332 - RNA, 23 nt, Human
caucaacagauaaauaguuuaug

SEQ ID NO: 2223333 - RNA, 14 nt, Human
aauauuauuuuaua

SEQ ID NO: 2223334 - RNA, 13 nt, Human
gcagaacagugau

SEQ ID NO: 2223335 - RNA, 16 nt, Human
cucucccaacuauaaa

SEQ ID NO: 2223336 - RNA, 13 nt, Human
uuuagugaaauau

SEQ ID NO: 2223337 - RNA, 16 nt, Human
ugagaugcuagaacuc

SEQ ID NO: 2223338 - RNA, 17 nt, Human
uggccgcagugaggcgg

SEQ ID NO: 2223339 - RNA, 19 nt, Human
uaggggggucagccagccc

SEQ ID NO: 2223340 - RNA, 13 nt, Human
caugggccccaga

SEQ ID NO: 2223341 - RNA, 22 nt, Human
aaacaccucagcugccucccca

SEQ ID NO: 2223342 - RNA, 20 nt, Human
cacuagacccacuggacuca

SEQ ID NO: 2223343 - RNA, 23 nt, Human
cucagucucccucccuuggggcc

SEQ ID NO: 2223344 - RNA, 13 nt, Human
gugcugcagcccc

SEQ ID NO: 2223345 - RNA, 15 nt, Human
guuucuuccuuuuuu

SEQ ID NO: 2223346 - RNA, 18 nt, Human
ucucuaggaaauauuuau

SEQ ID NO: 2223347 - RNA, 20 nt, Human
auaaauggcuuccuggcaau

SEQ ID NO: 2223348 - RNA, 12 nt, Human
accuucucaccu

SEQ ID NO: 2223349 - RNA, 12 nt, Human
ucaagaagcauc

SEQ ID NO: 2223350 - RNA, 21 nt, Human
ccacauccugugggaccuggg

SEQ ID NO: 2223351 - RNA, 15 nt, Human
cuaucuuugagcgcc

SEQ ID NO: 2223352 - RNA, 21 nt, Human
cuaccaaaaaucucaauauuu

SEQ ID NO: 2223353 - RNA, 12 nt, Human
ggaggcugagau

SEQ ID NO: 2223354 - RNA, 19 nt, Human
agaaaauaacgauaaaaga

SEQ ID NO: 2223355 - RNA, 19 nt, Human
gcuaccuuuugcuguggca

SEQ ID NO: 2223356 - RNA, 17 nt, Human
cgauaaaagacagugaa

SEQ ID NO: 2223357 - RNA, 17 nt, Human
ggugcugcagccccugg

SEQ ID NO: 2223358 - RNA, 23 nt, Human
aguacucauacauguuacaacac

SEQ ID NO: 2223359 - RNA, 14 nt, Human
auaccaugaugcug

SEQ ID NO: 2223360 - RNA, 13 nt, Human
caguuauuauauu

SEQ ID NO: 2223361 - RNA, 19 nt, Human
gagccucagucucccuccc

SEQ ID NO: 2223362 - RNA, 23 nt, Human
aucucuucuggguuccuuccucu

SEQ ID NO: 2223363 - RNA, 14 nt, Human
agucugacuguuuc

SEQ ID NO: 2223364 - RNA, 15 nt, Human
caggaggaaggcuua

SEQ ID NO: 2223365 - RNA, 15 nt, Human
cagaauucauucacu

SEQ ID NO: 2223366 - RNA, 21 nt, Human
aagacucgggauuaguacaca

SEQ ID NO: 2223367 - RNA, 20 nt, Human
ccugagcggaccuucccagc

SEQ ID NO: 2223368 - RNA, 23 nt, Human
cuggccgggagccugaucaccug

SEQ ID NO: 2223369 - RNA, 16 nt, Human
ugcaugguuuagaaag

SEQ ID NO: 2223370 - RNA, 17 nt, Human
cucuuuugggauuuuug

SEQ ID NO: 2223371 - RNA, 22 nt, Human
cagcucuaucccaaccucuccc

SEQ ID NO: 2223372 - RNA, 18 nt, Human
cugagucccaggcugagc

SEQ ID NO: 2223373 - RNA, 15 nt, Human
ccagaaugaccuggc

SEQ ID NO: 2223374 - RNA, 17 nt, Human
cucagucucccucccuu

SEQ ID NO: 2223375 - RNA, 15 nt, Human
uguuaaaugauuuca

SEQ ID NO: 2223376 - RNA, 23 nt, Human
uagauaggucagugcaaauacuc

SEQ ID NO: 2223377 - RNA, 19 nt, Human
gguuuaauaauuuuuaauu

SEQ ID NO: 2223378 - RNA, 21 nt, Human
aggcagcuuuuucucucccac

SEQ ID NO: 2223379 - RNA, 16 nt, Human
ggaugccccguccccc

SEQ ID NO: 2223380 - RNA, 19 nt, Human
aaugaauggcuaagcaaaa

SEQ ID NO: 2223381 - RNA, 12 nt, Human
cuacaagacaca

SEQ ID NO: 2223382 - RNA, 14 nt, Human
uuauuauauuuaca

SEQ ID NO: 2223383 - RNA, 20 nt, Human
cuggccuucggccuccaucc

SEQ ID NO: 2223384 - RNA, 20 nt, Human
gcagagaugaggccgccaug

SEQ ID NO: 2223385 - RNA, 16 nt, Human
uccucacaccaggcuu

SEQ ID NO: 2223386 - RNA, 15 nt, Human
cugaaagaggaauga

SEQ ID NO: 2223387 - RNA, 15 nt, Human
caggcagcuuuuucu

SEQ ID NO: 2223388 - RNA, 21 nt, Human
ucacaugaacuuguaaaggaa

SEQ ID NO: 2223389 - RNA, 16 nt, Human
uucucuaggaaauauu

SEQ ID NO: 2223390 - RNA, 17 nt, Human
cguaaucguguccccua

SEQ ID NO: 2223391 - RNA, 21 nt, Human
cuccagcuggccgggagccug

SEQ ID NO: 2223392 - RNA, 14 nt, Human
gaucaagccugccu

SEQ ID NO: 2223393 - RNA, 16 nt, Human
ccagaucaagccugcc

SEQ ID NO: 2223394 - RNA, 16 nt, Human
aaacuuuuccaaugac

SEQ ID NO: 2223395 - RNA, 14 nt, Human
ggggaacaugagcc

SEQ ID NO: 2223396 - RNA, 21 nt, Human
ccaaauauaaauaaaaauaau

SEQ ID NO: 2223397 - RNA, 23 nt, Human
gccugagcggaccuucccagcua

SEQ ID NO: 2223398 - RNA, 21 nt, Human
cccacuggacucaccuccccc

SEQ ID NO: 2223399 - RNA, 20 nt, Human
ccugccuaagugcagccccg

SEQ ID NO: 2223400 - RNA, 23 nt, Human
gaaugagagacacacugaagaag

SEQ ID NO: 2223401 - RNA, 12 nt, Human
aauuuuaaaaug

SEQ ID NO: 2223402 - RNA, 18 nt, Human
agguccacaacacacaga

SEQ ID NO: 2223403 - RNA, 15 nt, Human
cuuuucccaacucca

SEQ ID NO: 2223404 - RNA, 19 nt, Human
auccugugggaccugggcc

SEQ ID NO: 2223405 - RNA, 15 nt, Human
ggcagcuuuuucucu

SEQ ID NO: 2223406 - RNA, 12 nt, Human
guagacacacau

SEQ ID NO: 2223407 - RNA, 18 nt, Human
cucuauguucuaagaagu

SEQ ID NO: 2223408 - RNA, 16 nt, Human
ccuaugcagaggucca

SEQ ID NO: 2223409 - RNA, 21 nt, Human
ugcaggcagcuuuuucucucc

SEQ ID NO: 2223410 - RNA, 20 nt, Human
agccuuggggcugaugcagu

SEQ ID NO: 2223411 - RNA, 16 nt, Human
uuaauaauuuuuaauu

SEQ ID NO: 2223412 - RNA, 23 nt, Human
uagucauucugccugcccugaaa

SEQ ID NO: 2223413 - RNA, 23 nt, Human
ugaaaugaguuuuucuuuucauu

SEQ ID NO: 2223414 - RNA, 17 nt, Human
aaauguucaucaaugaa

SEQ ID NO: 2223415 - RNA, 20 nt, Human
acagcuucucauccugcagg

SEQ ID NO: 2223416 - RNA, 20 nt, Human
uaaaagacagugaaagaaaa

SEQ ID NO: 2223417 - RNA, 18 nt, Human
auguuaaaacugggacag

SEQ ID NO: 2223418 - RNA, 16 nt, Human
aauuuuuaauuauaug

SEQ ID NO: 2223419 - RNA, 13 nt, Human
gcuugccugcagg

SEQ ID NO: 2223420 - RNA, 15 nt, Human
ccgugugccugagcg

SEQ ID NO: 2223421 - RNA, 14 nt, Human
aaucucaauauuuc

SEQ ID NO: 2223422 - RNA, 20 nt, Human
caggcugagccucagucucc

SEQ ID NO: 2223423 - RNA, 19 nt, Human
gucuuucacauuuaaauaa

SEQ ID NO: 2223424 - RNA, 22 nt, Human
cuucagccugaaagaggaauga

SEQ ID NO: 2223425 - RNA, 17 nt, Human
cccccugcaaagcccag

SEQ ID NO: 2223426 - RNA, 16 nt, Human
ccuggugggcagagag

SEQ ID NO: 2223427 - RNA, 19 nt, Human
cagguaccuucucaccugu

SEQ ID NO: 2223428 - RNA, 12 nt, Human
ucccccucuggc

SEQ ID NO: 2223429 - RNA, 15 nt, Human
auaaaguguuugaaa

SEQ ID NO: 2223430 - RNA, 19 nt, Human
augaaguacucauacaugu

SEQ ID NO: 2223431 - RNA, 17 nt, Human
gcaagcucuaucaccaa

SEQ ID NO: 2223432 - RNA, 21 nt, Human
gaaauguuuacagauccccaa

SEQ ID NO: 2223433 - RNA, 23 nt, Human
acguaaucguguccccuauccua

SEQ ID NO: 2223434 - RNA, 14 nt, Human
ugagacucugucuc

SEQ ID NO: 2223435 - RNA, 22 nt, Human
cucuggucaagaagcaucgugu

SEQ ID NO: 2223436 - RNA, 22 nt, Human
cuuguaaaggaauuuaaaaauc

SEQ ID NO: 2223437 - RNA, 22 nt, Human
uauuccuuuuucucuccucucc

SEQ ID NO: 2223438 - RNA, 16 nt, Human
gucuaucuuugagcgc

SEQ ID NO: 2223439 - RNA, 18 nt, Human
cucccuuggggccuaugc

SEQ ID NO: 2223440 - RNA, 14 nt, Human
caacuauaaaacua

SEQ ID NO: 2223441 - RNA, 23 nt, Human
ugauggguuucuccagagggaau

SEQ ID NO: 2223442 - RNA, 19 nt, Human
augaauuacauuuguauaa

SEQ ID NO: 2223443 - RNA, 17 nt, Human
uauauuguagauaauac

SEQ ID NO: 2223444 - RNA, 14 nt, Human
cugaaagucccaga

SEQ ID NO: 2223445 - RNA, 15 nt, Human
auuugguaaggggaa

SEQ ID NO: 2223446 - RNA, 13 nt, Human
auuggacaguaaa

SEQ ID NO: 2223447 - RNA, 21 nt, Human
caccucagcugccuccccagc

SEQ ID NO: 2223448 - RNA, 13 nt, Human
ucauucugccugc

SEQ ID NO: 2223449 - RNA, 15 nt, Human
agaaaacaauaacga

SEQ ID NO: 2223450 - RNA, 19 nt, Human
augcagagguccacaacac

SEQ ID NO: 2223451 - RNA, 13 nt, Human
ccaaauugagcua

SEQ ID NO: 2223452 - RNA, 14 nt, Human
ugaagauguagagg

SEQ ID NO: 2223453 - RNA, 13 nt, Human
aacucuauaaugu

SEQ ID NO: 2223454 - RNA, 19 nt, Human
auuuacagagacagaaagc

SEQ ID NO: 2223455 - RNA, 18 nt, Human
auccugugggaccugggc

SEQ ID NO: 2223456 - RNA, 18 nt, Human
cauccaaaggcuccugag

SEQ ID NO: 2223457 - RNA, 13 nt, Human
aaaaauccuacuu

SEQ ID NO: 2223458 - RNA, 21 nt, Human
cauuucuugagguaaaagcau

SEQ ID NO: 2223459 - RNA, 15 nt, Human
acaucaacagauaaa

SEQ ID NO: 2223460 - RNA, 13 nt, Human
ggcuccugagaca

SEQ ID NO: 2223461 - RNA, 21 nt, Human
uauacugugugcuaaaacaag

SEQ ID NO: 2223462 - RNA, 12 nt, Human
cagugaaagaaa

SEQ ID NO: 2223463 - RNA, 18 nt, Human
gaugcaguucugaagaag

SEQ ID NO: 2223464 - RNA, 16 nt, Human
gccucagucucccucc

SEQ ID NO: 2223465 - RNA, 21 nt, Human
ugccugagcggaccuucccag

SEQ ID NO: 2223466 - RNA, 20 nt, Human
auuacuguaagaaaauauca

SEQ ID NO: 2223467 - RNA, 20 nt, Human
ucauucacucaacaaacaua

SEQ ID NO: 2223468 - RNA, 15 nt, Human
uuuagugaaauauua

SEQ ID NO: 2223469 - RNA, 16 nt, Human
caggaggcauccaaag

SEQ ID NO: 2223470 - RNA, 19 nt, Human
ugaacaaauuuacagagac

SEQ ID NO: 2223471 - RNA, 14 nt, Human
ggccgggagccuga

SEQ ID NO: 2223472 - RNA, 19 nt, Human
uugagaaggagcucccagg

SEQ ID NO: 2223473 - RNA, 16 nt, Human
cugagcauuuaauaug

SEQ ID NO: 2223474 - RNA, 18 nt, Human
auaaaguguuugaaagcu

SEQ ID NO: 2223475 - RNA, 20 nt, Human
uggaauaauccuaaacauau

SEQ ID NO: 2223476 - RNA, 23 nt, Human
aaaaacagaccgggguucccgug

SEQ ID NO: 2223477 - RNA, 18 nt, Human
aaaucuuauaauuuaaaa

SEQ ID NO: 2223478 - RNA, 22 nt, Human
caucucuucuggguuccuuccu

SEQ ID NO: 2223479 - RNA, 16 nt, Human
ccaaauugagcuaggg

SEQ ID NO: 2223480 - RNA, 22 nt, Human
cuuuuccaaugacauuuuguug

SEQ ID NO: 2223481 - RNA, 16 nt, Human
ccugccccccagcccu

SEQ ID NO: 2223482 - RNA, 20 nt, Human
aaauccuugaagauuuacca

SEQ ID NO: 2223483 - RNA, 22 nt, Human
uugagaaggagcucccaggagg

SEQ ID NO: 2223484 - RNA, 16 nt, Human
caauaacgauaaaaga

SEQ ID NO: 2223485 - RNA, 17 nt, Human
agguccacaacacacag

SEQ ID NO: 2223486 - RNA, 12 nt, Human
uuaauaaaccau

SEQ ID NO: 2223487 - RNA, 17 nt, Human
uccucugagccuuggga

SEQ ID NO: 2223488 - RNA, 15 nt, Human
uuagugaaauauuau

SEQ ID NO: 2223489 - RNA, 20 nt, Human
guucugcagauaaacaguag

SEQ ID NO: 2223490 - RNA, 17 nt, Human
cacuuggacaugggccc

SEQ ID NO: 2223491 - RNA, 16 nt, Human
gugcugcagccccugg

SEQ ID NO: 2223492 - RNA, 11 nt, Human
auaauuuaaau

SEQ ID NO: 2223493 - RNA, 19 nt, Human
gucaaauugugugaaaggu

SEQ ID NO: 2223494 - RNA, 17 nt, Human
ucugugagaugcuagaa

SEQ ID NO: 2223495 - RNA, 22 nt, Human
cuuccuaauuccacagcugcuc

SEQ ID NO: 2223496 - RNA, 19 nt, Human
agauaccaugaugcugagc

SEQ ID NO: 2223497 - RNA, 14 nt, Human
cucaccccuugcca

SEQ ID NO: 2223498 - RNA, 21 nt, Human
cuucucacauuuauauuuuug

SEQ ID NO: 2223499 - RNA, 21 nt, Human
uuuuauggcacuaguauuucu

SEQ ID NO: 2223500 - RNA, 11 nt, Human
auuuaaaaauc

SEQ ID NO: 2223501 - RNA, 18 nt, Human
auggugaaaugcagaguc

SEQ ID NO: 2223502 - RNA, 20 nt, Human
auuuucaguuauuauauuua

SEQ ID NO: 2223503 - RNA, 14 nt, Human
gaaaaaauaacaau

SEQ ID NO: 2223504 - RNA, 20 nt, Human
aguuuuuuuuuaaaaaagaa

SEQ ID NO: 2223505 - RNA, 20 nt, Human
cagcuggccgggagccugau

SEQ ID NO: 2223506 - RNA, 14 nt, Human
cuagaauucacucc

SEQ ID NO: 2223507 - RNA, 17 nt, Human
aggcaugagucagucug

SEQ ID NO: 2223508 - RNA, 13 nt, Human
cccaaaaggcaga

SEQ ID NO: 2223509 - RNA, 15 nt, Human
uacaggauuugaaau

SEQ ID NO: 2223510 - RNA, 20 nt, Human
gaauucauucacucaacaaa

SEQ ID NO: 2223511 - RNA, 16 nt, Human
uucacauuuaaauaaa

SEQ ID NO: 2223512 - RNA, 23 nt, Human
uccaaacugacucuuaagaagac

SEQ ID NO: 2223513 - RNA, 14 nt, Human
uaaauaaaaauaau

SEQ ID NO: 2223514 - RNA, 19 nt, Human
ucaauucuugccaaauaua

SEQ ID NO: 2223515 - RNA, 20 nt, Human
ggguuccuuccucugagccu

SEQ ID NO: 2223516 - RNA, 18 nt, Human
acauuugcucauggaauu

SEQ ID NO: 2223517 - RNA, 12 nt, Human
agaaaacaauaa

SEQ ID NO: 2223518 - RNA, 23 nt, Human
gaacaugagccuuuguugcuauc

SEQ ID NO: 2223519 - RNA, 23 nt, Human
ccucuucugacacuaaaacaccu

SEQ ID NO: 2223520 - RNA, 15 nt, Human
aaaaaauaacaauga

SEQ ID NO: 2223521 - RNA, 17 nt, Human
aauaugcucuaaacaug

SEQ ID NO: 2223522 - RNA, 16 nt, Human
gccaugugcuaguaau

SEQ ID NO: 2223523 - RNA, 18 nt, Human
acucuuaagaagacugca

SEQ ID NO: 2223524 - RNA, 23 nt, Human
uggaaauguuuacagauccccaa

SEQ ID NO: 2223525 - RNA, 19 nt, Human
auuauuuuuuaaaaaaauu

SEQ ID NO: 2223526 - RNA, 18 nt, Human
uuguaaaggaauuuaaaa

SEQ ID NO: 2223527 - RNA, 19 nt, Human
gagggaauugcagaguacu

SEQ ID NO: 2223528 - RNA, 18 nt, Human
uguauuauuuuuuaaaaa

SEQ ID NO: 2223529 - RNA, 13 nt, Human
gcucucuggccuu

SEQ ID NO: 2223530 - RNA, 19 nt, Human
aaguugcauagguuuaaua

SEQ ID NO: 2223531 - RNA, 14 nt, Human
ugguauguuuucag

SEQ ID NO: 2223532 - RNA, 18 nt, Human
uaauuuuaacucuauaau

SEQ ID NO: 2223533 - RNA, 14 nt, Human
gagagugaacaaau

SEQ ID NO: 2223534 - RNA, 17 nt, Human
gaggcauccuuccucac

SEQ ID NO: 2223535 - RNA, 13 nt, Human
ccacaacacacag

SEQ ID NO: 2223536 - RNA, 14 nt, Human
uugggaaaaaguaa

SEQ ID NO: 2223537 - RNA, 21 nt, Human
gaggugagguaccagccuugg

SEQ ID NO: 2223538 - RNA, 21 nt, Human
uuuguauaaaauaauuuuuau

SEQ ID NO: 2223539 - RNA, 15 nt, Human
aaggguacacugccu

SEQ ID NO: 2223540 - RNA, 19 nt, Human
augaaagcagggacuugaa

SEQ ID NO: 2223541 - RNA, 19 nt, Human
cagcuucucauccugcagg

SEQ ID NO: 2223542 - RNA, 16 nt, Human
ccucagucucccuccc

SEQ ID NO: 2223543 - RNA, 15 nt, Human
caggauggcaggagg

SEQ ID NO: 2223544 - RNA, 21 nt, Human
ccugagcggaccuucccagcu

SEQ ID NO: 2223545 - RNA, 14 nt, Human
cucaacaaacauaa

SEQ ID NO: 2223546 - RNA, 13 nt, Human
cugccuucucaac

SEQ ID NO: 2223547 - RNA, 23 nt, Human
ucuagcaugucgucaaagcugaa

SEQ ID NO: 2223548 - RNA, 12 nt, Human
acagagacagaa

SEQ ID NO: 2223549 - RNA, 14 nt, Human
uuuuaaaaaagaaa

SEQ ID NO: 2223550 - RNA, 16 nt, Human
auccuugaagauuuac

SEQ ID NO: 2223551 - RNA, 15 nt, Human
ccucauguccacugg

SEQ ID NO: 2223552 - RNA, 18 nt, Human
ccauccugccccugagcc

SEQ ID NO: 2223553 - RNA, 16 nt, Human
ugaauuaguuuuauau

SEQ ID NO: 2223554 - RNA, 18 nt, Human
ccucagcugccuccccag

SEQ ID NO: 2223555 - RNA, 17 nt, Human
aauaacaauaaaagaca

SEQ ID NO: 2223556 - RNA, 22 nt, Human
aauuguauuuuaguaagagauu

SEQ ID NO: 2223557 - RNA, 16 nt, Human
uaaauaaaaauaaucc

SEQ ID NO: 2223558 - RNA, 23 nt, Human
aggcuuacacccacaguggaaag

SEQ ID NO: 2223559 - RNA, 16 nt, Human
cagcucuaucccaacc

SEQ ID NO: 2223560 - RNA, 19 nt, Human
cagaaagcagaacagugau

SEQ ID NO: 2223561 - RNA, 12 nt, Human
gauaaaagacag

SEQ ID NO: 2223562 - RNA, 16 nt, Human
aaauauuuauuuuaau

SEQ ID NO: 2223563 - RNA, 21 nt, Human
cugagcccggaaacuccacau

SEQ ID NO: 2223564 - RNA, 20 nt, Human
ucaagucuuucacauuuaaa

SEQ ID NO: 2223565 - RNA, 15 nt, Human
ggcaagcucuaucac

SEQ ID NO: 2223566 - RNA, 14 nt, Human
agaauucauucacu

SEQ ID NO: 2223567 - RNA, 16 nt, Human
auuugaugcuacagga

SEQ ID NO: 2223568 - RNA, 22 nt, Human
ccaaacauccuacaagacacag

SEQ ID NO: 2223569 - RNA, 17 nt, Human
gcaaauugucacaggac

SEQ ID NO: 2223570 - RNA, 19 nt, Human
ggugcugcagccccuggga

SEQ ID NO: 2223571 - RNA, 15 nt, Human
ugccugcaggcauga

SEQ ID NO: 2223572 - RNA, 19 nt, Human
gcauccuuccucacaccag

SEQ ID NO: 2223573 - RNA, 14 nt, Human
uaaaagacaaggaa

SEQ ID NO: 2223574 - RNA, 23 nt, Human
cagaccgggguucccgugugccu

SEQ ID NO: 2223575 - RNA, 10 nt, Human
aauaaaacuu

SEQ ID NO: 2223576 - RNA, 14 nt, Human
aagcaucacaugaa

SEQ ID NO: 2223577 - RNA, 14 nt, Human
agagacagaaagca

SEQ ID NO: 2223578 - RNA, 13 nt, Human
auugucuagugaa

SEQ ID NO: 2223579 - RNA, 16 nt, Human
cuggccuucggccucc

SEQ ID NO: 2223580 - RNA, 23 nt, Human
cugggccauagucauucugccug

SEQ ID NO: 2223581 - RNA, 20 nt, Human
ccaaauguucaucaaugaau

SEQ ID NO: 2223582 - RNA, 16 nt, Human
acaggauggcaggagg

SEQ ID NO: 2223583 - RNA, 14 nt, Human
ugaucaccugcccu

SEQ ID NO: 2223584 - RNA, 15 nt, Human
accugggcugaggca

SEQ ID NO: 2223585 - RNA, 22 nt, Human
agccugccucaaucaguauuca

SEQ ID NO: 2223586 - RNA, 17 nt, Human
cccacuggacucaccuc

SEQ ID NO: 2223587 - RNA, 13 nt, Human
acuaauuuuaaaa

SEQ ID NO: 2223588 - RNA, 13 nt, Human
uggcuccagcugg

SEQ ID NO: 2223589 - RNA, 15 nt, Human
uaacaauaaaagaca

SEQ ID NO: 2223590 - RNA, 17 nt, Human
cugccucagaaaacaag

SEQ ID NO: 2223591 - RNA, 18 nt, Human
guuucaaacauauauaac

SEQ ID NO: 2223592 - RNA, 23 nt, Human
caacggggugaaacccugucucu

SEQ ID NO: 2223593 - RNA, 16 nt, Human
gucccagaucaagccu

SEQ ID NO: 2223594 - RNA, 17 nt, Human
ugaacuugguuuuaauu

SEQ ID NO: 2223595 - RNA, 12 nt, Human
acugaaaucaua

SEQ ID NO: 2223596 - RNA, 14 nt, Human
cuacaagacacagu

SEQ ID NO: 2223597 - RNA, 14 nt, Human
accauuuuuacuug

SEQ ID NO: 2223598 - RNA, 15 nt, Human
aaaagacaaggaaaa

SEQ ID NO: 2223599 - RNA, 18 nt, Human
ugaacuugguuuuaauua

SEQ ID NO: 2223600 - RNA, 18 nt, Human
aggaaaaaauaacaauga

SEQ ID NO: 2223601 - RNA, 15 nt, Human
acuuuuccaaugaca

SEQ ID NO: 2223602 - RNA, 16 nt, Human
ugagcucagcccuggu

SEQ ID NO: 2223603 - RNA, 14 nt, Human
ccagcuggccggga

SEQ ID NO: 2223604 - RNA, 21 nt, Human
cacaugaacuuguaaaggaau

SEQ ID NO: 2223605 - RNA, 18 nt, Human
gaaaauaacgauaaaaga

SEQ ID NO: 2223606 - RNA, 19 nt, Human
ucagugucaaugcagcccc

SEQ ID NO: 2223607 - RNA, 19 nt, Human
cuuggacaugggccccaga

SEQ ID NO: 2223608 - RNA, 14 nt, Human
cagauccuggaaau

SEQ ID NO: 2223609 - RNA, 12 nt, Human
ggcugaugcagu

SEQ ID NO: 2223610 - RNA, 16 nt, Human
aauugacccacaagaa

SEQ ID NO: 2223611 - RNA, 17 nt, Human
caaauauaaauaaaaau

SEQ ID NO: 2223612 - RNA, 20 nt, Human
aaauaauuuuuauauuugaa

SEQ ID NO: 2223613 - RNA, 22 nt, Human
uuugaugcuacaggauuugaaa

SEQ ID NO: 2223614 - RNA, 14 nt, Human
auucugccugcccu

SEQ ID NO: 2223615 - RNA, 23 nt, Human
agacagcuucucauccugcaggc

SEQ ID NO: 2223616 - RNA, 12 nt, Human
uauaauuuaaaa

SEQ ID NO: 2223617 - RNA, 13 nt, Human
uguauauuuuaua

SEQ ID NO: 2223618 - RNA, 16 nt, Human
acuaguuucccuugca

SEQ ID NO: 2223619 - RNA, 13 nt, Human
ccugccccccagc

SEQ ID NO: 2223620 - RNA, 21 nt, Human
gcugagucccaggcugagccu

SEQ ID NO: 2223621 - RNA, 22 nt, Human
cugggacaggggagaaccuagg

SEQ ID NO: 2223622 - RNA, 15 nt, Human
ccugaaagucccaga

SEQ ID NO: 2223623 - RNA, 13 nt, Human
aggagcucccagg

SEQ ID NO: 2223624 - RNA, 13 nt, Human
ucacuguaaaaua

SEQ ID NO: 2223625 - RNA, 22 nt, Human
accuaacgaaguauccuucagc

SEQ ID NO: 2223626 - RNA, 19 nt, Human
cugccccccagcccuccuu

SEQ ID NO: 2223627 - RNA, 19 nt, Human
uuguggggaugaacuuuuu

SEQ ID NO: 2223628 - RNA, 22 nt, Human
augcagagguccacaacacaca

SEQ ID NO: 2223629 - RNA, 15 nt, Human
ugggacagggaggac

SEQ ID NO: 2223630 - RNA, 21 nt, Human
uuauagcuacuaauuuuaaaa

SEQ ID NO: 2223631 - RNA, 18 nt, Human
ccugagcggaccuuccca

SEQ ID NO: 2223632 - RNA, 16 nt, Human
cagcuuuuucucuccc

SEQ ID NO: 2223633 - RNA, 14 nt, Human
uggcuugaguuuaa

SEQ ID NO: 2223634 - RNA, 19 nt, Human
ugcacacagcacgggggcc

SEQ ID NO: 2223635 - RNA, 21 nt, Human
gauaaaagacagugaaagaaa

SEQ ID NO: 2223636 - RNA, 12 nt, Human
aagaaaauaacg

SEQ ID NO: 2223637 - RNA, 16 nt, Human
uguucuaagaagugaa

SEQ ID NO: 2223638 - RNA, 20 nt, Human
uugaacccgggaggcagagg

SEQ ID NO: 2223639 - RNA, 17 nt, Human
auuuuaauaauguuuca

SEQ ID NO: 2223640 - RNA, 18 nt, Human
acugauggguuucuccag

SEQ ID NO: 2223641 - RNA, 14 nt, Human
cugccccccagccc

SEQ ID NO: 2223642 - RNA, 22 nt, Human
gaggggagcaugggaagugacg

SEQ ID NO: 2223643 - RNA, 21 nt, Human
aaacaauaacgauaaaagaca

SEQ ID NO: 2223644 - RNA, 18 nt, Human
caaucaguauucauauuu

SEQ ID NO: 2223645 - RNA, 15 nt, Human
ucuaugaaauauuau

SEQ ID NO: 2223646 - RNA, 20 nt, Human
acuaaaacaccucagcugcc

SEQ ID NO: 2223647 - RNA, 17 nt, Human
ugaaauauuauuuuaua

SEQ ID NO: 2223648 - RNA, 21 nt, Human
guccccuauccuacuuccccu

SEQ ID NO: 2223649 - RNA, 13 nt, Human
ucuauaauuuaaa

SEQ ID NO: 2223650 - RNA, 16 nt, Human
uuaaauuguaauaggc

SEQ ID NO: 2223651 - RNA, 13 nt, Human
ugauuauauguca

SEQ ID NO: 2223652 - RNA, 18 nt, Human
uguaaaggaauuuaaaaa

SEQ ID NO: 2223653 - RNA, 14 nt, Human
cagagguugcagug

SEQ ID NO: 2223654 - RNA, 20 nt, Human
uaaaagacaaggaaaaaaua

SEQ ID NO: 2223655 - RNA, 20 nt, Human
uauacugugugcuaaaacaa

SEQ ID NO: 2223656 - RNA, 16 nt, Human
cugagccucagucucc

SEQ ID NO: 2223657 - RNA, 15 nt, Human
cuucucuucacaguc

SEQ ID NO: 2223658 - RNA, 13 nt, Human
cacacugaagaag

SEQ ID NO: 2223659 - RNA, 17 nt, Human
ccacuggacucaccucc

SEQ ID NO: 2223660 - RNA, 20 nt, Human
aauucuugccaaauauaaau

SEQ ID NO: 2223661 - RNA, 19 nt, Human
cccugcaaagcccagcuug

SEQ ID NO: 2223662 - RNA, 17 nt, Human
agugagacagcucugca

SEQ ID NO: 2223663 - RNA, 16 nt, Human
ccugagcgacagugag

SEQ ID NO: 2223664 - RNA, 13 nt, Human
uuaaaaaagaaac

SEQ ID NO: 2223665 - RNA, 22 nt, Human
ccaaaggcuccugagacacaug

SEQ ID NO: 2223666 - RNA, 23 nt, Human
uauguuaaaacugggacagggga

SEQ ID NO: 2223667 - RNA, 17 nt, Human
uuucacauuuaaauaaa

SEQ ID NO: 2223668 - RNA, 11 nt, Human
uucacagggga

SEQ ID NO: 2223669 - RNA, 18 nt, Human
uaaaauccauacauuugu

SEQ ID NO: 2223670 - RNA, 14 nt, Human
cauccugugggacc

SEQ ID NO: 2223671 - RNA, 21 nt, Human
ugaaauggacuuuuguacaua

SEQ ID NO: 2223672 - RNA, 21 nt, Human
cccccauuguggucacaggaa

SEQ ID NO: 2223673 - RNA, 15 nt, Human
gcccacuagacccac

SEQ ID NO: 2223674 - RNA, 14 nt, Human
ugcuucuguuuuau

SEQ ID NO: 2223675 - RNA, 15 nt, Human
uuauagcuacuaauu

SEQ ID NO: 2223676 - RNA, 17 nt, Human
gacgagaaaacaauaac

SEQ ID NO: 2223677 - RNA, 18 nt, Human
cuccagccugagcgacag

SEQ ID NO: 2223678 - RNA, 19 nt, Human
cugcaaagcccagcuugaa

SEQ ID NO: 2223679 - RNA, 21 nt, Human
caaagcccagcuugaaaccuu

SEQ ID NO: 2223680 - RNA, 19 nt, Human
acucugucucaguccauga

SEQ ID NO: 2223681 - RNA, 17 nt, Human
uaauuuuuauauuugaa

SEQ ID NO: 2223682 - RNA, 14 nt, Human
aguuuuuuuuuaaa

SEQ ID NO: 2223683 - RNA, 14 nt, Human
agcggaccuuccca

SEQ ID NO: 2223684 - RNA, 22 nt, Human
uuuuauagcuacuaauuuuaaa

SEQ ID NO: 2223685 - RNA, 18 nt, Human
ucccaacuauaaaacuag

SEQ ID NO: 2223686 - RNA, 21 nt, Human
auuauauuuauuacuguaaga

SEQ ID NO: 2223687 - RNA, 18 nt, Human
gacccacuggacucaccu

SEQ ID NO: 2223688 - RNA, 15 nt, Human
cauccugcaggcagc

SEQ ID NO: 2223689 - RNA, 15 nt, Human
agcucuaucaccaag

SEQ ID NO: 2223690 - RNA, 17 nt, Human
agacagugaaagaaaau

SEQ ID NO: 2223691 - RNA, 22 nt, Human
agugagcagucaggaaagagaa

SEQ ID NO: 2223692 - RNA, 18 nt, Human
gccuuggggcugaugcag

SEQ ID NO: 2223693 - RNA, 17 nt, Human
uaaaagacaaggaaaaa

SEQ ID NO: 2223694 - RNA, 17 nt, Human
cuggcaaggguucaccu

SEQ ID NO: 2223695 - RNA, 12 nt, Human
ucugcacacagc

SEQ ID NO: 2223696 - RNA, 20 nt, Human
caccucagcugccuccccag

SEQ ID NO: 2223697 - RNA, 20 nt, Human
ucaauaaaauccauacauuu

SEQ ID NO: 2223698 - RNA, 19 nt, Human
aguauuucuaugaaauauu

SEQ ID NO: 2223699 - RNA, 16 nt, Human
uaccuuuugcuguggc

SEQ ID NO: 2223700 - RNA, 17 nt, Human
ggagcucguggaacagu

SEQ ID NO: 2223701 - RNA, 18 nt, Human
cucauccugcaggcagcu

SEQ ID NO: 2223702 - RNA, 18 nt, Human
cagaguacuggcugaugg

SEQ ID NO: 2223703 - RNA, 21 nt, Human
cucaguccaugaagauguaga

SEQ ID NO: 2223704 - RNA, 17 nt, Human
aucaaggguacacugcc

SEQ ID NO: 2223705 - RNA, 18 nt, Human
caaggcugauuaaaccaa

SEQ ID NO: 2223706 - RNA, 20 nt, Human
ccauacuaauuauacccccu

SEQ ID NO: 2223707 - RNA, 15 nt, Human
ccucuucugacacua

SEQ ID NO: 2223708 - RNA, 16 nt, Human
uacauuuguauaaaau

SEQ ID NO: 2223709 - RNA, 18 nt, Human
uuacaaaugggaaacaaa

SEQ ID NO: 2223710 - RNA, 13 nt, Human
acggggugaaacc

SEQ ID NO: 2223711 - RNA, 20 nt, Human
uaacaagccuccuuuuaaag

SEQ ID NO: 2223712 - RNA, 13 nt, Human
acaauaaaagaca

SEQ ID NO: 2223713 - RNA, 15 nt, Human
acucaacaaacauaa

SEQ ID NO: 2223714 - RNA, 12 nt, Human
ugagagacacac

SEQ ID NO: 2223715 - RNA, 22 nt, Human
aaugaaauggugaaaugcagag

SEQ ID NO: 2223716 - RNA, 19 nt, Human
ugagcgcccacuagaccca

SEQ ID NO: 2223717 - RNA, 13 nt, Human
uuaugcuaaguga

SEQ ID NO: 2223718 - RNA, 14 nt, Human
guaacugauuugua

SEQ ID NO: 2223719 - RNA, 18 nt, Human
agcuucucauccugcagg

SEQ ID NO: 2223720 - RNA, 15 nt, Human
uuaauucugaaagca

SEQ ID NO: 2223721 - RNA, 15 nt, Human
ucuuauaauuuaaaa

SEQ ID NO: 2223722 - RNA, 23 nt, Human
ggaugaauuaaguuuuuuuuuaa

SEQ ID NO: 2223723 - RNA, 19 nt, Human
caacucccugccccccagc

SEQ ID NO: 2223724 - RNA, 15 nt, Human
ugagaaggagcuccc

SEQ ID NO: 2223725 - RNA, 22 nt, Human
accucagcugccuccccagcuc

SEQ ID NO: 2223726 - RNA, 14 nt, Human
ggcaauagucaaau

SEQ ID NO: 2223727 - RNA, 18 nt, Human
uuuguuaaaugauuucau

SEQ ID NO: 2223728 - RNA, 17 nt, Human
caaauccaaugaaauga

SEQ ID NO: 2223729 - RNA, 14 nt, Human
cugaggcuccacuu

SEQ ID NO: 2223730 - RNA, 19 nt, Human
cuccagcuggccgggagcc

SEQ ID NO: 2223731 - RNA, 17 nt, Human
agucccaggcugagccu

SEQ ID NO: 2223732 - RNA, 14 nt, Human
uugcuggagcucug

SEQ ID NO: 2223733 - RNA, 15 nt, Human
auccugccccugagc

SEQ ID NO: 2223734 - RNA, 18 nt, Human
auccccaagccuggcaag

SEQ ID NO: 2223735 - RNA, 19 nt, Human
ccccuauccuacuuccccu

SEQ ID NO: 2223736 - RNA, 22 nt, Human
caaaugggaaacaaaaggauaa

SEQ ID NO: 2223737 - RNA, 20 nt, Human
aggcugagaugggagaauca

SEQ ID NO: 2223738 - RNA, 21 nt, Human
ugcccugaaagucccagauca

SEQ ID NO: 2223739 - RNA, 16 nt, Human
aggccaugggacaggg

SEQ ID NO: 2223740 - RNA, 22 nt, Human
agaagcaccaaucaugaauuag

SEQ ID NO: 2223741 - RNA, 19 nt, Human
gcacuaguauuucuaugaa

SEQ ID NO: 2223742 - RNA, 18 nt, Human
gccccugcacuccagccu

SEQ ID NO: 2223743 - RNA, 14 nt, Human
cucagucucccucc

SEQ ID NO: 2223744 - RNA, 22 nt, Human
gccauagucauucugccugccc

SEQ ID NO: 2223745 - RNA, 23 nt, Human
gaggcauccaaaggcuccugaga

SEQ ID NO: 2223746 - RNA, 17 nt, Human
aauucuugccaaauaua

SEQ ID NO: 2223747 - RNA, 22 nt, Human
uuccccuuccuaauuccacagc

SEQ ID NO: 2223748 - RNA, 22 nt, Human
cccuauccuacuuccccuuccu

SEQ ID NO: 2223749 - RNA, 13 nt, Human
uuggacgagaaaa

SEQ ID NO: 2223750 - RNA, 16 nt, Human
aauuccacagcugcuc

SEQ ID NO: 2223751 - RNA, 15 nt, Human
aaaaauaacaaugaa

SEQ ID NO: 2223752 - RNA, 14 nt, Human
aaaagacagugaaa

SEQ ID NO: 2223753 - RNA, 20 nt, Human
auacugugugcuaaaacaag

SEQ ID NO: 2223754 - RNA, 24 nt, Human
aaagacagcuucucauccugcagg

SEQ ID NO: 2223755 - RNA, 23 nt, Human
caaagcugaaauggacuuuugua

SEQ ID NO: 2223756 - RNA, 18 nt, Human
gaggcggauugagaagga

SEQ ID NO: 2223757 - RNA, 14 nt, Human
ucugggcagacucu

SEQ ID NO: 2223758 - RNA, 16 nt, Human
agguugcagugagccg

SEQ ID NO: 2223759 - RNA, 21 nt, Human
aaagaaaauaacgauaaaaga

SEQ ID NO: 2223760 - RNA, 21 nt, Human
aaaagguauuuuaaucaccaa

SEQ ID NO: 2223761 - RNA, 17 nt, Human
agaaucacuugaacccg

SEQ ID NO: 2223762 - RNA, 15 nt, Human
ccaugaugcugagcc

SEQ ID NO: 2223763 - RNA, 15 nt, Human
gccccugggaccagg

SEQ ID NO: 2223764 - RNA, 20 nt, Human
cacuguggguagacacacau

SEQ ID NO: 2223765 - RNA, 16 nt, Human
ccacuuauaggaauug

SEQ ID NO: 2223766 - RNA, 18 nt, Human
ccucuggcuccagcuggc

SEQ ID NO: 2223767 - RNA, 22 nt, Human
aauuuaaaaaaaaaccugagcc

SEQ ID NO: 2223768 - RNA, 15 nt, Human
acaaggaaaaaauaa

SEQ ID NO: 2223769 - RNA, 19 nt, Human
aaaacuaggugcugcagcc

SEQ ID NO: 2223770 - RNA, 12 nt, Human
aaaugaaagcag

SEQ ID NO: 2223771 - RNA, 18 nt, Human
ggggucagccagcccucu

SEQ ID NO: 2223772 - RNA, 17 nt, Human
guuuaauucugaaagca

SEQ ID NO: 2223773 - RNA, 12 nt, Human
aaaauaacaaua

SEQ ID NO: 2223774 - RNA, 13 nt, Human
uuaaauuguaaua

SEQ ID NO: 2223775 - RNA, 21 nt, Human
auaguuguaccgcaaugugac

SEQ ID NO: 2223776 - RNA, 16 nt, Human
gccaaggaugccccgu

SEQ ID NO: 2223777 - RNA, 14 nt, Human
aaagaggaaugaag

SEQ ID NO: 2223778 - RNA, 21 nt, Human
cuucucaccugugagaccaaa

SEQ ID NO: 2223779 - RNA, 19 nt, Human
gaaggagcucccaggaggg

SEQ ID NO: 2223780 - RNA, 15 nt, Human
gcaggcaugagucag

SEQ ID NO: 2223781 - RNA, 21 nt, Human
ugcagaguacuggcugaugga

SEQ ID NO: 2223782 - RNA, 15 nt, Human
aauaacgauaaaaga

SEQ ID NO: 2223783 - RNA, 17 nt, Human
aacaguuaccucugccu

SEQ ID NO: 2223784 - RNA, 15 nt, Human
ccugccccccagccc

SEQ ID NO: 2223785 - RNA, 18 nt, Human
ccaggaggggcuucuggg

SEQ ID NO: 2223786 - RNA, 19 nt, Human
auccuacaagacacaguga

SEQ ID NO: 2223787 - RNA, 18 nt, Human
aagucuuucacauuuaaa

SEQ ID NO: 2223788 - RNA, 22 nt, Human
augcugagcccggaaacuccac

SEQ ID NO: 2223789 - RNA, 18 nt, Human
cccucuggcuccagcugg

SEQ ID NO: 2223790 - RNA, 14 nt, Human
agaaaugaaagcag

SEQ ID NO: 2223791 - RNA, 19 nt, Human
aaucuacacuccagugaga

SEQ ID NO: 2223792 - RNA, 21 nt, Human
caacacacagauuugagcuca

SEQ ID NO: 2223793 - RNA, 19 nt, Human
agacagugaaagaaaauaa

SEQ ID NO: 2223794 - RNA, 12 nt, Human
uccugcaggcag

SEQ ID NO: 2223795 - RNA, 20 nt, Human
gaaaauaacaauaaaagaca

SEQ ID NO: 2223796 - RNA, 16 nt, Human
ggggcuucugggcaga

SEQ ID NO: 2223797 - RNA, 14 nt, Human
gcugauuaaaccaa

SEQ ID NO: 2223798 - RNA, 14 nt, Human
auuauuuuuuaaaa

SEQ ID NO: 2223799 - RNA, 14 nt, Human
uauaauuuaaaaua

SEQ ID NO: 2223800 - RNA, 16 nt, Human
guuuuuuuuuaaaaaa

SEQ ID NO: 2223801 - RNA, 12 nt, Human
gcaaagcccagc

SEQ ID NO: 2223802 - RNA, 18 nt, Human
acaaaugggaaacaaaag

SEQ ID NO: 2223803 - RNA, 21 nt, Human
cagagguccacaacacacaga

SEQ ID NO: 2223804 - RNA, 15 nt, Human
uggacucaccucccc

SEQ ID NO: 2223805 - RNA, 14 nt, Human
acuuggucugugag

SEQ ID NO: 2223806 - RNA, 16 nt, Human
ccccaucucuucuggg

SEQ ID NO: 2223807 - RNA, 16 nt, Human
gaauggcuaagcaaaa

SEQ ID NO: 2223808 - RNA, 13 nt, Human
cagcugccucccc

SEQ ID NO: 2223809 - RNA, 16 nt, Human
ccuacaugagguacug

SEQ ID NO: 2223810 - RNA, 14 nt, Human
auuguccaggucua

SEQ ID NO: 2223811 - RNA, 17 nt, Human
gacucaccucccccauc

SEQ ID NO: 2223812 - RNA, 17 nt, Human
uuauauuugaaauauug

SEQ ID NO: 2223813 - RNA, 18 nt, Human
auaauccuaaacauauga

SEQ ID NO: 2223814 - RNA, 15 nt, Human
aaacauaugaauuau

SEQ ID NO: 2223815 - RNA, 13 nt, Human
ccuucucaccugu

SEQ ID NO: 2223816 - RNA, 14 nt, Human
ccagcuagaauuca

SEQ ID NO: 2223817 - RNA, 19 nt, Human
acuaucucauuuccaagca

SEQ ID NO: 2223818 - RNA, 22 nt, Human
gugccucaccccuugccauaau

SEQ ID NO: 2223819 - RNA, 20 nt, Human
gcuugcagagaugaggccgc

SEQ ID NO: 2223820 - RNA, 16 nt, Human
ccugagcuugcagaga

SEQ ID NO: 2223821 - RNA, 19 nt, Human
uucccuugaugaagaaguu

SEQ ID NO: 2223822 - RNA, 16 nt, Human
acagagacagaaagca

SEQ ID NO: 2223823 - RNA, 18 nt, Human
ccaaaggcuccugagaca

SEQ ID NO: 2223824 - RNA, 16 nt, Human
ggccuccauccugagg

SEQ ID NO: 2223825 - RNA, 17 nt, Human
uaugcuaagugaaauaa

SEQ ID NO: 2223826 - RNA, 17 nt, Human
caccucccccaucucuu

SEQ ID NO: 2223827 - RNA, 13 nt, Human
ccugagcuugcag

SEQ ID NO: 2223828 - RNA, 18 nt, Human
agucauucugccugcccu

SEQ ID NO: 2223829 - RNA, 21 nt, Human
acaggauggcaggaggcaucc

SEQ ID NO: 2223830 - RNA, 18 nt, Human
auugagaaggagcuccca

SEQ ID NO: 2223831 - RNA, 20 nt, Human
uuccacagaagcuccaggua

SEQ ID NO: 2223832 - RNA, 16 nt, Human
agaacucugagcagug

SEQ ID NO: 2223833 - RNA, 18 nt, Human
uaucaaaagaaagaaaau

SEQ ID NO: 2223834 - RNA, 19 nt, Human
uccacauccugugggaccu

SEQ ID NO: 2223835 - RNA, 12 nt, Human
accccugagcuu

SEQ ID NO: 2223836 - RNA, 15 nt, Human
gacucaccuccccca

SEQ ID NO: 2223837 - RNA, 14 nt, Human
ugcagccccuggga

SEQ ID NO: 2223838 - RNA, 13 nt, Human
ugaaagaaaauaa

SEQ ID NO: 2223839 - RNA, 13 nt, Human
cucugagccuugg

SEQ ID NO: 2223840 - RNA, 16 nt, Human
uuucuauaauuuaaau

SEQ ID NO: 2223841 - RNA, 13 nt, Human
aaaugaaagcagg

SEQ ID NO: 2223842 - RNA, 18 nt, Human
cauggaauuggagcucgu

SEQ ID NO: 2223843 - RNA, 17 nt, Human
cugauggguuucuccag

SEQ ID NO: 2223844 - RNA, 15 nt, Human
aagccuccuuuuaaa

SEQ ID NO: 2223845 - RNA, 17 nt, Human
uguaaaggaauuuaaaa

SEQ ID NO: 2223846 - RNA, 20 nt, Human
caaauguucaucaaugaaug

SEQ ID NO: 2223847 - RNA, 14 nt, Human
cucauccugcaggc

SEQ ID NO: 2223848 - RNA, 14 nt, Human
aaacuuuuccaaug

SEQ ID NO: 2223849 - RNA, 22 nt, Human
auuacuguaagaaaauaucacu

SEQ ID NO: 2223850 - RNA, 20 nt, Human
ccagcuugaaaccuucacuu

SEQ ID NO: 2223851 - RNA, 21 nt, Human
cuaaauugacacuuaaaaaug

SEQ ID NO: 2223852 - RNA, 13 nt, Human
gccuccccagcuc

SEQ ID NO: 2223853 - RNA, 17 nt, Human
uuccaagccucaugucc

SEQ ID NO: 2223854 - RNA, 22 nt, Human
uauuucuaugaaauauuauguu

SEQ ID NO: 2223855 - RNA, 19 nt, Human
acuuauuuguacauuuuuu

SEQ ID NO: 2223856 - RNA, 20 nt, Human
cugagccucagucucccucc

SEQ ID NO: 2223857 - RNA, 15 nt, Human
ugagcucagcccugg

SEQ ID NO: 2223858 - RNA, 16 nt, Human
cauuucuaaagccauu

SEQ ID NO: 2223859 - RNA, 11 nt, Human
ggguuucucca

SEQ ID NO: 2223860 - RNA, 19 nt, Human
gagccugaucaccugcccu

SEQ ID NO: 2223861 - RNA, 22 nt, Human
uaaaacaagcacuaaacaaaga

SEQ ID NO: 2223862 - RNA, 17 nt, Human
augccccgucccccucu

SEQ ID NO: 2223863 - RNA, 22 nt, Human
uugacccacaagaaaugaaagc

SEQ ID NO: 2223864 - RNA, 14 nt, Human
uauuuauuuuaaua

SEQ ID NO: 2223865 - RNA, 16 nt, Human
uccugcaauuccacuu

SEQ ID NO: 2223866 - RNA, 16 nt, Human
agagggaauugcagag

SEQ ID NO: 2223867 - RNA, 22 nt, Human
aaacauguuuaucguauuugau

SEQ ID NO: 2223868 - RNA, 17 nt, Human
aaagcuccauuuuuagu

SEQ ID NO: 2223869 - RNA, 22 nt, Human
cuccugccuaagugcagccccg

SEQ ID NO: 2223870 - RNA, 14 nt, Human
gaaaacaauaacga

SEQ ID NO: 2223871 - RNA, 17 nt, Human
gaaaaucaggcuggcca

SEQ ID NO: 2223872 - RNA, 16 nt, Human
cacuuaaaaaugguuu

SEQ ID NO: 2223873 - RNA, 13 nt, Human
uggacgagaaaac

SEQ ID NO: 2223874 - RNA, 16 nt, Human
cagauccccaagccug

SEQ ID NO: 2223875 - RNA, 20 nt, Human
aaacuuuaugcuaagugaaa

SEQ ID NO: 2223876 - RNA, 21 nt, Human
acagcccuucuuuccacagaa

SEQ ID NO: 2223877 - RNA, 22 nt, Human
ggacaguaaaauccacagacca

SEQ ID NO: 2223878 - RNA, 15 nt, Human
gccuugggaccccug

SEQ ID NO: 2223879 - RNA, 21 nt, Human
aaaugucuugcuugauuguau

SEQ ID NO: 2223880 - RNA, 20 nt, Human
agcuucacuguaaaauaaua

SEQ ID NO: 2223881 - RNA, 18 nt, Human
agucagucugaugagaac

SEQ ID NO: 2223882 - RNA, 18 nt, Human
cagagacagaaagcagaa

SEQ ID NO: 2223883 - RNA, 14 nt, Human
ggaaguagaggagg

SEQ ID NO: 2223884 - RNA, 17 nt, Human
cauccugugggaccugg

SEQ ID NO: 2223885 - RNA, 18 nt, Human
uaagcuucacuguaaaau

SEQ ID NO: 2223886 - RNA, 17 nt, Human
aaucuuauaauuuaaaa

SEQ ID NO: 2223887 - RNA, 20 nt, Human
cccuuccuaauuccacagcu

SEQ ID NO: 2223888 - RNA, 15 nt, Human
guacuggcugaugga

SEQ ID NO: 2223889 - RNA, 16 nt, Human
agugaaauauuauuuu

SEQ ID NO: 2223890 - RNA, 13 nt, Human
augacauuuuguu

SEQ ID NO: 2223891 - RNA, 17 nt, Human
cugaucaccugcccugc

SEQ ID NO: 2223892 - RNA, 15 nt, Human
cucccuuggggccua

SEQ ID NO: 2223893 - RNA, 20 nt, Human
accucugccucagaaaacaa

SEQ ID NO: 2223894 - RNA, 17 nt, Human
guugcugggggggauug

SEQ ID NO: 2223895 - RNA, 16 nt, Human
gcugcagccccuggga

SEQ ID NO: 2223896 - RNA, 22 nt, Human
aaaaaaccugagccccaaaagg

SEQ ID NO: 2223897 - RNA, 12 nt, Human
aauugcagagua

SEQ ID NO: 2223898 - RNA, 15 nt, Human
uuuaauaauuuuuaa

SEQ ID NO: 2223899 - RNA, 19 nt, Human
aaacaauaacgauaaaaga

SEQ ID NO: 2223900 - RNA, 17 nt, Human
guguccccuauccuacu

SEQ ID NO: 2223901 - RNA, 18 nt, Human
aaagaaaaucaggcuggc

SEQ ID NO: 2223902 - RNA, 20 nt, Human
aagacagugaaagaaaauaa

SEQ ID NO: 2223903 - RNA, 17 nt, Human
uuaauaauuuuuaauua

SEQ ID NO: 2223904 - RNA, 15 nt, Human
gccuaagugcagccc

SEQ ID NO: 2223905 - RNA, 22 nt, Human
caaauuuacagagacagaaagc

SEQ ID NO: 2223906 - RNA, 16 nt, Human
aucaaaagaaagaaaa

SEQ ID NO: 2223907 - RNA, 12 nt, Human
uguuugaaagcu

SEQ ID NO: 2223908 - RNA, 13 nt, Human
guaacuaauuuua

SEQ ID NO: 2223909 - RNA, 17 nt, Human
acucaccucccccaucu

SEQ ID NO: 2223910 - RNA, 13 nt, Human
agccucagucucc

SEQ ID NO: 2223911 - RNA, 21 nt, Human
auuuguauaaaauaauuuuua

SEQ ID NO: 2223912 - RNA, 15 nt, Human
uaauauugcaaggca

SEQ ID NO: 2223913 - RNA, 23 nt, Human
ugaauuacauuuguauaaaauaa

SEQ ID NO: 2223914 - RNA, 11 nt, Human
ggucacaggaa

SEQ ID NO: 2223915 - RNA, 14 nt, Human
aagcucuaucacca

SEQ ID NO: 2223916 - RNA, 21 nt, Human
ccaaggaugccccgucccccu

SEQ ID NO: 2223917 - RNA, 19 nt, Human
aagcuuguauuccuuuuuc

SEQ ID NO: 2223918 - RNA, 17 nt, Human
aaaacaccucagcugcc

SEQ ID NO: 2223919 - RNA, 15 nt, Human
uucugcacacagcac

SEQ ID NO: 2223920 - RNA, 18 nt, Human
ugggcacaggguuuaugu

SEQ ID NO: 2223921 - RNA, 17 nt, Human
ucgggauuaguacacac

SEQ ID NO: 2223922 - RNA, 16 nt, Human
auuauacccccugcaa

SEQ ID NO: 2223923 - RNA, 17 nt, Human
uccuacaagacacagug

SEQ ID NO: 2223924 - RNA, 17 nt, Human
cugggaccaggcacccc

SEQ ID NO: 2223925 - RNA, 14 nt, Human
uucagccugaaaga

SEQ ID NO: 2223926 - RNA, 12 nt, Human
cccccagcccuc

SEQ ID NO: 2223927 - RNA, 18 nt, Human
gaagcaccaaucaugaau

SEQ ID NO: 2223928 - RNA, 14 nt, Human
augauguuuagaaa

SEQ ID NO: 2223929 - RNA, 17 nt, Human
uuauaaucuuucacagg

SEQ ID NO: 2223930 - RNA, 21 nt, Human
cuucuaaccugaacugauggg

SEQ ID NO: 2223931 - RNA, 14 nt, Human
uugacccacaagaa

SEQ ID NO: 2223932 - RNA, 23 nt, Human
agggaagggggaacaugagccuu

SEQ ID NO: 2223933 - RNA, 16 nt, Human
auaacuggaaacuuca

SEQ ID NO: 2223934 - RNA, 14 nt, Human
auggcaggaggcau

SEQ ID NO: 2223935 - RNA, 16 nt, Human
ucuucaacucccugcc

SEQ ID NO: 2223936 - RNA, 23 nt, Human
aggaugguucccuugaugaagaa

SEQ ID NO: 2223937 - RNA, 22 nt, Human
cugccuccccagcucuauccca

SEQ ID NO: 2223938 - RNA, 16 nt, Human
ucuugagguaaaagca

SEQ ID NO: 2223939 - RNA, 23 nt, Human
aucgugucuggcguuguggggau

SEQ ID NO: 2223940 - RNA, 21 nt, Human
ugaacugauggguuucuccag

SEQ ID NO: 2223941 - RNA, 21 nt, Human
ucaccugggcugaggcauccu

SEQ ID NO: 2223942 - RNA, 14 nt, Human
agagguccacaaca

SEQ ID NO: 2223943 - RNA, 20 nt, Human
aaugaauacuuuauaaagga

SEQ ID NO: 2223944 - RNA, 13 nt, Human
acacuuaaaaaug

SEQ ID NO: 2223945 - RNA, 18 nt, Human
uaauaauguuucaaacau

SEQ ID NO: 2223946 - RNA, 17 nt, Human
guauuauuuuuuaaaaa

SEQ ID NO: 2223947 - RNA, 21 nt, Human
ggucaagaagcaucgugucug

SEQ ID NO: 2223948 - RNA, 20 nt, Human
acuaaauugacacuuaaaaa

SEQ ID NO: 2223949 - RNA, 14 nt, Human
gccucagucucccu

SEQ ID NO: 2223950 - RNA, 22 nt, Human
aaaucaggguuaguauugucca

SEQ ID NO: 2223951 - RNA, 23 nt, Human
caggcaugagucagucugaugag

SEQ ID NO: 2223952 - RNA, 23 nt, Human
aagucccagaucaagccugccuc

SEQ ID NO: 2223953 - RNA, 14 nt, Human
uucuggaauaaucc

SEQ ID NO: 2223954 - RNA, 23 nt, Human
uagacacacaugaaguccaagca

SEQ ID NO: 2223955 - RNA, 19 nt, Human
uggugagugccuguaauca

SEQ ID NO: 2223956 - RNA, 14 nt, Human
cucagcugccuccc

SEQ ID NO: 2223957 - RNA, 15 nt, Human
augggacagggagga

SEQ ID NO: 2223958 - RNA, 18 nt, Human
cagcugcucaauaaagua

SEQ ID NO: 2223959 - RNA, 22 nt, Human
ugaaaaaguucugcagauaaac

SEQ ID NO: 2223960 - RNA, 21 nt, Human
agggugauauuaaccaggggc

SEQ ID NO: 2223961 - RNA, 19 nt, Human
auuucuucaacucccugcc

SEQ ID NO: 2223962 - RNA, 19 nt, Human
aggucuaccaaaaaucuca

SEQ ID NO: 2223963 - RNA, 22 nt, Human
ugggcacuguggguagacacac

SEQ ID NO: 2223964 - RNA, 17 nt, Human
cuuccucugagccuugg

SEQ ID NO: 2223965 - RNA, 13 nt, Human
aacacaacuauau

SEQ ID NO: 2223966 - RNA, 20 nt, Human
gagccucagucucccucccu

SEQ ID NO: 2223967 - RNA, 22 nt, Human
acauccuacaagacacagugac

SEQ ID NO: 2223968 - RNA, 16 nt, Human
cagggcucacagaauu

SEQ ID NO: 2223969 - RNA, 21 nt, Human
gacagcuucucauccugcagg

SEQ ID NO: 2223970 - RNA, 15 nt, Human
acuuuauaaaggauu

SEQ ID NO: 2223971 - RNA, 15 nt, Human
cuucaacucccugcc

SEQ ID NO: 2223972 - RNA, 15 nt, Human
uccaagccucauguc

SEQ ID NO: 2223973 - RNA, 23 nt, Human
agaaugauuaugaauuacauuug

SEQ ID NO: 2223974 - RNA, 21 nt, Human
cucagugucaaugcagccccc

SEQ ID NO: 2223975 - RNA, 17 nt, Human
aauauugcaaggcaaag

SEQ ID NO: 2223976 - RNA, 16 nt, Human
aucaauuuaaaaaaaa

SEQ ID NO: 2223977 - RNA, 14 nt, Human
uaguaucaaaagaa

SEQ ID NO: 2223978 - RNA, 14 nt, Human
agcccucuucugac

SEQ ID NO: 2223979 - RNA, 15 nt, Human
ggugcugcagccccu

SEQ ID NO: 2223980 - RNA, 23 nt, Human
uuuguauaaaauaauuuuuauau

SEQ ID NO: 2223981 - RNA, 13 nt, Human
aagacagugaaag

SEQ ID NO: 2223982 - RNA, 13 nt, Human
ugagcggaccuuc

SEQ ID NO: 2223983 - RNA, 18 nt, Human
caguuguugcccacagcu

SEQ ID NO: 2223984 - RNA, 21 nt, Human
uuacauuuguauaaaauaauu

SEQ ID NO: 2223985 - RNA, 23 nt, Human
gcccuggugccucaccccuugcc

SEQ ID NO: 2223986 - RNA, 14 nt, Human
uuuguauaaaauaa

SEQ ID NO: 2223987 - RNA, 16 nt, Human
ucagucucccucccuu

SEQ ID NO: 2223988 - RNA, 16 nt, Human
agccucagucucccuc

SEQ ID NO: 2223989 - RNA, 19 nt, Human
cccccucuggcuccagcug

SEQ ID NO: 2223990 - RNA, 15 nt, Human
aagccuggcaaggga

SEQ ID NO: 2223991 - RNA, 19 nt, Human
ugaaauggacuuuuguaca

SEQ ID NO: 2223992 - RNA, 16 nt, Human
cagaagcaacccaaau

SEQ ID NO: 2223993 - RNA, 16 nt, Human
cuccacauccuguggg

SEQ ID NO: 2223994 - RNA, 18 nt, Human
cccacuagacccacugga

SEQ ID NO: 2223995 - RNA, 14 nt, Human
agguugcagugagc

SEQ ID NO: 2223996 - RNA, 20 nt, Human
cugcacuccagccugagcga

SEQ ID NO: 2223997 - RNA, 14 nt, Human
aaaggaauuuaaaa

SEQ ID NO: 2223998 - RNA, 22 nt, Human
caaugcuguauuuuaaaagaau

SEQ ID NO: 2223999 - RNA, 21 nt, Human
uuuucaggcuagauguaugua

SEQ ID NO: 2224000 - RNA, 22 nt, Human
agacccacuggacucaccuccc

SEQ ID NO: 2224001 - RNA, 14 nt, Human
acaagagcuuaaca

SEQ ID NO: 2224002 - RNA, 16 nt, Human
gauggcaggaggcauc

SEQ ID NO: 2224003 - RNA, 16 nt, Human
auaauccuaaacauau

SEQ ID NO: 2224004 - RNA, 14 nt, Human
ucuauaauuuaaau

SEQ ID NO: 2224005 - RNA, 14 nt, Human
ucuuuuuuuuaaua

SEQ ID NO: 2224006 - RNA, 15 nt, Human
gcacagccucuuaga

SEQ ID NO: 2224007 - RNA, 23 nt, Human
cacaagaaaugaaagcagggacu

SEQ ID NO: 2224008 - RNA, 21 nt, Human
caucuagcaugucgucaaagc

SEQ ID NO: 2224009 - RNA, 13 nt, Human
auccugaggcucc

SEQ ID NO: 2224010 - RNA, 22 nt, Human
aaugggcacaggguuuauguuu

SEQ ID NO: 2224011 - RNA, 16 nt, Human
guuccuuccucugagc

SEQ ID NO: 2224012 - RNA, 17 nt, Human
ucuuauaauuuaaaaua

SEQ ID NO: 2224013 - RNA, 20 nt, Human
ugccccccagcccuccuuau

SEQ ID NO: 2224014 - RNA, 14 nt, Human
cuaucaauccaaga

SEQ ID NO: 2224015 - RNA, 14 nt, Human
ccccugagcuugca

SEQ ID NO: 2224016 - RNA, 19 nt, Human
cuaagcuucacuguaaaau

SEQ ID NO: 2224017 - RNA, 15 nt, Human
gggucagccagcccu

SEQ ID NO: 2224018 - RNA, 21 nt, Human
augucauuugcuggagcucug

SEQ ID NO: 2224019 - RNA, 20 nt, Human
ugauuauaugucacuuugcu

SEQ ID NO: 2224020 - RNA, 16 nt, Human
uauuuuugugauuuug

SEQ ID NO: 2224021 - RNA, 24 nt, Human
ccagguaccuucucaccugugaga

SEQ ID NO: 2224022 - RNA, 19 nt, Human
cuaguaucaaaagaaagaa

SEQ ID NO: 2224023 - RNA, 16 nt, Human
ccugaucaccugcccu

SEQ ID NO: 2224024 - RNA, 23 nt, Human
acucuauguucuaagaagugaaa

SEQ ID NO: 2224025 - RNA, 15 nt, Human
accaaggcugauuaa

SEQ ID NO: 2224026 - RNA, 15 nt, Human
gcaacccaaauguuc

SEQ ID NO: 2224027 - RNA, 18 nt, Human
ccugaaagaggaaugaag

SEQ ID NO: 2224028 - RNA, 17 nt, Human
uccagcuggccgggagc

SEQ ID NO: 2224029 - RNA, 16 nt, Human
uucaauaaaacuuuuc

SEQ ID NO: 2224030 - RNA, 22 nt, Human
aggcuccacuuggucugugaga

SEQ ID NO: 2224031 - RNA, 18 nt, Human
agaagcaacccaaauguu

SEQ ID NO: 2224032 - RNA, 19 nt, Human
guccaggucuaccaaaaau

SEQ ID NO: 2224033 - RNA, 16 nt, Human
uugccauaauuacuau

SEQ ID NO: 2224034 - RNA, 20 nt, Human
augucgucaaagcugaaaug

SEQ ID NO: 2224035 - RNA, 22 nt, Human
ggcuaagcuucacuguaaaaua

SEQ ID NO: 2224036 - RNA, 10 nt, Human
auguuuucag

SEQ ID NO: 2224037 - RNA, 15 nt, Human
uuuaugguuguauua

SEQ ID NO: 2224038 - RNA, 14 nt, Human
caaaugcauuucua

SEQ ID NO: 2224039 - RNA, 16 nt, Human
aaaagcaucacaugaa

SEQ ID NO: 2224040 - RNA, 15 nt, Human
cccccagcccuccuu

SEQ ID NO: 2224041 - RNA, 23 nt, Human
aaauuuacagagacagaaagcag

SEQ ID NO: 2224042 - RNA, 13 nt, Human
accuggccgcagu

SEQ ID NO: 2224043 - RNA, 16 nt, Human
acauuuauauuuuugu

SEQ ID NO: 2224044 - RNA, 20 nt, Human
caagccuccuuuuaaaguaa

SEQ ID NO: 2224045 - RNA, 14 nt, Human
cagaccgggguucc

SEQ ID NO: 2224046 - RNA, 17 nt, Human
gauacuccauggggugg

SEQ ID NO: 2224047 - RNA, 22 nt, Human
gagcuaggggggucagccagcc

SEQ ID NO: 2224048 - RNA, 21 nt, Human
ugaaacgaggauugggaaaaa

SEQ ID NO: 2224049 - RNA, 17 nt, Human
ccuacuuccccuuccua

SEQ ID NO: 2224050 - RNA, 11 nt, Human
uuauauuuauu

SEQ ID NO: 2224051 - RNA, 23 nt, Human
ccccucuggcuccagcuggccgg

SEQ ID NO: 2224052 - RNA, 16 nt, Human
auuccaccuacaugag

SEQ ID NO: 2224053 - RNA, 20 nt, Human
ugagucccaggcugagccuc

SEQ ID NO: 2224054 - RNA, 18 nt, Human
uauaacaaugcuguauuu

SEQ ID NO: 2224055 - RNA, 20 nt, Human
acaagacacagugaccauac

SEQ ID NO: 2224056 - RNA, 17 nt, Human
ucucauccugcaggcag

SEQ ID NO: 2224057 - RNA, 12 nt, Human
aauaaaguacaa

SEQ ID NO: 2224058 - RNA, 21 nt, Human
gccucagggugcacacaggau

SEQ ID NO: 2224059 - RNA, 22 nt, Human
gagucccaggcugagccucagu

SEQ ID NO: 2224060 - RNA, 21 nt, Human
auuuuuucucuaggaaauauu

SEQ ID NO: 2224061 - RNA, 14 nt, Human
uaacuaauuuuaac

SEQ ID NO: 2224062 - RNA, 22 nt, Human
cauaaauguugacaugggacau

SEQ ID NO: 2224063 - RNA, 18 nt, Human
ccugcccugaaaguccca

SEQ ID NO: 2224064 - RNA, 20 nt, Human
auuuugugauugauuauaug

SEQ ID NO: 2224065 - RNA, 15 nt, Human
ucauaauaaguugca

SEQ ID NO: 2224066 - RNA, 18 nt, Human
cagccucuuagaugcagu

SEQ ID NO: 2224067 - RNA, 17 nt, Human
cuggagggaagccuugg

SEQ ID NO: 2224068 - RNA, 21 nt, Human
uaguauuucuaugaaauauua

SEQ ID NO: 2224069 - RNA, 14 nt, Human
caggaggcauccaa

SEQ ID NO: 2224070 - RNA, 14 nt, Human
cuggccgggagccu

SEQ ID NO: 2224071 - RNA, 17 nt, Human
gccccagauaccaugau

SEQ ID NO: 2224072 - RNA, 15 nt, Human
cuacuaauuuuaaaa

SEQ ID NO: 2224073 - RNA, 12 nt, Human
aucguguccccu

SEQ ID NO: 2224074 - RNA, 14 nt, Human
ugcuggagcucugc

SEQ ID NO: 2224075 - RNA, 13 nt, Human
uacuuuauuuucu

SEQ ID NO: 2224076 - RNA, 23 nt, Human
ugagucagucugaugagaacucu

SEQ ID NO: 2224077 - RNA, 23 nt, Human
uggcuugaguuuaaauuguaaua

SEQ ID NO: 2224078 - RNA, 16 nt, Human
gcuugccugcaggcau

SEQ ID NO: 2224079 - RNA, 14 nt, Human
caugagucagucug

SEQ ID NO: 2224080 - RNA, 19 nt, Human
aaaauaacaauaaaagaca

SEQ ID NO: 2224081 - RNA, 18 nt, Human
cagaaagcagaacaguga

SEQ ID NO: 2224082 - RNA, 14 nt, Human
aaugauuaugaauu

SEQ ID NO: 2224083 - RNA, 17 nt, Human
agccagguaccuucuca

SEQ ID NO: 2224084 - RNA, 18 nt, Human
agauccccaagccuggca

SEQ ID NO: 2224085 - RNA, 18 nt, Human
uuacuguaagaaaauauc

SEQ ID NO: 2224086 - RNA, 15 nt, Human
acugaagaagcacca

SEQ ID NO: 2224087 - RNA, 23 nt, Human
uuuaguaagagauuccugagcca

SEQ ID NO: 2224088 - RNA, 19 nt, Human
cggccuccauccugaggcu

SEQ ID NO: 2224089 - RNA, 16 nt, Human
aguaagagauuccuga

SEQ ID NO: 2224090 - RNA, 18 nt, Human
auagcuacuaauuuuaaa

SEQ ID NO: 2224091 - RNA, 20 nt, Human
aguuguuucuacuacaugga

SEQ ID NO: 2224092 - RNA, 18 nt, Human
aaagagugaaggauuuau

SEQ ID NO: 2224093 - RNA, 18 nt, Human
acagcuucucauccugca

SEQ ID NO: 2224094 - RNA, 21 nt, Human
acaugagguacugagagugaa

SEQ ID NO: 2224095 - RNA, 21 nt, Human
ccucuguucugcacacagcac

SEQ ID NO: 2224096 - RNA, 21 nt, Human
ugccuguaaucacagcuacuu

SEQ ID NO: 2224097 - RNA, 13 nt, Human
uaugaaauauuau

SEQ ID NO: 2224098 - RNA, 16 nt, Human
agugaaggauuuaugu

SEQ ID NO: 2224099 - RNA, 21 nt, Human
uguauaaaauaauuuuuauau

SEQ ID NO: 2224100 - RNA, 16 nt, Human
uggucugugagaugcu

SEQ ID NO: 2224101 - RNA, 14 nt, Human
cagaaugaccuggc

SEQ ID NO: 2224102 - RNA, 21 nt, Human
ugagcucagcccuggugggca

SEQ ID NO: 2224103 - RNA, 16 nt, Human
aaaaauuccaagugau

SEQ ID NO: 2224104 - RNA, 20 nt, Human
aacaaugcuguauuuuaaaa

SEQ ID NO: 2224105 - RNA, 16 nt, Human
aaagacaaggaaaaaa

SEQ ID NO: 2224106 - RNA, 19 nt, Human
aaauaugccccauucaaca

SEQ ID NO: 2224107 - RNA, 20 nt, Human
agaagaacugaaaucauacu

SEQ ID NO: 2224108 - RNA, 15 nt, Human
cauuccaagccucau

SEQ ID NO: 2224109 - RNA, 13 nt, Human
gauuguaaaaugg

SEQ ID NO: 2224110 - RNA, 15 nt, Human
aaauauaaauaaaaa

SEQ ID NO: 2224111 - RNA, 16 nt, Human
gaaggcuuacacccac

SEQ ID NO: 2224112 - RNA, 23 nt, Human
cauuuuuuuuuucaauaaaacuu

SEQ ID NO: 2224113 - RNA, 23 nt, Human
caugcugucuacacuaagagaga

SEQ ID NO: 2224114 - RNA, 15 nt, Human
ucaaaggacaccauu

SEQ ID NO: 2224115 - RNA, 12 nt, Human
acaagacacagu

SEQ ID NO: 2224116 - RNA, 21 nt, Human
aauuuacagagacagaaagca

SEQ ID NO: 2224117 - RNA, 14 nt, Human
uccagauccuggaa

SEQ ID NO: 2224118 - RNA, 21 nt, Human
cccuauccuacuuccccuucc

SEQ ID NO: 2224119 - RNA, 13 nt, Human
aggaaaaaauaac

SEQ ID NO: 2224120 - RNA, 14 nt, Human
cagccccugggacc

SEQ ID NO: 2224121 - RNA, 23 nt, Human
uaggauggcuaguaucaaaagaa

SEQ ID NO: 2224122 - RNA, 23 nt, Human
uguugcccacagcuguaugauuc

SEQ ID NO: 2224123 - RNA, 17 nt, Human
gcuauugggguuggggg

SEQ ID NO: 2224124 - RNA, 19 nt, Human
agaaaauaacaauaaaaga

SEQ ID NO: 2224125 - RNA, 18 nt, Human
uuuauggcacuaguauuu

SEQ ID NO: 2224126 - RNA, 20 nt, Human
gccagcccucuucugacacu

SEQ ID NO: 2224127 - RNA, 15 nt, Human
ucccccaucucuucu

SEQ ID NO: 2224128 - RNA, 16 nt, Human
cacuggacucaccucc

SEQ ID NO: 2224129 - RNA, 13 nt, Human
ugaaaaucuuaua

SEQ ID NO: 2224130 - RNA, 17 nt, Human
uucugagcauuuaauau

SEQ ID NO: 2224131 - RNA, 12 nt, Human
uaagaagacugc

SEQ ID NO: 2224132 - RNA, 22 nt, Human
gcuaaaacaagcacuaaacaaa

SEQ ID NO: 2224133 - RNA, 15 nt, Human
cccugcaaagcccag

SEQ ID NO: 2224134 - RNA, 19 nt, Human
gucaaucagccuaguugau

SEQ ID NO: 2224135 - RNA, 14 nt, Human
aucaaaagaaagaa

SEQ ID NO: 2224136 - RNA, 16 nt, Human
aaaguguuugaaagcu

SEQ ID NO: 2224137 - RNA, 11 nt, Human
caacucccugc

SEQ ID NO: 2224138 - RNA, 16 nt, Human
ugacacuuaaaaaugg

SEQ ID NO: 2224139 - RNA, 13 nt, Human
aucaggcuggcca

SEQ ID NO: 2224140 - RNA, 14 nt, Human
accugggccauagu

SEQ ID NO: 2224141 - RNA, 20 nt, Human
cccugcacuccagccugagc

SEQ ID NO: 2224142 - RNA, 12 nt, Human
gccccugagccc

SEQ ID NO: 2224143 - RNA, 19 nt, Human
cucugcauacucauuagga

SEQ ID NO: 2224144 - RNA, 15 nt, Human
acucaccucccccau

SEQ ID NO: 2224145 - RNA, 13 nt, Human
aguguuugaaagc

SEQ ID NO: 2224146 - RNA, 15 nt, Human
cccucuucugacacu

SEQ ID NO: 2224147 - RNA, 10 nt, Human
accugagccc

SEQ ID NO: 2224148 - RNA, 18 nt, Human
cacuccagugagacagcu

SEQ ID NO: 2224149 - RNA, 12 nt, Human
cuuccucacacc

SEQ ID NO: 2224150 - RNA, 13 nt, Human
ccaaccucuccca

SEQ ID NO: 2224151 - RNA, 20 nt, Human
uuaaguuuuuuuuuaaaaaa

SEQ ID NO: 2224152 - RNA, 15 nt, Human
aagcacuaaacaaag

SEQ ID NO: 2224153 - RNA, 18 nt, Human
guuaguauuguccagguc

SEQ ID NO: 2224154 - RNA, 15 nt, Human
uccaaugacauuuug

SEQ ID NO: 2224155 - RNA, 12 nt, Human
cacaacacacag

SEQ ID NO: 2224156 - RNA, 13 nt, Human
augaacuuuccac

SEQ ID NO: 2224157 - RNA, 20 nt, Human
uagaugcaguucugaagaag

SEQ ID NO: 2224158 - RNA, 17 nt, Human
aaccuagggugauauua

SEQ ID NO: 2224159 - RNA, 17 nt, Human
cuccuuaucaaaggaca

SEQ ID NO: 2224160 - RNA, 15 nt, Human
ucacaggacagcccu

SEQ ID NO: 2224161 - RNA, 23 nt, Human
ucggccuccauccugaggcucca

SEQ ID NO: 2224162 - RNA, 16 nt, Human
acaaggaugaauuaag

SEQ ID NO: 2224163 - RNA, 18 nt, Human
gagccucagucucccucc

SEQ ID NO: 2224164 - RNA, 22 nt, Human
uauuucagauaaucacaauaca

SEQ ID NO: 2224165 - RNA, 23 nt, Human
cacagauuugagcucagcccugg

SEQ ID NO: 2224166 - RNA, 18 nt, Human
cccacuggacucaccucc

SEQ ID NO: 2224167 - RNA, 18 nt, Human
acaaaaggauaaugaaua

SEQ ID NO: 2224168 - RNA, 14 nt, Human
gaaagcagaacagu

SEQ ID NO: 2224169 - RNA, 18 nt, Human
aaaagacaaggaaaaaau

SEQ ID NO: 2224170 - RNA, 20 nt, Human
uguaauaggcguaacuaauu

SEQ ID NO: 2224171 - RNA, 22 nt, Human
gucacaggaaguagaggaggcc

SEQ ID NO: 2224172 - RNA, 18 nt, Human
acauuuauauuuuuguga

SEQ ID NO: 2224173 - RNA, 18 nt, Human
ccacuuggucugugagau

SEQ ID NO: 2224174 - RNA, 15 nt, Human
auagucauucugccu

SEQ ID NO: 2224175 - RNA, 13 nt, Human
aaaauaacgauaa

SEQ ID NO: 2224176 - RNA, 18 nt, Human
acauguuacaacacggac

SEQ ID NO: 2224177 - RNA, 20 nt, Human
auucccagccagcacagccu

SEQ ID NO: 2224178 - RNA, 17 nt, Human
uccugccccugagccca

SEQ ID NO: 2224179 - RNA, 22 nt, Human
uucccagcuagaauucacucca

SEQ ID NO: 2224180 - RNA, 20 nt, Human
cugagcggaccuucccagcu

SEQ ID NO: 2224181 - RNA, 20 nt, Human
ucacaugaacuuguaaagga

SEQ ID NO: 2224182 - RNA, 19 nt, Human
ccacuuggacaugggcccc

SEQ ID NO: 2224183 - RNA, 22 nt, Human
gugugaccacugcagaagacag

SEQ ID NO: 2224184 - RNA, 21 nt, Human
accaccugccuauauuuuuug

SEQ ID NO: 2224185 - RNA, 19 nt, Human
guuguauuauuuuuuaaaa

SEQ ID NO: 2224186 - RNA, 17 nt, Human
acccacuggacucaccu

SEQ ID NO: 2224187 - RNA, 18 nt, Human
aacaaugcuguauuuuaa

SEQ ID NO: 2224188 - RNA, 22 nt, Human
ccugggaccaggcacccccaga

SEQ ID NO: 2224189 - RNA, 14 nt, Human
agucucccucccuu

SEQ ID NO: 2224190 - RNA, 12 nt, Human
cauucugccugc

SEQ ID NO: 2224191 - RNA, 20 nt, Human
aauaauuuuuauauuugaaa

SEQ ID NO: 2224192 - RNA, 11 nt, Human
accauuuuuac

SEQ ID NO: 2224193 - RNA, 19 nt, Human
gguuccuuccucugagccu

SEQ ID NO: 2224194 - RNA, 12 nt, Human
uauuauuuuuua

SEQ ID NO: 2224195 - RNA, 19 nt, Human
ccccugagcuugcagagau

SEQ ID NO: 2224196 - RNA, 12 nt, Human
uuuuauauuuga

SEQ ID NO: 2224197 - RNA, 22 nt, Human
uggacgagaaaacaauaacgau

SEQ ID NO: 2224198 - RNA, 17 nt, Human
acuuccagauccuggaa

SEQ ID NO: 2224199 - RNA, 12 nt, Human
uauucacaagac

SEQ ID NO: 2224200 - RNA, 13 nt, Human
cugccuccccagc

SEQ ID NO: 2224201 - RNA, 16 nt, Human
agugagacagcucugc

SEQ ID NO: 2224202 - RNA, 15 nt, Human
ggcaauagucaaauu

SEQ ID NO: 2224203 - RNA, 22 nt, Human
gagccucagucucccucccuug

SEQ ID NO: 2224204 - RNA, 22 nt, Human
agaaagugacaagcucacagac

SEQ ID NO: 2224205 - RNA, 14 nt, Human
augggccauaugaa

SEQ ID NO: 2224206 - RNA, 17 nt, Human
auuuucuauaauuuaaa

SEQ ID NO: 2224207 - RNA, 18 nt, Human
ucuucuggguuccuuccu

SEQ ID NO: 2224208 - RNA, 14 nt, Human
aaccugagccccaa

SEQ ID NO: 2224209 - RNA, 21 nt, Human
aaacgaggauugggaaaaagu

SEQ ID NO: 2224210 - RNA, 15 nt, Human
uucacuguaaaauaa

SEQ ID NO: 2224211 - RNA, 19 nt, Human
aaugaaauggugaaaugca

SEQ ID NO: 2224212 - RNA, 15 nt, Human
aacgauaaaagacag

SEQ ID NO: 2224213 - RNA, 17 nt, Human
cucguggaacaguuacc

SEQ ID NO: 2224214 - RNA, 17 nt, Human
gccugagcgacagugag

SEQ ID NO: 2224215 - RNA, 14 nt, Human
auuuucuauaauuu

SEQ ID NO: 2224216 - RNA, 23 nt, Human
aguaauuggaaaggcagcucuaa

SEQ ID NO: 2224217 - RNA, 17 nt, Human
uuaaauggucaauuuug

SEQ ID NO: 2224218 - RNA, 19 nt, Human
ggaaaaaauaacaaugaaa

SEQ ID NO: 2224219 - RNA, 17 nt, Human
aaagcagggacuugaac

SEQ ID NO: 2224220 - RNA, 12 nt, Human
gaaaauaacaau

SEQ ID NO: 2224221 - RNA, 21 nt, Human
gaaaaaaagcuuuuuuugaau

SEQ ID NO: 2224222 - RNA, 15 nt, Human
accucccccaucucu

SEQ ID NO: 2224223 - RNA, 15 nt, Human
ugagcgcccacuaga

SEQ ID NO: 2224224 - RNA, 20 nt, Human
cucuguucugcacacagcac

SEQ ID NO: 2224225 - RNA, 19 nt, Human
aggggggucagccagcccu

SEQ ID NO: 2224226 - RNA, 19 nt, Human
auauugcaaggcaaagacu

SEQ ID NO: 2224227 - RNA, 15 nt, Human
gacaugggccccaga

SEQ ID NO: 2224228 - RNA, 20 nt, Human
uauuuauuacuguaagaaaa

SEQ ID NO: 2224229 - RNA, 24 nt, Human
gcuucugggcagacucuggucaag

SEQ ID NO: 2224230 - RNA, 19 nt, Human
caaggaugccccguccccc

SEQ ID NO: 2224231 - RNA, 17 nt, Human
ucauccugcaggcagcu

SEQ ID NO: 2224232 - RNA, 16 nt, Human
aaacuaggugcugcag

SEQ ID NO: 2224233 - RNA, 23 nt, Human
ugaauuauguuugcauguucacu

SEQ ID NO: 2224234 - RNA, 17 nt, Human
aaaguacaagagcuuaa

SEQ ID NO: 2224235 - RNA, 14 nt, Human
aaaagaaagaaaau

SEQ ID NO: 2224236 - RNA, 21 nt, Human
cuccccagcucuaucccaacc

SEQ ID NO: 2224237 - RNA, 13 nt, Human
uccugugggaccu

SEQ ID NO: 2224238 - RNA, 15 nt, Human
agccccugggaccag

SEQ ID NO: 2224239 - RNA, 18 nt, Human
gaugccccgucccccucu

SEQ ID NO: 2224240 - RNA, 13 nt, Human
guggaaaaacaga

SEQ ID NO: 2224241 - RNA, 12 nt, Human
cagaacagugau

SEQ ID NO: 2224242 - RNA, 13 nt, Human
auaacuggaaacu

SEQ ID NO: 2224243 - RNA, 12 nt, Human
ggaggggcuucu

SEQ ID NO: 2224244 - RNA, 15 nt, Human
acucugagcagugcu

SEQ ID NO: 2224245 - RNA, 19 nt, Human
cuuggggccuaugcagagg

SEQ ID NO: 2224246 - RNA, 13 nt, Human
agggagggaaggg

SEQ ID NO: 2224247 - RNA, 20 nt, Human
ucaggaggaaggcuuacacc

SEQ ID NO: 2224248 - RNA, 19 nt, Human
auuguaguccuguaaugga

SEQ ID NO: 2224249 - RNA, 21 nt, Human
ccauccugccccugagcccau

SEQ ID NO: 2224250 - RNA, 14 nt, Human
cguguccccuaucc

SEQ ID NO: 2224251 - RNA, 14 nt, Human
ugacacuuaaaaau

SEQ ID NO: 2224252 - RNA, 20 nt, Human
acaagacccaaaaggcagaa

SEQ ID NO: 2224253 - RNA, 18 nt, Human
aaaaucuuauaauuuaaa

SEQ ID NO: 2224254 - RNA, 21 nt, Human
cuaccuuuugcuguggcaaau

SEQ ID NO: 2224255 - RNA, 23 nt, Human
uuagaugcaguucugaagaagau

SEQ ID NO: 2224256 - RNA, 22 nt, Human
uaauaggcguaacuaauuuuaa

SEQ ID NO: 2224257 - RNA, 17 nt, Human
cuacacuccagugagac

SEQ ID NO: 2224258 - RNA, 13 nt, Human
ccagcccuccuua

SEQ ID NO: 2224259 - RNA, 22 nt, Human
caagcucuaucaccaaggagcc

SEQ ID NO: 2224260 - RNA, 17 nt, Human
aaacauccuacaagaca

SEQ ID NO: 2224261 - RNA, 16 nt, Human
uauccuacuuccccuu

SEQ ID NO: 2224262 - RNA, 21 nt, Human
gccugaucaccugcccugcug

SEQ ID NO: 2224263 - RNA, 21 nt, Human
uuuauauaagcuuguauuccu

SEQ ID NO: 2224264 - RNA, 16 nt, Human
accagccuuggauacu

SEQ ID NO: 2224265 - RNA, 23 nt, Human
uacaaaugggaaacaaaaggaua

SEQ ID NO: 2224266 - RNA, 20 nt, Human
agccuuuuuuugaaaaaaag

SEQ ID NO: 2224267 - RNA, 17 nt, Human
agggcauagaaguaaaa

SEQ ID NO: 2224268 - RNA, 14 nt, Human
ucaaugcagccccc

SEQ ID NO: 2224269 - RNA, 16 nt, Human
cugcucucaguucacu

SEQ ID NO: 2224270 - RNA, 12 nt, Human
gggggucagcca

SEQ ID NO: 2224271 - RNA, 20 nt, Human
accucauggaauuggagcuc

SEQ ID NO: 2224272 - RNA, 12 nt, Human
cagccccuggga

SEQ ID NO: 2224273 - RNA, 13 nt, Human
uucuauaauuuaa

SEQ ID NO: 2224274 - RNA, 13 nt, Human
uuccucugagccu

SEQ ID NO: 2224275 - RNA, 23 nt, Human
ucuccauguacuggcaagaccug

SEQ ID NO: 2224276 - RNA, 19 nt, Human
gcuuguauuccuuuuucuc

SEQ ID NO: 2224277 - RNA, 16 nt, Human
uaacaauaaaagacaa

SEQ ID NO: 2224278 - RNA, 16 nt, Human
aaaaugugauauguac

SEQ ID NO: 2224279 - RNA, 19 nt, Human
cagauccccaagccuggca

SEQ ID NO: 2224280 - RNA, 21 nt, Human
aauuaaguuuuuuuuuaaaaa

SEQ ID NO: 2224281 - RNA, 17 nt, Human
ccccaguuguuucuacu

SEQ ID NO: 2224282 - RNA, 20 nt, Human
aaagagugaaggauuuaugu

SEQ ID NO: 2224283 - RNA, 17 nt, Human
auguugacaugggacau

SEQ ID NO: 2224284 - RNA, 19 nt, Human
aauauuauguuaaaacugg

SEQ ID NO: 2224285 - RNA, 14 nt, Human
aaauauaaauaaaa

SEQ ID NO: 2224286 - RNA, 14 nt, Human
auaaauaaaaauaa

SEQ ID NO: 2224287 - RNA, 16 nt, Human
accucugccucagaaa

SEQ ID NO: 2224288 - RNA, 16 nt, Human
gagcucgugggacagu

SEQ ID NO: 2224289 - RNA, 14 nt, Human
agaucaagccugcc

SEQ ID NO: 2224290 - RNA, 12 nt, Human
cuucaacucccu

SEQ ID NO: 2224291 - RNA, 19 nt, Human
cagcacgggggccaaggau

SEQ ID NO: 2224292 - RNA, 16 nt, Human
ccaggcacccccagaa

SEQ ID NO: 2224293 - RNA, 13 nt, Human
ccccagcccuccu

SEQ ID NO: 2224294 - RNA, 19 nt, Human
ccaccugccuauauuuuuu

SEQ ID NO: 2224295 - RNA, 22 nt, Human
uagacacacaugaaguccaagc

SEQ ID NO: 2224296 - RNA, 14 nt, Human
gauuaguacacacu

SEQ ID NO: 2224297 - RNA, 22 nt, Human
ugaagcaaaauuuuuucucuag

SEQ ID NO: 2224298 - RNA, 15 nt, Human
ucucauccugcaggc

SEQ ID NO: 2224299 - RNA, 14 nt, Human
agacaucaacagau

SEQ ID NO: 2224300 - RNA, 13 nt, Human
uuauucacaagac

SEQ ID NO: 2224301 - RNA, 12 nt, Human
auuuuaaaagaa

SEQ ID NO: 2224302 - RNA, 15 nt, Human
guucugcagauaaac

SEQ ID NO: 2224303 - RNA, 12 nt, Human
aagagcuuaaca

SEQ ID NO: 2224304 - RNA, 21 nt, Human
ugcccauccugccccugagcc

SEQ ID NO: 2224305 - RNA, 16 nt, Human
ucuucugacacuaaaa

SEQ ID NO: 2224306 - RNA, 22 nt, Human
gaugcaguuguugcccacagcu

SEQ ID NO: 2224307 - RNA, 14 nt, Human
uuccugagccagug

SEQ ID NO: 2224308 - RNA, 13 nt, Human
uaagugcagcccc

SEQ ID NO: 2224309 - RNA, 22 nt, Human
guguccccuauccuacuucccc

SEQ ID NO: 2224310 - RNA, 16 nt, Human
ucuuggucucaguguc

SEQ ID NO: 2224311 - RNA, 18 nt, Human
agcuagaauucacuccac

SEQ ID NO: 2224312 - RNA, 19 nt, Human
uagugagcagucaggaaag

SEQ ID NO: 2224313 - RNA, 14 nt, Human
ccucagcugccucc

SEQ ID NO: 2224314 - RNA, 17 nt, Human
aaauccuacuuucauaa

SEQ ID NO: 2224315 - RNA, 21 nt, Human
ugggaggcugagaugggagaa

SEQ ID NO: 2224316 - RNA, 19 nt, Human
agcuacuaauuuuaaaaug

SEQ ID NO: 2224317 - RNA, 23 nt, Human
ggcuaagcuucacuguaaaauaa

SEQ ID NO: 2224318 - RNA, 19 nt, Human
uuuccugaaaacccuugcc

SEQ ID NO: 2224319 - RNA, 16 nt, Human
acaugaacuuguaaag

SEQ ID NO: 2224320 - RNA, 17 nt, Human
ugcacaucaaaauaugc

SEQ ID NO: 2224321 - RNA, 19 nt, Human
ugagucccaggcugagccu

SEQ ID NO: 2224322 - RNA, 16 nt, Human
ccacuuggucugugag

SEQ ID NO: 2224323 - RNA, 16 nt, Human
auuuuuagugaaauau

SEQ ID NO: 2224324 - RNA, 23 nt, Human
agccuugggaccccugagcuugc

SEQ ID NO: 2224325 - RNA, 15 nt, Human
caaauccaaugaaau

SEQ ID NO: 2224326 - RNA, 16 nt, Human
cuagaacucccuuuca

SEQ ID NO: 2224327 - RNA, 18 nt, Human
gaauaauccuaaacauau

SEQ ID NO: 2224328 - RNA, 12 nt, Human
ucccaaccucuc

SEQ ID NO: 2224329 - RNA, 22 nt, Human
ugucucuacuaaaaauacaaaa

SEQ ID NO: 2224330 - RNA, 21 nt, Human
auucagagcuuacuuaaaauu

SEQ ID NO: 2224331 - RNA, 23 nt, Human
cuagacccacuggacucaccucc

SEQ ID NO: 2224332 - RNA, 22 nt, Human
cucuggccuucggccuccaucc

SEQ ID NO: 2224333 - RNA, 23 nt, Human
ugcauagguuuaauaauuuuuaa

SEQ ID NO: 2224334 - RNA, 19 nt, Human
cccugccccccagcccucc

SEQ ID NO: 2224335 - RNA, 20 nt, Human
gaaacgaggauugggaaaaa

SEQ ID NO: 2224336 - RNA, 15 nt, Human
ucaguuuuugugaaa

SEQ ID NO: 2224337 - RNA, 15 nt, Human
gagauuccugagcca

SEQ ID NO: 2224338 - RNA, 15 nt, Human
augaauuaaguuuuu

SEQ ID NO: 2224339 - RNA, 16 nt, Human
auccuacaagacacag

SEQ ID NO: 2224340 - RNA, 16 nt, Human
ugcaaauugucacagg

SEQ ID NO: 2224341 - RNA, 15 nt, Human
cacuuggucugugag

SEQ ID NO: 2224342 - RNA, 15 nt, Human
caaauugagcuaggg

SEQ ID NO: 2224343 - RNA, 22 nt, Human
uaaaauaauuuuuauauuugaa

SEQ ID NO: 2224344 - RNA, 15 nt, Human
ugcuucuguuuuaua

SEQ ID NO: 2224345 - RNA, 14 nt, Human
aauaguuuaugauu

SEQ ID NO: 2224346 - RNA, 23 nt, Human
gauauuaaccaggggccaugaau

SEQ ID NO: 2224347 - RNA, 19 nt, Human
gaggcagagguugcaguga

SEQ ID NO: 2224348 - RNA, 14 nt, Human
acagaauuuuaugc

SEQ ID NO: 2224349 - RNA, 16 nt, Human
aaugaaagcagggacu

SEQ ID NO: 2224350 - RNA, 13 nt, Human
ggcacccccagaa

SEQ ID NO: 2224351 - RNA, 21 nt, Human
uauuauuuuauagcuacuaau

SEQ ID NO: 2224352 - RNA, 21 nt, Human
aaugaauggcuaagcaaaaug

SEQ ID NO: 2224353 - RNA, 20 nt, Human
cccagcuagaauucacucca

SEQ ID NO: 2224354 - RNA, 20 nt, Human
gggaggcagagguugcagug

SEQ ID NO: 2224355 - RNA, 15 nt, Human
gucccaggcugagcc

SEQ ID NO: 2224356 - RNA, 19 nt, Human
ccuucccagcuagaauuca

SEQ ID NO: 2224357 - RNA, 21 nt, Human
cacuugaacccgggaggcaga

SEQ ID NO: 2224358 - RNA, 18 nt, Human
aaauauuuauuuuaauaa

SEQ ID NO: 2224359 - RNA, 19 nt, Human
uuccucccuucucuucaca

SEQ ID NO: 2224360 - RNA, 15 nt, Human
ugcagauaaacagua

SEQ ID NO: 2224361 - RNA, 21 nt, Human
aggcucuuuugggauuuuuga

SEQ ID NO: 2224362 - RNA, 19 nt, Human
uggauacuccauggggugg

SEQ ID NO: 2224363 - RNA, 20 nt, Human
uguaagaaaauaucacuugu

SEQ ID NO: 2224364 - RNA, 20 nt, Human
gaacguaaucguguccccua

SEQ ID NO: 2224365 - RNA, 15 nt, Human
auuauuuuuuaaaaa

SEQ ID NO: 2224366 - RNA, 21 nt, Human
agccuuggauacuccaugggg

SEQ ID NO: 2224367 - RNA, 18 nt, Human
uacuuuauuuucuauaau

SEQ ID NO: 2224368 - RNA, 21 nt, Human
gggagccugaucaccugcccu

SEQ ID NO: 2224369 - RNA, 21 nt, Human
acacuaaaacaccucagcugc

SEQ ID NO: 2224370 - RNA, 23 nt, Human
ccagaucaagccugccucaauca

SEQ ID NO: 2224371 - RNA, 22 nt, Human
caagcacuaaacaaagagugaa

SEQ ID NO: 2224372 - RNA, 14 nt, Human
acacugaagaagca

SEQ ID NO: 2224373 - RNA, 19 nt, Human
ccauccugccccugagccc

SEQ ID NO: 2224374 - RNA, 13 nt, Human
aguuaccucugcc

SEQ ID NO: 2224375 - RNA, 13 nt, Human
uuauguuuaauuc

SEQ ID NO: 2224376 - RNA, 15 nt, Human
ugccccccagcccuc

SEQ ID NO: 2224377 - RNA, 14 nt, Human
ugcuagaacucccu

SEQ ID NO: 2224378 - RNA, 18 nt, Human
gagucccaggcugagccu

SEQ ID NO: 2224379 - RNA, 12 nt, Human
agacagugaaag

SEQ ID NO: 2224380 - RNA, 15 nt, Human
cuagaauucacucca

SEQ ID NO: 2224381 - RNA, 20 nt, Human
ggccuaugcagagguccaca

SEQ ID NO: 2224382 - RNA, 17 nt, Human
gccaugggacagggagg

SEQ ID NO: 2224383 - RNA, 22 nt, Human
gcagagagguagggauggggcu

SEQ ID NO: 2224384 - RNA, 16 nt, Human
ugacuuaaugccacua

SEQ ID NO: 2224385 - RNA, 23 nt, Human
gccagguaccuucucaccuguga

SEQ ID NO: 2224386 - RNA, 20 nt, Human
ccacuuggacaugggcccca

SEQ ID NO: 2224387 - RNA, 22 nt, Human
uucauucacucaacaaacauaa

SEQ ID NO: 2224388 - RNA, 17 nt, Human
ccauagucauucugccu

SEQ ID NO: 2224389 - RNA, 18 nt, Human
aagaccucauuuugaagg

SEQ ID NO: 2224390 - RNA, 16 nt, Human
gagaaacuggaacucu

SEQ ID NO: 2224391 - RNA, 18 nt, Human
ccaagccuggcaagggaa

SEQ ID NO: 2224392 - RNA, 16 nt, Human
cccuauccuacuuccc

SEQ ID NO: 2224393 - RNA, 12 nt, Human
gguuuauauaag

SEQ ID NO: 2224394 - RNA, 20 nt, Human
guccccuauccuacuucccc

SEQ ID NO: 2224395 - RNA, 15 nt, Human
ccgucccccucuggc

SEQ ID NO: 2224396 - RNA, 12 nt, Human
uuuuuuuuaaaa

SEQ ID NO: 2224397 - RNA, 16 nt, Human
uuuuagugaaauauua

SEQ ID NO: 2224398 - RNA, 15 nt, Human
ggacucaccuccccc

SEQ ID NO: 2224399 - RNA, 14 nt, Human
cacuaaacaaagag

SEQ ID NO: 2224400 - RNA, 13 nt, Human
aggcuagauguau

SEQ ID NO: 2224401 - RNA, 17 nt, Human
caagacccaaaaggcag

SEQ ID NO: 2224402 - RNA, 23 nt, Human
ucaauaucuuuuuuuuaauaaac

SEQ ID NO: 2224403 - RNA, 17 nt, Human
gaacucugagcagugcu

SEQ ID NO: 2224404 - RNA, 22 nt, Human
auaacaaugcuguauuuuaaaa

SEQ ID NO: 2224405 - RNA, 15 nt, Human
cccugccccccagcc

SEQ ID NO: 2224406 - RNA, 18 nt, Human
auucacuccacuuggaca

SEQ ID NO: 2224407 - RNA, 14 nt, Human
cuugagguaaaagc

SEQ ID NO: 2224408 - RNA, 19 nt, Human
aaaagacagugaaagaaaa

SEQ ID NO: 2224409 - RNA, 20 nt, Human
agaggagaaacuggaacucu

SEQ ID NO: 2224410 - RNA, 17 nt, Human
uacaaaugcauuucuaa

SEQ ID NO: 2224411 - RNA, 21 nt, Human
auaugcucuaaacauguuuau

SEQ ID NO: 2224412 - RNA, 17 nt, Human
gaacuuuccacauucag

SEQ ID NO: 2224413 - RNA, 16 nt, Human
uacaaaugggaaacaa

SEQ ID NO: 2224414 - RNA, 21 nt, Human
ccucccuuggggccuaugcag

SEQ ID NO: 2224415 - RNA, 18 nt, Human
auuuuaacucuauaaugu

SEQ ID NO: 2224416 - RNA, 19 nt, Human
gaaagaaaauaacaauaaa

SEQ ID NO: 2224417 - RNA, 16 nt, Human
uguccccuauccuacu

SEQ ID NO: 2224418 - RNA, 11 nt, Human
gcaugguuuag

SEQ ID NO: 2224419 - RNA, 16 nt, Human
cagcuucucauccugc

SEQ ID NO: 2224420 - RNA, 14 nt, Human
ggcuccagcuggcc

SEQ ID NO: 2224421 - RNA, 17 nt, Human
ucagacauagaauuaac

SEQ ID NO: 2224422 - RNA, 15 nt, Human
ugcaauuccacuuau

SEQ ID NO: 2224423 - RNA, 19 nt, Human
uaucucauuuccaagcaag

SEQ ID NO: 2224424 - RNA, 13 nt, Human
ccaaggaugcccc

SEQ ID NO: 2224425 - RNA, 16 nt, Human
gccuaagugcagcccc

SEQ ID NO: 2224426 - RNA, 18 nt, Human
ugagcucagcccuggugg

SEQ ID NO: 2224427 - RNA, 23 nt, Human
agcucugcccauccugccccuga

SEQ ID NO: 2224428 - RNA, 18 nt, Human
aagggaauuucuucaacu

SEQ ID NO: 2224429 - RNA, 20 nt, Human
ugagcgcccacuagacccac

SEQ ID NO: 2224430 - RNA, 18 nt, Human
gaaaugaaagcagggacu

SEQ ID NO: 2224431 - RNA, 18 nt, Human
cuucacuguaaaauaaua

SEQ ID NO: 2224432 - RNA, 17 nt, Human
agcuucacuguaaaaua

SEQ ID NO: 2224433 - RNA, 20 nt, Human
agcccucuucugacacuaaa

SEQ ID NO: 2224434 - RNA, 18 nt, Human
uaguaucaaaagaaagaa

SEQ ID NO: 2224435 - RNA, 22 nt, Human
cuggguuccuuccucugagccu

SEQ ID NO: 2224436 - RNA, 12 nt, Human
ccaggcugagcc

SEQ ID NO: 2224437 - RNA, 15 nt, Human
cuugaaaacuuuaug

SEQ ID NO: 2224438 - RNA, 14 nt, Human
ugagcuugcagaga

SEQ ID NO: 2224439 - RNA, 14 nt, Human
uggacucaccuccc

SEQ ID NO: 2224440 - RNA, 20 nt, Human
ucuucuggguuccuuccucu

SEQ ID NO: 2224441 - RNA, 16 nt, Human
cuccaugggguggggg

SEQ ID NO: 2224442 - RNA, 18 nt, Human
auagucaaauugugugaa

SEQ ID NO: 2224443 - RNA, 20 nt, Human
aaaagacagugaaagaaaau

SEQ ID NO: 2224444 - RNA, 19 nt, Human
guaguccuguaauggaagc

SEQ ID NO: 2224445 - RNA, 11 nt, Human
caauaaaagac

SEQ ID NO: 2224446 - RNA, 16 nt, Human
uuuucucuaggaaaua

SEQ ID NO: 2224447 - RNA, 18 nt, Human
auuuauuacuguaagaaa

SEQ ID NO: 2224448 - RNA, 15 nt, Human
gaagauguagaggag

SEQ ID NO: 2224449 - RNA, 16 nt, Human
guucugcacacagcac

SEQ ID NO: 2224450 - RNA, 21 nt, Human
uguaaaauggugugaccacug

SEQ ID NO: 2224451 - RNA, 17 nt, Human
agaaaugaaagcaggga

SEQ ID NO: 2224452 - RNA, 15 nt, Human
ucagucucccucccu

SEQ ID NO: 2224453 - RNA, 15 nt, Human
uagauaggccauggg

SEQ ID NO: 2224454 - RNA, 15 nt, Human
uauuuauuuuaauaa

SEQ ID NO: 2224455 - RNA, 14 nt, Human
gucccaggcugagc

SEQ ID NO: 2224456 - RNA, 17 nt, Human
ccugcaggcaugaguca

SEQ ID NO: 2224457 - RNA, 15 nt, Human
augauaacuggaaac

SEQ ID NO: 2224458 - RNA, 11 nt, Human
ugcagugagcc

SEQ ID NO: 2224459 - RNA, 23 nt, Human
gaggcauuuaggccaugggacag

SEQ ID NO: 2224460 - RNA, 15 nt, Human
gugaacuugguuuua

SEQ ID NO: 2224461 - RNA, 15 nt, Human
uuuuuaguucuucaa

SEQ ID NO: 2224462 - RNA, 13 nt, Human
cuucucaacucca

SEQ ID NO: 2224463 - RNA, 17 nt, Human
gucaaagcugaaaugga

SEQ ID NO: 2224464 - RNA, 19 nt, Human
caucaaggguacacugccu

SEQ ID NO: 2224465 - RNA, 13 nt, Human
cugagagugaaca

SEQ ID NO: 2224466 - RNA, 19 nt, Human
aagcauuccaacuaucuca

SEQ ID NO: 2224467 - RNA, 21 nt, Human
aggcauccaaaggcuccugag

SEQ ID NO: 2224468 - RNA, 15 nt, Human
augguuguauuauuu

SEQ ID NO: 2224469 - RNA, 18 nt, Human
aaggaugccccguccccc

SEQ ID NO: 2224470 - RNA, 20 nt, Human
gcacccccagaaugaccugg

SEQ ID NO: 2224471 - RNA, 21 nt, Human
auuccuuuuucucuccucucc

SEQ ID NO: 2224472 - RNA, 19 nt, Human
auucccagccagcacagcc

SEQ ID NO: 2224473 - RNA, 14 nt, Human
gggaccugggccau

SEQ ID NO: 2224474 - RNA, 23 nt, Human
gagguaccagccuuggauacucc

SEQ ID NO: 2224475 - RNA, 20 nt, Human
caagcucuaucaccaaggag

SEQ ID NO: 2224476 - RNA, 18 nt, Human
ugaaaaaguucugcagau

SEQ ID NO: 2224477 - RNA, 18 nt, Human
ccugccuaagugcagccc

SEQ ID NO: 2224478 - RNA, 17 nt, Human
acaaaugggaaacaaaa

SEQ ID NO: 2224479 - RNA, 20 nt, Human
uaaaacaagcacuaaacaaa

SEQ ID NO: 2224480 - RNA, 16 nt, Human
aggguguguaaguaga

SEQ ID NO: 2224481 - RNA, 17 nt, Human
ucuauaauuuaaauaua

SEQ ID NO: 2224482 - RNA, 15 nt, Human
ccugagcggaccuuc

SEQ ID NO: 2224483 - RNA, 19 nt, Human
ccuccauccugaggcucca

SEQ ID NO: 2224484 - RNA, 21 nt, Human
gaacuuuccacauucagagcu

SEQ ID NO: 2224485 - RNA, 17 nt, Human
ugagcggaccuucccag

SEQ ID NO: 2224486 - RNA, 17 nt, Human
aguauuucuaugaaaua

SEQ ID NO: 2224487 - RNA, 20 nt, Human
guaucaaaagaaagaaaauc

SEQ ID NO: 2224488 - RNA, 16 nt, Human
cauagaaguaaaaaca

SEQ ID NO: 2224489 - RNA, 14 nt, Human
aauuguauuacaaa

SEQ ID NO: 2224490 - RNA, 21 nt, Human
agcccuucuuuccacagaagc

SEQ ID NO: 2224491 - RNA, 11 nt, Human
gggaccugggc

SEQ ID NO: 2224492 - RNA, 16 nt, Human
ccauuuuuagugaaau

SEQ ID NO: 2224493 - RNA, 16 nt, Human
auugucuagugaaacu

SEQ ID NO: 2224494 - RNA, 16 nt, Human
uauugggguugggggg

SEQ ID NO: 2224495 - RNA, 15 nt, Human
gaccacugcagaaga

SEQ ID NO: 2224496 - RNA, 22 nt, Human
agcagcauaaauguugacaugg

SEQ ID NO: 2224497 - RNA, 18 nt, Human
gaaaauaucacuugucaa

SEQ ID NO: 2224498 - RNA, 14 nt, Human
auuuguauaaaaua

SEQ ID NO: 2224499 - RNA, 18 nt, Human
auagaauuaacacaugau

SEQ ID NO: 2224500 - RNA, 15 nt, Human
cuacaagacacagug

SEQ ID NO: 2224501 - RNA, 18 nt, Human
caagccucauguccacug

SEQ ID NO: 2224502 - RNA, 20 nt, Human
gaaacauuugguaaggggaa

SEQ ID NO: 2224503 - RNA, 19 nt, Human
uguaguguuggagaagaac

SEQ ID NO: 2224504 - RNA, 15 nt, Human
gccccauucaacauc

SEQ ID NO: 2224505 - RNA, 12 nt, Human
ucuuaagaagac

SEQ ID NO: 2224506 - RNA, 18 nt, Human
caugaagauguagaggag

SEQ ID NO: 2224507 - RNA, 18 nt, Human
acaaaugcauuucuaaag

SEQ ID NO: 2224508 - RNA, 19 nt, Human
auugaggacacugauaugg

SEQ ID NO: 2224509 - RNA, 14 nt, Human
gucauucugccugc

SEQ ID NO: 2224510 - RNA, 18 nt, Human
agggugcacacaggaugg

SEQ ID NO: 2224511 - RNA, 14 nt, Human
aauauuauguuaaa

SEQ ID NO: 2224512 - RNA, 16 nt, Human
uauaugucacuuugcu

SEQ ID NO: 2224513 - RNA, 19 nt, Human
auaaaagacagugaaagaa

SEQ ID NO: 2224514 - RNA, 22 nt, Human
cugaggcauccuuccucacacc

SEQ ID NO: 2224515 - RNA, 16 nt, Human
ccuaagugcagccccg

SEQ ID NO: 2224516 - RNA, 19 nt, Human
agucaaauugugugaaagg

SEQ ID NO: 2224517 - RNA, 15 nt, Human
ccugcaaagcccagc

SEQ ID NO: 2224518 - RNA, 16 nt, Human
ccucaaucaguauuca

SEQ ID NO: 2224519 - RNA, 20 nt, Human
cugauauuggacaguaaaau

SEQ ID NO: 2224520 - RNA, 22 nt, Human
uguugcccacagcuguaugauu

SEQ ID NO: 2224521 - RNA, 16 nt, Human
gggucagccagcccuc

SEQ ID NO: 2224522 - RNA, 20 nt, Human
ugaaaaucuuauaauuuaaa

SEQ ID NO: 2224523 - RNA, 16 nt, Human
aagacugcacaucaaa

SEQ ID NO: 2224524 - RNA, 14 nt, Human
ccucagucucccuc

SEQ ID NO: 2224525 - RNA, 21 nt, Human
cucaaaacuucagacauagaa

SEQ ID NO: 2224526 - RNA, 22 nt, Human
ccucccuuggggccuaugcaga

SEQ ID NO: 2224527 - RNA, 14 nt, Human
agcucguggaacag

SEQ ID NO: 2224528 - RNA, 21 nt, Human
gccuuuucccaacuccagaaa

SEQ ID NO: 2224529 - RNA, 11 nt, Human
cuguuuuauaa

SEQ ID NO: 2224530 - RNA, 13 nt, Human
agcgacagugaga

SEQ ID NO: 2224531 - RNA, 18 nt, Human
cuccauccugaggcucca

SEQ ID NO: 2224532 - RNA, 23 nt, Human
ggaugguucccuugaugaagaag

SEQ ID NO: 2224533 - RNA, 19 nt, Human
uccagccuggcaaggguuc

SEQ ID NO: 2224534 - RNA, 18 nt, Human
acugacucuuaagaagac

SEQ ID NO: 2224535 - RNA, 17 nt, Human
aaagacaaggaaaaaau

SEQ ID NO: 2224536 - RNA, 17 nt, Human
uuccaagugauugaaac

SEQ ID NO: 2224537 - RNA, 13 nt, Human
aagacaaggaaaa

SEQ ID NO: 2224538 - RNA, 20 nt, Human
cuugccauaauuacuauguc

SEQ ID NO: 2224539 - RNA, 19 nt, Human
acaauaacgauaaaagaca

SEQ ID NO: 2224540 - RNA, 23 nt, Human
gagcucccaggaggggcuucugg

SEQ ID NO: 2224541 - RNA, 22 nt, Human
uuaccucugccucagaaaacaa

SEQ ID NO: 2224542 - RNA, 17 nt, Human
ucuauaauguguucauu

SEQ ID NO: 2224543 - RNA, 20 nt, Human
uaagugaaauaagccagaca

SEQ ID NO: 2224544 - RNA, 22 nt, Human
guauucauauuuauagccaggu

SEQ ID NO: 2224545 - RNA, 16 nt, Human
uccuguaauggaagca

SEQ ID NO: 2224546 - RNA, 22 nt, Human
uggguuccuuccucugagccuu

SEQ ID NO: 2224547 - RNA, 22 nt, Human
ugggccccagauaccaugaugc

SEQ ID NO: 2224548 - RNA, 20 nt, Human
uaauaaguugcauagguuua

SEQ ID NO: 2224549 - RNA, 17 nt, Human
accucagcugccucccc

SEQ ID NO: 2224550 - RNA, 17 nt, Human
uaucaauuuaaaaaaaa

SEQ ID NO: 2224551 - RNA, 22 nt, Human
gacucaccucccccaucucuuc

SEQ ID NO: 2224552 - RNA, 18 nt, Human
auggcuugaguuuaaauu

SEQ ID NO: 2224553 - RNA, 17 nt, Human
aauaacgauaaaagaca

SEQ ID NO: 2224554 - RNA, 22 nt, Human
cagaguacuggcugauggagua

SEQ ID NO: 2224555 - RNA, 20 nt, Human
gccugagcggaccuucccag

SEQ ID NO: 2224556 - RNA, 17 nt, Human
uaauuccacagcugcuc

SEQ ID NO: 2224557 - RNA, 11 nt, Human
aaccugagccc

SEQ ID NO: 2224558 - RNA, 17 nt, Human
uuauuuguacauuuuuu

SEQ ID NO: 2224559 - RNA, 14 nt, Human
ugcuaagucuuaua

SEQ ID NO: 2224560 - RNA, 18 nt, Human
gcaaagcccagcuugaaa

SEQ ID NO: 2224561 - RNA, 23 nt, Human
ggaacaguuaccucugccucaga

SEQ ID NO: 2224562 - RNA, 22 nt, Human
cucugagccuugggaccccuga

SEQ ID NO: 2224563 - RNA, 14 nt, Human
auuuaaauauaugc

SEQ ID NO: 2224564 - RNA, 23 nt, Human
ucuaccaaaaaucucaauauuuc

SEQ ID NO: 2224565 - RNA, 22 nt, Human
guacacugccuucucaacucca

SEQ ID NO: 2224566 - RNA, 13 nt, Human
agacagcucugca

SEQ ID NO: 2224567 - RNA, 22 nt, Human
gaaugaccuggccgcagugagg

SEQ ID NO: 2224568 - RNA, 16 nt, Human
uaggugcugcagcccc

SEQ ID NO: 2224569 - RNA, 14 nt, Human
cagauuugagcuca

SEQ ID NO: 2224570 - RNA, 15 nt, Human
ccagcacagccucuu

SEQ ID NO: 2224571 - RNA, 22 nt, Human
ggguuccuuccucugagccuug

SEQ ID NO: 2224572 - RNA, 16 nt, Human
auagucauucugccug

SEQ ID NO: 2224573 - RNA, 15 nt, Human
ugagcggaccuuccc

SEQ ID NO: 2224574 - RNA, 13 nt, Human
gguccacaacaca

SEQ ID NO: 2224575 - RNA, 16 nt, Human
cuucggccuccauccu

SEQ ID NO: 2224576 - RNA, 23 nt, Human
guaauuccguagguuauuuucag

SEQ ID NO: 2224577 - RNA, 19 nt, Human
aaaaucuuauaauuuaaaa

SEQ ID NO: 2224578 - RNA, 19 nt, Human
auuguauuuuaguaagaga

SEQ ID NO: 2224579 - RNA, 14 nt, Human
gauugagaaggagc

SEQ ID NO: 2224580 - RNA, 24 nt, Human
uggccgggagccugaucaccugcc

SEQ ID NO: 2224581 - RNA, 23 nt, Human
aauaauccucaguuuuugugaaa

SEQ ID NO: 2224582 - RNA, 16 nt, Human
ucauucugccugcccu

SEQ ID NO: 2224583 - RNA, 19 nt, Human
cauggaauuggagcucgug

SEQ ID NO: 2224584 - RNA, 15 nt, Human
aaggaauuuaaaaau

SEQ ID NO: 2224585 - RNA, 13 nt, Human
acaagaaaugaaa

SEQ ID NO: 2224586 - RNA, 22 nt, Human
agcccuccuuaucaaaggacac

SEQ ID NO: 2224587 - RNA, 11 nt, Human
agccagguacc

SEQ ID NO: 2224588 - RNA, 21 nt, Human
cacuaaaacaccucagcugcc

SEQ ID NO: 2224589 - RNA, 20 nt, Human
gcccauccugccccugagcc

SEQ ID NO: 2224590 - RNA, 16 nt, Human
ggcagagagguaggga

SEQ ID NO: 2224591 - RNA, 17 nt, Human
uuacagagacagaaagc

SEQ ID NO: 2224592 - RNA, 22 nt, Human
cagcacgggggccaaggaugcc

SEQ ID NO: 2224593 - RNA, 12 nt, Human
cuggcuccagcu

SEQ ID NO: 2224594 - RNA, 16 nt, Human
cccaaccucucccaac

SEQ ID NO: 2224595 - RNA, 16 nt, Human
ugaaguacucauacau

SEQ ID NO: 2224596 - RNA, 17 nt, Human
gaaugagagacacacug

SEQ ID NO: 2224597 - RNA, 20 nt, Human
ugauuucugagcauuuaaua

SEQ ID NO: 2224598 - RNA, 11 nt, Human
gccaugggaca

SEQ ID NO: 2224599 - RNA, 23 nt, Human
ggucucagugucaaugcagcccc

SEQ ID NO: 2224600 - RNA, 18 nt, Human
acaugaacuuguaaagga

SEQ ID NO: 2224601 - RNA, 16 nt, Human
auaucaauuuaaaaaa

SEQ ID NO: 2224602 - RNA, 23 nt, Human
aaguauccuucagccugaaagag

SEQ ID NO: 2224603 - RNA, 16 nt, Human
cuagaauucacuccac

SEQ ID NO: 2224604 - RNA, 13 nt, Human
aacaauaaaagac

SEQ ID NO: 2224605 - RNA, 20 nt, Human
accuucccagcuagaauuca

SEQ ID NO: 2224606 - RNA, 20 nt, Human
ugggccccagauaccaugau

SEQ ID NO: 2224607 - RNA, 13 nt, Human
cacaacuauauug

SEQ ID NO: 2224608 - RNA, 15 nt, Human
aagaaaauaacaaua

SEQ ID NO: 2224609 - RNA, 14 nt, Human
aucaccaaggcuga

SEQ ID NO: 2224610 - RNA, 22 nt, Human
aaagacagugaaagaaaauaac

SEQ ID NO: 2224611 - RNA, 23 nt, Human
uuauagcuacuaauuuuaaaaug

SEQ ID NO: 2224612 - RNA, 18 nt, Human
gaacucugagcagugcuu

SEQ ID NO: 2224613 - RNA, 21 nt, Human
auucauagcagcuuauucaca

SEQ ID NO: 2224614 - RNA, 16 nt, Human
acaugaaguccaagca

SEQ ID NO: 2224615 - RNA, 16 nt, Human
acauuugcucauggaa

SEQ ID NO: 2224616 - RNA, 18 nt, Human
uuuucucuccucucccca

SEQ ID NO: 2224617 - RNA, 14 nt, Human
auuuauuuuaauaa

SEQ ID NO: 2224618 - RNA, 22 nt, Human
ugaguuuuucuuuucauuuacc

SEQ ID NO: 2224619 - RNA, 16 nt, Human
ugugagaugcuagaac

SEQ ID NO: 2224620 - RNA, 15 nt, Human
agccugaaagaggaa

SEQ ID NO: 2224621 - RNA, 20 nt, Human
caauaaaacuuuuccaauga

SEQ ID NO: 2224622 - RNA, 19 nt, Human
ggcaaggguucaccugggc

SEQ ID NO: 2224623 - RNA, 22 nt, Human
aauuuuuucucuaggaaauauu

SEQ ID NO: 2224624 - RNA, 17 nt, Human
uuauuacuguaagaaaa

SEQ ID NO: 2224625 - RNA, 18 nt, Human
ugagcuaggggggucagc

SEQ ID NO: 2224626 - RNA, 17 nt, Human
gauaaaagacagugaaa

SEQ ID NO: 2224627 - RNA, 16 nt, Human
aagcuucacuguaaaa

SEQ ID NO: 2224628 - RNA, 18 nt, Human
cuggaaacuucagcgguu

SEQ ID NO: 2224629 - RNA, 18 nt, Human
auuugcuggagcucugcc

SEQ ID NO: 2224630 - RNA, 13 nt, Human
ccaccugccuaua

SEQ ID NO: 2224631 - RNA, 15 nt, Human
caccucagcugccuc

SEQ ID NO: 2224632 - RNA, 17 nt, Human
agggaagggggaacaug

SEQ ID NO: 2224633 - RNA, 12 nt, Human
ucagcugccucc

SEQ ID NO: 2224634 - RNA, 19 nt, Human
augaguaacugauuuguaa

SEQ ID NO: 2224635 - RNA, 12 nt, Human
uucucuaggaaa

SEQ ID NO: 2224636 - RNA, 22 nt, Human
cacuuccaagagccuuuuuuug

SEQ ID NO: 2224637 - RNA, 18 nt, Human
aaaguaacccuacaaaac

SEQ ID NO: 2224638 - RNA, 15 nt, Human
auggugaaaugcaga

SEQ ID NO: 2224639 - RNA, 18 nt, Human
cuuuucccaacuccagaa

SEQ ID NO: 2224640 - RNA, 17 nt, Human
aggccaugggacaggga

SEQ ID NO: 2224641 - RNA, 22 nt, Human
ggcauuuaggccaugggacagg

SEQ ID NO: 2224642 - RNA, 15 nt, Human
auaauccuaaacaua

SEQ ID NO: 2224643 - RNA, 16 nt, Human
cucagcugccucccca

SEQ ID NO: 2224644 - RNA, 22 nt, Human
uuuauagcuacuaauuuuaaaa

SEQ ID NO: 2224645 - RNA, 15 nt, Human
uccagauccuggaaa

SEQ ID NO: 2224646 - RNA, 13 nt, Human
aagugcagccccg

SEQ ID NO: 2224647 - RNA, 18 nt, Human
gaaggagcucccaggagg

SEQ ID NO: 2224648 - RNA, 14 nt, Human
cuucucuucacagu

SEQ ID NO: 2224649 - RNA, 18 nt, Human
cugagccuugggaccccu

SEQ ID NO: 2224650 - RNA, 19 nt, Human
agagccuuuuuuugaaaaa

SEQ ID NO: 2224651 - RNA, 20 nt, Human
aagaugguaccaccagucug

SEQ ID NO: 2224652 - RNA, 21 nt, Human
aucuuuuuuuuaauaaaccau

SEQ ID NO: 2224653 - RNA, 22 nt, Human
aaguuguagguaauauugcaag

SEQ ID NO: 2224654 - RNA, 13 nt, Human
ugccugcaggcau

SEQ ID NO: 2224655 - RNA, 18 nt, Human
cagucucccucccuuggg

SEQ ID NO: 2224656 - RNA, 16 nt, Human
cagggacuugaaccca

SEQ ID NO: 2224657 - RNA, 19 nt, Human
uuugccaaguucuccacua

SEQ ID NO: 2224658 - RNA, 16 nt, Human
ggcugagccucagucu

SEQ ID NO: 2224659 - RNA, 15 nt, Human
gcuguauuuuaaaag

SEQ ID NO: 2224660 - RNA, 17 nt, Human
ucauacuucuuaggguu

SEQ ID NO: 2224661 - RNA, 14 nt, Human
acgagaaaacaaua

SEQ ID NO: 2224662 - RNA, 14 nt, Human
acauagugaggagc

SEQ ID NO: 2224663 - RNA, 14 nt, Human
ccaugggacaggga

SEQ ID NO: 2224664 - RNA, 13 nt, Human
uaaacauguuuau

SEQ ID NO: 2224665 - RNA, 23 nt, Human
uccaacuaucucauuuccaagca

SEQ ID NO: 2224666 - RNA, 22 nt, Human
uacaugagguacugagagugaa

SEQ ID NO: 2224667 - RNA, 19 nt, Human
agcucugcccauccugccc

SEQ ID NO: 2224668 - RNA, 23 nt, Human
ugaaaaucuuauaauuuaaaaua

SEQ ID NO: 2224669 - RNA, 15 nt, Human
agucugaugagaacu

SEQ ID NO: 2224670 - RNA, 15 nt, Human
uugcucauggaauug

SEQ ID NO: 2224671 - RNA, 13 nt, Human
ccagaucaagccu

SEQ ID NO: 2224672 - RNA, 24 nt, Human
cauucuggaauaauccuaaacaua

SEQ ID NO: 2224673 - RNA, 19 nt, Human
gcacacagcacgggggcca

SEQ ID NO: 2224674 - RNA, 17 nt, Human
cauuuguauaaaauaau

SEQ ID NO: 2224675 - RNA, 13 nt, Human
aucuacacuccag

SEQ ID NO: 2224676 - RNA, 20 nt, Human
auuacauuuguauaaaauaa

SEQ ID NO: 2224677 - RNA, 20 nt, Human
agaugcaguucugaagaaga

SEQ ID NO: 2224678 - RNA, 17 nt, Human
uaucuuuuuuuuaauaa

SEQ ID NO: 2224679 - RNA, 13 nt, Human
agacacagugacc

SEQ ID NO: 2224680 - RNA, 16 nt, Human
acauccuacaagacac

SEQ ID NO: 2224681 - RNA, 16 nt, Human
aaauaacaaugaaagu

SEQ ID NO: 2224682 - RNA, 20 nt, Human
cuucaacucccugcccccca

SEQ ID NO: 2224683 - RNA, 14 nt, Human
cucccuuggggccu

SEQ ID NO: 2224684 - RNA, 16 nt, Human
cacuaguauuucuaug

SEQ ID NO: 2224685 - RNA, 23 nt, Human
gaaaacaauaacgauaaaagaca

SEQ ID NO: 2224686 - RNA, 20 nt, Human
guauuauuuuuuaaaaaaau

SEQ ID NO: 2224687 - RNA, 15 nt, Human
gccagcccucuucug

SEQ ID NO: 2224688 - RNA, 22 nt, Human
ggccauagucauucugccugcc

SEQ ID NO: 2224689 - RNA, 18 nt, Human
ccuucggccuccauccug

SEQ ID NO: 2224690 - RNA, 21 nt, Human
gugccugagcggaccuuccca

SEQ ID NO: 2224691 - RNA, 13 nt, Human
uccuacuuccccu

SEQ ID NO: 2224692 - RNA, 12 nt, Human
uaauuccacagc

SEQ ID NO: 2224693 - RNA, 16 nt, Human
cccacuggacucaccu

SEQ ID NO: 2224694 - RNA, 20 nt, Human
auauuuuauaucaauuuaaa

SEQ ID NO: 2224695 - RNA, 13 nt, Human
cccugcacuccag

SEQ ID NO: 2224696 - RNA, 16 nt, Human
cugagcgacagugaga

SEQ ID NO: 2224697 - RNA, 14 nt, Human
cagauccccaagcc

SEQ ID NO: 2224698 - RNA, 15 nt, Human
aaggcuccugagaca

SEQ ID NO: 2224699 - RNA, 18 nt, Human
uccuaauuccacagcugc

SEQ ID NO: 2224700 - RNA, 13 nt, Human
aaaauaacaauga

SEQ ID NO: 2224701 - RNA, 20 nt, Human
agccuaguugaucagcuuau

SEQ ID NO: 2224702 - RNA, 15 nt, Human
ccacaagaaaugaaa

SEQ ID NO: 2224703 - RNA, 10 nt, Human
caacucccug

SEQ ID NO: 2224704 - RNA, 20 nt, Human
uaugcuucuguuuuauaauu

SEQ ID NO: 2224705 - RNA, 17 nt, Human
uucacuguaaaauaaua

SEQ ID NO: 2224706 - RNA, 15 nt, Human
gauccugcaauucca

SEQ ID NO: 2224707 - RNA, 19 nt, Human
ccgggcgugguggugagug

SEQ ID NO: 2224708 - RNA, 13 nt, Human
aagaaaauaacga

SEQ ID NO: 2224709 - RNA, 17 nt, Human
acaaguccagccuggca

SEQ ID NO: 2224710 - RNA, 18 nt, Human
cauagguuuaauaauuuu

SEQ ID NO: 2224711 - RNA, 22 nt, Human
auauuuacaaaugggaaacaaa

SEQ ID NO: 2224712 - RNA, 14 nt, Human
uugaaauuguauua

SEQ ID NO: 2224713 - RNA, 14 nt, Human
ucuaggaaauauuu

SEQ ID NO: 2224714 - RNA, 23 nt, Human
ccugggaccaggcacccccagaa

SEQ ID NO: 2224715 - RNA, 13 nt, Human
cacauccuguggg

SEQ ID NO: 2224716 - RNA, 20 nt, Human
acuagaguuuagcuggaaaa

SEQ ID NO: 2224717 - RNA, 14 nt, Human
agauguagaggaga

SEQ ID NO: 2224718 - RNA, 13 nt, Human
augauuccaccua

SEQ ID NO: 2224719 - RNA, 18 nt, Human
ugcauagguuuaauaauu

SEQ ID NO: 2224720 - RNA, 11 nt, Human
aauuccacagc

SEQ ID NO: 2224721 - RNA, 19 nt, Human
acuucagcgguuuauauaa

SEQ ID NO: 2224722 - RNA, 12 nt, Human
aauaauuuuuaa

SEQ ID NO: 2224723 - RNA, 19 nt, Human
auuaaguuuuuuuuuaaaa

SEQ ID NO: 2224724 - RNA, 20 nt, Human
ugguuguauuauuuuuuaaa

SEQ ID NO: 2224725 - RNA, 20 nt, Human
agagacacacugaagaagca

SEQ ID NO: 2224726 - RNA, 13 nt, Human
aaacauccuacaa

SEQ ID NO: 2224727 - RNA, 20 nt, Human
uuacaaauccaaugaaauga

SEQ ID NO: 2224728 - RNA, 13 nt, Human
augcuagaacucc

SEQ ID NO: 2224729 - RNA, 19 nt, Human
cucauggaauuggagcucg

SEQ ID NO: 2224730 - RNA, 23 nt, Human
agcuaggggggucagccagcccu

SEQ ID NO: 2224731 - RNA, 13 nt, Human
acacacaugaagu

SEQ ID NO: 2224732 - RNA, 20 nt, Human
ccuucucaccugugagacca

SEQ ID NO: 2224733 - RNA, 21 nt, Human
ccuuuuuuugaaaaaaagcuu

SEQ ID NO: 2224734 - RNA, 13 nt, Human
agggggaacauga

SEQ ID NO: 2224735 - RNA, 23 nt, Human
ugucaauucuugccaaauauaaa

SEQ ID NO: 2224736 - RNA, 15 nt, Human
guaaggggaauugag

SEQ ID NO: 2224737 - RNA, 11 nt, Human
caucuagugag

SEQ ID NO: 2224738 - RNA, 22 nt, Human
agcacagccucuuagaugcagu

SEQ ID NO: 2224739 - RNA, 13 nt, Human
ugagcgacaguga

SEQ ID NO: 2224740 - RNA, 16 nt, Human
ucuuauaauuuaaaau

SEQ ID NO: 2224741 - RNA, 19 nt, Human
gugacuuaaugccacuaaa

SEQ ID NO: 2224742 - RNA, 13 nt, Human
cccagauaccaug

SEQ ID NO: 2224743 - RNA, 23 nt, Human
uuuauaugcuucuguuuuauaau

SEQ ID NO: 2224744 - RNA, 13 nt, Human
ugaaauuguauua

SEQ ID NO: 2224745 - RNA, 18 nt, Human
ugccauaauuacuauguc

SEQ ID NO: 2224746 - RNA, 18 nt, Human
aaguugauaugccuuuuc

SEQ ID NO: 2224747 - RNA, 22 nt, Human
agcucuaucccaaccucuccca

SEQ ID NO: 2224748 - RNA, 18 nt, Human
guaauauugcaaggcaaa

SEQ ID NO: 2224749 - RNA, 12 nt, Human
uucagccugaaa

SEQ ID NO: 2224750 - RNA, 12 nt, Human
accaggcacccc

SEQ ID NO: 2224751 - RNA, 22 nt, Human
uucaauaucuuuuuuuuaauaa

SEQ ID NO: 2224752 - RNA, 18 nt, Human
gaccccugagcuugcaga

SEQ ID NO: 2224753 - RNA, 18 nt, Human
ggaaagacagcuucucau

SEQ ID NO: 2224754 - RNA, 20 nt, Human
cuaggggggucagccagccc

SEQ ID NO: 2224755 - RNA, 23 nt, Human
aucacagcuacuugggaggcuga

SEQ ID NO: 2224756 - RNA, 18 nt, Human
agccugaucaccugcccu

SEQ ID NO: 2224757 - RNA, 15 nt, Human
auauaaauaaaaaua

SEQ ID NO: 2224758 - RNA, 20 nt, Human
uuaaugccacuaaauugaca

SEQ ID NO: 2224759 - RNA, 19 nt, Human
agccugaucaccugcccug

SEQ ID NO: 2224760 - RNA, 22 nt, Human
aaauguugacaugggacauuug

SEQ ID NO: 2224761 - RNA, 14 nt, Human
caggaggggcuucu

SEQ ID NO: 2224762 - RNA, 13 nt, Human
cuccccagcucua

SEQ ID NO: 2224763 - RNA, 18 nt, Human
ggaggacgcucucuggcc

SEQ ID NO: 2224764 - RNA, 16 nt, Human
uggcaagcucuaucac

SEQ ID NO: 2224765 - RNA, 18 nt, Human
uauuuucuauaauuuaaa

SEQ ID NO: 2224766 - RNA, 17 nt, Human
acuugaacccauauuug

SEQ ID NO: 2224767 - RNA, 14 nt, Human
cuaagcauuccaac

SEQ ID NO: 2224768 - RNA, 13 nt, Human
aaaguguuugaaa

SEQ ID NO: 2224769 - RNA, 22 nt, Human
aggcuccugagacacaugggug

SEQ ID NO: 2224770 - RNA, 19 nt, Human
uuggcaagcucuaucacca

SEQ ID NO: 2224771 - RNA, 21 nt, Human
ccaggaggggcuucugggcag

SEQ ID NO: 2224772 - RNA, 16 nt, Human
uaaaagacaaggaaaa

SEQ ID NO: 2224773 - RNA, 14 nt, Human
aagaagugaaaauc

SEQ ID NO: 2224774 - RNA, 20 nt, Human
augaaguuguagguaauauu

SEQ ID NO: 2224775 - RNA, 13 nt, Human
uuuaaaaaagaaa

SEQ ID NO: 2224776 - RNA, 19 nt, Human
agggaauugcagaguacug

SEQ ID NO: 2224777 - RNA, 16 nt, Human
cagccagcccucuucu

SEQ ID NO: 2224778 - RNA, 21 nt, Human
uccuucagccugaaagaggaa

SEQ ID NO: 2224779 - RNA, 19 nt, Human
aaagacagugaaagaaaau

SEQ ID NO: 2224780 - RNA, 18 nt, Human
acaccucagcugccuccc

SEQ ID NO: 2224781 - RNA, 21 nt, Human
acaguuaccucugccucagaa

SEQ ID NO: 2224782 - RNA, 13 nt, Human
acaagagcuuaac

SEQ ID NO: 2224783 - RNA, 13 nt, Human
ucuuauaauuuaa

SEQ ID NO: 2224784 - RNA, 16 nt, Human
uucaguuauuauauuu

SEQ ID NO: 2224785 - RNA, 11 nt, Human
cauaugaaaag

SEQ ID NO: 2224786 - RNA, 17 nt, Human
caagccuccuuuuaaag

SEQ ID NO: 2224787 - RNA, 20 nt, Human
uauaugcuaagucuuauaua

SEQ ID NO: 2224788 - RNA, 16 nt, Human
gcuuuuucucucccac

SEQ ID NO: 2224789 - RNA, 16 nt, Human
ccugcaaagcccagcu

SEQ ID NO: 2224790 - RNA, 23 nt, Human
caucucuucuggguuccuuccuc

SEQ ID NO: 2224791 - RNA, 20 nt, Human
aagucuuucacauuuaaaua

SEQ ID NO: 2224792 - RNA, 14 nt, Human
aaagagaacuucca

SEQ ID NO: 2224793 - RNA, 17 nt, Human
auaaaguacaagagcuu

SEQ ID NO: 2224794 - RNA, 19 nt, Human
auuggagcucgugggacag

SEQ ID NO: 2224795 - RNA, 15 nt, Human
cucccugccccccag

SEQ ID NO: 2224796 - RNA, 16 nt, Human
cugaucaccugcccug

SEQ ID NO: 2224797 - RNA, 12 nt, Human
acacugaagaag

SEQ ID NO: 2224798 - RNA, 16 nt, Human
augccccgucccccuc

SEQ ID NO: 2224799 - RNA, 17 nt, Human
ggccaugggacagggag

SEQ ID NO: 2224800 - RNA, 17 nt, Human
aaauaacgauaaaagac

SEQ ID NO: 2224801 - RNA, 21 nt, Human
uagggugauauuaaccagggg

SEQ ID NO: 2224802 - RNA, 23 nt, Human
agcccuccuuaucaaaggacacc

SEQ ID NO: 2224803 - RNA, 12 nt, Human
gugggaccuggg

SEQ ID NO: 2224804 - RNA, 17 nt, Human
ccucagcugccucccca

SEQ ID NO: 2224805 - RNA, 21 nt, Human
auuuuccugaaaacccuugcc

SEQ ID NO: 2224806 - RNA, 19 nt, Human
uggaacaguuaccucugcc

SEQ ID NO: 2224807 - RNA, 23 nt, Human
caccucauggaauuggagcucgu

SEQ ID NO: 2224808 - RNA, 22 nt, Human
cacuuggacaugggccccagau

SEQ ID NO: 2224809 - RNA, 13 nt, Human
gcuggagcucugc

SEQ ID NO: 2224810 - RNA, 19 nt, Human
gccccccagcccuccuuau

SEQ ID NO: 2224811 - RNA, 18 nt, Human
uuuuauaucaauuuaaaa

SEQ ID NO: 2224812 - RNA, 14 nt, Human
cagucugaugagaa

SEQ ID NO: 2224813 - RNA, 21 nt, Human
uacaugagguacugagaguga

SEQ ID NO: 2224814 - RNA, 17 nt, Human
uuauaucaauuuaaaaa

SEQ ID NO: 2224815 - RNA, 14 nt, Human
uccacaacacacag

SEQ ID NO: 2224816 - RNA, 21 nt, Human
acuuuuccaaugacauuuugu

SEQ ID NO: 2224817 - RNA, 23 nt, Human
augucaauucuugccaaauauaa

SEQ ID NO: 2224818 - RNA, 19 nt, Human
gagguacugagagugaaca

SEQ ID NO: 2224819 - RNA, 22 nt, Human
cuccagagggaauugcagagua

SEQ ID NO: 2224820 - RNA, 14 nt, Human
cacuuauaggaauu

SEQ ID NO: 2224821 - RNA, 16 nt, Human
uaucaaaagaaagaaa

SEQ ID NO: 2224822 - RNA, 10 nt, Human
ccugagcccc

SEQ ID NO: 2224823 - RNA, 20 nt, Human
aagcuucacuguaaaauaau

SEQ ID NO: 2224824 - RNA, 19 nt, Human
cucaccucccccaucucuu

SEQ ID NO: 2224825 - RNA, 14 nt, Human
uuuuuguuuuguuu

SEQ ID NO: 2224826 - RNA, 14 nt, Human
cuccagugagacag

SEQ ID NO: 2224827 - RNA, 12 nt, Human
gagcucccagga

SEQ ID NO: 2224828 - RNA, 13 nt, Human
caacaucuaguga

SEQ ID NO: 2224829 - RNA, 15 nt, Human
uaggaaauauuuauu

SEQ ID NO: 2224830 - RNA, 19 nt, Human
uuauggcacuaguauuucu

SEQ ID NO: 2224831 - RNA, 22 nt, Human
ugugccugagcggaccuuccca

SEQ ID NO: 2224832 - RNA, 18 nt, Human
uccagcuggccgggagcc

SEQ ID NO: 2224833 - RNA, 13 nt, Human
ucucccucccuug

SEQ ID NO: 2224834 - RNA, 22 nt, Human
caauaaaagacaaggaaaaaau

SEQ ID NO: 2224835 - RNA, 13 nt, Human
uuuaaaaauccua

SEQ ID NO: 2224836 - RNA, 21 nt, Human
accaaggagccaaacauccua

SEQ ID NO: 2224837 - RNA, 16 nt, Human
cauccuuccucacacc

SEQ ID NO: 2224838 - RNA, 18 nt, Human
uuuuagugaaauauuauu

SEQ ID NO: 2224839 - RNA, 12 nt, Human
agaucaagccug

SEQ ID NO: 2224840 - RNA, 21 nt, Human
cuaguaucaaaagaaagaaaa

SEQ ID NO: 2224841 - RNA, 22 nt, Human
caucgcaauguaagacucggga

SEQ ID NO: 2224842 - RNA, 15 nt, Human
aagugaaaaucuaca

SEQ ID NO: 2224843 - RNA, 13 nt, Human
gaagaacugaaau

SEQ ID NO: 2224844 - RNA, 21 nt, Human
acgcucucuggccuucggccu

SEQ ID NO: 2224845 - RNA, 14 nt, Human
uuucaauaaaacuu

SEQ ID NO: 2224846 - RNA, 12 nt, Human
auauaaauaaaa

SEQ ID NO: 2224847 - RNA, 21 nt, Human
ugcucaauaaaguacaagagc

SEQ ID NO: 2224848 - RNA, 18 nt, Human
uauuuucaguuauuauau

SEQ ID NO: 2224849 - RNA, 15 nt, Human
gccagugucaggagg

SEQ ID NO: 2224850 - RNA, 13 nt, Human
cacuguaaaauaa

SEQ ID NO: 2224851 - RNA, 16 nt, Human
aauuacauuuguauaa

SEQ ID NO: 2224852 - RNA, 13 nt, Human
uuuucuuuucauu

SEQ ID NO: 2224853 - RNA, 16 nt, Human
ucaucaaugaaugaau

SEQ ID NO: 2224854 - RNA, 19 nt, Human
caauucuugccaaauauaa

SEQ ID NO: 2224855 - RNA, 23 nt, Human
auauaacaaugcuguauuuuaaa

SEQ ID NO: 2224856 - RNA, 22 nt, Human
ggguggaaaaacagaccggggu

SEQ ID NO: 2224857 - RNA, 22 nt, Human
gaaaaucuuauaauuuaaaaua

SEQ ID NO: 2224858 - RNA, 14 nt, Human
acccgggaggcaga

SEQ ID NO: 2224859 - RNA, 21 nt, Human
gccaaauauaaauaaaaauaa

SEQ ID NO: 2224860 - RNA, 17 nt, Human
caggaggggcuucuggg

SEQ ID NO: 2224861 - RNA, 19 nt, Human
ccugagcggaccuucccag

SEQ ID NO: 2224862 - RNA, 21 nt, Human
caaggaaaaaauaacaaugaa

SEQ ID NO: 2224863 - RNA, 23 nt, Human
ccucagcugccuccccagcucua

SEQ ID NO: 2224864 - RNA, 22 nt, Human
caccagucugacuguuuccauc

SEQ ID NO: 2224865 - RNA, 21 nt, Human
gcaucgugucuggcguugugg

SEQ ID NO: 2224866 - RNA, 21 nt, Human
cauuuucuucucacauuuaua

SEQ ID NO: 2224867 - RNA, 15 nt, Human
ccccugagcuugcag

SEQ ID NO: 2224868 - RNA, 18 nt, Human
acagagacagaaagcaga

SEQ ID NO: 2224869 - RNA, 21 nt, Human
aauuuuuauauuugaaauauu

SEQ ID NO: 2224870 - RNA, 17 nt, Human
ugguucccuugaugaag

SEQ ID NO: 2224871 - RNA, 18 nt, Human
uagugaaauauuauuuua

SEQ ID NO: 2224872 - RNA, 19 nt, Human
uauauuuuugugauuuugu

SEQ ID NO: 2224873 - RNA, 14 nt, Human
cauagaaguaaaaa

SEQ ID NO: 2224874 - RNA, 18 nt, Human
gaaauggugaaaugcaga

SEQ ID NO: 2224875 - RNA, 16 nt, Human
acuaggugcugcagcc

SEQ ID NO: 2224876 - RNA, 16 nt, Human
uuauaauuuaaaauau

SEQ ID NO: 2224877 - RNA, 16 nt, Human
ccuccuuuuaaaguaa

SEQ ID NO: 2224878 - RNA, 21 nt, Human
cgacagugagacucugucuca

SEQ ID NO: 2224879 - RNA, 16 nt, Human
agggagggaaggggga

SEQ ID NO: 2224880 - RNA, 15 nt, Human
cucaacaaacauaau

SEQ ID NO: 2224881 - RNA, 20 nt, Human
uaacgauaaaagacagugaa

SEQ ID NO: 2224882 - RNA, 21 nt, Human
cuuuuccaaugacauuuuguu

SEQ ID NO: 2224883 - RNA, 16 nt, Human
aagcauuuagauguau

SEQ ID NO: 2224884 - RNA, 19 nt, Human
auagcuacuaauuuuaaaa

SEQ ID NO: 2224885 - RNA, 17 nt, Human
cuggacucaccuccccc

SEQ ID NO: 2224886 - RNA, 16 nt, Human
uaaugaauacuuuaua

SEQ ID NO: 2224887 - RNA, 18 nt, Human
auuuguauaaaauaauuu

SEQ ID NO: 2224888 - RNA, 12 nt, Human
cucauggaauug

SEQ ID NO: 2224889 - RNA, 16 nt, Human
caggcugagccucagu

SEQ ID NO: 2224890 - RNA, 14 nt, Human
ugacacuaaaacac

SEQ ID NO: 2224891 - RNA, 20 nt, Human
cacccccagaaugaccuggc

SEQ ID NO: 2224892 - RNA, 17 nt, Human
auauuugaaauauugac

SEQ ID NO: 2224893 - RNA, 21 nt, Human
gagcuaggggggucagccagc

SEQ ID NO: 2224894 - RNA, 18 nt, Human
caaggcuagaaccaccug

SEQ ID NO: 2224895 - RNA, 20 nt, Human
accuacacgagauacagaau

SEQ ID NO: 2224896 - RNA, 21 nt, Human
cagagucaaugaacuuuccac

SEQ ID NO: 2224897 - RNA, 12 nt, Human
cucccugccccc

SEQ ID NO: 2224898 - RNA, 19 nt, Human
ccaggcacccccagaauga

SEQ ID NO: 2224899 - RNA, 20 nt, Human
aauaagccagacaucaacag

SEQ ID NO: 2224900 - RNA, 20 nt, Human
uccacuuggacaugggcccc

SEQ ID NO: 2224901 - RNA, 17 nt, Human
cugagcgacagugagac

SEQ ID NO: 2224902 - RNA, 19 nt, Human
acagugauuaccagggacu

SEQ ID NO: 2224903 - RNA, 17 nt, Human
uucugacacuaaaacac

SEQ ID NO: 2224904 - RNA, 17 nt, Human
ucccagaucaagccugc

SEQ ID NO: 2224905 - RNA, 16 nt, Human
aauuucuucaacuccc

SEQ ID NO: 2224906 - RNA, 18 nt, Human
uaaguuuuuuuuuaaaaa

SEQ ID NO: 2224907 - RNA, 16 nt, Human
ugaaguccaagcauuu

SEQ ID NO: 2224908 - RNA, 13 nt, Human
agagguccacaac

SEQ ID NO: 2224909 - RNA, 22 nt, Human
acaggauggcaggaggcaucca

SEQ ID NO: 2224910 - RNA, 14 nt, Human
ccugggcugaggca

SEQ ID NO: 2224911 - RNA, 17 nt, Human
cugcacuccagccugag

SEQ ID NO: 2224912 - RNA, 20 nt, Human
uuucuucaacucccugcccc

SEQ ID NO: 2224913 - RNA, 16 nt, Human
gacauuugcucaugga

SEQ ID NO: 2224914 - RNA, 18 nt, Human
uaaaagacaaggaaaaaa

SEQ ID NO: 2224915 - RNA, 12 nt, Human
caagccugccuc

SEQ ID NO: 2224916 - RNA, 18 nt, Human
uuuauguuuaauucugaa

SEQ ID NO: 2224917 - RNA, 23 nt, Human
aggcaugagucagucugaugaga

SEQ ID NO: 2224918 - RNA, 14 nt, Human
agaaaauaacaaua

SEQ ID NO: 2224919 - RNA, 13 nt, Human
ugcauuucuaaag

SEQ ID NO: 2224920 - RNA, 20 nt, Human
acuccacuuggacaugggcc

SEQ ID NO: 2224921 - RNA, 16 nt, Human
agguacuucaaauccu

SEQ ID NO: 2224922 - RNA, 20 nt, Human
cucuucugacacuaaaacac

SEQ ID NO: 2224923 - RNA, 15 nt, Human
ugaaauuguauuaca

SEQ ID NO: 2224924 - RNA, 20 nt, Human
aauuuugugaagcaaaauuu

SEQ ID NO: 2224925 - RNA, 14 nt, Human
cuuggucugugaga

SEQ ID NO: 2224926 - RNA, 22 nt, Human
acaugagguacugagagugaac

SEQ ID NO: 2224927 - RNA, 16 nt, Human
aagaaaauaacaauaa

SEQ ID NO: 2224928 - RNA, 14 nt, Human
auaaaauaauuuuu

SEQ ID NO: 2224929 - RNA, 16 nt, Human
augcuguauuuuaaaa

SEQ ID NO: 2224930 - RNA, 15 nt, Human
gccucuuagaugcag

SEQ ID NO: 2224931 - RNA, 15 nt, Human
ucugucucaguccau

SEQ ID NO: 2224932 - RNA, 13 nt, Human
uacagagacagaa

SEQ ID NO: 2224933 - RNA, 23 nt, Human
ccagguaccuucucaccugugag

SEQ ID NO: 2224934 - RNA, 14 nt, Human
gcuggagcucugcc

SEQ ID NO: 2224935 - RNA, 18 nt, Human
agcugcucaauaaaguac

SEQ ID NO: 2224936 - RNA, 20 nt, Human
cuuauucacaagacccaaaa

SEQ ID NO: 2224937 - RNA, 15 nt, Human
acauccuacaagaca

SEQ ID NO: 2224938 - RNA, 18 nt, Human
cucuggccuucggccucc

SEQ ID NO: 2224939 - RNA, 14 nt, Human
ucugccugcccuga

SEQ ID NO: 2224940 - RNA, 17 nt, Human
ggauacuccauggggug

SEQ ID NO: 2224941 - RNA, 11 nt, Human
aauugcagagu

SEQ ID NO: 2224942 - RNA, 13 nt, Human
cgggaggcagagg

SEQ ID NO: 2224943 - RNA, 15 nt, Human
uauaauuuaaauaua

SEQ ID NO: 2224944 - RNA, 18 nt, Human
acaaauccaaugaaauga

SEQ ID NO: 2224945 - RNA, 21 nt, Human
auggcagcuuuccucaaaacu

SEQ ID NO: 2224946 - RNA, 20 nt, Human
ccaaccucucccaacuauaa

SEQ ID NO: 2224947 - RNA, 14 nt, Human
uauaaauaaaaaua

SEQ ID NO: 2224948 - RNA, 22 nt, Human
aaagagugaaggauuuauguuu

SEQ ID NO: 2224949 - RNA, 18 nt, Human
cagggaggacgcucucug

SEQ ID NO: 2224950 - RNA, 17 nt, Human
gugccuguaaucacagc

SEQ ID NO: 2224951 - RNA, 23 nt, Human
ugcagagguccacaacacacaga

SEQ ID NO: 2224952 - RNA, 13 nt, Human
aaaugggaaacaa

SEQ ID NO: 2224953 - RNA, 22 nt, Human
auauauaacaaugcuguauuuu

SEQ ID NO: 2224954 - RNA, 15 nt, Human
cuggacucaccuccc

SEQ ID NO: 2224955 - RNA, 18 nt, Human
aauaaaacuuuuccaaug

SEQ ID NO: 2224956 - RNA, 20 nt, Human
ggagccugaucaccugcccu

SEQ ID NO: 2224957 - RNA, 23 nt, Human
cuuaagaagacugcauuauauuu

SEQ ID NO: 2224958 - RNA, 19 nt, Human
cccauggcacucuauguuc

SEQ ID NO: 2224959 - RNA, 22 nt, Human
aacucccugccccccagcccuc

SEQ ID NO: 2224960 - RNA, 14 nt, Human
ucccuugaugaaga

SEQ ID NO: 2224961 - RNA, 15 nt, Human
aauucugaaagcaac

SEQ ID NO: 2224962 - RNA, 15 nt, Human
uggaguaaaucgcua

SEQ ID NO: 2224963 - RNA, 12 nt, Human
gcugaugcaguu

SEQ ID NO: 2224964 - RNA, 12 nt, Human
cuccauuuuuag

SEQ ID NO: 2224965 - RNA, 11 nt, Human
aauuuaaauau

SEQ ID NO: 2224966 - RNA, 18 nt, Human
gacauuugcucauggaau

SEQ ID NO: 2224967 - RNA, 21 nt, Human
gaaagcagggacuugaaccca

SEQ ID NO: 2224968 - RNA, 15 nt, Human
gagaugcuagaacuc

SEQ ID NO: 2224969 - RNA, 14 nt, Human
caaggaaaaaauaa

SEQ ID NO: 2224970 - RNA, 22 nt, Human
agcuuguauuccuuuuucucuc

SEQ ID NO: 2224971 - RNA, 21 nt, Human
uuauguuuaauucugaaagca

SEQ ID NO: 2224972 - RNA, 19 nt, Human
uacuucuuaggguuaugau

SEQ ID NO: 2224973 - RNA, 15 nt, Human
auagaaguaaaaaca

SEQ ID NO: 2224974 - RNA, 14 nt, Human
gcaaagcccagcuu

SEQ ID NO: 2224975 - RNA, 22 nt, Human
accaaucaugaauuaguuuuau

SEQ ID NO: 2224976 - RNA, 16 nt, Human
ucccugccccccagcc

SEQ ID NO: 2224977 - RNA, 17 nt, Human
ugaaauaagccagacau

SEQ ID NO: 2224978 - RNA, 16 nt, Human
cacgggggccaaggau

SEQ ID NO: 2224979 - RNA, 23 nt, Human
uaacgauaaaagacagugaaaga

SEQ ID NO: 2224980 - RNA, 13 nt, Human
ucuacuaaaaaua

SEQ ID NO: 2224981 - RNA, 18 nt, Human
auuaaguuuuuuuuuaaa

SEQ ID NO: 2224982 - RNA, 15 nt, Human
ugaaacccugucucu

SEQ ID NO: 2224983 - RNA, 13 nt, Human
auaaauaaaaaua

SEQ ID NO: 2224984 - RNA, 20 nt, Human
gauugugccccugcacucca

SEQ ID NO: 2224985 - RNA, 15 nt, Human
cuuaagaagacugca

SEQ ID NO: 2224986 - RNA, 17 nt, Human
ugaucaccugcccugcu

SEQ ID NO: 2224987 - RNA, 14 nt, Human
uugccugcaggcau

SEQ ID NO: 2224988 - RNA, 22 nt, Human
ccauagucauucugccugcccu

SEQ ID NO: 2224989 - RNA, 22 nt, Human
auuuucuucucacauuuauauu

SEQ ID NO: 2224990 - RNA, 21 nt, Human
uccauccugaggcuccacuug

SEQ ID NO: 2224991 - RNA, 23 nt, Human
cuaguaauuggaaaggcagcucu

SEQ ID NO: 2224992 - RNA, 14 nt, Human
ugcugcagccccug

SEQ ID NO: 2224993 - RNA, 23 nt, Human
agcagugcuugaaugaaguugua

SEQ ID NO: 2224994 - RNA, 15 nt, Human
acaaaugggaaacaa

SEQ ID NO: 2224995 - RNA, 23 nt, Human
auuauauggcuugaguuuaaauu

SEQ ID NO: 2224996 - RNA, 13 nt, Human
uuuuaaaaaagaa

SEQ ID NO: 2224997 - RNA, 22 nt, Human
uuuccaagcaaguauuagaaua

SEQ ID NO: 2224998 - RNA, 21 nt, Human
gcccauccugccccugagccc

SEQ ID NO: 2224999 - RNA, 20 nt, Human
gaaaauaacgauaaaagaca

SEQ ID NO: 2225000 - RNA, 19 nt, Human
guuauuauauuuacaaaug

SEQ ID NO: 2225001 - RNA, 18 nt, Human
aggcggauugagaaggag

SEQ ID NO: 2225002 - RNA, 16 nt, Human
aaauauuauguuaaaa

SEQ ID NO: 2225003 - RNA, 18 nt, Human
ccuuccuaauuccacagc

SEQ ID NO: 2225004 - RNA, 23 nt, Human
uaaaagacagugaaagaaaauaa

SEQ ID NO: 2225005 - RNA, 12 nt, Human
gucccaggcuga

SEQ ID NO: 2225006 - RNA, 18 nt, Human
cagguaccuucucaccug

SEQ ID NO: 2225007 - RNA, 12 nt, Human
acacuaaaacac

SEQ ID NO: 2225008 - RNA, 19 nt, Human
ccccucuggcuccagcugg

SEQ ID NO: 2225009 - RNA, 12 nt, Human
acuauaaaacua

SEQ ID NO: 2225010 - RNA, 11 nt, Human
ucaccuccccc

SEQ ID NO: 2225011 - RNA, 19 nt, Human
gugaacuugguuuuaauua

SEQ ID NO: 2225012 - RNA, 14 nt, Human
cacaagaaaugaaa

SEQ ID NO: 2225013 - RNA, 20 nt, Human
accaggcacccccagaauga

SEQ ID NO: 2225014 - RNA, 15 nt, Human
ucuggcuccagcugg

SEQ ID NO: 2225015 - RNA, 17 nt, Human
uaaaagacagugaaaga

SEQ ID NO: 2225016 - RNA, 11 nt, Human
uuuuuuuucaa

SEQ ID NO: 2225017 - RNA, 16 nt, Human
aacuugguuuuaauua

SEQ ID NO: 2225018 - RNA, 13 nt, Human
auccugcaggcag

SEQ ID NO: 2225019 - RNA, 23 nt, Human
uuuuauagcuacuaauuuuaaaa

SEQ ID NO: 2225020 - RNA, 19 nt, Human
uguuggacgagaaaacaau

SEQ ID NO: 2225021 - RNA, 23 nt, Human
ggcaaagacuauucccuucuaac

SEQ ID NO: 2225022 - RNA, 17 nt, Human
uguucuaagaagugaaa

SEQ ID NO: 2225023 - RNA, 17 nt, Human
acaaaugcauuucuaaa

SEQ ID NO: 2225024 - RNA, 20 nt, Human
ugagagacacacugaagaag

SEQ ID NO: 2225025 - RNA, 16 nt, Human
agugucaaugcagccc

SEQ ID NO: 2225026 - RNA, 23 nt, Human
ucacaccaggcuugccugcaggc

SEQ ID NO: 2225027 - RNA, 20 nt, Human
augcuucuguuuuauaauuu

SEQ ID NO: 2225028 - RNA, 16 nt, Human
ugaaauuguauuacaa

SEQ ID NO: 2225029 - RNA, 19 nt, Human
auguuuacagauccccaag

SEQ ID NO: 2225030 - RNA, 18 nt, Human
uguacuuuauuuucuaua

SEQ ID NO: 2225031 - RNA, 17 nt, Human
agaacucccuuucaaca

SEQ ID NO: 2225032 - RNA, 15 nt, Human
ucugcagauaaacag

SEQ ID NO: 2225033 - RNA, 24 nt, Human
ccccugagcuugcagagaugaggc

SEQ ID NO: 2225034 - RNA, 22 nt, Human
cuggcaaggguucaccugggcu

SEQ ID NO: 2225035 - RNA, 13 nt, Human
aucaagccugccu

SEQ ID NO: 2225036 - RNA, 19 nt, Human
ggaauuucuucaacucccu

SEQ ID NO: 2225037 - RNA, 18 nt, Human
ccuugggaccccugagcu

SEQ ID NO: 2225038 - RNA, 15 nt, Human
uuacagagacagaaa

SEQ ID NO: 2225039 - RNA, 22 nt, Human
gaauuaaguuuuuuuuuaaaaa

SEQ ID NO: 2225040 - RNA, 19 nt, Human
cuggccuucggccuccauc

SEQ ID NO: 2225041 - RNA, 22 nt, Human
cuucaacucccugccccccagc

SEQ ID NO: 2225042 - RNA, 15 nt, Human
aaugauuaugaauua

SEQ ID NO: 2225043 - RNA, 17 nt, Human
gcaugguuuagaaagcu

SEQ ID NO: 2225044 - RNA, 22 nt, Human
uggaaaguuuaugguuguauua

SEQ ID NO: 2225045 - RNA, 18 nt, Human
gaaaauaacaauaaaaga

SEQ ID NO: 2225046 - RNA, 22 nt, Human
agucuuucacauuuaaauaaag

SEQ ID NO: 2225047 - RNA, 16 nt, Human
cugcacuccagccuga

SEQ ID NO: 2225048 - RNA, 23 nt, Human
gggagccugaucaccugcccugc

SEQ ID NO: 2225049 - RNA, 18 nt, Human
gcuccauuuuuagugaaa

SEQ ID NO: 2225050 - RNA, 18 nt, Human
uacauuuguauaaaauaa

SEQ ID NO: 2225051 - RNA, 20 nt, Human
ggccaugggacagggaggac

SEQ ID NO: 2225052 - RNA, 12 nt, Human
gaaagucccaga

SEQ ID NO: 2225053 - RNA, 14 nt, Human
aaaagaaacauuug

SEQ ID NO: 2225054 - RNA, 15 nt, Human
agccucagucucccu

SEQ ID NO: 2225055 - RNA, 14 nt, Human
gauaaaagacagug

SEQ ID NO: 2225056 - RNA, 21 nt, Human
agucucccucccuuggggccu

SEQ ID NO: 2225057 - RNA, 15 nt, Human
uaaaacuuuuccaau

SEQ ID NO: 2225058 - RNA, 22 nt, Human
acagauuugagcucagcccugg

SEQ ID NO: 2225059 - RNA, 15 nt, Human
ccacaggaaccacaa

SEQ ID NO: 2225060 - RNA, 14 nt, Human
caguucugaagaag

SEQ ID NO: 2225061 - RNA, 17 nt, Human
uggugaaaugcagaguc

SEQ ID NO: 2225062 - RNA, 16 nt, Human
uggggaugaacuuuuu

SEQ ID NO: 2225063 - RNA, 14 nt, Human
uccacuuggucugu

SEQ ID NO: 2225064 - RNA, 14 nt, Human
auccuugaagauuu

SEQ ID NO: 2225065 - RNA, 23 nt, Human
gcagacucuggucaagaagcauc

SEQ ID NO: 2225066 - RNA, 23 nt, Human
gaaaaaguucugcagauaaacag

SEQ ID NO: 2225067 - RNA, 21 nt, Human
cugauauuggacaguaaaauc

SEQ ID NO: 2225068 - RNA, 13 nt, Human
ccucauggaauug

SEQ ID NO: 2225069 - RNA, 17 nt, Human
ugaccacugcagaagac

SEQ ID NO: 2225070 - RNA, 18 nt, Human
gggggucagccagcccuc

SEQ ID NO: 2225071 - RNA, 12 nt, Human
aagaaaauaaca

SEQ ID NO: 2225072 - RNA, 14 nt, Human
uugugauugauuau

SEQ ID NO: 2225073 - RNA, 22 nt, Human
cucagcccuggugggcagagag

SEQ ID NO: 2225074 - RNA, 16 nt, Human
ccaggcugagccucag

SEQ ID NO: 2225075 - RNA, 16 nt, Human
auuuguauaaaauaau

SEQ ID NO: 2225076 - RNA, 17 nt, Human
uugugaagcaaaauuuu

SEQ ID NO: 2225077 - RNA, 20 nt, Human
caaauauaaauaaaaauaau

SEQ ID NO: 2225078 - RNA, 13 nt, Human
cacaccaggcuug

SEQ ID NO: 2225079 - RNA, 22 nt, Human
ggcagcuuuccucaaaacuuca

SEQ ID NO: 2225080 - RNA, 12 nt, Human
ccuucagccuga

SEQ ID NO: 2225081 - RNA, 12 nt, Human
aaggaugccccg

SEQ ID NO: 2225082 - RNA, 18 nt, Human
aaggagcucccaggaggg

SEQ ID NO: 2225083 - RNA, 22 nt, Human
cagcccuggugggcagagaggu

SEQ ID NO: 2225084 - RNA, 12 nt, Human
uugccugcaggc

SEQ ID NO: 2225085 - RNA, 14 nt, Human
ccugccccugagcc

SEQ ID NO: 2225086 - RNA, 22 nt, Human
uuguaacaagccuccuuuuaaa

SEQ ID NO: 2225087 - RNA, 12 nt, Human
aacuuauuugua

SEQ ID NO: 2225088 - RNA, 16 nt, Human
cucaauaaaguacaag

SEQ ID NO: 2225089 - RNA, 18 nt, Human
acuggacucaccuccccc

SEQ ID NO: 2225090 - RNA, 17 nt, Human
cuaagcuucacuguaaa

SEQ ID NO: 2225091 - RNA, 16 nt, Human
ccucaaaacuucagac

SEQ ID NO: 2225092 - RNA, 18 nt, Human
cuuuccacagaagcucca

SEQ ID NO: 2225093 - RNA, 16 nt, Human
accaggcuugccugca

SEQ ID NO: 2225094 - RNA, 14 nt, Human
caaggcuagaacca

SEQ ID NO: 2225095 - RNA, 21 nt, Human
caccagucugacuguuuccau

SEQ ID NO: 2225096 - RNA, 20 nt, Human
uccagagggaauugcagagu

SEQ ID NO: 2225097 - RNA, 17 nt, Human
cacuagacaaguccagc

SEQ ID NO: 2225098 - RNA, 17 nt, Human
uuuuuaauuauauggcu

SEQ ID NO: 2225099 - RNA, 16 nt, Human
ugccucaccccuugcc

SEQ ID NO: 2225100 - RNA, 14 nt, Human
caugggccccagau

SEQ ID NO: 2225101 - RNA, 21 nt, Human
aauaauccucaguuuuuguga

SEQ ID NO: 2225102 - RNA, 20 nt, Human
aauaucuuuuuuuuaauaaa

SEQ ID NO: 2225103 - RNA, 13 nt, Human
aacucccugcccc

SEQ ID NO: 2225104 - RNA, 22 nt, Human
ucuggguuccuuccucugagcc

SEQ ID NO: 2225105 - RNA, 15 nt, Human
auaaauaaaaauaau

SEQ ID NO: 2225106 - RNA, 16 nt, Human
aaaagcuccauuuuua

SEQ ID NO: 2225107 - RNA, 20 nt, Human
caggaggggcuucugggcag

SEQ ID NO: 2225108 - RNA, 19 nt, Human
uaguuuaugauuccaccua

SEQ ID NO: 2225109 - RNA, 22 nt, Human
ccauacuaauuauacccccugc

SEQ ID NO: 2225110 - RNA, 14 nt, Human
ccaaauauaaauaa

SEQ ID NO: 2225111 - RNA, 12 nt, Human
ggggugggggug

SEQ ID NO: 2225112 - RNA, 16 nt, Human
uaaaauccauacauuu

SEQ ID NO: 2225113 - RNA, 20 nt, Human
caagagccuuuuuuugaaaa

SEQ ID NO: 2225114 - RNA, 19 nt, Human
cagagaugaggccgccaug

SEQ ID NO: 2225115 - RNA, 14 nt, Human
auuuauguuuaauu

SEQ ID NO: 2225116 - RNA, 13 nt, Human
ccaggcugagccu

SEQ ID NO: 2225117 - RNA, 15 nt, Human
cauucugccugcccu

SEQ ID NO: 2225118 - RNA, 13 nt, Human
cucaccuccccca

SEQ ID NO: 2225119 - RNA, 22 nt, Human
cccaugauguuuagaaacacaa

SEQ ID NO: 2225120 - RNA, 21 nt, Human
aagucuuucacauuuaaauaa

SEQ ID NO: 2225121 - RNA, 15 nt, Human
cugacucuuaagaag

SEQ ID NO: 2225122 - RNA, 19 nt, Human
ugaaauuguauuacaaauc

SEQ ID NO: 2225123 - RNA, 22 nt, Human
cucccacuagacaaguccagcc

SEQ ID NO: 2225124 - RNA, 13 nt, Human
uuuuuuuuuucaa

SEQ ID NO: 2225125 - RNA, 16 nt, Human
cugauggguuucucca

SEQ ID NO: 2225126 - RNA, 14 nt, Human
aagagugaaggauu

SEQ ID NO: 2225127 - RNA, 22 nt, Human
cacuaguauuucuaugaaauau

SEQ ID NO: 2225128 - RNA, 17 nt, Human
agcucccaggaggggcu

SEQ ID NO: 2225129 - RNA, 23 nt, Human
auuucugagcauuuaauauggau

SEQ ID NO: 2225130 - RNA, 21 nt, Human
cugagccucagucucccuccc

SEQ ID NO: 2225131 - RNA, 19 nt, Human
auuuucuauaauuuaaaua

SEQ ID NO: 2225132 - RNA, 12 nt, Human
uaguacacacuu

SEQ ID NO: 2225133 - RNA, 16 nt, Human
aaauauaaauaaaaau

SEQ ID NO: 2225134 - RNA, 21 nt, Human
ucuucaacucccugcccccca

SEQ ID NO: 2225135 - RNA, 20 nt, Human
ugagcagugcuugaaugaag

SEQ ID NO: 2225136 - RNA, 12 nt, Human
cuuccucugagc

SEQ ID NO: 2225137 - RNA, 11 nt, Human
acugggacagg

SEQ ID NO: 2225138 - RNA, 15 nt, Human
cugcagauaaacagu

SEQ ID NO: 2225139 - RNA, 14 nt, Human
uaugaauuacauuu

SEQ ID NO: 2225140 - RNA, 17 nt, Human
cucgugggacagucacc

SEQ ID NO: 2225141 - RNA, 15 nt, Human
cagccccugggacca

SEQ ID NO: 2225142 - RNA, 14 nt, Human
ccaaugaaaugagu

SEQ ID NO: 2225143 - RNA, 18 nt, Human
cagcuuauugucuaguga

SEQ ID NO: 2225144 - RNA, 22 nt, Human
ccauuucuugagguaaaagcau

SEQ ID NO: 2225145 - RNA, 16 nt, Human
ucccagaucaagccug

SEQ ID NO: 2225146 - RNA, 19 nt, Human
gcucauggaauuggagcuc

SEQ ID NO: 2225147 - RNA, 20 nt, Human
gagccugaucaccugcccug

SEQ ID NO: 2225148 - RNA, 14 nt, Human
ccuugaugaagaag

SEQ ID NO: 2225149 - RNA, 16 nt, Human
uucugacacuaaaaca

SEQ ID NO: 2225150 - RNA, 19 nt, Human
ucaguccaugaagauguag

SEQ ID NO: 2225151 - RNA, 14 nt, Human
uaguuucccuugca

SEQ ID NO: 2225152 - RNA, 11 nt, Human
augggacaggg

SEQ ID NO: 2225153 - RNA, 17 nt, Human
ucaauccaagaacuuau

SEQ ID NO: 2225154 - RNA, 23 nt, Human
aacuuuuccaaugacauuuuguu

SEQ ID NO: 2225155 - RNA, 20 nt, Human
ccauuguggucacaggaagu

SEQ ID NO: 2225156 - RNA, 17 nt, Human
cauauuuauagccaggu

SEQ ID NO: 2225157 - RNA, 18 nt, Human
ucaaggguacacugccuu

SEQ ID NO: 2225158 - RNA, 23 nt, Human
auucaauaucuuuuuuuuaauaa

SEQ ID NO: 2225159 - RNA, 22 nt, Human
gaugguucccuugaugaagaag

SEQ ID NO: 2225160 - RNA, 17 nt, Human
aaacaccucagcugccu

SEQ ID NO: 2225161 - RNA, 20 nt, Human
auaauccuaaacauaugaau

SEQ ID NO: 2225162 - RNA, 15 nt, Human
cauguccacugguuc

SEQ ID NO: 2225163 - RNA, 13 nt, Human
caccaaggagcca

SEQ ID NO: 2225164 - RNA, 15 nt, Human
gucaaugcagccccc

SEQ ID NO: 2225165 - RNA, 16 nt, Human
uugucaauaaaaucca

SEQ ID NO: 2225166 - RNA, 13 nt, Human
aggauuugaaauu

SEQ ID NO: 2225167 - RNA, 14 nt, Human
aacgauaaaagaca

SEQ ID NO: 2225168 - RNA, 16 nt, Human
agaugcuagaacuccc

SEQ ID NO: 2225169 - RNA, 17 nt, Human
cuucacuguaaaauaau

SEQ ID NO: 2225170 - RNA, 22 nt, Human
gaaaacaauaacgauaaaagac

SEQ ID NO: 2225171 - RNA, 19 nt, Human
auuuugugaagcaaaauuu

SEQ ID NO: 2225172 - RNA, 18 nt, Human
acuuuaugcuaagugaaa

SEQ ID NO: 2225173 - RNA, 21 nt, Human
gaccaggcacccccagaauga

SEQ ID NO: 2225174 - RNA, 12 nt, Human
aaaagaaagaaa

SEQ ID NO: 2225175 - RNA, 14 nt, Human
acccaaaaggcaga

SEQ ID NO: 2225176 - RNA, 17 nt, Human
uggcuaagcaaaaugug

SEQ ID NO: 2225177 - RNA, 15 nt, Human
uucccgugugccuga

SEQ ID NO: 2225178 - RNA, 17 nt, Human
ugaaaaucuuauaauuu

SEQ ID NO: 2225179 - RNA, 13 nt, Human
uccccagcucuau

SEQ ID NO: 2225180 - RNA, 23 nt, Human
ccccugggaccaggcacccccag

SEQ ID NO: 2225181 - RNA, 20 nt, Human
aacaagccuccuuuuaaagu

SEQ ID NO: 2225182 - RNA, 21 nt, Human
aauaauguuucaaacauauau

SEQ ID NO: 2225183 - RNA, 13 nt, Human
cuaugaaauauua

SEQ ID NO: 2225184 - RNA, 18 nt, Human
uauagcuacuaauuuuaa

SEQ ID NO: 2225185 - RNA, 19 nt, Human
cugagccucagucucccuc

SEQ ID NO: 2225186 - RNA, 14 nt, Human
ccuuaucaaaggac

SEQ ID NO: 2225187 - RNA, 23 nt, Human
auugcagaguacuggcugaugga

SEQ ID NO: 2225188 - RNA, 21 nt, Human
aauucauucacucaacaaaca

SEQ ID NO: 2225189 - RNA, 12 nt, Human
gguauuuuaauc

SEQ ID NO: 2225190 - RNA, 16 nt, Human
auaaugaauacuuuau

SEQ ID NO: 2225191 - RNA, 11 nt, Human
ccugagcccca

SEQ ID NO: 2225192 - RNA, 17 nt, Human
aaucuuucacaggggac

SEQ ID NO: 2225193 - RNA, 17 nt, Human
uucucuaggaaauauuu

SEQ ID NO: 2225194 - RNA, 17 nt, Human
ccaaaagguauuuuaau

SEQ ID NO: 2225195 - RNA, 14 nt, Human
uuucuaugaaauau

SEQ ID NO: 2225196 - RNA, 14 nt, Human
cgcuaccuuuugcu

SEQ ID NO: 2225197 - RNA, 13 nt, Human
gaaccuaggguga

SEQ ID NO: 2225198 - RNA, 22 nt, Human
ucaacuccaaacugacucuuaa

SEQ ID NO: 2225199 - RNA, 17 nt, Human
ccagaucaagccugccu

SEQ ID NO: 2225200 - RNA, 16 nt, Human
agugaaagaaaauaac

SEQ ID NO: 2225201 - RNA, 22 nt, Human
ccgggagccugaucaccugccc

SEQ ID NO: 2225202 - RNA, 18 nt, Human
uucucuaggaaauauuua

SEQ ID NO: 2225203 - RNA, 20 nt, Human
guuccuuccucugagccuug

SEQ ID NO: 2225204 - RNA, 22 nt, Human
uuuauggcacuaguauuucuau

SEQ ID NO: 2225205 - RNA, 13 nt, Human
ccagcacagccuc

SEQ ID NO: 2225206 - RNA, 17 nt, Human
gacagugaaagaaaaua

SEQ ID NO: 2225207 - RNA, 19 nt, Human
gaggcauccaaaggcuccu

SEQ ID NO: 2225208 - RNA, 20 nt, Human
ccccuauccuacuuccccuu

SEQ ID NO: 2225209 - RNA, 18 nt, Human
agcuuacuuaaaauugua

SEQ ID NO: 2225210 - RNA, 13 nt, Human
ccaaaagguauuu

SEQ ID NO: 2225211 - RNA, 15 nt, Human
caggaaguagaggag

SEQ ID NO: 2225212 - RNA, 18 nt, Human
accaggcuugccugcagg

SEQ ID NO: 2225213 - RNA, 17 nt, Human
aagacagugaaagaaaa

SEQ ID NO: 2225214 - RNA, 19 nt, Human
accccugagcuugcagaga

SEQ ID NO: 2225215 - RNA, 16 nt, Human
agauagggagggaagg

SEQ ID NO: 2225216 - RNA, 15 nt, Human
auuucuaugaaauau

SEQ ID NO: 2225217 - RNA, 14 nt, Human
gacaugggccccag

SEQ ID NO: 2225218 - RNA, 17 nt, Human
acuaggugcugcagccc

SEQ ID NO: 2225219 - RNA, 18 nt, Human
cuuucacauuuaaauaaa

SEQ ID NO: 2225220 - RNA, 15 nt, Human
cagugaaagaaaaua

SEQ ID NO: 2225221 - RNA, 22 nt, Human
gaagugaaaaucuacacuccag

SEQ ID NO: 2225222 - RNA, 19 nt, Human
uccugugggaccugggcca

SEQ ID NO: 2225223 - RNA, 20 nt, Human
gauugagaaggagcucccag

SEQ ID NO: 2225224 - RNA, 15 nt, Human
gcaagcucuaucacc

SEQ ID NO: 2225225 - RNA, 20 nt, Human
ucaaaacuucagacauagaa

SEQ ID NO: 2225226 - RNA, 16 nt, Human
cuacacuccagugaga

SEQ ID NO: 2225227 - RNA, 18 nt, Human
cuuccucugagccuuggg

SEQ ID NO: 2225228 - RNA, 22 nt, Human
auggaaauguuuacagaucccc

SEQ ID NO: 2225229 - RNA, 15 nt, Human
ugucaauaaaaucca

SEQ ID NO: 2225230 - RNA, 16 nt, Human
aggcuugccugcaggc

SEQ ID NO: 2225231 - RNA, 12 nt, Human
caugggaaguga

SEQ ID NO: 2225232 - RNA, 18 nt, Human
ugcugcagccccugggac

SEQ ID NO: 2225233 - RNA, 22 nt, Human
uguucugauauuggacaguaaa

SEQ ID NO: 2225234 - RNA, 22 nt, Human
aauuacauuuguauaaaauaau

SEQ ID NO: 2225235 - RNA, 23 nt, Human
cccagcccuccuuaucaaaggac

SEQ ID NO: 2225236 - RNA, 15 nt, Human
acgagauacagaauu

SEQ ID NO: 2225237 - RNA, 13 nt, Human
uauuucuaugaaa

SEQ ID NO: 2225238 - RNA, 21 nt, Human
acagugaaagaaaauaacaau

SEQ ID NO: 2225239 - RNA, 21 nt, Human
gacagaaagcagaacagugau

SEQ ID NO: 2225240 - RNA, 15 nt, Human
ggccuucggccucca

SEQ ID NO: 2225241 - RNA, 19 nt, Human
accauuuuggcaagcucua

SEQ ID NO: 2225242 - RNA, 17 nt, Human
ccucuggcuccagcugg

SEQ ID NO: 2225243 - RNA, 23 nt, Human
cugaaaucauacuucuuaggguu

SEQ ID NO: 2225244 - RNA, 17 nt, Human
uauuuguacauuuuuuu

SEQ ID NO: 2225245 - RNA, 19 nt, Human
aauuuuguuauguauauuu

SEQ ID NO: 2225246 - RNA, 19 nt, Human
ugaucaccugcccugcuga

SEQ ID NO: 2225247 - RNA, 17 nt, Human
ugcccugaaagucccag

SEQ ID NO: 2225248 - RNA, 12 nt, Human
aaacuccacauc

SEQ ID NO: 2225249 - RNA, 14 nt, Human
auuugaaauuguau

SEQ ID NO: 2225250 - RNA, 24 nt, Human
cauaugaaaaggcuaagcuucacu

SEQ ID NO: 2225251 - RNA, 15 nt, Human
aguucuucaaagaua

SEQ ID NO: 2225252 - RNA, 22 nt, Human
ucuuccuuuuuuaguucuucaa

SEQ ID NO: 2225253 - RNA, 14 nt, Human
ugugaaaagcucca

SEQ ID NO: 2225254 - RNA, 21 nt, Human
caagacugcacaucaaaauau

SEQ ID NO: 2225255 - RNA, 14 nt, Human
gagcccauggcacu

SEQ ID NO: 2225256 - RNA, 18 nt, Human
guuuaugguuguauuauu

SEQ ID NO: 2225257 - RNA, 18 nt, Human
uaucccaaccucucccaa

SEQ ID NO: 2225258 - RNA, 21 nt, Human
aggacagcccuucuuuccaca

SEQ ID NO: 2225259 - RNA, 21 nt, Human
cagccccugggaccaggcacc

SEQ ID NO: 2225260 - RNA, 14 nt, Human
aauugcagaguacu

SEQ ID NO: 2225261 - RNA, 16 nt, Human
cuucuggguuccuucc

SEQ ID NO: 2225262 - RNA, 17 nt, Human
ucuuucacauuuaaaua

SEQ ID NO: 2225263 - RNA, 19 nt, Human
cacaggaaccacaagacug

SEQ ID NO: 2225264 - RNA, 14 nt, Human
acuaauuuuaaaau

SEQ ID NO: 2225265 - RNA, 16 nt, Human
cuucacuguaaaauaa

SEQ ID NO: 2225266 - RNA, 17 nt, Human
cuuccuaauuccacagc

SEQ ID NO: 2225267 - RNA, 21 nt, Human
uaauaggcguaacuaauuuua

SEQ ID NO: 2225268 - RNA, 15 nt, Human
auuuuaaaagaauga

SEQ ID NO: 2225269 - RNA, 17 nt, Human
aauaaaguguuugaaag

SEQ ID NO: 2225270 - RNA, 18 nt, Human
aaauauaaauaaaaauaa

SEQ ID NO: 2225271 - RNA, 23 nt, Human
gaccccugagcuugcagagauga

SEQ ID NO: 2225272 - RNA, 20 nt, Human
uuuaaauaaaguguuugaaa

SEQ ID NO: 2225273 - RNA, 20 nt, Human
cugcacacagcacgggggcc

SEQ ID NO: 2225274 - RNA, 13 nt, Human
aaaaaugguuuaa

SEQ ID NO: 2225275 - RNA, 14 nt, Human
cacaacacacagau

SEQ ID NO: 2225276 - RNA, 17 nt, Human
ugaaauggugaaaugca

SEQ ID NO: 2225277 - RNA, 15 nt, Human
agacagcucugcaua

SEQ ID NO: 2225278 - RNA, 16 nt, Human
aauauaaauaaaaaua

SEQ ID NO: 2225279 - RNA, 20 nt, Human
ccuccugccuaagugcagcc

SEQ ID NO: 2225280 - RNA, 17 nt, Human
cuauccuacuuccccuu

SEQ ID NO: 2225281 - RNA, 16 nt, Human
ugcauagguuuaauaa

SEQ ID NO: 2225282 - RNA, 16 nt, Human
aaaauccauacauuug

SEQ ID NO: 2225283 - RNA, 15 nt, Human
ccuugccaugugcua

SEQ ID NO: 2225284 - RNA, 18 nt, Human
ccacauucagagcuuacu

SEQ ID NO: 2225285 - RNA, 22 nt, Human
ucuacuaaaaauacaaaaaaaa

SEQ ID NO: 2225286 - RNA, 23 nt, Human
ccagagggaauugcagaguacug

SEQ ID NO: 2225287 - RNA, 23 nt, Human
uaauuuguaguguuggagaagaa

SEQ ID NO: 2225288 - RNA, 17 nt, Human
caauaacgauaaaagac

SEQ ID NO: 2225289 - RNA, 16 nt, Human
uuguaaaggaauuuaa

SEQ ID NO: 2225290 - RNA, 15 nt, Human
cuggguuccuuccuc

SEQ ID NO: 2225291 - RNA, 16 nt, Human
gaaaaaauaacaauga

SEQ ID NO: 2225292 - RNA, 16 nt, Human
cuccauccugaggcuc

SEQ ID NO: 2225293 - RNA, 20 nt, Human
uguuggugaacuugguuuua

SEQ ID NO: 2225294 - RNA, 18 nt, Human
uguggucacaggaaguag

SEQ ID NO: 2225295 - RNA, 13 nt, Human
cuuaucaaaggac

SEQ ID NO: 2225296 - RNA, 16 nt, Human
aacaauaaaagacaag

SEQ ID NO: 2225297 - RNA, 21 nt, Human
cccugggaccaggcaccccca

SEQ ID NO: 2225298 - RNA, 23 nt, Human
cauuguggucacaggaaguagag

SEQ ID NO: 2225299 - RNA, 19 nt, Human
auagucauucugccugccc

SEQ ID NO: 2225300 - RNA, 17 nt, Human
acaagaaaugaaagcag

SEQ ID NO: 2225301 - RNA, 14 nt, Human
cccugccccccagc

SEQ ID NO: 2225302 - RNA, 14 nt, Human
gagccagugucagg

SEQ ID NO: 2225303 - RNA, 18 nt, Human
cccaggcugagccucagu

SEQ ID NO: 2225304 - RNA, 15 nt, Human
cuaggugcugcagcc

SEQ ID NO: 2225305 - RNA, 17 nt, Human
auaaguacaugauaagc

SEQ ID NO: 2225306 - RNA, 14 nt, Human
cucccucccuuggg

SEQ ID NO: 2225307 - RNA, 17 nt, Human
uccacaacacacagauu

SEQ ID NO: 2225308 - RNA, 23 nt, Human
cuacacgagauacagaauuuuau

SEQ ID NO: 2225309 - RNA, 21 nt, Human
ccuggugccucaccccuugcc

SEQ ID NO: 2225310 - RNA, 17 nt, Human
cugagcggaccuuccca

SEQ ID NO: 2225311 - RNA, 16 nt, Human
caugguuuagaaagcu

SEQ ID NO: 2225312 - RNA, 16 nt, Human
ucugcagauaaacagu

SEQ ID NO: 2225313 - RNA, 19 nt, Human
ugcuauugggguugggggg

SEQ ID NO: 2225314 - RNA, 19 nt, Human
gaaaauaacgauaaaagac

SEQ ID NO: 2225315 - RNA, 22 nt, Human
cugagcagugcuugaaugaagu

SEQ ID NO: 2225316 - RNA, 14 nt, Human
cgucccccucuggc

SEQ ID NO: 2225317 - RNA, 17 nt, Human
gacagucaccucaugga

SEQ ID NO: 2225318 - RNA, 13 nt, Human
cggauugagaagg

SEQ ID NO: 2225319 - RNA, 16 nt, Human
auuuuaauaauguuuc

SEQ ID NO: 2225320 - RNA, 20 nt, Human
gauaccaugaugcugagccc

SEQ ID NO: 2225321 - RNA, 14 nt, Human
ugagcuaggggggu

SEQ ID NO: 2225322 - RNA, 14 nt, Human
cuaagucuuauaua

SEQ ID NO: 2225323 - RNA, 16 nt, Human
gugagacagcucugca

SEQ ID NO: 2225324 - RNA, 18 nt, Human
accaccugccuauauuuu

SEQ ID NO: 2225325 - RNA, 23 nt, Human
gggccuaugcagagguccacaac

SEQ ID NO: 2225326 - RNA, 22 nt, Human
cuaucaauccaagaacuuauuu

SEQ ID NO: 2225327 - RNA, 18 nt, Human
cugcagccccugggacca

SEQ ID NO: 2225328 - RNA, 22 nt, Human
aaacaaggaugaauuaaguuuu

SEQ ID NO: 2225329 - RNA, 21 nt, Human
aaagcugaaauggacuuuugu

SEQ ID NO: 2225330 - RNA, 13 nt, Human
gagcuaggggggu

SEQ ID NO: 2225331 - RNA, 16 nt, Human
cucauccugcaggcag

SEQ ID NO: 2225332 - RNA, 14 nt, Human
auuucuaugaaaua

SEQ ID NO: 2225333 - RNA, 22 nt, Human
gucaagaagcaucgugucuggc

SEQ ID NO: 2225334 - RNA, 18 nt, Human
uucugauauuggacagua

SEQ ID NO: 2225335 - RNA, 19 nt, Human
aauaaaacuuuuccaauga

SEQ ID NO: 2225336 - RNA, 18 nt, Human
acaagccuccuuuuaaag

SEQ ID NO: 2225337 - RNA, 15 nt, Human
aaauauuuauuuuaa

SEQ ID NO: 2225338 - RNA, 15 nt, Human
aauauaaauaaaaau

SEQ ID NO: 2225339 - RNA, 15 nt, Human
uauaaauaaaaauaa

SEQ ID NO: 2225340 - RNA, 21 nt, Human
aguuguugcccacagcuguau

SEQ ID NO: 2225341 - RNA, 15 nt, Human
ccuggugggcagaga

SEQ ID NO: 2225342 - RNA, 18 nt, Human
uuggggccuaugcagagg

SEQ ID NO: 2225343 - RNA, 18 nt, Human
gccuucggccuccauccu

SEQ ID NO: 2225344 - RNA, 21 nt, Human
aggcaugagucagucugauga

SEQ ID NO: 2225345 - RNA, 18 nt, Human
agcaaaauuuuuucucua

SEQ ID NO: 2225346 - RNA, 21 nt, Human
ugagccagugucaggaggaag

SEQ ID NO: 2225347 - RNA, 13 nt, Human
ggaccuucccagc

SEQ ID NO: 2225348 - RNA, 17 nt, Human
agcucugcccauccugc

SEQ ID NO: 2225349 - RNA, 22 nt, Human
aagacccaaaaggcagaagcaa

SEQ ID NO: 2225350 - RNA, 17 nt, Human
agaugggagaaucacuu

SEQ ID NO: 2225351 - RNA, 17 nt, Human
cagugcuugaaugaagu

SEQ ID NO: 2225352 - RNA, 16 nt, Human
gcccugaaagucccag

SEQ ID NO: 2225353 - RNA, 22 nt, Human
gcuugcagagaugaggccgcca

SEQ ID NO: 2225354 - RNA, 17 nt, Human
ccucagucucccucccu

SEQ ID NO: 2225355 - RNA, 14 nt, Human
cacuuggacauggg

SEQ ID NO: 2225356 - RNA, 22 nt, Human
cccagaaugaccuggccgcagu

SEQ ID NO: 2225357 - RNA, 19 nt, Human
agaguuuagcuggaaaagu

SEQ ID NO: 2225358 - RNA, 16 nt, Human
caggaaguagaggagg

SEQ ID NO: 2225359 - RNA, 19 nt, Human
ccccugcaaagcccagcuu

SEQ ID NO: 2225360 - RNA, 13 nt, Human
cacaggauggcag

SEQ ID NO: 2225361 - RNA, 21 nt, Human
agccucuuagaugcaguucug

SEQ ID NO: 2225362 - RNA, 19 nt, Human
ggacucaccucccccaucu

SEQ ID NO: 2225363 - RNA, 19 nt, Human
guacugagagugaacaaau

SEQ ID NO: 2225364 - RNA, 13 nt, Human
agcccagcuugaa

SEQ ID NO: 2225365 - RNA, 14 nt, Human
caugaacuuguaaa

SEQ ID NO: 2225366 - RNA, 21 nt, Human
cucuucuggguuccuuccucu

SEQ ID NO: 2225367 - RNA, 17 nt, Human
ggaaauauuuauuuuaa

SEQ ID NO: 2225368 - RNA, 18 nt, Human
gccuuggauacuccaugg

SEQ ID NO: 2225369 - RNA, 22 nt, Human
aguauguuagugcaaauuguca

SEQ ID NO: 2225370 - RNA, 19 nt, Human
uauauuuuuuguuaaauga

SEQ ID NO: 2225371 - RNA, 12 nt, Human
aauacuuuauaa

SEQ ID NO: 2225372 - RNA, 14 nt, Human
cugcaaagcccagc

SEQ ID NO: 2225373 - RNA, 22 nt, Human
uauccuacuuccccuuccuaau

SEQ ID NO: 2225374 - RNA, 16 nt, Human
uuucacauuuaaauaa

SEQ ID NO: 2225375 - RNA, 22 nt, Human
ugagacucugucucaguccaug

SEQ ID NO: 2225376 - RNA, 18 nt, Human
aguucuccacuagcuaug

SEQ ID NO: 2225377 - RNA, 14 nt, Human
cuuucauaauaagu

SEQ ID NO: 2225378 - RNA, 21 nt, Human
uccuacaagacacagugacca

SEQ ID NO: 2225379 - RNA, 12 nt, Human
agggauggggcu

SEQ ID NO: 2225380 - RNA, 22 nt, Human
gugaacaaauuuacagagacag

SEQ ID NO: 2225381 - RNA, 15 nt, Human
gaaaugaaagcaggg

SEQ ID NO: 2225382 - RNA, 13 nt, Human
uaauuuuuauauu

SEQ ID NO: 2225383 - RNA, 12 nt, Human
agugcagccccg

SEQ ID NO: 2225384 - RNA, 21 nt, Human
ucccagaucaagccugccuca

SEQ ID NO: 2225385 - RNA, 23 nt, Human
aaaauaucacuugucaauaaaau

SEQ ID NO: 2225386 - RNA, 21 nt, Human
uuauuuucuauaauuuaaaua

SEQ ID NO: 2225387 - RNA, 17 nt, Human
aaaaauccuacuuucau

SEQ ID NO: 2225388 - RNA, 17 nt, Human
caaacauauauaacaau

SEQ ID NO: 2225389 - RNA, 22 nt, Human
ccacagcuguaugauucccagc

SEQ ID NO: 2225390 - RNA, 17 nt, Human
cccacuagacccacugg

SEQ ID NO: 2225391 - RNA, 23 nt, Human
acugucuuguuggacgagaaaac

SEQ ID NO: 2225392 - RNA, 14 nt, Human
acaaauccaaugaa

SEQ ID NO: 2225393 - RNA, 14 nt, Human
agcucuaucaccaa

SEQ ID NO: 2225394 - RNA, 19 nt, Human
acaaauuuacagagacaga

SEQ ID NO: 2225395 - RNA, 18 nt, Human
acagaaagcagaacagug

SEQ ID NO: 2225396 - RNA, 14 nt, Human
cugagucccaggcu

SEQ ID NO: 2225397 - RNA, 15 nt, Human
aagccagauuuuccu

SEQ ID NO: 2225398 - RNA, 17 nt, Human
aggcuagaaccaccugc

SEQ ID NO: 2225399 - RNA, 17 nt, Human
agucugacuguuuccau

SEQ ID NO: 2225400 - RNA, 18 nt, Human
cagugaaagaaaauaaca

SEQ ID NO: 2225401 - RNA, 22 nt, Human
ucuagcaugucgucaaagcuga

SEQ ID NO: 2225402 - RNA, 21 nt, Human
gcccugcugagucccaggcug

SEQ ID NO: 2225403 - RNA, 19 nt, Human
agugaggagcuuugaaacg

SEQ ID NO: 2225404 - RNA, 20 nt, Human
acuuuauuuucuauaauuua

SEQ ID NO: 2225405 - RNA, 19 nt, Human
cauccaaaggcuccugaga

SEQ ID NO: 2225406 - RNA, 22 nt, Human
cccccugcaaagcccagcuuga

SEQ ID NO: 2225407 - RNA, 17 nt, Human
cugagaugggagaauca

SEQ ID NO: 2225408 - RNA, 15 nt, Human
gauuccugagccagu

SEQ ID NO: 2225409 - RNA, 13 nt, Human
agcucugcccauc

SEQ ID NO: 2225410 - RNA, 17 nt, Human
uccauccugaggcucca

SEQ ID NO: 2225411 - RNA, 23 nt, Human
cucagcccuggugggcagagagg

SEQ ID NO: 2225412 - RNA, 22 nt, Human
aauugacccacaagaaaugaaa

SEQ ID NO: 2225413 - RNA, 23 nt, Human
aagagccuuuuuuugaaaaaaag

SEQ ID NO: 2225414 - RNA, 18 nt, Human
acugugugcuaaaacaag

SEQ ID NO: 2225415 - RNA, 19 nt, Human
uauacugugugcuaaaaca

SEQ ID NO: 2225416 - RNA, 16 nt, Human
aaaugggaaacaaaag

SEQ ID NO: 2225417 - RNA, 14 nt, Human
aauauuuauuuuaa

SEQ ID NO: 2225418 - RNA, 15 nt, Human
cuaagugcagccccg

SEQ ID NO: 2225419 - RNA, 15 nt, Human
uucggccuccauccu

SEQ ID NO: 2225420 - RNA, 12 nt, Human
auaacuggaaac

SEQ ID NO: 2225421 - RNA, 21 nt, Human
aaaaaguucugcagauaaaca

SEQ ID NO: 2225422 - RNA, 18 nt, Human
auucuugccaaauauaaa

SEQ ID NO: 2225423 - RNA, 20 nt, Human
cugacacuaaaacaccucag

SEQ ID NO: 2225424 - RNA, 17 nt, Human
aguugauaaguacauga

SEQ ID NO: 2225425 - RNA, 15 nt, Human
gaaagaaaauaacga

SEQ ID NO: 2225426 - RNA, 13 nt, Human
cucagaaaacaag

SEQ ID NO: 2225427 - RNA, 23 nt, Human
uaaguuuuuuuuuaaaaaagaaa

SEQ ID NO: 2225428 - RNA, 15 nt, Human
cuccacauccugugg

SEQ ID NO: 2225429 - RNA, 13 nt, Human
aagcauuccaacu

SEQ ID NO: 2225430 - RNA, 17 nt, Human
auaucaauuuaaaaaaa

SEQ ID NO: 2225431 - RNA, 23 nt, Human
ggaggcagagguugcagugagcc

SEQ ID NO: 2225432 - RNA, 18 nt, Human
gccccgucccccucuggc

SEQ ID NO: 2225433 - RNA, 23 nt, Human
caauaacgauaaaagacagugaa

SEQ ID NO: 2225434 - RNA, 22 nt, Human
acaccuuguacuuuauuuucua

SEQ ID NO: 2225435 - RNA, 20 nt, Human
ggaggcauccaaaggcuccu

SEQ ID NO: 2225436 - RNA, 17 nt, Human
cuuauuuguacauuuuu

SEQ ID NO: 2225437 - RNA, 18 nt, Human
uucaauaucuuuuuuuua

SEQ ID NO: 2225438 - RNA, 20 nt, Human
uuaaauggucaauuuuguua

SEQ ID NO: 2225439 - RNA, 18 nt, Human
cuccauuuuuagugaaau

SEQ ID NO: 2225440 - RNA, 13 nt, Human
cugagacacaugg

SEQ ID NO: 2225441 - RNA, 16 nt, Human
agcggaccuucccagc

SEQ ID NO: 2225442 - RNA, 18 nt, Human
gcccuggugggcagagag

SEQ ID NO: 2225443 - RNA, 16 nt, Human
augaauacuuuauaaa

SEQ ID NO: 2225444 - RNA, 15 nt, Human
uugacacuuaaaaau

SEQ ID NO: 2225445 - RNA, 23 nt, Human
aucaccaaggcugauuaaaccaa

SEQ ID NO: 2225446 - RNA, 15 nt, Human
ucaguauucauauuu

SEQ ID NO: 2225447 - RNA, 19 nt, Human
ugggacaggggagaaccua

SEQ ID NO: 2225448 - RNA, 14 nt, Human
cucccugcccccca

SEQ ID NO: 2225449 - RNA, 22 nt, Human
ccgggaggcagagguugcagug

SEQ ID NO: 2225450 - RNA, 19 nt, Streptococcus pyogenes MGAS8232
uugaguagcuacugccuca

SEQ ID NO: 2225451 - RNA, 21 nt, Streptococcus pyogenes MGAS8232
uaaaauagcaccuacgauaaa

SEQ ID NO: 2225452 - RNA, 16 nt, Streptococcus pyogenes MGAS8232
ucaaaaauacuaccuu

SEQ ID NO: 2225453 - RNA, 17 nt, Streptococcus pyogenes MGAS8232
ucaucccuacuaggcuu

SEQ ID NO: 2225454 - RNA, 18 nt, Streptococcus pyogenes MGAS8232
ucuaacauguccaaaucg

SEQ ID NO: 2225455 - RNA, 17 nt, Streptococcus pyogenes MGAS8232
gcucuaucaucuuugua

SEQ ID NO: 2225456 - RNA, 16 nt, Streptococcus pyogenes MGAS8232
cuuacuagugaagaca

SEQ ID NO: 2225457 - RNA, 21 nt, Streptococcus pyogenes MGAS8232
cuaagauuuccacuuggucca

SEQ ID NO: 2225458 - RNA, 18 nt, Streptococcus pyogenes MGAS8232
gcaauauccauagaaauu

SEQ ID NO: 2225459 - RNA, 16 nt, Streptococcus pyogenes MGAS8232
caaaacugucuggaaa

SEQ ID NO: 2225460 - RNA, 22 nt, Streptococcus pyogenes MGAS8232
cacaugcuugaguagcuacugc

SEQ ID NO: 2225461 - RNA, 17 nt, Streptococcus pyogenes MGAS8232
agugccaguaaggaaau

SEQ ID NO: 2225462 - RNA, 15 nt, Streptococcus pyogenes MGAS8232
agguauuguucaacc

SEQ ID NO: 2225463 - RNA, 17 nt, Streptococcus pyogenes MGAS8232
agaagauccuacaagag

SEQ ID NO: 2225464 - RNA, 19 nt, Streptococcus pyogenes MGAS8232
guucgucaagcaccuugau

SEQ ID NO: 2225465 - RNA, 23 nt, Streptococcus pyogenes MGAS8232
uaagcaucauuauugacaaaucc

SEQ ID NO: 2225466 - RNA, 15 nt, Streptococcus pyogenes MGAS8232
uagcugguugaccaa

SEQ ID NO: 2225467 - RNA, 23 nt, Streptococcus pyogenes MGAS8232
ucaggguuguauggguaugccug

SEQ ID NO: 2225468 - RNA, 13 nt, Streptococcus pyogenes MGAS8232
ucuuagcaccgcu

SEQ ID NO: 2225469 - RNA, 18 nt, Streptococcus pyogenes MGAS8232
acauaaaaugacuucaaa

SEQ ID NO: 2225470 - RNA, 20 nt, Streptococcus pyogenes MGAS8232
uugucuaugagauaccuuca

SEQ ID NO: 2225471 - RNA, 15 nt, Streptococcus pyogenes MGAS8232
uugaugauugaguaa

SEQ ID NO: 2225472 - RNA, 18 nt, Streptococcus pyogenes MGAS8232
uuagcaauccaacuuuga

SEQ ID NO: 2225473 - RNA, 22 nt, Streptococcus pyogenes MGAS8232
aaauacuucaaggaaggcuugu

SEQ ID NO: 2225474 - RNA, 23 nt, Streptococcus pyogenes MGAS8232
agcuauuaaugguaaaggccuua

SEQ ID NO: 2225475 - RNA, 18 nt, Streptococcus pyogenes MGAS8232
auaccugagccgccaaca

SEQ ID NO: 2225476 - RNA, 17 nt, Streptococcus pyogenes MGAS8232
auugaaucuuguuuaac

SEQ ID NO: 2225477 - RNA, 23 nt, Streptococcus pyogenes MGAS8232
auguugcuuaaugaccuuugaua

SEQ ID NO: 2225478 - RNA, 19 nt, Streptococcus pyogenes MGAS8232
caaucuucaacaccuucgu

SEQ ID NO: 2225479 - RNA, 17 nt, Streptococcus pyogenes MGAS8232
cagauaagaccuucaaa

SEQ ID NO: 2225480 - RNA, 14 nt, Streptococcus pyogenes MGAS8232
cauuuuuugcaauu

SEQ ID NO: 2225481 - RNA, 15 nt, Streptococcus pyogenes MGAS8232
ccauacgcuccaacg

SEQ ID NO: 2225482 - RNA, 23 nt, Streptococcus pyogenes MGAS8232
ccuuuagcaauccaacuuugaca

SEQ ID NO: 2225483 - RNA, 17 nt, Streptococcus pyogenes MGAS8232
ccuuuaauucuuuaaua

SEQ ID NO: 2225484 - RNA, 13 nt, Streptococcus pyogenes MGAS8232
gcuauuaauggua

SEQ ID NO: 2225485 - RNA, 18 nt, Streptococcus pyogenes MGAS8232
gccuguauuucuuuggua

SEQ ID NO: 2225486 - RNA, 19 nt, Streptococcus pyogenes MGAS8232
gacuugguuuaauacguuu

SEQ ID NO: 2225487 - RNA, 13 nt, Streptococcus pyogenes MGAS8232
gccauaauggucg

SEQ ID NO: 2225488 - RNA, 14 nt, Streptococcus pyogenes MGAS8232
cucaucuacucuau

SEQ ID NO: 2225489 - RNA, 15 nt, Streptococcus pyogenes MGAS8232
uuccuuguacaagag

SEQ ID NO: 2225490 - RNA, 16 nt, Streptococcus pyogenes MGAS8232
ugucaauaacaacguc

SEQ ID NO: 2225491 - RNA, 16 nt, Streptococcus pyogenes MGAS8232
uaaaaugacugacaaa

SEQ ID NO: 2225492 - RNA, 15 nt, Streptococcus pyogenes MGAS8232
uaagagccaucagcu

SEQ ID NO: 2225493 - RNA, 19 nt, Streptococcus pyogenes MGAS8232
uccuuagcgaaagcuucau

SEQ ID NO: 2225494 - RNA, 17 nt, Streptococcus pyogenes MGAS8232
ucgaaaugauagcaccu

SEQ ID NO: 2225495 - RNA, 16 nt, Streptococcus pyogenes MGAS8232
ucuucaacaccuucgu

SEQ ID NO: 2225496 - RNA, 22 nt, Streptococcus pyogenes MGAS8232
ucugguguugcaaggcuaaggc

SEQ ID NO: 2225497 - RNA, 15 nt, Streptococcus pyogenes MGAS8232
ucgcugaaagucuua

SEQ ID NO: 2225498 - RNA, 20 nt, Streptococcus pyogenes MGAS8232
gucuccauaacauacucuau

SEQ ID NO: 2225499 - RNA, 22 nt, Streptococcus pyogenes MGAS8232
gcgaucauaaauaaagauaauu

SEQ ID NO: 2225500 - RNA, 16 nt, Streptococcus pyogenes MGAS8232
ggagcuuuaguugcuu

SEQ ID NO: 2225501 - RNA, 17 nt, Streptococcus pyogenes MGAS8232
cuuagcgaaagcuucau

SEQ ID NO: 2225502 - RNA, 20 nt, Streptococcus pyogenes MGAS8232
cgucaaaaagucgucaacgc

SEQ ID NO: 2225503 - RNA, 15 nt, Streptococcus pyogenes MGAS8232
cugaugacuuguaaa

SEQ ID NO: 2225504 - RNA, 18 nt, Streptococcus pyogenes MGAS8232
ccuuuuuugauaccguuu

SEQ ID NO: 2225505 - RNA, 20 nt, Streptococcus pyogenes MGAS8232
cagcauaaccuuugccauuu

SEQ ID NO: 2225506 - RNA, 21 nt, Streptococcus pyogenes MGAS8232
ccaauauagcaaucuucaaca

SEQ ID NO: 2225507 - RNA, 15 nt, Streptococcus pyogenes MGAS8232
aggauuuagcuguua

SEQ ID NO: 2225508 - RNA, 22 nt, Streptococcus pyogenes MGAS8232
agcgccagcauuugccauggca

SEQ ID NO: 2225509 - RNA, 16 nt, Streptococcus pyogenes MGAS8232
agcaaauuguuugauu

SEQ ID NO: 2225510 - RNA, 16 nt, Streptococcus pyogenes MGAS8232
agauuaaacuuacaaa

SEQ ID NO: 2225511 - RNA, 15 nt, Streptococcus pyogenes MGAS8232
aucuuguuuaaccuc

SEQ ID NO: 2225512 - RNA, 19 nt, Streptococcus pyogenes MGAS8232
auugacaaauccaaugacu

SEQ ID NO: 2225513 - RNA, 13 nt, Streptococcus pyogenes MGAS8232
caauauagcaauc

SEQ ID NO: 2225514 - RNA, 18 nt, Streptococcus pyogenes MGAS8232
caauaaaauaucuagaac

SEQ ID NO: 2225515 - RNA, 15 nt, Streptococcus pyogenes MGAS8232
uugggagaguuccug

SEQ ID NO: 2225516 - RNA, 17 nt, Streptococcus pyogenes MGAS8232
aauuucaauaauaccau

SEQ ID NO: 2225517 - RNA, 21 nt, Streptococcus pyogenes MGAS8232
uucuuucaaacggaguuccuc

SEQ ID NO: 2225518 - RNA, 21 nt, Streptococcus pyogenes MGAS8232
acuguaauauuuccuuuuaaa

SEQ ID NO: 2225519 - RNA, 21 nt, Streptococcus pyogenes MGAS8232
gugccaguaaggaaaucaauc

SEQ ID NO: 2225520 - RNA, 13 nt, Streptococcus pyogenes MGAS8232
uaaaauagcaccu

SEQ ID NO: 2225521 - RNA, 19 nt, Streptococcus pyogenes MGAS8232
ucauuugacuacuagccug

SEQ ID NO: 2225522 - RNA, 19 nt, Streptococcus pyogenes MGAS8232
ucaacuaucaaguaugcuu

SEQ ID NO: 2225523 - RNA, 20 nt, Streptococcus pyogenes MGAS8232
ugaugaguaggcgaacuuua

SEQ ID NO: 2225524 - RNA, 22 nt, Streptococcus pyogenes MGAS8232
ugcaagugauaaccuuaaagac

SEQ ID NO: 2225525 - RNA, 16 nt, Streptococcus pyogenes MGAS8232
auuuaaucauguccaa

SEQ ID NO: 2225526 - RNA, 18 nt, Streptococcus pyogenes MGAS8232
aaacucaaaaaauacaau

SEQ ID NO: 2225527 - RNA, 19 nt, Streptococcus pyogenes MGAS8232
aucgacaacauccauacca

SEQ ID NO: 2225528 - RNA, 22 nt, Streptococcus pyogenes MGAS8232
auggauaccauuucuuugcaaa

SEQ ID NO: 2225529 - RNA, 21 nt, Streptococcus pyogenes MGAS8232
gucgcagaguacaaggcaauc

SEQ ID NO: 2225530 - RNA, 23 nt, Streptococcus pyogenes MGAS8232
gcuugucuaugagauaccuucau

SEQ ID NO: 2225531 - RNA, 24 nt, Streptococcus pyogenes MGAS8232
gcacugagccccaaaaguuggcua

SEQ ID NO: 2225532 - RNA, 15 nt, Streptococcus pyogenes MGAS8232
cucuuagaagccuua

SEQ ID NO: 2225533 - RNA, 16 nt, Streptococcus pyogenes MGAS8232
cuggcaauaagugacg

SEQ ID NO: 2225534 - RNA, 21 nt, Streptococcus pyogenes MGAS8232
cuuucucaucuacucaugaca

SEQ ID NO: 2225535 - RNA, 18 nt, Streptococcus pyogenes MGAS8232
agauagcaaggaugaaau

SEQ ID NO: 2225536 - RNA, 22 nt, Streptococcus pyogenes MGAS8232
agaauucuuagguggagcuuua

SEQ ID NO: 2225537 - RNA, 13 nt, Streptococcus pyogenes MGAS8232
aagaacagcauuu

SEQ ID NO: 2225538 - RNA, 14 nt, Streptococcus pyogenes MGAS8232
aacuauuuaacuua

SEQ ID NO: 2225539 - RNA, 17 nt, Streptococcus pyogenes MGAS8232
aaccuaucacgccagua

SEQ ID NO: 2225540 - RNA, 20 nt, Streptococcus pyogenes MGAS8232
aauauccauagaaauuguaa

SEQ ID NO: 2225541 - RNA, 20 nt, Streptococcus pyogenes MGAS8232
aauuucuuuuucauuuguaa

SEQ ID NO: 2225542 - RNA, 13 nt, Streptococcus pyogenes MGAS8232
aaauaacuuuaaa

SEQ ID NO: 2225543 - RNA, 15 nt, Streptococcus pyogenes MGAS8232
aaaagggcugaccuu

SEQ ID NO: 2225544 - RNA, 17 nt, Streptococcus pyogenes MGAS8232
aaaaagccagagcaguu

SEQ ID NO: 2225545 - RNA, 22 nt, Streptococcus pyogenes MGAS8232
aaaagccuauuuaauaggcuuu

SEQ ID NO: 2225546 - RNA, 16 nt, Streptococcus pyogenes MGAS8232
uuuucuuuuggccuac

SEQ ID NO: 2225547 - RNA, 19 nt, Streptococcus pyogenes MGAS8232
uuuugcaggguaucugcuc

SEQ ID NO: 2225548 - RNA, 19 nt, Streptococcus pyogenes MGAS8232
uuuuccuugccgaccuaua

SEQ ID NO: 2225549 - RNA, 21 nt, Streptococcus pyogenes MGAS8232
uuuucaacaaauccuuuugcu

SEQ ID NO: 2225550 - RNA, 17 nt, Streptococcus pyogenes MGAS8232
uuuucagagaugcuucu

SEQ ID NO: 2225551 - RNA, 16 nt, Streptococcus pyogenes MGAS8232
uuuugguugauauaaa

SEQ ID NO: 2225552 - RNA, 15 nt, Streptococcus pyogenes MGAS8232
uuuuggcaaccuuac

SEQ ID NO: 2225553 - RNA, 23 nt, Streptococcus pyogenes MGAS8232
uuuuguugaguguuaugaugaug

SEQ ID NO: 2225554 - RNA, 17 nt, Streptococcus pyogenes MGAS8232
uuuugucguuuuuugcu

SEQ ID NO: 2225555 - RNA, 16 nt, Streptococcus pyogenes MGAS8232
uuuuguaucucauaac

SEQ ID NO: 2225556 - RNA, 18 nt, Streptococcus pyogenes MGAS8232
uuuuucaaaaucuuuucu

SEQ ID NO: 2225557 - RNA, 14 nt, Streptococcus pyogenes MGAS8232
uuuuuaauuauuuu

SEQ ID NO: 2225558 - RNA, 17 nt, Streptococcus pyogenes MGAS8232
uucguaaggguuacuau

SEQ ID NO: 2225559 - RNA, 18 nt, Streptococcus pyogenes MGAS8232
uucguaaggguuacuauu

SEQ ID NO: 2225560 - RNA, 14 nt, Streptococcus pyogenes MGAS8232
uucgguuauuguua

SEQ ID NO: 2225561 - RNA, 23 nt, Streptococcus pyogenes MGAS8232
uucuagacucuagcauaaaagau

SEQ ID NO: 2225562 - RNA, 19 nt, Streptococcus pyogenes MGAS8232
uucuagguuaaaauagaag

SEQ ID NO: 2225563 - RNA, 18 nt, Streptococcus pyogenes MGAS8232
uucuaagagccaaaauaa

SEQ ID NO: 2225564 - RNA, 23 nt, Streptococcus pyogenes MGAS8232
uucuaguuuaggauauaagaagg

SEQ ID NO: 2225565 - RNA, 18 nt, Streptococcus pyogenes MGAS8232
uucuaguuucauagaaga

SEQ ID NO: 2225566 - RNA, 14 nt, Streptococcus pyogenes MGAS8232
uucucauguuuuau

SEQ ID NO: 2225567 - RNA, 15 nt, Streptococcus pyogenes MGAS8232
uucucauguuuuauu

SEQ ID NO: 2225568 - RNA, 18 nt, Streptococcus pyogenes MGAS8232
uucuuacuaugaaaaaag

SEQ ID NO: 2225569 - RNA, 23 nt, Streptococcus pyogenes MGAS8232
uucugaaaauaaaauauuuuucc

SEQ ID NO: 2225570 - RNA, 16 nt, Streptococcus pyogenes MGAS8232
uucugaaaauaaaaua

SEQ ID NO: 2225571 - RNA, 22 nt, Streptococcus pyogenes MGAS8232
uucugagauauucauuuucuuc

SEQ ID NO: 2225572 - RNA, 16 nt, Streptococcus pyogenes MGAS8232
uugcagcuaaaaacaa

SEQ ID NO: 2225573 - RNA, 22 nt, Streptococcus pyogenes MGAS8232
uugaugagguauuuauaaauau

SEQ ID NO: 2225574 - RNA, 21 nt, Streptococcus pyogenes MGAS8232
uugaugauugaguaagcagca

SEQ ID NO: 2225575 - RNA, 22 nt, Streptococcus pyogenes MGAS8232
uugaugauugaguaagcagcau

SEQ ID NO: 2225576 - RNA, 18 nt, Streptococcus pyogenes MGAS8232
uugauugccauuuaauug

SEQ ID NO: 2225577 - RNA, 15 nt, Streptococcus pyogenes MGAS8232
uugauauuuuuucuc

SEQ ID NO: 2225578 - RNA, 18 nt, Streptococcus pyogenes MGAS8232
uugauauuuuuucucaaa

SEQ ID NO: 2225579 - RNA, 22 nt, Streptococcus pyogenes MGAS8232
uugauauuuuuucucaaaaaua

SEQ ID NO: 2225580 - RNA, 19 nt, Streptococcus pyogenes MGAS8232
uugagccuuuucuuuuugg

SEQ ID NO: 2225581 - RNA, 18 nt, Streptococcus pyogenes MGAS8232
uugaaagaggugcaacug

SEQ ID NO: 2225582 - RNA, 12 nt, Streptococcus pyogenes MGAS8232
uucuuuuuuacc

SEQ ID NO: 2225583 - RNA, 18 nt, Streptococcus pyogenes MGAS8232
uugacuuguuacaaaaaa

SEQ ID NO: 2225584 - RNA, 13 nt, Streptococcus pyogenes MGAS8232
uugagaagaaaaa

SEQ ID NO: 2225585 - RNA, 14 nt, Streptococcus pyogenes MGAS8232
uugagaagaaaaaa

SEQ ID NO: 2225586 - RNA, 17 nt, Streptococcus pyogenes MGAS8232
uugaauugaaaaaagac

SEQ ID NO: 2225587 - RNA, 14 nt, Streptococcus pyogenes MGAS8232
uugaauguuguauu

SEQ ID NO: 2225588 - RNA, 16 nt, Streptococcus pyogenes MGAS8232
uuguguugaagaaggu

SEQ ID NO: 2225589 - RNA, 16 nt, Streptococcus pyogenes MGAS8232
uuguuaguggaccucu

SEQ ID NO: 2225590 - RNA, 18 nt, Streptococcus pyogenes MGAS8232
uuguuaguuuuauccccu

SEQ ID NO: 2225591 - RNA, 22 nt, Streptococcus pyogenes MGAS8232
uugugguuacagacuuuuaaug

SEQ ID NO: 2225592 - RNA, 14 nt, Streptococcus pyogenes MGAS8232
uugugauauaaaau

SEQ ID NO: 2225593 - RNA, 14 nt, Streptococcus pyogenes MGAS8232
uuguaaaauuuauc

SEQ ID NO: 2225594 - RNA, 23 nt, Streptococcus pyogenes MGAS8232
uuguagaggacuaaguccuuuua

SEQ ID NO: 2225595 - RNA, 20 nt, Streptococcus pyogenes MGAS8232
uuuaagguauuguucaaccg

SEQ ID NO: 2225596 - RNA, 18 nt, Streptococcus pyogenes MGAS8232
uuuaaucuuuguuucuau

SEQ ID NO: 2225597 - RNA, 13 nt, Streptococcus pyogenes MGAS8232
uuuaauuuuucuu

SEQ ID NO: 2225598 - RNA, 21 nt, Streptococcus pyogenes MGAS8232
uuuaagauuaaacuuacaaaa

SEQ ID NO: 2225599 - RNA, 15 nt, Streptococcus pyogenes MGAS8232
uuggugauuaacgcu

SEQ ID NO: 2225600 - RNA, 12 nt, Streptococcus pyogenes MGAS8232
uuggguauuuuu

SEQ ID NO: 2225601 - RNA, 17 nt, Streptococcus pyogenes MGAS8232
uugccauuaauaauauu

SEQ ID NO: 2225602 - RNA, 22 nt, Streptococcus pyogenes MGAS8232
uugccauuaauaauauuaaccg

SEQ ID NO: 2225603 - RNA, 20 nt, Streptococcus pyogenes MGAS8232
uugcagguaauuaucugaau

SEQ ID NO: 2225604 - RNA, 16 nt, Streptococcus pyogenes MGAS8232
uuccuuguacaagagc

SEQ ID NO: 2225605 - RNA, 15 nt, Streptococcus pyogenes MGAS8232
uucgaaaaaggggag

SEQ ID NO: 2225606 - RNA, 14 nt, Streptococcus pyogenes MGAS8232
uuccgucguuuuuu

SEQ ID NO: 2225607 - RNA, 14 nt, Streptococcus pyogenes MGAS8232
uuccuacaaaauaa

SEQ ID NO: 2225608 - RNA, 13 nt, Streptococcus pyogenes MGAS8232
uuccuacaaaaua

SEQ ID NO: 2225609 - RNA, 20 nt, Streptococcus pyogenes MGAS8232
uuccucaaacacguauuuuu

SEQ ID NO: 2225610 - RNA, 21 nt, Streptococcus pyogenes MGAS8232
uucgccuaggaauaaaaugcc

SEQ ID NO: 2225611 - RNA, 13 nt, Streptococcus pyogenes MGAS8232
uuccccacaaaag

SEQ ID NO: 2225612 - RNA, 15 nt, Streptococcus pyogenes MGAS8232
uuccaaaccauuuua

SEQ ID NO: 2225613 - RNA, 23 nt, Streptococcus pyogenes MGAS8232
uuccaaaccauuuuaugagaaaa

SEQ ID NO: 2225614 - RNA, 15 nt, Streptococcus pyogenes MGAS8232
uuccaagcugucaau

SEQ ID NO: 2225615 - RNA, 16 nt, Streptococcus pyogenes MGAS8232
uuccauacuuccaucu

SEQ ID NO: 2225616 - RNA, 19 nt, Streptococcus pyogenes MGAS8232
uucacuauaauuucaauaa

SEQ ID NO: 2225617 - RNA, 21 nt, Streptococcus pyogenes MGAS8232
uucacuauaauuucaauaaua

SEQ ID NO: 2225618 - RNA, 21 nt, Streptococcus pyogenes MGAS8232
uucagcaucguuaaguggaau

SEQ ID NO: 2225619 - RNA, 16 nt, Streptococcus pyogenes MGAS8232
uucagagaugcuucuu

SEQ ID NO: 2225620 - RNA, 23 nt, Streptococcus pyogenes MGAS8232
uucagagcacguuuucugguuuu

SEQ ID NO: 2225621 - RNA, 15 nt, Streptococcus pyogenes MGAS8232
uucaauaucacauuu

SEQ ID NO: 2225622 - RNA, 15 nt, Streptococcus pyogenes MGAS8232
uucaauauuuuauua

SEQ ID NO: 2225623 - RNA, 19 nt, Streptococcus pyogenes MGAS8232
uucaauauuuuauuaauaa

SEQ ID NO: 2225624 - RNA, 16 nt, Streptococcus pyogenes MGAS8232
uucauguuuaaaaaac

SEQ ID NO: 2225625 - RNA, 19 nt, Streptococcus pyogenes MGAS8232
uucaugacgccuccaaaua

SEQ ID NO: 2225626 - RNA, 13 nt, Streptococcus pyogenes MGAS8232
uucauuuuacuau

SEQ ID NO: 2225627 - RNA, 14 nt, Streptococcus pyogenes MGAS8232
uucauuuacucacc

SEQ ID NO: 2225628 - RNA, 21 nt, Streptococcus pyogenes MGAS8232
uucaugauguuauuaaauaau

SEQ ID NO: 2225629 - RNA, 20 nt, Streptococcus pyogenes MGAS8232
uucaugauguuuauuccaaa

SEQ ID NO: 2225630 - RNA, 21 nt, Streptococcus pyogenes MGAS8232
uucaucaucaagaauagcuuu

SEQ ID NO: 2225631 - RNA, 20 nt, Streptococcus pyogenes MGAS8232
uggcuacucuauuuuaagua

SEQ ID NO: 2225632 - RNA, 13 nt, Streptococcus pyogenes MGAS8232
ugguuaaaaagag

SEQ ID NO: 2225633 - RNA, 14 nt, Streptococcus pyogenes MGAS8232
ugguuaaaaagaga

SEQ ID NO: 2225634 - RNA, 18 nt, Streptococcus pyogenes MGAS8232
ugguuacagacuuuuaau

SEQ ID NO: 2225635 - RNA, 12 nt, Streptococcus pyogenes MGAS8232
uguaauccccuc

SEQ ID NO: 2225636 - RNA, 16 nt, Streptococcus pyogenes MGAS8232
uggugcuacugaugua

SEQ ID NO: 2225637 - RNA, 23 nt, Streptococcus pyogenes MGAS8232
uggucaauggaaauuuuaaauga

SEQ ID NO: 2225638 - RNA, 14 nt, Streptococcus pyogenes MGAS8232
uggguaaaaugacu

SEQ ID NO: 2225639 - RNA, 17 nt, Streptococcus pyogenes MGAS8232
uguuaauauagucugca

SEQ ID NO: 2225640 - RNA, 22 nt, Streptococcus pyogenes MGAS8232
uguucaaccgucacuauugaau

SEQ ID NO: 2225641 - RNA, 18 nt, Streptococcus pyogenes MGAS8232
uguuaguggaccucuuuu

SEQ ID NO: 2225642 - RNA, 20 nt, Streptococcus pyogenes MGAS8232
uguugacucugauccgaguu

SEQ ID NO: 2225643 - RNA, 21 nt, Streptococcus pyogenes MGAS8232
ugugaugaaucauuuuggaga

SEQ ID NO: 2225644 - RNA, 16 nt, Streptococcus pyogenes MGAS8232
ugugauguaauugucu

SEQ ID NO: 2225645 - RNA, 19 nt, Streptococcus pyogenes MGAS8232
ugugacaauuggugauuaa

SEQ ID NO: 2225646 - RNA, 23 nt, Streptococcus pyogenes MGAS8232
ugucuggaaacuggucaaaagcu

SEQ ID NO: 2225647 - RNA, 18 nt, Streptococcus pyogenes MGAS8232
ugucuuagccuuuuuuug

SEQ ID NO: 2225648 - RNA, 15 nt, Streptococcus pyogenes MGAS8232
ugucuucuucuuuuc

SEQ ID NO: 2225649 - RNA, 19 nt, Streptococcus pyogenes MGAS8232
ugucuucuccgacugcaau

SEQ ID NO: 2225650 - RNA, 13 nt, Streptococcus pyogenes MGAS8232
ugucucacuauuu

SEQ ID NO: 2225651 - RNA, 14 nt, Streptococcus pyogenes MGAS8232
ugucuccuucuuug

SEQ ID NO: 2225652 - RNA, 15 nt, Streptococcus pyogenes MGAS8232
ugucuccuucuuugc

SEQ ID NO: 2225653 - RNA, 17 nt, Streptococcus pyogenes MGAS8232
ugucucgaauauaauuc

SEQ ID NO: 2225654 - RNA, 17 nt, Streptococcus pyogenes MGAS8232
uguccuagucuuuuggc

SEQ ID NO: 2225655 - RNA, 18 nt, Streptococcus pyogenes MGAS8232
uguccuagucuuuuggcu

SEQ ID NO: 2225656 - RNA, 14 nt, Streptococcus pyogenes MGAS8232
uguauucuuaaaaa

SEQ ID NO: 2225657 - RNA, 15 nt, Streptococcus pyogenes MGAS8232
uguauucuuaaaaaa

SEQ ID NO: 2225658 - RNA, 17 nt, Streptococcus pyogenes MGAS8232
ugucauacucaauagcu

SEQ ID NO: 2225659 - RNA, 17 nt, Streptococcus pyogenes MGAS8232
ugucaggggaauuuccu

SEQ ID NO: 2225660 - RNA, 23 nt, Streptococcus pyogenes MGAS8232
ugucaagccauagccagauggug

SEQ ID NO: 2225661 - RNA, 13 nt, Streptococcus pyogenes MGAS8232
uguccaauaccua

SEQ ID NO: 2225662 - RNA, 12 nt, Streptococcus pyogenes MGAS8232
ugucauuucuug

SEQ ID NO: 2225663 - RNA, 15 nt, Streptococcus pyogenes MGAS8232
uguccauuuuuuaua

SEQ ID NO: 2225664 - RNA, 22 nt, Streptococcus pyogenes MGAS8232
uuauagcacguuggaaaaggaa

SEQ ID NO: 2225665 - RNA, 19 nt, Streptococcus pyogenes MGAS8232
uuauaauaauauuauagua

SEQ ID NO: 2225666 - RNA, 18 nt, Streptococcus pyogenes MGAS8232
uuagagcccauucuuaaa

SEQ ID NO: 2225667 - RNA, 14 nt, Streptococcus pyogenes MGAS8232
uuaugagaaaaaua

SEQ ID NO: 2225668 - RNA, 16 nt, Streptococcus pyogenes MGAS8232
uuauguuauaagauaa

SEQ ID NO: 2225669 - RNA, 13 nt, Streptococcus pyogenes MGAS8232
uuauuaaagagaa

SEQ ID NO: 2225670 - RNA, 18 nt, Streptococcus pyogenes MGAS8232
uuaucucauaaaaaagaa

SEQ ID NO: 2225671 - RNA, 17 nt, Streptococcus pyogenes MGAS8232
uuauccucccagccauc

SEQ ID NO: 2225672 - RNA, 22 nt, Streptococcus pyogenes MGAS8232
uucaacuugggagaguuccugc

SEQ ID NO: 2225673 - RNA, 16 nt, Streptococcus pyogenes MGAS8232
uucaaacggaguucuc

SEQ ID NO: 2225674 - RNA, 19 nt, Streptococcus pyogenes MGAS8232
uucaaaaaagggaagaaga

SEQ ID NO: 2225675 - RNA, 14 nt, Streptococcus pyogenes MGAS8232
uucaaaaauacuac

SEQ ID NO: 2225676 - RNA, 14 nt, Streptococcus pyogenes MGAS8232
uuauuuuugagaua

SEQ ID NO: 2225677 - RNA, 16 nt, Streptococcus pyogenes MGAS8232
uuauuuuuuaaagcua

SEQ ID NO: 2225678 - RNA, 22 nt, Streptococcus pyogenes MGAS8232
uuauuaaccaauuccucccuau

SEQ ID NO: 2225679 - RNA, 23 nt, Streptococcus pyogenes MGAS8232
uuauuaaccaauuccucccuauu

SEQ ID NO: 2225680 - RNA, 19 nt, Streptococcus pyogenes MGAS8232
uuauuaguaaccauagaag

SEQ ID NO: 2225681 - RNA, 15 nt, Streptococcus pyogenes MGAS8232
uuauuccauuuaucu

SEQ ID NO: 2225682 - RNA, 14 nt, Streptococcus pyogenes MGAS8232
uuauuggaaaguaa

SEQ ID NO: 2225683 - RNA, 17 nt, Streptococcus pyogenes MGAS8232
uuauuugacauuagucc

SEQ ID NO: 2225684 - RNA, 20 nt, Streptococcus pyogenes MGAS8232
uuaacaggugacauaguguu

SEQ ID NO: 2225685 - RNA, 18 nt, Streptococcus pyogenes MGAS8232
uuaacguuaacaaaaaua

SEQ ID NO: 2225686 - RNA, 14 nt, Streptococcus pyogenes MGAS8232
uuaaccuccuaaac

SEQ ID NO: 2225687 - RNA, 18 nt, Streptococcus pyogenes MGAS8232
uuaaccauaucacaaaac

SEQ ID NO: 2225688 - RNA, 16 nt, Streptococcus pyogenes MGAS8232
uuaaccauaucacaaa

SEQ ID NO: 2225689 - RNA, 15 nt, Streptococcus pyogenes MGAS8232
uuaacuauuuaacuu

SEQ ID NO: 2225690 - RNA, 17 nt, Streptococcus pyogenes MGAS8232
uuaagcuuuguugcauu

SEQ ID NO: 2225691 - RNA, 13 nt, Streptococcus pyogenes MGAS8232
uuaacaaaaauaa

SEQ ID NO: 2225692 - RNA, 14 nt, Streptococcus pyogenes MGAS8232
uuaaaugcaaaaaa

SEQ ID NO: 2225693 - RNA, 15 nt, Streptococcus pyogenes MGAS8232
uuaaaugcaaaaaag

SEQ ID NO: 2225694 - RNA, 13 nt, Streptococcus pyogenes MGAS8232
uuaaacauauuau

SEQ ID NO: 2225695 - RNA, 21 nt, Streptococcus pyogenes MGAS8232
uuaaagagaaagaggaaacaa

SEQ ID NO: 2225696 - RNA, 16 nt, Streptococcus pyogenes MGAS8232
uuaaagacaaaaaaac

SEQ ID NO: 2225697 - RNA, 21 nt, Streptococcus pyogenes MGAS8232
uuaaagacaaaaaaacuggaa

SEQ ID NO: 2225698 - RNA, 15 nt, Streptococcus pyogenes MGAS8232
uuacuaacuagcaag

SEQ ID NO: 2225699 - RNA, 13 nt, Streptococcus pyogenes MGAS8232
uuacgcauaccug

SEQ ID NO: 2225700 - RNA, 14 nt, Streptococcus pyogenes MGAS8232
uuacuauggcuucu

SEQ ID NO: 2225701 - RNA, 17 nt, Streptococcus pyogenes MGAS8232
uuacucaucuacucuau

SEQ ID NO: 2225702 - RNA, 19 nt, Streptococcus pyogenes MGAS8232
uuagaauccuccucuuuuu

SEQ ID NO: 2225703 - RNA, 21 nt, Streptococcus pyogenes MGAS8232
uuacugggucaacuccaaucu

SEQ ID NO: 2225704 - RNA, 22 nt, Streptococcus pyogenes MGAS8232
uuaaucuuuguuucuauacaua

SEQ ID NO: 2225705 - RNA, 19 nt, Streptococcus pyogenes MGAS8232
uuaaucuuauuaaagagaa

SEQ ID NO: 2225706 - RNA, 21 nt, Streptococcus pyogenes MGAS8232
uuacauuuggagagauaaaaa

SEQ ID NO: 2225707 - RNA, 16 nt, Streptococcus pyogenes MGAS8232
ugccauggguaaaaug

SEQ ID NO: 2225708 - RNA, 12 nt, Streptococcus pyogenes MGAS8232
ugccauuaauaa

SEQ ID NO: 2225709 - RNA, 16 nt, Streptococcus pyogenes MGAS8232
ugccauuaauaauauu

SEQ ID NO: 2225710 - RNA, 16 nt, Streptococcus pyogenes MGAS8232
ugccauuuaaaagggc

SEQ ID NO: 2225711 - RNA, 15 nt, Streptococcus pyogenes MGAS8232
ugccaguaaggaaau

SEQ ID NO: 2225712 - RNA, 14 nt, Streptococcus pyogenes MGAS8232
ugcaugaagugguu

SEQ ID NO: 2225713 - RNA, 18 nt, Streptococcus pyogenes MGAS8232
ugcgcgacuaaaaucaug

SEQ ID NO: 2225714 - RNA, 18 nt, Streptococcus pyogenes MGAS8232
ugcuuauagcuaccuacu

SEQ ID NO: 2225715 - RNA, 14 nt, Streptococcus pyogenes MGAS8232
ugcuucaaaggaaa

SEQ ID NO: 2225716 - RNA, 23 nt, Streptococcus pyogenes MGAS8232
ugcuuuuuuugucguuuuuugcu

SEQ ID NO: 2225717 - RNA, 13 nt, Streptococcus pyogenes MGAS8232
ugcuuuuuuuguc

SEQ ID NO: 2225718 - RNA, 13 nt, Streptococcus pyogenes MGAS8232
ugcuuuaaaaagu

SEQ ID NO: 2225719 - RNA, 12 nt, Streptococcus pyogenes MGAS8232
ugcuuuaaaaag

SEQ ID NO: 2225720 - RNA, 16 nt, Streptococcus pyogenes MGAS8232
ugcuguuugucauacu

SEQ ID NO: 2225721 - RNA, 20 nt, Streptococcus pyogenes MGAS8232
ugcugauuuuggaugaaagu

SEQ ID NO: 2225722 - RNA, 13 nt, Streptococcus pyogenes MGAS8232
ugcguuuauaaag

SEQ ID NO: 2225723 - RNA, 19 nt, Streptococcus pyogenes MGAS8232
ugcguuguagguaauagcg

SEQ ID NO: 2225724 - RNA, 21 nt, Streptococcus pyogenes MGAS8232
ugcucaauugcuuuuagccug

SEQ ID NO: 2225725 - RNA, 14 nt, Streptococcus pyogenes MGAS8232
ugaaucauuuugga

SEQ ID NO: 2225726 - RNA, 20 nt, Streptococcus pyogenes MGAS8232
ugaauuuugucuaaaauaaa

SEQ ID NO: 2225727 - RNA, 16 nt, Streptococcus pyogenes MGAS8232
ugacaauagcgaaaaa

SEQ ID NO: 2225728 - RNA, 17 nt, Streptococcus pyogenes MGAS8232
ugacaauagcgaaaaag

SEQ ID NO: 2225729 - RNA, 18 nt, Streptococcus pyogenes MGAS8232
ugacaauagcgaaaaagg

SEQ ID NO: 2225730 - RNA, 20 nt, Streptococcus pyogenes MGAS8232
ugacaauagcgaaaaagggu

SEQ ID NO: 2225731 - RNA, 23 nt, Streptococcus pyogenes MGAS8232
ugaagccuaauugaccugcugca

SEQ ID NO: 2225732 - RNA, 21 nt, Streptococcus pyogenes MGAS8232
ugaccgaaaaaggcaaagaaa

SEQ ID NO: 2225733 - RNA, 19 nt, Streptococcus pyogenes MGAS8232
ugacauuaguccaaaaugu

SEQ ID NO: 2225734 - RNA, 17 nt, Streptococcus pyogenes MGAS8232
ugacaauuggugauuaa

SEQ ID NO: 2225735 - RNA, 11 nt, Streptococcus pyogenes MGAS8232
ugacaauguga

SEQ ID NO: 2225736 - RNA, 16 nt, Streptococcus pyogenes MGAS8232
ugagcaaggcaagagg

SEQ ID NO: 2225737 - RNA, 13 nt, Streptococcus pyogenes MGAS8232
ugagaguaaacga

SEQ ID NO: 2225738 - RNA, 14 nt, Streptococcus pyogenes MGAS8232
ugacuaguuuauua

SEQ ID NO: 2225739 - RNA, 22 nt, Streptococcus pyogenes MGAS8232
ugacuauauccguaguaggcug

SEQ ID NO: 2225740 - RNA, 21 nt, Streptococcus pyogenes MGAS8232
ugacuacuagccuguccuagu

SEQ ID NO: 2225741 - RNA, 20 nt, Streptococcus pyogenes MGAS8232
ugacucugauccgaguuuug

SEQ ID NO: 2225742 - RNA, 22 nt, Streptococcus pyogenes MGAS8232
ugacucugauccgaguuuugcu

SEQ ID NO: 2225743 - RNA, 21 nt, Streptococcus pyogenes MGAS8232
ugauuaguuuuuagcagcaga

SEQ ID NO: 2225744 - RNA, 17 nt, Streptococcus pyogenes MGAS8232
ugauugauuugucuucu

SEQ ID NO: 2225745 - RNA, 18 nt, Streptococcus pyogenes MGAS8232
ugauugaguaagcagcau

SEQ ID NO: 2225746 - RNA, 12 nt, Streptococcus pyogenes MGAS8232
ugauucuuuuuu

SEQ ID NO: 2225747 - RNA, 16 nt, Streptococcus pyogenes MGAS8232
ugauuuuuaauucuuc

SEQ ID NO: 2225748 - RNA, 17 nt, Streptococcus pyogenes MGAS8232
ugauuuuuaauucuucu

SEQ ID NO: 2225749 - RNA, 22 nt, Streptococcus pyogenes MGAS8232
ugcaacugccaguugagccuuu

SEQ ID NO: 2225750 - RNA, 14 nt, Streptococcus pyogenes MGAS8232
ugcaccaccaaccu

SEQ ID NO: 2225751 - RNA, 18 nt, Streptococcus pyogenes MGAS8232
ugaucuguuuaaaaacaa

SEQ ID NO: 2225752 - RNA, 16 nt, Streptococcus pyogenes MGAS8232
ugaucuguuuaaaaac

SEQ ID NO: 2225753 - RNA, 21 nt, Streptococcus pyogenes MGAS8232
ugaugaguaggcgaacuuuau

SEQ ID NO: 2225754 - RNA, 15 nt, Streptococcus pyogenes MGAS8232
ugaugagguauuuau

SEQ ID NO: 2225755 - RNA, 12 nt, Streptococcus pyogenes MGAS8232
ugaugauggagu

SEQ ID NO: 2225756 - RNA, 14 nt, Streptococcus pyogenes MGAS8232
ugauauaaaaaugg

SEQ ID NO: 2225757 - RNA, 13 nt, Streptococcus pyogenes MGAS8232
ugauauaaaauug

SEQ ID NO: 2225758 - RNA, 19 nt, Streptococcus pyogenes MGAS8232
ugauaaaugccguuguaag

SEQ ID NO: 2225759 - RNA, 20 nt, Streptococcus pyogenes MGAS8232
ugauaaaggccuguauuucu

SEQ ID NO: 2225760 - RNA, 15 nt, Streptococcus pyogenes MGAS8232
ugaguuuauguaugc

SEQ ID NO: 2225761 - RNA, 13 nt, Streptococcus pyogenes MGAS8232
ugaguugauuuau

SEQ ID NO: 2225762 - RNA, 18 nt, Streptococcus pyogenes MGAS8232
ugauaagguuuuuuuaag

SEQ ID NO: 2225763 - RNA, 18 nt, Streptococcus pyogenes MGAS8232
ucgaaauugguccucuga

SEQ ID NO: 2225764 - RNA, 21 nt, Streptococcus pyogenes MGAS8232
ucgaauauaauucauguuuaa

SEQ ID NO: 2225765 - RNA, 20 nt, Streptococcus pyogenes MGAS8232
ucgacaauuaaaaaagcuuu

SEQ ID NO: 2225766 - RNA, 14 nt, Streptococcus pyogenes MGAS8232
uccuuuuaaagaca

SEQ ID NO: 2225767 - RNA, 13 nt, Streptococcus pyogenes MGAS8232
uccuucuuuuucc

SEQ ID NO: 2225768 - RNA, 18 nt, Streptococcus pyogenes MGAS8232
ucguuuuuugcuuuugau

SEQ ID NO: 2225769 - RNA, 19 nt, Streptococcus pyogenes MGAS8232
ucguuuuuuaguuuguaaa

SEQ ID NO: 2225770 - RNA, 21 nt, Streptococcus pyogenes MGAS8232
ucguuuuuuaguuuguaaaau

SEQ ID NO: 2225771 - RNA, 18 nt, Streptococcus pyogenes MGAS8232
ucgugaauaaucuucaga

SEQ ID NO: 2225772 - RNA, 16 nt, Streptococcus pyogenes MGAS8232
ucuaaaaaagcucuau

SEQ ID NO: 2225773 - RNA, 22 nt, Streptococcus pyogenes MGAS8232
ucuaaaaaagcucuaucaucuu

SEQ ID NO: 2225774 - RNA, 18 nt, Streptococcus pyogenes MGAS8232
ucgguuuuuuuaaguaag

SEQ ID NO: 2225775 - RNA, 20 nt, Streptococcus pyogenes MGAS8232
ucguaaggguuacuauuuag

SEQ ID NO: 2225776 - RNA, 14 nt, Streptococcus pyogenes MGAS8232
ucgguauucuuuuu

SEQ ID NO: 2225777 - RNA, 20 nt, Streptococcus pyogenes MGAS8232
ucuuuuucguauacuuuaaa

SEQ ID NO: 2225778 - RNA, 23 nt, Streptococcus pyogenes MGAS8232
ucuuuucuauuuaaccuucaaca

SEQ ID NO: 2225779 - RNA, 19 nt, Streptococcus pyogenes MGAS8232
ucuuuuuuacuuuuaaaau

SEQ ID NO: 2225780 - RNA, 17 nt, Streptococcus pyogenes MGAS8232
ucuuuuuuacuuuuaaa

SEQ ID NO: 2225781 - RNA, 18 nt, Streptococcus pyogenes MGAS8232
ugaaaaaacucaagaggu

SEQ ID NO: 2225782 - RNA, 14 nt, Streptococcus pyogenes MGAS8232
ucuuuuuuuuauua

SEQ ID NO: 2225783 - RNA, 18 nt, Streptococcus pyogenes MGAS8232
ucuuuuuuuuauuauucu

SEQ ID NO: 2225784 - RNA, 16 nt, Streptococcus pyogenes MGAS8232
ucuuuguccauucuuu

SEQ ID NO: 2225785 - RNA, 20 nt, Streptococcus pyogenes MGAS8232
ucuuuuaaccauaucacaaa

SEQ ID NO: 2225786 - RNA, 22 nt, Streptococcus pyogenes MGAS8232
ucuuuuaggccaccagaugcuu

SEQ ID NO: 2225787 - RNA, 13 nt, Streptococcus pyogenes MGAS8232
ucuuuuaguucag

SEQ ID NO: 2225788 - RNA, 19 nt, Streptococcus pyogenes MGAS8232
ucuuugcagagaugcuucu

SEQ ID NO: 2225789 - RNA, 15 nt, Streptococcus pyogenes MGAS8232
ucuuugacaauguca

SEQ ID NO: 2225790 - RNA, 23 nt, Streptococcus pyogenes MGAS8232
ucuuguuuaaccuccuaaacuaa

SEQ ID NO: 2225791 - RNA, 23 nt, Streptococcus pyogenes MGAS8232
ucuuguuuugguugauauaaaau

SEQ ID NO: 2225792 - RNA, 22 nt, Streptococcus pyogenes MGAS8232
ucuuuaauaguuuuacagucaa

SEQ ID NO: 2225793 - RNA, 14 nt, Streptococcus pyogenes MGAS8232
ugaacaaaacaaaa

SEQ ID NO: 2225794 - RNA, 17 nt, Streptococcus pyogenes MGAS8232
ugaaaacguguauucuu

SEQ ID NO: 2225795 - RNA, 22 nt, Streptococcus pyogenes MGAS8232
ugaaaagaugcacacaaaucuu

SEQ ID NO: 2225796 - RNA, 16 nt, Streptococcus pyogenes MGAS8232
ugaaaaagccuuuaca

SEQ ID NO: 2225797 - RNA, 13 nt, Streptococcus pyogenes MGAS8232
ugaaaauaaaaua

SEQ ID NO: 2225798 - RNA, 17 nt, Streptococcus pyogenes MGAS8232
ugaaaauaucuuuuuua

SEQ ID NO: 2225799 - RNA, 21 nt, Streptococcus pyogenes MGAS8232
ugaaaauaucuuuuuuacuuu

SEQ ID NO: 2225800 - RNA, 15 nt, Streptococcus pyogenes MGAS8232
ugaaaguaucuagga

SEQ ID NO: 2225801 - RNA, 20 nt, Streptococcus pyogenes MGAS8232
ugaaaguaacauguccauug

SEQ ID NO: 2225802 - RNA, 17 nt, Streptococcus pyogenes MGAS8232
ugaaagaggugcaacug

SEQ ID NO: 2225803 - RNA, 12 nt, Streptococcus pyogenes MGAS8232
ucuucaucuguu

SEQ ID NO: 2225804 - RNA, 14 nt, Streptococcus pyogenes MGAS8232
ucuuacuaugaaaa

SEQ ID NO: 2225805 - RNA, 15 nt, Streptococcus pyogenes MGAS8232
ucuuagcaccgcuua

SEQ ID NO: 2225806 - RNA, 14 nt, Streptococcus pyogenes MGAS8232
ucugguuuaucauu

SEQ ID NO: 2225807 - RNA, 18 nt, Streptococcus pyogenes MGAS8232
ucugcagauuuuaagaca

SEQ ID NO: 2225808 - RNA, 19 nt, Streptococcus pyogenes MGAS8232
ucugcaaguucuuugccuu

SEQ ID NO: 2225809 - RNA, 15 nt, Streptococcus pyogenes MGAS8232
ucugcaaguucuuug

SEQ ID NO: 2225810 - RNA, 19 nt, Streptococcus pyogenes MGAS8232
ucugcaauauccauagaaa

SEQ ID NO: 2225811 - RNA, 19 nt, Streptococcus pyogenes MGAS8232
ucugaaaauaaaauauuuu

SEQ ID NO: 2225812 - RNA, 16 nt, Streptococcus pyogenes MGAS8232
ucugacguaagcauca

SEQ ID NO: 2225813 - RNA, 15 nt, Streptococcus pyogenes MGAS8232
ucugagauauucauu

SEQ ID NO: 2225814 - RNA, 13 nt, Streptococcus pyogenes MGAS8232
ucugcaacaucaa

SEQ ID NO: 2225815 - RNA, 16 nt, Streptococcus pyogenes MGAS8232
ggugcuuuaaaaaguu

SEQ ID NO: 2225816 - RNA, 20 nt, Streptococcus pyogenes MGAS8232
gguuucgccuaggaauaaaa

SEQ ID NO: 2225817 - RNA, 18 nt, Streptococcus pyogenes MGAS8232
ggucauuauugucacuga

SEQ ID NO: 2225818 - RNA, 16 nt, Streptococcus pyogenes MGAS8232
ggggauuacgauuaaa

SEQ ID NO: 2225819 - RNA, 21 nt, Streptococcus pyogenes MGAS8232
gucguuuuuugcuuuugauac

SEQ ID NO: 2225820 - RNA, 18 nt, Streptococcus pyogenes MGAS8232
gucuaucugcagauuuua

SEQ ID NO: 2225821 - RNA, 14 nt, Streptococcus pyogenes MGAS8232
guccuccucuuuag

SEQ ID NO: 2225822 - RNA, 22 nt, Streptococcus pyogenes MGAS8232
guccaaacucaaacuaaacaaa

SEQ ID NO: 2225823 - RNA, 14 nt, Streptococcus pyogenes MGAS8232
guauuguagaggac

SEQ ID NO: 2225824 - RNA, 20 nt, Streptococcus pyogenes MGAS8232
guauuggccuucuuggaaaa

SEQ ID NO: 2225825 - RNA, 20 nt, Streptococcus pyogenes MGAS8232
guauuuacugggucaacucc

SEQ ID NO: 2225826 - RNA, 12 nt, Streptococcus pyogenes MGAS8232
guauuucuuugg

SEQ ID NO: 2225827 - RNA, 14 nt, Streptococcus pyogenes MGAS8232
guauucuuaaaaaa

SEQ ID NO: 2225828 - RNA, 15 nt, Streptococcus pyogenes MGAS8232
gucacaccguugaug

SEQ ID NO: 2225829 - RNA, 18 nt, Streptococcus pyogenes MGAS8232
gucacaccguugauguua

SEQ ID NO: 2225830 - RNA, 19 nt, Streptococcus pyogenes MGAS8232
gucaauacagccguucuua

SEQ ID NO: 2225831 - RNA, 14 nt, Streptococcus pyogenes MGAS8232
guaucuaagcuaua

SEQ ID NO: 2225832 - RNA, 16 nt, Streptococcus pyogenes MGAS8232
guaucuaagcuauaga

SEQ ID NO: 2225833 - RNA, 17 nt, Streptococcus pyogenes MGAS8232
guaucuaagcuauagaa

SEQ ID NO: 2225834 - RNA, 20 nt, Streptococcus pyogenes MGAS8232
guaucuaagcuauagaaacu

SEQ ID NO: 2225835 - RNA, 23 nt, Streptococcus pyogenes MGAS8232
guaugcuuuuaauuuuauuuuuu

SEQ ID NO: 2225836 - RNA, 13 nt, Streptococcus pyogenes MGAS8232
guauguaaauaua

SEQ ID NO: 2225837 - RNA, 16 nt, Streptococcus pyogenes MGAS8232
guauggguaugccuga

SEQ ID NO: 2225838 - RNA, 15 nt, Streptococcus pyogenes MGAS8232
guauagcauaaaaua

SEQ ID NO: 2225839 - RNA, 16 nt, Streptococcus pyogenes MGAS8232
guauagcauaaaauag

SEQ ID NO: 2225840 - RNA, 21 nt, Streptococcus pyogenes MGAS8232
guauagacaaacagaaauacu

SEQ ID NO: 2225841 - RNA, 15 nt, Streptococcus pyogenes MGAS8232
guacacgugauaaau

SEQ ID NO: 2225842 - RNA, 14 nt, Streptococcus pyogenes MGAS8232
guacagaaaugaaa

SEQ ID NO: 2225843 - RNA, 20 nt, Streptococcus pyogenes MGAS8232
guaauuuauuccauuuaucu

SEQ ID NO: 2225844 - RNA, 14 nt, Streptococcus pyogenes MGAS8232
guaauagaauaaaa

SEQ ID NO: 2225845 - RNA, 21 nt, Streptococcus pyogenes MGAS8232
guagaacgagucaauuuagcc

SEQ ID NO: 2225846 - RNA, 14 nt, Streptococcus pyogenes MGAS8232
guagcguacaugga

SEQ ID NO: 2225847 - RNA, 16 nt, Streptococcus pyogenes MGAS8232
gugggauauuuagaug

SEQ ID NO: 2225848 - RNA, 11 nt, Streptococcus pyogenes MGAS8232
guguuauccuc

SEQ ID NO: 2225849 - RNA, 18 nt, Streptococcus pyogenes MGAS8232
guguauucuuaaaaaaau

SEQ ID NO: 2225850 - RNA, 14 nt, Streptococcus pyogenes MGAS8232
gugucuacuaaaac

SEQ ID NO: 2225851 - RNA, 19 nt, Streptococcus pyogenes MGAS8232
guuauccucuuuuaguuca

SEQ ID NO: 2225852 - RNA, 22 nt, Streptococcus pyogenes MGAS8232
guuauccucccagccaucaaua

SEQ ID NO: 2225853 - RNA, 17 nt, Streptococcus pyogenes MGAS8232
guuauagcuccuaaaac

SEQ ID NO: 2225854 - RNA, 19 nt, Streptococcus pyogenes MGAS8232
guuaggagcacaaaagagg

SEQ ID NO: 2225855 - RNA, 20 nt, Streptococcus pyogenes MGAS8232
guuauuaaagacaaaaaaac

SEQ ID NO: 2225856 - RNA, 14 nt, Streptococcus pyogenes MGAS8232
guuauguuauaaga

SEQ ID NO: 2225857 - RNA, 19 nt, Streptococcus pyogenes MGAS8232
guucaauggauauaacaac

SEQ ID NO: 2225858 - RNA, 20 nt, Streptococcus pyogenes MGAS8232
guucuaguuuaggauauaag

SEQ ID NO: 2225859 - RNA, 14 nt, Streptococcus pyogenes MGAS8232
guucugaaaauaaa

SEQ ID NO: 2225860 - RNA, 18 nt, Streptococcus pyogenes MGAS8232
guuccaucugcacaugcu

SEQ ID NO: 2225861 - RNA, 13 nt, Streptococcus pyogenes MGAS8232
gugagaaaauuuu

SEQ ID NO: 2225862 - RNA, 16 nt, Streptococcus pyogenes MGAS8232
gugacgacacaacuca

SEQ ID NO: 2225863 - RNA, 14 nt, Streptococcus pyogenes MGAS8232
gugaauaaucuuca

SEQ ID NO: 2225864 - RNA, 17 nt, Streptococcus pyogenes MGAS8232
gucuggaaacuggucaa

SEQ ID NO: 2225865 - RNA, 17 nt, Streptococcus pyogenes MGAS8232
gucugcaugaagugguu

SEQ ID NO: 2225866 - RNA, 14 nt, Streptococcus pyogenes MGAS8232
gucugagugacuaa

SEQ ID NO: 2225867 - RNA, 21 nt, Streptococcus pyogenes MGAS8232
uaaauauccaaugaaaacucc

SEQ ID NO: 2225868 - RNA, 14 nt, Streptococcus pyogenes MGAS8232
uaaaugacaugaaa

SEQ ID NO: 2225869 - RNA, 16 nt, Streptococcus pyogenes MGAS8232
uaaauaaagauaauuu

SEQ ID NO: 2225870 - RNA, 14 nt, Streptococcus pyogenes MGAS8232
uaaagacaaaaaaa

SEQ ID NO: 2225871 - RNA, 21 nt, Streptococcus pyogenes MGAS8232
uaaagagaaagaggaaacaaa

SEQ ID NO: 2225872 - RNA, 23 nt, Streptococcus pyogenes MGAS8232
uaaagagaaagaggaaacaaaaa

SEQ ID NO: 2225873 - RNA, 16 nt, Streptococcus pyogenes MGAS8232
uaaagccaaccccaag

SEQ ID NO: 2225874 - RNA, 14 nt, Streptococcus pyogenes MGAS8232
uaaacuaauaagau

SEQ ID NO: 2225875 - RNA, 16 nt, Streptococcus pyogenes MGAS8232
uaaacgguaauuuauu

SEQ ID NO: 2225876 - RNA, 23 nt, Streptococcus pyogenes MGAS8232
uaacaaaaugaagcaaaauaaac

SEQ ID NO: 2225877 - RNA, 18 nt, Streptococcus pyogenes MGAS8232
uaaauugauuauucucua

SEQ ID NO: 2225878 - RNA, 13 nt, Streptococcus pyogenes MGAS8232
uaacgaaaagcau

SEQ ID NO: 2225879 - RNA, 15 nt, Streptococcus pyogenes MGAS8232
uaacgauagcaauca

SEQ ID NO: 2225880 - RNA, 17 nt, Streptococcus pyogenes MGAS8232
uaacgauagcaaucaca

SEQ ID NO: 2225881 - RNA, 13 nt, Streptococcus pyogenes MGAS8232
uaacaucuugauu

SEQ ID NO: 2225882 - RNA, 22 nt, Streptococcus pyogenes MGAS8232
uaacccgucuuacaauuaauag

SEQ ID NO: 2225883 - RNA, 23 nt, Streptococcus pyogenes MGAS8232
uaacccucauugucaaagcugac

SEQ ID NO: 2225884 - RNA, 14 nt, Streptococcus pyogenes MGAS8232
uaaccauugccauu

SEQ ID NO: 2225885 - RNA, 16 nt, Streptococcus pyogenes MGAS8232
uaaccauaucacaaaa

SEQ ID NO: 2225886 - RNA, 18 nt, Streptococcus pyogenes MGAS8232
uaaccauagaagccaauu

SEQ ID NO: 2225887 - RNA, 16 nt, Streptococcus pyogenes MGAS8232
guuuugucuuaucuaa

SEQ ID NO: 2225888 - RNA, 15 nt, Streptococcus pyogenes MGAS8232
guuuuuaaagcgaua

SEQ ID NO: 2225889 - RNA, 21 nt, Streptococcus pyogenes MGAS8232
guuuucugguguugcaaggcu

SEQ ID NO: 2225890 - RNA, 21 nt, Streptococcus pyogenes MGAS8232
guuuuuuugucuccuucuuug

SEQ ID NO: 2225891 - RNA, 16 nt, Streptococcus pyogenes MGAS8232
guuuuuuuuauuucac

SEQ ID NO: 2225892 - RNA, 13 nt, Streptococcus pyogenes MGAS8232
uaaaaaaaucccu

SEQ ID NO: 2225893 - RNA, 15 nt, Streptococcus pyogenes MGAS8232
guuuuuugucuucuu

SEQ ID NO: 2225894 - RNA, 16 nt, Streptococcus pyogenes MGAS8232
uaaaaaauauuguaaa

SEQ ID NO: 2225895 - RNA, 17 nt, Streptococcus pyogenes MGAS8232
uaaaaaagcucuaucau

SEQ ID NO: 2225896 - RNA, 18 nt, Streptococcus pyogenes MGAS8232
uaaaaaaccuuaucaaac

SEQ ID NO: 2225897 - RNA, 21 nt, Streptococcus pyogenes MGAS8232
uaaaaaagaagcaaaauuauu

SEQ ID NO: 2225898 - RNA, 19 nt, Streptococcus pyogenes MGAS8232
uaaaaguuagccaagcaau

SEQ ID NO: 2225899 - RNA, 16 nt, Streptococcus pyogenes MGAS8232
uaaaagaaaaucuaau

SEQ ID NO: 2225900 - RNA, 20 nt, Streptococcus pyogenes MGAS8232
guuuucucagagacaauaag

SEQ ID NO: 2225901 - RNA, 18 nt, Streptococcus pyogenes MGAS8232
guuuucucaacaguauaa

SEQ ID NO: 2225902 - RNA, 13 nt, Streptococcus pyogenes MGAS8232
guuuuauuuugau

SEQ ID NO: 2225903 - RNA, 20 nt, Streptococcus pyogenes MGAS8232
guuucuugcaaugccagcag

SEQ ID NO: 2225904 - RNA, 12 nt, Streptococcus pyogenes MGAS8232
guuuauuuaguu

SEQ ID NO: 2225905 - RNA, 16 nt, Streptococcus pyogenes MGAS8232
guuucauagaagacgg

SEQ ID NO: 2225906 - RNA, 20 nt, Streptococcus pyogenes MGAS8232
guuucggaaaacuuuugacu

SEQ ID NO: 2225907 - RNA, 23 nt, Streptococcus pyogenes MGAS8232
guucuguuucuaggcaaauagca

SEQ ID NO: 2225908 - RNA, 18 nt, Streptococcus pyogenes MGAS8232
guucuuaaaagaaaaucu

SEQ ID NO: 2225909 - RNA, 17 nt, Streptococcus pyogenes MGAS8232
ucaaaaaauuaagaagg

SEQ ID NO: 2225910 - RNA, 15 nt, Streptococcus pyogenes MGAS8232
ucaaaaauauauucu

SEQ ID NO: 2225911 - RNA, 18 nt, Streptococcus pyogenes MGAS8232
ucaaaagaccauaaaaaa

SEQ ID NO: 2225912 - RNA, 15 nt, Streptococcus pyogenes MGAS8232
ucaaaaaucuuuuuc

SEQ ID NO: 2225913 - RNA, 18 nt, Streptococcus pyogenes MGAS8232
uauuuuugaaaaaaauga

SEQ ID NO: 2225914 - RNA, 11 nt, Streptococcus pyogenes MGAS8232
uauuuuuuagu

SEQ ID NO: 2225915 - RNA, 15 nt, Streptococcus pyogenes MGAS8232
uauuuugauauuuuu

SEQ ID NO: 2225916 - RNA, 19 nt, Streptococcus pyogenes MGAS8232
uauuuugauauuuuuucuc

SEQ ID NO: 2225917 - RNA, 13 nt, Streptococcus pyogenes MGAS8232
uauuuugcuucua

SEQ ID NO: 2225918 - RNA, 15 nt, Streptococcus pyogenes MGAS8232
ucaaagcugacagua

SEQ ID NO: 2225919 - RNA, 15 nt, Streptococcus pyogenes MGAS8232
ucaaacacguauuuu

SEQ ID NO: 2225920 - RNA, 19 nt, Streptococcus pyogenes MGAS8232
ucaaacacguauuuuucga

SEQ ID NO: 2225921 - RNA, 13 nt, Streptococcus pyogenes MGAS8232
ucaaacuaaacaa

SEQ ID NO: 2225922 - RNA, 21 nt, Streptococcus pyogenes MGAS8232
ucaacaguauaacuguuuuuc

SEQ ID NO: 2225923 - RNA, 23 nt, Streptococcus pyogenes MGAS8232
ucaacaguauaacuguuuuucuu

SEQ ID NO: 2225924 - RNA, 19 nt, Streptococcus pyogenes MGAS8232
ucaacagcaggccuuuccg

SEQ ID NO: 2225925 - RNA, 16 nt, Streptococcus pyogenes MGAS8232
ucaaauuuuuuucaug

SEQ ID NO: 2225926 - RNA, 19 nt, Streptococcus pyogenes MGAS8232
ucaaauccgcuugcagcau

SEQ ID NO: 2225927 - RNA, 16 nt, Streptococcus pyogenes MGAS8232
ucaaccgcuucuuuug

SEQ ID NO: 2225928 - RNA, 16 nt, Streptococcus pyogenes MGAS8232
ucaacgcuagcauaau

SEQ ID NO: 2225929 - RNA, 21 nt, Streptococcus pyogenes MGAS8232
ucaacuaucaaguaugcuuuu

SEQ ID NO: 2225930 - RNA, 22 nt, Streptococcus pyogenes MGAS8232
ucaacuaucaaguaugcuuuua

SEQ ID NO: 2225931 - RNA, 17 nt, Streptococcus pyogenes MGAS8232
ucaacuuaccagcaccu

SEQ ID NO: 2225932 - RNA, 14 nt, Streptococcus pyogenes MGAS8232
uauugagaagaaaa

SEQ ID NO: 2225933 - RNA, 22 nt, Streptococcus pyogenes MGAS8232
uauuuacugggucaacuccaau

SEQ ID NO: 2225934 - RNA, 22 nt, Streptococcus pyogenes MGAS8232
uauuguggcgggccuucuauca

SEQ ID NO: 2225935 - RNA, 15 nt, Streptococcus pyogenes MGAS8232
uauuguuaauauagu

SEQ ID NO: 2225936 - RNA, 14 nt, Streptococcus pyogenes MGAS8232
uauugugcuauuca

SEQ ID NO: 2225937 - RNA, 17 nt, Streptococcus pyogenes MGAS8232
uauuuaacuuauuauuu

SEQ ID NO: 2225938 - RNA, 18 nt, Streptococcus pyogenes MGAS8232
uauuuaacuuauuauuuu

SEQ ID NO: 2225939 - RNA, 17 nt, Streptococcus pyogenes MGAS8232
uauuugaaguaaaggau

SEQ ID NO: 2225940 - RNA, 23 nt, Streptococcus pyogenes MGAS8232
uauuugacuuguuacaaaaaaca

SEQ ID NO: 2225941 - RNA, 20 nt, Streptococcus pyogenes MGAS8232
uauuuuaaaauccucuuuua

SEQ ID NO: 2225942 - RNA, 13 nt, Streptococcus pyogenes MGAS8232
uauuuuaaaauag

SEQ ID NO: 2225943 - RNA, 15 nt, Streptococcus pyogenes MGAS8232
uauuuauaaauauuu

SEQ ID NO: 2225944 - RNA, 19 nt, Streptococcus pyogenes MGAS8232
uauuucggccacuucaagc

SEQ ID NO: 2225945 - RNA, 20 nt, Streptococcus pyogenes MGAS8232
uauuucggccacuucaagca

SEQ ID NO: 2225946 - RNA, 23 nt, Streptococcus pyogenes MGAS8232
uauuucacuagacauucguucua

SEQ ID NO: 2225947 - RNA, 22 nt, Streptococcus pyogenes MGAS8232
uauuauacucaauauaauaaaa

SEQ ID NO: 2225948 - RNA, 15 nt, Streptococcus pyogenes MGAS8232
uauuauauuaaauua

SEQ ID NO: 2225949 - RNA, 17 nt, Streptococcus pyogenes MGAS8232
uauuauauuaaauuaau

SEQ ID NO: 2225950 - RNA, 15 nt, Streptococcus pyogenes MGAS8232
uauuaaccaauuccu

SEQ ID NO: 2225951 - RNA, 15 nt, Streptococcus pyogenes MGAS8232
uauuaaauaauacag

SEQ ID NO: 2225952 - RNA, 12 nt, Streptococcus pyogenes MGAS8232
uauuaaagagaa

SEQ ID NO: 2225953 - RNA, 20 nt, Streptococcus pyogenes MGAS8232
uauuaauaaguauuuuaaaa

SEQ ID NO: 2225954 - RNA, 20 nt, Streptococcus pyogenes MGAS8232
uauuaaccggcucuaaaaua

SEQ ID NO: 2225955 - RNA, 16 nt, Streptococcus pyogenes MGAS8232
uauucuuaaaaaaauc

SEQ ID NO: 2225956 - RNA, 16 nt, Streptococcus pyogenes MGAS8232
uauucauuuucuucuu

SEQ ID NO: 2225957 - RNA, 14 nt, Streptococcus pyogenes MGAS8232
ucacaacuucuaua

SEQ ID NO: 2225958 - RNA, 22 nt, Streptococcus pyogenes MGAS8232
ucacagccucgcugaaagucuu

SEQ ID NO: 2225959 - RNA, 22 nt, Streptococcus pyogenes MGAS8232
ucaauuaauguuaggagcacaa

SEQ ID NO: 2225960 - RNA, 16 nt, Streptococcus pyogenes MGAS8232
ucaauguuuugcucga

SEQ ID NO: 2225961 - RNA, 13 nt, Streptococcus pyogenes MGAS8232
ucaauguuuugcu

SEQ ID NO: 2225962 - RNA, 18 nt, Streptococcus pyogenes MGAS8232
ucaauuuuguugaguguu

SEQ ID NO: 2225963 - RNA, 19 nt, Streptococcus pyogenes MGAS8232
ucaauuuagccguccuuaa

SEQ ID NO: 2225964 - RNA, 20 nt, Streptococcus pyogenes MGAS8232
ucaauuuuugauuuuaauuu

SEQ ID NO: 2225965 - RNA, 22 nt, Streptococcus pyogenes MGAS8232
ucaaugacuugaccaaauacag

SEQ ID NO: 2225966 - RNA, 20 nt, Streptococcus pyogenes MGAS8232
ucaauggaaauuuuaaauga

SEQ ID NO: 2225967 - RNA, 19 nt, Streptococcus pyogenes MGAS8232
ucaauaacagaaauuaaua

SEQ ID NO: 2225968 - RNA, 22 nt, Streptococcus pyogenes MGAS8232
ucaauaacaacgucaauuuuau

SEQ ID NO: 2225969 - RNA, 23 nt, Streptococcus pyogenes MGAS8232
ucaaggggauuacgauuaaaaga

SEQ ID NO: 2225970 - RNA, 20 nt, Streptococcus pyogenes MGAS8232
ucaauaacagaaauuaauaa

SEQ ID NO: 2225971 - RNA, 14 nt, Streptococcus pyogenes MGAS8232
ucaauaucacauuu

SEQ ID NO: 2225972 - RNA, 18 nt, Streptococcus pyogenes MGAS8232
ucaauaucacauuuuaau

SEQ ID NO: 2225973 - RNA, 13 nt, Streptococcus pyogenes MGAS8232
ucaauagcugcug

SEQ ID NO: 2225974 - RNA, 22 nt, Streptococcus pyogenes MGAS8232
ucaauauuuuauuaauaaguau

SEQ ID NO: 2225975 - RNA, 21 nt, Streptococcus pyogenes MGAS8232
ucaauauuuuauuaauaagua

SEQ ID NO: 2225976 - RNA, 12 nt, Streptococcus pyogenes MGAS8232
ucacuauaauuu

SEQ ID NO: 2225977 - RNA, 20 nt, Streptococcus pyogenes MGAS8232
ucacuagauaagucauuuua

SEQ ID NO: 2225978 - RNA, 19 nt, Streptococcus pyogenes MGAS8232
ucacuaucugauacagagc

SEQ ID NO: 2225979 - RNA, 17 nt, Streptococcus pyogenes MGAS8232
ucacguacagaaaugaa

SEQ ID NO: 2225980 - RNA, 21 nt, Streptococcus pyogenes MGAS8232
ucaccuuaggcagacaauuau

SEQ ID NO: 2225981 - RNA, 19 nt, Streptococcus pyogenes MGAS8232
ucaccuuaggcagacaauu

SEQ ID NO: 2225982 - RNA, 18 nt, Streptococcus pyogenes MGAS8232
ucaccuuucuauauaacu

SEQ ID NO: 2225983 - RNA, 19 nt, Streptococcus pyogenes MGAS8232
ucagaucauuaaauugauu

SEQ ID NO: 2225984 - RNA, 19 nt, Streptococcus pyogenes MGAS8232
ucagauaagaccuucaaaa

SEQ ID NO: 2225985 - RNA, 20 nt, Streptococcus pyogenes MGAS8232
ucagagcuuuuuuuguuuug

SEQ ID NO: 2225986 - RNA, 19 nt, Streptococcus pyogenes MGAS8232
ucagagaugcuucuuucaa

SEQ ID NO: 2225987 - RNA, 15 nt, Streptococcus pyogenes MGAS8232
ucagagacaauaagg

SEQ ID NO: 2225988 - RNA, 15 nt, Streptococcus pyogenes MGAS8232
ucagaauaagaaaac

SEQ ID NO: 2225989 - RNA, 19 nt, Streptococcus pyogenes MGAS8232
ucagcaucguuaaguggaa

SEQ ID NO: 2225990 - RNA, 20 nt, Streptococcus pyogenes MGAS8232
ucagcauaaccuuugccauu

SEQ ID NO: 2225991 - RNA, 14 nt, Streptococcus pyogenes MGAS8232
uagaugaauuuugu

SEQ ID NO: 2225992 - RNA, 23 nt, Streptococcus pyogenes MGAS8232
uagaugaauuuugucuaaaauaa

SEQ ID NO: 2225993 - RNA, 13 nt, Streptococcus pyogenes MGAS8232
uagcagacaaaag

SEQ ID NO: 2225994 - RNA, 13 nt, Streptococcus pyogenes MGAS8232
uagcaagaaguuu

SEQ ID NO: 2225995 - RNA, 16 nt, Streptococcus pyogenes MGAS8232
uaggcagacaauuauu

SEQ ID NO: 2225996 - RNA, 18 nt, Streptococcus pyogenes MGAS8232
uaggcagagccuuaaaaa

SEQ ID NO: 2225997 - RNA, 19 nt, Streptococcus pyogenes MGAS8232
uaggcagagccuuaaaaag

SEQ ID NO: 2225998 - RNA, 17 nt, Streptococcus pyogenes MGAS8232
uaguaaagccuuaucca

SEQ ID NO: 2225999 - RNA, 15 nt, Streptococcus pyogenes MGAS8232
uaguaaccauugcca

SEQ ID NO: 2226000 - RNA, 22 nt, Streptococcus pyogenes MGAS8232
uaggucuaauuagcauauuuug

SEQ ID NO: 2226001 - RNA, 20 nt, Streptococcus pyogenes MGAS8232
uaggcuuuuuuuguaucuca

SEQ ID NO: 2226002 - RNA, 14 nt, Streptococcus pyogenes MGAS8232
uagguuaaaauaga

SEQ ID NO: 2226003 - RNA, 22 nt, Streptococcus pyogenes MGAS8232
uagguugcaccaccaaccuuaa

SEQ ID NO: 2226004 - RNA, 22 nt, Streptococcus pyogenes MGAS8232
uagucgacucccuuuaauucuu

SEQ ID NO: 2226005 - RNA, 20 nt, Streptococcus pyogenes MGAS8232
uaguccaaaauguacauccu

SEQ ID NO: 2226006 - RNA, 21 nt, Streptococcus pyogenes MGAS8232
uagucaaaauaggcagagccu

SEQ ID NO: 2226007 - RNA, 15 nt, Streptococcus pyogenes MGAS8232
uaguagcaaauaaca

SEQ ID NO: 2226008 - RNA, 15 nt, Streptococcus pyogenes MGAS8232
uauaacuguuuuucu

SEQ ID NO: 2226009 - RNA, 17 nt, Streptococcus pyogenes MGAS8232
uauaacuguuuuucuua

SEQ ID NO: 2226010 - RNA, 15 nt, Streptococcus pyogenes MGAS8232
uauaacuguucauuu

SEQ ID NO: 2226011 - RNA, 20 nt, Streptococcus pyogenes MGAS8232
uauaagauaaguaauauuuu

SEQ ID NO: 2226012 - RNA, 13 nt, Streptococcus pyogenes MGAS8232
uauaaggcaauca

SEQ ID NO: 2226013 - RNA, 20 nt, Streptococcus pyogenes MGAS8232
uauaaccucuagcuugugag

SEQ ID NO: 2226014 - RNA, 15 nt, Streptococcus pyogenes MGAS8232
uauaaagaaacaaaa

SEQ ID NO: 2226015 - RNA, 17 nt, Streptococcus pyogenes MGAS8232
uauaaagaaacaaaaau

SEQ ID NO: 2226016 - RNA, 18 nt, Streptococcus pyogenes MGAS8232
uaguugguauauagcuca

SEQ ID NO: 2226017 - RNA, 15 nt, Streptococcus pyogenes MGAS8232
uaguugguauauagc

SEQ ID NO: 2226018 - RNA, 22 nt, Streptococcus pyogenes MGAS8232
uaguuuaggaaucacaacuucu

SEQ ID NO: 2226019 - RNA, 17 nt, Streptococcus pyogenes MGAS8232
uaguuggauccuuuauc

SEQ ID NO: 2226020 - RNA, 14 nt, Streptococcus pyogenes MGAS8232
uaguucagaaguug

SEQ ID NO: 2226021 - RNA, 20 nt, Streptococcus pyogenes MGAS8232
uauccuccuaaauauaaauu

SEQ ID NO: 2226022 - RNA, 14 nt, Streptococcus pyogenes MGAS8232
uauccuccuaaaua

SEQ ID NO: 2226023 - RNA, 16 nt, Streptococcus pyogenes MGAS8232
uaucgccaauaaaaaa

SEQ ID NO: 2226024 - RNA, 18 nt, Streptococcus pyogenes MGAS8232
uaucucauaacaaauuua

SEQ ID NO: 2226025 - RNA, 14 nt, Streptococcus pyogenes MGAS8232
uaucucauaaaaaa

SEQ ID NO: 2226026 - RNA, 13 nt, Streptococcus pyogenes MGAS8232
uauccauuauaaa

SEQ ID NO: 2226027 - RNA, 14 nt, Streptococcus pyogenes MGAS8232
uauccauagaaauu

SEQ ID NO: 2226028 - RNA, 16 nt, Streptococcus pyogenes MGAS8232
uauccauagaaauugu

SEQ ID NO: 2226029 - RNA, 13 nt, Streptococcus pyogenes MGAS8232
uauaguuauguua

SEQ ID NO: 2226030 - RNA, 15 nt, Streptococcus pyogenes MGAS8232
uauaguauuaucuca

SEQ ID NO: 2226031 - RNA, 17 nt, Streptococcus pyogenes MGAS8232
uauaguauuaucucauu

SEQ ID NO: 2226032 - RNA, 16 nt, Streptococcus pyogenes MGAS8232
uaucaaauccgcuugc

SEQ ID NO: 2226033 - RNA, 21 nt, Streptococcus pyogenes MGAS8232
uauaugucaucaaaagaccau

SEQ ID NO: 2226034 - RNA, 18 nt, Streptococcus pyogenes MGAS8232
uauaugcgugguggaggu

SEQ ID NO: 2226035 - RNA, 16 nt, Streptococcus pyogenes MGAS8232
uauguaaauauaaagu

SEQ ID NO: 2226036 - RNA, 22 nt, Streptococcus pyogenes MGAS8232
uauguaacgcuuguuuaugaaa

SEQ ID NO: 2226037 - RNA, 19 nt, Streptococcus pyogenes MGAS8232
uauguauuuuucaaaaucu

SEQ ID NO: 2226038 - RNA, 18 nt, Streptococcus pyogenes MGAS8232
uaugugauuauuauucua

SEQ ID NO: 2226039 - RNA, 15 nt, Streptococcus pyogenes MGAS8232
uaugugauuauuauu

SEQ ID NO: 2226040 - RNA, 16 nt, Streptococcus pyogenes MGAS8232
uaugacaaauucuuuu

SEQ ID NO: 2226041 - RNA, 18 nt, Streptococcus pyogenes MGAS8232
uaugcagguguuuaaaga

SEQ ID NO: 2226042 - RNA, 14 nt, Streptococcus pyogenes MGAS8232
uaugcauguagaug

SEQ ID NO: 2226043 - RNA, 18 nt, Streptococcus pyogenes MGAS8232
uaugaaaaaagaacaaag

SEQ ID NO: 2226044 - RNA, 18 nt, Streptococcus pyogenes MGAS8232
uacuggucaauggaaauu

SEQ ID NO: 2226045 - RNA, 16 nt, Streptococcus pyogenes MGAS8232
uacuguauaaacuugu

SEQ ID NO: 2226046 - RNA, 20 nt, Streptococcus pyogenes MGAS8232
uacugggucaacuccaaucu

SEQ ID NO: 2226047 - RNA, 14 nt, Streptococcus pyogenes MGAS8232
uacuguauaaacuu

SEQ ID NO: 2226048 - RNA, 20 nt, Streptococcus pyogenes MGAS8232
uacuguaauauuuccuuuua

SEQ ID NO: 2226049 - RNA, 22 nt, Streptococcus pyogenes MGAS8232
uacuucaaggaaggcuuguucu

SEQ ID NO: 2226050 - RNA, 21 nt, Streptococcus pyogenes MGAS8232
uacuucgguauucuuuuuccg

SEQ ID NO: 2226051 - RNA, 12 nt, Streptococcus pyogenes MGAS8232
uacuuuuaaaau

SEQ ID NO: 2226052 - RNA, 15 nt, Streptococcus pyogenes MGAS8232
uacugauaaacuuga

SEQ ID NO: 2226053 - RNA, 13 nt, Streptococcus pyogenes MGAS8232
uacugauaaacuu

SEQ ID NO: 2226054 - RNA, 18 nt, Streptococcus pyogenes MGAS8232
uacucuauuuuaaguaaa

SEQ ID NO: 2226055 - RNA, 17 nt, Streptococcus pyogenes MGAS8232
uacuccguuucuaguuu

SEQ ID NO: 2226056 - RNA, 16 nt, Streptococcus pyogenes MGAS8232
uacucaucuacucuau

SEQ ID NO: 2226057 - RNA, 17 nt, Streptococcus pyogenes MGAS8232
uacucaauauaauaaaa

SEQ ID NO: 2226058 - RNA, 21 nt, Streptococcus pyogenes MGAS8232
uacucaccgaacuccccuuua

SEQ ID NO: 2226059 - RNA, 17 nt, Streptococcus pyogenes MGAS8232
uaccauuuuuaucugua

SEQ ID NO: 2226060 - RNA, 14 nt, Streptococcus pyogenes MGAS8232
uaccagcaccuucu

SEQ ID NO: 2226061 - RNA, 17 nt, Streptococcus pyogenes MGAS8232
uaccuuauuuucuaggu

SEQ ID NO: 2226062 - RNA, 14 nt, Streptococcus pyogenes MGAS8232
uaccuucauagaca

SEQ ID NO: 2226063 - RNA, 15 nt, Streptococcus pyogenes MGAS8232
uaccuauauuauacu

SEQ ID NO: 2226064 - RNA, 18 nt, Streptococcus pyogenes MGAS8232
uaccuauugagucuuuuu

SEQ ID NO: 2226065 - RNA, 19 nt, Streptococcus pyogenes MGAS8232
uaccuauugagucuuuuuc

SEQ ID NO: 2226066 - RNA, 21 nt, Streptococcus pyogenes MGAS8232
uacaaaacugucuggaaacug

SEQ ID NO: 2226067 - RNA, 13 nt, Streptococcus pyogenes MGAS8232
uacaaaauaaccc

SEQ ID NO: 2226068 - RNA, 11 nt, Streptococcus pyogenes MGAS8232
uacaaaaaaca

SEQ ID NO: 2226069 - RNA, 19 nt, Streptococcus pyogenes MGAS8232
uacaaaaaaccuuccugua

SEQ ID NO: 2226070 - RNA, 12 nt, Streptococcus pyogenes MGAS8232
uaauuuuuccuu

SEQ ID NO: 2226071 - RNA, 16 nt, Streptococcus pyogenes MGAS8232
uaauuuuauuuuuuaa

SEQ ID NO: 2226072 - RNA, 13 nt, Streptococcus pyogenes MGAS8232
uaauuucuuuuuc

SEQ ID NO: 2226073 - RNA, 19 nt, Streptococcus pyogenes MGAS8232
uaauuuaccccaaaggcug

SEQ ID NO: 2226074 - RNA, 15 nt, Streptococcus pyogenes MGAS8232
uacaagagcuuaaaa

SEQ ID NO: 2226075 - RNA, 16 nt, Streptococcus pyogenes MGAS8232
uacaagagcuuaaaag

SEQ ID NO: 2226076 - RNA, 18 nt, Streptococcus pyogenes MGAS8232
uaauauaaggcaaucacc

SEQ ID NO: 2226077 - RNA, 13 nt, Streptococcus pyogenes MGAS8232
uaauuaucugaau

SEQ ID NO: 2226078 - RNA, 11 nt, Streptococcus pyogenes MGAS8232
uaauuaucuga

SEQ ID NO: 2226079 - RNA, 17 nt, Streptococcus pyogenes MGAS8232
uaauuaucugaauuauu

SEQ ID NO: 2226080 - RNA, 18 nt, Streptococcus pyogenes MGAS8232
uaauuaugcaaaagauga

SEQ ID NO: 2226081 - RNA, 19 nt, Streptococcus pyogenes MGAS8232
uaauuauuuuaauuuuucc

SEQ ID NO: 2226082 - RNA, 21 nt, Streptococcus pyogenes MGAS8232
uaauuauuuuaauuuuuccuu

SEQ ID NO: 2226083 - RNA, 18 nt, Streptococcus pyogenes MGAS8232
uaaugauuuuuaauucuu

SEQ ID NO: 2226084 - RNA, 19 nt, Streptococcus pyogenes MGAS8232
uaaugauuuuuaauucuuc

SEQ ID NO: 2226085 - RNA, 20 nt, Streptococcus pyogenes MGAS8232
uaaugagcaaggcaagagga

SEQ ID NO: 2226086 - RNA, 15 nt, Streptococcus pyogenes MGAS8232
ggcauaacccucauu

SEQ ID NO: 2226087 - RNA, 23 nt, Streptococcus pyogenes MGAS8232
ggauauaacaacucccuccuaag

SEQ ID NO: 2226088 - RNA, 13 nt, Streptococcus pyogenes MGAS8232
ggaagaagauccu

SEQ ID NO: 2226089 - RNA, 18 nt, Streptococcus pyogenes MGAS8232
ggaagaacagcauuuuca

SEQ ID NO: 2226090 - RNA, 15 nt, Streptococcus pyogenes MGAS8232
ggaacacucaucaua

SEQ ID NO: 2226091 - RNA, 13 nt, Streptococcus pyogenes MGAS8232
ggaaaacagaaag

SEQ ID NO: 2226092 - RNA, 21 nt, Streptococcus pyogenes MGAS8232
gcuuuuggcaaccuuaccuac

SEQ ID NO: 2226093 - RNA, 19 nt, Streptococcus pyogenes MGAS8232
gcuuugauuuuucuuguuu

SEQ ID NO: 2226094 - RNA, 18 nt, Streptococcus pyogenes MGAS8232
gcuuugauuuuucuuguu

SEQ ID NO: 2226095 - RNA, 13 nt, Streptococcus pyogenes MGAS8232
gcuugucuaugag

SEQ ID NO: 2226096 - RNA, 14 nt, Streptococcus pyogenes MGAS8232
gcuuguucuuuauu

SEQ ID NO: 2226097 - RNA, 18 nt, Streptococcus pyogenes MGAS8232
gcuuggauuuccucuaac

SEQ ID NO: 2226098 - RNA, 23 nt, Streptococcus pyogenes MGAS8232
gcuuaucaagguugcaagugaua

SEQ ID NO: 2226099 - RNA, 22 nt, Streptococcus pyogenes MGAS8232
gcuucuuacuaugaaaaaagaa

SEQ ID NO: 2226100 - RNA, 16 nt, Streptococcus pyogenes MGAS8232
gcuucuggcaauaagu

SEQ ID NO: 2226101 - RNA, 14 nt, Streptococcus pyogenes MGAS8232
gcuucuaaaaaaaa

SEQ ID NO: 2226102 - RNA, 15 nt, Streptococcus pyogenes MGAS8232
gcugcugcuaaagca

SEQ ID NO: 2226103 - RNA, 16 nt, Streptococcus pyogenes MGAS8232
gcugcuaaagcaauca

SEQ ID NO: 2226104 - RNA, 15 nt, Streptococcus pyogenes MGAS8232
gcuguuauuggaaag

SEQ ID NO: 2226105 - RNA, 14 nt, Streptococcus pyogenes MGAS8232
gcugguuuuuuuaa

SEQ ID NO: 2226106 - RNA, 19 nt, Streptococcus pyogenes MGAS8232
gcggaagaacagcauuuuc

SEQ ID NO: 2226107 - RNA, 21 nt, Streptococcus pyogenes MGAS8232
gcggaagaacagcauuuucau

SEQ ID NO: 2226108 - RNA, 14 nt, Streptococcus pyogenes MGAS8232
gcucuuagaagccu

SEQ ID NO: 2226109 - RNA, 20 nt, Streptococcus pyogenes MGAS8232
gcucuaauuuagucauuucu

SEQ ID NO: 2226110 - RNA, 21 nt, Streptococcus pyogenes MGAS8232
gcucuaauuuagucauuucuu

SEQ ID NO: 2226111 - RNA, 17 nt, Streptococcus pyogenes MGAS8232
gcuauaccuaaaaaaua

SEQ ID NO: 2226112 - RNA, 23 nt, Streptococcus pyogenes MGAS8232
gcuauuauccaacuuuuaucacu

SEQ ID NO: 2226113 - RNA, 20 nt, Streptococcus pyogenes MGAS8232
gccaucugcuuggauuuccu

SEQ ID NO: 2226114 - RNA, 23 nt, Streptococcus pyogenes MGAS8232
gccacuucaagcauaauaaaaag

SEQ ID NO: 2226115 - RNA, 21 nt, Streptococcus pyogenes MGAS8232
gccaaauuucagauaagaccu

SEQ ID NO: 2226116 - RNA, 17 nt, Streptococcus pyogenes MGAS8232
gcauuuugcaagucucu

SEQ ID NO: 2226117 - RNA, 15 nt, Streptococcus pyogenes MGAS8232
gcauuuuugcagggu

SEQ ID NO: 2226118 - RNA, 14 nt, Streptococcus pyogenes MGAS8232
gcauguaacaagcc

SEQ ID NO: 2226119 - RNA, 17 nt, Streptococcus pyogenes MGAS8232
gcauguaaugaccaccc

SEQ ID NO: 2226120 - RNA, 21 nt, Streptococcus pyogenes MGAS8232
gcaucuacagcaccuucaacc

SEQ ID NO: 2226121 - RNA, 17 nt, Streptococcus pyogenes MGAS8232
gcaucuacagcaccuuc

SEQ ID NO: 2226122 - RNA, 13 nt, Streptococcus pyogenes MGAS8232
gcccugcuggcuu

SEQ ID NO: 2226123 - RNA, 16 nt, Streptococcus pyogenes MGAS8232
gcccuuauguauuuuu

SEQ ID NO: 2226124 - RNA, 14 nt, Streptococcus pyogenes MGAS8232
gcaccuucuuuuag

SEQ ID NO: 2226125 - RNA, 16 nt, Streptococcus pyogenes MGAS8232
gcaaauucuuccuuag

SEQ ID NO: 2226126 - RNA, 15 nt, Streptococcus pyogenes MGAS8232
gcaauagagccaaga

SEQ ID NO: 2226127 - RNA, 14 nt, Streptococcus pyogenes MGAS8232
gcaaucuucaacac

SEQ ID NO: 2226128 - RNA, 19 nt, Streptococcus pyogenes MGAS8232
gcaauucuuuuauuaaugu

SEQ ID NO: 2226129 - RNA, 16 nt, Streptococcus pyogenes MGAS8232
gcauaauaaaaagagu

SEQ ID NO: 2226130 - RNA, 21 nt, Streptococcus pyogenes MGAS8232
gcaaauagcaaugguuaaaaa

SEQ ID NO: 2226131 - RNA, 17 nt, Streptococcus pyogenes MGAS8232
gauuuuggaugaaagua

SEQ ID NO: 2226132 - RNA, 23 nt, Streptococcus pyogenes MGAS8232
gauuuuuccuagcgggaacacuc

SEQ ID NO: 2226133 - RNA, 21 nt, Streptococcus pyogenes MGAS8232
gauuugaccacaccuaauaaa

SEQ ID NO: 2226134 - RNA, 15 nt, Streptococcus pyogenes MGAS8232
gauuauuauucuaaa

SEQ ID NO: 2226135 - RNA, 20 nt, Streptococcus pyogenes MGAS8232
gauuauuauucuaaaugaca

SEQ ID NO: 2226136 - RNA, 20 nt, Streptococcus pyogenes MGAS8232
gauguaccaauuuaagguau

SEQ ID NO: 2226137 - RNA, 21 nt, Streptococcus pyogenes MGAS8232
gauggucuugcucauguuuuc

SEQ ID NO: 2226138 - RNA, 17 nt, Streptococcus pyogenes MGAS8232
gauuacgauuaaaagau

SEQ ID NO: 2226139 - RNA, 15 nt, Streptococcus pyogenes MGAS8232
gaugcguuuauaaag

SEQ ID NO: 2226140 - RNA, 20 nt, Streptococcus pyogenes MGAS8232
gaugcugcuuaucucuugag

SEQ ID NO: 2226141 - RNA, 22 nt, Streptococcus pyogenes MGAS8232
gaugaauuuugucuaaaauaaa

SEQ ID NO: 2226142 - RNA, 16 nt, Streptococcus pyogenes MGAS8232
gaugaaucauuuugga

SEQ ID NO: 2226143 - RNA, 21 nt, Streptococcus pyogenes MGAS8232
gauauugaucucugcaacauc

SEQ ID NO: 2226144 - RNA, 17 nt, Streptococcus pyogenes MGAS8232
gauagcaaggaugaaau

SEQ ID NO: 2226145 - RNA, 21 nt, Streptococcus pyogenes MGAS8232
gauaauuucuuuuucauuugu

SEQ ID NO: 2226146 - RNA, 21 nt, Streptococcus pyogenes MGAS8232
gauaauaguagguagaacgag

SEQ ID NO: 2226147 - RNA, 13 nt, Streptococcus pyogenes MGAS8232
gauaccuuuuuug

SEQ ID NO: 2226148 - RNA, 20 nt, Streptococcus pyogenes MGAS8232
gauacaguccaaacucaaac

SEQ ID NO: 2226149 - RNA, 20 nt, Streptococcus pyogenes MGAS8232
gauacuucgguauucuuuuu

SEQ ID NO: 2226150 - RNA, 12 nt, Streptococcus pyogenes MGAS8232
gauaaaggccug

SEQ ID NO: 2226151 - RNA, 14 nt, Streptococcus pyogenes MGAS8232
gauaaaacaaauaa

SEQ ID NO: 2226152 - RNA, 16 nt, Streptococcus pyogenes MGAS8232
gaauuuccuaaugcaa

SEQ ID NO: 2226153 - RNA, 14 nt, Streptococcus pyogenes MGAS8232
gagucaaugaaaag

SEQ ID NO: 2226154 - RNA, 19 nt, Streptococcus pyogenes MGAS8232
cuuuuaauuuuauuuuuua

SEQ ID NO: 2226155 - RNA, 21 nt, Streptococcus pyogenes MGAS8232
cuuuuaauuuuauuuuuuaaa

SEQ ID NO: 2226156 - RNA, 13 nt, Streptococcus pyogenes MGAS8232
cuuuguugcauug

SEQ ID NO: 2226157 - RNA, 16 nt, Streptococcus pyogenes MGAS8232
cuuuguccauucuuua

SEQ ID NO: 2226158 - RNA, 20 nt, Streptococcus pyogenes MGAS8232
cuuuguuaccuucuucaagc

SEQ ID NO: 2226159 - RNA, 15 nt, Streptococcus pyogenes MGAS8232
cuuuuauuaauguaa

SEQ ID NO: 2226160 - RNA, 17 nt, Streptococcus pyogenes MGAS8232
cuuuucagagaugcuuc

SEQ ID NO: 2226161 - RNA, 18 nt, Streptococcus pyogenes MGAS8232
cuuuugauaccuuuuuug

SEQ ID NO: 2226162 - RNA, 15 nt, Streptococcus pyogenes MGAS8232
cuuuugauaccuuuu

SEQ ID NO: 2226163 - RNA, 17 nt, Streptococcus pyogenes MGAS8232
cuuuugacuugguuuaa

SEQ ID NO: 2226164 - RNA, 19 nt, Streptococcus pyogenes MGAS8232
cuuuucguuuuauuuugau

SEQ ID NO: 2226165 - RNA, 11 nt, Streptococcus pyogenes MGAS8232
cuuuuuaauug

SEQ ID NO: 2226166 - RNA, 13 nt, Streptococcus pyogenes MGAS8232
cuuuuucuuuucu

SEQ ID NO: 2226167 - RNA, 18 nt, Streptococcus pyogenes MGAS8232
cuuuuugccuuuaacaug

SEQ ID NO: 2226168 - RNA, 21 nt, Streptococcus pyogenes MGAS8232
gaaaacguguauucuuaaaaa

SEQ ID NO: 2226169 - RNA, 20 nt, Streptococcus pyogenes MGAS8232
gaaaagaugcacacaaaucu

SEQ ID NO: 2226170 - RNA, 22 nt, Streptococcus pyogenes MGAS8232
gaaaaugcuuuuucguuaacgu

SEQ ID NO: 2226171 - RNA, 17 nt, Streptococcus pyogenes MGAS8232
gaaaaucuguauuccau

SEQ ID NO: 2226172 - RNA, 19 nt, Streptococcus pyogenes MGAS8232
gaaaaaggcaaagaaagcc

SEQ ID NO: 2226173 - RNA, 14 nt, Streptococcus pyogenes MGAS8232
gaaaaaggguccac

SEQ ID NO: 2226174 - RNA, 11 nt, Streptococcus pyogenes MGAS8232
gaaaacagaaa

SEQ ID NO: 2226175 - RNA, 19 nt, Streptococcus pyogenes MGAS8232
cuuuuuuugucguuuuuug

SEQ ID NO: 2226176 - RNA, 14 nt, Streptococcus pyogenes MGAS8232
gaaaaaaacuugca

SEQ ID NO: 2226177 - RNA, 13 nt, Streptococcus pyogenes MGAS8232
gaaaaaauuucca

SEQ ID NO: 2226178 - RNA, 17 nt, Streptococcus pyogenes MGAS8232
cuuuuuuacuuuuaaaa

SEQ ID NO: 2226179 - RNA, 16 nt, Streptococcus pyogenes MGAS8232
gaaacugcacugagcc

SEQ ID NO: 2226180 - RNA, 17 nt, Streptococcus pyogenes MGAS8232
gaaacuggucaaaagcu

SEQ ID NO: 2226181 - RNA, 13 nt, Streptococcus pyogenes MGAS8232
gaaacuaaaggca

SEQ ID NO: 2226182 - RNA, 20 nt, Streptococcus pyogenes MGAS8232
gaaacguuauuaaagacaaa

SEQ ID NO: 2226183 - RNA, 24 nt, Streptococcus pyogenes MGAS8232
gaaauacuccguuucuaguuucau

SEQ ID NO: 2226184 - RNA, 13 nt, Streptococcus pyogenes MGAS8232
gaaaguagcaccu

SEQ ID NO: 2226185 - RNA, 12 nt, Streptococcus pyogenes MGAS8232
gaacagcugcuu

SEQ ID NO: 2226186 - RNA, 18 nt, Streptococcus pyogenes MGAS8232
gaaauuguaaccacagca

SEQ ID NO: 2226187 - RNA, 16 nt, Streptococcus pyogenes MGAS8232
gaaauuuuaaaugaca

SEQ ID NO: 2226188 - RNA, 17 nt, Streptococcus pyogenes MGAS8232
gaaauucaaauacuuca

SEQ ID NO: 2226189 - RNA, 15 nt, Streptococcus pyogenes MGAS8232
gaaaugauagcaccu

SEQ ID NO: 2226190 - RNA, 16 nt, Streptococcus pyogenes MGAS8232
gaaaugauagcaccua

SEQ ID NO: 2226191 - RNA, 17 nt, Streptococcus pyogenes MGAS8232
gaaaucgauuaauugca

SEQ ID NO: 2226192 - RNA, 12 nt, Streptococcus pyogenes MGAS8232
gaacuuguccug

SEQ ID NO: 2226193 - RNA, 18 nt, Streptococcus pyogenes MGAS8232
gaagaacagcauuuucau

SEQ ID NO: 2226194 - RNA, 23 nt, Streptococcus pyogenes MGAS8232
gaagaacagcauuuucaucauca

SEQ ID NO: 2226195 - RNA, 15 nt, Streptococcus pyogenes MGAS8232
gaagagagaagcugu

SEQ ID NO: 2226196 - RNA, 22 nt, Streptococcus pyogenes MGAS8232
gaaggaacucuccaaaguucuu

SEQ ID NO: 2226197 - RNA, 22 nt, Streptococcus pyogenes MGAS8232
gaagccgcucuaauuuagucau

SEQ ID NO: 2226198 - RNA, 17 nt, Streptococcus pyogenes MGAS8232
gaacuccuggauuaaau

SEQ ID NO: 2226199 - RNA, 23 nt, Streptococcus pyogenes MGAS8232
gaaucgcuuuaggaauaucauga

SEQ ID NO: 2226200 - RNA, 16 nt, Streptococcus pyogenes MGAS8232
gaaggcucuuaucuuu

SEQ ID NO: 2226201 - RNA, 13 nt, Streptococcus pyogenes MGAS8232
gaauaaaaugccu

SEQ ID NO: 2226202 - RNA, 22 nt, Streptococcus pyogenes MGAS8232
gaaguuugcggcucggugcuga

SEQ ID NO: 2226203 - RNA, 15 nt, Streptococcus pyogenes MGAS8232
gaagucucuuuugug

SEQ ID NO: 2226204 - RNA, 19 nt, Streptococcus pyogenes MGAS8232
gaauaucaggcaaaacaaa

SEQ ID NO: 2226205 - RNA, 19 nt, Streptococcus pyogenes MGAS8232
cuuaaacaugccuuucaca

SEQ ID NO: 2226206 - RNA, 22 nt, Streptococcus pyogenes MGAS8232
cuuaaacaugccuuucacagcc

SEQ ID NO: 2226207 - RNA, 14 nt, Streptococcus pyogenes MGAS8232
cuguuuuugcuguc

SEQ ID NO: 2226208 - RNA, 17 nt, Streptococcus pyogenes MGAS8232
cuguuucuugcaaugcc

SEQ ID NO: 2226209 - RNA, 22 nt, Streptococcus pyogenes MGAS8232
cuguucucuuuggagaaauuca

SEQ ID NO: 2226210 - RNA, 13 nt, Streptococcus pyogenes MGAS8232
cuguucucuuugg

SEQ ID NO: 2226211 - RNA, 22 nt, Streptococcus pyogenes MGAS8232
cugucuggaaacuggucaaaag

SEQ ID NO: 2226212 - RNA, 23 nt, Streptococcus pyogenes MGAS8232
cugucuacuuauuugacauuagu

SEQ ID NO: 2226213 - RNA, 14 nt, Streptococcus pyogenes MGAS8232
cuuacaaaaagccu

SEQ ID NO: 2226214 - RNA, 19 nt, Streptococcus pyogenes MGAS8232
cuuacaaaaagccuauuua

SEQ ID NO: 2226215 - RNA, 21 nt, Streptococcus pyogenes MGAS8232
cuuacaaaaagccuauuuaau

SEQ ID NO: 2226216 - RNA, 13 nt, Streptococcus pyogenes MGAS8232
cuuacaaaaagcc

SEQ ID NO: 2226217 - RNA, 20 nt, Streptococcus pyogenes MGAS8232
cuuacagcugguuuuuuuaa

SEQ ID NO: 2226218 - RNA, 15 nt, Streptococcus pyogenes MGAS8232
cuuacuaacuagcaa

SEQ ID NO: 2226219 - RNA, 15 nt, Streptococcus pyogenes MGAS8232
cuuacgaaaguauuu

SEQ ID NO: 2226220 - RNA, 18 nt, Streptococcus pyogenes MGAS8232
cuuaucaagguugcaagu

SEQ ID NO: 2226221 - RNA, 14 nt, Streptococcus pyogenes MGAS8232
cuuauaugaaagaa

SEQ ID NO: 2226222 - RNA, 20 nt, Streptococcus pyogenes MGAS8232
cuucaucgaugauagcuuuu

SEQ ID NO: 2226223 - RNA, 21 nt, Streptococcus pyogenes MGAS8232
cuucaucgaugauagcuuuua

SEQ ID NO: 2226224 - RNA, 17 nt, Streptococcus pyogenes MGAS8232
cuuaucucuugaggccu

SEQ ID NO: 2226225 - RNA, 13 nt, Streptococcus pyogenes MGAS8232
cuuggaaaacaga

SEQ ID NO: 2226226 - RNA, 14 nt, Streptococcus pyogenes MGAS8232
cuuguuacaaaaaa

SEQ ID NO: 2226227 - RNA, 21 nt, Streptococcus pyogenes MGAS8232
cuuguuauccucccagccauc

SEQ ID NO: 2226228 - RNA, 17 nt, Streptococcus pyogenes MGAS8232
cuuguucuuuauuuuga

SEQ ID NO: 2226229 - RNA, 12 nt, Streptococcus pyogenes MGAS8232
cuuguucugguu

SEQ ID NO: 2226230 - RNA, 22 nt, Streptococcus pyogenes MGAS8232
cuuguuuugguugauauaaaau

SEQ ID NO: 2226231 - RNA, 21 nt, Streptococcus pyogenes MGAS8232
cuuguuuugguugauauaaaa

SEQ ID NO: 2226232 - RNA, 14 nt, Streptococcus pyogenes MGAS8232
cuuguuuugguuga

SEQ ID NO: 2226233 - RNA, 11 nt, Streptococcus pyogenes MGAS8232
cuuuaaaaagu

SEQ ID NO: 2226234 - RNA, 19 nt, Streptococcus pyogenes MGAS8232
cuuuaacaaugagaucuuc

SEQ ID NO: 2226235 - RNA, 23 nt, Streptococcus pyogenes MGAS8232
cuuuaacaaugagaucuucuuuu

SEQ ID NO: 2226236 - RNA, 18 nt, Streptococcus pyogenes MGAS8232
cuuuaucagucuguccaa

SEQ ID NO: 2226237 - RNA, 17 nt, Streptococcus pyogenes MGAS8232
cuuuaccuccuaauuua

SEQ ID NO: 2226238 - RNA, 16 nt, Streptococcus pyogenes MGAS8232
cuuuaauaguuuuaca

SEQ ID NO: 2226239 - RNA, 22 nt, Streptococcus pyogenes MGAS8232
cuugcguagauagcaaggauga

SEQ ID NO: 2226240 - RNA, 14 nt, Streptococcus pyogenes MGAS8232
cuugcuuugacaaa

SEQ ID NO: 2226241 - RNA, 20 nt, Streptococcus pyogenes MGAS8232
cuugcucauguuuucucaac

SEQ ID NO: 2226242 - RNA, 12 nt, Streptococcus pyogenes MGAS8232
cuucuuuccagc

SEQ ID NO: 2226243 - RNA, 19 nt, Streptococcus pyogenes MGAS8232
cuucugaugcguuuauaaa

SEQ ID NO: 2226244 - RNA, 13 nt, Streptococcus pyogenes MGAS8232
cuucuucuuuuca

SEQ ID NO: 2226245 - RNA, 12 nt, Streptococcus pyogenes MGAS8232
cuucuucuuuuc

SEQ ID NO: 2226246 - RNA, 23 nt, Streptococcus pyogenes MGAS8232
cuucuugaagccgcucuaauuua

SEQ ID NO: 2226247 - RNA, 15 nt, Streptococcus pyogenes MGAS8232
cuucuuacuaugaaa

SEQ ID NO: 2226248 - RNA, 15 nt, Streptococcus pyogenes MGAS8232
cuggcagcuucauuu

SEQ ID NO: 2226249 - RNA, 19 nt, Streptococcus pyogenes MGAS8232
cuggcauuugucuguggcu

SEQ ID NO: 2226250 - RNA, 19 nt, Streptococcus pyogenes MGAS8232
cuggaaucgaucgucucgg

SEQ ID NO: 2226251 - RNA, 21 nt, Streptococcus pyogenes MGAS8232
cuggaaacuggucaaaagcua

SEQ ID NO: 2226252 - RNA, 24 nt, Streptococcus pyogenes MGAS8232
cuggaaagcgucaucuuaacgaaa

SEQ ID NO: 2226253 - RNA, 13 nt, Streptococcus pyogenes MGAS8232
cuguauaaacuug

SEQ ID NO: 2226254 - RNA, 20 nt, Streptococcus pyogenes MGAS8232
cugucaacuuaccagcaccu

SEQ ID NO: 2226255 - RNA, 23 nt, Streptococcus pyogenes MGAS8232
cugucaacuuaccagcaccuucu

SEQ ID NO: 2226256 - RNA, 19 nt, Streptococcus pyogenes MGAS8232
cugucaaaaaauuaagaag

SEQ ID NO: 2226257 - RNA, 18 nt, Streptococcus pyogenes MGAS8232
cuguauuccauacuucca

SEQ ID NO: 2226258 - RNA, 18 nt, Streptococcus pyogenes MGAS8232
cugcaauauccauagaaa

SEQ ID NO: 2226259 - RNA, 23 nt, Streptococcus pyogenes MGAS8232
cugcaauauccauagaaauugua

SEQ ID NO: 2226260 - RNA, 22 nt, Streptococcus pyogenes MGAS8232
cucuauuugaaguaaaggauuu

SEQ ID NO: 2226261 - RNA, 18 nt, Streptococcus pyogenes MGAS8232
cucuauuuacucaucuac

SEQ ID NO: 2226262 - RNA, 14 nt, Streptococcus pyogenes MGAS8232
cugaguucuuuuuc

SEQ ID NO: 2226263 - RNA, 18 nt, Streptococcus pyogenes MGAS8232
cugaucccuucauuuuac

SEQ ID NO: 2226264 - RNA, 19 nt, Streptococcus pyogenes MGAS8232
cugauaagguuuuuuuaag

SEQ ID NO: 2226265 - RNA, 13 nt, Streptococcus pyogenes MGAS8232
cugccauauuuuu

SEQ ID NO: 2226266 - RNA, 19 nt, Streptococcus pyogenes MGAS8232
cuauaaacgguaauuuauu

SEQ ID NO: 2226267 - RNA, 16 nt, Streptococcus pyogenes MGAS8232
cuauaccuaaaaaaua

SEQ ID NO: 2226268 - RNA, 21 nt, Streptococcus pyogenes MGAS8232
cuauagaaaguuauaaagaaa

SEQ ID NO: 2226269 - RNA, 16 nt, Streptococcus pyogenes MGAS8232
cuaugaucuguuuaaa

SEQ ID NO: 2226270 - RNA, 17 nt, Streptococcus pyogenes MGAS8232
cuauggcuucuaaaaaa

SEQ ID NO: 2226271 - RNA, 15 nt, Streptococcus pyogenes MGAS8232
cuaugaaaaaagaac

SEQ ID NO: 2226272 - RNA, 20 nt, Streptococcus pyogenes MGAS8232
cuacuagccuguccuagucu

SEQ ID NO: 2226273 - RNA, 19 nt, Streptococcus pyogenes MGAS8232
cuacuaaaacgugagaaaa

SEQ ID NO: 2226274 - RNA, 18 nt, Streptococcus pyogenes MGAS8232
cuagcauaaugcauguaa

SEQ ID NO: 2226275 - RNA, 12 nt, Streptococcus pyogenes MGAS8232
cuagcacaaaau

SEQ ID NO: 2226276 - RNA, 15 nt, Streptococcus pyogenes MGAS8232
cuaccuacuacuuca

SEQ ID NO: 2226277 - RNA, 17 nt, Streptococcus pyogenes MGAS8232
cucaugggcaaauaaac

SEQ ID NO: 2226278 - RNA, 22 nt, Streptococcus pyogenes MGAS8232
cucagagcuuuuuuuguuuugg

SEQ ID NO: 2226279 - RNA, 14 nt, Streptococcus pyogenes MGAS8232
cucagagacaauaa

SEQ ID NO: 2226280 - RNA, 11 nt, Streptococcus pyogenes MGAS8232
cuauuuaaccu

SEQ ID NO: 2226281 - RNA, 17 nt, Streptococcus pyogenes MGAS8232
cuauuuaaccuucaaca

SEQ ID NO: 2226282 - RNA, 20 nt, Streptococcus pyogenes MGAS8232
cuauuagcauaccuaaaaga

SEQ ID NO: 2226283 - RNA, 22 nt, Streptococcus pyogenes MGAS8232
cuauuagcauaccuaaaagaac

SEQ ID NO: 2226284 - RNA, 19 nt, Streptococcus pyogenes MGAS8232
cuauuaccuauagaaaguu

SEQ ID NO: 2226285 - RNA, 23 nt, Streptococcus pyogenes MGAS8232
cuauuuagguacucguaagcauu

SEQ ID NO: 2226286 - RNA, 12 nt, Streptococcus pyogenes MGAS8232
cuauuuuaagua

SEQ ID NO: 2226287 - RNA, 17 nt, Streptococcus pyogenes MGAS8232
cuauuuugugacuauau

SEQ ID NO: 2226288 - RNA, 15 nt, Streptococcus pyogenes MGAS8232
cucgguuuuuuuaag

SEQ ID NO: 2226289 - RNA, 14 nt, Streptococcus pyogenes MGAS8232
cucccuuuaauucu

SEQ ID NO: 2226290 - RNA, 17 nt, Streptococcus pyogenes MGAS8232
cuccguuucuaguuuca

SEQ ID NO: 2226291 - RNA, 19 nt, Streptococcus pyogenes MGAS8232
cuccuaggacgaaacauuu

SEQ ID NO: 2226292 - RNA, 13 nt, Streptococcus pyogenes MGAS8232
cguuaacaaaaau

SEQ ID NO: 2226293 - RNA, 20 nt, Streptococcus pyogenes MGAS8232
cguuaaguggaauguuuacu

SEQ ID NO: 2226294 - RNA, 17 nt, Streptococcus pyogenes MGAS8232
cguuagcagacaaaagg

SEQ ID NO: 2226295 - RNA, 21 nt, Streptococcus pyogenes MGAS8232
cguuuuacggcuucuacacaa

SEQ ID NO: 2226296 - RNA, 12 nt, Streptococcus pyogenes MGAS8232
cuaaaaaauaac

SEQ ID NO: 2226297 - RNA, 13 nt, Streptococcus pyogenes MGAS8232
cuaaaaaaaaguu

SEQ ID NO: 2226298 - RNA, 16 nt, Streptococcus pyogenes MGAS8232
cuaaaagcauaaaaau

SEQ ID NO: 2226299 - RNA, 22 nt, Streptococcus pyogenes MGAS8232
cguuuaaauguccgaaaaaaac

SEQ ID NO: 2226300 - RNA, 23 nt, Streptococcus pyogenes MGAS8232
cuaacauggauaccauuucuuug

SEQ ID NO: 2226301 - RNA, 21 nt, Streptococcus pyogenes MGAS8232
cuaaagcaucagcauaaccuu

SEQ ID NO: 2226302 - RNA, 17 nt, Streptococcus pyogenes MGAS8232
cgucuuuguccauucuu

SEQ ID NO: 2226303 - RNA, 22 nt, Streptococcus pyogenes MGAS8232
cgcugaaagucuuagcaccgcu

SEQ ID NO: 2226304 - RNA, 13 nt, Streptococcus pyogenes MGAS8232
cgcuuccagaaca

SEQ ID NO: 2226305 - RNA, 14 nt, Streptococcus pyogenes MGAS8232
cguaacuugcuuug

SEQ ID NO: 2226306 - RNA, 20 nt, Streptococcus pyogenes MGAS8232
cguaaggguuacuauuuagg

SEQ ID NO: 2226307 - RNA, 17 nt, Streptococcus pyogenes MGAS8232
cguaaugucuuguucug

SEQ ID NO: 2226308 - RNA, 14 nt, Streptococcus pyogenes MGAS8232
cgguauucuuuuuc

SEQ ID NO: 2226309 - RNA, 18 nt, Streptococcus pyogenes MGAS8232
cgguaauuuauuccauuu

SEQ ID NO: 2226310 - RNA, 13 nt, Streptococcus pyogenes MGAS8232
ccgaguuuugcug

SEQ ID NO: 2226311 - RNA, 13 nt, Streptococcus pyogenes MGAS8232
ccgaaaaaaacuu

SEQ ID NO: 2226312 - RNA, 15 nt, Streptococcus pyogenes MGAS8232
cccugcuggcuuuuu

SEQ ID NO: 2226313 - RNA, 14 nt, Streptococcus pyogenes MGAS8232
ccuguauuucuuug

SEQ ID NO: 2226314 - RNA, 15 nt, Streptococcus pyogenes MGAS8232
ccugucaagcccugc

SEQ ID NO: 2226315 - RNA, 16 nt, Streptococcus pyogenes MGAS8232
ccugucaagcccugcu

SEQ ID NO: 2226316 - RNA, 23 nt, Streptococcus pyogenes MGAS8232
ccugucaacuuaccagcaccuuc

SEQ ID NO: 2226317 - RNA, 16 nt, Streptococcus pyogenes MGAS8232
ccuguccuagucuuuu

SEQ ID NO: 2226318 - RNA, 17 nt, Streptococcus pyogenes MGAS8232
ccugcucaauugcuuuu

SEQ ID NO: 2226319 - RNA, 16 nt, Streptococcus pyogenes MGAS8232
ccucuuuagaauucuu

SEQ ID NO: 2226320 - RNA, 23 nt, Streptococcus pyogenes MGAS8232
ccuccuaaacuaauaagauucaa

SEQ ID NO: 2226321 - RNA, 13 nt, Streptococcus pyogenes MGAS8232
ccuccaccaaaac

SEQ ID NO: 2226322 - RNA, 19 nt, Streptococcus pyogenes MGAS8232
ccuacgauaaaacaaauaa

SEQ ID NO: 2226323 - RNA, 12 nt, Streptococcus pyogenes MGAS8232
ccgugaggacuu

SEQ ID NO: 2226324 - RNA, 19 nt, Streptococcus pyogenes MGAS8232
ccuaaauugguuuuuuagu

SEQ ID NO: 2226325 - RNA, 21 nt, Streptococcus pyogenes MGAS8232
cgauaauaaagugcgcuucca

SEQ ID NO: 2226326 - RNA, 17 nt, Streptococcus pyogenes MGAS8232
cgauaaucuuugacaau

SEQ ID NO: 2226327 - RNA, 21 nt, Streptococcus pyogenes MGAS8232
cgacugcaauagcaugacugu

SEQ ID NO: 2226328 - RNA, 18 nt, Streptococcus pyogenes MGAS8232
cgagauuccuucuuuuuc

SEQ ID NO: 2226329 - RNA, 16 nt, Streptococcus pyogenes MGAS8232
cgcagaguacaaggca

SEQ ID NO: 2226330 - RNA, 17 nt, Streptococcus pyogenes MGAS8232
ccuuuuugccuuuaaca

SEQ ID NO: 2226331 - RNA, 18 nt, Streptococcus pyogenes MGAS8232
ccuuuuuuauugaugauu

SEQ ID NO: 2226332 - RNA, 23 nt, Streptococcus pyogenes MGAS8232
cgaaaaaggggagacggauuuaa

SEQ ID NO: 2226333 - RNA, 14 nt, Streptococcus pyogenes MGAS8232
ccuuuaucuuauuu

SEQ ID NO: 2226334 - RNA, 21 nt, Streptococcus pyogenes MGAS8232
ccuuuagagaaucaaggggau

SEQ ID NO: 2226335 - RNA, 16 nt, Streptococcus pyogenes MGAS8232
cgaacaauaauauaau

SEQ ID NO: 2226336 - RNA, 21 nt, Streptococcus pyogenes MGAS8232
ccuugcaauagagccaagauu

SEQ ID NO: 2226337 - RNA, 20 nt, Streptococcus pyogenes MGAS8232
ccuucguauuggccuucuug

SEQ ID NO: 2226338 - RNA, 22 nt, Streptococcus pyogenes MGAS8232
ccuucuuugucgcuauggcuua

SEQ ID NO: 2226339 - RNA, 13 nt, Streptococcus pyogenes MGAS8232
cgaagucucuuuu

SEQ ID NO: 2226340 - RNA, 15 nt, Streptococcus pyogenes MGAS8232
ccaugcucauaggca

SEQ ID NO: 2226341 - RNA, 15 nt, Streptococcus pyogenes MGAS8232
ccauuaauaauauua

SEQ ID NO: 2226342 - RNA, 15 nt, Streptococcus pyogenes MGAS8232
ccauuauaaaucuua

SEQ ID NO: 2226343 - RNA, 16 nt, Streptococcus pyogenes MGAS8232
ccauuauaaaucuuac

SEQ ID NO: 2226344 - RNA, 16 nt, Streptococcus pyogenes MGAS8232
ccaucugcacaugcuu

SEQ ID NO: 2226345 - RNA, 20 nt, Streptococcus pyogenes MGAS8232
ccaugccuaaaucccaucga

SEQ ID NO: 2226346 - RNA, 22 nt, Streptococcus pyogenes MGAS8232
ccaucaacaaguguuuugucuu

SEQ ID NO: 2226347 - RNA, 11 nt, Streptococcus pyogenes MGAS8232
ccauauaugcg

SEQ ID NO: 2226348 - RNA, 11 nt, Streptococcus pyogenes MGAS8232
ccauagaagcc

SEQ ID NO: 2226349 - RNA, 12 nt, Streptococcus pyogenes MGAS8232
ccagcuuacagc

SEQ ID NO: 2226350 - RNA, 15 nt, Streptococcus pyogenes MGAS8232
ccacaccuaauaaaa

SEQ ID NO: 2226351 - RNA, 15 nt, Streptococcus pyogenes MGAS8232
ccaauuguugaauaa

SEQ ID NO: 2226352 - RNA, 22 nt, Streptococcus pyogenes MGAS8232
ccacaaaagacaacgacgcuua

SEQ ID NO: 2226353 - RNA, 13 nt, Streptococcus pyogenes MGAS8232
ccaaugacuaagg

SEQ ID NO: 2226354 - RNA, 20 nt, Streptococcus pyogenes MGAS8232
ccaaggucugcgcgacuaaa

SEQ ID NO: 2226355 - RNA, 19 nt, Streptococcus pyogenes MGAS8232
ccaaauuucagauaagacc

SEQ ID NO: 2226356 - RNA, 19 nt, Streptococcus pyogenes MGAS8232
ccaaccuaucacgccagua

SEQ ID NO: 2226357 - RNA, 19 nt, Streptococcus pyogenes MGAS8232
ccagccaucaauagcagca

SEQ ID NO: 2226358 - RNA, 20 nt, Streptococcus pyogenes MGAS8232
caguauguaaauauaaaguc

SEQ ID NO: 2226359 - RNA, 14 nt, Streptococcus pyogenes MGAS8232
cagguguuuaaaga

SEQ ID NO: 2226360 - RNA, 23 nt, Streptococcus pyogenes MGAS8232
cauaaugcauguaaugaccaccc

SEQ ID NO: 2226361 - RNA, 18 nt, Streptococcus pyogenes MGAS8232
cauaaaagauauuuuaaa

SEQ ID NO: 2226362 - RNA, 14 nt, Streptococcus pyogenes MGAS8232
caguccgucaaaaa

SEQ ID NO: 2226363 - RNA, 13 nt, Streptococcus pyogenes MGAS8232
cagcuaaaagcau

SEQ ID NO: 2226364 - RNA, 23 nt, Streptococcus pyogenes MGAS8232
caggauauugagaagaaaaaauu

SEQ ID NO: 2226365 - RNA, 21 nt, Streptococcus pyogenes MGAS8232
cauggcuaaugauaaggcugc

SEQ ID NO: 2226366 - RNA, 16 nt, Streptococcus pyogenes MGAS8232
cauguaaugaccaccc

SEQ ID NO: 2226367 - RNA, 19 nt, Streptococcus pyogenes MGAS8232
cauguaaugaccacccuca

SEQ ID NO: 2226368 - RNA, 17 nt, Streptococcus pyogenes MGAS8232
caugauguuuauuccaa

SEQ ID NO: 2226369 - RNA, 21 nt, Streptococcus pyogenes MGAS8232
caugaugccauuuaaaagggc

SEQ ID NO: 2226370 - RNA, 20 nt, Streptococcus pyogenes MGAS8232
caugaggcaaaugaaaaaac

SEQ ID NO: 2226371 - RNA, 22 nt, Streptococcus pyogenes MGAS8232
caugaaguauaguuauguuaua

SEQ ID NO: 2226372 - RNA, 20 nt, Streptococcus pyogenes MGAS8232
caugacacuuaaaugcaaaa

SEQ ID NO: 2226373 - RNA, 15 nt, Streptococcus pyogenes MGAS8232
cauuuccuacaaaau

SEQ ID NO: 2226374 - RNA, 15 nt, Streptococcus pyogenes MGAS8232
cauugucaaauaaaa

SEQ ID NO: 2226375 - RNA, 17 nt, Streptococcus pyogenes MGAS8232
cauugucaaauaaaauc

SEQ ID NO: 2226376 - RNA, 17 nt, Streptococcus pyogenes MGAS8232
cauugucaaagcugaca

SEQ ID NO: 2226377 - RNA, 21 nt, Streptococcus pyogenes MGAS8232
cauugccauuaauaauauuaa

SEQ ID NO: 2226378 - RNA, 17 nt, Streptococcus pyogenes MGAS8232
cauuaccuuauuuucua

SEQ ID NO: 2226379 - RNA, 14 nt, Streptococcus pyogenes MGAS8232
cauuauugacaaau

SEQ ID NO: 2226380 - RNA, 21 nt, Streptococcus pyogenes MGAS8232
cauuauugacaaauccaauga

SEQ ID NO: 2226381 - RNA, 17 nt, Streptococcus pyogenes MGAS8232
cauagguugcaccacca

SEQ ID NO: 2226382 - RNA, 19 nt, Streptococcus pyogenes MGAS8232
caucaacaaguguuuuguc

SEQ ID NO: 2226383 - RNA, 22 nt, Streptococcus pyogenes MGAS8232
caucaacaaguguuuugucuua

SEQ ID NO: 2226384 - RNA, 11 nt, Streptococcus pyogenes MGAS8232
caucaauagca

SEQ ID NO: 2226385 - RNA, 18 nt, Streptococcus pyogenes MGAS8232
caucagaauaagaaaacc

SEQ ID NO: 2226386 - RNA, 16 nt, Streptococcus pyogenes MGAS8232
caucacguacagaaau

SEQ ID NO: 2226387 - RNA, 17 nt, Streptococcus pyogenes MGAS8232
caucagcucucaagaga

SEQ ID NO: 2226388 - RNA, 20 nt, Streptococcus pyogenes MGAS8232
caucguuaaguggaauguuu

SEQ ID NO: 2226389 - RNA, 17 nt, Streptococcus pyogenes MGAS8232
caucuacagcaccuuca

SEQ ID NO: 2226390 - RNA, 11 nt, Streptococcus pyogenes MGAS8232
caaaauuauua

SEQ ID NO: 2226391 - RNA, 19 nt, Streptococcus pyogenes MGAS8232
caaaauuauuauuuugcuu

SEQ ID NO: 2226392 - RNA, 21 nt, Streptococcus pyogenes MGAS8232
caaaaguuggcuacucuauuu

SEQ ID NO: 2226393 - RNA, 14 nt, Streptococcus pyogenes MGAS8232
caaacuauauuguu

SEQ ID NO: 2226394 - RNA, 15 nt, Streptococcus pyogenes MGAS8232
caaacuauauuguua

SEQ ID NO: 2226395 - RNA, 16 nt, Streptococcus pyogenes MGAS8232
caaacuaaacaaacgg

SEQ ID NO: 2226396 - RNA, 15 nt, Streptococcus pyogenes MGAS8232
caaacggaguuccuc

SEQ ID NO: 2226397 - RNA, 13 nt, Streptococcus pyogenes MGAS8232
caaaccauuuuau

SEQ ID NO: 2226398 - RNA, 20 nt, Streptococcus pyogenes MGAS8232
caaaccauuuuaugagaaaa

SEQ ID NO: 2226399 - RNA, 14 nt, Streptococcus pyogenes MGAS8232
caaaucaacauggc

SEQ ID NO: 2226400 - RNA, 24 nt, Streptococcus pyogenes MGAS8232
caaaucaacauggcuaaugauaag

SEQ ID NO: 2226401 - RNA, 20 nt, Streptococcus pyogenes MGAS8232
caaauacugguauguugauu

SEQ ID NO: 2226402 - RNA, 21 nt, Streptococcus pyogenes MGAS8232
caaauccgcuugcagcauaau

SEQ ID NO: 2226403 - RNA, 23 nt, Streptococcus pyogenes MGAS8232
caaauccgcuugcagcauaauca

SEQ ID NO: 2226404 - RNA, 22 nt, Streptococcus pyogenes MGAS8232
caacaaguguuuugucuuauag

SEQ ID NO: 2226405 - RNA, 14 nt, Streptococcus pyogenes MGAS8232
caacauacuuuauu

SEQ ID NO: 2226406 - RNA, 14 nt, Streptococcus pyogenes MGAS8232
caaggcaagaggag

SEQ ID NO: 2226407 - RNA, 18 nt, Streptococcus pyogenes MGAS8232
caagcucgguuuuaaacu

SEQ ID NO: 2226408 - RNA, 15 nt, Streptococcus pyogenes MGAS8232
caagucuuagaaaua

SEQ ID NO: 2226409 - RNA, 22 nt, Streptococcus pyogenes MGAS8232
caagugauaaccuuaaagaccc

SEQ ID NO: 2226410 - RNA, 17 nt, Streptococcus pyogenes MGAS8232
caagugauacuugguau

SEQ ID NO: 2226411 - RNA, 22 nt, Streptococcus pyogenes MGAS8232
caagugacccguuuuccugcuc

SEQ ID NO: 2226412 - RNA, 17 nt, Streptococcus pyogenes MGAS8232
caauauaauaaaaagua

SEQ ID NO: 2226413 - RNA, 23 nt, Streptococcus pyogenes MGAS8232
caauagcaaguccugcuuuugau

SEQ ID NO: 2226414 - RNA, 15 nt, Streptococcus pyogenes MGAS8232
caauagcagcaacaa

SEQ ID NO: 2226415 - RNA, 15 nt, Streptococcus pyogenes MGAS8232
caaucaccuuucuau

SEQ ID NO: 2226416 - RNA, 20 nt, Streptococcus pyogenes MGAS8232
caauaugugauuauuauucu

SEQ ID NO: 2226417 - RNA, 19 nt, Streptococcus pyogenes MGAS8232
caagagcuuaaaaguuagc

SEQ ID NO: 2226418 - RNA, 15 nt, Streptococcus pyogenes MGAS8232
caagaggaguugaac

SEQ ID NO: 2226419 - RNA, 14 nt, Streptococcus pyogenes MGAS8232
caagaggaguugaa

SEQ ID NO: 2226420 - RNA, 19 nt, Streptococcus pyogenes MGAS8232
caacuugggagaguuccug

SEQ ID NO: 2226421 - RNA, 20 nt, Streptococcus pyogenes MGAS8232
caagaauagcuuuuguaaua

SEQ ID NO: 2226422 - RNA, 17 nt, Streptococcus pyogenes MGAS8232
caagaaguuuuauagcu

SEQ ID NO: 2226423 - RNA, 18 nt, Streptococcus pyogenes MGAS8232
caaccuuaaacaugccuu

SEQ ID NO: 2226424 - RNA, 12 nt, Streptococcus pyogenes MGAS8232
caacauagcuaa

SEQ ID NO: 2226425 - RNA, 11 nt, Streptococcus pyogenes MGAS8232
caacaucaagg

SEQ ID NO: 2226426 - RNA, 17 nt, Streptococcus pyogenes MGAS8232
auuuugguugauagaag

SEQ ID NO: 2226427 - RNA, 17 nt, Streptococcus pyogenes MGAS8232
auuuuggagagauuuuu

SEQ ID NO: 2226428 - RNA, 18 nt, Streptococcus pyogenes MGAS8232
auuuuuacauuuuuacaa

SEQ ID NO: 2226429 - RNA, 19 nt, Streptococcus pyogenes MGAS8232
auuugacuuguuacaaaaa

SEQ ID NO: 2226430 - RNA, 20 nt, Streptococcus pyogenes MGAS8232
auuugacuuguuacaaaaaa

SEQ ID NO: 2226431 - RNA, 22 nt, Streptococcus pyogenes MGAS8232
auuugaccacaccuaauaaaau

SEQ ID NO: 2226432 - RNA, 19 nt, Streptococcus pyogenes MGAS8232
auuugccauggcaagagca

SEQ ID NO: 2226433 - RNA, 22 nt, Streptococcus pyogenes MGAS8232
auuugcagaggcuugcauuuuu

SEQ ID NO: 2226434 - RNA, 19 nt, Streptococcus pyogenes MGAS8232
auuuuaaucuuuuugugau

SEQ ID NO: 2226435 - RNA, 14 nt, Streptococcus pyogenes MGAS8232
auuuuaauuuuucu

SEQ ID NO: 2226436 - RNA, 13 nt, Streptococcus pyogenes MGAS8232
auuuuaauuuuuc

SEQ ID NO: 2226437 - RNA, 14 nt, Streptococcus pyogenes MGAS8232
auuuuaauuuuucc

SEQ ID NO: 2226438 - RNA, 14 nt, Streptococcus pyogenes MGAS8232
auuuguuuucuuua

SEQ ID NO: 2226439 - RNA, 13 nt, Streptococcus pyogenes MGAS8232
auuuggaggugaa

SEQ ID NO: 2226440 - RNA, 18 nt, Streptococcus pyogenes MGAS8232
auuuaagguauuguucaa

SEQ ID NO: 2226441 - RNA, 17 nt, Streptococcus pyogenes MGAS8232
auuuaagguauuguuca

SEQ ID NO: 2226442 - RNA, 18 nt, Streptococcus pyogenes MGAS8232
auuguuuuaguaaagccu

SEQ ID NO: 2226443 - RNA, 16 nt, Streptococcus pyogenes MGAS8232
auuuccuacaaaauaa

SEQ ID NO: 2226444 - RNA, 22 nt, Streptococcus pyogenes MGAS8232
auuuaugcugauuuuggaugaa

SEQ ID NO: 2226445 - RNA, 18 nt, Streptococcus pyogenes MGAS8232
auuucacuagacauucgu

SEQ ID NO: 2226446 - RNA, 15 nt, Streptococcus pyogenes MGAS8232
auuuccaagcuguca

SEQ ID NO: 2226447 - RNA, 16 nt, Streptococcus pyogenes MGAS8232
auuccuucuuuuuccu

SEQ ID NO: 2226448 - RNA, 23 nt, Streptococcus pyogenes MGAS8232
auuccucaaacacguauuuuucg

SEQ ID NO: 2226449 - RNA, 19 nt, Streptococcus pyogenes MGAS8232
auucaugacgccuccaaau

SEQ ID NO: 2226450 - RNA, 14 nt, Streptococcus pyogenes MGAS8232
auuccauacuucca

SEQ ID NO: 2226451 - RNA, 14 nt, Streptococcus pyogenes MGAS8232
auucuaacauggau

SEQ ID NO: 2226452 - RNA, 15 nt, Streptococcus pyogenes MGAS8232
auucuuuauaauggu

SEQ ID NO: 2226453 - RNA, 14 nt, Streptococcus pyogenes MGAS8232
auuggaaaauauau

SEQ ID NO: 2226454 - RNA, 20 nt, Streptococcus pyogenes MGAS8232
auugcaugaggcaaaugaaa

SEQ ID NO: 2226455 - RNA, 22 nt, Streptococcus pyogenes MGAS8232
auugaucucugcaacaucaagg

SEQ ID NO: 2226456 - RNA, 23 nt, Streptococcus pyogenes MGAS8232
auugaucucugcaacaucaaggg

SEQ ID NO: 2226457 - RNA, 21 nt, Streptococcus pyogenes MGAS8232
auugacaaauccaaugacuaa

SEQ ID NO: 2226458 - RNA, 17 nt, Streptococcus pyogenes MGAS8232
auugcagcuaaaaacaa

SEQ ID NO: 2226459 - RNA, 17 nt, Streptococcus pyogenes MGAS8232
auugauuauucucuauu

SEQ ID NO: 2226460 - RNA, 18 nt, Streptococcus pyogenes MGAS8232
cacuaucugauacagagc

SEQ ID NO: 2226461 - RNA, 15 nt, Streptococcus pyogenes MGAS8232
cacuauuuugugacu

SEQ ID NO: 2226462 - RNA, 23 nt, Streptococcus pyogenes MGAS8232
caccuacgauaaaacaaauaauu

SEQ ID NO: 2226463 - RNA, 22 nt, Streptococcus pyogenes MGAS8232
caccuucguauuggccuucuug

SEQ ID NO: 2226464 - RNA, 21 nt, Streptococcus pyogenes MGAS8232
caccuuaggcagacaauuauu

SEQ ID NO: 2226465 - RNA, 12 nt, Streptococcus pyogenes MGAS8232
caccaccaaccu

SEQ ID NO: 2226466 - RNA, 12 nt, Streptococcus pyogenes MGAS8232
caccaaaaaaag

SEQ ID NO: 2226467 - RNA, 14 nt, Streptococcus pyogenes MGAS8232
caccaaaaaaagca

SEQ ID NO: 2226468 - RNA, 23 nt, Streptococcus pyogenes MGAS8232
cacauuuuaaucuuuuugugaua

SEQ ID NO: 2226469 - RNA, 11 nt, Streptococcus pyogenes MGAS8232
cacagcaauuu

SEQ ID NO: 2226470 - RNA, 21 nt, Streptococcus pyogenes MGAS8232
cacagcaauuuguuccaucug

SEQ ID NO: 2226471 - RNA, 21 nt, Streptococcus pyogenes MGAS8232
cacauaaugauuuuuaauucu

SEQ ID NO: 2226472 - RNA, 20 nt, Streptococcus pyogenes MGAS8232
caauuaauguuaggagcaca

SEQ ID NO: 2226473 - RNA, 22 nt, Streptococcus pyogenes MGAS8232
caauucaagguaguaaugacga

SEQ ID NO: 2226474 - RNA, 14 nt, Streptococcus pyogenes MGAS8232
caauucagcaucgu

SEQ ID NO: 2226475 - RNA, 15 nt, Streptococcus pyogenes MGAS8232
caauugcuuuuagcc

SEQ ID NO: 2226476 - RNA, 20 nt, Streptococcus pyogenes MGAS8232
caauugcuuuuagccugcca

SEQ ID NO: 2226477 - RNA, 20 nt, Streptococcus pyogenes MGAS8232
auccuuuaucuuauuuuaag

SEQ ID NO: 2226478 - RNA, 16 nt, Streptococcus pyogenes MGAS8232
aucgccaauaaaaaag

SEQ ID NO: 2226479 - RNA, 17 nt, Streptococcus pyogenes MGAS8232
aucguaaugucuuguuc

SEQ ID NO: 2226480 - RNA, 14 nt, Streptococcus pyogenes MGAS8232
auccucccagccau

SEQ ID NO: 2226481 - RNA, 17 nt, Streptococcus pyogenes MGAS8232
auccucucacaaauaca

SEQ ID NO: 2226482 - RNA, 19 nt, Streptococcus pyogenes MGAS8232
auccucucacaaauacaga

SEQ ID NO: 2226483 - RNA, 23 nt, Streptococcus pyogenes MGAS8232
auccucucacaaauacagaagaa

SEQ ID NO: 2226484 - RNA, 11 nt, Streptococcus pyogenes MGAS8232
auccuacugac

SEQ ID NO: 2226485 - RNA, 18 nt, Streptococcus pyogenes MGAS8232
auccccucguuuaaaugu

SEQ ID NO: 2226486 - RNA, 18 nt, Streptococcus pyogenes MGAS8232
aucccuaugaucuguuua

SEQ ID NO: 2226487 - RNA, 13 nt, Streptococcus pyogenes MGAS8232
aucccaucuuugu

SEQ ID NO: 2226488 - RNA, 21 nt, Streptococcus pyogenes MGAS8232
aucauuuuggagagauuuuua

SEQ ID NO: 2226489 - RNA, 22 nt, Streptococcus pyogenes MGAS8232
aucauguccaaggggugucuga

SEQ ID NO: 2226490 - RNA, 20 nt, Streptococcus pyogenes MGAS8232
aucauggagucaaugaaaag

SEQ ID NO: 2226491 - RNA, 22 nt, Streptococcus pyogenes MGAS8232
aucaucuuuguaguaggugaca

SEQ ID NO: 2226492 - RNA, 22 nt, Streptococcus pyogenes MGAS8232
aucauaaauaaagauaauuucu

SEQ ID NO: 2226493 - RNA, 18 nt, Streptococcus pyogenes MGAS8232
aucauauuguuaauaugu

SEQ ID NO: 2226494 - RNA, 16 nt, Streptococcus pyogenes MGAS8232
aucaguccuccucuuu

SEQ ID NO: 2226495 - RNA, 17 nt, Streptococcus pyogenes MGAS8232
aucaggcuuaaacauau

SEQ ID NO: 2226496 - RNA, 22 nt, Streptococcus pyogenes MGAS8232
augcauguaaugaccacccuca

SEQ ID NO: 2226497 - RNA, 13 nt, Streptococcus pyogenes MGAS8232
augcauguagaug

SEQ ID NO: 2226498 - RNA, 22 nt, Streptococcus pyogenes MGAS8232
augcuccuccaccaaaaccaag

SEQ ID NO: 2226499 - RNA, 17 nt, Streptococcus pyogenes MGAS8232
augcucauaggcagaga

SEQ ID NO: 2226500 - RNA, 19 nt, Streptococcus pyogenes MGAS8232
augcuugaguagcuacugc

SEQ ID NO: 2226501 - RNA, 21 nt, Streptococcus pyogenes MGAS8232
augcuugaguagcuacugccu

SEQ ID NO: 2226502 - RNA, 16 nt, Streptococcus pyogenes MGAS8232
augcuucuuucaaacg

SEQ ID NO: 2226503 - RNA, 19 nt, Streptococcus pyogenes MGAS8232
augcuguccaugauuuuca

SEQ ID NO: 2226504 - RNA, 20 nt, Streptococcus pyogenes MGAS8232
auggaaauuuuaaaugacau

SEQ ID NO: 2226505 - RNA, 21 nt, Streptococcus pyogenes MGAS8232
auggauauaacaacucccucc

SEQ ID NO: 2226506 - RNA, 21 nt, Streptococcus pyogenes MGAS8232
auggacuggcagcuucauuua

SEQ ID NO: 2226507 - RNA, 20 nt, Streptococcus pyogenes MGAS8232
auguuaggagcacaaaagag

SEQ ID NO: 2226508 - RNA, 23 nt, Streptococcus pyogenes MGAS8232
auguaccaauuuaagguauuguu

SEQ ID NO: 2226509 - RNA, 12 nt, Streptococcus pyogenes MGAS8232
auguauuuuuca

SEQ ID NO: 2226510 - RNA, 16 nt, Streptococcus pyogenes MGAS8232
auguauuuuucaaaau

SEQ ID NO: 2226511 - RNA, 16 nt, Streptococcus pyogenes MGAS8232
auggguaaaaugacug

SEQ ID NO: 2226512 - RNA, 17 nt, Streptococcus pyogenes MGAS8232
auggggugucaggggaa

SEQ ID NO: 2226513 - RNA, 16 nt, Streptococcus pyogenes MGAS8232
auguaaacaauugguu

SEQ ID NO: 2226514 - RNA, 22 nt, Streptococcus pyogenes MGAS8232
auguaaacaauugguuuacaug

SEQ ID NO: 2226515 - RNA, 16 nt, Streptococcus pyogenes MGAS8232
augaucuguuuaaaaa

SEQ ID NO: 2226516 - RNA, 17 nt, Streptococcus pyogenes MGAS8232
augaucuguuuaaaaac

SEQ ID NO: 2226517 - RNA, 21 nt, Streptococcus pyogenes MGAS8232
augaucuguuuaaaaacaaau

SEQ ID NO: 2226518 - RNA, 22 nt, Streptococcus pyogenes MGAS8232
augaugccauuuaaaagggcaa

SEQ ID NO: 2226519 - RNA, 16 nt, Streptococcus pyogenes MGAS8232
augauuuuaacguuuu

SEQ ID NO: 2226520 - RNA, 20 nt, Streptococcus pyogenes MGAS8232
augauugaguaagcagcauc

SEQ ID NO: 2226521 - RNA, 23 nt, Streptococcus pyogenes MGAS8232
augauuuuuaauucuucuuucca

SEQ ID NO: 2226522 - RNA, 14 nt, Streptococcus pyogenes MGAS8232
augauauaaaaaug

SEQ ID NO: 2226523 - RNA, 14 nt, Streptococcus pyogenes MGAS8232
augaggcaaaugaa

SEQ ID NO: 2226524 - RNA, 15 nt, Streptococcus pyogenes MGAS8232
augacgguaaauaaa

SEQ ID NO: 2226525 - RNA, 12 nt, Streptococcus pyogenes MGAS8232
augaauuuuguc

SEQ ID NO: 2226526 - RNA, 13 nt, Streptococcus pyogenes MGAS8232
augacacauuucg

SEQ ID NO: 2226527 - RNA, 21 nt, Streptococcus pyogenes MGAS8232
augacacauuucgguuauugu

SEQ ID NO: 2226528 - RNA, 14 nt, Streptococcus pyogenes MGAS8232
aucuuugacaaugu

SEQ ID NO: 2226529 - RNA, 19 nt, Streptococcus pyogenes MGAS8232
aucuuuguuucuauacaua

SEQ ID NO: 2226530 - RNA, 20 nt, Streptococcus pyogenes MGAS8232
aucuuuaucagucuguccaa

SEQ ID NO: 2226531 - RNA, 16 nt, Streptococcus pyogenes MGAS8232
aucuuguugggcacuu

SEQ ID NO: 2226532 - RNA, 14 nt, Streptococcus pyogenes MGAS8232
augaaaacguguau

SEQ ID NO: 2226533 - RNA, 18 nt, Streptococcus pyogenes MGAS8232
augaaaacguguauucuu

SEQ ID NO: 2226534 - RNA, 13 nt, Streptococcus pyogenes MGAS8232
augaaaaagaagu

SEQ ID NO: 2226535 - RNA, 14 nt, Streptococcus pyogenes MGAS8232
augaaaaaagaaca

SEQ ID NO: 2226536 - RNA, 18 nt, Streptococcus pyogenes MGAS8232
augaaaaaagaacaaaga

SEQ ID NO: 2226537 - RNA, 21 nt, Streptococcus pyogenes MGAS8232
aucuguauauuuaauagcauu

SEQ ID NO: 2226538 - RNA, 24 nt, Streptococcus pyogenes MGAS8232
aucugcuuggauuuccucuaacau

SEQ ID NO: 2226539 - RNA, 17 nt, Streptococcus pyogenes MGAS8232
aucuaaucgaacaauaa

SEQ ID NO: 2226540 - RNA, 16 nt, Streptococcus pyogenes MGAS8232
aucuguuuaaaaacaa

SEQ ID NO: 2226541 - RNA, 17 nt, Streptococcus pyogenes MGAS8232
aucuguuuaaaaacaaa

SEQ ID NO: 2226542 - RNA, 15 nt, Streptococcus pyogenes MGAS8232
aucuguuuaaaaaca

SEQ ID NO: 2226543 - RNA, 13 nt, Streptococcus pyogenes MGAS8232
aucuuauuuuaag

SEQ ID NO: 2226544 - RNA, 19 nt, Streptococcus pyogenes MGAS8232
auauccccuccuugcaaua

SEQ ID NO: 2226545 - RNA, 14 nt, Streptococcus pyogenes MGAS8232
auaugaaagaacua

SEQ ID NO: 2226546 - RNA, 18 nt, Streptococcus pyogenes MGAS8232
auauaaagucagacucaa

SEQ ID NO: 2226547 - RNA, 13 nt, Streptococcus pyogenes MGAS8232
auaguucccuuaa

SEQ ID NO: 2226548 - RNA, 10 nt, Streptococcus pyogenes MGAS8232
auauaaaauu

SEQ ID NO: 2226549 - RNA, 16 nt, Streptococcus pyogenes MGAS8232
auagcgaaaaaggguc

SEQ ID NO: 2226550 - RNA, 16 nt, Streptococcus pyogenes MGAS8232
auauaaggcaaucacc

SEQ ID NO: 2226551 - RNA, 14 nt, Streptococcus pyogenes MGAS8232
auaugucaucaaaa

SEQ ID NO: 2226552 - RNA, 17 nt, Streptococcus pyogenes MGAS8232
auaugugauuauuauuc

SEQ ID NO: 2226553 - RNA, 23 nt, Streptococcus pyogenes MGAS8232
auauuauaguaaccauugccauu

SEQ ID NO: 2226554 - RNA, 16 nt, Streptococcus pyogenes MGAS8232
auauuauauuaaauua

SEQ ID NO: 2226555 - RNA, 13 nt, Streptococcus pyogenes MGAS8232
auauucauuuucu

SEQ ID NO: 2226556 - RNA, 17 nt, Streptococcus pyogenes MGAS8232
auauugagaagaaaaaa

SEQ ID NO: 2226557 - RNA, 19 nt, Streptococcus pyogenes MGAS8232
aucaauaacagaaauuaau

SEQ ID NO: 2226558 - RNA, 17 nt, Streptococcus pyogenes MGAS8232
aucaagaauagcuuuug

SEQ ID NO: 2226559 - RNA, 15 nt, Streptococcus pyogenes MGAS8232
aucaaaagaccauaa

SEQ ID NO: 2226560 - RNA, 15 nt, Streptococcus pyogenes MGAS8232
auauuugaccgaaaa

SEQ ID NO: 2226561 - RNA, 18 nt, Streptococcus pyogenes MGAS8232
aucaaaggguguuuuuua

SEQ ID NO: 2226562 - RNA, 23 nt, Streptococcus pyogenes MGAS8232
auacaguccaaacucaaacuaaa

SEQ ID NO: 2226563 - RNA, 14 nt, Streptococcus pyogenes MGAS8232
auacauacaagucu

SEQ ID NO: 2226564 - RNA, 15 nt, Streptococcus pyogenes MGAS8232
auaaucugagcgguu

SEQ ID NO: 2226565 - RNA, 21 nt, Streptococcus pyogenes MGAS8232
auaauuaguauauuguaauaa

SEQ ID NO: 2226566 - RNA, 16 nt, Streptococcus pyogenes MGAS8232
auaauuucuuuuucau

SEQ ID NO: 2226567 - RNA, 18 nt, Streptococcus pyogenes MGAS8232
auaauuucuuuuucauuu

SEQ ID NO: 2226568 - RNA, 13 nt, Streptococcus pyogenes MGAS8232
auaccaacaaugu

SEQ ID NO: 2226569 - RNA, 23 nt, Streptococcus pyogenes MGAS8232
auaccaacaauguagcuaucaaa

SEQ ID NO: 2226570 - RNA, 21 nt, Streptococcus pyogenes MGAS8232
auaccauuucuuugcaaaaga

SEQ ID NO: 2226571 - RNA, 16 nt, Streptococcus pyogenes MGAS8232
auaccauuucuuugca

SEQ ID NO: 2226572 - RNA, 15 nt, Streptococcus pyogenes MGAS8232
auaccauuucuuugc

SEQ ID NO: 2226573 - RNA, 14 nt, Streptococcus pyogenes MGAS8232
auaccuaaaaaaua

SEQ ID NO: 2226574 - RNA, 16 nt, Streptococcus pyogenes MGAS8232
auagcauaaaauaguu

SEQ ID NO: 2226575 - RNA, 13 nt, Streptococcus pyogenes MGAS8232
auagcauaaaaua

SEQ ID NO: 2226576 - RNA, 18 nt, Streptococcus pyogenes MGAS8232
auagcauugucaaauaaa

SEQ ID NO: 2226577 - RNA, 22 nt, Streptococcus pyogenes MGAS8232
auagaccccuuaguucaaugga

SEQ ID NO: 2226578 - RNA, 23 nt, Streptococcus pyogenes MGAS8232
auagauaguugguauauagcuca

SEQ ID NO: 2226579 - RNA, 14 nt, Streptococcus pyogenes MGAS8232
auagaauaaccagc

SEQ ID NO: 2226580 - RNA, 12 nt, Streptococcus pyogenes MGAS8232
auaaaaaagaac

SEQ ID NO: 2226581 - RNA, 23 nt, Streptococcus pyogenes MGAS8232
auaaaaacgaucaaaaaucuuuu

SEQ ID NO: 2226582 - RNA, 16 nt, Streptococcus pyogenes MGAS8232
aguuuauguaugcugu

SEQ ID NO: 2226583 - RNA, 17 nt, Streptococcus pyogenes MGAS8232
aguuuaggauauaagaa

SEQ ID NO: 2226584 - RNA, 18 nt, Streptococcus pyogenes MGAS8232
aguugagacuaaaggucu

SEQ ID NO: 2226585 - RNA, 21 nt, Streptococcus pyogenes MGAS8232
aguugcgaucauaaauaaaga

SEQ ID NO: 2226586 - RNA, 14 nt, Streptococcus pyogenes MGAS8232
aguucuucuaaacg

SEQ ID NO: 2226587 - RNA, 18 nt, Streptococcus pyogenes MGAS8232
aguucgauuauuaaccaa

SEQ ID NO: 2226588 - RNA, 17 nt, Streptococcus pyogenes MGAS8232
aguuaucacuaaggcug

SEQ ID NO: 2226589 - RNA, 15 nt, Streptococcus pyogenes MGAS8232
aguucagcagcacug

SEQ ID NO: 2226590 - RNA, 13 nt, Streptococcus pyogenes MGAS8232
aguucagcagcac

SEQ ID NO: 2226591 - RNA, 22 nt, Streptococcus pyogenes MGAS8232
auaaaaauauucccaaugcccc

SEQ ID NO: 2226592 - RNA, 14 nt, Streptococcus pyogenes MGAS8232
auaaaagauauuuu

SEQ ID NO: 2226593 - RNA, 20 nt, Streptococcus pyogenes MGAS8232
auaaaagauauuuuaaaaua

SEQ ID NO: 2226594 - RNA, 17 nt, Streptococcus pyogenes MGAS8232
auaaaauuccccacaaa

SEQ ID NO: 2226595 - RNA, 21 nt, Streptococcus pyogenes MGAS8232
auaacaacgucaauuuuauca

SEQ ID NO: 2226596 - RNA, 15 nt, Streptococcus pyogenes MGAS8232
agugcgcuuccagaa

SEQ ID NO: 2226597 - RNA, 18 nt, Streptococcus pyogenes MGAS8232
agucuccauaacauacuc

SEQ ID NO: 2226598 - RNA, 21 nt, Streptococcus pyogenes MGAS8232
agucuccauaacauacucuau

SEQ ID NO: 2226599 - RNA, 23 nt, Streptococcus pyogenes MGAS8232
agucuaugcauguagaugaauuu

SEQ ID NO: 2226600 - RNA, 18 nt, Streptococcus pyogenes MGAS8232
agucccacugcacgugcu

SEQ ID NO: 2226601 - RNA, 20 nt, Streptococcus pyogenes MGAS8232
aguauauuguaauaacaaaa

SEQ ID NO: 2226602 - RNA, 23 nt, Streptococcus pyogenes MGAS8232
aguaucaccuugcuuauagcuac

SEQ ID NO: 2226603 - RNA, 14 nt, Streptococcus pyogenes MGAS8232
aguaugcuuuuaau

SEQ ID NO: 2226604 - RNA, 19 nt, Streptococcus pyogenes MGAS8232
aguaugcuuuuaauuuuau

SEQ ID NO: 2226605 - RNA, 21 nt, Streptococcus pyogenes MGAS8232
aguaucuaggagggacuguca

SEQ ID NO: 2226606 - RNA, 14 nt, Streptococcus pyogenes MGAS8232
agucagaucauuaa

SEQ ID NO: 2226607 - RNA, 13 nt, Streptococcus pyogenes MGAS8232
agucacaccguug

SEQ ID NO: 2226608 - RNA, 20 nt, Streptococcus pyogenes MGAS8232
agucacgaguguuaaaacga

SEQ ID NO: 2226609 - RNA, 13 nt, Streptococcus pyogenes MGAS8232
aguaguuucucau

SEQ ID NO: 2226610 - RNA, 19 nt, Streptococcus pyogenes MGAS8232
aguaguuucucauguuuua

SEQ ID NO: 2226611 - RNA, 15 nt, Streptococcus pyogenes MGAS8232
aguagcaccuuuuuu

SEQ ID NO: 2226612 - RNA, 13 nt, Streptococcus pyogenes MGAS8232
aguagcaccuuuu

SEQ ID NO: 2226613 - RNA, 13 nt, Streptococcus pyogenes MGAS8232
aguagcaaauaac

SEQ ID NO: 2226614 - RNA, 18 nt, Streptococcus pyogenes MGAS8232
aguagagacgucuggauu

SEQ ID NO: 2226615 - RNA, 16 nt, Streptococcus pyogenes MGAS8232
agccuauuuaauaggc

SEQ ID NO: 2226616 - RNA, 14 nt, Streptococcus pyogenes MGAS8232
agcgaaagcuucau

SEQ ID NO: 2226617 - RNA, 22 nt, Streptococcus pyogenes MGAS8232
agccuuuucuuuuuggcugaug

SEQ ID NO: 2226618 - RNA, 22 nt, Streptococcus pyogenes MGAS8232
agcccuuuuugccuuuaacaug

SEQ ID NO: 2226619 - RNA, 20 nt, Streptococcus pyogenes MGAS8232
agcccuuauguauuuuucaa

SEQ ID NO: 2226620 - RNA, 18 nt, Streptococcus pyogenes MGAS8232
agcguugacaguuaaaaa

SEQ ID NO: 2226621 - RNA, 16 nt, Streptococcus pyogenes MGAS8232
agcuagggcaacugca

SEQ ID NO: 2226622 - RNA, 17 nt, Streptococcus pyogenes MGAS8232
agcuaaaagcauaaaaa

SEQ ID NO: 2226623 - RNA, 13 nt, Streptococcus pyogenes MGAS8232
agcuaaaaacaau

SEQ ID NO: 2226624 - RNA, 18 nt, Streptococcus pyogenes MGAS8232
agcugagcaaaacaauaa

SEQ ID NO: 2226625 - RNA, 15 nt, Streptococcus pyogenes MGAS8232
agcugagcaaaacaa

SEQ ID NO: 2226626 - RNA, 20 nt, Streptococcus pyogenes MGAS8232
agcugcugcuaaagcaauca

SEQ ID NO: 2226627 - RNA, 22 nt, Streptococcus pyogenes MGAS8232
agcucgucuuuguccauuuuuu

SEQ ID NO: 2226628 - RNA, 14 nt, Streptococcus pyogenes MGAS8232
agcuccuaaaacca

SEQ ID NO: 2226629 - RNA, 21 nt, Streptococcus pyogenes MGAS8232
agcaagugugacuaguuuauu

SEQ ID NO: 2226630 - RNA, 19 nt, Streptococcus pyogenes MGAS8232
agcaaugguuaaaaagaga

SEQ ID NO: 2226631 - RNA, 17 nt, Streptococcus pyogenes MGAS8232
agcaaugguuaaaaaga

SEQ ID NO: 2226632 - RNA, 21 nt, Streptococcus pyogenes MGAS8232
agcaaucuucaacaccuucgu

SEQ ID NO: 2226633 - RNA, 16 nt, Streptococcus pyogenes MGAS8232
agcaaccucaguucug

SEQ ID NO: 2226634 - RNA, 22 nt, Streptococcus pyogenes MGAS8232
agcaaaacaauaacacagaagc

SEQ ID NO: 2226635 - RNA, 16 nt, Streptococcus pyogenes MGAS8232
agcaaaaugcuguuug

SEQ ID NO: 2226636 - RNA, 20 nt, Streptococcus pyogenes MGAS8232
agcagcagaagcaaauucuu

SEQ ID NO: 2226637 - RNA, 18 nt, Streptococcus pyogenes MGAS8232
agcagcagaagcaaauuc

SEQ ID NO: 2226638 - RNA, 11 nt, Streptococcus pyogenes MGAS8232
agcagcagaag

SEQ ID NO: 2226639 - RNA, 13 nt, Streptococcus pyogenes MGAS8232
agcaccuucaacc

SEQ ID NO: 2226640 - RNA, 18 nt, Streptococcus pyogenes MGAS8232
agcaccuacgauaaaaca

SEQ ID NO: 2226641 - RNA, 15 nt, Streptococcus pyogenes MGAS8232
agcacaaaagaggca

SEQ ID NO: 2226642 - RNA, 19 nt, Streptococcus pyogenes MGAS8232
agcaauuguuuuuucaaca

SEQ ID NO: 2226643 - RNA, 15 nt, Streptococcus pyogenes MGAS8232
agcaauuguuuuuuc

SEQ ID NO: 2226644 - RNA, 15 nt, Streptococcus pyogenes MGAS8232
agcaggcguuuuguu

SEQ ID NO: 2226645 - RNA, 22 nt, Streptococcus pyogenes MGAS8232
agcagcaucacguacagaaaug

SEQ ID NO: 2226646 - RNA, 18 nt, Streptococcus pyogenes MGAS8232
agcaguucagcagcacug

SEQ ID NO: 2226647 - RNA, 15 nt, Streptococcus pyogenes MGAS8232
agcaguucagcagca

SEQ ID NO: 2226648 - RNA, 17 nt, Streptococcus pyogenes MGAS8232
agcaguucagcagcacu

SEQ ID NO: 2226649 - RNA, 24 nt, Streptococcus pyogenes MGAS8232
agcauaaaagauauuuuaaaauag

SEQ ID NO: 2226650 - RNA, 18 nt, Streptococcus pyogenes MGAS8232
agcauaaccuuugccauu

SEQ ID NO: 2226651 - RNA, 15 nt, Streptococcus pyogenes MGAS8232
agcauaauaaaaaga

SEQ ID NO: 2226652 - RNA, 16 nt, Streptococcus pyogenes MGAS8232
agcauaccuaaaagaa

SEQ ID NO: 2226653 - RNA, 16 nt, Streptococcus pyogenes MGAS8232
agcaucguuaagugga

SEQ ID NO: 2226654 - RNA, 19 nt, Streptococcus pyogenes MGAS8232
agcauauuuugauuacuga

SEQ ID NO: 2226655 - RNA, 18 nt, Streptococcus pyogenes MGAS8232
agcaucacguacagaaau

SEQ ID NO: 2226656 - RNA, 18 nt, Streptococcus pyogenes MGAS8232
agcaugauuuaguuuuua

SEQ ID NO: 2226657 - RNA, 14 nt, Streptococcus pyogenes MGAS8232
agccaaauccaccu

SEQ ID NO: 2226658 - RNA, 13 nt, Streptococcus pyogenes MGAS8232
agcauuuucauca

SEQ ID NO: 2226659 - RNA, 15 nt, Streptococcus pyogenes MGAS8232
agcauuuucaucauc

SEQ ID NO: 2226660 - RNA, 17 nt, Streptococcus pyogenes MGAS8232
agcauuuugagaacgaa

SEQ ID NO: 2226661 - RNA, 13 nt, Streptococcus pyogenes MGAS8232
agccaaaauaaca

SEQ ID NO: 2226662 - RNA, 12 nt, Streptococcus pyogenes MGAS8232
agccaauuacuu

SEQ ID NO: 2226663 - RNA, 23 nt, Streptococcus pyogenes MGAS8232
agccagauggugcuacugaugua

SEQ ID NO: 2226664 - RNA, 21 nt, Streptococcus pyogenes MGAS8232
acuugguucugaaaauaaaau

SEQ ID NO: 2226665 - RNA, 17 nt, Streptococcus pyogenes MGAS8232
acuugcaucgcaaacag

SEQ ID NO: 2226666 - RNA, 18 nt, Streptococcus pyogenes MGAS8232
acuugcaucgcaaacaga

SEQ ID NO: 2226667 - RNA, 24 nt, Streptococcus pyogenes MGAS8232
acuucuauauguguaauuucuugu

SEQ ID NO: 2226668 - RNA, 15 nt, Streptococcus pyogenes MGAS8232
acuucgguauucuuu

SEQ ID NO: 2226669 - RNA, 20 nt, Streptococcus pyogenes MGAS8232
acuucuuccuuguacaagag

SEQ ID NO: 2226670 - RNA, 22 nt, Streptococcus pyogenes MGAS8232
acuguaauauuuccuuuuaaag

SEQ ID NO: 2226671 - RNA, 14 nt, Streptococcus pyogenes MGAS8232
acuguaauuaugca

SEQ ID NO: 2226672 - RNA, 15 nt, Streptococcus pyogenes MGAS8232
acuuacaaaaagccu

SEQ ID NO: 2226673 - RNA, 16 nt, Streptococcus pyogenes MGAS8232
acuuauuuuuuuaaga

SEQ ID NO: 2226674 - RNA, 22 nt, Streptococcus pyogenes MGAS8232
acuuccaaaccauuuuaugaga

SEQ ID NO: 2226675 - RNA, 23 nt, Streptococcus pyogenes MGAS8232
acuuauuauuuugggacuaggaa

SEQ ID NO: 2226676 - RNA, 22 nt, Streptococcus pyogenes MGAS8232
acuuucaguuaucugauauuuc

SEQ ID NO: 2226677 - RNA, 12 nt, Streptococcus pyogenes MGAS8232
acuuuuaaaauc

SEQ ID NO: 2226678 - RNA, 19 nt, Streptococcus pyogenes MGAS8232
acuuugacagacaccaaaa

SEQ ID NO: 2226679 - RNA, 14 nt, Streptococcus pyogenes MGAS8232
acuuucuacuauug

SEQ ID NO: 2226680 - RNA, 14 nt, Streptococcus pyogenes MGAS8232
agaaacaaaaauga

SEQ ID NO: 2226681 - RNA, 22 nt, Streptococcus pyogenes MGAS8232
agaaauacuccguuucuaguuu

SEQ ID NO: 2226682 - RNA, 16 nt, Streptococcus pyogenes MGAS8232
agaaagaggaaacaaa

SEQ ID NO: 2226683 - RNA, 19 nt, Streptococcus pyogenes MGAS8232
agaaagacuuaaggauuua

SEQ ID NO: 2226684 - RNA, 20 nt, Streptococcus pyogenes MGAS8232
agaaagacuuaaggauuuag

SEQ ID NO: 2226685 - RNA, 21 nt, Streptococcus pyogenes MGAS8232
agauaagaccuucaaaaaagg

SEQ ID NO: 2226686 - RNA, 16 nt, Streptococcus pyogenes MGAS8232
agaguacaaggcaauc

SEQ ID NO: 2226687 - RNA, 19 nt, Streptococcus pyogenes MGAS8232
agagcaguucagcagcacu

SEQ ID NO: 2226688 - RNA, 17 nt, Streptococcus pyogenes MGAS8232
agagcaguucagcagca

SEQ ID NO: 2226689 - RNA, 13 nt, Streptococcus pyogenes MGAS8232
agagcccauucuu

SEQ ID NO: 2226690 - RNA, 16 nt, Streptococcus pyogenes MGAS8232
agagaaucaaggggau

SEQ ID NO: 2226691 - RNA, 10 nt, Streptococcus pyogenes MGAS8232
agagaaucaa

SEQ ID NO: 2226692 - RNA, 22 nt, Streptococcus pyogenes MGAS8232
agacuucuuccuuguacaagag

SEQ ID NO: 2226693 - RNA, 13 nt, Streptococcus pyogenes MGAS8232
agagaaagaggaa

SEQ ID NO: 2226694 - RNA, 14 nt, Streptococcus pyogenes MGAS8232
agacuuaaggauuu

SEQ ID NO: 2226695 - RNA, 14 nt, Streptococcus pyogenes MGAS8232
agacauucguucua

SEQ ID NO: 2226696 - RNA, 15 nt, Streptococcus pyogenes MGAS8232
agaccuucaaaaaag

SEQ ID NO: 2226697 - RNA, 13 nt, Streptococcus pyogenes MGAS8232
agaccuucaaaaa

SEQ ID NO: 2226698 - RNA, 14 nt, Streptococcus pyogenes MGAS8232
agaagccucuucug

SEQ ID NO: 2226699 - RNA, 19 nt, Streptococcus pyogenes MGAS8232
agaaggaacucuccaaagu

SEQ ID NO: 2226700 - RNA, 17 nt, Streptococcus pyogenes MGAS8232
agaagauccuacaagag

SEQ ID NO: 2226701 - RNA, 21 nt, Streptococcus pyogenes MGAS8232
agaauagguaaagauuuuaaa

SEQ ID NO: 2226702 - RNA, 16 nt, Streptococcus pyogenes MGAS8232
agaauaaccagcugau

SEQ ID NO: 2226703 - RNA, 16 nt, Streptococcus pyogenes MGAS8232
acgcauuucuuuuuug

SEQ ID NO: 2226704 - RNA, 13 nt, Streptococcus pyogenes MGAS8232
acuaugaaaaaag

SEQ ID NO: 2226705 - RNA, 15 nt, Streptococcus pyogenes MGAS8232
acuaugaaaaaagaa

SEQ ID NO: 2226706 - RNA, 12 nt, Streptococcus pyogenes MGAS8232
acuaugaaaaaa

SEQ ID NO: 2226707 - RNA, 14 nt, Streptococcus pyogenes MGAS8232
acucaauugaaaga

SEQ ID NO: 2226708 - RNA, 18 nt, Streptococcus pyogenes MGAS8232
acucaucauauuguuaau

SEQ ID NO: 2226709 - RNA, 22 nt, Streptococcus pyogenes MGAS8232
acuccagcuggaguuuuuuuau

SEQ ID NO: 2226710 - RNA, 13 nt, Streptococcus pyogenes MGAS8232
acucuauuuugag

SEQ ID NO: 2226711 - RNA, 20 nt, Streptococcus pyogenes MGAS8232
acucccuuuaauucuuuaau

SEQ ID NO: 2226712 - RNA, 13 nt, Streptococcus pyogenes MGAS8232
acuaauauaaggc

SEQ ID NO: 2226713 - RNA, 16 nt, Streptococcus pyogenes MGAS8232
acuaagguacggucau

SEQ ID NO: 2226714 - RNA, 19 nt, Streptococcus pyogenes MGAS8232
acuaggaaucgcuuuagga

SEQ ID NO: 2226715 - RNA, 20 nt, Streptococcus pyogenes MGAS8232
acuaggaaucgcuuuaggaa

SEQ ID NO: 2226716 - RNA, 16 nt, Streptococcus pyogenes MGAS8232
acuagccuacagucug

SEQ ID NO: 2226717 - RNA, 20 nt, Streptococcus pyogenes MGAS8232
acuagucggguaagggugaa

SEQ ID NO: 2226718 - RNA, 14 nt, Streptococcus pyogenes MGAS8232
acuauaauuucaau

SEQ ID NO: 2226719 - RNA, 17 nt, Streptococcus pyogenes MGAS8232
acuagcacaaaaucauu

SEQ ID NO: 2226720 - RNA, 19 nt, Streptococcus pyogenes MGAS8232
acuagauaagucauuuuaa

SEQ ID NO: 2226721 - RNA, 16 nt, Streptococcus pyogenes MGAS8232
acuacaagcauuuuug

SEQ ID NO: 2226722 - RNA, 20 nt, Streptococcus pyogenes MGAS8232
acguguauucuuaaaaaaau

SEQ ID NO: 2226723 - RNA, 19 nt, Streptococcus pyogenes MGAS8232
acguguauucuuaaaaaaa

SEQ ID NO: 2226724 - RNA, 12 nt, Streptococcus pyogenes MGAS8232
acgugagaaaau

SEQ ID NO: 2226725 - RNA, 22 nt, Streptococcus pyogenes MGAS8232
acguauuuuucgacaauuaaaa

SEQ ID NO: 2226726 - RNA, 23 nt, Streptococcus pyogenes MGAS8232
acgucagcggcugcucuuuuguu

SEQ ID NO: 2226727 - RNA, 14 nt, Streptococcus pyogenes MGAS8232
accgcuaaaacagu

SEQ ID NO: 2226728 - RNA, 19 nt, Streptococcus pyogenes MGAS8232
accgaaaaaggcaaagaaa

SEQ ID NO: 2226729 - RNA, 15 nt, Streptococcus pyogenes MGAS8232
acccgucuuacaauu

SEQ ID NO: 2226730 - RNA, 12 nt, Streptococcus pyogenes MGAS8232
accaagauucau

SEQ ID NO: 2226731 - RNA, 18 nt, Streptococcus pyogenes MGAS8232
accaauaaugagcaaggc

SEQ ID NO: 2226732 - RNA, 18 nt, Streptococcus pyogenes MGAS8232
accacaccuaauaaaaua

SEQ ID NO: 2226733 - RNA, 15 nt, Streptococcus pyogenes MGAS8232
accacaccuaauaaa

SEQ ID NO: 2226734 - RNA, 22 nt, Streptococcus pyogenes MGAS8232
acauaguguuuugaauguugua

SEQ ID NO: 2226735 - RNA, 21 nt, Streptococcus pyogenes MGAS8232
acauacuuuauuaaucaaaaa

SEQ ID NO: 2226736 - RNA, 19 nt, Streptococcus pyogenes MGAS8232
acauacucuauuuacucau

SEQ ID NO: 2226737 - RNA, 18 nt, Streptococcus pyogenes MGAS8232
acaucaacuaucaaguau

SEQ ID NO: 2226738 - RNA, 16 nt, Streptococcus pyogenes MGAS8232
acauucguucuaguuu

SEQ ID NO: 2226739 - RNA, 15 nt, Streptococcus pyogenes MGAS8232
acauuaguccaaaau

SEQ ID NO: 2226740 - RNA, 16 nt, Streptococcus pyogenes MGAS8232
acagaagccucuucug

SEQ ID NO: 2226741 - RNA, 13 nt, Streptococcus pyogenes MGAS8232
acagaaagcggaa

SEQ ID NO: 2226742 - RNA, 17 nt, Streptococcus pyogenes MGAS8232
acacgugauaaaugccg

SEQ ID NO: 2226743 - RNA, 21 nt, Streptococcus pyogenes MGAS8232
acacgguuuucugucuacuua

SEQ ID NO: 2226744 - RNA, 23 nt, Streptococcus pyogenes MGAS8232
acagagucuuaguuuaggaauca

SEQ ID NO: 2226745 - RNA, 21 nt, Streptococcus pyogenes MGAS8232
acaccauuaaaaaaaccagcu

SEQ ID NO: 2226746 - RNA, 20 nt, Streptococcus pyogenes MGAS8232
acaaucuuaaguuagggucu

SEQ ID NO: 2226747 - RNA, 19 nt, Streptococcus pyogenes MGAS8232
acaaugagaucuucuuuug

SEQ ID NO: 2226748 - RNA, 19 nt, Streptococcus pyogenes MGAS8232
acaauaaggucaucagaau

SEQ ID NO: 2226749 - RNA, 14 nt, Streptococcus pyogenes MGAS8232
acaaggcaauccaa

SEQ ID NO: 2226750 - RNA, 18 nt, Streptococcus pyogenes MGAS8232
acacauaaugauuuuuaa

SEQ ID NO: 2226751 - RNA, 19 nt, Streptococcus pyogenes MGAS8232
acacauaaugauuuuuaau

SEQ ID NO: 2226752 - RNA, 12 nt, Streptococcus pyogenes MGAS8232
acaauuaaaaaa

SEQ ID NO: 2226753 - RNA, 13 nt, Streptococcus pyogenes MGAS8232
acaauuaaaaaag

SEQ ID NO: 2226754 - RNA, 16 nt, Streptococcus pyogenes MGAS8232
acaauuaaaaaagcuu

SEQ ID NO: 2226755 - RNA, 14 nt, Streptococcus pyogenes MGAS8232
acacaaaagcuuua

SEQ ID NO: 2226756 - RNA, 14 nt, Streptococcus pyogenes MGAS8232
aauuuuaaaugaca

SEQ ID NO: 2226757 - RNA, 17 nt, Streptococcus pyogenes MGAS8232
aauuuuaaaugacauga

SEQ ID NO: 2226758 - RNA, 17 nt, Streptococcus pyogenes MGAS8232
aauuugguggaagagua

SEQ ID NO: 2226759 - RNA, 19 nt, Streptococcus pyogenes MGAS8232
acaaaaugaagcaaaauaa

SEQ ID NO: 2226760 - RNA, 20 nt, Streptococcus pyogenes MGAS8232
acaaaaugaagcaaaauaaa

SEQ ID NO: 2226761 - RNA, 22 nt, Streptococcus pyogenes MGAS8232
acaaaaacugugaacaaaacaa

SEQ ID NO: 2226762 - RNA, 23 nt, Streptococcus pyogenes MGAS8232
acaaaaacugugaacaaaacaaa

SEQ ID NO: 2226763 - RNA, 13 nt, Streptococcus pyogenes MGAS8232
acaaaacaaaaca

SEQ ID NO: 2226764 - RNA, 14 nt, Streptococcus pyogenes MGAS8232
acaaaacaaaacaa

SEQ ID NO: 2226765 - RNA, 15 nt, Streptococcus pyogenes MGAS8232
acaaaacaaaacaaa

SEQ ID NO: 2226766 - RNA, 16 nt, Streptococcus pyogenes MGAS8232
acaaaacaaaacaaaa

SEQ ID NO: 2226767 - RNA, 15 nt, Streptococcus pyogenes MGAS8232
aauuuuucuucugac

SEQ ID NO: 2226768 - RNA, 10 nt, Streptococcus pyogenes MGAS8232
aauuuuucuu

SEQ ID NO: 2226769 - RNA, 13 nt, Streptococcus pyogenes MGAS8232
acaacauccauac

SEQ ID NO: 2226770 - RNA, 16 nt, Streptococcus pyogenes MGAS8232
acaacgcuauuuuuaa

SEQ ID NO: 2226771 - RNA, 16 nt, Streptococcus pyogenes MGAS8232
acaacgucaauuuuau

SEQ ID NO: 2226772 - RNA, 22 nt, Streptococcus pyogenes MGAS8232
acaacgucaauuuuaucagacu

SEQ ID NO: 2226773 - RNA, 15 nt, Streptococcus pyogenes MGAS8232
acaagagcuuaaaag

SEQ ID NO: 2226774 - RNA, 18 nt, Streptococcus pyogenes MGAS8232
acaagagcuuaaaaguua

SEQ ID NO: 2226775 - RNA, 16 nt, Streptococcus pyogenes MGAS8232
acaaagauuggauuuc

SEQ ID NO: 2226776 - RNA, 13 nt, Streptococcus pyogenes MGAS8232
acaaauucuuuuu

SEQ ID NO: 2226777 - RNA, 14 nt, Streptococcus pyogenes MGAS8232
aaggcaagaggagg

SEQ ID NO: 2226778 - RNA, 21 nt, Streptococcus pyogenes MGAS8232
aaggcaauccaaaucaacaug

SEQ ID NO: 2226779 - RNA, 20 nt, Streptococcus pyogenes MGAS8232
aaggcaaucacccauguaaa

SEQ ID NO: 2226780 - RNA, 22 nt, Streptococcus pyogenes MGAS8232
aagguacacgugauaaaugccg

SEQ ID NO: 2226781 - RNA, 22 nt, Streptococcus pyogenes MGAS8232
aaggcuuguucuuuauuuugau

SEQ ID NO: 2226782 - RNA, 21 nt, Streptococcus pyogenes MGAS8232
aaggaauugcagcuaaaaaca

SEQ ID NO: 2226783 - RNA, 17 nt, Streptococcus pyogenes MGAS8232
aaggagcuuuaccuccu

SEQ ID NO: 2226784 - RNA, 15 nt, Streptococcus pyogenes MGAS8232
aagcuuuaagcuuug

SEQ ID NO: 2226785 - RNA, 13 nt, Streptococcus pyogenes MGAS8232
aagcuuuaaaaaa

SEQ ID NO: 2226786 - RNA, 15 nt, Streptococcus pyogenes MGAS8232
aagcuuuaaaaaaua

SEQ ID NO: 2226787 - RNA, 16 nt, Streptococcus pyogenes MGAS8232
aagcucuuagaagccu

SEQ ID NO: 2226788 - RNA, 17 nt, Streptococcus pyogenes MGAS8232
aagcucuuagaagccuu

SEQ ID NO: 2226789 - RNA, 16 nt, Streptococcus pyogenes MGAS8232
aagcucuaucaucuuu

SEQ ID NO: 2226790 - RNA, 18 nt, Streptococcus pyogenes MGAS8232
aagugccaguaaggaaau

SEQ ID NO: 2226791 - RNA, 22 nt, Streptococcus pyogenes MGAS8232
aagugccaguaaggaaaucaau

SEQ ID NO: 2226792 - RNA, 15 nt, Streptococcus pyogenes MGAS8232
aaguguuuugucuua

SEQ ID NO: 2226793 - RNA, 22 nt, Streptococcus pyogenes MGAS8232
aaguguuuugucuuauagaaua

SEQ ID NO: 2226794 - RNA, 12 nt, Streptococcus pyogenes MGAS8232
aaguuaccaauu

SEQ ID NO: 2226795 - RNA, 20 nt, Streptococcus pyogenes MGAS8232
aagucagacucaauugaaag

SEQ ID NO: 2226796 - RNA, 22 nt, Streptococcus pyogenes MGAS8232
aagucacaccguugauguuaau

SEQ ID NO: 2226797 - RNA, 18 nt, Streptococcus pyogenes MGAS8232
aagucuaucugcagauuu

SEQ ID NO: 2226798 - RNA, 18 nt, Streptococcus pyogenes MGAS8232
aaguuccuuagcaguuau

SEQ ID NO: 2226799 - RNA, 12 nt, Streptococcus pyogenes MGAS8232
aaguucuuugcc

SEQ ID NO: 2226800 - RNA, 15 nt, Streptococcus pyogenes MGAS8232
aaguucuuugccuuu

SEQ ID NO: 2226801 - RNA, 19 nt, Streptococcus pyogenes MGAS8232
aaguuggcuacucuauuug

SEQ ID NO: 2226802 - RNA, 16 nt, Streptococcus pyogenes MGAS8232
aaguuggcuacucuau

SEQ ID NO: 2226803 - RNA, 14 nt, Streptococcus pyogenes MGAS8232
aauaaaauagcacc

SEQ ID NO: 2226804 - RNA, 18 nt, Streptococcus pyogenes MGAS8232
aagaugguuuugauuaaa

SEQ ID NO: 2226805 - RNA, 21 nt, Streptococcus pyogenes MGAS8232
aagauggugcuuuaaaaaguu

SEQ ID NO: 2226806 - RNA, 24 nt, Streptococcus pyogenes MGAS8232
aagauuuccacuugguccaucagu

SEQ ID NO: 2226807 - RNA, 16 nt, Streptococcus pyogenes MGAS8232
aagauccuacaagagg

SEQ ID NO: 2226808 - RNA, 21 nt, Streptococcus pyogenes MGAS8232
aagauaccggguuguuuuuuc

SEQ ID NO: 2226809 - RNA, 22 nt, Streptococcus pyogenes MGAS8232
aagauagugauggcuugaagua

SEQ ID NO: 2226810 - RNA, 16 nt, Streptococcus pyogenes MGAS8232
aagcaugggcuaagua

SEQ ID NO: 2226811 - RNA, 14 nt, Streptococcus pyogenes MGAS8232
aagcauuuuugcag

SEQ ID NO: 2226812 - RNA, 17 nt, Streptococcus pyogenes MGAS8232
aagcauaauaaaaagag

SEQ ID NO: 2226813 - RNA, 20 nt, Streptococcus pyogenes MGAS8232
aagcaaaauuauuauuuugc

SEQ ID NO: 2226814 - RNA, 13 nt, Streptococcus pyogenes MGAS8232
aagcaaaauuauu

SEQ ID NO: 2226815 - RNA, 22 nt, Streptococcus pyogenes MGAS8232
aagagcuuaaaaguuagccaag

SEQ ID NO: 2226816 - RNA, 17 nt, Streptococcus pyogenes MGAS8232
aagagcacacauaauga

SEQ ID NO: 2226817 - RNA, 21 nt, Streptococcus pyogenes MGAS8232
aagagcacacauaaugauuuu

SEQ ID NO: 2226818 - RNA, 15 nt, Streptococcus pyogenes MGAS8232
aagagccaucagcuc

SEQ ID NO: 2226819 - RNA, 15 nt, Streptococcus pyogenes MGAS8232
aagaggaaacaaaaa

SEQ ID NO: 2226820 - RNA, 18 nt, Streptococcus pyogenes MGAS8232
aagacuauguugcuuaau

SEQ ID NO: 2226821 - RNA, 20 nt, Streptococcus pyogenes MGAS8232
aagacuuauaugaaagaacu

SEQ ID NO: 2226822 - RNA, 15 nt, Streptococcus pyogenes MGAS8232
aagacuagagucucu

SEQ ID NO: 2226823 - RNA, 23 nt, Streptococcus pyogenes MGAS8232
aagagagguugguaaaaaggcag

SEQ ID NO: 2226824 - RNA, 22 nt, Streptococcus pyogenes MGAS8232
aagaauuggggcggcacuucca

SEQ ID NO: 2226825 - RNA, 16 nt, Streptococcus pyogenes MGAS8232
aagaccauaaaaaacc

SEQ ID NO: 2226826 - RNA, 19 nt, Streptococcus pyogenes MGAS8232
aagaccuucaaaaaaggga

SEQ ID NO: 2226827 - RNA, 14 nt, Streptococcus pyogenes MGAS8232
aaauucuuuuugaa

SEQ ID NO: 2226828 - RNA, 12 nt, Streptococcus pyogenes MGAS8232
aaugucuuguuc

SEQ ID NO: 2226829 - RNA, 15 nt, Streptococcus pyogenes MGAS8232
aauguaugauuuuaa

SEQ ID NO: 2226830 - RNA, 14 nt, Streptococcus pyogenes MGAS8232
aaugguaaaggccu

SEQ ID NO: 2226831 - RNA, 12 nt, Streptococcus pyogenes MGAS8232
aauguuuugcuc

SEQ ID NO: 2226832 - RNA, 16 nt, Streptococcus pyogenes MGAS8232
aauuaaaccauucuaa

SEQ ID NO: 2226833 - RNA, 22 nt, Streptococcus pyogenes MGAS8232
aaucuaagaauuggggcggcac

SEQ ID NO: 2226834 - RNA, 18 nt, Streptococcus pyogenes MGAS8232
aaucgcuuuaggaauauc

SEQ ID NO: 2226835 - RNA, 13 nt, Streptococcus pyogenes MGAS8232
aaucgaaaugaua

SEQ ID NO: 2226836 - RNA, 15 nt, Streptococcus pyogenes MGAS8232
aaugauagcaccuaa

SEQ ID NO: 2226837 - RNA, 14 nt, Streptococcus pyogenes MGAS8232
aaugauaaggcugc

SEQ ID NO: 2226838 - RNA, 16 nt, Streptococcus pyogenes MGAS8232
aaugacuucaaaauca

SEQ ID NO: 2226839 - RNA, 19 nt, Streptococcus pyogenes MGAS8232
aaugaccacccucaacagc

SEQ ID NO: 2226840 - RNA, 14 nt, Streptococcus pyogenes MGAS8232
aaucuuguuuaacc

SEQ ID NO: 2226841 - RNA, 18 nt, Streptococcus pyogenes MGAS8232
aaucuuuauaaagcuuua

SEQ ID NO: 2226842 - RNA, 15 nt, Streptococcus pyogenes MGAS8232
aaugacaguauacau

SEQ ID NO: 2226843 - RNA, 18 nt, Streptococcus pyogenes MGAS8232
aaucaccguaacuugcuu

SEQ ID NO: 2226844 - RNA, 18 nt, Streptococcus pyogenes MGAS8232
aaucaccuuucuauauaa

SEQ ID NO: 2226845 - RNA, 12 nt, Streptococcus pyogenes MGAS8232
aaucaaaaaacu

SEQ ID NO: 2226846 - RNA, 20 nt, Streptococcus pyogenes MGAS8232
aaucaacauggcuaaugaua

SEQ ID NO: 2226847 - RNA, 12 nt, Streptococcus pyogenes MGAS8232
aauaugauauaa

SEQ ID NO: 2226848 - RNA, 15 nt, Streptococcus pyogenes MGAS8232
aauaugauauaaaaa

SEQ ID NO: 2226849 - RNA, 22 nt, Streptococcus pyogenes MGAS8232
aauauuauaguauuaucucauu

SEQ ID NO: 2226850 - RNA, 14 nt, Streptococcus pyogenes MGAS8232
aauauuauauuaaa

SEQ ID NO: 2226851 - RNA, 17 nt, Streptococcus pyogenes MGAS8232
aauauuauauuaaauua

SEQ ID NO: 2226852 - RNA, 13 nt, Streptococcus pyogenes MGAS8232
aauauaauaaaaa

SEQ ID NO: 2226853 - RNA, 21 nt, Streptococcus pyogenes MGAS8232
aauaucgccaauaaaaaagaa

SEQ ID NO: 2226854 - RNA, 24 nt, Streptococcus pyogenes MGAS8232
aauaugaaaacguguauucuuaaa

SEQ ID NO: 2226855 - RNA, 17 nt, Streptococcus pyogenes MGAS8232
aauaucgccaauaaaaa

SEQ ID NO: 2226856 - RNA, 15 nt, Streptococcus pyogenes MGAS8232
aauaucacauuuuaa

SEQ ID NO: 2226857 - RNA, 16 nt, Streptococcus pyogenes MGAS8232
aauagcugcugcuaaa

SEQ ID NO: 2226858 - RNA, 19 nt, Streptococcus pyogenes MGAS8232
aauagcugcugcuaaagca

SEQ ID NO: 2226859 - RNA, 13 nt, Streptococcus pyogenes MGAS8232
aauaccauuuuua

SEQ ID NO: 2226860 - RNA, 15 nt, Streptococcus pyogenes MGAS8232
aauagaauaaaaaga

SEQ ID NO: 2226861 - RNA, 13 nt, Streptococcus pyogenes MGAS8232
aauaaagaugaga

SEQ ID NO: 2226862 - RNA, 17 nt, Streptococcus pyogenes MGAS8232
aauaaagauaauuucuu

SEQ ID NO: 2226863 - RNA, 16 nt, Streptococcus pyogenes MGAS8232
aaauuauaguauaccu

SEQ ID NO: 2226864 - RNA, 17 nt, Streptococcus pyogenes MGAS8232
aaauuaguuaucucaua

SEQ ID NO: 2226865 - RNA, 21 nt, Streptococcus pyogenes MGAS8232
aaauuauuaacguuaacaaaa

SEQ ID NO: 2226866 - RNA, 18 nt, Streptococcus pyogenes MGAS8232
uuuuuuguauuacucaau

SEQ ID NO: 2226867 - RNA, 13 nt, Streptococcus pyogenes MGAS8232
aaauucaaauacu

SEQ ID NO: 2226868 - RNA, 14 nt, Streptococcus pyogenes MGAS8232
aaauuccccacaaa

SEQ ID NO: 2226869 - RNA, 20 nt, Streptococcus pyogenes MGAS8232
aaauuccccacaaaagacaa

SEQ ID NO: 2226870 - RNA, 15 nt, Streptococcus pyogenes MGAS8232
uuuuugucuccuucu

SEQ ID NO: 2226871 - RNA, 15 nt, Streptococcus pyogenes MGAS8232
uuuuugucuucuucu

SEQ ID NO: 2226872 - RNA, 15 nt, Streptococcus pyogenes MGAS8232
aaauuaagaaggaac

SEQ ID NO: 2226873 - RNA, 16 nt, Streptococcus pyogenes MGAS8232
uuuugucuuauagaau

SEQ ID NO: 2226874 - RNA, 18 nt, Streptococcus pyogenes MGAS8232
uuuugucuuaucuaaagg

SEQ ID NO: 2226875 - RNA, 15 nt, Streptococcus pyogenes MGAS8232
uuuugucuucuucuu

SEQ ID NO: 2226876 - RNA, 14 nt, Streptococcus pyogenes MGAS8232
uuuugucuccuucu

SEQ ID NO: 2226877 - RNA, 18 nt, Streptococcus pyogenes MGAS8232
uuuugguugauauaaaau

SEQ ID NO: 2226878 - RNA, 18 nt, Streptococcus pyogenes MGAS8232
uuuuguuguauuaugagg

SEQ ID NO: 2226879 - RNA, 12 nt, Streptococcus pyogenes MGAS8232
uuuuuaucugua

SEQ ID NO: 2226880 - RNA, 14 nt, Streptococcus pyogenes MGAS8232
uuuugauuuuaauu

SEQ ID NO: 2226881 - RNA, 20 nt, Streptococcus pyogenes MGAS8232
uuuugaugcagcuaaaagca

SEQ ID NO: 2226882 - RNA, 20 nt, Streptococcus pyogenes MGAS8232
uuuuggaugaaaguaacaug

SEQ ID NO: 2226883 - RNA, 23 nt, Streptococcus pyogenes MGAS8232
uuuucucaaaaauauauucuaau

SEQ ID NO: 2226884 - RNA, 15 nt, Streptococcus pyogenes MGAS8232
uuuucugguuuuaau

SEQ ID NO: 2226885 - RNA, 14 nt, Streptococcus pyogenes MGAS8232
uuuucugccuuuuu

SEQ ID NO: 2226886 - RNA, 14 nt, Streptococcus pyogenes MGAS8232
uuuucuuuuuggcu

SEQ ID NO: 2226887 - RNA, 21 nt, Streptococcus pyogenes MGAS8232
uuuuaaaauccucuuuuaauu

SEQ ID NO: 2226888 - RNA, 15 nt, Streptococcus pyogenes MGAS8232
uuuuaaaauccucuu

SEQ ID NO: 2226889 - RNA, 13 nt, Streptococcus pyogenes MGAS8232
uuuuaaaaccuuu

SEQ ID NO: 2226890 - RNA, 13 nt, Streptococcus pyogenes MGAS8232
uuuuaaauaucuu

SEQ ID NO: 2226891 - RNA, 21 nt, Streptococcus pyogenes MGAS8232
uuuuaaacuuccaaaccauuu

SEQ ID NO: 2226892 - RNA, 14 nt, Streptococcus pyogenes MGAS8232
uuuguuuucuuuag

SEQ ID NO: 2226893 - RNA, 22 nt, Streptococcus pyogenes MGAS8232
uuuuaagauuaaacuuacaaaa

SEQ ID NO: 2226894 - RNA, 15 nt, Streptococcus pyogenes MGAS8232
uuuuaacguuuugaa

SEQ ID NO: 2226895 - RNA, 17 nt, Streptococcus pyogenes MGAS8232
uuuuacauuuuuacaau

SEQ ID NO: 2226896 - RNA, 22 nt, Streptococcus pyogenes MGAS8232
uuugguaccguuagcagacaaa

SEQ ID NO: 2226897 - RNA, 19 nt, Streptococcus pyogenes MGAS8232
uuuggccaauaaaauaucu

SEQ ID NO: 2226898 - RNA, 19 nt, Streptococcus pyogenes MGAS8232
uuuggccuacuagcacaaa

SEQ ID NO: 2226899 - RNA, 19 nt, Streptococcus pyogenes MGAS8232
uuuggagagauuuuuaaaa

SEQ ID NO: 2226900 - RNA, 20 nt, Streptococcus pyogenes MGAS8232
uuuggaggugaaaauaucuu

SEQ ID NO: 2226901 - RNA, 16 nt, Streptococcus pyogenes MGAS8232
uuugcuuuuggcaacc

SEQ ID NO: 2226902 - RNA, 17 nt, Streptococcus pyogenes MGAS8232
uuuguaucucauaacaa

SEQ ID NO: 2226903 - RNA, 19 nt, Streptococcus pyogenes MGAS8232
uuuguaucucauaacaaau

SEQ ID NO: 2226904 - RNA, 19 nt, Streptococcus pyogenes MGAS8232
uuuguaguaggugacacua

SEQ ID NO: 2226905 - RNA, 21 nt, Streptococcus pyogenes MGAS8232
uuugucaacucgauaaaaacg

SEQ ID NO: 2226906 - RNA, 18 nt, Streptococcus pyogenes MGAS8232
uuuguauuguagaggacu

SEQ ID NO: 2226907 - RNA, 13 nt, Streptococcus pyogenes MGAS8232
uuugugauggucu

SEQ ID NO: 2226908 - RNA, 20 nt, Streptococcus pyogenes MGAS8232
uuuguccauuuuuuauaaug

SEQ ID NO: 2226909 - RNA, 23 nt, Streptococcus pyogenes MGAS8232
uuuuauuaauaaguauuuuaaaa

SEQ ID NO: 2226910 - RNA, 16 nt, Streptococcus pyogenes MGAS8232
uuuuauuauacucaau

SEQ ID NO: 2226911 - RNA, 13 nt, Streptococcus pyogenes MGAS8232
uuuuauuucacua

SEQ ID NO: 2226912 - RNA, 18 nt, Streptococcus pyogenes MGAS8232
uuuuauaugucaucaaaa

SEQ ID NO: 2226913 - RNA, 19 nt, Streptococcus pyogenes MGAS8232
uuuuauauuauguucuaaa

SEQ ID NO: 2226914 - RNA, 18 nt, Streptococcus pyogenes MGAS8232
uuuuauccccuauucaau

SEQ ID NO: 2226915 - RNA, 13 nt, Streptococcus pyogenes MGAS8232
uuuuacuuuuaaa

SEQ ID NO: 2226916 - RNA, 14 nt, Streptococcus pyogenes MGAS8232
uuuuacuuuuaaaa

SEQ ID NO: 2226917 - RNA, 22 nt, Streptococcus pyogenes MGAS8232
uuuuaguaaagccuuauccauu

SEQ ID NO: 2226918 - RNA, 19 nt, Streptococcus pyogenes MGAS8232
uuuuagccugccagccaua

SEQ ID NO: 2226919 - RNA, 19 nt, Streptococcus pyogenes MGAS8232
uuuuauagcugauuuguuu

SEQ ID NO: 2226920 - RNA, 15 nt, Streptococcus pyogenes MGAS8232
uuuucguauacuuua

SEQ ID NO: 2226921 - RNA, 18 nt, Streptococcus pyogenes MGAS8232
uuuucaaagggagauucu

SEQ ID NO: 2226922 - RNA, 15 nt, Streptococcus pyogenes MGAS8232
uuuucaaaaucuuuu

SEQ ID NO: 2226923 - RNA, 11 nt, Streptococcus pyogenes MGAS8232
uuucucaguaa

SEQ ID NO: 2226924 - RNA, 21 nt, Streptococcus pyogenes MGAS8232
uuucggaaaacuuuugacuug

SEQ ID NO: 2226925 - RNA, 12 nt, Streptococcus pyogenes MGAS8232
uuucuauauaac

SEQ ID NO: 2226926 - RNA, 18 nt, Streptococcus pyogenes MGAS8232
uuuccuagcgggaacacu

SEQ ID NO: 2226927 - RNA, 17 nt, Streptococcus pyogenes MGAS8232
uuucgacaauuaaaaaa

SEQ ID NO: 2226928 - RNA, 17 nt, Streptococcus pyogenes MGAS8232
uuucgaccaauucuaaa

SEQ ID NO: 2226929 - RNA, 19 nt, Streptococcus pyogenes MGAS8232
uuugacagacaccaaaaaa

SEQ ID NO: 2226930 - RNA, 21 nt, Streptococcus pyogenes MGAS8232
uuugagauaguuagcaaauug

SEQ ID NO: 2226931 - RNA, 13 nt, Streptococcus pyogenes MGAS8232
uuugagaacgaau

SEQ ID NO: 2226932 - RNA, 16 nt, Streptococcus pyogenes MGAS8232
uuugacuucaaaaaua

SEQ ID NO: 2226933 - RNA, 21 nt, Streptococcus pyogenes MGAS8232
uuugacuuguuacaaaaaaca

SEQ ID NO: 2226934 - RNA, 15 nt, Streptococcus pyogenes MGAS8232
uuugaaguaaaggau

SEQ ID NO: 2226935 - RNA, 14 nt, Streptococcus pyogenes MGAS8232
uuucuuguuuuggu

SEQ ID NO: 2226936 - RNA, 20 nt, Streptococcus pyogenes MGAS8232
uuugcugaaauaucuuucag

SEQ ID NO: 2226937 - RNA, 19 nt, Streptococcus pyogenes MGAS8232
uuugccauggcaagagcac

SEQ ID NO: 2226938 - RNA, 19 nt, Streptococcus pyogenes MGAS8232
uuugauauuuuuucucaaa

SEQ ID NO: 2226939 - RNA, 22 nt, Streptococcus pyogenes MGAS8232
uuugaggugauguucucauaaa

SEQ ID NO: 2226940 - RNA, 16 nt, Streptococcus pyogenes MGAS8232
uuucauuauaggcuau

SEQ ID NO: 2226941 - RNA, 16 nt, Streptococcus pyogenes MGAS8232
uuucaugauguuuauu

SEQ ID NO: 2226942 - RNA, 13 nt, Streptococcus pyogenes MGAS8232
uuuauuauucuaa

SEQ ID NO: 2226943 - RNA, 16 nt, Streptococcus pyogenes MGAS8232
uuuauuuugauauuuu

SEQ ID NO: 2226944 - RNA, 19 nt, Streptococcus pyogenes MGAS8232
uuuauuuguugaagugucu

SEQ ID NO: 2226945 - RNA, 14 nt, Streptococcus pyogenes MGAS8232
uuucaacaaauccu

SEQ ID NO: 2226946 - RNA, 20 nt, Streptococcus pyogenes MGAS8232
uuucaauaauaccauuuuua

SEQ ID NO: 2226947 - RNA, 19 nt, Streptococcus pyogenes MGAS8232
uuuaaccuccuaaacuaau

SEQ ID NO: 2226948 - RNA, 15 nt, Streptococcus pyogenes MGAS8232
uuuaacaugauguac

SEQ ID NO: 2226949 - RNA, 21 nt, Streptococcus pyogenes MGAS8232
uuguuuaaccuccuaaacuaa

SEQ ID NO: 2226950 - RNA, 16 nt, Streptococcus pyogenes MGAS8232
uuguuuaauaccugcu

SEQ ID NO: 2226951 - RNA, 17 nt, Streptococcus pyogenes MGAS8232
uuuaaaagggcugaccu

SEQ ID NO: 2226952 - RNA, 16 nt, Streptococcus pyogenes MGAS8232
uuuaaaaacaaauugu

SEQ ID NO: 2226953 - RNA, 23 nt, Streptococcus pyogenes MGAS8232
uuguuuuuucaaagggagauucu

SEQ ID NO: 2226954 - RNA, 21 nt, Streptococcus pyogenes MGAS8232
uuguucaaccgucacuauuga

SEQ ID NO: 2226955 - RNA, 14 nt, Streptococcus pyogenes MGAS8232
uuguuacaaaaaac

SEQ ID NO: 2226956 - RNA, 16 nt, Streptococcus pyogenes MGAS8232
uuguuacaaaaaacaa

SEQ ID NO: 2226957 - RNA, 13 nt, Streptococcus pyogenes MGAS8232
uuuaggucuaauu

SEQ ID NO: 2226958 - RNA, 17 nt, Streptococcus pyogenes MGAS8232
uuuagguacucguaagc

SEQ ID NO: 2226959 - RNA, 15 nt, Streptococcus pyogenes MGAS8232
uuuaguugcuucuuu

SEQ ID NO: 2226960 - RNA, 13 nt, Streptococcus pyogenes MGAS8232
uuuauaaauauuu

SEQ ID NO: 2226961 - RNA, 20 nt, Streptococcus pyogenes MGAS8232
uuuacuauggcuucuaaaaa

SEQ ID NO: 2226962 - RNA, 20 nt, Streptococcus pyogenes MGAS8232
uuuaacgcaauaaaauaaca

SEQ ID NO: 2226963 - RNA, 14 nt, Streptococcus pyogenes MGAS8232
uuuaauuauuuuaa

SEQ ID NO: 2226964 - RNA, 15 nt, Streptococcus pyogenes MGAS8232
uuuaauucuucuuuc

SEQ ID NO: 2226965 - RNA, 19 nt, Streptococcus pyogenes MGAS8232
uuuacauuuuuacaauacg

SEQ ID NO: 2226966 - RNA, 14 nt, Streptococcus pyogenes MGAS8232
uuuaauuuuuccuu

SEQ ID NO: 2226967 - RNA, 16 nt, Streptococcus pyogenes MGAS8232
uugacaguuaaaaaua

SEQ ID NO: 2226968 - RNA, 22 nt, Streptococcus pyogenes MGAS8232
uugacagacaccaaaaaaagca

SEQ ID NO: 2226969 - RNA, 13 nt, Streptococcus pyogenes MGAS8232
uugaccacaccua

SEQ ID NO: 2226970 - RNA, 13 nt, Streptococcus pyogenes MGAS8232
uugacaaagccau

SEQ ID NO: 2226971 - RNA, 16 nt, Streptococcus pyogenes MGAS8232
uugaauguuguauuug

SEQ ID NO: 2226972 - RNA, 18 nt, Streptococcus pyogenes MGAS8232
uucuugaggugauucuuu

SEQ ID NO: 2226973 - RNA, 20 nt, Streptococcus pyogenes MGAS8232
uucuugaggugauucuuuuu

SEQ ID NO: 2226974 - RNA, 16 nt, Streptococcus pyogenes MGAS8232
uucuugaggugauucu

SEQ ID NO: 2226975 - RNA, 23 nt, Streptococcus pyogenes MGAS8232
uucuuuauuuugauauuuuuucu

SEQ ID NO: 2226976 - RNA, 21 nt, Streptococcus pyogenes MGAS8232
uucuuuuaaccauaucacaaa

SEQ ID NO: 2226977 - RNA, 15 nt, Streptococcus pyogenes MGAS8232
uucuuuuuuaccuuu

SEQ ID NO: 2226978 - RNA, 20 nt, Streptococcus pyogenes MGAS8232
uucuuuuaggccaccagaug

SEQ ID NO: 2226979 - RNA, 13 nt, Streptococcus pyogenes MGAS8232
uucuuuuuccguu

SEQ ID NO: 2226980 - RNA, 23 nt, Streptococcus pyogenes MGAS8232
uugauauuuuuucucaaaaauau

SEQ ID NO: 2226981 - RNA, 19 nt, Streptococcus pyogenes MGAS8232
uugauaugguggguaaaac

SEQ ID NO: 2226982 - RNA, 15 nt, Streptococcus pyogenes MGAS8232
uugacuucaaaaaua

SEQ ID NO: 2226983 - RNA, 21 nt, Streptococcus pyogenes MGAS8232
uugacuugguucugaaaauaa

SEQ ID NO: 2226984 - RNA, 22 nt, Streptococcus pyogenes MGAS8232
uugcaauagagccaagauuuua

SEQ ID NO: 2226985 - RNA, 14 nt, Streptococcus pyogenes MGAS8232
uugcaagucucuug

SEQ ID NO: 2226986 - RNA, 18 nt, Streptococcus pyogenes MGAS8232
uugccugaaauauaaccu

SEQ ID NO: 2226987 - RNA, 19 nt, Streptococcus pyogenes MGAS8232
uucccaaugccccaaagua

SEQ ID NO: 2226988 - RNA, 17 nt, Streptococcus pyogenes MGAS8232
uuccccacaaaagacaa

SEQ ID NO: 2226989 - RNA, 21 nt, Streptococcus pyogenes MGAS8232
uuccagaacaugggagcgcac

SEQ ID NO: 2226990 - RNA, 16 nt, Streptococcus pyogenes MGAS8232
uuccagaacaugggag

SEQ ID NO: 2226991 - RNA, 17 nt, Streptococcus pyogenes MGAS8232
uuccauacuuccaucua

SEQ ID NO: 2226992 - RNA, 20 nt, Streptococcus pyogenes MGAS8232
uucgccuaggaauaaaaugc

SEQ ID NO: 2226993 - RNA, 18 nt, Streptococcus pyogenes MGAS8232
uucgccuaggaauaaaau

SEQ ID NO: 2226994 - RNA, 13 nt, Streptococcus pyogenes MGAS8232
uucguucuaguuu

SEQ ID NO: 2226995 - RNA, 19 nt, Streptococcus pyogenes MGAS8232
uucuaaaugacaguauaca

SEQ ID NO: 2226996 - RNA, 19 nt, Streptococcus pyogenes MGAS8232
uucuaacauggauaccauu

SEQ ID NO: 2226997 - RNA, 19 nt, Streptococcus pyogenes MGAS8232
uucuaguuucauagaagac

SEQ ID NO: 2226998 - RNA, 20 nt, Streptococcus pyogenes MGAS8232
uucucauaaacaaugaguca

SEQ ID NO: 2226999 - RNA, 13 nt, Streptococcus pyogenes MGAS8232
uucucauaaacaa

SEQ ID NO: 2227000 - RNA, 13 nt, Streptococcus pyogenes MGAS8232
uuauccauucuua

SEQ ID NO: 2227001 - RNA, 12 nt, Streptococcus pyogenes MGAS8232
uuauccucccag

SEQ ID NO: 2227002 - RNA, 15 nt, Streptococcus pyogenes MGAS8232
uuauccuuuacugua

SEQ ID NO: 2227003 - RNA, 18 nt, Streptococcus pyogenes MGAS8232
uuauauuauguucuaaaa

SEQ ID NO: 2227004 - RNA, 16 nt, Streptococcus pyogenes MGAS8232
uuauauugugcuauuc

SEQ ID NO: 2227005 - RNA, 14 nt, Streptococcus pyogenes MGAS8232
uuauagcuccuaaa

SEQ ID NO: 2227006 - RNA, 18 nt, Streptococcus pyogenes MGAS8232
uuaucugauauuucaucu

SEQ ID NO: 2227007 - RNA, 21 nt, Streptococcus pyogenes MGAS8232
uuaugagaaaaauaagugugu

SEQ ID NO: 2227008 - RNA, 18 nt, Streptococcus pyogenes MGAS8232
uuauuaacguuaacaaaa

SEQ ID NO: 2227009 - RNA, 18 nt, Streptococcus pyogenes MGAS8232
uuauuaaccaauuccucc

SEQ ID NO: 2227010 - RNA, 20 nt, Streptococcus pyogenes MGAS8232
uuauuaacguuaacaaaaau

SEQ ID NO: 2227011 - RNA, 17 nt, Streptococcus pyogenes MGAS8232
uuauuaaagagaaagag

SEQ ID NO: 2227012 - RNA, 20 nt, Streptococcus pyogenes MGAS8232
uuauuaaagagaaagaggaa

SEQ ID NO: 2227013 - RNA, 16 nt, Streptococcus pyogenes MGAS8232
uuaugcugauuuugga

SEQ ID NO: 2227014 - RNA, 16 nt, Streptococcus pyogenes MGAS8232
uuaugcuucaaaggaa

SEQ ID NO: 2227015 - RNA, 11 nt, Streptococcus pyogenes MGAS8232
uucagcagcac

SEQ ID NO: 2227016 - RNA, 19 nt, Streptococcus pyogenes MGAS8232
uucagcagcacuggcuuuu

SEQ ID NO: 2227017 - RNA, 21 nt, Streptococcus pyogenes MGAS8232
uucagcagcacuggcuuuuuu

SEQ ID NO: 2227018 - RNA, 18 nt, Streptococcus pyogenes MGAS8232
uucaauaugaaaacgugu

SEQ ID NO: 2227019 - RNA, 21 nt, Streptococcus pyogenes MGAS8232
uucaauauuuuauuaauaagu

SEQ ID NO: 2227020 - RNA, 17 nt, Streptococcus pyogenes MGAS8232
uucaaaaauacuaccuu

SEQ ID NO: 2227021 - RNA, 15 nt, Streptococcus pyogenes MGAS8232
uuauuugacauuagu

SEQ ID NO: 2227022 - RNA, 23 nt, Streptococcus pyogenes MGAS8232
uuauuguuagagcccauucuuaa

SEQ ID NO: 2227023 - RNA, 19 nt, Streptococcus pyogenes MGAS8232
uucaauaauaccauuuuua

SEQ ID NO: 2227024 - RNA, 16 nt, Streptococcus pyogenes MGAS8232
uucaagcauaauaaaa

SEQ ID NO: 2227025 - RNA, 17 nt, Streptococcus pyogenes MGAS8232
uuagcagacaaaaggga

SEQ ID NO: 2227026 - RNA, 14 nt, Streptococcus pyogenes MGAS8232
uuagcauauuuuga

SEQ ID NO: 2227027 - RNA, 18 nt, Streptococcus pyogenes MGAS8232
uuagcauaccuaaaagaa

SEQ ID NO: 2227028 - RNA, 13 nt, Streptococcus pyogenes MGAS8232
uuacuuuuaaaau

SEQ ID NO: 2227029 - RNA, 18 nt, Streptococcus pyogenes MGAS8232
uuacucaauuaauguuag

SEQ ID NO: 2227030 - RNA, 18 nt, Streptococcus pyogenes MGAS8232
uuauaaagaaacaaaaau

SEQ ID NO: 2227031 - RNA, 23 nt, Streptococcus pyogenes MGAS8232
uuauaaaguuuucucagagacaa

SEQ ID NO: 2227032 - RNA, 15 nt, Streptococcus pyogenes MGAS8232
uuauaagauaaguaa

SEQ ID NO: 2227033 - RNA, 14 nt, Streptococcus pyogenes MGAS8232
uuaguuuuguauug

SEQ ID NO: 2227034 - RNA, 15 nt, Streptococcus pyogenes MGAS8232
uuaguugauuagaau

SEQ ID NO: 2227035 - RNA, 19 nt, Streptococcus pyogenes MGAS8232
uuaguuuaggaaucacaac

SEQ ID NO: 2227036 - RNA, 19 nt, Streptococcus pyogenes MGAS8232
uuagguggagcuuuaguug

SEQ ID NO: 2227037 - RNA, 12 nt, Streptococcus pyogenes MGAS8232
uuaguagagacg

SEQ ID NO: 2227038 - RNA, 13 nt, Streptococcus pyogenes MGAS8232
uuagucauuucuu

SEQ ID NO: 2227039 - RNA, 21 nt, Streptococcus pyogenes MGAS8232
uuaaugauucaauaucacauu

SEQ ID NO: 2227040 - RNA, 16 nt, Streptococcus pyogenes MGAS8232
uuaauuauuuuaauuu

SEQ ID NO: 2227041 - RNA, 14 nt, Streptococcus pyogenes MGAS8232
uuacagcugguuuu

SEQ ID NO: 2227042 - RNA, 19 nt, Streptococcus pyogenes MGAS8232
uuacauggguguuuaaucu

SEQ ID NO: 2227043 - RNA, 21 nt, Streptococcus pyogenes MGAS8232
uuaauagcauugucaaauaaa

SEQ ID NO: 2227044 - RNA, 12 nt, Streptococcus pyogenes MGAS8232
uuaaucaaaaaa

SEQ ID NO: 2227045 - RNA, 23 nt, Streptococcus pyogenes MGAS8232
uuaagacaacauacuuuauuaau

SEQ ID NO: 2227046 - RNA, 20 nt, Streptococcus pyogenes MGAS8232
uuaagaaggaacucuccaaa

SEQ ID NO: 2227047 - RNA, 18 nt, Streptococcus pyogenes MGAS8232
uuaagagggccaaggucu

SEQ ID NO: 2227048 - RNA, 18 nt, Streptococcus pyogenes MGAS8232
uuaaccggcucuaaaaua

SEQ ID NO: 2227049 - RNA, 21 nt, Streptococcus pyogenes MGAS8232
uggauaccauuucuuugcaaa

SEQ ID NO: 2227050 - RNA, 16 nt, Streptococcus pyogenes MGAS8232
uggaugaaaguaacau

SEQ ID NO: 2227051 - RNA, 16 nt, Streptococcus pyogenes MGAS8232
uggagagauaaaaagu

SEQ ID NO: 2227052 - RNA, 21 nt, Streptococcus pyogenes MGAS8232
uggacgucuucuuuuuauuau

SEQ ID NO: 2227053 - RNA, 20 nt, Streptococcus pyogenes MGAS8232
uggacgucuucuuuuuauua

SEQ ID NO: 2227054 - RNA, 19 nt, Streptococcus pyogenes MGAS8232
uggagcuuuaguugcuucu

SEQ ID NO: 2227055 - RNA, 22 nt, Streptococcus pyogenes MGAS8232
uggauuaaaugcccaagauggg

SEQ ID NO: 2227056 - RNA, 23 nt, Streptococcus pyogenes MGAS8232
uggauuaaaugcccaagaugggu

SEQ ID NO: 2227057 - RNA, 23 nt, Streptococcus pyogenes MGAS8232
uggcuauaaauggacaaucuuaa

SEQ ID NO: 2227058 - RNA, 14 nt, Streptococcus pyogenes MGAS8232
ugucuucuucuuuu

SEQ ID NO: 2227059 - RNA, 14 nt, Streptococcus pyogenes MGAS8232
ugugaacaaaacaa

SEQ ID NO: 2227060 - RNA, 22 nt, Streptococcus pyogenes MGAS8232
ugugauuaguuuuuagcagcag

SEQ ID NO: 2227061 - RNA, 18 nt, Streptococcus pyogenes MGAS8232
ugugauuauuauucuaaa

SEQ ID NO: 2227062 - RNA, 21 nt, Streptococcus pyogenes MGAS8232
ugugauuaguuuuuagcagca

SEQ ID NO: 2227063 - RNA, 16 nt, Streptococcus pyogenes MGAS8232
ugucguuuuuugcuuu

SEQ ID NO: 2227064 - RNA, 21 nt, Streptococcus pyogenes MGAS8232
ugucguuuuuugcuuuugaua

SEQ ID NO: 2227065 - RNA, 17 nt, Streptococcus pyogenes MGAS8232
ugucguuuuuuuuauuu

SEQ ID NO: 2227066 - RNA, 14 nt, Streptococcus pyogenes MGAS8232
ugucuaaaauaaag

SEQ ID NO: 2227067 - RNA, 16 nt, Streptococcus pyogenes MGAS8232
ugucucacuauuuugu

SEQ ID NO: 2227068 - RNA, 13 nt, Streptococcus pyogenes MGAS8232
uguccuagucuuu

SEQ ID NO: 2227069 - RNA, 16 nt, Streptococcus pyogenes MGAS8232
uguauuccauacuucc

SEQ ID NO: 2227070 - RNA, 16 nt, Streptococcus pyogenes MGAS8232
uguauuaugaggugaa

SEQ ID NO: 2227071 - RNA, 18 nt, Streptococcus pyogenes MGAS8232
ugguuaaaaagagagcuu

SEQ ID NO: 2227072 - RNA, 20 nt, Streptococcus pyogenes MGAS8232
ugguguuauccucuuuuagu

SEQ ID NO: 2227073 - RNA, 12 nt, Streptococcus pyogenes MGAS8232
ugguuaaaaaga

SEQ ID NO: 2227074 - RNA, 23 nt, Streptococcus pyogenes MGAS8232
uggucuaccgcuaggauuuuucc

SEQ ID NO: 2227075 - RNA, 20 nt, Streptococcus pyogenes MGAS8232
uggucguacuuggcaaguga

SEQ ID NO: 2227076 - RNA, 12 nt, Streptococcus pyogenes MGAS8232
uguaauaacaaa

SEQ ID NO: 2227077 - RNA, 14 nt, Streptococcus pyogenes MGAS8232
uguaauuaugcaaa

SEQ ID NO: 2227078 - RNA, 18 nt, Streptococcus pyogenes MGAS8232
uguaauuaugcaaaagau

SEQ ID NO: 2227079 - RNA, 18 nt, Streptococcus pyogenes MGAS8232
uguaaauauaaagucaga

SEQ ID NO: 2227080 - RNA, 18 nt, Streptococcus pyogenes MGAS8232
ugguugccugaaauauaa

SEQ ID NO: 2227081 - RNA, 16 nt, Streptococcus pyogenes MGAS8232
ugccuuuuuaaucuug

SEQ ID NO: 2227082 - RNA, 21 nt, Streptococcus pyogenes MGAS8232
ugccugaagccgugaggacuu

SEQ ID NO: 2227083 - RNA, 17 nt, Streptococcus pyogenes MGAS8232
ugcuaauggguuguuuu

SEQ ID NO: 2227084 - RNA, 16 nt, Streptococcus pyogenes MGAS8232
ugcucauguuuucuca

SEQ ID NO: 2227085 - RNA, 17 nt, Streptococcus pyogenes MGAS8232
ugcucauguuuucucaa

SEQ ID NO: 2227086 - RNA, 16 nt, Streptococcus pyogenes MGAS8232
ugcucaauugcuuuua

SEQ ID NO: 2227087 - RNA, 12 nt, Streptococcus pyogenes MGAS8232
uggacgaaggcu

SEQ ID NO: 2227088 - RNA, 23 nt, Streptococcus pyogenes MGAS8232
uggaaaguaaggguuaacaauga

SEQ ID NO: 2227089 - RNA, 14 nt, Streptococcus pyogenes MGAS8232
uggaaauuuuaaau

SEQ ID NO: 2227090 - RNA, 21 nt, Streptococcus pyogenes MGAS8232
ugcuuugacaaagcagugcuu

SEQ ID NO: 2227091 - RNA, 12 nt, Streptococcus pyogenes MGAS8232
ugcuucuuucaa

SEQ ID NO: 2227092 - RNA, 14 nt, Streptococcus pyogenes MGAS8232
ugcuugaguagcua

SEQ ID NO: 2227093 - RNA, 16 nt, Streptococcus pyogenes MGAS8232
ugcuucuagcucuuua

SEQ ID NO: 2227094 - RNA, 19 nt, Streptococcus pyogenes MGAS8232
ugcuguuggauacagucca

SEQ ID NO: 2227095 - RNA, 20 nt, Streptococcus pyogenes MGAS8232
aaauguccgaaaaaaacuug

SEQ ID NO: 2227096 - RNA, 19 nt, Streptococcus pyogenes MGAS8232
aaauguacauccuaauggu

SEQ ID NO: 2227097 - RNA, 15 nt, Streptococcus pyogenes MGAS8232
ugcugaguucuuuuu

SEQ ID NO: 2227098 - RNA, 15 nt, Streptococcus pyogenes MGAS8232
ugcugauuuuggaug

SEQ ID NO: 2227099 - RNA, 21 nt, Streptococcus pyogenes MGAS8232
ugcugccauauuuuugaaaaa

SEQ ID NO: 2227100 - RNA, 14 nt, Streptococcus pyogenes MGAS8232
ugaaaauaucuuuu

SEQ ID NO: 2227101 - RNA, 20 nt, Streptococcus pyogenes MGAS8232
ugaaacguuauuaaagacaa

SEQ ID NO: 2227102 - RNA, 16 nt, Streptococcus pyogenes MGAS8232
ugaaaguuccuuagca

SEQ ID NO: 2227103 - RNA, 23 nt, Streptococcus pyogenes MGAS8232
ugaaaagaugcacacaaaucuuc

SEQ ID NO: 2227104 - RNA, 16 nt, Streptococcus pyogenes MGAS8232
ugaaaacguguauucu

SEQ ID NO: 2227105 - RNA, 12 nt, Streptococcus pyogenes MGAS8232
ugaaaaaagaac

SEQ ID NO: 2227106 - RNA, 14 nt, Streptococcus pyogenes MGAS8232
ugaaccgcuaaaac

SEQ ID NO: 2227107 - RNA, 14 nt, Streptococcus pyogenes MGAS8232
ugaagcaaaauaaa

SEQ ID NO: 2227108 - RNA, 21 nt, Streptococcus pyogenes MGAS8232
ugaagacauggucgaccuuaa

SEQ ID NO: 2227109 - RNA, 17 nt, Streptococcus pyogenes MGAS8232
ucuuuguccauucuuua

SEQ ID NO: 2227110 - RNA, 19 nt, Streptococcus pyogenes MGAS8232
ucuuuguccauuuuuuaua

SEQ ID NO: 2227111 - RNA, 16 nt, Streptococcus pyogenes MGAS8232
ucuuuguuaccuucuu

SEQ ID NO: 2227112 - RNA, 13 nt, Streptococcus pyogenes MGAS8232
ucuuuuuuaccuu

SEQ ID NO: 2227113 - RNA, 13 nt, Streptococcus pyogenes MGAS8232
ucuuuuuggcuga

SEQ ID NO: 2227114 - RNA, 15 nt, Streptococcus pyogenes MGAS8232
ucuuuuuggcugaug

SEQ ID NO: 2227115 - RNA, 19 nt, Streptococcus pyogenes MGAS8232
ucuuucaguuguuuuaacu

SEQ ID NO: 2227116 - RNA, 18 nt, Streptococcus pyogenes MGAS8232
ucuuuggagaaauucaaa

SEQ ID NO: 2227117 - RNA, 13 nt, Streptococcus pyogenes MGAS8232
ucuuuaauaguuu

SEQ ID NO: 2227118 - RNA, 13 nt, Streptococcus pyogenes MGAS8232
ucuuguuuugguu

SEQ ID NO: 2227119 - RNA, 20 nt, Streptococcus pyogenes MGAS8232
ucuuguuuugguugauauaa

SEQ ID NO: 2227120 - RNA, 13 nt, Streptococcus pyogenes MGAS8232
ucuugcucauguu

SEQ ID NO: 2227121 - RNA, 23 nt, Streptococcus pyogenes MGAS8232
ucuuuauuuugauauuuuuucuc

SEQ ID NO: 2227122 - RNA, 21 nt, Streptococcus pyogenes MGAS8232
ucuuuauuuugauauuuuuuc

SEQ ID NO: 2227123 - RNA, 22 nt, Streptococcus pyogenes MGAS8232
ucuuuauaaugguuuuuugucu

SEQ ID NO: 2227124 - RNA, 17 nt, Streptococcus pyogenes MGAS8232
ucuugcauuaccuuauu

SEQ ID NO: 2227125 - RNA, 22 nt, Streptococcus pyogenes MGAS8232
ucuugaggugauucuuuuuuac

SEQ ID NO: 2227126 - RNA, 14 nt, Streptococcus pyogenes MGAS8232
ucuucuaaacguuu

SEQ ID NO: 2227127 - RNA, 16 nt, Streptococcus pyogenes MGAS8232
ucuguuucuugcaaug

SEQ ID NO: 2227128 - RNA, 20 nt, Streptococcus pyogenes MGAS8232
ucuggaaacuggucaaaagc

SEQ ID NO: 2227129 - RNA, 18 nt, Streptococcus pyogenes MGAS8232
ucuggccagcuacaaggc

SEQ ID NO: 2227130 - RNA, 21 nt, Streptococcus pyogenes MGAS8232
ucuggcauuugucuguggcuu

SEQ ID NO: 2227131 - RNA, 22 nt, Streptococcus pyogenes MGAS8232
ucugaugcguuuauaaaguuuu

SEQ ID NO: 2227132 - RNA, 20 nt, Streptococcus pyogenes MGAS8232
ucugaugcguuuauaaaguu

SEQ ID NO: 2227133 - RNA, 14 nt, Streptococcus pyogenes MGAS8232
ucugccuuuuuaau

SEQ ID NO: 2227134 - RNA, 15 nt, Streptococcus pyogenes MGAS8232
ucugccuuuuuaauc

SEQ ID NO: 2227135 - RNA, 12 nt, Streptococcus pyogenes MGAS8232
ucugaauuauua

SEQ ID NO: 2227136 - RNA, 13 nt, Streptococcus pyogenes MGAS8232
ucugagauauuca

SEQ ID NO: 2227137 - RNA, 19 nt, Streptococcus pyogenes MGAS8232
ucucuuuugugauuaguuu

SEQ ID NO: 2227138 - RNA, 19 nt, Streptococcus pyogenes MGAS8232
ugaccaauauagcaaucuu

SEQ ID NO: 2227139 - RNA, 20 nt, Streptococcus pyogenes MGAS8232
ugaccacaccuaauaaaaua

SEQ ID NO: 2227140 - RNA, 21 nt, Streptococcus pyogenes MGAS8232
ugaccaccggugccucaccac

SEQ ID NO: 2227141 - RNA, 15 nt, Streptococcus pyogenes MGAS8232
ugaccccaaaaguug

SEQ ID NO: 2227142 - RNA, 19 nt, Streptococcus pyogenes MGAS8232
ugacccguuuuccugcuca

SEQ ID NO: 2227143 - RNA, 12 nt, Streptococcus pyogenes MGAS8232
ugacuucaaaaa

SEQ ID NO: 2227144 - RNA, 21 nt, Streptococcus pyogenes MGAS8232
ugauaugguggguaaaaccaa

SEQ ID NO: 2227145 - RNA, 13 nt, Streptococcus pyogenes MGAS8232
ugauauaaaaaug

SEQ ID NO: 2227146 - RNA, 14 nt, Streptococcus pyogenes MGAS8232
ugauauaaaauugg

SEQ ID NO: 2227147 - RNA, 16 nt, Streptococcus pyogenes MGAS8232
ugauauaaaaauggag

SEQ ID NO: 2227148 - RNA, 18 nt, Streptococcus pyogenes MGAS8232
ugauaggaaaaagccaga

SEQ ID NO: 2227149 - RNA, 22 nt, Streptococcus pyogenes MGAS8232
ugagguauuuauaaauauuuua

SEQ ID NO: 2227150 - RNA, 13 nt, Streptococcus pyogenes MGAS8232
ugaggugaacacc

SEQ ID NO: 2227151 - RNA, 22 nt, Streptococcus pyogenes MGAS8232
ugcauuuaaucuuauuaaagag

SEQ ID NO: 2227152 - RNA, 21 nt, Streptococcus pyogenes MGAS8232
ugcacacaaaucuucuagaau

SEQ ID NO: 2227153 - RNA, 15 nt, Streptococcus pyogenes MGAS8232
ugcacgugcuccuag

SEQ ID NO: 2227154 - RNA, 15 nt, Streptococcus pyogenes MGAS8232
ugcagcuaaaaacaa

SEQ ID NO: 2227155 - RNA, 20 nt, Streptococcus pyogenes MGAS8232
ugcaauauccauagaaauug

SEQ ID NO: 2227156 - RNA, 17 nt, Streptococcus pyogenes MGAS8232
ugcaauauccauagaaa

SEQ ID NO: 2227157 - RNA, 15 nt, Streptococcus pyogenes MGAS8232
ugcaauucagcaucg

SEQ ID NO: 2227158 - RNA, 19 nt, Streptococcus pyogenes MGAS8232
ugcaacaucaaggguaaag

SEQ ID NO: 2227159 - RNA, 19 nt, Streptococcus pyogenes MGAS8232
ugcaaauaguagcaaauaa

SEQ ID NO: 2227160 - RNA, 12 nt, Streptococcus pyogenes MGAS8232
ugauuuuuaauu

SEQ ID NO: 2227161 - RNA, 14 nt, Streptococcus pyogenes MGAS8232
ugauuuuuaauucu

SEQ ID NO: 2227162 - RNA, 23 nt, Streptococcus pyogenes MGAS8232
ugauuuuucuuguuuugguugau

SEQ ID NO: 2227163 - RNA, 13 nt, Streptococcus pyogenes MGAS8232
ugauugccauuua

SEQ ID NO: 2227164 - RNA, 17 nt, Streptococcus pyogenes MGAS8232
ugauuuuaauuuuucuu

SEQ ID NO: 2227165 - RNA, 22 nt, Streptococcus pyogenes MGAS8232
ugaugagguauuuauaaauauu

SEQ ID NO: 2227166 - RNA, 21 nt, Streptococcus pyogenes MGAS8232
ugaugauaaaggccuguauuu

SEQ ID NO: 2227167 - RNA, 16 nt, Streptococcus pyogenes MGAS8232
ucauguuuuauuacca

SEQ ID NO: 2227168 - RNA, 23 nt, Streptococcus pyogenes MGAS8232
ucaguucugagauauucauuuuc

SEQ ID NO: 2227169 - RNA, 20 nt, Streptococcus pyogenes MGAS8232
ucaguucugagauauucauu

SEQ ID NO: 2227170 - RNA, 11 nt, Streptococcus pyogenes MGAS8232
ucauuuugguu

SEQ ID NO: 2227171 - RNA, 21 nt, Streptococcus pyogenes MGAS8232
uccaaaccauuuuaugagaaa

SEQ ID NO: 2227172 - RNA, 23 nt, Streptococcus pyogenes MGAS8232
uccaaaccauuuuaugagaaaaa

SEQ ID NO: 2227173 - RNA, 12 nt, Streptococcus pyogenes MGAS8232
uccaacaacgcu

SEQ ID NO: 2227174 - RNA, 22 nt, Streptococcus pyogenes MGAS8232
ucauuuguaacuccuuaaauua

SEQ ID NO: 2227175 - RNA, 15 nt, Streptococcus pyogenes MGAS8232
ucauugucaaagcug

SEQ ID NO: 2227176 - RNA, 17 nt, Streptococcus pyogenes MGAS8232
uccaaugaaaacuccag

SEQ ID NO: 2227177 - RNA, 15 nt, Streptococcus pyogenes MGAS8232
uccauucuuuauaau

SEQ ID NO: 2227178 - RNA, 16 nt, Streptococcus pyogenes MGAS8232
uccgaaaaaaacuugc

SEQ ID NO: 2227179 - RNA, 18 nt, Streptococcus pyogenes MGAS8232
ucccuuuaauucuuuaau

SEQ ID NO: 2227180 - RNA, 19 nt, Streptococcus pyogenes MGAS8232
ucccuuuaauucuuuaaua

SEQ ID NO: 2227181 - RNA, 18 nt, Streptococcus pyogenes MGAS8232
uccccuccuugcaauaga

SEQ ID NO: 2227182 - RNA, 21 nt, Streptococcus pyogenes MGAS8232
ucccagccaucaauagcagca

SEQ ID NO: 2227183 - RNA, 15 nt, Streptococcus pyogenes MGAS8232
uccuccuaaauauaa

SEQ ID NO: 2227184 - RNA, 16 nt, Streptococcus pyogenes MGAS8232
uccucgguuuuuuuaa

SEQ ID NO: 2227185 - RNA, 19 nt, Streptococcus pyogenes MGAS8232
uccucgguuuuuuuaagua

SEQ ID NO: 2227186 - RNA, 13 nt, Streptococcus pyogenes MGAS8232
uccucugaaaagu

SEQ ID NO: 2227187 - RNA, 15 nt, Streptococcus pyogenes MGAS8232
uccuuaaaagaaaau

SEQ ID NO: 2227188 - RNA, 17 nt, Streptococcus pyogenes MGAS8232
uccuggauuaaaugccc

SEQ ID NO: 2227189 - RNA, 18 nt, Streptococcus pyogenes MGAS8232
uccuaggacgaaacauuu

SEQ ID NO: 2227190 - RNA, 18 nt, Streptococcus pyogenes MGAS8232
uccuagucuuuuggcugu

SEQ ID NO: 2227191 - RNA, 23 nt, Streptococcus pyogenes MGAS8232
uccucaaacacguauuuuucgac

SEQ ID NO: 2227192 - RNA, 12 nt, Streptococcus pyogenes MGAS8232
uccguuugagau

SEQ ID NO: 2227193 - RNA, 16 nt, Streptococcus pyogenes MGAS8232
uccuaaaaccauaccu

SEQ ID NO: 2227194 - RNA, 16 nt, Streptococcus pyogenes MGAS8232
uccgucguuuuuuagu

SEQ ID NO: 2227195 - RNA, 21 nt, Streptococcus pyogenes MGAS8232
uccggcaggggucauuauugu

SEQ ID NO: 2227196 - RNA, 15 nt, Streptococcus pyogenes MGAS8232
ucgaucgucucgguu

SEQ ID NO: 2227197 - RNA, 17 nt, Streptococcus pyogenes MGAS8232
ucgacucccuuuaauuc

SEQ ID NO: 2227198 - RNA, 13 nt, Streptococcus pyogenes MGAS8232
uccuuugaccaca

SEQ ID NO: 2227199 - RNA, 13 nt, Streptococcus pyogenes MGAS8232
uccuuuugcuucu

SEQ ID NO: 2227200 - RNA, 18 nt, Streptococcus pyogenes MGAS8232
ucgaaaaugcuuuuucgu

SEQ ID NO: 2227201 - RNA, 22 nt, Streptococcus pyogenes MGAS8232
uccuuguacaagagcuuaaaag

SEQ ID NO: 2227202 - RNA, 17 nt, Streptococcus pyogenes MGAS8232
uccuugcguagauagca

SEQ ID NO: 2227203 - RNA, 14 nt, Streptococcus pyogenes MGAS8232
ucgacaauuaaaaa

SEQ ID NO: 2227204 - RNA, 15 nt, Streptococcus pyogenes MGAS8232
ucgacaauuaaaaaa

SEQ ID NO: 2227205 - RNA, 22 nt, Streptococcus pyogenes MGAS8232
uagucuccauaacauacucuau

SEQ ID NO: 2227206 - RNA, 15 nt, Streptococcus pyogenes MGAS8232
uagucuuuuggcugu

SEQ ID NO: 2227207 - RNA, 17 nt, Streptococcus pyogenes MGAS8232
uaguuauguuauaagau

SEQ ID NO: 2227208 - RNA, 13 nt, Streptococcus pyogenes MGAS8232
uaguuaucucaua

SEQ ID NO: 2227209 - RNA, 19 nt, Streptococcus pyogenes MGAS8232
uaguuaucucauaaaaaag

SEQ ID NO: 2227210 - RNA, 14 nt, Streptococcus pyogenes MGAS8232
uagugguauagaca

SEQ ID NO: 2227211 - RNA, 17 nt, Streptococcus pyogenes MGAS8232
uaguaaccauugccauu

SEQ ID NO: 2227212 - RNA, 20 nt, Streptococcus pyogenes MGAS8232
uaguaaccguuggcauaacc

SEQ ID NO: 2227213 - RNA, 20 nt, Streptococcus pyogenes MGAS8232
uagucagaucauuaaauuga

SEQ ID NO: 2227214 - RNA, 13 nt, Streptococcus pyogenes MGAS8232
uauaagagccauc

SEQ ID NO: 2227215 - RNA, 19 nt, Streptococcus pyogenes MGAS8232
uauaaaucuuacuaacuag

SEQ ID NO: 2227216 - RNA, 19 nt, Streptococcus pyogenes MGAS8232
uaguugauuagaauagucu

SEQ ID NO: 2227217 - RNA, 15 nt, Streptococcus pyogenes MGAS8232
uaguugcuucuuuua

SEQ ID NO: 2227218 - RNA, 18 nt, Streptococcus pyogenes MGAS8232
uauaaugguuuuuugucu

SEQ ID NO: 2227219 - RNA, 13 nt, Streptococcus pyogenes MGAS8232
uauaaugguuuuu

SEQ ID NO: 2227220 - RNA, 18 nt, Streptococcus pyogenes MGAS8232
uauaaugaugucucgaau

SEQ ID NO: 2227221 - RNA, 14 nt, Streptococcus pyogenes MGAS8232
uauaauaauauuau

SEQ ID NO: 2227222 - RNA, 23 nt, Streptococcus pyogenes MGAS8232
uauaguaaccauugccauuaaua

SEQ ID NO: 2227223 - RNA, 14 nt, Streptococcus pyogenes MGAS8232
uauaauuucaauaa

SEQ ID NO: 2227224 - RNA, 16 nt, Streptococcus pyogenes MGAS8232
uauauguguaauuucu

SEQ ID NO: 2227225 - RNA, 20 nt, Streptococcus pyogenes MGAS8232
uaucaccuugcuuauagcua

SEQ ID NO: 2227226 - RNA, 13 nt, Streptococcus pyogenes MGAS8232
uaucaagagucau

SEQ ID NO: 2227227 - RNA, 17 nt, Streptococcus pyogenes MGAS8232
uauccucuuuuaguuca

SEQ ID NO: 2227228 - RNA, 19 nt, Streptococcus pyogenes MGAS8232
uauccuccuaaauauaaau

SEQ ID NO: 2227229 - RNA, 16 nt, Streptococcus pyogenes MGAS8232
uaucaggcaaaacaaa

SEQ ID NO: 2227230 - RNA, 16 nt, Streptococcus pyogenes MGAS8232
uauggcuauaaaugga

SEQ ID NO: 2227231 - RNA, 20 nt, Streptococcus pyogenes MGAS8232
uauggcuucuaaaaaaaagu

SEQ ID NO: 2227232 - RNA, 17 nt, Streptococcus pyogenes MGAS8232
uauggguaugccugaag

SEQ ID NO: 2227233 - RNA, 14 nt, Streptococcus pyogenes MGAS8232
uaugcuguccauga

SEQ ID NO: 2227234 - RNA, 13 nt, Streptococcus pyogenes MGAS8232
uaugauauaaaaa

SEQ ID NO: 2227235 - RNA, 14 nt, Streptococcus pyogenes MGAS8232
uaugauauaaaaau

SEQ ID NO: 2227236 - RNA, 18 nt, Streptococcus pyogenes MGAS8232
uaucuagaacagcugcuu

SEQ ID NO: 2227237 - RNA, 14 nt, Streptococcus pyogenes MGAS8232
uaucuagaacagcu

SEQ ID NO: 2227238 - RNA, 17 nt, Streptococcus pyogenes MGAS8232
uaucuaagcuauagaaa

SEQ ID NO: 2227239 - RNA, 23 nt, Streptococcus pyogenes MGAS8232
uaucugcagauuuuaagacaaca

SEQ ID NO: 2227240 - RNA, 13 nt, Streptococcus pyogenes MGAS8232
uaugaaaaagaag

SEQ ID NO: 2227241 - RNA, 21 nt, Streptococcus pyogenes MGAS8232
uaucuuuguuaccuucuucaa

SEQ ID NO: 2227242 - RNA, 14 nt, Streptococcus pyogenes MGAS8232
uauuguuaguuuua

SEQ ID NO: 2227243 - RNA, 16 nt, Streptococcus pyogenes MGAS8232
uauuggaaaauauauu

SEQ ID NO: 2227244 - RNA, 22 nt, Streptococcus pyogenes MGAS8232
uauuggccuucuuggaaaacag

SEQ ID NO: 2227245 - RNA, 12 nt, Streptococcus pyogenes MGAS8232
uauuauuuugcu

SEQ ID NO: 2227246 - RNA, 20 nt, Streptococcus pyogenes MGAS8232
uauguugcuuaaugaccuuu

SEQ ID NO: 2227247 - RNA, 13 nt, Streptococcus pyogenes MGAS8232
uauguucuaaaaa

SEQ ID NO: 2227248 - RNA, 16 nt, Streptococcus pyogenes MGAS8232
uauguugauugccauu

SEQ ID NO: 2227249 - RNA, 19 nt, Streptococcus pyogenes MGAS8232
uauguuauaagauaaguaa

SEQ ID NO: 2227250 - RNA, 19 nt, Streptococcus pyogenes MGAS8232
uauguaacgcuuguuuaug

SEQ ID NO: 2227251 - RNA, 16 nt, Streptococcus pyogenes MGAS8232
uauuacaaaacugucu

SEQ ID NO: 2227252 - RNA, 19 nt, Streptococcus pyogenes MGAS8232
uauuaauaaguauuuuaaa

SEQ ID NO: 2227253 - RNA, 15 nt, Streptococcus pyogenes MGAS8232
uauuaaucaaaaaac

SEQ ID NO: 2227254 - RNA, 14 nt, Streptococcus pyogenes MGAS8232
uauuaaagagaaag

SEQ ID NO: 2227255 - RNA, 12 nt, Streptococcus pyogenes MGAS8232
uauuaaagacaa

SEQ ID NO: 2227256 - RNA, 22 nt, Streptococcus pyogenes MGAS8232
uauuaaccggcucuaaaauaua

SEQ ID NO: 2227257 - RNA, 13 nt, Streptococcus pyogenes MGAS8232
ucaauaucacauu

SEQ ID NO: 2227258 - RNA, 17 nt, Streptococcus pyogenes MGAS8232
ucaauauaauaaaaagu

SEQ ID NO: 2227259 - RNA, 14 nt, Streptococcus pyogenes MGAS8232
ucaauauaauaaaa

SEQ ID NO: 2227260 - RNA, 20 nt, Streptococcus pyogenes MGAS8232
ucaauacucccuucucuagu

SEQ ID NO: 2227261 - RNA, 17 nt, Streptococcus pyogenes MGAS8232
ucaauaacagaaauuaa

SEQ ID NO: 2227262 - RNA, 13 nt, Streptococcus pyogenes MGAS8232
ucaauugcuuuua

SEQ ID NO: 2227263 - RNA, 16 nt, Streptococcus pyogenes MGAS8232
ucaacaaauccuuuug

SEQ ID NO: 2227264 - RNA, 19 nt, Streptococcus pyogenes MGAS8232
ucaacaaauccuuuugcuu

SEQ ID NO: 2227265 - RNA, 21 nt, Streptococcus pyogenes MGAS8232
ucaacagauagucaaaaagac

SEQ ID NO: 2227266 - RNA, 16 nt, Streptococcus pyogenes MGAS8232
ucaacaguauaacugu

SEQ ID NO: 2227267 - RNA, 20 nt, Streptococcus pyogenes MGAS8232
ucaacgcuagcauaaugcau

SEQ ID NO: 2227268 - RNA, 14 nt, Streptococcus pyogenes MGAS8232
uauuuaauagcauu

SEQ ID NO: 2227269 - RNA, 23 nt, Streptococcus pyogenes MGAS8232
uauuuaauagcauugucaaauaa

SEQ ID NO: 2227270 - RNA, 12 nt, Streptococcus pyogenes MGAS8232
uauuuaauagca

SEQ ID NO: 2227271 - RNA, 20 nt, Streptococcus pyogenes MGAS8232
ucaaaagaccauaaaaaacc

SEQ ID NO: 2227272 - RNA, 20 nt, Streptococcus pyogenes MGAS8232
ucaaacuauauuguuaguuu

SEQ ID NO: 2227273 - RNA, 15 nt, Streptococcus pyogenes MGAS8232
ucacuauaauuucaa

SEQ ID NO: 2227274 - RNA, 23 nt, Streptococcus pyogenes MGAS8232
ucacuauaauuucaauaauacca

SEQ ID NO: 2227275 - RNA, 17 nt, Streptococcus pyogenes MGAS8232
ucacuagauaagucauu

SEQ ID NO: 2227276 - RNA, 13 nt, Streptococcus pyogenes MGAS8232
ucagagcuuuuuu

SEQ ID NO: 2227277 - RNA, 13 nt, Streptococcus pyogenes MGAS8232
ucagagaugcuuc

SEQ ID NO: 2227278 - RNA, 16 nt, Streptococcus pyogenes MGAS8232
ucagaauaagaaaacc

SEQ ID NO: 2227279 - RNA, 19 nt, Streptococcus pyogenes MGAS8232
ucagaauaagaaaaccuua

SEQ ID NO: 2227280 - RNA, 14 nt, Streptococcus pyogenes MGAS8232
ucagaauaagaaaa

SEQ ID NO: 2227281 - RNA, 24 nt, Streptococcus pyogenes MGAS8232
aaaucuaaucagaacucgucuuug

SEQ ID NO: 2227282 - RNA, 13 nt, Streptococcus pyogenes MGAS8232
ucagcucucaaga

SEQ ID NO: 2227283 - RNA, 22 nt, Streptococcus pyogenes MGAS8232
guggaggucugugaugaaucau

SEQ ID NO: 2227284 - RNA, 13 nt, Streptococcus pyogenes MGAS8232
aaauauaaauuau

SEQ ID NO: 2227285 - RNA, 17 nt, Streptococcus pyogenes MGAS8232
aaauauaaauuauuaac

SEQ ID NO: 2227286 - RNA, 14 nt, Streptococcus pyogenes MGAS8232
aaauauauucuaau

SEQ ID NO: 2227287 - RNA, 21 nt, Streptococcus pyogenes MGAS8232
guuccuuagcaguuauaauua

SEQ ID NO: 2227288 - RNA, 16 nt, Streptococcus pyogenes MGAS8232
guuaucugauauuuca

SEQ ID NO: 2227289 - RNA, 20 nt, Streptococcus pyogenes MGAS8232
guuaacaaaaauaaguauag

SEQ ID NO: 2227290 - RNA, 17 nt, Streptococcus pyogenes MGAS8232
guuaaguggaauguuua

SEQ ID NO: 2227291 - RNA, 20 nt, Streptococcus pyogenes MGAS8232
guuaagagagguugguaaaa

SEQ ID NO: 2227292 - RNA, 17 nt, Streptococcus pyogenes MGAS8232
guuggucguacuuggca

SEQ ID NO: 2227293 - RNA, 19 nt, Streptococcus pyogenes MGAS8232
guugcuacaauuuuuucaa

SEQ ID NO: 2227294 - RNA, 21 nt, Streptococcus pyogenes MGAS8232
guucuaguuuaggauauaaga

SEQ ID NO: 2227295 - RNA, 18 nt, Streptococcus pyogenes MGAS8232
guucuaaacuuauguuua

SEQ ID NO: 2227296 - RNA, 13 nt, Streptococcus pyogenes MGAS8232
guugagccuuuuc

SEQ ID NO: 2227297 - RNA, 18 nt, Streptococcus pyogenes MGAS8232
guugcaccaccaaccuua

SEQ ID NO: 2227298 - RNA, 21 nt, Streptococcus pyogenes MGAS8232
aaauaucuuuuuuacuuuuaa

SEQ ID NO: 2227299 - RNA, 23 nt, Streptococcus pyogenes MGAS8232
aaauaucuuuuuuacuuuuaaaa

SEQ ID NO: 2227300 - RNA, 15 nt, Streptococcus pyogenes MGAS8232
aaauaucuuaccauu

SEQ ID NO: 2227301 - RNA, 17 nt, Streptococcus pyogenes MGAS8232
guuuugauuaaaucuuc

SEQ ID NO: 2227302 - RNA, 14 nt, Streptococcus pyogenes MGAS8232
guuucuaguuucau

SEQ ID NO: 2227303 - RNA, 17 nt, Streptococcus pyogenes MGAS8232
gugaggacuuauuuuuu

SEQ ID NO: 2227304 - RNA, 22 nt, Streptococcus pyogenes MGAS8232
gugaaaguaucuaggagggacu

SEQ ID NO: 2227305 - RNA, 16 nt, Streptococcus pyogenes MGAS8232
gucuuuguccauucuu

SEQ ID NO: 2227306 - RNA, 21 nt, Streptococcus pyogenes MGAS8232
gucuugcucauguuuucucaa

SEQ ID NO: 2227307 - RNA, 16 nt, Streptococcus pyogenes MGAS8232
gucuucuucuuuucag

SEQ ID NO: 2227308 - RNA, 18 nt, Streptococcus pyogenes MGAS8232
gucuguggcuuucucauc

SEQ ID NO: 2227309 - RNA, 13 nt, Streptococcus pyogenes MGAS8232
gucugugaugaau

SEQ ID NO: 2227310 - RNA, 17 nt, Streptococcus pyogenes MGAS8232
gucugcaaguucuuugc

SEQ ID NO: 2227311 - RNA, 22 nt, Streptococcus pyogenes MGAS8232
gucugacaccacccgaagcuaa

SEQ ID NO: 2227312 - RNA, 18 nt, Streptococcus pyogenes MGAS8232
gucugcgcgacuaaaauc

SEQ ID NO: 2227313 - RNA, 22 nt, Streptococcus pyogenes MGAS8232
gucuggcauuugucuguggcuu

SEQ ID NO: 2227314 - RNA, 12 nt, Streptococcus pyogenes MGAS8232
gucucuuuugug

SEQ ID NO: 2227315 - RNA, 21 nt, Streptococcus pyogenes MGAS8232
gucuccuucuuugcagagaug

SEQ ID NO: 2227316 - RNA, 20 nt, Streptococcus pyogenes MGAS8232
gucucgaauauaauucaugu

SEQ ID NO: 2227317 - RNA, 18 nt, Streptococcus pyogenes MGAS8232
gucgaccuuaaaggccuc

SEQ ID NO: 2227318 - RNA, 19 nt, Streptococcus pyogenes MGAS8232
gucgaccuuaaaggccucc

SEQ ID NO: 2227319 - RNA, 21 nt, Streptococcus pyogenes MGAS8232
guccuagucuuuuggcuguau

SEQ ID NO: 2227320 - RNA, 17 nt, Streptococcus pyogenes MGAS8232
gucgcugaccaccggug

SEQ ID NO: 2227321 - RNA, 22 nt, Streptococcus pyogenes MGAS8232
gucaucaaaagaccauaaaaaa

SEQ ID NO: 2227322 - RNA, 16 nt, Streptococcus pyogenes MGAS8232
gucauuuuaaguaguc

SEQ ID NO: 2227323 - RNA, 13 nt, Streptococcus pyogenes MGAS8232
guccaugauuuuc

SEQ ID NO: 2227324 - RNA, 19 nt, Streptococcus pyogenes MGAS8232
gucaacuuaccagcaccuu

SEQ ID NO: 2227325 - RNA, 20 nt, Streptococcus pyogenes MGAS8232
gucaacuuaccagcaccuuc

SEQ ID NO: 2227326 - RNA, 20 nt, Streptococcus pyogenes MGAS8232
gucaauuuagccguccuuaa

SEQ ID NO: 2227327 - RNA, 15 nt, Streptococcus pyogenes MGAS8232
uacuaauauuauauu

SEQ ID NO: 2227328 - RNA, 19 nt, Streptococcus pyogenes MGAS8232
uacggcuucuacacaaaag

SEQ ID NO: 2227329 - RNA, 16 nt, Streptococcus pyogenes MGAS8232
uacgggauuuaguucu

SEQ ID NO: 2227330 - RNA, 17 nt, Streptococcus pyogenes MGAS8232
uacgacagcagcaguug

SEQ ID NO: 2227331 - RNA, 16 nt, Streptococcus pyogenes MGAS8232
uacuaggcuuucauua

SEQ ID NO: 2227332 - RNA, 15 nt, Streptococcus pyogenes MGAS8232
uacuagugaagacau

SEQ ID NO: 2227333 - RNA, 24 nt, Streptococcus pyogenes MGAS8232
uacuaguguguugucaaacauaac

SEQ ID NO: 2227334 - RNA, 16 nt, Streptococcus pyogenes MGAS8232
uacucuauuuuaagua

SEQ ID NO: 2227335 - RNA, 14 nt, Streptococcus pyogenes MGAS8232
uacuucaaggaagg

SEQ ID NO: 2227336 - RNA, 14 nt, Streptococcus pyogenes MGAS8232
uaccauuucuuugc

SEQ ID NO: 2227337 - RNA, 13 nt, Streptococcus pyogenes MGAS8232
uaccccaaaggcu

SEQ ID NO: 2227338 - RNA, 21 nt, Streptococcus pyogenes MGAS8232
uaccaacaauguagcuaucaa

SEQ ID NO: 2227339 - RNA, 16 nt, Streptococcus pyogenes MGAS8232
uacaguauguaaauau

SEQ ID NO: 2227340 - RNA, 12 nt, Streptococcus pyogenes MGAS8232
uacaaaaaacaa

SEQ ID NO: 2227341 - RNA, 14 nt, Streptococcus pyogenes MGAS8232
uaauuucuugugcu

SEQ ID NO: 2227342 - RNA, 17 nt, Streptococcus pyogenes MGAS8232
uaauuuauuccauuuau

SEQ ID NO: 2227343 - RNA, 20 nt, Streptococcus pyogenes MGAS8232
uaauuuauuccauuuaucuu

SEQ ID NO: 2227344 - RNA, 15 nt, Streptococcus pyogenes MGAS8232
uacaagcauuuugca

SEQ ID NO: 2227345 - RNA, 18 nt, Streptococcus pyogenes MGAS8232
uacaagagcuuaaaaguu

SEQ ID NO: 2227346 - RNA, 21 nt, Streptococcus pyogenes MGAS8232
uaauguuauaauaauauuaua

SEQ ID NO: 2227347 - RNA, 11 nt, Streptococcus pyogenes MGAS8232
uaauuagcaua

SEQ ID NO: 2227348 - RNA, 15 nt, Streptococcus pyogenes MGAS8232
uaaugauucaauauc

SEQ ID NO: 2227349 - RNA, 16 nt, Streptococcus pyogenes MGAS8232
uaaugauuuuuaauuc

SEQ ID NO: 2227350 - RNA, 15 nt, Streptococcus pyogenes MGAS8232
uaaugauaaggcugc

SEQ ID NO: 2227351 - RNA, 14 nt, Streptococcus pyogenes MGAS8232
uaaucgaugauaau

SEQ ID NO: 2227352 - RNA, 18 nt, Streptococcus pyogenes MGAS8232
uaaucgagagauuauucu

SEQ ID NO: 2227353 - RNA, 16 nt, Streptococcus pyogenes MGAS8232
uaauauguaacgcuug

SEQ ID NO: 2227354 - RNA, 14 nt, Streptococcus pyogenes MGAS8232
uaauauuuuuacau

SEQ ID NO: 2227355 - RNA, 16 nt, Streptococcus pyogenes MGAS8232
uaauccaacaacgcua

SEQ ID NO: 2227356 - RNA, 16 nt, Streptococcus pyogenes MGAS8232
uaaucagagcucgucu

SEQ ID NO: 2227357 - RNA, 18 nt, Streptococcus pyogenes MGAS8232
uaauaagauucaauauga

SEQ ID NO: 2227358 - RNA, 20 nt, Streptococcus pyogenes MGAS8232
uaauaaguauuuuaaaaucc

SEQ ID NO: 2227359 - RNA, 14 nt, Streptococcus pyogenes MGAS8232
uaauaaguauuuua

SEQ ID NO: 2227360 - RNA, 17 nt, Streptococcus pyogenes MGAS8232
uaauaaguauuuuaaaa

SEQ ID NO: 2227361 - RNA, 16 nt, Streptococcus pyogenes MGAS8232
uaauacgagcuagggc

SEQ ID NO: 2227362 - RNA, 11 nt, Streptococcus pyogenes MGAS8232
uaauaguuuua

SEQ ID NO: 2227363 - RNA, 15 nt, Streptococcus pyogenes MGAS8232
uaacuccuuaaauua

SEQ ID NO: 2227364 - RNA, 19 nt, Streptococcus pyogenes MGAS8232
uaacuccuuaaauuauagu

SEQ ID NO: 2227365 - RNA, 22 nt, Streptococcus pyogenes MGAS8232
uaacuccuuaaauuauaguaua

SEQ ID NO: 2227366 - RNA, 20 nt, Streptococcus pyogenes MGAS8232
uaagagccaucagcucucaa

SEQ ID NO: 2227367 - RNA, 23 nt, Streptococcus pyogenes MGAS8232
uaagagagguugguaaaaaggca

SEQ ID NO: 2227368 - RNA, 13 nt, Streptococcus pyogenes MGAS8232
uaagaccuucaaa

SEQ ID NO: 2227369 - RNA, 20 nt, Streptococcus pyogenes MGAS8232
uaagauuaaacuuacaaaaa

SEQ ID NO: 2227370 - RNA, 16 nt, Streptococcus pyogenes MGAS8232
uaagauggugcuuuaa

SEQ ID NO: 2227371 - RNA, 17 nt, Streptococcus pyogenes MGAS8232
uaagauaaguaauauuu

SEQ ID NO: 2227372 - RNA, 20 nt, Streptococcus pyogenes MGAS8232
uaagaaggaacucuccaaag

SEQ ID NO: 2227373 - RNA, 15 nt, Streptococcus pyogenes MGAS8232
uaagaaggucucaaa

SEQ ID NO: 2227374 - RNA, 13 nt, Streptococcus pyogenes MGAS8232
uaacuuucuauua

SEQ ID NO: 2227375 - RNA, 18 nt, Streptococcus pyogenes MGAS8232
uaagcugacgauaaguca

SEQ ID NO: 2227376 - RNA, 17 nt, Streptococcus pyogenes MGAS8232
uaaggcugcgaugauuu

SEQ ID NO: 2227377 - RNA, 17 nt, Streptococcus pyogenes MGAS8232
uaaggcuuacgacagca

SEQ ID NO: 2227378 - RNA, 20 nt, Streptococcus pyogenes MGAS8232
uaaggauuaugaaaaagaag

SEQ ID NO: 2227379 - RNA, 13 nt, Streptococcus pyogenes MGAS8232
uaaggauuuagcu

SEQ ID NO: 2227380 - RNA, 20 nt, Streptococcus pyogenes MGAS8232
uaagauuugaccacaccuaa

SEQ ID NO: 2227381 - RNA, 12 nt, Streptococcus pyogenes MGAS8232
uaagauuuccac

SEQ ID NO: 2227382 - RNA, 21 nt, Streptococcus pyogenes MGAS8232
uaagcaucauuauugacaaau

SEQ ID NO: 2227383 - RNA, 15 nt, Streptococcus pyogenes MGAS8232
uaagcauuuugagaa

SEQ ID NO: 2227384 - RNA, 13 nt, Streptococcus pyogenes MGAS8232
uaagcauuuugag

SEQ ID NO: 2227385 - RNA, 14 nt, Streptococcus pyogenes MGAS8232
uaaggguuaacaau

SEQ ID NO: 2227386 - RNA, 21 nt, Streptococcus pyogenes MGAS8232
uaagguacacgugauaaaugc

SEQ ID NO: 2227387 - RNA, 13 nt, Streptococcus pyogenes MGAS8232
uaaguaaaagcga

SEQ ID NO: 2227388 - RNA, 17 nt, Streptococcus pyogenes MGAS8232
uaaguauuuuaaaaucc

SEQ ID NO: 2227389 - RNA, 15 nt, Streptococcus pyogenes MGAS8232
uaaguauuuuaaaau

SEQ ID NO: 2227390 - RNA, 18 nt, Streptococcus pyogenes MGAS8232
uaaguccuuuuaguuuua

SEQ ID NO: 2227391 - RNA, 17 nt, Streptococcus pyogenes MGAS8232
uaaguagucaaaauagg

SEQ ID NO: 2227392 - RNA, 12 nt, Streptococcus pyogenes MGAS8232
uaauaaaaagua

SEQ ID NO: 2227393 - RNA, 13 nt, Streptococcus pyogenes MGAS8232
uaauaaaaagagu

SEQ ID NO: 2227394 - RNA, 19 nt, Streptococcus pyogenes MGAS8232
uaauaaacuguauacaaaa

SEQ ID NO: 2227395 - RNA, 17 nt, Streptococcus pyogenes MGAS8232
uaagugagcgcccuaaa

SEQ ID NO: 2227396 - RNA, 22 nt, Streptococcus pyogenes MGAS8232
uaaauuaaugauucaauaucac

SEQ ID NO: 2227397 - RNA, 22 nt, Streptococcus pyogenes MGAS8232
uaaauuauuaacguuaacaaaa

SEQ ID NO: 2227398 - RNA, 13 nt, Streptococcus pyogenes MGAS8232
uaacaaaaauaag

SEQ ID NO: 2227399 - RNA, 15 nt, Streptococcus pyogenes MGAS8232
uaacaaaaauaagua

SEQ ID NO: 2227400 - RNA, 16 nt, Streptococcus pyogenes MGAS8232
uaacaucuugauugua

SEQ ID NO: 2227401 - RNA, 17 nt, Streptococcus pyogenes MGAS8232
uaacagaaauuaauaaa

SEQ ID NO: 2227402 - RNA, 17 nt, Streptococcus pyogenes MGAS8232
uaacccucauugucaaa

SEQ ID NO: 2227403 - RNA, 18 nt, Streptococcus pyogenes MGAS8232
uaacgcuuguuuaugaaa

SEQ ID NO: 2227404 - RNA, 19 nt, Streptococcus pyogenes MGAS8232
uaaauaucuuaccauugua

SEQ ID NO: 2227405 - RNA, 14 nt, Streptococcus pyogenes MGAS8232
uaaauauaaauuau

SEQ ID NO: 2227406 - RNA, 16 nt, Streptococcus pyogenes MGAS8232
uaaagcaucagcauaa

SEQ ID NO: 2227407 - RNA, 13 nt, Streptococcus pyogenes MGAS8232
uaaagcaucagca

SEQ ID NO: 2227408 - RNA, 23 nt, Streptococcus pyogenes MGAS8232
uaaacacuaccuuaaauguauga

SEQ ID NO: 2227409 - RNA, 15 nt, Streptococcus pyogenes MGAS8232
uaaacuuacaaaaag

SEQ ID NO: 2227410 - RNA, 15 nt, Streptococcus pyogenes MGAS8232
uaaacuuauguuuau

SEQ ID NO: 2227411 - RNA, 17 nt, Streptococcus pyogenes MGAS8232
uaaacuguauacaaaaa

SEQ ID NO: 2227412 - RNA, 20 nt, Streptococcus pyogenes MGAS8232
gcugauaggucugcaauauc

SEQ ID NO: 2227413 - RNA, 15 nt, Streptococcus pyogenes MGAS8232
gcugagcaaaacaau

SEQ ID NO: 2227414 - RNA, 14 nt, Streptococcus pyogenes MGAS8232
gcugcgaugauuuu

SEQ ID NO: 2227415 - RNA, 19 nt, Streptococcus pyogenes MGAS8232
gcugcuaauggguuguuuu

SEQ ID NO: 2227416 - RNA, 22 nt, Streptococcus pyogenes MGAS8232
gcucuaauuuagucauuucuuc

SEQ ID NO: 2227417 - RNA, 17 nt, Streptococcus pyogenes MGAS8232
gcucuaauuuagucauu

SEQ ID NO: 2227418 - RNA, 13 nt, Streptococcus pyogenes MGAS8232
gcucuaucaucuu

SEQ ID NO: 2227419 - RNA, 17 nt, Streptococcus pyogenes MGAS8232
gcucggugcugacuggu

SEQ ID NO: 2227420 - RNA, 23 nt, Streptococcus pyogenes MGAS8232
aaaggauuuaguuuuguauugua

SEQ ID NO: 2227421 - RNA, 20 nt, Streptococcus pyogenes MGAS8232
gcuucuaaaaaaaaguuauc

SEQ ID NO: 2227422 - RNA, 13 nt, Streptococcus pyogenes MGAS8232
gcuucuuucaaac

SEQ ID NO: 2227423 - RNA, 14 nt, Streptococcus pyogenes MGAS8232
gcuugacuuucuac

SEQ ID NO: 2227424 - RNA, 16 nt, Streptococcus pyogenes MGAS8232
gcuugcucaauuuuug

SEQ ID NO: 2227425 - RNA, 13 nt, Streptococcus pyogenes MGAS8232
gcuguuggauaca

SEQ ID NO: 2227426 - RNA, 16 nt, Streptococcus pyogenes MGAS8232
gcuuacgacagcagca

SEQ ID NO: 2227427 - RNA, 15 nt, Streptococcus pyogenes MGAS8232
aaagucacgaguguu

SEQ ID NO: 2227428 - RNA, 15 nt, Streptococcus pyogenes MGAS8232
aaaguaguuucucau

SEQ ID NO: 2227429 - RNA, 18 nt, Streptococcus pyogenes MGAS8232
aaaguaaggguuaacaau

SEQ ID NO: 2227430 - RNA, 20 nt, Streptococcus pyogenes MGAS8232
aaaguaaggguuaacaauga

SEQ ID NO: 2227431 - RNA, 16 nt, Streptococcus pyogenes MGAS8232
ggaugauucaaaugaa

SEQ ID NO: 2227432 - RNA, 14 nt, Streptococcus pyogenes MGAS8232
ggauauugagaaga

SEQ ID NO: 2227433 - RNA, 23 nt, Streptococcus pyogenes MGAS8232
aaaggcuuuuuuguauuacucaa

SEQ ID NO: 2227434 - RNA, 17 nt, Streptococcus pyogenes MGAS8232
ggaaauuuuaaaugaca

SEQ ID NO: 2227435 - RNA, 21 nt, Streptococcus pyogenes MGAS8232
ggaauguuuacuggacgaaca

SEQ ID NO: 2227436 - RNA, 15 nt, Streptococcus pyogenes MGAS8232
ggucaucagaauaag

SEQ ID NO: 2227437 - RNA, 17 nt, Streptococcus pyogenes MGAS8232
gguaguuacgcauaccu

SEQ ID NO: 2227438 - RNA, 15 nt, Streptococcus pyogenes MGAS8232
gguauuuuucgacca

SEQ ID NO: 2227439 - RNA, 14 nt, Streptococcus pyogenes MGAS8232
ggucaacuccaauc

SEQ ID NO: 2227440 - RNA, 14 nt, Streptococcus pyogenes MGAS8232
gguaaaaaggcagu

SEQ ID NO: 2227441 - RNA, 16 nt, Streptococcus pyogenes MGAS8232
gguaaagauuuuaaau

SEQ ID NO: 2227442 - RNA, 14 nt, Streptococcus pyogenes MGAS8232
gggugucugacacc

SEQ ID NO: 2227443 - RNA, 17 nt, Streptococcus pyogenes MGAS8232
ggguaaaaugacugaca

SEQ ID NO: 2227444 - RNA, 10 nt, Streptococcus pyogenes MGAS8232
ggguccacuu

SEQ ID NO: 2227445 - RNA, 18 nt, Streptococcus pyogenes MGAS8232
ggggauagacaaaaggga

SEQ ID NO: 2227446 - RNA, 18 nt, Streptococcus pyogenes MGAS8232
gggcuaaguagauacuuc

SEQ ID NO: 2227447 - RNA, 12 nt, Streptococcus pyogenes MGAS8232
gggcaaugccau

SEQ ID NO: 2227448 - RNA, 17 nt, Streptococcus pyogenes MGAS8232
gggauagacaaaaggga

SEQ ID NO: 2227449 - RNA, 17 nt, Streptococcus pyogenes MGAS8232
ggcuuuccauucuugca

SEQ ID NO: 2227450 - RNA, 15 nt, Streptococcus pyogenes MGAS8232
gggagacggauuuaa

SEQ ID NO: 2227451 - RNA, 14 nt, Streptococcus pyogenes MGAS8232
ggcuucuaaaaaaa

SEQ ID NO: 2227452 - RNA, 15 nt, Streptococcus pyogenes MGAS8232
ggcuucuaaaaaaaa

SEQ ID NO: 2227453 - RNA, 17 nt, Streptococcus pyogenes MGAS8232
ggcuugcauuuuuugca

SEQ ID NO: 2227454 - RNA, 13 nt, Streptococcus pyogenes MGAS8232
ggcuuaaacauau

SEQ ID NO: 2227455 - RNA, 15 nt, Streptococcus pyogenes MGAS8232
aaauaacuuuaaaag

SEQ ID NO: 2227456 - RNA, 14 nt, Streptococcus pyogenes MGAS8232
aaauaacuuuaaaa

SEQ ID NO: 2227457 - RNA, 20 nt, Streptococcus pyogenes MGAS8232
aaauaacaucaaaggguguu

SEQ ID NO: 2227458 - RNA, 19 nt, Streptococcus pyogenes MGAS8232
gccguccuuaaaagaaaau

SEQ ID NO: 2227459 - RNA, 14 nt, Streptococcus pyogenes MGAS8232
gccguccuuaaaag

SEQ ID NO: 2227460 - RNA, 17 nt, Streptococcus pyogenes MGAS8232
gccguccuuaaaagaaa

SEQ ID NO: 2227461 - RNA, 21 nt, Streptococcus pyogenes MGAS8232
gccucgcugaaagucuuagca

SEQ ID NO: 2227462 - RNA, 17 nt, Streptococcus pyogenes MGAS8232
gccuuuuuaaucuuguu

SEQ ID NO: 2227463 - RNA, 13 nt, Streptococcus pyogenes MGAS8232
gcgaaagcuucau

SEQ ID NO: 2227464 - RNA, 14 nt, Streptococcus pyogenes MGAS8232
gccugucaagcccu

SEQ ID NO: 2227465 - RNA, 16 nt, Streptococcus pyogenes MGAS8232
gccugucaagcccugc

SEQ ID NO: 2227466 - RNA, 23 nt, Streptococcus pyogenes MGAS8232
gccucuucugaugcguuuauaaa

SEQ ID NO: 2227467 - RNA, 20 nt, Streptococcus pyogenes MGAS8232
gcgcgacuaaaaucauggga

SEQ ID NO: 2227468 - RNA, 22 nt, Streptococcus pyogenes MGAS8232
gcauaaaagauauuuuaaaaua

SEQ ID NO: 2227469 - RNA, 23 nt, Streptococcus pyogenes MGAS8232
gcaguugcgaucauaaauaaaga

SEQ ID NO: 2227470 - RNA, 19 nt, Streptococcus pyogenes MGAS8232
gcaguuauaauuaguauau

SEQ ID NO: 2227471 - RNA, 13 nt, Streptococcus pyogenes MGAS8232
gcaggcguuuugu

SEQ ID NO: 2227472 - RNA, 17 nt, Streptococcus pyogenes MGAS8232
gcaucgcaaacagaugc

SEQ ID NO: 2227473 - RNA, 16 nt, Streptococcus pyogenes MGAS8232
gcaucuacagcaccuu

SEQ ID NO: 2227474 - RNA, 15 nt, Streptococcus pyogenes MGAS8232
gcaucuacagcaccu

SEQ ID NO: 2227475 - RNA, 20 nt, Streptococcus pyogenes MGAS8232
gcauauugaaacuugcugcc

SEQ ID NO: 2227476 - RNA, 18 nt, Streptococcus pyogenes MGAS8232
gcauaaugcauguaauga

SEQ ID NO: 2227477 - RNA, 14 nt, Streptococcus pyogenes MGAS8232
gcauaauaaaaaga

SEQ ID NO: 2227478 - RNA, 16 nt, Streptococcus pyogenes MGAS8232
gcauuuucaucaucaa

SEQ ID NO: 2227479 - RNA, 23 nt, Streptococcus pyogenes MGAS8232
gcauuccucaaacacguauuuuu

SEQ ID NO: 2227480 - RNA, 22 nt, Streptococcus pyogenes MGAS8232
gccaaauuucagauaagaccuu

SEQ ID NO: 2227481 - RNA, 21 nt, Streptococcus pyogenes MGAS8232
gccagagcaguucagcagcac

SEQ ID NO: 2227482 - RNA, 14 nt, Streptococcus pyogenes MGAS8232
gccauuuaaaaggg

SEQ ID NO: 2227483 - RNA, 15 nt, Streptococcus pyogenes MGAS8232
gauuuuggaugaaag

SEQ ID NO: 2227484 - RNA, 18 nt, Streptococcus pyogenes MGAS8232
gcaaaagaugauggacug

SEQ ID NO: 2227485 - RNA, 13 nt, Streptococcus pyogenes MGAS8232
gcaaaacaauaac

SEQ ID NO: 2227486 - RNA, 17 nt, Streptococcus pyogenes MGAS8232
gcaaauaguagcaaaua

SEQ ID NO: 2227487 - RNA, 20 nt, Streptococcus pyogenes MGAS8232
gauuugcugagcuaaagcca

SEQ ID NO: 2227488 - RNA, 22 nt, Streptococcus pyogenes MGAS8232
gauuugaccacaccuaauaaaa

SEQ ID NO: 2227489 - RNA, 22 nt, Streptococcus pyogenes MGAS8232
gauuugucuucuccgacugcaa

SEQ ID NO: 2227490 - RNA, 13 nt, Streptococcus pyogenes MGAS8232
gauuuuaaauauc

SEQ ID NO: 2227491 - RNA, 13 nt, Streptococcus pyogenes MGAS8232
gauucaauaugaa

SEQ ID NO: 2227492 - RNA, 16 nt, Streptococcus pyogenes MGAS8232
gauuacaagcauuuug

SEQ ID NO: 2227493 - RNA, 15 nt, Streptococcus pyogenes MGAS8232
gauuacgauuaaaag

SEQ ID NO: 2227494 - RNA, 19 nt, Streptococcus pyogenes MGAS8232
gauuaguuuuuagcagcag

SEQ ID NO: 2227495 - RNA, 18 nt, Streptococcus pyogenes MGAS8232
gauuaguuuuuagcagca

SEQ ID NO: 2227496 - RNA, 12 nt, Streptococcus pyogenes MGAS8232
gauuaugaaaaa

SEQ ID NO: 2227497 - RNA, 19 nt, Streptococcus pyogenes MGAS8232
gauuauuauucuaaaugac

SEQ ID NO: 2227498 - RNA, 15 nt, Streptococcus pyogenes MGAS8232
gauuaugaaaaagaa

SEQ ID NO: 2227499 - RNA, 14 nt, Streptococcus pyogenes MGAS8232
gauguuuauuccaa

SEQ ID NO: 2227500 - RNA, 14 nt, Streptococcus pyogenes MGAS8232
gaugcuucuuucaa

SEQ ID NO: 2227501 - RNA, 15 nt, Streptococcus pyogenes MGAS8232
gaugcacacaaaucu

SEQ ID NO: 2227502 - RNA, 12 nt, Streptococcus pyogenes MGAS8232
gaugauuuugaa

SEQ ID NO: 2227503 - RNA, 17 nt, Streptococcus pyogenes MGAS8232
gaugauugaguaagcag

SEQ ID NO: 2227504 - RNA, 22 nt, Streptococcus pyogenes MGAS8232
gaugacuuguaaaaugauccuu

SEQ ID NO: 2227505 - RNA, 14 nt, Streptococcus pyogenes MGAS8232
gaugaaaugauugu

SEQ ID NO: 2227506 - RNA, 21 nt, Streptococcus pyogenes MGAS8232
gagagguugguaaaaaggcag

SEQ ID NO: 2227507 - RNA, 12 nt, Streptococcus pyogenes MGAS8232
gagcaaggcaag

SEQ ID NO: 2227508 - RNA, 19 nt, Streptococcus pyogenes MGAS8232
gagcaaggcaagaggaggc

SEQ ID NO: 2227509 - RNA, 17 nt, Streptococcus pyogenes MGAS8232
gagcaaggcaagaggag

SEQ ID NO: 2227510 - RNA, 15 nt, Streptococcus pyogenes MGAS8232
gaguuccucgguuuu

SEQ ID NO: 2227511 - RNA, 14 nt, Streptococcus pyogenes MGAS8232
gaggaaacaaaaac

SEQ ID NO: 2227512 - RNA, 15 nt, Streptococcus pyogenes MGAS8232
gaguaagcagcauca

SEQ ID NO: 2227513 - RNA, 15 nt, Streptococcus pyogenes MGAS8232
aaagccagagcaguu

SEQ ID NO: 2227514 - RNA, 20 nt, Streptococcus pyogenes MGAS8232
aaagcccuuauguauuuuuc

SEQ ID NO: 2227515 - RNA, 22 nt, Streptococcus pyogenes MGAS8232
gaucauuaaauugauuauucuc

SEQ ID NO: 2227516 - RNA, 14 nt, Streptococcus pyogenes MGAS8232
gauaccuucauaga

SEQ ID NO: 2227517 - RNA, 18 nt, Streptococcus pyogenes MGAS8232
gauaagaccuucaaaaaa

SEQ ID NO: 2227518 - RNA, 22 nt, Streptococcus pyogenes MGAS8232
gauaagacuuauaugaaagaac

SEQ ID NO: 2227519 - RNA, 23 nt, Streptococcus pyogenes MGAS8232
gauaggucugcaauauccauaga

SEQ ID NO: 2227520 - RNA, 18 nt, Streptococcus pyogenes MGAS8232
gauagucaaaaagacuuc

SEQ ID NO: 2227521 - RNA, 20 nt, Streptococcus pyogenes MGAS8232
gauagucaaaaagacuucuu

SEQ ID NO: 2227522 - RNA, 14 nt, Streptococcus pyogenes MGAS8232
cuuuccauucuugc

SEQ ID NO: 2227523 - RNA, 19 nt, Streptococcus pyogenes MGAS8232
cuuugacaaugucaauuga

SEQ ID NO: 2227524 - RNA, 15 nt, Streptococcus pyogenes MGAS8232
cuuuguccauuuuuu

SEQ ID NO: 2227525 - RNA, 14 nt, Streptococcus pyogenes MGAS8232
cuuugauuuuucuu

SEQ ID NO: 2227526 - RNA, 16 nt, Streptococcus pyogenes MGAS8232
cuuuaggaucauuauc

SEQ ID NO: 2227527 - RNA, 19 nt, Streptococcus pyogenes MGAS8232
cuuuagcaauuguuuuuuc

SEQ ID NO: 2227528 - RNA, 17 nt, Streptococcus pyogenes MGAS8232
cuuuauuaaucaaaaaa

SEQ ID NO: 2227529 - RNA, 19 nt, Streptococcus pyogenes MGAS8232
cuuucaguuaucugauauu

SEQ ID NO: 2227530 - RNA, 11 nt, Streptococcus pyogenes MGAS8232
cuuuauugaug

SEQ ID NO: 2227531 - RNA, 17 nt, Streptococcus pyogenes MGAS8232
aaagaccauaaaaaacc

SEQ ID NO: 2227532 - RNA, 16 nt, Streptococcus pyogenes MGAS8232
cuuuuucuaacaaaau

SEQ ID NO: 2227533 - RNA, 18 nt, Streptococcus pyogenes MGAS8232
gaaaaaacucaagagguc

SEQ ID NO: 2227534 - RNA, 12 nt, Streptococcus pyogenes MGAS8232
cuuuuaaaaucu

SEQ ID NO: 2227535 - RNA, 13 nt, Streptococcus pyogenes MGAS8232
cuuuuaaaaucug

SEQ ID NO: 2227536 - RNA, 18 nt, Streptococcus pyogenes MGAS8232
aaagacccccuagacugu

SEQ ID NO: 2227537 - RNA, 21 nt, Streptococcus pyogenes MGAS8232
gaaccaacuuggacgaaggcu

SEQ ID NO: 2227538 - RNA, 19 nt, Streptococcus pyogenes MGAS8232
gaaccaacuuggacgaagg

SEQ ID NO: 2227539 - RNA, 19 nt, Streptococcus pyogenes MGAS8232
gaacuccuggauuaaaugc

SEQ ID NO: 2227540 - RNA, 19 nt, Streptococcus pyogenes MGAS8232
gaacuccccuuuauaacuu

SEQ ID NO: 2227541 - RNA, 18 nt, Streptococcus pyogenes MGAS8232
aaagagaaagaggaaaca

SEQ ID NO: 2227542 - RNA, 22 nt, Streptococcus pyogenes MGAS8232
gaaacuugcugccauauuuuug

SEQ ID NO: 2227543 - RNA, 19 nt, Streptococcus pyogenes MGAS8232
gaaacuaaaggcaauagca

SEQ ID NO: 2227544 - RNA, 15 nt, Streptococcus pyogenes MGAS8232
gaaagcggaagaaca

SEQ ID NO: 2227545 - RNA, 19 nt, Streptococcus pyogenes MGAS8232
gaaauacuccguuucuagu

SEQ ID NO: 2227546 - RNA, 18 nt, Streptococcus pyogenes MGAS8232
gacagacaccaaaaaaag

SEQ ID NO: 2227547 - RNA, 20 nt, Streptococcus pyogenes MGAS8232
gacagacaccaaaaaaagca

SEQ ID NO: 2227548 - RNA, 23 nt, Streptococcus pyogenes MGAS8232
gacagacaccaaaaaaagcaugg

SEQ ID NO: 2227549 - RNA, 16 nt, Streptococcus pyogenes MGAS8232
gacaguuaaaaauaac

SEQ ID NO: 2227550 - RNA, 21 nt, Streptococcus pyogenes MGAS8232
gacauuuaugcugauuuugga

SEQ ID NO: 2227551 - RNA, 17 nt, Streptococcus pyogenes MGAS8232
gacauuuaugcugauuu

SEQ ID NO: 2227552 - RNA, 19 nt, Streptococcus pyogenes MGAS8232
gacauuuaugcugauuuug

SEQ ID NO: 2227553 - RNA, 19 nt, Streptococcus pyogenes MGAS8232
gaccccuuaguucaaugga

SEQ ID NO: 2227554 - RNA, 14 nt, Streptococcus pyogenes MGAS8232
gaccauuaucaaua

SEQ ID NO: 2227555 - RNA, 16 nt, Streptococcus pyogenes MGAS8232
gaccaccggugccuca

SEQ ID NO: 2227556 - RNA, 21 nt, Streptococcus pyogenes MGAS8232
gaccacccucaacagcaggcc

SEQ ID NO: 2227557 - RNA, 20 nt, Streptococcus pyogenes MGAS8232
gacgauaagucaguuuuuuc

SEQ ID NO: 2227558 - RNA, 14 nt, Streptococcus pyogenes MGAS8232
gaccuuugauaaga

SEQ ID NO: 2227559 - RNA, 13 nt, Streptococcus pyogenes MGAS8232
gacuaaguccuuu

SEQ ID NO: 2227560 - RNA, 21 nt, Streptococcus pyogenes MGAS8232
gacuaggaaucgcuuuaggaa

SEQ ID NO: 2227561 - RNA, 21 nt, Streptococcus pyogenes MGAS8232
gaauuuugucuaaaauaaaga

SEQ ID NO: 2227562 - RNA, 21 nt, Streptococcus pyogenes MGAS8232
gacaaaaaaacuggaaacugc

SEQ ID NO: 2227563 - RNA, 19 nt, Streptococcus pyogenes MGAS8232
gacaauuauuuugcaggua

SEQ ID NO: 2227564 - RNA, 13 nt, Streptococcus pyogenes MGAS8232
gacaaugugacaa

SEQ ID NO: 2227565 - RNA, 14 nt, Streptococcus pyogenes MGAS8232
aaagauauuuuaaa

SEQ ID NO: 2227566 - RNA, 23 nt, Streptococcus pyogenes MGAS8232
gaauaaaaagacuagagucucua

SEQ ID NO: 2227567 - RNA, 22 nt, Streptococcus pyogenes MGAS8232
gaagaaaaaauuuccaauucaa

SEQ ID NO: 2227568 - RNA, 15 nt, Streptococcus pyogenes MGAS8232
aaagagucugagcaa

SEQ ID NO: 2227569 - RNA, 23 nt, Streptococcus pyogenes MGAS8232
cuguagcguuuguguugaagaag

SEQ ID NO: 2227570 - RNA, 14 nt, Streptococcus pyogenes MGAS8232
cuguauauuuaaua

SEQ ID NO: 2227571 - RNA, 14 nt, Streptococcus pyogenes MGAS8232
cuguauacaaaaag

SEQ ID NO: 2227572 - RNA, 19 nt, Streptococcus pyogenes MGAS8232
cuguauccccuugauaugg

SEQ ID NO: 2227573 - RNA, 21 nt, Streptococcus pyogenes MGAS8232
cugucaaaaaauuaagaagga

SEQ ID NO: 2227574 - RNA, 13 nt, Streptococcus pyogenes MGAS8232
cugucaagcccug

SEQ ID NO: 2227575 - RNA, 20 nt, Streptococcus pyogenes MGAS8232
cugucaagcccugcuggcuu

SEQ ID NO: 2227576 - RNA, 16 nt, Streptococcus pyogenes MGAS8232
cugugaugaaucauuu

SEQ ID NO: 2227577 - RNA, 14 nt, Streptococcus pyogenes MGAS8232
cuguggguuaagag

SEQ ID NO: 2227578 - RNA, 19 nt, Streptococcus pyogenes MGAS8232
cuguggcuuucucaucuac

SEQ ID NO: 2227579 - RNA, 15 nt, Streptococcus pyogenes MGAS8232
cugugaacaaaacaa

SEQ ID NO: 2227580 - RNA, 16 nt, Streptococcus pyogenes MGAS8232
cugugaacaaaacaaa

SEQ ID NO: 2227581 - RNA, 19 nt, Streptococcus pyogenes MGAS8232
cuguaaaucaguagugaug

SEQ ID NO: 2227582 - RNA, 14 nt, Streptococcus pyogenes MGAS8232
cugguuuuuuuaau

SEQ ID NO: 2227583 - RNA, 19 nt, Streptococcus pyogenes MGAS8232
cugguuuuaauauugggac

SEQ ID NO: 2227584 - RNA, 23 nt, Streptococcus pyogenes MGAS8232
cugguguugcaaggcuaaggcuu

SEQ ID NO: 2227585 - RNA, 14 nt, Streptococcus pyogenes MGAS8232
aaacuuacaaaaag

SEQ ID NO: 2227586 - RNA, 23 nt, Streptococcus pyogenes MGAS8232
cuucaaggaaggcuuguucuuua

SEQ ID NO: 2227587 - RNA, 18 nt, Streptococcus pyogenes MGAS8232
cuucaagcucgguuuuaa

SEQ ID NO: 2227588 - RNA, 13 nt, Streptococcus pyogenes MGAS8232
cuucaacauuucg

SEQ ID NO: 2227589 - RNA, 18 nt, Streptococcus pyogenes MGAS8232
cuuccaaaccauuuuaug

SEQ ID NO: 2227590 - RNA, 19 nt, Streptococcus pyogenes MGAS8232
cuucaucgaugauagcuuu

SEQ ID NO: 2227591 - RNA, 13 nt, Streptococcus pyogenes MGAS8232
cuuaaggauuuag

SEQ ID NO: 2227592 - RNA, 11 nt, Streptococcus pyogenes MGAS8232
cuuacaaaaag

SEQ ID NO: 2227593 - RNA, 18 nt, Streptococcus pyogenes MGAS8232
cuuacagcugguuuuuuu

SEQ ID NO: 2227594 - RNA, 17 nt, Streptococcus pyogenes MGAS8232
cuuaguguagauaaacu

SEQ ID NO: 2227595 - RNA, 15 nt, Streptococcus pyogenes MGAS8232
cuuagugguuugcaa

SEQ ID NO: 2227596 - RNA, 13 nt, Streptococcus pyogenes MGAS8232
cuuagaagccuua

SEQ ID NO: 2227597 - RNA, 21 nt, Streptococcus pyogenes MGAS8232
cuuaucucggagcuuuaccuc

SEQ ID NO: 2227598 - RNA, 16 nt, Streptococcus pyogenes MGAS8232
cuguuugccguguucu

SEQ ID NO: 2227599 - RNA, 21 nt, Streptococcus pyogenes MGAS8232
cuguuggauacaguccaaacu

SEQ ID NO: 2227600 - RNA, 15 nt, Streptococcus pyogenes MGAS8232
cuuaaacauauuaua

SEQ ID NO: 2227601 - RNA, 17 nt, Streptococcus pyogenes MGAS8232
aaacuguauacaaaaag

SEQ ID NO: 2227602 - RNA, 17 nt, Streptococcus pyogenes MGAS8232
cuuaacggcaucuacag

SEQ ID NO: 2227603 - RNA, 23 nt, Streptococcus pyogenes MGAS8232
cuguucauuuagugguauagaca

SEQ ID NO: 2227604 - RNA, 13 nt, Streptococcus pyogenes MGAS8232
aaacuauauuguu

SEQ ID NO: 2227605 - RNA, 20 nt, Streptococcus pyogenes MGAS8232
cugagcuaaagccaacccca

SEQ ID NO: 2227606 - RNA, 14 nt, Streptococcus pyogenes MGAS8232
cugauuuuggauga

SEQ ID NO: 2227607 - RNA, 17 nt, Streptococcus pyogenes MGAS8232
cugacuuacauuuggag

SEQ ID NO: 2227608 - RNA, 22 nt, Streptococcus pyogenes MGAS8232
cugacgauaagucaguuuuuuc

SEQ ID NO: 2227609 - RNA, 19 nt, Streptococcus pyogenes MGAS8232
cguuaucuccacagagucu

SEQ ID NO: 2227610 - RNA, 18 nt, Streptococcus pyogenes MGAS8232
cuaaaagcauaaaaauau

SEQ ID NO: 2227611 - RNA, 17 nt, Streptococcus pyogenes MGAS8232
cuaaaagcauaaaaaua

SEQ ID NO: 2227612 - RNA, 19 nt, Streptococcus pyogenes MGAS8232
cuaaaacgugagaaaauuu

SEQ ID NO: 2227613 - RNA, 24 nt, Streptococcus pyogenes MGAS8232
cuaaaaaagcucuaucaucuuugu

SEQ ID NO: 2227614 - RNA, 19 nt, Streptococcus pyogenes MGAS8232
cguuuuuuaguuuguaaaa

SEQ ID NO: 2227615 - RNA, 19 nt, Streptococcus pyogenes MGAS8232
cguuuuguuguauuaugag

SEQ ID NO: 2227616 - RNA, 18 nt, Streptococcus pyogenes MGAS8232
cuaaucgaacaauaauau

SEQ ID NO: 2227617 - RNA, 14 nt, Streptococcus pyogenes MGAS8232
cuaauauuauauua

SEQ ID NO: 2227618 - RNA, 12 nt, Streptococcus pyogenes MGAS8232
cuaauaagauuc

SEQ ID NO: 2227619 - RNA, 18 nt, Streptococcus pyogenes MGAS8232
cuaauuuagucauuucuu

SEQ ID NO: 2227620 - RNA, 15 nt, Streptococcus pyogenes MGAS8232
cuaauugaccugcug

SEQ ID NO: 2227621 - RNA, 18 nt, Streptococcus pyogenes MGAS8232
cuaauaaaauagcaccua

SEQ ID NO: 2227622 - RNA, 17 nt, Streptococcus pyogenes MGAS8232
cuaaguccuuuuaguuu

SEQ ID NO: 2227623 - RNA, 21 nt, Streptococcus pyogenes MGAS8232
cuaagaugguuuugauuaaau

SEQ ID NO: 2227624 - RNA, 23 nt, Streptococcus pyogenes MGAS8232
cuaagcuauagaaacuuuuuaua

SEQ ID NO: 2227625 - RNA, 23 nt, Streptococcus pyogenes MGAS8232
cuaagagccaaaauaacaaucug

SEQ ID NO: 2227626 - RNA, 15 nt, Streptococcus pyogenes MGAS8232
cguauuggccuucuu

SEQ ID NO: 2227627 - RNA, 22 nt, Streptococcus pyogenes MGAS8232
cuagccuguccuagucuuuugg

SEQ ID NO: 2227628 - RNA, 15 nt, Streptococcus pyogenes MGAS8232
cuagccuacagucug

SEQ ID NO: 2227629 - RNA, 12 nt, Streptococcus pyogenes MGAS8232
cuacuaaaacgu

SEQ ID NO: 2227630 - RNA, 18 nt, Streptococcus pyogenes MGAS8232
cuacgguuauuaccuauu

SEQ ID NO: 2227631 - RNA, 14 nt, Streptococcus pyogenes MGAS8232
cuaggaauaaaaug

SEQ ID NO: 2227632 - RNA, 21 nt, Streptococcus pyogenes MGAS8232
cuaggagggacugucaaaaaa

SEQ ID NO: 2227633 - RNA, 22 nt, Streptococcus pyogenes MGAS8232
cuagucgaaauugguccucuga

SEQ ID NO: 2227634 - RNA, 21 nt, Streptococcus pyogenes MGAS8232
cuaguguguugucaaacauaa

SEQ ID NO: 2227635 - RNA, 14 nt, Streptococcus pyogenes MGAS8232
cuacacaaaagcuu

SEQ ID NO: 2227636 - RNA, 14 nt, Streptococcus pyogenes MGAS8232
cuacagcaccuuca

SEQ ID NO: 2227637 - RNA, 19 nt, Streptococcus pyogenes MGAS8232
cuacaggauauugagaaga

SEQ ID NO: 2227638 - RNA, 23 nt, Streptococcus pyogenes MGAS8232
cuacaggauauugagaagaaaaa

SEQ ID NO: 2227639 - RNA, 15 nt, Streptococcus pyogenes MGAS8232
cuacaugaccaaaaa

SEQ ID NO: 2227640 - RNA, 17 nt, Streptococcus pyogenes MGAS8232
cuaccgcaauuaaacca

SEQ ID NO: 2227641 - RNA, 12 nt, Streptococcus pyogenes MGAS8232
cucaaaaaauac

SEQ ID NO: 2227642 - RNA, 19 nt, Streptococcus pyogenes MGAS8232
cucaauuuuugauuuuaau

SEQ ID NO: 2227643 - RNA, 15 nt, Streptococcus pyogenes MGAS8232
cuauggcuucuaaaa

SEQ ID NO: 2227644 - RNA, 19 nt, Streptococcus pyogenes MGAS8232
cuaucucguaauccuugau

SEQ ID NO: 2227645 - RNA, 22 nt, Streptococcus pyogenes MGAS8232
cuaucugcagauuuuaagacaa

SEQ ID NO: 2227646 - RNA, 14 nt, Streptococcus pyogenes MGAS8232
cuaucugauacaga

SEQ ID NO: 2227647 - RNA, 21 nt, Streptococcus pyogenes MGAS8232
cuaugaaaaaagaacaaagau

SEQ ID NO: 2227648 - RNA, 21 nt, Streptococcus pyogenes MGAS8232
cuauuuaauaggcuuuuuuug

SEQ ID NO: 2227649 - RNA, 20 nt, Streptococcus pyogenes MGAS8232
cuauuguagaggugaugaag

SEQ ID NO: 2227650 - RNA, 16 nt, Streptococcus pyogenes MGAS8232
cuauugacuugguucu

SEQ ID NO: 2227651 - RNA, 18 nt, Streptococcus pyogenes MGAS8232
cuauugaaucuuguuuaa

SEQ ID NO: 2227652 - RNA, 20 nt, Streptococcus pyogenes MGAS8232
cucaaaaauauauucuaauu

SEQ ID NO: 2227653 - RNA, 20 nt, Streptococcus pyogenes MGAS8232
cuauuuuaaguaaaggauuu

SEQ ID NO: 2227654 - RNA, 21 nt, Streptococcus pyogenes MGAS8232
cucuaacauguccaaaucgua

SEQ ID NO: 2227655 - RNA, 21 nt, Streptococcus pyogenes MGAS8232
cucuaauuuagucauuucuuc

SEQ ID NO: 2227656 - RNA, 13 nt, Streptococcus pyogenes MGAS8232
cuccuccaccaaa

SEQ ID NO: 2227657 - RNA, 22 nt, Streptococcus pyogenes MGAS8232
cuccuaaggaguaguugcuggu

SEQ ID NO: 2227658 - RNA, 11 nt, Streptococcus pyogenes MGAS8232
aaaaaagaacu

SEQ ID NO: 2227659 - RNA, 22 nt, Streptococcus pyogenes MGAS8232
aaaaaagaagcaaaauuauuau

SEQ ID NO: 2227660 - RNA, 20 nt, Streptococcus pyogenes MGAS8232
aaaaacaaauuguagggauu

SEQ ID NO: 2227661 - RNA, 15 nt, Streptococcus pyogenes MGAS8232
aaaaacaaauuguag

SEQ ID NO: 2227662 - RNA, 22 nt, Streptococcus pyogenes MGAS8232
aaaaaauuuccaauucaaggua

SEQ ID NO: 2227663 - RNA, 14 nt, Streptococcus pyogenes MGAS8232
aaaaaauuaagaag

SEQ ID NO: 2227664 - RNA, 15 nt, Streptococcus pyogenes MGAS8232
aaaaagccagagcag

SEQ ID NO: 2227665 - RNA, 22 nt, Streptococcus pyogenes MGAS8232
aaaaagagaccgaagucucuuu

SEQ ID NO: 2227666 - RNA, 14 nt, Streptococcus pyogenes MGAS8232
aaaaagaacaaaga

SEQ ID NO: 2227667 - RNA, 23 nt, Streptococcus pyogenes MGAS8232
aaaaaggcagucgcagaguacaa

SEQ ID NO: 2227668 - RNA, 14 nt, Streptococcus pyogenes MGAS8232
aaaaagccuuuaca

SEQ ID NO: 2227669 - RNA, 23 nt, Streptococcus pyogenes MGAS8232
aaaaagccuauuuaauaggcuuu

SEQ ID NO: 2227670 - RNA, 11 nt, Streptococcus pyogenes MGAS8232
aaaaagcuuuu

SEQ ID NO: 2227671 - RNA, 15 nt, Streptococcus pyogenes MGAS8232
aaaaagcucuuagaa

SEQ ID NO: 2227672 - RNA, 13 nt, Streptococcus pyogenes MGAS8232
aaaaacucaaaaa

SEQ ID NO: 2227673 - RNA, 17 nt, Streptococcus pyogenes MGAS8232
aaaaacugugaacaaaa

SEQ ID NO: 2227674 - RNA, 11 nt, Streptococcus pyogenes MGAS8232
aaaaacaaugc

SEQ ID NO: 2227675 - RNA, 18 nt, Streptococcus pyogenes MGAS8232
aaaaaccgcucauuugau

SEQ ID NO: 2227676 - RNA, 19 nt, Streptococcus pyogenes MGAS8232
aaaaacgaucaaaaaucuu

SEQ ID NO: 2227677 - RNA, 18 nt, Streptococcus pyogenes MGAS8232
aaaaacgaucaaaaaucu

SEQ ID NO: 2227678 - RNA, 18 nt, Streptococcus pyogenes MGAS8232
aaaaacucaaaaaauaca

SEQ ID NO: 2227679 - RNA, 12 nt, Streptococcus pyogenes MGAS8232
aaaacaaaacaa

SEQ ID NO: 2227680 - RNA, 15 nt, Streptococcus pyogenes MGAS8232
aaaacaaaacauagc

SEQ ID NO: 2227681 - RNA, 21 nt, Streptococcus pyogenes MGAS8232
aaacacuaccuuaaauguaug

SEQ ID NO: 2227682 - RNA, 18 nt, Streptococcus pyogenes MGAS8232
aaacacuaccuuaaaugu

SEQ ID NO: 2227683 - RNA, 20 nt, Streptococcus pyogenes MGAS8232
aaacaccaccaauaaugagc

SEQ ID NO: 2227684 - RNA, 17 nt, Streptococcus pyogenes MGAS8232
aaacaccaccaauaaug

SEQ ID NO: 2227685 - RNA, 20 nt, Streptococcus pyogenes MGAS8232
aaacagaugcucaaacuaua

SEQ ID NO: 2227686 - RNA, 12 nt, Streptococcus pyogenes MGAS8232
aaaccauuuuau

SEQ ID NO: 2227687 - RNA, 21 nt, Streptococcus pyogenes MGAS8232
aaaccauuuuaugagaaaaau

SEQ ID NO: 2227688 - RNA, 22 nt, Streptococcus pyogenes MGAS8232
aaaccauuuuaugagaaaaaua

SEQ ID NO: 2227689 - RNA, 20 nt, Streptococcus pyogenes MGAS8232
aaaagcuaaguaagcuucug

SEQ ID NO: 2227690 - RNA, 18 nt, Streptococcus pyogenes MGAS8232
aaaaacugugaacaaaac

SEQ ID NO: 2227691 - RNA, 20 nt, Streptococcus pyogenes MGAS8232
aaaagcucuaucaucuuugu

SEQ ID NO: 2227692 - RNA, 18 nt, Streptococcus pyogenes MGAS8232
aaaagcucuuagaagccu

SEQ ID NO: 2227693 - RNA, 17 nt, Streptococcus pyogenes MGAS8232
aaaaagaacaaagauug

SEQ ID NO: 2227694 - RNA, 14 nt, Streptococcus pyogenes MGAS8232
aaaauaacuuuaaa

SEQ ID NO: 2227695 - RNA, 15 nt, Streptococcus pyogenes MGAS8232
aaaaggggagacgga

SEQ ID NO: 2227696 - RNA, 15 nt, Streptococcus pyogenes MGAS8232
aaaaugacugacaaa

SEQ ID NO: 2227697 - RNA, 21 nt, Streptococcus pyogenes MGAS8232
aaaaugacacauuucgguuau

SEQ ID NO: 2227698 - RNA, 16 nt, Streptococcus pyogenes MGAS8232
aaaauguacauccuaa

SEQ ID NO: 2227699 - RNA, 19 nt, Streptococcus pyogenes MGAS8232
aaaauaucuuuuuuacuuu

SEQ ID NO: 2227700 - RNA, 20 nt, Streptococcus pyogenes MGAS8232
aaaauacaauaaagcguuga

SEQ ID NO: 2227701 - RNA, 23 nt, Streptococcus pyogenes MGAS8232
aaaauauauuguuuuucuuuguc

SEQ ID NO: 2227702 - RNA, 17 nt, Streptococcus pyogenes MGAS8232
aaaguaacauguccauu

SEQ ID NO: 2227703 - RNA, 17 nt, Streptococcus pyogenes MGAS8232
aaaguaaaaucuuauuu

SEQ ID NO: 2227704 - RNA, 15 nt, Streptococcus pyogenes MGAS8232
aaagcuuuaaaaaau

SEQ ID NO: 2227705 - RNA, 18 nt, Streptococcus pyogenes MGAS8232
aaagaggaaacaaaaacu

SEQ ID NO: 2227706 - RNA, 19 nt, Streptococcus pyogenes MGAS8232
aaagagucugagcaaucau

SEQ ID NO: 2227707 - RNA, 14 nt, Streptococcus pyogenes MGAS8232
aaagacaaaaaaac

SEQ ID NO: 2227708 - RNA, 21 nt, Streptococcus pyogenes MGAS8232
aaauagcaaugguuaaaaaga

SEQ ID NO: 2227709 - RNA, 19 nt, Streptococcus pyogenes MGAS8232
aaauagcaaugguuaaaaa

SEQ ID NO: 2227710 - RNA, 18 nt, Streptococcus pyogenes MGAS8232
aaauauaaccucuagcuu

SEQ ID NO: 2227711 - RNA, 12 nt, Streptococcus pyogenes MGAS8232
aaauaucuagaa

SEQ ID NO: 2227712 - RNA, 16 nt, Streptococcus pyogenes MGAS8232
aaauacagaagaaagc

SEQ ID NO: 2227713 - RNA, 19 nt, Streptococcus pyogenes MGAS8232
aaauacagaagaaagcuug

SEQ ID NO: 2227714 - RNA, 20 nt, Streptococcus pyogenes MGAS8232
aaaguuauucccauauaugc

SEQ ID NO: 2227715 - RNA, 15 nt, Streptococcus pyogenes MGAS8232
aaaguugauaucccc

SEQ ID NO: 2227716 - RNA, 11 nt, Streptococcus pyogenes MGAS8232
aaaguuuucuc

SEQ ID NO: 2227717 - RNA, 13 nt, Streptococcus pyogenes MGAS8232
aaauaaacuuuca

SEQ ID NO: 2227718 - RNA, 17 nt, Streptococcus pyogenes MGAS8232
aaagugcgcuuccagaa

SEQ ID NO: 2227719 - RNA, 22 nt, Streptococcus pyogenes MGAS8232
aaaguaauaaguagcguacaug

SEQ ID NO: 2227720 - RNA, 16 nt, Streptococcus pyogenes MGAS8232
aaauuaauaaauuuuu

SEQ ID NO: 2227721 - RNA, 23 nt, Streptococcus pyogenes MGAS8232
aaauuaaugauucaauaucacau

SEQ ID NO: 2227722 - RNA, 15 nt, Streptococcus pyogenes MGAS8232
aaauuaguuaucuca

SEQ ID NO: 2227723 - RNA, 16 nt, Streptococcus pyogenes MGAS8232
aaauuaguuaucucau

SEQ ID NO: 2227724 - RNA, 18 nt, Streptococcus pyogenes MGAS8232
aaauguccgaaaaaaacu

SEQ ID NO: 2227725 - RNA, 17 nt, Streptococcus pyogenes MGAS8232
aaauguaugauuuuaac

SEQ ID NO: 2227726 - RNA, 18 nt, Streptococcus pyogenes MGAS8232
aaauguaugauuuuaacg

SEQ ID NO: 2227727 - RNA, 16 nt, Streptococcus pyogenes MGAS8232
aaaugccaaucuuugu

SEQ ID NO: 2227728 - RNA, 13 nt, Streptococcus pyogenes MGAS8232
aaaucuucuagaa

SEQ ID NO: 2227729 - RNA, 15 nt, Streptococcus pyogenes MGAS8232
aaaugacaugaaagu

SEQ ID NO: 2227730 - RNA, 14 nt, Streptococcus pyogenes MGAS8232
aaauccuuuugcuu

SEQ ID NO: 2227731 - RNA, 20 nt, Streptococcus pyogenes MGAS8232
aaauugguuuuuuaguugcg

SEQ ID NO: 2227732 - RNA, 23 nt, Streptococcus pyogenes MGAS8232
aaauuguagggauuuuuuuaacu

SEQ ID NO: 2227733 - RNA, 14 nt, Streptococcus pyogenes MGAS8232
aaauugauuauucu

SEQ ID NO: 2227734 - RNA, 23 nt, Streptococcus pyogenes MGAS8232
aaauucuuuuugaauugaaaaaa

SEQ ID NO: 2227735 - RNA, 23 nt, Streptococcus pyogenes MGAS8232
aaauuucaugauguuauuaaaua

SEQ ID NO: 2227736 - RNA, 13 nt, Streptococcus pyogenes MGAS8232
aaauuuuauugca

SEQ ID NO: 2227737 - RNA, 14 nt, Streptococcus pyogenes MGAS8232
aaauuguuugauug

SEQ ID NO: 2227738 - RNA, 12 nt, Streptococcus pyogenes MGAS8232
aacaaaaucaca

SEQ ID NO: 2227739 - RNA, 12 nt, Streptococcus pyogenes MGAS8232
aacaaagauugg

SEQ ID NO: 2227740 - RNA, 11 nt, Streptococcus pyogenes MGAS8232
aacaaaacaaa

SEQ ID NO: 2227741 - RNA, 13 nt, Streptococcus pyogenes MGAS8232
aacaaaacaaaac

SEQ ID NO: 2227742 - RNA, 14 nt, Streptococcus pyogenes MGAS8232
aacaaaacaaaaca

SEQ ID NO: 2227743 - RNA, 15 nt, Streptococcus pyogenes MGAS8232
aacaaaacaaaacaa

SEQ ID NO: 2227744 - RNA, 16 nt, Streptococcus pyogenes MGAS8232
aaauuuuuuucaugau

SEQ ID NO: 2227745 - RNA, 22 nt, Streptococcus pyogenes MGAS8232
aaauuuuuuucaugauguuuau

SEQ ID NO: 2227746 - RNA, 16 nt, Streptococcus pyogenes MGAS8232
caacucgauaaaaacg

SEQ ID NO: 2227747 - RNA, 20 nt, Streptococcus pyogenes MGAS8232
caacuguggguuaagagagg

SEQ ID NO: 2227748 - RNA, 13 nt, Streptococcus pyogenes MGAS8232
caacucccuccua

SEQ ID NO: 2227749 - RNA, 16 nt, Streptococcus pyogenes MGAS8232
caacuucuauaugugu

SEQ ID NO: 2227750 - RNA, 21 nt, Streptococcus pyogenes MGAS8232
caagagguucgucaagcaccu

SEQ ID NO: 2227751 - RNA, 13 nt, Streptococcus pyogenes MGAS8232
caagagcuuaaaa

SEQ ID NO: 2227752 - RNA, 15 nt, Streptococcus pyogenes MGAS8232
caagagcuuaaaagu

SEQ ID NO: 2227753 - RNA, 19 nt, Streptococcus pyogenes MGAS8232
caauagcgaaaaagggucc

SEQ ID NO: 2227754 - RNA, 16 nt, Streptococcus pyogenes MGAS8232
caauacucccuucucu

SEQ ID NO: 2227755 - RNA, 21 nt, Streptococcus pyogenes MGAS8232
caauaugugauuauuauucua

SEQ ID NO: 2227756 - RNA, 17 nt, Streptococcus pyogenes MGAS8232
caauaacagaaauuaau

SEQ ID NO: 2227757 - RNA, 15 nt, Streptococcus pyogenes MGAS8232
caauaacacagaagc

SEQ ID NO: 2227758 - RNA, 13 nt, Streptococcus pyogenes MGAS8232
caauaaugagcaa

SEQ ID NO: 2227759 - RNA, 20 nt, Streptococcus pyogenes MGAS8232
caauaauuccuuugccagcc

SEQ ID NO: 2227760 - RNA, 20 nt, Streptococcus pyogenes MGAS8232
caaugaaaaguuauucccau

SEQ ID NO: 2227761 - RNA, 20 nt, Streptococcus pyogenes MGAS8232
caaugacuugaccaaauaca

SEQ ID NO: 2227762 - RNA, 13 nt, Streptococcus pyogenes MGAS8232
caaugccaucugc

SEQ ID NO: 2227763 - RNA, 13 nt, Streptococcus pyogenes MGAS8232
caaauucuuuuug

SEQ ID NO: 2227764 - RNA, 14 nt, Streptococcus pyogenes MGAS8232
caaauucuuccuua

SEQ ID NO: 2227765 - RNA, 16 nt, Streptococcus pyogenes MGAS8232
caaauagcaaugguua

SEQ ID NO: 2227766 - RNA, 21 nt, Streptococcus pyogenes MGAS8232
caacgcauuucuuuuuugguu

SEQ ID NO: 2227767 - RNA, 13 nt, Streptococcus pyogenes MGAS8232
caaaguaauccaa

SEQ ID NO: 2227768 - RNA, 16 nt, Streptococcus pyogenes MGAS8232
caaauacagaagaaag

SEQ ID NO: 2227769 - RNA, 19 nt, Streptococcus pyogenes MGAS8232
caaauacugguauguugau

SEQ ID NO: 2227770 - RNA, 15 nt, Streptococcus pyogenes MGAS8232
caaacucaaacuaaa

SEQ ID NO: 2227771 - RNA, 23 nt, Streptococcus pyogenes MGAS8232
caaaacccuuucguaagaaagac

SEQ ID NO: 2227772 - RNA, 16 nt, Streptococcus pyogenes MGAS8232
caaacagaaauacucc

SEQ ID NO: 2227773 - RNA, 14 nt, Streptococcus pyogenes MGAS8232
caaacagaaauacu

SEQ ID NO: 2227774 - RNA, 16 nt, Streptococcus pyogenes MGAS8232
caaacauccaaucacc

SEQ ID NO: 2227775 - RNA, 13 nt, Streptococcus pyogenes MGAS8232
caaacauccaauc

SEQ ID NO: 2227776 - RNA, 20 nt, Streptococcus pyogenes MGAS8232
cacccucaacagcaggccuu

SEQ ID NO: 2227777 - RNA, 22 nt, Streptococcus pyogenes MGAS8232
caccaauaaugagcaaggcaag

SEQ ID NO: 2227778 - RNA, 13 nt, Streptococcus pyogenes MGAS8232
cacauaaugauuu

SEQ ID NO: 2227779 - RNA, 21 nt, Streptococcus pyogenes MGAS8232
caccacccgaagcuaagauuu

SEQ ID NO: 2227780 - RNA, 14 nt, Streptococcus pyogenes MGAS8232
aaaaguuggcuacu

SEQ ID NO: 2227781 - RNA, 21 nt, Streptococcus pyogenes MGAS8232
aaaaguugauauccccuccuu

SEQ ID NO: 2227782 - RNA, 21 nt, Streptococcus pyogenes MGAS8232
caccauuaaaaaaaccagcuu

SEQ ID NO: 2227783 - RNA, 12 nt, Streptococcus pyogenes MGAS8232
caauuaaaaaag

SEQ ID NO: 2227784 - RNA, 18 nt, Streptococcus pyogenes MGAS8232
caauuaaaccauucuaaa

SEQ ID NO: 2227785 - RNA, 23 nt, Streptococcus pyogenes MGAS8232
caauuaauguuaggagcacaaaa

SEQ ID NO: 2227786 - RNA, 10 nt, Streptococcus pyogenes MGAS8232
caauucuuuu

SEQ ID NO: 2227787 - RNA, 21 nt, Streptococcus pyogenes MGAS8232
caauuguuuuuucaacaaauc

SEQ ID NO: 2227788 - RNA, 13 nt, Streptococcus pyogenes MGAS8232
cacacaaaucuuc

SEQ ID NO: 2227789 - RNA, 17 nt, Streptococcus pyogenes MGAS8232
cacacaaaucuucuaga

SEQ ID NO: 2227790 - RNA, 19 nt, Streptococcus pyogenes MGAS8232
cacaaauacagaagaaagc

SEQ ID NO: 2227791 - RNA, 17 nt, Streptococcus pyogenes MGAS8232
auuucagauaagaccuu

SEQ ID NO: 2227792 - RNA, 18 nt, Streptococcus pyogenes MGAS8232
auuucagauaagaccuuc

SEQ ID NO: 2227793 - RNA, 17 nt, Streptococcus pyogenes MGAS8232
auuucaauaauaccauu

SEQ ID NO: 2227794 - RNA, 18 nt, Streptococcus pyogenes MGAS8232
auuucaauaauaccauuu

SEQ ID NO: 2227795 - RNA, 21 nt, Streptococcus pyogenes MGAS8232
auuucaauaauaccauuuuua

SEQ ID NO: 2227796 - RNA, 22 nt, Streptococcus pyogenes MGAS8232
auuucaauaauaccauuuuuau

SEQ ID NO: 2227797 - RNA, 23 nt, Streptococcus pyogenes MGAS8232
auuuagguacucguaagcauuuu

SEQ ID NO: 2227798 - RNA, 14 nt, Streptococcus pyogenes MGAS8232
auuuaguucuaagu

SEQ ID NO: 2227799 - RNA, 20 nt, Streptococcus pyogenes MGAS8232
auuuccucuaacauguccaa

SEQ ID NO: 2227800 - RNA, 22 nt, Streptococcus pyogenes MGAS8232
auuugcugaaaccguuugguuu

SEQ ID NO: 2227801 - RNA, 20 nt, Streptococcus pyogenes MGAS8232
auuuguaacuccuuaaauua

SEQ ID NO: 2227802 - RNA, 22 nt, Streptococcus pyogenes MGAS8232
auuuguaacuccuuaaauuaua

SEQ ID NO: 2227803 - RNA, 14 nt, Streptococcus pyogenes MGAS8232
auuugacauuaguc

SEQ ID NO: 2227804 - RNA, 17 nt, Streptococcus pyogenes MGAS8232
auuugacauuaguccaa

SEQ ID NO: 2227805 - RNA, 14 nt, Streptococcus pyogenes MGAS8232
auuucuuugcaaaa

SEQ ID NO: 2227806 - RNA, 15 nt, Streptococcus pyogenes MGAS8232
auuucuuugcaaaag

SEQ ID NO: 2227807 - RNA, 20 nt, Streptococcus pyogenes MGAS8232
auuugcagaggcuugcauuu

SEQ ID NO: 2227808 - RNA, 22 nt, Streptococcus pyogenes MGAS8232
caaaaaacaagucuaucugcag

SEQ ID NO: 2227809 - RNA, 15 nt, Streptococcus pyogenes MGAS8232
auuuuucaaaaucuu

SEQ ID NO: 2227810 - RNA, 23 nt, Streptococcus pyogenes MGAS8232
caaaaagucgucaacgcuagcau

SEQ ID NO: 2227811 - RNA, 23 nt, Streptococcus pyogenes MGAS8232
caaaaauauauucuaauuuguga

SEQ ID NO: 2227812 - RNA, 18 nt, Streptococcus pyogenes MGAS8232
caaaaaggcuaagaugga

SEQ ID NO: 2227813 - RNA, 13 nt, Streptococcus pyogenes MGAS8232
caaaacaaaacaa

SEQ ID NO: 2227814 - RNA, 17 nt, Streptococcus pyogenes MGAS8232
caaaacaaaacaaaaca

SEQ ID NO: 2227815 - RNA, 14 nt, Streptococcus pyogenes MGAS8232
caaaacaaaacaua

SEQ ID NO: 2227816 - RNA, 11 nt, Streptococcus pyogenes MGAS8232
auuuugguuga

SEQ ID NO: 2227817 - RNA, 15 nt, Streptococcus pyogenes MGAS8232
auuuuuacauuuuua

SEQ ID NO: 2227818 - RNA, 19 nt, Streptococcus pyogenes MGAS8232
auuuugcagguaauuaucu

SEQ ID NO: 2227819 - RNA, 18 nt, Streptococcus pyogenes MGAS8232
auuuugcagguaauuauc

SEQ ID NO: 2227820 - RNA, 18 nt, Streptococcus pyogenes MGAS8232
auuuugcaagucucuugc

SEQ ID NO: 2227821 - RNA, 20 nt, Streptococcus pyogenes MGAS8232
auuuuaaauaucuuaccauu

SEQ ID NO: 2227822 - RNA, 15 nt, Streptococcus pyogenes MGAS8232
auuuuaugagaaaaa

SEQ ID NO: 2227823 - RNA, 16 nt, Streptococcus pyogenes MGAS8232
auugaaucuuguuuaa

SEQ ID NO: 2227824 - RNA, 15 nt, Streptococcus pyogenes MGAS8232
auugaguaagcagca

SEQ ID NO: 2227825 - RNA, 20 nt, Streptococcus pyogenes MGAS8232
auucuuuuauuaauguaaaa

SEQ ID NO: 2227826 - RNA, 16 nt, Streptococcus pyogenes MGAS8232
auuccggcagggguca

SEQ ID NO: 2227827 - RNA, 15 nt, Streptococcus pyogenes MGAS8232
auuggaaaauauauu

SEQ ID NO: 2227828 - RNA, 14 nt, Streptococcus pyogenes MGAS8232
auugucaaauaaaa

SEQ ID NO: 2227829 - RNA, 17 nt, Streptococcus pyogenes MGAS8232
auugucacugaaaaagc

SEQ ID NO: 2227830 - RNA, 18 nt, Streptococcus pyogenes MGAS8232
auuggggcggcacuucca

SEQ ID NO: 2227831 - RNA, 22 nt, Streptococcus pyogenes MGAS8232
auuggccuucuuggaaaacaga

SEQ ID NO: 2227832 - RNA, 13 nt, Streptococcus pyogenes MGAS8232
auuuaaucuuauu

SEQ ID NO: 2227833 - RNA, 15 nt, Streptococcus pyogenes MGAS8232
auuuagaaauuuuau

SEQ ID NO: 2227834 - RNA, 17 nt, Streptococcus pyogenes MGAS8232
auuuagaaauuuuauug

SEQ ID NO: 2227835 - RNA, 16 nt, Streptococcus pyogenes MGAS8232
auuuacaguuguaugg

SEQ ID NO: 2227836 - RNA, 19 nt, Streptococcus pyogenes MGAS8232
augccccaaaguaauccaa

SEQ ID NO: 2227837 - RNA, 14 nt, Streptococcus pyogenes MGAS8232
augccagcagccug

SEQ ID NO: 2227838 - RNA, 18 nt, Streptococcus pyogenes MGAS8232
augcgugguggaggucug

SEQ ID NO: 2227839 - RNA, 17 nt, Streptococcus pyogenes MGAS8232
auggcuucuaaaaaaaa

SEQ ID NO: 2227840 - RNA, 20 nt, Streptococcus pyogenes MGAS8232
auggguguuuaaucuuuguu

SEQ ID NO: 2227841 - RNA, 23 nt, Streptococcus pyogenes MGAS8232
auggguguuuaaucuuuguuucu

SEQ ID NO: 2227842 - RNA, 15 nt, Streptococcus pyogenes MGAS8232
augcugaguucuuuu

SEQ ID NO: 2227843 - RNA, 16 nt, Streptococcus pyogenes MGAS8232
augcugaguucuuuuu

SEQ ID NO: 2227844 - RNA, 14 nt, Streptococcus pyogenes MGAS8232
augcuguccaugau

SEQ ID NO: 2227845 - RNA, 12 nt, Streptococcus pyogenes MGAS8232
augcuguccaug

SEQ ID NO: 2227846 - RNA, 19 nt, Streptococcus pyogenes MGAS8232
auuaucugaauuauuagua

SEQ ID NO: 2227847 - RNA, 15 nt, Streptococcus pyogenes MGAS8232
auuaucugauaaggu

SEQ ID NO: 2227848 - RNA, 14 nt, Streptococcus pyogenes MGAS8232
auuauccaacuuuu

SEQ ID NO: 2227849 - RNA, 13 nt, Streptococcus pyogenes MGAS8232
auuaucaauaaca

SEQ ID NO: 2227850 - RNA, 13 nt, Streptococcus pyogenes MGAS8232
auuaugaggugaa

SEQ ID NO: 2227851 - RNA, 17 nt, Streptococcus pyogenes MGAS8232
auuaugaggugaacacc

SEQ ID NO: 2227852 - RNA, 15 nt, Streptococcus pyogenes MGAS8232
auuaugaaaaagaag

SEQ ID NO: 2227853 - RNA, 21 nt, Streptococcus pyogenes MGAS8232
aaaagcucuaucaucuuugua

SEQ ID NO: 2227854 - RNA, 18 nt, Streptococcus pyogenes MGAS8232
auuaguuuuuagcagcag

SEQ ID NO: 2227855 - RNA, 17 nt, Streptococcus pyogenes MGAS8232
auuaguuuuuagcagca

SEQ ID NO: 2227856 - RNA, 19 nt, Streptococcus pyogenes MGAS8232
auuauacucaauauaauaa

SEQ ID NO: 2227857 - RNA, 20 nt, Streptococcus pyogenes MGAS8232
auucaauaucacauuuuaau

SEQ ID NO: 2227858 - RNA, 22 nt, Streptococcus pyogenes MGAS8232
auuaaucaaaaaacugagacaa

SEQ ID NO: 2227859 - RNA, 13 nt, Streptococcus pyogenes MGAS8232
auuaaucaaaaaa

SEQ ID NO: 2227860 - RNA, 13 nt, Streptococcus pyogenes MGAS8232
aaaagcaugggcu

SEQ ID NO: 2227861 - RNA, 12 nt, Streptococcus pyogenes MGAS8232
auuaauguaaaa

SEQ ID NO: 2227862 - RNA, 22 nt, Streptococcus pyogenes MGAS8232
auguuuugcucgacagugcgca

SEQ ID NO: 2227863 - RNA, 17 nt, Streptococcus pyogenes MGAS8232
auguccgaaaaaaacuu

SEQ ID NO: 2227864 - RNA, 22 nt, Streptococcus pyogenes MGAS8232
auguccauugaugaguuuaugu

SEQ ID NO: 2227865 - RNA, 17 nt, Streptococcus pyogenes MGAS8232
auguuuauuccaaacau

SEQ ID NO: 2227866 - RNA, 21 nt, Streptococcus pyogenes MGAS8232
auguuuauccucuuauagcac

SEQ ID NO: 2227867 - RNA, 15 nt, Streptococcus pyogenes MGAS8232
auauugagaagaaaa

SEQ ID NO: 2227868 - RNA, 18 nt, Streptococcus pyogenes MGAS8232
auauugagaagaaaaaau

SEQ ID NO: 2227869 - RNA, 13 nt, Streptococcus pyogenes MGAS8232
auauuuuauauua

SEQ ID NO: 2227870 - RNA, 18 nt, Streptococcus pyogenes MGAS8232
auauuuuauauuauguuc

SEQ ID NO: 2227871 - RNA, 13 nt, Streptococcus pyogenes MGAS8232
auauuuuauuaau

SEQ ID NO: 2227872 - RNA, 18 nt, Streptococcus pyogenes MGAS8232
aucaaaagaccauaaaaa

SEQ ID NO: 2227873 - RNA, 23 nt, Streptococcus pyogenes MGAS8232
auauuguuaauauagucugcaug

SEQ ID NO: 2227874 - RNA, 22 nt, Streptococcus pyogenes MGAS8232
auauugguugccugaaauauaa

SEQ ID NO: 2227875 - RNA, 16 nt, Streptococcus pyogenes MGAS8232
auauugggacuuuuca

SEQ ID NO: 2227876 - RNA, 19 nt, Streptococcus pyogenes MGAS8232
aucaaaagaccauaaaaaa

SEQ ID NO: 2227877 - RNA, 14 nt, Streptococcus pyogenes MGAS8232
aaaacgaucaaaaa

SEQ ID NO: 2227878 - RNA, 21 nt, Streptococcus pyogenes MGAS8232
aucaucgaguggauacaaggu

SEQ ID NO: 2227879 - RNA, 19 nt, Streptococcus pyogenes MGAS8232
aucaccguaacuugcuuug

SEQ ID NO: 2227880 - RNA, 12 nt, Streptococcus pyogenes MGAS8232
aucaauguuuug

SEQ ID NO: 2227881 - RNA, 20 nt, Streptococcus pyogenes MGAS8232
auauccauagaaauuguaac

SEQ ID NO: 2227882 - RNA, 21 nt, Streptococcus pyogenes MGAS8232
auaucauaaguuaccaauuca

SEQ ID NO: 2227883 - RNA, 17 nt, Streptococcus pyogenes MGAS8232
auaucgacauuuaugcu

SEQ ID NO: 2227884 - RNA, 18 nt, Streptococcus pyogenes MGAS8232
auaucuagaacagcugcu

SEQ ID NO: 2227885 - RNA, 16 nt, Streptococcus pyogenes MGAS8232
auaucuagaacagcug

SEQ ID NO: 2227886 - RNA, 19 nt, Streptococcus pyogenes MGAS8232
auaucuagaacagcugcuu

SEQ ID NO: 2227887 - RNA, 16 nt, Streptococcus pyogenes MGAS8232
auaucuuaccauugua

SEQ ID NO: 2227888 - RNA, 15 nt, Streptococcus pyogenes MGAS8232
auaugaaagaacuau

SEQ ID NO: 2227889 - RNA, 13 nt, Streptococcus pyogenes MGAS8232
auauaauaaaaag

SEQ ID NO: 2227890 - RNA, 20 nt, Streptococcus pyogenes MGAS8232
auauagaauagguaaagauu

SEQ ID NO: 2227891 - RNA, 15 nt, Streptococcus pyogenes MGAS8232
auaguucccuuaaua

SEQ ID NO: 2227892 - RNA, 21 nt, Streptococcus pyogenes MGAS8232
auagcugcugcuaaagcaauc

SEQ ID NO: 2227893 - RNA, 21 nt, Streptococcus pyogenes MGAS8232
auaguuugacuucaaaaauac

SEQ ID NO: 2227894 - RNA, 22 nt, Streptococcus pyogenes MGAS8232
auaguuugacuucaaaaauacu

SEQ ID NO: 2227895 - RNA, 19 nt, Streptococcus pyogenes MGAS8232
auagcguaaagcaagggaa

SEQ ID NO: 2227896 - RNA, 20 nt, Streptococcus pyogenes MGAS8232
auagcguaaagcaagggaaa

SEQ ID NO: 2227897 - RNA, 23 nt, Streptococcus pyogenes MGAS8232
auagcauuaaggauuaugaaaaa

SEQ ID NO: 2227898 - RNA, 18 nt, Streptococcus pyogenes MGAS8232
auagcacguuggaaaagg

SEQ ID NO: 2227899 - RNA, 21 nt, Streptococcus pyogenes MGAS8232
auagcaccuacgauaaaacaa

SEQ ID NO: 2227900 - RNA, 19 nt, Streptococcus pyogenes MGAS8232
auagauaguugguauauag

SEQ ID NO: 2227901 - RNA, 21 nt, Streptococcus pyogenes MGAS8232
auacucaauauaauaaaaagu

SEQ ID NO: 2227902 - RNA, 23 nt, Streptococcus pyogenes MGAS8232
auacucuauuuacucaucuacuc

SEQ ID NO: 2227903 - RNA, 15 nt, Streptococcus pyogenes MGAS8232
auaccuucauagaca

SEQ ID NO: 2227904 - RNA, 17 nt, Streptococcus pyogenes MGAS8232
aaaagaaaaucuaauca

SEQ ID NO: 2227905 - RNA, 13 nt, Streptococcus pyogenes MGAS8232
aucauuauccuuu

SEQ ID NO: 2227906 - RNA, 14 nt, Streptococcus pyogenes MGAS8232
aucauuauugacaa

SEQ ID NO: 2227907 - RNA, 19 nt, Streptococcus pyogenes MGAS8232
aucauuauugacaaaucca

SEQ ID NO: 2227908 - RNA, 23 nt, Streptococcus pyogenes MGAS8232
aucauuuuggagagauuuuuaaa

SEQ ID NO: 2227909 - RNA, 17 nt, Streptococcus pyogenes MGAS8232
auccaacuuuuaucacu

SEQ ID NO: 2227910 - RNA, 20 nt, Streptococcus pyogenes MGAS8232
auccaaucaccuuucuauau

SEQ ID NO: 2227911 - RNA, 16 nt, Streptococcus pyogenes MGAS8232
auccauuauaaaucuu

SEQ ID NO: 2227912 - RNA, 21 nt, Streptococcus pyogenes MGAS8232
aucccuucauuuuacuauggc

SEQ ID NO: 2227913 - RNA, 16 nt, Streptococcus pyogenes MGAS8232
auccgaguuuugcuga

SEQ ID NO: 2227914 - RNA, 22 nt, Streptococcus pyogenes MGAS8232
aucgacauuuaugcugauuuug

SEQ ID NO: 2227915 - RNA, 14 nt, Streptococcus pyogenes MGAS8232
aucgacauuuaugc

SEQ ID NO: 2227916 - RNA, 22 nt, Streptococcus pyogenes MGAS8232
aucgaaaugauagcaccuaauu

SEQ ID NO: 2227917 - RNA, 13 nt, Streptococcus pyogenes MGAS8232
aucuuauuuuuua

SEQ ID NO: 2227918 - RNA, 15 nt, Streptococcus pyogenes MGAS8232
aucuucaacaccuuc

SEQ ID NO: 2227919 - RNA, 13 nt, Streptococcus pyogenes MGAS8232
aucugaauuauua

SEQ ID NO: 2227920 - RNA, 15 nt, Streptococcus pyogenes MGAS8232
aucuacagcaccuuc

SEQ ID NO: 2227921 - RNA, 14 nt, Streptococcus pyogenes MGAS8232
aucgucaugacaac

SEQ ID NO: 2227922 - RNA, 13 nt, Streptococcus pyogenes MGAS8232
augauauaaaaau

SEQ ID NO: 2227923 - RNA, 19 nt, Streptococcus pyogenes MGAS8232
augauaucccaucuuuguu

SEQ ID NO: 2227924 - RNA, 16 nt, Streptococcus pyogenes MGAS8232
augaguuuauguaugc

SEQ ID NO: 2227925 - RNA, 18 nt, Streptococcus pyogenes MGAS8232
augacugacaaaacuuca

SEQ ID NO: 2227926 - RNA, 17 nt, Streptococcus pyogenes MGAS8232
augacaguauacaucaa

SEQ ID NO: 2227927 - RNA, 13 nt, Streptococcus pyogenes MGAS8232
augagguauuuau

SEQ ID NO: 2227928 - RNA, 18 nt, Streptococcus pyogenes MGAS8232
augagguauuuauaaaua

SEQ ID NO: 2227929 - RNA, 14 nt, Streptococcus pyogenes MGAS8232
augacuugaccaaa

SEQ ID NO: 2227930 - RNA, 23 nt, Streptococcus pyogenes MGAS8232
augaaaacguguauucuuaaaaa

SEQ ID NO: 2227931 - RNA, 21 nt, Streptococcus pyogenes MGAS8232
augaaaugauuguuauuuguu

SEQ ID NO: 2227932 - RNA, 18 nt, Streptococcus pyogenes MGAS8232
aucuuuguuuuuuuuagu

SEQ ID NO: 2227933 - RNA, 21 nt, Streptococcus pyogenes MGAS8232
augaauuuugucuaaaauaaa

SEQ ID NO: 2227934 - RNA, 22 nt, Streptococcus pyogenes MGAS8232
augaauuuugucuaaaauaaag

SEQ ID NO: 2227935 - RNA, 12 nt, Streptococcus pyogenes MGAS8232
augaaucauuuu

SEQ ID NO: 2227936 - RNA, 22 nt, Streptococcus pyogenes MGAS8232
augaaucauuuuggagagauuu

SEQ ID NO: 2227937 - RNA, 23 nt, Streptococcus pyogenes MGAS8232
aguuagccaagcaaucuaagaau

SEQ ID NO: 2227938 - RNA, 13 nt, Streptococcus pyogenes MGAS8232
aguucagaaguug

SEQ ID NO: 2227939 - RNA, 18 nt, Streptococcus pyogenes MGAS8232
aguuauucccauauaugc

SEQ ID NO: 2227940 - RNA, 20 nt, Streptococcus pyogenes MGAS8232
aguucugagauauucauuuu

SEQ ID NO: 2227941 - RNA, 15 nt, Streptococcus pyogenes MGAS8232
aguuuguaaaauuua

SEQ ID NO: 2227942 - RNA, 21 nt, Streptococcus pyogenes MGAS8232
aguuguauggcuauaaaugga

SEQ ID NO: 2227943 - RNA, 17 nt, Streptococcus pyogenes MGAS8232
aguugugauauaaaaug

SEQ ID NO: 2227944 - RNA, 20 nt, Streptococcus pyogenes MGAS8232
agucaaaaagacuucuuccu

SEQ ID NO: 2227945 - RNA, 13 nt, Streptococcus pyogenes MGAS8232
aguauuuuuuagu

SEQ ID NO: 2227946 - RNA, 12 nt, Streptococcus pyogenes MGAS8232
aguauuuuaaaa

SEQ ID NO: 2227947 - RNA, 21 nt, Streptococcus pyogenes MGAS8232
aguccuccucuuuagaauucu

SEQ ID NO: 2227948 - RNA, 15 nt, Streptococcus pyogenes MGAS8232
agucuuuuucuaaca

SEQ ID NO: 2227949 - RNA, 23 nt, Streptococcus pyogenes MGAS8232
agucuuuuucuaacaaaaucaca

SEQ ID NO: 2227950 - RNA, 18 nt, Streptococcus pyogenes MGAS8232
auacagaagaaagcuugu

SEQ ID NO: 2227951 - RNA, 14 nt, Streptococcus pyogenes MGAS8232
auacagcauacauc

SEQ ID NO: 2227952 - RNA, 19 nt, Streptococcus pyogenes MGAS8232
auacaagguuaaguaaaag

SEQ ID NO: 2227953 - RNA, 23 nt, Streptococcus pyogenes MGAS8232
auacaaagcaucaggauugccau

SEQ ID NO: 2227954 - RNA, 16 nt, Streptococcus pyogenes MGAS8232
auacaagucuuagaaa

SEQ ID NO: 2227955 - RNA, 18 nt, Streptococcus pyogenes MGAS8232
auacaagucuuagaaaua

SEQ ID NO: 2227956 - RNA, 19 nt, Streptococcus pyogenes MGAS8232
auacaagucuuagaaauag

SEQ ID NO: 2227957 - RNA, 15 nt, Streptococcus pyogenes MGAS8232
auaauuucaauaaua

SEQ ID NO: 2227958 - RNA, 13 nt, Streptococcus pyogenes MGAS8232
auaaugguuuuuu

SEQ ID NO: 2227959 - RNA, 18 nt, Streptococcus pyogenes MGAS8232
auaaucgaugauaauagu

SEQ ID NO: 2227960 - RNA, 16 nt, Streptococcus pyogenes MGAS8232
auaaugagcaaggcaa

SEQ ID NO: 2227961 - RNA, 14 nt, Streptococcus pyogenes MGAS8232
auaauauaaugaug

SEQ ID NO: 2227962 - RNA, 12 nt, Streptococcus pyogenes MGAS8232
auaauaaaaagu

SEQ ID NO: 2227963 - RNA, 13 nt, Streptococcus pyogenes MGAS8232
auaauaaaaagag

SEQ ID NO: 2227964 - RNA, 15 nt, Streptococcus pyogenes MGAS8232
auaacuguugucuca

SEQ ID NO: 2227965 - RNA, 18 nt, Streptococcus pyogenes MGAS8232
auaaaaucguuauuaauu

SEQ ID NO: 2227966 - RNA, 23 nt, Streptococcus pyogenes MGAS8232
auaaaaucguuauuaauuguuuu

SEQ ID NO: 2227967 - RNA, 16 nt, Streptococcus pyogenes MGAS8232
auaaaauauuuuucca

SEQ ID NO: 2227968 - RNA, 14 nt, Streptococcus pyogenes MGAS8232
aguuuuauuuugau

SEQ ID NO: 2227969 - RNA, 12 nt, Streptococcus pyogenes MGAS8232
auaaaaugccuc

SEQ ID NO: 2227970 - RNA, 20 nt, Streptococcus pyogenes MGAS8232
auaaaauuccccacaaaaga

SEQ ID NO: 2227971 - RNA, 23 nt, Streptococcus pyogenes MGAS8232
auaaaauuccccacaaaagacaa

SEQ ID NO: 2227972 - RNA, 22 nt, Streptococcus pyogenes MGAS8232
auaaagcguugacaguuaaaaa

SEQ ID NO: 2227973 - RNA, 19 nt, Streptococcus pyogenes MGAS8232
auaaauaaagauaauuucu

SEQ ID NO: 2227974 - RNA, 15 nt, Streptococcus pyogenes MGAS8232
auaacaaauuuaucc

SEQ ID NO: 2227975 - RNA, 15 nt, Streptococcus pyogenes MGAS8232
auaaccgccaucuaa

SEQ ID NO: 2227976 - RNA, 22 nt, Streptococcus pyogenes MGAS8232
agcuuacuucuaagagccaaaa

SEQ ID NO: 2227977 - RNA, 14 nt, Streptococcus pyogenes MGAS8232
agcuuaucaagguu

SEQ ID NO: 2227978 - RNA, 13 nt, Streptococcus pyogenes MGAS8232
agcuucauuuacu

SEQ ID NO: 2227979 - RNA, 18 nt, Streptococcus pyogenes MGAS8232
agcugucaauaacaacgu

SEQ ID NO: 2227980 - RNA, 20 nt, Streptococcus pyogenes MGAS8232
agcugucaauaacaacguca

SEQ ID NO: 2227981 - RNA, 16 nt, Streptococcus pyogenes MGAS8232
aggaaggcuuguucuu

SEQ ID NO: 2227982 - RNA, 15 nt, Streptococcus pyogenes MGAS8232
aggccuguauuucuu

SEQ ID NO: 2227983 - RNA, 18 nt, Streptococcus pyogenes MGAS8232
aggcaaaacaaaaagaga

SEQ ID NO: 2227984 - RNA, 17 nt, Streptococcus pyogenes MGAS8232
aggauuaugaaaaagaa

SEQ ID NO: 2227985 - RNA, 14 nt, Streptococcus pyogenes MGAS8232
aggagcuuuaccuc

SEQ ID NO: 2227986 - RNA, 17 nt, Streptococcus pyogenes MGAS8232
aggcagacaauuauuuu

SEQ ID NO: 2227987 - RNA, 20 nt, Streptococcus pyogenes MGAS8232
agguaauagcguaaagcaag

SEQ ID NO: 2227988 - RNA, 21 nt, Streptococcus pyogenes MGAS8232
aggguaucugcucagagcuuu

SEQ ID NO: 2227989 - RNA, 21 nt, Streptococcus pyogenes MGAS8232
agguagaugauuauauuagga

SEQ ID NO: 2227990 - RNA, 20 nt, Streptococcus pyogenes MGAS8232
aggucucaaauuuuuuucau

SEQ ID NO: 2227991 - RNA, 20 nt, Streptococcus pyogenes MGAS8232
aggcuuggccagcgucugau

SEQ ID NO: 2227992 - RNA, 20 nt, Streptococcus pyogenes MGAS8232
agggaaacaccaccaauaau

SEQ ID NO: 2227993 - RNA, 18 nt, Streptococcus pyogenes MGAS8232
aguauauuguaauaacaa

SEQ ID NO: 2227994 - RNA, 14 nt, Streptococcus pyogenes MGAS8232
aguauuaucucauu

SEQ ID NO: 2227995 - RNA, 14 nt, Streptococcus pyogenes MGAS8232
aguagcaaauaaca

SEQ ID NO: 2227996 - RNA, 20 nt, Streptococcus pyogenes MGAS8232
aguagugaugaguaggcgaa

SEQ ID NO: 2227997 - RNA, 20 nt, Streptococcus pyogenes MGAS8232
aguaguuucucauguuuuau

SEQ ID NO: 2227998 - RNA, 24 nt, Streptococcus pyogenes MGAS8232
aguaguaaccguuggcauaacccu

SEQ ID NO: 2227999 - RNA, 20 nt, Streptococcus pyogenes MGAS8232
agguugguaaaaaggcaguc

SEQ ID NO: 2228000 - RNA, 16 nt, Streptococcus pyogenes MGAS8232
aguaaaggauuuaguu

SEQ ID NO: 2228001 - RNA, 13 nt, Streptococcus pyogenes MGAS8232
aguaaaggauuua

SEQ ID NO: 2228002 - RNA, 22 nt, Streptococcus pyogenes MGAS8232
agcuaaagcuguaguuagaaau

SEQ ID NO: 2228003 - RNA, 22 nt, Streptococcus pyogenes MGAS8232
agcguugacaguuaaaaauaac

SEQ ID NO: 2228004 - RNA, 14 nt, Streptococcus pyogenes MGAS8232
agcuauagaaacuu

SEQ ID NO: 2228005 - RNA, 22 nt, Streptococcus pyogenes MGAS8232
agcuauuaaugguaaaggccuu

SEQ ID NO: 2228006 - RNA, 15 nt, Streptococcus pyogenes MGAS8232
agcucaucccuacua

SEQ ID NO: 2228007 - RNA, 16 nt, Streptococcus pyogenes MGAS8232
agcgguuuugucuuau

SEQ ID NO: 2228008 - RNA, 21 nt, Streptococcus pyogenes MGAS8232
agcgggaacacucaucauauu

SEQ ID NO: 2228009 - RNA, 15 nt, Streptococcus pyogenes MGAS8232
agccugucaagcccu

SEQ ID NO: 2228010 - RNA, 16 nt, Streptococcus pyogenes MGAS8232
agccugucaagcccug

SEQ ID NO: 2228011 - RNA, 15 nt, Streptococcus pyogenes MGAS8232
agcaguuauaauuag

SEQ ID NO: 2228012 - RNA, 17 nt, Streptococcus pyogenes MGAS8232
agcaguuauaauuagua

SEQ ID NO: 2228013 - RNA, 15 nt, Streptococcus pyogenes MGAS8232
agcagugcuuuaaca

SEQ ID NO: 2228014 - RNA, 19 nt, Streptococcus pyogenes MGAS8232
agcaucacguacagaaaug

SEQ ID NO: 2228015 - RNA, 17 nt, Streptococcus pyogenes MGAS8232
agcaucacguacagaaa

SEQ ID NO: 2228016 - RNA, 23 nt, Streptococcus pyogenes MGAS8232
agcaucaggauugccaucaaugu

SEQ ID NO: 2228017 - RNA, 18 nt, Streptococcus pyogenes MGAS8232
agcagcaacaauacuaug

SEQ ID NO: 2228018 - RNA, 16 nt, Streptococcus pyogenes MGAS8232
agcagcagaagcaaau

SEQ ID NO: 2228019 - RNA, 20 nt, Streptococcus pyogenes MGAS8232
agcagcaucacguacagaaa

SEQ ID NO: 2228020 - RNA, 12 nt, Streptococcus pyogenes MGAS8232
agcagcaucacg

SEQ ID NO: 2228021 - RNA, 14 nt, Streptococcus pyogenes MGAS8232
agccaucaauagca

SEQ ID NO: 2228022 - RNA, 15 nt, Streptococcus pyogenes MGAS8232
agccagagcaguuca

SEQ ID NO: 2228023 - RNA, 20 nt, Streptococcus pyogenes MGAS8232
agcaaaacaauaacacagaa

SEQ ID NO: 2228024 - RNA, 13 nt, Streptococcus pyogenes MGAS8232
agauuuuaaauau

SEQ ID NO: 2228025 - RNA, 14 nt, Streptococcus pyogenes MGAS8232
agauuuuaagacaa

SEQ ID NO: 2228026 - RNA, 22 nt, Streptococcus pyogenes MGAS8232
agauuggauuucgacucaugau

SEQ ID NO: 2228027 - RNA, 16 nt, Streptococcus pyogenes MGAS8232
agauucaauaugaaaa

SEQ ID NO: 2228028 - RNA, 18 nt, Streptococcus pyogenes MGAS8232
aaaaccauaccuacugcc

SEQ ID NO: 2228029 - RNA, 13 nt, Streptococcus pyogenes MGAS8232
aaaaccgcccaga

SEQ ID NO: 2228030 - RNA, 18 nt, Streptococcus pyogenes MGAS8232
agaugacgguaaauaaag

SEQ ID NO: 2228031 - RNA, 14 nt, Streptococcus pyogenes MGAS8232
agaugaauuuuguc

SEQ ID NO: 2228032 - RNA, 16 nt, Streptococcus pyogenes MGAS8232
agaugagaguaaacga

SEQ ID NO: 2228033 - RNA, 16 nt, Streptococcus pyogenes MGAS8232
agaugucgcaaaggcu

SEQ ID NO: 2228034 - RNA, 19 nt, Streptococcus pyogenes MGAS8232
agaguacaaggcaauccaa

SEQ ID NO: 2228035 - RNA, 15 nt, Streptococcus pyogenes MGAS8232
agaguacaaggcaau

SEQ ID NO: 2228036 - RNA, 14 nt, Streptococcus pyogenes MGAS8232
agaguacaaggcaa

SEQ ID NO: 2228037 - RNA, 18 nt, Streptococcus pyogenes MGAS8232
agauaagugccaucaggc

SEQ ID NO: 2228038 - RNA, 16 nt, Streptococcus pyogenes MGAS8232
agauaaguaauauuuu

SEQ ID NO: 2228039 - RNA, 13 nt, Streptococcus pyogenes MGAS8232
agauacuucggua

SEQ ID NO: 2228040 - RNA, 21 nt, Streptococcus pyogenes MGAS8232
agauacuucgguauucuuuuu

SEQ ID NO: 2228041 - RNA, 20 nt, Streptococcus pyogenes MGAS8232
agauauuguuaauauagucu

SEQ ID NO: 2228042 - RNA, 15 nt, Streptococcus pyogenes MGAS8232
agagguugguaaaaa

SEQ ID NO: 2228043 - RNA, 21 nt, Streptococcus pyogenes MGAS8232
agagguugguaaaaaggcagu

SEQ ID NO: 2228044 - RNA, 13 nt, Streptococcus pyogenes MGAS8232
agaggacuaaguc

SEQ ID NO: 2228045 - RNA, 20 nt, Streptococcus pyogenes MGAS8232
agagcaguucagcagcacug

SEQ ID NO: 2228046 - RNA, 16 nt, Streptococcus pyogenes MGAS8232
agagaugauagguuuu

SEQ ID NO: 2228047 - RNA, 18 nt, Streptococcus pyogenes MGAS8232
agaccuuauuaaagcccu

SEQ ID NO: 2228048 - RNA, 15 nt, Streptococcus pyogenes MGAS8232
agacaccaaaaaaag

SEQ ID NO: 2228049 - RNA, 14 nt, Streptococcus pyogenes MGAS8232
agacaccaaaaaaa

SEQ ID NO: 2228050 - RNA, 21 nt, Streptococcus pyogenes MGAS8232
agacaauaaggucaucagaau

SEQ ID NO: 2228051 - RNA, 17 nt, Streptococcus pyogenes MGAS8232
agacaaggugaauauaa

SEQ ID NO: 2228052 - RNA, 21 nt, Streptococcus pyogenes MGAS8232
agaauuggggcggcacuucca

SEQ ID NO: 2228053 - RNA, 15 nt, Streptococcus pyogenes MGAS8232
agaauccuccucuuu

SEQ ID NO: 2228054 - RNA, 17 nt, Streptococcus pyogenes MGAS8232
aaaacaauaacacagaa

SEQ ID NO: 2228055 - RNA, 13 nt, Streptococcus pyogenes MGAS8232
agaaauagucucc

SEQ ID NO: 2228056 - RNA, 17 nt, Streptococcus pyogenes MGAS8232
agaacagcugcuugaaa

SEQ ID NO: 2228057 - RNA, 14 nt, Streptococcus pyogenes MGAS8232
agaagcaaaauuau

SEQ ID NO: 2228058 - RNA, 20 nt, Streptococcus pyogenes MGAS8232
agaagauccuacaagaggag

SEQ ID NO: 2228059 - RNA, 23 nt, Streptococcus pyogenes MGAS8232
agaagauccuacaagaggaguug

SEQ ID NO: 2228060 - RNA, 20 nt, Streptococcus pyogenes MGAS8232
acuugauaaucccuugcuuu

SEQ ID NO: 2228061 - RNA, 17 nt, Streptococcus pyogenes MGAS8232
agaaagaggaaacaaaa

SEQ ID NO: 2228062 - RNA, 22 nt, Streptococcus pyogenes MGAS8232
agaaagcggaagaacagcauuu

SEQ ID NO: 2228063 - RNA, 21 nt, Streptococcus pyogenes MGAS8232
accaucaaugacuugaccaaa

SEQ ID NO: 2228064 - RNA, 13 nt, Streptococcus pyogenes MGAS8232
accaugccuaaau

SEQ ID NO: 2228065 - RNA, 19 nt, Streptococcus pyogenes MGAS8232
accaugccuaaaucccauc

SEQ ID NO: 2228066 - RNA, 12 nt, Streptococcus pyogenes MGAS8232
accauugccauu

SEQ ID NO: 2228067 - RNA, 13 nt, Streptococcus pyogenes MGAS8232
accauugccauua

SEQ ID NO: 2228068 - RNA, 22 nt, Streptococcus pyogenes MGAS8232
accauugccauuaauaauauua

SEQ ID NO: 2228069 - RNA, 19 nt, Streptococcus pyogenes MGAS8232
accauuuuaugagaaaaau

SEQ ID NO: 2228070 - RNA, 19 nt, Streptococcus pyogenes MGAS8232
acccgucuuacaauuaaua

SEQ ID NO: 2228071 - RNA, 19 nt, Streptococcus pyogenes MGAS8232
accgcaauuaaaccauucu

SEQ ID NO: 2228072 - RNA, 15 nt, Streptococcus pyogenes MGAS8232
accgcgaauaugaua

SEQ ID NO: 2228073 - RNA, 14 nt, Streptococcus pyogenes MGAS8232
acgauagcaaucac

SEQ ID NO: 2228074 - RNA, 15 nt, Streptococcus pyogenes MGAS8232
acgauagcaaucaca

SEQ ID NO: 2228075 - RNA, 23 nt, Streptococcus pyogenes MGAS8232
acgagguaacuagccuacagucu

SEQ ID NO: 2228076 - RNA, 20 nt, Streptococcus pyogenes MGAS8232
accuuaugcagguguuuaaa

SEQ ID NO: 2228077 - RNA, 15 nt, Streptococcus pyogenes MGAS8232
accuucaacauuucg

SEQ ID NO: 2228078 - RNA, 19 nt, Streptococcus pyogenes MGAS8232
accugagccgccaacauag

SEQ ID NO: 2228079 - RNA, 17 nt, Streptococcus pyogenes MGAS8232
accuccuaaacuaauaa

SEQ ID NO: 2228080 - RNA, 14 nt, Streptococcus pyogenes MGAS8232
accuauagaaaguu

SEQ ID NO: 2228081 - RNA, 15 nt, Streptococcus pyogenes MGAS8232
accucuuuuucugga

SEQ ID NO: 2228082 - RNA, 18 nt, Streptococcus pyogenes MGAS8232
acgggucucuuugggaaa

SEQ ID NO: 2228083 - RNA, 12 nt, Streptococcus pyogenes MGAS8232
acguacagaaau

SEQ ID NO: 2228084 - RNA, 18 nt, Streptococcus pyogenes MGAS8232
acggcuucuacacaaaag

SEQ ID NO: 2228085 - RNA, 14 nt, Streptococcus pyogenes MGAS8232
acgcuuaccgcaua

SEQ ID NO: 2228086 - RNA, 22 nt, Streptococcus pyogenes MGAS8232
acgcuagcauaaugcauguaau

SEQ ID NO: 2228087 - RNA, 12 nt, Streptococcus pyogenes MGAS8232
acuaaaaucaug

SEQ ID NO: 2228088 - RNA, 21 nt, Streptococcus pyogenes MGAS8232
acuagccuguccuagucuuuu

SEQ ID NO: 2228089 - RNA, 18 nt, Streptococcus pyogenes MGAS8232
acuacaggauauugagaa

SEQ ID NO: 2228090 - RNA, 20 nt, Streptococcus pyogenes MGAS8232
acuauugaaucuuguuuaac

SEQ ID NO: 2228091 - RNA, 23 nt, Streptococcus pyogenes MGAS8232
acuauugcaugaggcaaaugaaa

SEQ ID NO: 2228092 - RNA, 22 nt, Streptococcus pyogenes MGAS8232
acuauauuguuaguuuuauccc

SEQ ID NO: 2228093 - RNA, 13 nt, Streptococcus pyogenes MGAS8232
acuaaguccuuuu

SEQ ID NO: 2228094 - RNA, 15 nt, Streptococcus pyogenes MGAS8232
acuaauauaaggcaa

SEQ ID NO: 2228095 - RNA, 21 nt, Streptococcus pyogenes MGAS8232
acuuaccagcaccuucuuuua

SEQ ID NO: 2228096 - RNA, 20 nt, Streptococcus pyogenes MGAS8232
acuggcagcuucauuuacuc

SEQ ID NO: 2228097 - RNA, 17 nt, Streptococcus pyogenes MGAS8232
acugugaacaaaacaaa

SEQ ID NO: 2228098 - RNA, 14 nt, Streptococcus pyogenes MGAS8232
acuucaaaaauacu

SEQ ID NO: 2228099 - RNA, 15 nt, Streptococcus pyogenes MGAS8232
acuuauuuuuuuaag

SEQ ID NO: 2228100 - RNA, 14 nt, Streptococcus pyogenes MGAS8232
acuuauguuuaucc

SEQ ID NO: 2228101 - RNA, 21 nt, Streptococcus pyogenes MGAS8232
acuucaaggaaggcuuguucu

SEQ ID NO: 2228102 - RNA, 22 nt, Streptococcus pyogenes MGAS8232
acuucaagcauaauaaaaagag

SEQ ID NO: 2228103 - RNA, 23 nt, Streptococcus pyogenes MGAS8232
acuuccaucaucgaguggauaca

SEQ ID NO: 2228104 - RNA, 15 nt, Streptococcus pyogenes MGAS8232
acucuccaaaguucu

SEQ ID NO: 2228105 - RNA, 12 nt, Streptococcus pyogenes MGAS8232
acuauuuuguga

SEQ ID NO: 2228106 - RNA, 15 nt, Streptococcus pyogenes MGAS8232
acugagccccaaaag

SEQ ID NO: 2228107 - RNA, 18 nt, Streptococcus pyogenes MGAS8232
aaaaauuaguuaucucau

SEQ ID NO: 2228108 - RNA, 17 nt, Streptococcus pyogenes MGAS8232
aauccuuuugaaaaauu

SEQ ID NO: 2228109 - RNA, 13 nt, Streptococcus pyogenes MGAS8232
aauccuuuugcuu

SEQ ID NO: 2228110 - RNA, 17 nt, Streptococcus pyogenes MGAS8232
aauccuuuugcuucuag

SEQ ID NO: 2228111 - RNA, 18 nt, Streptococcus pyogenes MGAS8232
aaucgaacaauaauauaa

SEQ ID NO: 2228112 - RNA, 16 nt, Streptococcus pyogenes MGAS8232
aaugaccacccucaac

SEQ ID NO: 2228113 - RNA, 15 nt, Streptococcus pyogenes MGAS8232
aaugaccuuugauaa

SEQ ID NO: 2228114 - RNA, 18 nt, Streptococcus pyogenes MGAS8232
aaugauaaggcugcgaug

SEQ ID NO: 2228115 - RNA, 16 nt, Streptococcus pyogenes MGAS8232
aaugagaucuucuuuu

SEQ ID NO: 2228116 - RNA, 16 nt, Streptococcus pyogenes MGAS8232
aaucuuuauaaagcuu

SEQ ID NO: 2228117 - RNA, 12 nt, Streptococcus pyogenes MGAS8232
aaucuuuucuau

SEQ ID NO: 2228118 - RNA, 17 nt, Streptococcus pyogenes MGAS8232
aauuccucccuauuuac

SEQ ID NO: 2228119 - RNA, 15 nt, Streptococcus pyogenes MGAS8232
aauugauuugcagag

SEQ ID NO: 2228120 - RNA, 14 nt, Streptococcus pyogenes MGAS8232
aaaacaaaacaaaa

SEQ ID NO: 2228121 - RNA, 15 nt, Streptococcus pyogenes MGAS8232
aaaacaaaacaaaac

SEQ ID NO: 2228122 - RNA, 16 nt, Streptococcus pyogenes MGAS8232
aaaacaaaacaaaaca

SEQ ID NO: 2228123 - RNA, 17 nt, Streptococcus pyogenes MGAS8232
aaaacaaaacaaaacaa

SEQ ID NO: 2228124 - RNA, 12 nt, Streptococcus pyogenes MGAS8232
aaaacaaaacau

SEQ ID NO: 2228125 - RNA, 17 nt, Streptococcus pyogenes MGAS8232
aauugcagcuaaaaaca

SEQ ID NO: 2228126 - RNA, 17 nt, Streptococcus pyogenes MGAS8232
aaaacaaaaagagaccg

SEQ ID NO: 2228127 - RNA, 13 nt, Streptococcus pyogenes MGAS8232
aaaacaaaaagag

SEQ ID NO: 2228128 - RNA, 14 nt, Streptococcus pyogenes MGAS8232
aaaacaaaaagaga

SEQ ID NO: 2228129 - RNA, 16 nt, Streptococcus pyogenes MGAS8232
aauguaugauuuuaac

SEQ ID NO: 2228130 - RNA, 16 nt, Streptococcus pyogenes MGAS8232
aauuaauaaauuuuug

SEQ ID NO: 2228131 - RNA, 15 nt, Streptococcus pyogenes MGAS8232
aauuaguauauugua

SEQ ID NO: 2228132 - RNA, 15 nt, Streptococcus pyogenes MGAS8232
aauuaugcaaaagau

SEQ ID NO: 2228133 - RNA, 14 nt, Streptococcus pyogenes MGAS8232
aauuaguuaucuca

SEQ ID NO: 2228134 - RNA, 22 nt, Streptococcus pyogenes MGAS8232
aauuaguuaucucauaaaaaag

SEQ ID NO: 2228135 - RNA, 17 nt, Streptococcus pyogenes MGAS8232
aauuauuuuaauuuuuc

SEQ ID NO: 2228136 - RNA, 12 nt, Streptococcus pyogenes MGAS8232
aauuauuuuaau

SEQ ID NO: 2228137 - RNA, 12 nt, Streptococcus pyogenes MGAS8232
aauuuuuccuua

SEQ ID NO: 2228138 - RNA, 15 nt, Streptococcus pyogenes MGAS8232
aauuuauuccauuua

SEQ ID NO: 2228139 - RNA, 17 nt, Streptococcus pyogenes MGAS8232
aauuucaauaauaccau

SEQ ID NO: 2228140 - RNA, 16 nt, Streptococcus pyogenes MGAS8232
aauuuagccguccuua

SEQ ID NO: 2228141 - RNA, 14 nt, Streptococcus pyogenes MGAS8232
aauuuccuaaugca

SEQ ID NO: 2228142 - RNA, 20 nt, Streptococcus pyogenes MGAS8232
accacacgauuaaccguucc

SEQ ID NO: 2228143 - RNA, 14 nt, Streptococcus pyogenes MGAS8232
accaccaaccuuaa

SEQ ID NO: 2228144 - RNA, 17 nt, Streptococcus pyogenes MGAS8232
accaauuuaagguauug

SEQ ID NO: 2228145 - RNA, 21 nt, Streptococcus pyogenes MGAS8232
accaauuuaagguauuguuca

SEQ ID NO: 2228146 - RNA, 22 nt, Streptococcus pyogenes MGAS8232
accaauuugcaguuagcauucc

SEQ ID NO: 2228147 - RNA, 16 nt, Streptococcus pyogenes MGAS8232
accaauuguugaauaa

SEQ ID NO: 2228148 - RNA, 16 nt, Streptococcus pyogenes MGAS8232
accaauauagcaaucu

SEQ ID NO: 2228149 - RNA, 16 nt, Streptococcus pyogenes MGAS8232
acauacucuauuuacu

SEQ ID NO: 2228150 - RNA, 23 nt, Streptococcus pyogenes MGAS8232
acauacucuauuuacucaucuac

SEQ ID NO: 2228151 - RNA, 13 nt, Streptococcus pyogenes MGAS8232
acauaguguuuug

SEQ ID NO: 2228152 - RNA, 17 nt, Streptococcus pyogenes MGAS8232
acauagccuucuuuguc

SEQ ID NO: 2228153 - RNA, 20 nt, Streptococcus pyogenes MGAS8232
acaucaaaggcuuuuuugua

SEQ ID NO: 2228154 - RNA, 21 nt, Streptococcus pyogenes MGAS8232
acaucaaaggcuuuuuuguau

SEQ ID NO: 2228155 - RNA, 14 nt, Streptococcus pyogenes MGAS8232
acauuuaugcugau

SEQ ID NO: 2228156 - RNA, 22 nt, Streptococcus pyogenes MGAS8232
acauggucgaccuuaaaggccu

SEQ ID NO: 2228157 - RNA, 14 nt, Streptococcus pyogenes MGAS8232
acagacaccaaaaa

SEQ ID NO: 2228158 - RNA, 17 nt, Streptococcus pyogenes MGAS8232
acagacaccaaaaaaag

SEQ ID NO: 2228159 - RNA, 18 nt, Streptococcus pyogenes MGAS8232
acagaaagcggaagaaca

SEQ ID NO: 2228160 - RNA, 12 nt, Streptococcus pyogenes MGAS8232
acagaaagcgga

SEQ ID NO: 2228161 - RNA, 15 nt, Streptococcus pyogenes MGAS8232
acacuuaaaugcaaa

SEQ ID NO: 2228162 - RNA, 11 nt, Streptococcus pyogenes MGAS8232
acagagucuua

SEQ ID NO: 2228163 - RNA, 17 nt, Streptococcus pyogenes MGAS8232
acagauagucaaaaaga

SEQ ID NO: 2228164 - RNA, 19 nt, Streptococcus pyogenes MGAS8232
acagaugaaaaucuguauu

SEQ ID NO: 2228165 - RNA, 15 nt, Streptococcus pyogenes MGAS8232
acagcauauugaaac

SEQ ID NO: 2228166 - RNA, 17 nt, Streptococcus pyogenes MGAS8232
acaauuauuuugcaggu

SEQ ID NO: 2228167 - RNA, 14 nt, Streptococcus pyogenes MGAS8232
acaaugaaacguua

SEQ ID NO: 2228168 - RNA, 13 nt, Streptococcus pyogenes MGAS8232
acaaugcucuuaa

SEQ ID NO: 2228169 - RNA, 21 nt, Streptococcus pyogenes MGAS8232
acaaugcucuuaacucucaua

SEQ ID NO: 2228170 - RNA, 18 nt, Streptococcus pyogenes MGAS8232
acaauguagcuaucaaau

SEQ ID NO: 2228171 - RNA, 15 nt, Streptococcus pyogenes MGAS8232
acacagaagccucuu

SEQ ID NO: 2228172 - RNA, 14 nt, Streptococcus pyogenes MGAS8232
acaagagcuuaaaa

SEQ ID NO: 2228173 - RNA, 21 nt, Streptococcus pyogenes MGAS8232
acaagaccuuauuaaagcccu

SEQ ID NO: 2228174 - RNA, 18 nt, Streptococcus pyogenes MGAS8232
acaagcauuuuugcaggg

SEQ ID NO: 2228175 - RNA, 19 nt, Streptococcus pyogenes MGAS8232
acaagcauuuuugcagggu

SEQ ID NO: 2228176 - RNA, 15 nt, Streptococcus pyogenes MGAS8232
acaauaacacagaag

SEQ ID NO: 2228177 - RNA, 16 nt, Streptococcus pyogenes MGAS8232
aauuuuugauuuuaau

SEQ ID NO: 2228178 - RNA, 22 nt, Streptococcus pyogenes MGAS8232
aagcuugucuaugagauaccuu

SEQ ID NO: 2228179 - RNA, 23 nt, Streptococcus pyogenes MGAS8232
aaggaauugcagcuaaaaacaau

SEQ ID NO: 2228180 - RNA, 21 nt, Streptococcus pyogenes MGAS8232
aaggaaggcuuguucuuuauu

SEQ ID NO: 2228181 - RNA, 21 nt, Streptococcus pyogenes MGAS8232
aaggcagucgcagaguacaag

SEQ ID NO: 2228182 - RNA, 18 nt, Streptococcus pyogenes MGAS8232
aaggcaauccaaaucaac

SEQ ID NO: 2228183 - RNA, 16 nt, Streptococcus pyogenes MGAS8232
aaggauuaugaaaaag

SEQ ID NO: 2228184 - RNA, 17 nt, Streptococcus pyogenes MGAS8232
aaggauuaugaaaaaga

SEQ ID NO: 2228185 - RNA, 16 nt, Streptococcus pyogenes MGAS8232
aaggcugcgaugauuu

SEQ ID NO: 2228186 - RNA, 14 nt, Streptococcus pyogenes MGAS8232
aagucucuugcaag

SEQ ID NO: 2228187 - RNA, 22 nt, Streptococcus pyogenes MGAS8232
aagucuaucugcagauuuuaag

SEQ ID NO: 2228188 - RNA, 17 nt, Streptococcus pyogenes MGAS8232
aaguauagcauaaaaua

SEQ ID NO: 2228189 - RNA, 23 nt, Streptococcus pyogenes MGAS8232
aaguauuuuaaaauccucuuuua

SEQ ID NO: 2228190 - RNA, 22 nt, Streptococcus pyogenes MGAS8232
aagguuuuuuuaagcaugauuu

SEQ ID NO: 2228191 - RNA, 19 nt, Streptococcus pyogenes MGAS8232
aagguuuuuuuaagcauga

SEQ ID NO: 2228192 - RNA, 14 nt, Streptococcus pyogenes MGAS8232
aauaucaugaagua

SEQ ID NO: 2228193 - RNA, 17 nt, Streptococcus pyogenes MGAS8232
aauaucaggcaaaacaa

SEQ ID NO: 2228194 - RNA, 22 nt, Streptococcus pyogenes MGAS8232
aauaucacauuuuaaucuuuuu

SEQ ID NO: 2228195 - RNA, 18 nt, Streptococcus pyogenes MGAS8232
aauaucgccaauaaaaaa

SEQ ID NO: 2228196 - RNA, 13 nt, Streptococcus pyogenes MGAS8232
aauaucuuaccau

SEQ ID NO: 2228197 - RNA, 23 nt, Streptococcus pyogenes MGAS8232
aauaucuuaccauuguagaguuu

SEQ ID NO: 2228198 - RNA, 15 nt, Streptococcus pyogenes MGAS8232
aauauaauaaaaagu

SEQ ID NO: 2228199 - RNA, 16 nt, Streptococcus pyogenes MGAS8232
aauauaauaaaaagua

SEQ ID NO: 2228200 - RNA, 16 nt, Streptococcus pyogenes MGAS8232
aauauaaggcaaucac

SEQ ID NO: 2228201 - RNA, 19 nt, Streptococcus pyogenes MGAS8232
aauauaauucauguuuaaa

SEQ ID NO: 2228202 - RNA, 11 nt, Streptococcus pyogenes MGAS8232
aauauagcaau

SEQ ID NO: 2228203 - RNA, 20 nt, Streptococcus pyogenes MGAS8232
aauaguucccuuaauaaacu

SEQ ID NO: 2228204 - RNA, 16 nt, Streptococcus pyogenes MGAS8232
aauagguaaagauuuu

SEQ ID NO: 2228205 - RNA, 23 nt, Streptococcus pyogenes MGAS8232
aauagguaaagauuuuaaauauc

SEQ ID NO: 2228206 - RNA, 18 nt, Streptococcus pyogenes MGAS8232
aauaguagcaaauaacau

SEQ ID NO: 2228207 - RNA, 17 nt, Streptococcus pyogenes MGAS8232
aauagaagacaagguga

SEQ ID NO: 2228208 - RNA, 16 nt, Streptococcus pyogenes MGAS8232
aauagcaaugguuaaa

SEQ ID NO: 2228209 - RNA, 13 nt, Streptococcus pyogenes MGAS8232
aauagcgaaaaag

SEQ ID NO: 2228210 - RNA, 21 nt, Streptococcus pyogenes MGAS8232
aauagcguaaagcaagggaaa

SEQ ID NO: 2228211 - RNA, 15 nt, Streptococcus pyogenes MGAS8232
aauacagaagaaagc

SEQ ID NO: 2228212 - RNA, 14 nt, Streptococcus pyogenes MGAS8232
aauaccauuuuuau

SEQ ID NO: 2228213 - RNA, 21 nt, Streptococcus pyogenes MGAS8232
aaaaaucccuaugaucuguuu

SEQ ID NO: 2228214 - RNA, 23 nt, Streptococcus pyogenes MGAS8232
aauaaguauagcauaaaauaguu

SEQ ID NO: 2228215 - RNA, 16 nt, Streptococcus pyogenes MGAS8232
aauaaggucaucagaa

SEQ ID NO: 2228216 - RNA, 15 nt, Streptococcus pyogenes MGAS8232
aauaacuuuaaaagg

SEQ ID NO: 2228217 - RNA, 11 nt, Streptococcus pyogenes MGAS8232
aauaagauuca

SEQ ID NO: 2228218 - RNA, 14 nt, Streptococcus pyogenes MGAS8232
aagaggaaacaaaa

SEQ ID NO: 2228219 - RNA, 20 nt, Streptococcus pyogenes MGAS8232
aagagccaucagcucucaag

SEQ ID NO: 2228220 - RNA, 15 nt, Streptococcus pyogenes MGAS8232
aagagagcuugguuu

SEQ ID NO: 2228221 - RNA, 16 nt, Streptococcus pyogenes MGAS8232
aagagccaaaauaaca

SEQ ID NO: 2228222 - RNA, 17 nt, Streptococcus pyogenes MGAS8232
aagauauuuuaaaauag

SEQ ID NO: 2228223 - RNA, 16 nt, Streptococcus pyogenes MGAS8232
aagauaaguaauauuu

SEQ ID NO: 2228224 - RNA, 12 nt, Streptococcus pyogenes MGAS8232
aagacaaaaaaa

SEQ ID NO: 2228225 - RNA, 14 nt, Streptococcus pyogenes MGAS8232
aagacaaaaaaacu

SEQ ID NO: 2228226 - RNA, 17 nt, Streptococcus pyogenes MGAS8232
aagacaaaaaaacugga

SEQ ID NO: 2228227 - RNA, 14 nt, Streptococcus pyogenes MGAS8232
aagaccauaaaaaa

SEQ ID NO: 2228228 - RNA, 17 nt, Streptococcus pyogenes MGAS8232
aagaccauaaaaaaccu

SEQ ID NO: 2228229 - RNA, 17 nt, Streptococcus pyogenes MGAS8232
aagaccuucaaaaaagg

SEQ ID NO: 2228230 - RNA, 15 nt, Streptococcus pyogenes MGAS8232
aagacggaguauuuu

SEQ ID NO: 2228231 - RNA, 16 nt, Streptococcus pyogenes MGAS8232
aagacuuaaggauuua

SEQ ID NO: 2228232 - RNA, 15 nt, Streptococcus pyogenes MGAS8232
aacucgauaaaaacg

SEQ ID NO: 2228233 - RNA, 22 nt, Streptococcus pyogenes MGAS8232
aacucuaaucuuuauaaagcuu

SEQ ID NO: 2228234 - RNA, 14 nt, Streptococcus pyogenes MGAS8232
aacuuuuaucacua

SEQ ID NO: 2228235 - RNA, 16 nt, Streptococcus pyogenes MGAS8232
aacuugucaagccaua

SEQ ID NO: 2228236 - RNA, 13 nt, Streptococcus pyogenes MGAS8232
aacuuucaguuau

SEQ ID NO: 2228237 - RNA, 18 nt, Streptococcus pyogenes MGAS8232
aacugccaguugagccuu

SEQ ID NO: 2228238 - RNA, 23 nt, Streptococcus pyogenes MGAS8232
aacgcuagcauaaugcauguaau

SEQ ID NO: 2228239 - RNA, 20 nt, Streptococcus pyogenes MGAS8232
aacgaauugugucauuucuu

SEQ ID NO: 2228240 - RNA, 21 nt, Streptococcus pyogenes MGAS8232
aaccuuccuguaucaggaggg

SEQ ID NO: 2228241 - RNA, 17 nt, Streptococcus pyogenes MGAS8232
aaccuuuagagaaucaa

SEQ ID NO: 2228242 - RNA, 17 nt, Streptococcus pyogenes MGAS8232
aaccacagcaauuuguu

SEQ ID NO: 2228243 - RNA, 22 nt, Streptococcus pyogenes MGAS8232
aacauggauaccauuucuuugc

SEQ ID NO: 2228244 - RNA, 17 nt, Streptococcus pyogenes MGAS8232
aacaugccuuucacagc

SEQ ID NO: 2228245 - RNA, 16 nt, Streptococcus pyogenes MGAS8232
aacauuuaaucauguc

SEQ ID NO: 2228246 - RNA, 17 nt, Streptococcus pyogenes MGAS8232
aacaguuccaguucugu

SEQ ID NO: 2228247 - RNA, 19 nt, Streptococcus pyogenes MGAS8232
cgcuauaccuaaaaaauaa

SEQ ID NO: 2228248 - RNA, 14 nt, Streptococcus pyogenes MGAS8232
cgcuagcauaaugc

SEQ ID NO: 2228249 - RNA, 20 nt, Streptococcus pyogenes MGAS8232
cgcguuucgaaaaaggggag

SEQ ID NO: 2228250 - RNA, 18 nt, Streptococcus pyogenes MGAS8232
cgauuaaccguuccuguc

SEQ ID NO: 2228251 - RNA, 14 nt, Streptococcus pyogenes MGAS8232
cgauuaaaagaugu

SEQ ID NO: 2228252 - RNA, 17 nt, Streptococcus pyogenes MGAS8232
cggcaucuacagcaccu

SEQ ID NO: 2228253 - RNA, 13 nt, Streptococcus pyogenes MGAS8232
cggcaucuacagc

SEQ ID NO: 2228254 - RNA, 16 nt, Streptococcus pyogenes MGAS8232
cgcuugcagcauaauc

SEQ ID NO: 2228255 - RNA, 13 nt, Streptococcus pyogenes MGAS8232
ccauuaaaaaaac

SEQ ID NO: 2228256 - RNA, 12 nt, Streptococcus pyogenes MGAS8232
ccauucuaaaca

SEQ ID NO: 2228257 - RNA, 18 nt, Streptococcus pyogenes MGAS8232
ccauucuaaacaagaccu

SEQ ID NO: 2228258 - RNA, 20 nt, Streptococcus pyogenes MGAS8232
ccauauuuuugaaaaaaaug

SEQ ID NO: 2228259 - RNA, 18 nt, Streptococcus pyogenes MGAS8232
aaaccauuuuaugagaaa

SEQ ID NO: 2228260 - RNA, 13 nt, Streptococcus pyogenes MGAS8232
aaacauauuauag

SEQ ID NO: 2228261 - RNA, 16 nt, Streptococcus pyogenes MGAS8232
aaacauagccuucuuu

SEQ ID NO: 2228262 - RNA, 20 nt, Streptococcus pyogenes MGAS8232
ccgaaaaaggcaaagaaagc

SEQ ID NO: 2228263 - RNA, 14 nt, Streptococcus pyogenes MGAS8232
aaacauuuaaucau

SEQ ID NO: 2228264 - RNA, 15 nt, Streptococcus pyogenes MGAS8232
aaacauuuaaucaug

SEQ ID NO: 2228265 - RNA, 20 nt, Streptococcus pyogenes MGAS8232
aaacauuuaaucauguccaa

SEQ ID NO: 2228266 - RNA, 13 nt, Streptococcus pyogenes MGAS8232
ccggcagggguca

SEQ ID NO: 2228267 - RNA, 21 nt, Streptococcus pyogenes MGAS8232
ccguuugagauaacucuucgg

SEQ ID NO: 2228268 - RNA, 11 nt, Streptococcus pyogenes MGAS8232
ccuaaaagaac

SEQ ID NO: 2228269 - RNA, 17 nt, Streptococcus pyogenes MGAS8232
ccuccuugcaauagagc

SEQ ID NO: 2228270 - RNA, 22 nt, Streptococcus pyogenes MGAS8232
ccuauuugacuuguuacaaaaa

SEQ ID NO: 2228271 - RNA, 13 nt, Streptococcus pyogenes MGAS8232
ccuaggaauaaaa

SEQ ID NO: 2228272 - RNA, 20 nt, Streptococcus pyogenes MGAS8232
ccuacgauaaaacaaauaau

SEQ ID NO: 2228273 - RNA, 20 nt, Streptococcus pyogenes MGAS8232
ccuacuagcacaaaaucauu

SEQ ID NO: 2228274 - RNA, 18 nt, Streptococcus pyogenes MGAS8232
ccuaauuuaauuuacccc

SEQ ID NO: 2228275 - RNA, 20 nt, Streptococcus pyogenes MGAS8232
cgaauaugauauaaaaaugg

SEQ ID NO: 2228276 - RNA, 16 nt, Streptococcus pyogenes MGAS8232
cgaauaugauauaaaa

SEQ ID NO: 2228277 - RNA, 14 nt, Streptococcus pyogenes MGAS8232
ccuuuugcuucuag

SEQ ID NO: 2228278 - RNA, 16 nt, Streptococcus pyogenes MGAS8232
cgaagcuaagauuucc

SEQ ID NO: 2228279 - RNA, 20 nt, Streptococcus pyogenes MGAS8232
cgaauugugucauuucuuga

SEQ ID NO: 2228280 - RNA, 15 nt, Streptococcus pyogenes MGAS8232
cgacauuuaugcuga

SEQ ID NO: 2228281 - RNA, 19 nt, Streptococcus pyogenes MGAS8232
ccuuuaucuuauuuuaaga

SEQ ID NO: 2228282 - RNA, 21 nt, Streptococcus pyogenes MGAS8232
ccuuuagcaauuguuuuuuca

SEQ ID NO: 2228283 - RNA, 17 nt, Streptococcus pyogenes MGAS8232
ccuuucuauauaacugu

SEQ ID NO: 2228284 - RNA, 22 nt, Streptococcus pyogenes MGAS8232
ccuuguacaagagcuuaaaagu

SEQ ID NO: 2228285 - RNA, 13 nt, Streptococcus pyogenes MGAS8232
ccuucuuggaaaa

SEQ ID NO: 2228286 - RNA, 13 nt, Streptococcus pyogenes MGAS8232
ccuucuucaagcu

SEQ ID NO: 2228287 - RNA, 22 nt, Streptococcus pyogenes MGAS8232
ccuucaaaaaagggaagaagau

SEQ ID NO: 2228288 - RNA, 17 nt, Streptococcus pyogenes MGAS8232
ccuucaaaaaagggaag

SEQ ID NO: 2228289 - RNA, 21 nt, Streptococcus pyogenes MGAS8232
ccugcuauaaacgguaauuua

SEQ ID NO: 2228290 - RNA, 16 nt, Streptococcus pyogenes MGAS8232
cauggguaaaaugacu

SEQ ID NO: 2228291 - RNA, 22 nt, Streptococcus pyogenes MGAS8232
cauguaaacaauugguuuacau

SEQ ID NO: 2228292 - RNA, 15 nt, Streptococcus pyogenes MGAS8232
caugaagugguucaa

SEQ ID NO: 2228293 - RNA, 15 nt, Streptococcus pyogenes MGAS8232
caugaccaaaaaauu

SEQ ID NO: 2228294 - RNA, 12 nt, Streptococcus pyogenes MGAS8232
caugaggcaaau

SEQ ID NO: 2228295 - RNA, 22 nt, Streptococcus pyogenes MGAS8232
caugaaaguuauagcuccuaaa

SEQ ID NO: 2228296 - RNA, 19 nt, Streptococcus pyogenes MGAS8232
caugauaucccaucuuugu

SEQ ID NO: 2228297 - RNA, 19 nt, Streptococcus pyogenes MGAS8232
caugaugccauuuaaaagg

SEQ ID NO: 2228298 - RNA, 18 nt, Streptococcus pyogenes MGAS8232
caugauguuauuaaauaa

SEQ ID NO: 2228299 - RNA, 21 nt, Streptococcus pyogenes MGAS8232
caucgaguggauacaagguua

SEQ ID NO: 2228300 - RNA, 16 nt, Streptococcus pyogenes MGAS8232
caucaauguuuugcuc

SEQ ID NO: 2228301 - RNA, 21 nt, Streptococcus pyogenes MGAS8232
caucaaaggcuuuuuuguauu

SEQ ID NO: 2228302 - RNA, 19 nt, Streptococcus pyogenes MGAS8232
caucaaaggguguuuuuua

SEQ ID NO: 2228303 - RNA, 14 nt, Streptococcus pyogenes MGAS8232
cauauuuuugaaaa

SEQ ID NO: 2228304 - RNA, 16 nt, Streptococcus pyogenes MGAS8232
cauauuuuugaaaaaa

SEQ ID NO: 2228305 - RNA, 18 nt, Streptococcus pyogenes MGAS8232
cauauuuuugaaaaaaau

SEQ ID NO: 2228306 - RNA, 15 nt, Streptococcus pyogenes MGAS8232
cauaucgacauuuau

SEQ ID NO: 2228307 - RNA, 18 nt, Streptococcus pyogenes MGAS8232
cauaucgacauuuaugcu

SEQ ID NO: 2228308 - RNA, 21 nt, Streptococcus pyogenes MGAS8232
cauagacaagcuuuuuuauaa

SEQ ID NO: 2228309 - RNA, 21 nt, Streptococcus pyogenes MGAS8232
cauagaagacggaguauuuuu

SEQ ID NO: 2228310 - RNA, 19 nt, Streptococcus pyogenes MGAS8232
cauagaucgucacuaucug

SEQ ID NO: 2228311 - RNA, 21 nt, Streptococcus pyogenes MGAS8232
cauacuuuauuaaucaaaaaa

SEQ ID NO: 2228312 - RNA, 23 nt, Streptococcus pyogenes MGAS8232
ccagaugcuugcucaauuuuuga

SEQ ID NO: 2228313 - RNA, 12 nt, Streptococcus pyogenes MGAS8232
ccacuucaagca

SEQ ID NO: 2228314 - RNA, 16 nt, Streptococcus pyogenes MGAS8232
ccagccacuacaagca

SEQ ID NO: 2228315 - RNA, 15 nt, Streptococcus pyogenes MGAS8232
ccagcauuugccaug

SEQ ID NO: 2228316 - RNA, 15 nt, Streptococcus pyogenes MGAS8232
ccagcaccuucuuuu

SEQ ID NO: 2228317 - RNA, 16 nt, Streptococcus pyogenes MGAS8232
ccaauaaugagcaagg

SEQ ID NO: 2228318 - RNA, 12 nt, Streptococcus pyogenes MGAS8232
ccaaucuuugug

SEQ ID NO: 2228319 - RNA, 12 nt, Streptococcus pyogenes MGAS8232
ccaauucuaaaa

SEQ ID NO: 2228320 - RNA, 22 nt, Streptococcus pyogenes MGAS8232
ccaaggucugcgcgacuaaaau

SEQ ID NO: 2228321 - RNA, 21 nt, Streptococcus pyogenes MGAS8232
cauuuuggagagauuuuuaaa

SEQ ID NO: 2228322 - RNA, 16 nt, Streptococcus pyogenes MGAS8232
caguaaggaaaucaau

SEQ ID NO: 2228323 - RNA, 16 nt, Streptococcus pyogenes MGAS8232
cagguuucuuuugguu

SEQ ID NO: 2228324 - RNA, 23 nt, Streptococcus pyogenes MGAS8232
caguccuccucuuuagaauucuu

SEQ ID NO: 2228325 - RNA, 16 nt, Streptococcus pyogenes MGAS8232
caguccuccucuuuag

SEQ ID NO: 2228326 - RNA, 21 nt, Streptococcus pyogenes MGAS8232
cagucaagagcacacauaaug

SEQ ID NO: 2228327 - RNA, 23 nt, Streptococcus pyogenes MGAS8232
cagcugguuuuuuuaauuauuuu

SEQ ID NO: 2228328 - RNA, 21 nt, Streptococcus pyogenes MGAS8232
cagaaauuaauaaauuuuugu

SEQ ID NO: 2228329 - RNA, 20 nt, Streptococcus pyogenes MGAS8232
cagaagcaaauucuuccuua

SEQ ID NO: 2228330 - RNA, 16 nt, Streptococcus pyogenes MGAS8232
cagaagccucuucuga

SEQ ID NO: 2228331 - RNA, 15 nt, Streptococcus pyogenes MGAS8232
cagacaccaaaaaaa

SEQ ID NO: 2228332 - RNA, 19 nt, Streptococcus pyogenes MGAS8232
aaaaucaugggaaaagcua

SEQ ID NO: 2228333 - RNA, 15 nt, Streptococcus pyogenes MGAS8232
cagagcaguucagca

SEQ ID NO: 2228334 - RNA, 17 nt, Streptococcus pyogenes MGAS8232
cagagcucgucuuuguc

SEQ ID NO: 2228335 - RNA, 22 nt, Streptococcus pyogenes MGAS8232
cagacuuuuaauguauuggaaa

SEQ ID NO: 2228336 - RNA, 13 nt, Streptococcus pyogenes MGAS8232
aaaaugaagcaaa

SEQ ID NO: 2228337 - RNA, 19 nt, Streptococcus pyogenes MGAS8232
aaaaucuuuucuauuuaac

SEQ ID NO: 2228338 - RNA, 20 nt, Streptococcus pyogenes MGAS8232
cagauaagaccuucaaaaaa

SEQ ID NO: 2228339 - RNA, 14 nt, Streptococcus pyogenes MGAS8232
cagauaagaccuuc

SEQ ID NO: 2228340 - RNA, 17 nt, Streptococcus pyogenes MGAS8232
cagauaagaccuucaaa

SEQ ID NO: 2228341 - RNA, 17 nt, Streptococcus pyogenes MGAS8232
aaaaugcuguuugucau

SEQ ID NO: 2228342 - RNA, 18 nt, Streptococcus pyogenes MGAS8232
aaaaugcuuuuucguuaa

SEQ ID NO: 2228343 - RNA, 12 nt, Streptococcus pyogenes MGAS8232
cagcaauuuguu

SEQ ID NO: 2228344 - RNA, 21 nt, Streptococcus pyogenes MGAS8232
cagcacuggcuuuuuugcuuu

SEQ ID NO: 2228345 - RNA, 14 nt, Streptococcus pyogenes MGAS8232
uuuuuuauacggua

SEQ ID NO: 2228346 - RNA, 14 nt, Streptococcus pyogenes MGAS8232
uuuuuguauuacuc

SEQ ID NO: 2228347 - RNA, 15 nt, Streptococcus pyogenes MGAS8232
uuuuuguauuacuca

SEQ ID NO: 2228348 - RNA, 22 nt, Streptococcus pyogenes MGAS8232
uuuuuuaagacuauguugcuua

SEQ ID NO: 2228349 - RNA, 16 nt, Streptococcus pyogenes MGAS8232
uuuugauuuucucagu

SEQ ID NO: 2228350 - RNA, 23 nt, Streptococcus pyogenes MGAS8232
uuuuucucaaaaauauauucuaa

SEQ ID NO: 2228351 - RNA, 19 nt, Streptococcus pyogenes MGAS8232
uuuuaguaaagccuuaucc

SEQ ID NO: 2228352 - RNA, 18 nt, Streptococcus pyogenes MGAS8232
uuuuaguugauuagaaua

SEQ ID NO: 2228353 - RNA, 19 nt, Streptococcus pyogenes MGAS8232
uuuuaggccaccagaugcu

SEQ ID NO: 2228354 - RNA, 12 nt, Streptococcus pyogenes MGAS8232
uuuuaguuuuau

SEQ ID NO: 2228355 - RNA, 19 nt, Streptococcus pyogenes MGAS8232
uuuuaguugugauauaaaa

SEQ ID NO: 2228356 - RNA, 14 nt, Streptococcus pyogenes MGAS8232
uuuuaguuuguaaa

SEQ ID NO: 2228357 - RNA, 18 nt, Streptococcus pyogenes MGAS8232
uuuuaguuuguaaaauuu

SEQ ID NO: 2228358 - RNA, 22 nt, Streptococcus pyogenes MGAS8232
uuuuauccccuauucaauauuu

SEQ ID NO: 2228359 - RNA, 14 nt, Streptococcus pyogenes MGAS8232
uuuuaugagaaaaa

SEQ ID NO: 2228360 - RNA, 16 nt, Streptococcus pyogenes MGAS8232
uuuugaguuugaugag

SEQ ID NO: 2228361 - RNA, 15 nt, Streptococcus pyogenes MGAS8232
uuuuauuuuuuaaag

SEQ ID NO: 2228362 - RNA, 13 nt, Streptococcus pyogenes MGAS8232
uuuggcaaccuua

SEQ ID NO: 2228363 - RNA, 18 nt, Streptococcus pyogenes MGAS8232
uuugcguuguagguaaua

SEQ ID NO: 2228364 - RNA, 18 nt, Streptococcus pyogenes MGAS8232
uuugcugagcuaaagcca

SEQ ID NO: 2228365 - RNA, 21 nt, Streptococcus pyogenes MGAS8232
uuugguguuauccucuuuuag

SEQ ID NO: 2228366 - RNA, 16 nt, Streptococcus pyogenes MGAS8232
uuugguggaagaguaa

SEQ ID NO: 2228367 - RNA, 17 nt, Streptococcus pyogenes MGAS8232
uuuggccuacuagcaca

SEQ ID NO: 2228368 - RNA, 22 nt, Streptococcus pyogenes MGAS8232
uuuggccuacuagcacaaaauc

SEQ ID NO: 2228369 - RNA, 16 nt, Streptococcus pyogenes MGAS8232
uuuuaacuauuuaacu

SEQ ID NO: 2228370 - RNA, 19 nt, Streptococcus pyogenes MGAS8232
uuuuaaauaucuuaccauu

SEQ ID NO: 2228371 - RNA, 19 nt, Streptococcus pyogenes MGAS8232
uuuguuccaucugcacaug

SEQ ID NO: 2228372 - RNA, 21 nt, Streptococcus pyogenes MGAS8232
uuuguguugaagaaggucaug

SEQ ID NO: 2228373 - RNA, 13 nt, Streptococcus pyogenes MGAS8232
uuuguuaacaggu

SEQ ID NO: 2228374 - RNA, 20 nt, Streptococcus pyogenes MGAS8232
uuuguuaccuucuucaagcu

SEQ ID NO: 2228375 - RNA, 19 nt, Streptococcus pyogenes MGAS8232
uuugucuucuucuuuucag

SEQ ID NO: 2228376 - RNA, 22 nt, Streptococcus pyogenes MGAS8232
uuuacagucaagagcacacaua

SEQ ID NO: 2228377 - RNA, 21 nt, Streptococcus pyogenes MGAS8232
uuuacuauggcuucuaaaaaa

SEQ ID NO: 2228378 - RNA, 15 nt, Streptococcus pyogenes MGAS8232
uuuacuuuuaaaauc

SEQ ID NO: 2228379 - RNA, 21 nt, Streptococcus pyogenes MGAS8232
uuuagcuuauaguuugacuuc

SEQ ID NO: 2228380 - RNA, 20 nt, Streptococcus pyogenes MGAS8232
uuuagucauuucuucagguu

SEQ ID NO: 2228381 - RNA, 19 nt, Streptococcus pyogenes MGAS8232
uuuagcaauuguuuuuuca

SEQ ID NO: 2228382 - RNA, 16 nt, Streptococcus pyogenes MGAS8232
uuuauuaaucaaaaaa

SEQ ID NO: 2228383 - RNA, 18 nt, Streptococcus pyogenes MGAS8232
uuuauuaauaaguauuuu

SEQ ID NO: 2228384 - RNA, 19 nt, Streptococcus pyogenes MGAS8232
uuuauguaugcuguccaug

SEQ ID NO: 2228385 - RNA, 19 nt, Streptococcus pyogenes MGAS8232
uuuaugaccauuuuuacug

SEQ ID NO: 2228386 - RNA, 14 nt, Streptococcus pyogenes MGAS8232
uuuaugaaagguau

SEQ ID NO: 2228387 - RNA, 16 nt, Streptococcus pyogenes MGAS8232
uuuauaaauauuuuau

SEQ ID NO: 2228388 - RNA, 19 nt, Streptococcus pyogenes MGAS8232
uuuauaaagcuuuaaaaaa

SEQ ID NO: 2228389 - RNA, 18 nt, Streptococcus pyogenes MGAS8232
uuuauacgguaaaaacuc

SEQ ID NO: 2228390 - RNA, 19 nt, Streptococcus pyogenes MGAS8232
uuucaugauguuuauucca

SEQ ID NO: 2228391 - RNA, 22 nt, Streptococcus pyogenes MGAS8232
uuucagauaagaccuucaaaaa

SEQ ID NO: 2228392 - RNA, 15 nt, Streptococcus pyogenes MGAS8232
uuucaguuguuuuaa

SEQ ID NO: 2228393 - RNA, 16 nt, Streptococcus pyogenes MGAS8232
uuucagucuucuguaa

SEQ ID NO: 2228394 - RNA, 21 nt, Streptococcus pyogenes MGAS8232
uuucaacaaauccuuuugcuu

SEQ ID NO: 2228395 - RNA, 23 nt, Streptococcus pyogenes MGAS8232
uuuauuuugauauuuuuucucaa

SEQ ID NO: 2228396 - RNA, 12 nt, Streptococcus pyogenes MGAS8232
uuuauuucacua

SEQ ID NO: 2228397 - RNA, 21 nt, Streptococcus pyogenes MGAS8232
uuucuuauauugugcuauuca

SEQ ID NO: 2228398 - RNA, 19 nt, Streptococcus pyogenes MGAS8232
uuucuucagguuucuuuug

SEQ ID NO: 2228399 - RNA, 22 nt, Streptococcus pyogenes MGAS8232
uuugaaccgaaacguaacguaa

SEQ ID NO: 2228400 - RNA, 13 nt, Streptococcus pyogenes MGAS8232
uuucuuugucaug

SEQ ID NO: 2228401 - RNA, 12 nt, Streptococcus pyogenes MGAS8232
uuugaauguugu

SEQ ID NO: 2228402 - RNA, 23 nt, Streptococcus pyogenes MGAS8232
uuugaccgaaaaaggcaaagaaa

SEQ ID NO: 2228403 - RNA, 20 nt, Streptococcus pyogenes MGAS8232
uuugauauuuuuucucaaaa

SEQ ID NO: 2228404 - RNA, 21 nt, Streptococcus pyogenes MGAS8232
uuugauugauuugucuucucc

SEQ ID NO: 2228405 - RNA, 20 nt, Streptococcus pyogenes MGAS8232
uuucucagagacaauaaggu

SEQ ID NO: 2228406 - RNA, 17 nt, Streptococcus pyogenes MGAS8232
uuucuauauaacuguuc

SEQ ID NO: 2228407 - RNA, 14 nt, Streptococcus pyogenes MGAS8232
uuuccuacaaaaua

SEQ ID NO: 2228408 - RNA, 22 nt, Streptococcus pyogenes MGAS8232
uugguggaagaguaaggaccaa

SEQ ID NO: 2228409 - RNA, 21 nt, Streptococcus pyogenes MGAS8232
uuggcuacucuauuuuaagua

SEQ ID NO: 2228410 - RNA, 17 nt, Streptococcus pyogenes MGAS8232
uuggcuacucuauuuua

SEQ ID NO: 2228411 - RNA, 13 nt, Streptococcus pyogenes MGAS8232
uugcuuaaugacc

SEQ ID NO: 2228412 - RNA, 20 nt, Streptococcus pyogenes MGAS8232
uugcuuaaugaccuuugaua

SEQ ID NO: 2228413 - RNA, 19 nt, Streptococcus pyogenes MGAS8232
uugcuuuuggcaaccuuac

SEQ ID NO: 2228414 - RNA, 14 nt, Streptococcus pyogenes MGAS8232
uugcuuuugauacc

SEQ ID NO: 2228415 - RNA, 20 nt, Streptococcus pyogenes MGAS8232
uuggcauaacccucauuguc

SEQ ID NO: 2228416 - RNA, 14 nt, Streptococcus pyogenes MGAS8232
uuggagagauuuuu

SEQ ID NO: 2228417 - RNA, 19 nt, Streptococcus pyogenes MGAS8232
uuggagagauuuuuaaaac

SEQ ID NO: 2228418 - RNA, 19 nt, Streptococcus pyogenes MGAS8232
uuggagagauaaaaaguaa

SEQ ID NO: 2228419 - RNA, 22 nt, Streptococcus pyogenes MGAS8232
uuguuuuggccaauaaaauauc

SEQ ID NO: 2228420 - RNA, 12 nt, Streptococcus pyogenes MGAS8232
uuguuuuuucaa

SEQ ID NO: 2228421 - RNA, 13 nt, Streptococcus pyogenes MGAS8232
uuguuguauuaug

SEQ ID NO: 2228422 - RNA, 23 nt, Streptococcus pyogenes MGAS8232
uuguuguauuaugaggugaacac

SEQ ID NO: 2228423 - RNA, 17 nt, Streptococcus pyogenes MGAS8232
uuguuuaaccuccuaaa

SEQ ID NO: 2228424 - RNA, 20 nt, Streptococcus pyogenes MGAS8232
uuuaacaugauguaccaauu

SEQ ID NO: 2228425 - RNA, 23 nt, Streptococcus pyogenes MGAS8232
uuuaaaauaguucccuuaauaaa

SEQ ID NO: 2228426 - RNA, 18 nt, Streptococcus pyogenes MGAS8232
uuuaaaagggcaacaauu

SEQ ID NO: 2228427 - RNA, 21 nt, Streptococcus pyogenes MGAS8232
uuuaaaauccucuuuuaauuu

SEQ ID NO: 2228428 - RNA, 16 nt, Streptococcus pyogenes MGAS8232
uuuaauacguuuauuu

SEQ ID NO: 2228429 - RNA, 18 nt, Streptococcus pyogenes MGAS8232
uuuaacuauuuaacuuau

SEQ ID NO: 2228430 - RNA, 19 nt, Streptococcus pyogenes MGAS8232
uuguaauaacaaaaugaag

SEQ ID NO: 2228431 - RNA, 22 nt, Streptococcus pyogenes MGAS8232
uugugcuaaucuaucucguaau

SEQ ID NO: 2228432 - RNA, 23 nt, Streptococcus pyogenes MGAS8232
uugugauuaguuuuuagcagcag

SEQ ID NO: 2228433 - RNA, 17 nt, Streptococcus pyogenes MGAS8232
uugucuccuucuuugca

SEQ ID NO: 2228434 - RNA, 17 nt, Streptococcus pyogenes MGAS8232
uugucguuuuuugcuuu

SEQ ID NO: 2228435 - RNA, 13 nt, Streptococcus pyogenes MGAS8232
uuguuacaaaaaa

SEQ ID NO: 2228436 - RNA, 21 nt, Streptococcus pyogenes MGAS8232
uuguuagagcccauucuuaaa

SEQ ID NO: 2228437 - RNA, 13 nt, Streptococcus pyogenes MGAS8232
uugugcuauucaa

SEQ ID NO: 2228438 - RNA, 17 nt, Streptococcus pyogenes MGAS8232
uuguggcgggccuucua

SEQ ID NO: 2228439 - RNA, 18 nt, Streptococcus pyogenes MGAS8232
uucucaaaaauauauucu

SEQ ID NO: 2228440 - RNA, 14 nt, Streptococcus pyogenes MGAS8232
uucuauuaccuaua

SEQ ID NO: 2228441 - RNA, 17 nt, Streptococcus pyogenes MGAS8232
uucuaucaaaacguuau

SEQ ID NO: 2228442 - RNA, 17 nt, Streptococcus pyogenes MGAS8232
uucgucaagcaccuuga

SEQ ID NO: 2228443 - RNA, 19 nt, Streptococcus pyogenes MGAS8232
uucucuuuggagaaauuca

SEQ ID NO: 2228444 - RNA, 22 nt, Streptococcus pyogenes MGAS8232
uucuuaacgaucuauugacuug

SEQ ID NO: 2228445 - RNA, 14 nt, Streptococcus pyogenes MGAS8232
uucuuauccauuau

SEQ ID NO: 2228446 - RNA, 17 nt, Streptococcus pyogenes MGAS8232
uugauuacugauaaacu

SEQ ID NO: 2228447 - RNA, 12 nt, Streptococcus pyogenes MGAS8232
uugcaccaccaa

SEQ ID NO: 2228448 - RNA, 20 nt, Streptococcus pyogenes MGAS8232
uugauaucauaaguuaccaa

SEQ ID NO: 2228449 - RNA, 13 nt, Streptococcus pyogenes MGAS8232
uugauauaaaauu

SEQ ID NO: 2228450 - RNA, 13 nt, Streptococcus pyogenes MGAS8232
uugauacguuuau

SEQ ID NO: 2228451 - RNA, 16 nt, Streptococcus pyogenes MGAS8232
uugauacguuuauugu

SEQ ID NO: 2228452 - RNA, 19 nt, Streptococcus pyogenes MGAS8232
uugaaaagaugcacacaaa

SEQ ID NO: 2228453 - RNA, 20 nt, Streptococcus pyogenes MGAS8232
uucuuuucagagaugcuucu

SEQ ID NO: 2228454 - RNA, 15 nt, Streptococcus pyogenes MGAS8232
uugaccacaccuaau

SEQ ID NO: 2228455 - RNA, 24 nt, Streptococcus pyogenes MGAS8232
uugaccacaccuaauaaaauagca

SEQ ID NO: 2228456 - RNA, 18 nt, Streptococcus pyogenes MGAS8232
uugacagacaccaaaaaa

SEQ ID NO: 2228457 - RNA, 19 nt, Streptococcus pyogenes MGAS8232
uugaaucuuguuuaaccuc

SEQ ID NO: 2228458 - RNA, 21 nt, Streptococcus pyogenes MGAS8232
uugaauaucgccaauaaaaaa

SEQ ID NO: 2228459 - RNA, 17 nt, Streptococcus pyogenes MGAS8232
ugauuauuauucuaaau

SEQ ID NO: 2228460 - RNA, 17 nt, Streptococcus pyogenes MGAS8232
ugauuauucucuauuuu

SEQ ID NO: 2228461 - RNA, 15 nt, Streptococcus pyogenes MGAS8232
ugcaaaaaagcucuu

SEQ ID NO: 2228462 - RNA, 20 nt, Streptococcus pyogenes MGAS8232
ugauuuuaacguuuugaacu

SEQ ID NO: 2228463 - RNA, 14 nt, Streptococcus pyogenes MGAS8232
ugaugcguuuauaa

SEQ ID NO: 2228464 - RNA, 23 nt, Streptococcus pyogenes MGAS8232
ugaugauugaguaagcagcauca

SEQ ID NO: 2228465 - RNA, 23 nt, Streptococcus pyogenes MGAS8232
ugaugaaucauuuuggagagauu

SEQ ID NO: 2228466 - RNA, 23 nt, Streptococcus pyogenes MGAS8232
ugauauugaucucugcaacauca

SEQ ID NO: 2228467 - RNA, 20 nt, Streptococcus pyogenes MGAS8232
ugauauuucaucuugcauua

SEQ ID NO: 2228468 - RNA, 20 nt, Streptococcus pyogenes MGAS8232
ugcacacaaaucuucuagaa

SEQ ID NO: 2228469 - RNA, 21 nt, Streptococcus pyogenes MGAS8232
ugcaagcguccauauaguaag

SEQ ID NO: 2228470 - RNA, 18 nt, Streptococcus pyogenes MGAS8232
ugcaagugauaaccuuaa

SEQ ID NO: 2228471 - RNA, 17 nt, Streptococcus pyogenes MGAS8232
ugcaaguucuuugccuu

SEQ ID NO: 2228472 - RNA, 17 nt, Streptococcus pyogenes MGAS8232
ugcaggguaucugcuca

SEQ ID NO: 2228473 - RNA, 18 nt, Streptococcus pyogenes MGAS8232
ugcagagaugcuucuuuc

SEQ ID NO: 2228474 - RNA, 15 nt, Streptococcus pyogenes MGAS8232
ugaggucaaccucua

SEQ ID NO: 2228475 - RNA, 16 nt, Streptococcus pyogenes MGAS8232
ugaggugauucuuuuu

SEQ ID NO: 2228476 - RNA, 18 nt, Streptococcus pyogenes MGAS8232
ugagucuuuuucuaacaa

SEQ ID NO: 2228477 - RNA, 19 nt, Streptococcus pyogenes MGAS8232
ugaggcaaaugaaaaaacu

SEQ ID NO: 2228478 - RNA, 21 nt, Streptococcus pyogenes MGAS8232
ugagguauuuauaaauauuuu

SEQ ID NO: 2228479 - RNA, 16 nt, Streptococcus pyogenes MGAS8232
ugagauaccuucauag

SEQ ID NO: 2228480 - RNA, 17 nt, Streptococcus pyogenes MGAS8232
ugagauauucauuuucu

SEQ ID NO: 2228481 - RNA, 14 nt, Streptococcus pyogenes MGAS8232
ugagaucuucuuuu

SEQ ID NO: 2228482 - RNA, 14 nt, Streptococcus pyogenes MGAS8232
ugagcaaaacaaua

SEQ ID NO: 2228483 - RNA, 21 nt, Streptococcus pyogenes MGAS8232
ugagcaaaacaauaacacaga

SEQ ID NO: 2228484 - RNA, 16 nt, Streptococcus pyogenes MGAS8232
ugagccccaaaaguug

SEQ ID NO: 2228485 - RNA, 15 nt, Streptococcus pyogenes MGAS8232
ugacuugguuuaaua

SEQ ID NO: 2228486 - RNA, 19 nt, Streptococcus pyogenes MGAS8232
ugacuuguuacaaaaaaca

SEQ ID NO: 2228487 - RNA, 17 nt, Streptococcus pyogenes MGAS8232
ugaccauuuuuacugua

SEQ ID NO: 2228488 - RNA, 17 nt, Streptococcus pyogenes MGAS8232
ugacaguuaaaaauaac

SEQ ID NO: 2228489 - RNA, 20 nt, Streptococcus pyogenes MGAS8232
ugacagacaccaaaaaaagc

SEQ ID NO: 2228490 - RNA, 18 nt, Streptococcus pyogenes MGAS8232
ugacagacaccaaaaaaa

SEQ ID NO: 2228491 - RNA, 15 nt, Streptococcus pyogenes MGAS8232
ugaauugaaaaaaga

SEQ ID NO: 2228492 - RNA, 15 nt, Streptococcus pyogenes MGAS8232
ugacaaauucuuuuu

SEQ ID NO: 2228493 - RNA, 12 nt, Streptococcus pyogenes MGAS8232
ugacacauuucg

SEQ ID NO: 2228494 - RNA, 13 nt, Streptococcus pyogenes MGAS8232
ugccuuuuuaauc

SEQ ID NO: 2228495 - RNA, 15 nt, Streptococcus pyogenes MGAS8232
ugccuuuuuaaucuu

SEQ ID NO: 2228496 - RNA, 19 nt, Streptococcus pyogenes MGAS8232
ugcgaugauuuugaaccaa

SEQ ID NO: 2228497 - RNA, 14 nt, Streptococcus pyogenes MGAS8232
ugccuuucacagcc

SEQ ID NO: 2228498 - RNA, 23 nt, Streptococcus pyogenes MGAS8232
ugccucaccaccaucaaagguca

SEQ ID NO: 2228499 - RNA, 14 nt, Streptococcus pyogenes MGAS8232
ugccagccauacca

SEQ ID NO: 2228500 - RNA, 16 nt, Streptococcus pyogenes MGAS8232
ugcuaucauggaguca

SEQ ID NO: 2228501 - RNA, 16 nt, Streptococcus pyogenes MGAS8232
ugcgugguggaggucu

SEQ ID NO: 2228502 - RNA, 12 nt, Streptococcus pyogenes MGAS8232
uggaauguuuac

SEQ ID NO: 2228503 - RNA, 21 nt, Streptococcus pyogenes MGAS8232
uggacgaaggcucuuaucuuu

SEQ ID NO: 2228504 - RNA, 19 nt, Streptococcus pyogenes MGAS8232
uggacaaucuuaaguuagg

SEQ ID NO: 2228505 - RNA, 22 nt, Streptococcus pyogenes MGAS8232
uggaaacugcacugagccccaa

SEQ ID NO: 2228506 - RNA, 18 nt, Streptococcus pyogenes MGAS8232
uggaaauuuuaaaugaca

SEQ ID NO: 2228507 - RNA, 21 nt, Streptococcus pyogenes MGAS8232
ugcuuuugaugcagcuaaaag

SEQ ID NO: 2228508 - RNA, 15 nt, Streptococcus pyogenes MGAS8232
ugcuucuuacuauga

SEQ ID NO: 2228509 - RNA, 19 nt, Streptococcus pyogenes MGAS8232
ugcuugcucaauuuuugau

SEQ ID NO: 2228510 - RNA, 13 nt, Streptococcus pyogenes MGAS8232
ugcuucuagucag

SEQ ID NO: 2228511 - RNA, 23 nt, Streptococcus pyogenes MGAS8232
ugcuguuugucauacucaauagc

SEQ ID NO: 2228512 - RNA, 17 nt, Streptococcus pyogenes MGAS8232
ugcuguuugucauacuc

SEQ ID NO: 2228513 - RNA, 21 nt, Streptococcus pyogenes MGAS8232
uuaguaaagccuuauccauuc

SEQ ID NO: 2228514 - RNA, 12 nt, Streptococcus pyogenes MGAS8232
uuaguuuuauuu

SEQ ID NO: 2228515 - RNA, 17 nt, Streptococcus pyogenes MGAS8232
uuaguugcuucuuuuaa

SEQ ID NO: 2228516 - RNA, 22 nt, Streptococcus pyogenes MGAS8232
uuaguuaucucauaaaaaagaa

SEQ ID NO: 2228517 - RNA, 12 nt, Streptococcus pyogenes MGAS8232
uuaguuuuuaaa

SEQ ID NO: 2228518 - RNA, 15 nt, Streptococcus pyogenes MGAS8232
uuaguuuuauuuuga

SEQ ID NO: 2228519 - RNA, 15 nt, Streptococcus pyogenes MGAS8232
uuauaaauauuuuau

SEQ ID NO: 2228520 - RNA, 14 nt, Streptococcus pyogenes MGAS8232
uuagucauuucuuc

SEQ ID NO: 2228521 - RNA, 18 nt, Streptococcus pyogenes MGAS8232
uuagugguauagacaaac

SEQ ID NO: 2228522 - RNA, 16 nt, Streptococcus pyogenes MGAS8232
uuaguguagauaaacu

SEQ ID NO: 2228523 - RNA, 22 nt, Streptococcus pyogenes MGAS8232
uuauaguuugacuucaaaaaua

SEQ ID NO: 2228524 - RNA, 17 nt, Streptococcus pyogenes MGAS8232
uuauaguauaccuauau

SEQ ID NO: 2228525 - RNA, 15 nt, Streptococcus pyogenes MGAS8232
uuaucaaaccaaggu

SEQ ID NO: 2228526 - RNA, 13 nt, Streptococcus pyogenes MGAS8232
uuauauuaaauua

SEQ ID NO: 2228527 - RNA, 15 nt, Streptococcus pyogenes MGAS8232
uuagcagacaaaagg

SEQ ID NO: 2228528 - RNA, 15 nt, Streptococcus pyogenes MGAS8232
uuagcaauuguuuuu

SEQ ID NO: 2228529 - RNA, 19 nt, Streptococcus pyogenes MGAS8232
uuagcgccagcauuugcca

SEQ ID NO: 2228530 - RNA, 22 nt, Streptococcus pyogenes MGAS8232
uuaagggcaaugccaucugcuu

SEQ ID NO: 2228531 - RNA, 19 nt, Streptococcus pyogenes MGAS8232
uuaagacuauguugcuuaa

SEQ ID NO: 2228532 - RNA, 14 nt, Streptococcus pyogenes MGAS8232
uuaacucucauaaa

SEQ ID NO: 2228533 - RNA, 16 nt, Streptococcus pyogenes MGAS8232
uuaacucucauaaaau

SEQ ID NO: 2228534 - RNA, 17 nt, Streptococcus pyogenes MGAS8232
uuaauauagucugcaug

SEQ ID NO: 2228535 - RNA, 20 nt, Streptococcus pyogenes MGAS8232
uuaauagcauugucaaauaa

SEQ ID NO: 2228536 - RNA, 23 nt, Streptococcus pyogenes MGAS8232
uuaauagcauugucaaauaaaau

SEQ ID NO: 2228537 - RNA, 22 nt, Streptococcus pyogenes MGAS8232
uuaauaggcuuuuuuuguaucu

SEQ ID NO: 2228538 - RNA, 18 nt, Streptococcus pyogenes MGAS8232
uuaauagagaacagauaa

SEQ ID NO: 2228539 - RNA, 14 nt, Streptococcus pyogenes MGAS8232
uuaauaauauuaac

SEQ ID NO: 2228540 - RNA, 15 nt, Streptococcus pyogenes MGAS8232
uuaaucaaaaaacug

SEQ ID NO: 2228541 - RNA, 19 nt, Streptococcus pyogenes MGAS8232
uuaauauagucugcaugaa

SEQ ID NO: 2228542 - RNA, 14 nt, Streptococcus pyogenes MGAS8232
uuaccagcaccuuc

SEQ ID NO: 2228543 - RNA, 21 nt, Streptococcus pyogenes MGAS8232
uuacagucaagagcacacaua

SEQ ID NO: 2228544 - RNA, 14 nt, Streptococcus pyogenes MGAS8232
uuaauuuuucuucu

SEQ ID NO: 2228545 - RNA, 12 nt, Streptococcus pyogenes MGAS8232
uuaauuuuauuu

SEQ ID NO: 2228546 - RNA, 22 nt, Streptococcus pyogenes MGAS8232
ugugacuaguuuauuacaaaac

SEQ ID NO: 2228547 - RNA, 16 nt, Streptococcus pyogenes MGAS8232
uguuguauuaugaggu

SEQ ID NO: 2228548 - RNA, 15 nt, Streptococcus pyogenes MGAS8232
uguucucauaaacaa

SEQ ID NO: 2228549 - RNA, 15 nt, Streptococcus pyogenes MGAS8232
uguuccaucugcaca

SEQ ID NO: 2228550 - RNA, 13 nt, Streptococcus pyogenes MGAS8232
uuaaaaauaacuu

SEQ ID NO: 2228551 - RNA, 22 nt, Streptococcus pyogenes MGAS8232
uguuuuggccaauaaaauaucu

SEQ ID NO: 2228552 - RNA, 14 nt, Streptococcus pyogenes MGAS8232
uguuuuguuuaaua

SEQ ID NO: 2228553 - RNA, 13 nt, Streptococcus pyogenes MGAS8232
uguuuuucuuaua

SEQ ID NO: 2228554 - RNA, 20 nt, Streptococcus pyogenes MGAS8232
uguuuuuucaacaaauccuu

SEQ ID NO: 2228555 - RNA, 23 nt, Streptococcus pyogenes MGAS8232
uuaaaagaaaaucuaaucagaac

SEQ ID NO: 2228556 - RNA, 15 nt, Streptococcus pyogenes MGAS8232
uuaaaagaugucgca

SEQ ID NO: 2228557 - RNA, 15 nt, Streptococcus pyogenes MGAS8232
uuaaaauagaagaca

SEQ ID NO: 2228558 - RNA, 14 nt, Streptococcus pyogenes MGAS8232
uguuuaaaaaacuu

SEQ ID NO: 2228559 - RNA, 13 nt, Streptococcus pyogenes MGAS8232
uguuuauuccaaa

SEQ ID NO: 2228560 - RNA, 20 nt, Streptococcus pyogenes MGAS8232
uguuuuaguaaagccuuauc

SEQ ID NO: 2228561 - RNA, 11 nt, Streptococcus pyogenes MGAS8232
uguuuuauuac

SEQ ID NO: 2228562 - RNA, 14 nt, Streptococcus pyogenes MGAS8232
uggcaaccuuaccu

SEQ ID NO: 2228563 - RNA, 15 nt, Streptococcus pyogenes MGAS8232
uggcaaccuuaccua

SEQ ID NO: 2228564 - RNA, 16 nt, Streptococcus pyogenes MGAS8232
uggauaccauuucuuu

SEQ ID NO: 2228565 - RNA, 20 nt, Streptococcus pyogenes MGAS8232
uggauauaacaacucccucc

SEQ ID NO: 2228566 - RNA, 21 nt, Streptococcus pyogenes MGAS8232
uggagagauuucguugacaaa

SEQ ID NO: 2228567 - RNA, 18 nt, Streptococcus pyogenes MGAS8232
uggagcuuuaguugcuuc

SEQ ID NO: 2228568 - RNA, 23 nt, Streptococcus pyogenes MGAS8232
uggagcuuuaguugcuucuuuua

SEQ ID NO: 2228569 - RNA, 22 nt, Streptococcus pyogenes MGAS8232
uggagcuuuaguugcuucuuuu

SEQ ID NO: 2228570 - RNA, 16 nt, Streptococcus pyogenes MGAS8232
uggaggucugugauga

SEQ ID NO: 2228571 - RNA, 21 nt, Streptococcus pyogenes MGAS8232
uggccaauaaaauaucuagaa

SEQ ID NO: 2228572 - RNA, 16 nt, Streptococcus pyogenes MGAS8232
uggccuucuuggaaaa

SEQ ID NO: 2228573 - RNA, 13 nt, Streptococcus pyogenes MGAS8232
uguaauugucucu

SEQ ID NO: 2228574 - RNA, 23 nt, Streptococcus pyogenes MGAS8232
uguaauaacaaaaugaagcaaaa

SEQ ID NO: 2228575 - RNA, 19 nt, Streptococcus pyogenes MGAS8232
uguaauacgagcuagggca

SEQ ID NO: 2228576 - RNA, 13 nt, Streptococcus pyogenes MGAS8232
uguacaagagcuu

SEQ ID NO: 2228577 - RNA, 19 nt, Streptococcus pyogenes MGAS8232
uguaaaucaguagugauga

SEQ ID NO: 2228578 - RNA, 14 nt, Streptococcus pyogenes MGAS8232
uguaaaauuuaucu

SEQ ID NO: 2228579 - RNA, 13 nt, Streptococcus pyogenes MGAS8232
uguauacaaaaag

SEQ ID NO: 2228580 - RNA, 21 nt, Streptococcus pyogenes MGAS8232
uguaucaagagucauuugacu

SEQ ID NO: 2228581 - RNA, 21 nt, Streptococcus pyogenes MGAS8232
uguauauuuaauagcauuguc

SEQ ID NO: 2228582 - RNA, 16 nt, Streptococcus pyogenes MGAS8232
uguauuacucaauuaa

SEQ ID NO: 2228583 - RNA, 20 nt, Streptococcus pyogenes MGAS8232
uguaucucauaacaaauuua

SEQ ID NO: 2228584 - RNA, 20 nt, Streptococcus pyogenes MGAS8232
ugucaaacauaacaauccua

SEQ ID NO: 2228585 - RNA, 13 nt, Streptococcus pyogenes MGAS8232
uguauuuuucaaa

SEQ ID NO: 2228586 - RNA, 15 nt, Streptococcus pyogenes MGAS8232
uguauuucuuuggua

SEQ ID NO: 2228587 - RNA, 15 nt, Streptococcus pyogenes MGAS8232
uggguguuuaaucuu

SEQ ID NO: 2228588 - RNA, 16 nt, Streptococcus pyogenes MGAS8232
uggguguuuaaucuuu

SEQ ID NO: 2228589 - RNA, 13 nt, Streptococcus pyogenes MGAS8232
ugguaaaaaggca

SEQ ID NO: 2228590 - RNA, 19 nt, Streptococcus pyogenes MGAS8232
uggugacaauagcgaaaaa

SEQ ID NO: 2228591 - RNA, 18 nt, Streptococcus pyogenes MGAS8232
ucugugaugaaucauuuu

SEQ ID NO: 2228592 - RNA, 21 nt, Streptococcus pyogenes MGAS8232
ucuuaaaagaaaaucuaauca

SEQ ID NO: 2228593 - RNA, 20 nt, Streptococcus pyogenes MGAS8232
ucugcuucuuacuaugaaaa

SEQ ID NO: 2228594 - RNA, 15 nt, Streptococcus pyogenes MGAS8232
ucugagcgguuuugu

SEQ ID NO: 2228595 - RNA, 22 nt, Streptococcus pyogenes MGAS8232
ucuucugaugcguuuauaaagu

SEQ ID NO: 2228596 - RNA, 12 nt, Streptococcus pyogenes MGAS8232
ucuucuucuuuu

SEQ ID NO: 2228597 - RNA, 23 nt, Streptococcus pyogenes MGAS8232
ucuucuuuuuauuauacucaaua

SEQ ID NO: 2228598 - RNA, 19 nt, Streptococcus pyogenes MGAS8232
ucuucuuuuuauuauacuc

SEQ ID NO: 2228599 - RNA, 13 nt, Streptococcus pyogenes MGAS8232
ucuugcauuaccu

SEQ ID NO: 2228600 - RNA, 14 nt, Streptococcus pyogenes MGAS8232
ucuucagguuucuu

SEQ ID NO: 2228601 - RNA, 19 nt, Streptococcus pyogenes MGAS8232
ucgucugcaaguucuuugc

SEQ ID NO: 2228602 - RNA, 11 nt, Streptococcus pyogenes MGAS8232
ucuaaaauaua

SEQ ID NO: 2228603 - RNA, 14 nt, Streptococcus pyogenes MGAS8232
ucuaaaauauauug

SEQ ID NO: 2228604 - RNA, 14 nt, Streptococcus pyogenes MGAS8232
ucuaaacuuauguu

SEQ ID NO: 2228605 - RNA, 15 nt, Streptococcus pyogenes MGAS8232
ucuacagcaccuuca

SEQ ID NO: 2228606 - RNA, 21 nt, Streptococcus pyogenes MGAS8232
ucuacuaaaacgugagaaaau

SEQ ID NO: 2228607 - RNA, 12 nt, Streptococcus pyogenes MGAS8232
ucuaaucagaac

SEQ ID NO: 2228608 - RNA, 14 nt, Streptococcus pyogenes MGAS8232
ucuaaucagagcuc

SEQ ID NO: 2228609 - RNA, 17 nt, Streptococcus pyogenes MGAS8232
ucuaaucgaacaauaau

SEQ ID NO: 2228610 - RNA, 15 nt, Streptococcus pyogenes MGAS8232
ucuacacaaaagcuu

SEQ ID NO: 2228611 - RNA, 23 nt, Streptococcus pyogenes MGAS8232
ucuaggagggacugucaaaaaau

SEQ ID NO: 2228612 - RNA, 14 nt, Streptococcus pyogenes MGAS8232
ucuagcuugugagg

SEQ ID NO: 2228613 - RNA, 17 nt, Streptococcus pyogenes MGAS8232
ucuagcucuuuaucacc

SEQ ID NO: 2228614 - RNA, 16 nt, Streptococcus pyogenes MGAS8232
ucuagucuuuuuaugu

SEQ ID NO: 2228615 - RNA, 20 nt, Streptococcus pyogenes MGAS8232
ucuagacucuagcauaaaag

SEQ ID NO: 2228616 - RNA, 16 nt, Streptococcus pyogenes MGAS8232
ucuagaacagcugcuu

SEQ ID NO: 2228617 - RNA, 12 nt, Streptococcus pyogenes MGAS8232
ucuaucaaaacg

SEQ ID NO: 2228618 - RNA, 13 nt, Streptococcus pyogenes MGAS8232
ucuaucaaaacgu

SEQ ID NO: 2228619 - RNA, 11 nt, Streptococcus pyogenes MGAS8232
ucuauuaccua

SEQ ID NO: 2228620 - RNA, 21 nt, Streptococcus pyogenes MGAS8232
ucucagagacaauaaggucau

SEQ ID NO: 2228621 - RNA, 12 nt, Streptococcus pyogenes MGAS8232
ucucaaaaauau

SEQ ID NO: 2228622 - RNA, 14 nt, Streptococcus pyogenes MGAS8232
ucucaaauuuuuuu

SEQ ID NO: 2228623 - RNA, 13 nt, Streptococcus pyogenes MGAS8232
ucuauuuuaagua

SEQ ID NO: 2228624 - RNA, 21 nt, Streptococcus pyogenes MGAS8232
ucuccaaaguucuucuaaacg

SEQ ID NO: 2228625 - RNA, 16 nt, Streptococcus pyogenes MGAS8232
uccuaaacuaauaaga

SEQ ID NO: 2228626 - RNA, 13 nt, Streptococcus pyogenes MGAS8232
uccuccucuuuuu

SEQ ID NO: 2228627 - RNA, 22 nt, Streptococcus pyogenes MGAS8232
uccuaggacgaaacauuuaauc

SEQ ID NO: 2228628 - RNA, 17 nt, Streptococcus pyogenes MGAS8232
uccucuaacauguccaa

SEQ ID NO: 2228629 - RNA, 23 nt, Streptococcus pyogenes MGAS8232
uccucuuuuaauuuggaggugaa

SEQ ID NO: 2228630 - RNA, 14 nt, Streptococcus pyogenes MGAS8232
uccucugaaaaguu

SEQ ID NO: 2228631 - RNA, 23 nt, Streptococcus pyogenes MGAS8232
uccucuuauagcacguuggaaaa

SEQ ID NO: 2228632 - RNA, 14 nt, Streptococcus pyogenes MGAS8232
ucgauuauuaacca

SEQ ID NO: 2228633 - RNA, 20 nt, Streptococcus pyogenes MGAS8232
ucgaugauagcuuuuaauug

SEQ ID NO: 2228634 - RNA, 17 nt, Streptococcus pyogenes MGAS8232
ucgcagaguacaaggca

SEQ ID NO: 2228635 - RNA, 23 nt, Streptococcus pyogenes MGAS8232
ucgacauuuaugcugauuuugga

SEQ ID NO: 2228636 - RNA, 17 nt, Streptococcus pyogenes MGAS8232
ucgaccaauucuaaaac

SEQ ID NO: 2228637 - RNA, 21 nt, Streptococcus pyogenes MGAS8232
ucgacauuuaugcugauuuug

SEQ ID NO: 2228638 - RNA, 20 nt, Streptococcus pyogenes MGAS8232
ucgacucccuuuaauucuuu

SEQ ID NO: 2228639 - RNA, 20 nt, Streptococcus pyogenes MGAS8232
ucgcguuuaggcucauauua

SEQ ID NO: 2228640 - RNA, 21 nt, Streptococcus pyogenes MGAS8232
ucgcguuucgaaaaaggggag

SEQ ID NO: 2228641 - RNA, 17 nt, Streptococcus pyogenes MGAS8232
ucgccuaggaauaaaau

SEQ ID NO: 2228642 - RNA, 16 nt, Streptococcus pyogenes MGAS8232
ucccuucauuuuacua

SEQ ID NO: 2228643 - RNA, 16 nt, Streptococcus pyogenes MGAS8232
ucccuacuaggcuuuc

SEQ ID NO: 2228644 - RNA, 23 nt, Streptococcus pyogenes MGAS8232
uccauuauaaaucuuacuaacua

SEQ ID NO: 2228645 - RNA, 18 nt, Streptococcus pyogenes MGAS8232
uccauuauaaaucuuacu

SEQ ID NO: 2228646 - RNA, 15 nt, Streptococcus pyogenes MGAS8232
uccauuauaaaucuu

SEQ ID NO: 2228647 - RNA, 13 nt, Streptococcus pyogenes MGAS8232
uccauuauaaauc

SEQ ID NO: 2228648 - RNA, 12 nt, Streptococcus pyogenes MGAS8232
uccaugauuuuc

SEQ ID NO: 2228649 - RNA, 23 nt, Streptococcus pyogenes MGAS8232
uccaucuaaucgaacaauaauau

SEQ ID NO: 2228650 - RNA, 15 nt, Streptococcus pyogenes MGAS8232
uccauuuuuuauaau

SEQ ID NO: 2228651 - RNA, 22 nt, Streptococcus pyogenes MGAS8232
ucccaucuuuguuuuuuuuagu

SEQ ID NO: 2228652 - RNA, 13 nt, Streptococcus pyogenes MGAS8232
uccaaugacuaag

SEQ ID NO: 2228653 - RNA, 16 nt, Streptococcus pyogenes MGAS8232
uccaacuuuuaucacu

SEQ ID NO: 2228654 - RNA, 17 nt, Streptococcus pyogenes MGAS8232
uccacuugguccaucag

SEQ ID NO: 2228655 - RNA, 16 nt, Streptococcus pyogenes MGAS8232
uccauacuuccaucua

SEQ ID NO: 2228656 - RNA, 14 nt, Streptococcus pyogenes MGAS8232
ucauuuugguugau

SEQ ID NO: 2228657 - RNA, 22 nt, Streptococcus pyogenes MGAS8232
ucauuuuggagagauuuuuaaa

SEQ ID NO: 2228658 - RNA, 23 nt, Streptococcus pyogenes MGAS8232
ucauuuuggagagauuuuuaaaa

SEQ ID NO: 2228659 - RNA, 17 nt, Streptococcus pyogenes MGAS8232
uccaaaguucuucuaaa

SEQ ID NO: 2228660 - RNA, 18 nt, Streptococcus pyogenes MGAS8232
uccaacaacgcuauuuuu

SEQ ID NO: 2228661 - RNA, 22 nt, Streptococcus pyogenes MGAS8232
uccaaaccauuuuaugagaaaa

SEQ ID NO: 2228662 - RNA, 21 nt, Streptococcus pyogenes MGAS8232
ucauggagucaaugaaaaguu

SEQ ID NO: 2228663 - RNA, 19 nt, Streptococcus pyogenes MGAS8232
ucaugugcuaucauggagu

SEQ ID NO: 2228664 - RNA, 19 nt, Streptococcus pyogenes MGAS8232
ucauuacuccuuugaccac

SEQ ID NO: 2228665 - RNA, 21 nt, Streptococcus pyogenes MGAS8232
ucaugauguuauuaaauaaua

SEQ ID NO: 2228666 - RNA, 13 nt, Streptococcus pyogenes MGAS8232
ucaugauguuuau

SEQ ID NO: 2228667 - RNA, 19 nt, Streptococcus pyogenes MGAS8232
ucaugauguuuauuccaaa

SEQ ID NO: 2228668 - RNA, 13 nt, Streptococcus pyogenes MGAS8232
ucaucuacucuau

SEQ ID NO: 2228669 - RNA, 16 nt, Streptococcus pyogenes MGAS8232
ucaucuacucuauuuu

SEQ ID NO: 2228670 - RNA, 16 nt, Streptococcus pyogenes MGAS8232
ucaucagaauaagaaa

SEQ ID NO: 2228671 - RNA, 17 nt, Streptococcus pyogenes MGAS8232
ucauacacaaaaaaccg

SEQ ID NO: 2228672 - RNA, 17 nt, Streptococcus pyogenes MGAS8232
ucaucaagaauagcuuu

SEQ ID NO: 2228673 - RNA, 21 nt, Streptococcus pyogenes MGAS8232
ucaucaagaauagcuuuugua

SEQ ID NO: 2228674 - RNA, 15 nt, Streptococcus pyogenes MGAS8232
ucaguuuuuuugauu

SEQ ID NO: 2228675 - RNA, 18 nt, Streptococcus pyogenes MGAS8232
ucaguuuuuuugauuuuc

SEQ ID NO: 2228676 - RNA, 13 nt, Streptococcus pyogenes MGAS8232
ucauaaaaaagaa

SEQ ID NO: 2228677 - RNA, 17 nt, Streptococcus pyogenes MGAS8232
ucauaacaaauuuaucc

SEQ ID NO: 2228678 - RNA, 15 nt, Streptococcus pyogenes MGAS8232
ucauaaauaaagaua

SEQ ID NO: 2228679 - RNA, 23 nt, Streptococcus pyogenes MGAS8232
ucaguaaucuaaagcaucagcau

SEQ ID NO: 2228680 - RNA, 23 nt, Streptococcus pyogenes MGAS8232
ucaguccuccucuuuagaauucu

SEQ ID NO: 2228681 - RNA, 16 nt, Streptococcus pyogenes MGAS8232
ggcaauccaaaucaac

SEQ ID NO: 2228682 - RNA, 17 nt, Streptococcus pyogenes MGAS8232
ggaugauucaaaugaag

SEQ ID NO: 2228683 - RNA, 19 nt, Streptococcus pyogenes MGAS8232
ggauuuagcuguuauugga

SEQ ID NO: 2228684 - RNA, 16 nt, Streptococcus pyogenes MGAS8232
ggcaaaacaaaaagag

SEQ ID NO: 2228685 - RNA, 11 nt, Streptococcus pyogenes MGAS8232
ggcaaccuuac

SEQ ID NO: 2228686 - RNA, 22 nt, Streptococcus pyogenes MGAS8232
ggacacuuugaaaguuccuuag

SEQ ID NO: 2228687 - RNA, 22 nt, Streptococcus pyogenes MGAS8232
ggaaucgaucgucucgguucac

SEQ ID NO: 2228688 - RNA, 17 nt, Streptococcus pyogenes MGAS8232
ggacuuuucagucuucu

SEQ ID NO: 2228689 - RNA, 21 nt, Streptococcus pyogenes MGAS8232
ggccguaggugucuacuaaaa

SEQ ID NO: 2228690 - RNA, 16 nt, Streptococcus pyogenes MGAS8232
ggccaauaaaauaucu

SEQ ID NO: 2228691 - RNA, 22 nt, Streptococcus pyogenes MGAS8232
ggccacuucaagcauaauaaaa

SEQ ID NO: 2228692 - RNA, 17 nt, Streptococcus pyogenes MGAS8232
ggccuucuaucaaaacg

SEQ ID NO: 2228693 - RNA, 22 nt, Streptococcus pyogenes MGAS8232
gucaugaugccauuuaaaaggg

SEQ ID NO: 2228694 - RNA, 21 nt, Streptococcus pyogenes MGAS8232
gucaugugcuaucauggaguc

SEQ ID NO: 2228695 - RNA, 19 nt, Streptococcus pyogenes MGAS8232
gucacugaaaaagccuuua

SEQ ID NO: 2228696 - RNA, 20 nt, Streptococcus pyogenes MGAS8232
gucaauuuuaucagacugac

SEQ ID NO: 2228697 - RNA, 13 nt, Streptococcus pyogenes MGAS8232
gucaacuccaauc

SEQ ID NO: 2228698 - RNA, 21 nt, Streptococcus pyogenes MGAS8232
gucaaccucuaggccauaaug

SEQ ID NO: 2228699 - RNA, 20 nt, Streptococcus pyogenes MGAS8232
guauuuuucaaaaucuuuuc

SEQ ID NO: 2228700 - RNA, 19 nt, Streptococcus pyogenes MGAS8232
gucaaaaaauuaagaagga

SEQ ID NO: 2228701 - RNA, 17 nt, Streptococcus pyogenes MGAS8232
gucaaaagcuaaacuag

SEQ ID NO: 2228702 - RNA, 22 nt, Streptococcus pyogenes MGAS8232
guauaccuauauuauacuaaua

SEQ ID NO: 2228703 - RNA, 14 nt, Streptococcus pyogenes MGAS8232
guauacaaaaaggc

SEQ ID NO: 2228704 - RNA, 20 nt, Streptococcus pyogenes MGAS8232
guauauagcucaucccuacu

SEQ ID NO: 2228705 - RNA, 18 nt, Streptococcus pyogenes MGAS8232
guccuagucuuuuggcug

SEQ ID NO: 2228706 - RNA, 17 nt, Streptococcus pyogenes MGAS8232
gucgcagaguacaaggc

SEQ ID NO: 2228707 - RNA, 16 nt, Streptococcus pyogenes MGAS8232
guagaggugaugaagc

SEQ ID NO: 2228708 - RNA, 20 nt, Streptococcus pyogenes MGAS8232
guagauagcaaggaugaaau

SEQ ID NO: 2228709 - RNA, 21 nt, Streptococcus pyogenes MGAS8232
guagaugaauuuugucuaaaa

SEQ ID NO: 2228710 - RNA, 18 nt, Streptococcus pyogenes MGAS8232
guauaacuguuuuucuua

SEQ ID NO: 2228711 - RNA, 16 nt, Streptococcus pyogenes MGAS8232
guaguuacgcauaccu

SEQ ID NO: 2228712 - RNA, 20 nt, Streptococcus pyogenes MGAS8232
guaguaggcugaucucccau

SEQ ID NO: 2228713 - RNA, 16 nt, Streptococcus pyogenes MGAS8232
guaaagcaagggaaac

SEQ ID NO: 2228714 - RNA, 20 nt, Streptococcus pyogenes MGAS8232
guaaagauuuuaaauaucuu

SEQ ID NO: 2228715 - RNA, 21 nt, Streptococcus pyogenes MGAS8232
guaaaggauuuaguucuguau

SEQ ID NO: 2228716 - RNA, 17 nt, Streptococcus pyogenes MGAS8232
guaacgcuuguuuauga

SEQ ID NO: 2228717 - RNA, 23 nt, Streptococcus pyogenes MGAS8232
guaacauguccauugaugaguuu

SEQ ID NO: 2228718 - RNA, 20 nt, Streptococcus pyogenes MGAS8232
guaaccauagaagccaauua

SEQ ID NO: 2228719 - RNA, 18 nt, Streptococcus pyogenes MGAS8232
guaauauuuccuuuuaaa

SEQ ID NO: 2228720 - RNA, 17 nt, Streptococcus pyogenes MGAS8232
guaauagcguaaagcaa

SEQ ID NO: 2228721 - RNA, 18 nt, Streptococcus pyogenes MGAS8232
guaauagcguaaagcaag

SEQ ID NO: 2228722 - RNA, 20 nt, Streptococcus pyogenes MGAS8232
guaagcaaccucaguucuga

SEQ ID NO: 2228723 - RNA, 20 nt, Streptococcus pyogenes MGAS8232
guaaggaaaucaauccugua

SEQ ID NO: 2228724 - RNA, 12 nt, Streptococcus pyogenes MGAS8232
gguaaaggccuu

SEQ ID NO: 2228725 - RNA, 20 nt, Streptococcus pyogenes MGAS8232
gguaaaaacucaaaaaauac

SEQ ID NO: 2228726 - RNA, 14 nt, Streptococcus pyogenes MGAS8232
gggugaaucauuac

SEQ ID NO: 2228727 - RNA, 21 nt, Streptococcus pyogenes MGAS8232
gguaauuuauuccauuuaucu

SEQ ID NO: 2228728 - RNA, 12 nt, Streptococcus pyogenes MGAS8232
ggcuuuuuugcu

SEQ ID NO: 2228729 - RNA, 20 nt, Streptococcus pyogenes MGAS8232
ggcugaugcgauucccaucu

SEQ ID NO: 2228730 - RNA, 16 nt, Streptococcus pyogenes MGAS8232
gggauagacaaaaggg

SEQ ID NO: 2228731 - RNA, 15 nt, Streptococcus pyogenes MGAS8232
uaauuaguauauugu

SEQ ID NO: 2228732 - RNA, 19 nt, Streptococcus pyogenes MGAS8232
uaauuccugugacaaccca

SEQ ID NO: 2228733 - RNA, 12 nt, Streptococcus pyogenes MGAS8232
uaauucuucuuu

SEQ ID NO: 2228734 - RNA, 11 nt, Streptococcus pyogenes MGAS8232
uaaucuuuguu

SEQ ID NO: 2228735 - RNA, 18 nt, Streptococcus pyogenes MGAS8232
uaaucuuuauaaagcuuu

SEQ ID NO: 2228736 - RNA, 23 nt, Streptococcus pyogenes MGAS8232
uaaucuucagagcacguuuucug

SEQ ID NO: 2228737 - RNA, 18 nt, Streptococcus pyogenes MGAS8232
uaauguaaaaaccgcuca

SEQ ID NO: 2228738 - RNA, 23 nt, Streptococcus pyogenes MGAS8232
uaauguuaggagcacaaaagagg

SEQ ID NO: 2228739 - RNA, 15 nt, Streptococcus pyogenes MGAS8232
uaaucguaaugucuu

SEQ ID NO: 2228740 - RNA, 15 nt, Streptococcus pyogenes MGAS8232
uaaucuuauuaaaga

SEQ ID NO: 2228741 - RNA, 15 nt, Streptococcus pyogenes MGAS8232
uaaucuaaagcauca

SEQ ID NO: 2228742 - RNA, 13 nt, Streptococcus pyogenes MGAS8232
uaaucaaaaaacu

SEQ ID NO: 2228743 - RNA, 20 nt, Streptococcus pyogenes MGAS8232
uaaucaaaaaacugagacaa

SEQ ID NO: 2228744 - RNA, 13 nt, Streptococcus pyogenes MGAS8232
uaauagaauaaaa

SEQ ID NO: 2228745 - RNA, 15 nt, Streptococcus pyogenes MGAS8232
uaagucauuuuaagu

SEQ ID NO: 2228746 - RNA, 18 nt, Streptococcus pyogenes MGAS8232
uaaguccuuuucguuuua

SEQ ID NO: 2228747 - RNA, 16 nt, Streptococcus pyogenes MGAS8232
uaagucacaccguuga

SEQ ID NO: 2228748 - RNA, 21 nt, Streptococcus pyogenes MGAS8232
uaauaaaaaguaguuucucau

SEQ ID NO: 2228749 - RNA, 18 nt, Streptococcus pyogenes MGAS8232
uaaguaaaggauuuaguu

SEQ ID NO: 2228750 - RNA, 14 nt, Streptococcus pyogenes MGAS8232
uaaguaauguguug

SEQ ID NO: 2228751 - RNA, 18 nt, Streptococcus pyogenes MGAS8232
uaaguaauguguuguaua

SEQ ID NO: 2228752 - RNA, 14 nt, Streptococcus pyogenes MGAS8232
uaaguaagauggug

SEQ ID NO: 2228753 - RNA, 15 nt, Streptococcus pyogenes MGAS8232
uaaggaccaagauuc

SEQ ID NO: 2228754 - RNA, 15 nt, Streptococcus pyogenes MGAS8232
uaaggauuaugaaaa

SEQ ID NO: 2228755 - RNA, 15 nt, Streptococcus pyogenes MGAS8232
uaauaacaaaaugaa

SEQ ID NO: 2228756 - RNA, 15 nt, Streptococcus pyogenes MGAS8232
uaauaaacuguauac

SEQ ID NO: 2228757 - RNA, 20 nt, Streptococcus pyogenes MGAS8232
uaauaagauucaauaugaaa

SEQ ID NO: 2228758 - RNA, 22 nt, Streptococcus pyogenes MGAS8232
uaauaagauucaauaugaaaac

SEQ ID NO: 2228759 - RNA, 12 nt, Streptococcus pyogenes MGAS8232
uaauaagauuca

SEQ ID NO: 2228760 - RNA, 21 nt, Streptococcus pyogenes MGAS8232
uaauaaguauuuuaaaauccu

SEQ ID NO: 2228761 - RNA, 19 nt, Streptococcus pyogenes MGAS8232
uaauaaguauuuuaaaauc

SEQ ID NO: 2228762 - RNA, 19 nt, Streptococcus pyogenes MGAS8232
uaauacguuuauuuaguua

SEQ ID NO: 2228763 - RNA, 13 nt, Streptococcus pyogenes MGAS8232
uacgacagcagca

SEQ ID NO: 2228764 - RNA, 16 nt, Streptococcus pyogenes MGAS8232
uacgguaaaaacucaa

SEQ ID NO: 2228765 - RNA, 17 nt, Streptococcus pyogenes MGAS8232
uaccuaaaaaauaacuu

SEQ ID NO: 2228766 - RNA, 20 nt, Streptococcus pyogenes MGAS8232
uaccuccuaaauugguuuuu

SEQ ID NO: 2228767 - RNA, 18 nt, Streptococcus pyogenes MGAS8232
uaccccaaaggcugaugc

SEQ ID NO: 2228768 - RNA, 20 nt, Streptococcus pyogenes MGAS8232
uacauggguguuuaaucuuu

SEQ ID NO: 2228769 - RNA, 14 nt, Streptococcus pyogenes MGAS8232
uacaugaccaaaaa

SEQ ID NO: 2228770 - RNA, 16 nt, Streptococcus pyogenes MGAS8232
uacaugaccaaaaaau

SEQ ID NO: 2228771 - RNA, 21 nt, Streptococcus pyogenes MGAS8232
uacauuuggagagauaaaaag

SEQ ID NO: 2228772 - RNA, 23 nt, Streptococcus pyogenes MGAS8232
uacauuuggagagauaaaaagua

SEQ ID NO: 2228773 - RNA, 22 nt, Streptococcus pyogenes MGAS8232
uaauuguugcaaccugaaaagu

SEQ ID NO: 2228774 - RNA, 22 nt, Streptococcus pyogenes MGAS8232
uacaauacgauaguguguguga

SEQ ID NO: 2228775 - RNA, 16 nt, Streptococcus pyogenes MGAS8232
uacagaaaugaaaaga

SEQ ID NO: 2228776 - RNA, 21 nt, Streptococcus pyogenes MGAS8232
uacagaagaaagcuugucuau

SEQ ID NO: 2228777 - RNA, 14 nt, Streptococcus pyogenes MGAS8232
uagaauaaaaagac

SEQ ID NO: 2228778 - RNA, 23 nt, Streptococcus pyogenes MGAS8232
uagaauagguaaagauuuuaaau

SEQ ID NO: 2228779 - RNA, 18 nt, Streptococcus pyogenes MGAS8232
uacuauggcuucuaaaaa

SEQ ID NO: 2228780 - RNA, 21 nt, Streptococcus pyogenes MGAS8232
uacuaugaucuccaaagacau

SEQ ID NO: 2228781 - RNA, 13 nt, Streptococcus pyogenes MGAS8232
uacuaugaaaaaa

SEQ ID NO: 2228782 - RNA, 18 nt, Streptococcus pyogenes MGAS8232
uagaaacuuuuuauaagc

SEQ ID NO: 2228783 - RNA, 18 nt, Streptococcus pyogenes MGAS8232
uacuagcacaaaaucauu

SEQ ID NO: 2228784 - RNA, 21 nt, Streptococcus pyogenes MGAS8232
uagaaauuguaaccacagcaa

SEQ ID NO: 2228785 - RNA, 15 nt, Streptococcus pyogenes MGAS8232
uagaaaguuauaaag

SEQ ID NO: 2228786 - RNA, 12 nt, Streptococcus pyogenes MGAS8232
uagaaauagucu

SEQ ID NO: 2228787 - RNA, 23 nt, Streptococcus pyogenes MGAS8232
uagaaauagucuccauaacauac

SEQ ID NO: 2228788 - RNA, 20 nt, Streptococcus pyogenes MGAS8232
uagagaacagauaagugcca

SEQ ID NO: 2228789 - RNA, 16 nt, Streptococcus pyogenes MGAS8232
uaggaaucacaacuuc

SEQ ID NO: 2228790 - RNA, 18 nt, Streptococcus pyogenes MGAS8232
uaggaauaucaugaagua

SEQ ID NO: 2228791 - RNA, 16 nt, Streptococcus pyogenes MGAS8232
uaggaauaucaugaag

SEQ ID NO: 2228792 - RNA, 21 nt, Streptococcus pyogenes MGAS8232
uaggauauagaauagguaaag

SEQ ID NO: 2228793 - RNA, 22 nt, Streptococcus pyogenes MGAS8232
uaggauauaagaaggucucaaa

SEQ ID NO: 2228794 - RNA, 23 nt, Streptococcus pyogenes MGAS8232
uagggcggaugauucaaaugaag

SEQ ID NO: 2228795 - RNA, 14 nt, Streptococcus pyogenes MGAS8232
uagcuuuuguaaua

SEQ ID NO: 2228796 - RNA, 12 nt, Streptococcus pyogenes MGAS8232
uagcuuuuaauu

SEQ ID NO: 2228797 - RNA, 17 nt, Streptococcus pyogenes MGAS8232
uagcaaugguuaaaaag

SEQ ID NO: 2228798 - RNA, 17 nt, Streptococcus pyogenes MGAS8232
uagcaaguccugcuuuu

SEQ ID NO: 2228799 - RNA, 16 nt, Streptococcus pyogenes MGAS8232
uagcauaaugcaugua

SEQ ID NO: 2228800 - RNA, 14 nt, Streptococcus pyogenes MGAS8232
uagcauauuuugau

SEQ ID NO: 2228801 - RNA, 15 nt, Streptococcus pyogenes MGAS8232
uagcacguuggaaaa

SEQ ID NO: 2228802 - RNA, 21 nt, Streptococcus pyogenes MGAS8232
uagccagauggugcuacugau

SEQ ID NO: 2228803 - RNA, 14 nt, Streptococcus pyogenes MGAS8232
uaucucguaauccu

SEQ ID NO: 2228804 - RNA, 21 nt, Streptococcus pyogenes MGAS8232
uaucucggagcuuuaccuccu

SEQ ID NO: 2228805 - RNA, 18 nt, Streptococcus pyogenes MGAS8232
uaucugauaagguuuuuu

SEQ ID NO: 2228806 - RNA, 18 nt, Streptococcus pyogenes MGAS8232
uaucauggagucaaugaa

SEQ ID NO: 2228807 - RNA, 19 nt, Streptococcus pyogenes MGAS8232
uaucaugaaguauaguuau

SEQ ID NO: 2228808 - RNA, 23 nt, Streptococcus pyogenes MGAS8232
uauagcuccuaaaaccauaccua

SEQ ID NO: 2228809 - RNA, 15 nt, Streptococcus pyogenes MGAS8232
uauauuauguucuaa

SEQ ID NO: 2228810 - RNA, 22 nt, Streptococcus pyogenes MGAS8232
uaucaauaacagaaauuaauaa

SEQ ID NO: 2228811 - RNA, 17 nt, Streptococcus pyogenes MGAS8232
uauauugugcuauucaa

SEQ ID NO: 2228812 - RNA, 21 nt, Streptococcus pyogenes MGAS8232
uaucaaguaugcuuuuaauuu

SEQ ID NO: 2228813 - RNA, 18 nt, Streptococcus pyogenes MGAS8232
uaucaggcaaaacaaaaa

SEQ ID NO: 2228814 - RNA, 17 nt, Streptococcus pyogenes MGAS8232
uaucacauuuuaaucuu

SEQ ID NO: 2228815 - RNA, 16 nt, Streptococcus pyogenes MGAS8232
uaguuauuuuugagau

SEQ ID NO: 2228816 - RNA, 22 nt, Streptococcus pyogenes MGAS8232
uaguuauguuauaagauaagua

SEQ ID NO: 2228817 - RNA, 16 nt, Streptococcus pyogenes MGAS8232
uaguuucucauguuuu

SEQ ID NO: 2228818 - RNA, 18 nt, Streptococcus pyogenes MGAS8232
uaguuucucauguuuuau

SEQ ID NO: 2228819 - RNA, 17 nt, Streptococcus pyogenes MGAS8232
uaguuuuuagcagcaga

SEQ ID NO: 2228820 - RNA, 17 nt, Streptococcus pyogenes MGAS8232
uagugugugugauguaa

SEQ ID NO: 2228821 - RNA, 18 nt, Streptococcus pyogenes MGAS8232
uagugguauagacaaaca

SEQ ID NO: 2228822 - RNA, 22 nt, Streptococcus pyogenes MGAS8232
uauacuaauauuauauuaaauu

SEQ ID NO: 2228823 - RNA, 22 nt, Streptococcus pyogenes MGAS8232
uaagagagguugguaaaaaggc

SEQ ID NO: 2228824 - RNA, 22 nt, Streptococcus pyogenes MGAS8232
uaagagccaucagcucucaaga

SEQ ID NO: 2228825 - RNA, 14 nt, Streptococcus pyogenes MGAS8232
uaagaccuucaaaa

SEQ ID NO: 2228826 - RNA, 18 nt, Streptococcus pyogenes MGAS8232
uaagaccuucaaaaaagg

SEQ ID NO: 2228827 - RNA, 19 nt, Streptococcus pyogenes MGAS8232
uaagaccuucaaaaaaggg

SEQ ID NO: 2228828 - RNA, 17 nt, Streptococcus pyogenes MGAS8232
uaagacuauguugcuua

SEQ ID NO: 2228829 - RNA, 14 nt, Streptococcus pyogenes MGAS8232
uaacuguugucuca

SEQ ID NO: 2228830 - RNA, 20 nt, Streptococcus pyogenes MGAS8232
uaacuuuaaaagggcugacc

SEQ ID NO: 2228831 - RNA, 21 nt, Streptococcus pyogenes MGAS8232
uaagcuuacuucuaagagcca

SEQ ID NO: 2228832 - RNA, 13 nt, Streptococcus pyogenes MGAS8232
uaagauucaauau

SEQ ID NO: 2228833 - RNA, 23 nt, Streptococcus pyogenes MGAS8232
uaagcagcaucacguacagaaau

SEQ ID NO: 2228834 - RNA, 16 nt, Streptococcus pyogenes MGAS8232
uaacuagccuacaguc

SEQ ID NO: 2228835 - RNA, 15 nt, Streptococcus pyogenes MGAS8232
uaaccuucaacauuu

SEQ ID NO: 2228836 - RNA, 22 nt, Streptococcus pyogenes MGAS8232
uaaccauugccauuaauaauau

SEQ ID NO: 2228837 - RNA, 20 nt, Streptococcus pyogenes MGAS8232
uaacagaaauuaauaaauuu

SEQ ID NO: 2228838 - RNA, 12 nt, Streptococcus pyogenes MGAS8232
uaacaaauuuau

SEQ ID NO: 2228839 - RNA, 19 nt, Streptococcus pyogenes MGAS8232
uaacacgguuuucugucua

SEQ ID NO: 2228840 - RNA, 15 nt, Streptococcus pyogenes MGAS8232
uaacacgguuuucug

SEQ ID NO: 2228841 - RNA, 14 nt, Streptococcus pyogenes MGAS8232
uaaacuuacaaaaa

SEQ ID NO: 2228842 - RNA, 16 nt, Streptococcus pyogenes MGAS8232
uaaagauaauuucuuu

SEQ ID NO: 2228843 - RNA, 22 nt, Streptococcus pyogenes MGAS8232
uaaagaugagaguaaacgaaaa

SEQ ID NO: 2228844 - RNA, 17 nt, Streptococcus pyogenes MGAS8232
uaaaggccuguauuucu

SEQ ID NO: 2228845 - RNA, 19 nt, Streptococcus pyogenes MGAS8232
uaaaggccuguauuucuuu

SEQ ID NO: 2228846 - RNA, 12 nt, Streptococcus pyogenes MGAS8232
uaaaggauuuag

SEQ ID NO: 2228847 - RNA, 14 nt, Streptococcus pyogenes MGAS8232
uaaagcaagggaaa

SEQ ID NO: 2228848 - RNA, 19 nt, Streptococcus pyogenes MGAS8232
uaaacuguauacaaaaagg

SEQ ID NO: 2228849 - RNA, 20 nt, Streptococcus pyogenes MGAS8232
uaaacauauuauaguaacca

SEQ ID NO: 2228850 - RNA, 15 nt, Streptococcus pyogenes MGAS8232
uaaacaugccuuuca

SEQ ID NO: 2228851 - RNA, 17 nt, Streptococcus pyogenes MGAS8232
uaaauccuuuugaaaaa

SEQ ID NO: 2228852 - RNA, 15 nt, Streptococcus pyogenes MGAS8232
uaaaugcaaaaaagc

SEQ ID NO: 2228853 - RNA, 23 nt, Streptococcus pyogenes MGAS8232
uaaaauaucuagaacagcugcuu

SEQ ID NO: 2228854 - RNA, 21 nt, Streptococcus pyogenes MGAS8232
uaaaauaucuagaacagcugc

SEQ ID NO: 2228855 - RNA, 19 nt, Streptococcus pyogenes MGAS8232
uaaaauccucuuuuaauuu

SEQ ID NO: 2228856 - RNA, 18 nt, Streptococcus pyogenes MGAS8232
uaaaauccucuuuuaauu

SEQ ID NO: 2228857 - RNA, 20 nt, Streptococcus pyogenes MGAS8232
uaaacaaugagucaccugua

SEQ ID NO: 2228858 - RNA, 19 nt, Streptococcus pyogenes MGAS8232
uaaacaagaccuuauuaaa

SEQ ID NO: 2228859 - RNA, 21 nt, Streptococcus pyogenes MGAS8232
uaaacacuaccuuaaauguau

SEQ ID NO: 2228860 - RNA, 19 nt, Streptococcus pyogenes MGAS8232
uaaacaauugguuuacaug

SEQ ID NO: 2228861 - RNA, 23 nt, Streptococcus pyogenes MGAS8232
uaaaauuccccacaaaagacaac

SEQ ID NO: 2228862 - RNA, 14 nt, Streptococcus pyogenes MGAS8232
uaaaaccauaccua

SEQ ID NO: 2228863 - RNA, 20 nt, Streptococcus pyogenes MGAS8232
uaaaagauauuuuaaaauag

SEQ ID NO: 2228864 - RNA, 15 nt, Streptococcus pyogenes MGAS8232
uaaaacgugagaaaa

SEQ ID NO: 2228865 - RNA, 21 nt, Streptococcus pyogenes MGAS8232
uaaaaaguuucugaguugauu

SEQ ID NO: 2228866 - RNA, 22 nt, Streptococcus pyogenes MGAS8232
guuugauugauuugucuucucc

SEQ ID NO: 2228867 - RNA, 18 nt, Streptococcus pyogenes MGAS8232
guuugauugauuugucuu

SEQ ID NO: 2228868 - RNA, 16 nt, Streptococcus pyogenes MGAS8232
guuugauugauuuguc

SEQ ID NO: 2228869 - RNA, 20 nt, Streptococcus pyogenes MGAS8232
uaaaaacgaucaaaaaucuu

SEQ ID NO: 2228870 - RNA, 13 nt, Streptococcus pyogenes MGAS8232
guuggcauaaccc

SEQ ID NO: 2228871 - RNA, 14 nt, Streptococcus pyogenes MGAS8232
guuucgaaaaaggg

SEQ ID NO: 2228872 - RNA, 13 nt, Streptococcus pyogenes MGAS8232
guuucgaaaaagg

SEQ ID NO: 2228873 - RNA, 18 nt, Streptococcus pyogenes MGAS8232
guuuauguaugcugucca

SEQ ID NO: 2228874 - RNA, 20 nt, Streptococcus pyogenes MGAS8232
guuuaggaaucacaacuucu

SEQ ID NO: 2228875 - RNA, 15 nt, Streptococcus pyogenes MGAS8232
guuguauuaugaggu

SEQ ID NO: 2228876 - RNA, 13 nt, Streptococcus pyogenes MGAS8232
guugcaauaaucg

SEQ ID NO: 2228877 - RNA, 19 nt, Streptococcus pyogenes MGAS8232
guucauuuagugguauaga

SEQ ID NO: 2228878 - RNA, 14 nt, Streptococcus pyogenes MGAS8232
guuaaaauagaaga

SEQ ID NO: 2228879 - RNA, 20 nt, Streptococcus pyogenes MGAS8232
guguuuaaagaccucucaug

SEQ ID NO: 2228880 - RNA, 16 nt, Streptococcus pyogenes MGAS8232
guguugucaaacauaa

SEQ ID NO: 2228881 - RNA, 20 nt, Streptococcus pyogenes MGAS8232
gugauguucucauaaacaau

SEQ ID NO: 2228882 - RNA, 14 nt, Streptococcus pyogenes MGAS8232
gugcuacugaugua

SEQ ID NO: 2228883 - RNA, 20 nt, Streptococcus pyogenes MGAS8232
gccuuuaacaugauguacca

SEQ ID NO: 2228884 - RNA, 15 nt, Streptococcus pyogenes MGAS8232
gccuucuaucaaaac

SEQ ID NO: 2228885 - RNA, 14 nt, Streptococcus pyogenes MGAS8232
gcgaucauaaauaa

SEQ ID NO: 2228886 - RNA, 20 nt, Streptococcus pyogenes MGAS8232
gcguuaucuccacagagucu

SEQ ID NO: 2228887 - RNA, 16 nt, Streptococcus pyogenes MGAS8232
gcgugguggaggucug

SEQ ID NO: 2228888 - RNA, 18 nt, Streptococcus pyogenes MGAS8232
gcuaaaaacaaugcucuu

SEQ ID NO: 2228889 - RNA, 15 nt, Streptococcus pyogenes MGAS8232
gcguuucgaaaaagg

SEQ ID NO: 2228890 - RNA, 15 nt, Streptococcus pyogenes MGAS8232
gcuaaaacaguucca

SEQ ID NO: 2228891 - RNA, 16 nt, Streptococcus pyogenes MGAS8232
gcuaaaagcauaaaaa

SEQ ID NO: 2228892 - RNA, 18 nt, Streptococcus pyogenes MGAS8232
gcuaaguagauacuucgg

SEQ ID NO: 2228893 - RNA, 13 nt, Streptococcus pyogenes MGAS8232
gcuacaaggcacc

SEQ ID NO: 2228894 - RNA, 22 nt, Streptococcus pyogenes MGAS8232
gcucaauugcuuuuagccugcc

SEQ ID NO: 2228895 - RNA, 13 nt, Streptococcus pyogenes MGAS8232
gccucauuugcug

SEQ ID NO: 2228896 - RNA, 14 nt, Streptococcus pyogenes MGAS8232
gcauaccuaaaaga

SEQ ID NO: 2228897 - RNA, 14 nt, Streptococcus pyogenes MGAS8232
gcaaucauguuguc

SEQ ID NO: 2228898 - RNA, 20 nt, Streptococcus pyogenes MGAS8232
gcaauaacaucuugauugua

SEQ ID NO: 2228899 - RNA, 16 nt, Streptococcus pyogenes MGAS8232
gcaccaccaaccuuaa

SEQ ID NO: 2228900 - RNA, 15 nt, Streptococcus pyogenes MGAS8232
gcaccgcuuacccua

SEQ ID NO: 2228901 - RNA, 13 nt, Streptococcus pyogenes MGAS8232
gcaguucgauuau

SEQ ID NO: 2228902 - RNA, 15 nt, Streptococcus pyogenes MGAS8232
gcaggguaucugcuc

SEQ ID NO: 2228903 - RNA, 17 nt, Streptococcus pyogenes MGAS8232
gcaggguaucugcucag

SEQ ID NO: 2228904 - RNA, 17 nt, Streptococcus pyogenes MGAS8232
gcagcuaaaaacaaugc

SEQ ID NO: 2228905 - RNA, 20 nt, Streptococcus pyogenes MGAS8232
gcagauggggugucagggga

SEQ ID NO: 2228906 - RNA, 22 nt, Streptococcus pyogenes MGAS8232
gaguagcuacugccucauuugc

SEQ ID NO: 2228907 - RNA, 13 nt, Streptococcus pyogenes MGAS8232
gagucuuuuucua

SEQ ID NO: 2228908 - RNA, 11 nt, Streptococcus pyogenes MGAS8232
gaguggauaca

SEQ ID NO: 2228909 - RNA, 21 nt, Streptococcus pyogenes MGAS8232
gauaagaccuucaaaaaaggg

SEQ ID NO: 2228910 - RNA, 22 nt, Streptococcus pyogenes MGAS8232
gauaagaccuucaaaaaaggga

SEQ ID NO: 2228911 - RNA, 19 nt, Streptococcus pyogenes MGAS8232
gaggucuggccagcuacaa

SEQ ID NO: 2228912 - RNA, 17 nt, Streptococcus pyogenes MGAS8232
gagguugguaaaaaggc

SEQ ID NO: 2228913 - RNA, 14 nt, Streptococcus pyogenes MGAS8232
gaguacaaggcaau

SEQ ID NO: 2228914 - RNA, 19 nt, Streptococcus pyogenes MGAS8232
gaguaaggaccaagauuca

SEQ ID NO: 2228915 - RNA, 19 nt, Streptococcus pyogenes MGAS8232
gaucaaaaaucuuuuucuu

SEQ ID NO: 2228916 - RNA, 21 nt, Streptococcus pyogenes MGAS8232
gauauuuuuucucaaaaauau

SEQ ID NO: 2228917 - RNA, 14 nt, Streptococcus pyogenes MGAS8232
gauaagugccauca

SEQ ID NO: 2228918 - RNA, 16 nt, Streptococcus pyogenes MGAS8232
gauacguuuauuguug

SEQ ID NO: 2228919 - RNA, 13 nt, Streptococcus pyogenes MGAS8232
gauauaaaauugg

SEQ ID NO: 2228920 - RNA, 13 nt, Streptococcus pyogenes MGAS8232
gauagugugugug

SEQ ID NO: 2228921 - RNA, 12 nt, Streptococcus pyogenes MGAS8232
gauauaagaagg

SEQ ID NO: 2228922 - RNA, 19 nt, Streptococcus pyogenes MGAS8232
gauauagaauagguaaaga

SEQ ID NO: 2228923 - RNA, 21 nt, Streptococcus pyogenes MGAS8232
gauauagaauagguaaagauu

SEQ ID NO: 2228924 - RNA, 18 nt, Streptococcus pyogenes MGAS8232
gaugaaaugauuguuauu

SEQ ID NO: 2228925 - RNA, 18 nt, Streptococcus pyogenes MGAS8232
gaucucgauuaucuuuuu

SEQ ID NO: 2228926 - RNA, 15 nt, Streptococcus pyogenes MGAS8232
gaucuccaaagacau

SEQ ID NO: 2228927 - RNA, 18 nt, Streptococcus pyogenes MGAS8232
gaugccauuuaaaagggc

SEQ ID NO: 2228928 - RNA, 19 nt, Streptococcus pyogenes MGAS8232
gaugauugaguaagcagca

SEQ ID NO: 2228929 - RNA, 16 nt, Streptococcus pyogenes MGAS8232
gaugacgguaaauaaa

SEQ ID NO: 2228930 - RNA, 19 nt, Streptococcus pyogenes MGAS8232
gauugccauuuaauuggua

SEQ ID NO: 2228931 - RNA, 22 nt, Streptococcus pyogenes MGAS8232
gauuuccucuaacauguccaaa

SEQ ID NO: 2228932 - RNA, 20 nt, Streptococcus pyogenes MGAS8232
gauuucggaccaugccuaaa

SEQ ID NO: 2228933 - RNA, 17 nt, Streptococcus pyogenes MGAS8232
gagaugacgguaaauaa

SEQ ID NO: 2228934 - RNA, 18 nt, Streptococcus pyogenes MGAS8232
gagcaaggcaagaggagg

SEQ ID NO: 2228935 - RNA, 16 nt, Streptococcus pyogenes MGAS8232
gagauuuuuaaaaccu

SEQ ID NO: 2228936 - RNA, 18 nt, Streptococcus pyogenes MGAS8232
gagcacguuuucugguuu

SEQ ID NO: 2228937 - RNA, 17 nt, Streptococcus pyogenes MGAS8232
gagccgccaacauagcu

SEQ ID NO: 2228938 - RNA, 19 nt, Streptococcus pyogenes MGAS8232
gagcuuuuuuuguuuuggc

SEQ ID NO: 2228939 - RNA, 21 nt, Streptococcus pyogenes MGAS8232
gaggaguugaaccgcuaaaac

SEQ ID NO: 2228940 - RNA, 21 nt, Streptococcus pyogenes MGAS8232
gagccuuuucuuuuuggcuga

SEQ ID NO: 2228941 - RNA, 14 nt, Streptococcus pyogenes MGAS8232
gacgguaaauaaag

SEQ ID NO: 2228942 - RNA, 19 nt, Streptococcus pyogenes MGAS8232
gacucaauugaaagaggug

SEQ ID NO: 2228943 - RNA, 16 nt, Streptococcus pyogenes MGAS8232
gacucuagcauaaaag

SEQ ID NO: 2228944 - RNA, 17 nt, Streptococcus pyogenes MGAS8232
gacucuagcauaaaaga

SEQ ID NO: 2228945 - RNA, 14 nt, Streptococcus pyogenes MGAS8232
gagacaauaagguc

SEQ ID NO: 2228946 - RNA, 20 nt, Streptococcus pyogenes MGAS8232
gagacuaaaggucugcuucu

SEQ ID NO: 2228947 - RNA, 23 nt, Streptococcus pyogenes MGAS8232
gagaaacuaaaggcaauagcaag

SEQ ID NO: 2228948 - RNA, 21 nt, Streptococcus pyogenes MGAS8232
gacuuguuacaaaaaacaagu

SEQ ID NO: 2228949 - RNA, 20 nt, Streptococcus pyogenes MGAS8232
gacuugguucugaaaauaaa

SEQ ID NO: 2228950 - RNA, 23 nt, Streptococcus pyogenes MGAS8232
gacuugguucugaaaauaaaaua

SEQ ID NO: 2228951 - RNA, 16 nt, Streptococcus pyogenes MGAS8232
gacuuguaaaaugauc

SEQ ID NO: 2228952 - RNA, 14 nt, Streptococcus pyogenes MGAS8232
gacuucaaaaauac

SEQ ID NO: 2228953 - RNA, 17 nt, Streptococcus pyogenes MGAS8232
gacuguauguaucaaga

SEQ ID NO: 2228954 - RNA, 15 nt, Streptococcus pyogenes MGAS8232
gacugugaaaguauc

SEQ ID NO: 2228955 - RNA, 15 nt, Streptococcus pyogenes MGAS8232
gacaguuaaaaauaa

SEQ ID NO: 2228956 - RNA, 15 nt, Streptococcus pyogenes MGAS8232
gacauucguucuagu

SEQ ID NO: 2228957 - RNA, 13 nt, Streptococcus pyogenes MGAS8232
gacauucguucua

SEQ ID NO: 2228958 - RNA, 21 nt, Streptococcus pyogenes MGAS8232
gacauuaguccaaaauguaca

SEQ ID NO: 2228959 - RNA, 14 nt, Streptococcus pyogenes MGAS8232
gacaacccaacgca

SEQ ID NO: 2228960 - RNA, 16 nt, Streptococcus pyogenes MGAS8232
gacaauuauuuugcag

SEQ ID NO: 2228961 - RNA, 11 nt, Streptococcus pyogenes MGAS8232
gacaacaauau

SEQ ID NO: 2228962 - RNA, 16 nt, Streptococcus pyogenes MGAS8232
gaccuucaaaaaaggg

SEQ ID NO: 2228963 - RNA, 12 nt, Streptococcus pyogenes MGAS8232
gaccccuuaguu

SEQ ID NO: 2228964 - RNA, 22 nt, Streptococcus pyogenes MGAS8232
gaccgaaaaaggcaaagaaagc

SEQ ID NO: 2228965 - RNA, 21 nt, Streptococcus pyogenes MGAS8232
gaccucucaugggcaaauaaa

SEQ ID NO: 2228966 - RNA, 13 nt, Streptococcus pyogenes MGAS8232
gaccucuuuuucu

SEQ ID NO: 2228967 - RNA, 15 nt, Streptococcus pyogenes MGAS8232
cuaaaauaaagauga

SEQ ID NO: 2228968 - RNA, 19 nt, Streptococcus pyogenes MGAS8232
cguuuauuuaguuauuuuu

SEQ ID NO: 2228969 - RNA, 21 nt, Streptococcus pyogenes MGAS8232
cguuucagaaguuugcggcuc

SEQ ID NO: 2228970 - RNA, 13 nt, Streptococcus pyogenes MGAS8232
cuaagauuuccac

SEQ ID NO: 2228971 - RNA, 18 nt, Streptococcus pyogenes MGAS8232
cuaagauuuccacuuggu

SEQ ID NO: 2228972 - RNA, 11 nt, Streptococcus pyogenes MGAS8232
cuaauaaaaua

SEQ ID NO: 2228973 - RNA, 23 nt, Streptococcus pyogenes MGAS8232
cuaaauccuuuugaaaaauuaug

SEQ ID NO: 2228974 - RNA, 21 nt, Streptococcus pyogenes MGAS8232
cuaaauccuuuugaaaaauua

SEQ ID NO: 2228975 - RNA, 14 nt, Streptococcus pyogenes MGAS8232
cuaaauauaaauua

SEQ ID NO: 2228976 - RNA, 19 nt, Streptococcus pyogenes MGAS8232
cuaagagccaaaauaacaa

SEQ ID NO: 2228977 - RNA, 17 nt, Streptococcus pyogenes MGAS8232
cuaaucgaacaauaaua

SEQ ID NO: 2228978 - RNA, 14 nt, Streptococcus pyogenes MGAS8232
cuaauccaguagua

SEQ ID NO: 2228979 - RNA, 23 nt, Streptococcus pyogenes MGAS8232
cuaaucagaacucgucuuugucc

SEQ ID NO: 2228980 - RNA, 20 nt, Streptococcus pyogenes MGAS8232
cuaauauuauauuaaauuaa

SEQ ID NO: 2228981 - RNA, 12 nt, Streptococcus pyogenes MGAS8232
cuacaaaauaac

SEQ ID NO: 2228982 - RNA, 16 nt, Streptococcus pyogenes MGAS8232
cuaauugugagaaacu

SEQ ID NO: 2228983 - RNA, 17 nt, Streptococcus pyogenes MGAS8232
cuaauuuagucauuucu

SEQ ID NO: 2228984 - RNA, 20 nt, Streptococcus pyogenes MGAS8232
cuacaggauauugagaagaa

SEQ ID NO: 2228985 - RNA, 21 nt, Streptococcus pyogenes MGAS8232
cuacaggauauugagaagaaa

SEQ ID NO: 2228986 - RNA, 19 nt, Streptococcus pyogenes MGAS8232
cuacaugaccaaaaaauua

SEQ ID NO: 2228987 - RNA, 12 nt, Streptococcus pyogenes MGAS8232
cuccaaagacau

SEQ ID NO: 2228988 - RNA, 21 nt, Streptococcus pyogenes MGAS8232
cucauugucaaagcugacagu

SEQ ID NO: 2228989 - RNA, 16 nt, Streptococcus pyogenes MGAS8232
cuccaaaguucuucua

SEQ ID NO: 2228990 - RNA, 18 nt, Streptococcus pyogenes MGAS8232
cucaguucugagauauuc

SEQ ID NO: 2228991 - RNA, 19 nt, Streptococcus pyogenes MGAS8232
cucauaacaaauuuauccu

SEQ ID NO: 2228992 - RNA, 14 nt, Streptococcus pyogenes MGAS8232
cucauaaaaaagaa

SEQ ID NO: 2228993 - RNA, 15 nt, Streptococcus pyogenes MGAS8232
cucauaaaaaagaac

SEQ ID NO: 2228994 - RNA, 21 nt, Streptococcus pyogenes MGAS8232
cucacaaauacagaagaaagc

SEQ ID NO: 2228995 - RNA, 13 nt, Streptococcus pyogenes MGAS8232
cucaauauaauaa

SEQ ID NO: 2228996 - RNA, 19 nt, Streptococcus pyogenes MGAS8232
cucaauauaauaaaaagua

SEQ ID NO: 2228997 - RNA, 14 nt, Streptococcus pyogenes MGAS8232
cucaauagcugcug

SEQ ID NO: 2228998 - RNA, 21 nt, Streptococcus pyogenes MGAS8232
cuauugaaucuuguuuaaccu

SEQ ID NO: 2228999 - RNA, 16 nt, Streptococcus pyogenes MGAS8232
cuauugagucuuuuuc

SEQ ID NO: 2229000 - RNA, 18 nt, Streptococcus pyogenes MGAS8232
cuauugagucuuuuucua

SEQ ID NO: 2229001 - RNA, 15 nt, Streptococcus pyogenes MGAS8232
cucaaauuuuuuuca

SEQ ID NO: 2229002 - RNA, 20 nt, Streptococcus pyogenes MGAS8232
cuaucauggagucaaugaaa

SEQ ID NO: 2229003 - RNA, 22 nt, Streptococcus pyogenes MGAS8232
cuaucauggagucaaugaaaag

SEQ ID NO: 2229004 - RNA, 14 nt, Streptococcus pyogenes MGAS8232
cuaguuuaggauau

SEQ ID NO: 2229005 - RNA, 19 nt, Streptococcus pyogenes MGAS8232
cuauucaauauuuuauuaa

SEQ ID NO: 2229006 - RNA, 22 nt, Streptococcus pyogenes MGAS8232
cuaggcuuucauuauaggcuau

SEQ ID NO: 2229007 - RNA, 18 nt, Streptococcus pyogenes MGAS8232
cuagcuuugucaacucga

SEQ ID NO: 2229008 - RNA, 21 nt, Streptococcus pyogenes MGAS8232
cuagcucuuuaucaccuguca

SEQ ID NO: 2229009 - RNA, 13 nt, Streptococcus pyogenes MGAS8232
cuagucuuuuuau

SEQ ID NO: 2229010 - RNA, 15 nt, Streptococcus pyogenes MGAS8232
cuagguuaaaauaga

SEQ ID NO: 2229011 - RNA, 17 nt, Streptococcus pyogenes MGAS8232
cuagguuaaaauagaag

SEQ ID NO: 2229012 - RNA, 16 nt, Streptococcus pyogenes MGAS8232
cuagacugugaaagua

SEQ ID NO: 2229013 - RNA, 20 nt, Streptococcus pyogenes MGAS8232
cuagacucuagcauaaaaga

SEQ ID NO: 2229014 - RNA, 23 nt, Streptococcus pyogenes MGAS8232
cucuucggugcggaacuuguccu

SEQ ID NO: 2229015 - RNA, 14 nt, Streptococcus pyogenes MGAS8232
cugaaaauaaaaua

SEQ ID NO: 2229016 - RNA, 13 nt, Streptococcus pyogenes MGAS8232
cucuuuugugauu

SEQ ID NO: 2229017 - RNA, 13 nt, Streptococcus pyogenes MGAS8232
cucuuuuuuuuau

SEQ ID NO: 2229018 - RNA, 20 nt, Streptococcus pyogenes MGAS8232
cucuuuuuuuuauuauucua

SEQ ID NO: 2229019 - RNA, 13 nt, Streptococcus pyogenes MGAS8232
cugacuguaauua

SEQ ID NO: 2229020 - RNA, 16 nt, Streptococcus pyogenes MGAS8232
cugagauauucauuuu

SEQ ID NO: 2229021 - RNA, 22 nt, Streptococcus pyogenes MGAS8232
cugagcgguuuugucuuaucuc

SEQ ID NO: 2229022 - RNA, 17 nt, Streptococcus pyogenes MGAS8232
cugagauauucauuuuc

SEQ ID NO: 2229023 - RNA, 18 nt, Streptococcus pyogenes MGAS8232
cugagauauucauuuucu

SEQ ID NO: 2229024 - RNA, 20 nt, Streptococcus pyogenes MGAS8232
cugagauauucauuuucuuc

SEQ ID NO: 2229025 - RNA, 17 nt, Streptococcus pyogenes MGAS8232
cugagcaaucauguugu

SEQ ID NO: 2229026 - RNA, 23 nt, Streptococcus pyogenes MGAS8232
cugacaaaacuucaaauuucaug

SEQ ID NO: 2229027 - RNA, 17 nt, Streptococcus pyogenes MGAS8232
cucucaugggcaaauaa

SEQ ID NO: 2229028 - RNA, 17 nt, Streptococcus pyogenes MGAS8232
cucuaacauguccaaau

SEQ ID NO: 2229029 - RNA, 16 nt, Streptococcus pyogenes MGAS8232
cucuaauuuagucauu

SEQ ID NO: 2229030 - RNA, 20 nt, Streptococcus pyogenes MGAS8232
cuccuugcaauagagccaag

SEQ ID NO: 2229031 - RNA, 21 nt, Streptococcus pyogenes MGAS8232
cuccuuguuauccucccagcc

SEQ ID NO: 2229032 - RNA, 22 nt, Streptococcus pyogenes MGAS8232
cuguuaucccuggaccauuauc

SEQ ID NO: 2229033 - RNA, 13 nt, Streptococcus pyogenes MGAS8232
cugugaugaauca

SEQ ID NO: 2229034 - RNA, 13 nt, Streptococcus pyogenes MGAS8232
cugugaacaaaac

SEQ ID NO: 2229035 - RNA, 15 nt, Streptococcus pyogenes MGAS8232
cugguuuaucauuuu

SEQ ID NO: 2229036 - RNA, 21 nt, Streptococcus pyogenes MGAS8232
cuggguaucaguccuccucuu

SEQ ID NO: 2229037 - RNA, 21 nt, Streptococcus pyogenes MGAS8232
cuguccaauaccuagguaguu

SEQ ID NO: 2229038 - RNA, 15 nt, Streptococcus pyogenes MGAS8232
cugcuguuggauaca

SEQ ID NO: 2229039 - RNA, 14 nt, Streptococcus pyogenes MGAS8232
cuggccagcuacaa

SEQ ID NO: 2229040 - RNA, 19 nt, Streptococcus pyogenes MGAS8232
cuggcuuuuuugcuuuuua

SEQ ID NO: 2229041 - RNA, 15 nt, Streptococcus pyogenes MGAS8232
cugccagccauacca

SEQ ID NO: 2229042 - RNA, 15 nt, Streptococcus pyogenes MGAS8232
cugaugcguuuauaa

SEQ ID NO: 2229043 - RNA, 23 nt, Streptococcus pyogenes MGAS8232
cugaugcgauucccaucuuuauc

SEQ ID NO: 2229044 - RNA, 12 nt, Streptococcus pyogenes MGAS8232
cugccuuuuuaa

SEQ ID NO: 2229045 - RNA, 14 nt, Streptococcus pyogenes MGAS8232
cugcugcuaaagca

SEQ ID NO: 2229046 - RNA, 20 nt, Streptococcus pyogenes MGAS8232
cuucaaggaaggcuuguucu

SEQ ID NO: 2229047 - RNA, 17 nt, Streptococcus pyogenes MGAS8232
cuucaaccgcuucuuuu

SEQ ID NO: 2229048 - RNA, 20 nt, Streptococcus pyogenes MGAS8232
cuucaaccgcuucuuuugca

SEQ ID NO: 2229049 - RNA, 18 nt, Streptococcus pyogenes MGAS8232
cuucaccuuaggcagaca

SEQ ID NO: 2229050 - RNA, 17 nt, Streptococcus pyogenes MGAS8232
cuuauguauuuuucaaa

SEQ ID NO: 2229051 - RNA, 15 nt, Streptococcus pyogenes MGAS8232
cuuaacggcaucuac

SEQ ID NO: 2229052 - RNA, 22 nt, Streptococcus pyogenes MGAS8232
cuuaauaaacuguauacaaaaa

SEQ ID NO: 2229053 - RNA, 23 nt, Streptococcus pyogenes MGAS8232
cuuaauaaacuguauacaaaaag

SEQ ID NO: 2229054 - RNA, 22 nt, Streptococcus pyogenes MGAS8232
cuuagcgauagggguaauuugg

SEQ ID NO: 2229055 - RNA, 21 nt, Streptococcus pyogenes MGAS8232
cuuaggcagacaauuauuuug

SEQ ID NO: 2229056 - RNA, 12 nt, Streptococcus pyogenes MGAS8232
cuucuaaaaaaa

SEQ ID NO: 2229057 - RNA, 21 nt, Streptococcus pyogenes MGAS8232
cuuugacagacaccaaaaaaa

SEQ ID NO: 2229058 - RNA, 18 nt, Streptococcus pyogenes MGAS8232
cuuugauuuuucuuguuu

SEQ ID NO: 2229059 - RNA, 14 nt, Streptococcus pyogenes MGAS8232
cuugucuaugagau

SEQ ID NO: 2229060 - RNA, 16 nt, Streptococcus pyogenes MGAS8232
cuuguccuguaaauca

SEQ ID NO: 2229061 - RNA, 17 nt, Streptococcus pyogenes MGAS8232
cuuuacuguaauauuuc

SEQ ID NO: 2229062 - RNA, 13 nt, Streptococcus pyogenes MGAS8232
cuuuagagaauca

SEQ ID NO: 2229063 - RNA, 13 nt, Streptococcus pyogenes MGAS8232
cuuuauugaugau

SEQ ID NO: 2229064 - RNA, 17 nt, Streptococcus pyogenes MGAS8232
cuuuaguugcuucuuuu

SEQ ID NO: 2229065 - RNA, 18 nt, Streptococcus pyogenes MGAS8232
cuuuaguugcuucuuuua

SEQ ID NO: 2229066 - RNA, 15 nt, Streptococcus pyogenes MGAS8232
cuuuaguugcuucuu

SEQ ID NO: 2229067 - RNA, 22 nt, Streptococcus pyogenes MGAS8232
cuuuauaaugguuuuuugucuu

SEQ ID NO: 2229068 - RNA, 13 nt, Streptococcus pyogenes MGAS8232
cuuucaaacggag

SEQ ID NO: 2229069 - RNA, 19 nt, Streptococcus pyogenes MGAS8232
cuuucaaacggaguuccuc

SEQ ID NO: 2229070 - RNA, 12 nt, Streptococcus pyogenes MGAS8232
cuuuauuuugau

SEQ ID NO: 2229071 - RNA, 21 nt, Streptococcus pyogenes MGAS8232
cuugguucugaaaauaaaaua

SEQ ID NO: 2229072 - RNA, 19 nt, Streptococcus pyogenes MGAS8232
cuugguucugaaaauaaaa

SEQ ID NO: 2229073 - RNA, 17 nt, Streptococcus pyogenes MGAS8232
cuugcaaugccagcagc

SEQ ID NO: 2229074 - RNA, 12 nt, Streptococcus pyogenes MGAS8232
cuugacuuucua

SEQ ID NO: 2229075 - RNA, 19 nt, Streptococcus pyogenes MGAS8232
cuugaagccgcucuaauuu

SEQ ID NO: 2229076 - RNA, 13 nt, Streptococcus pyogenes MGAS8232
cuucuuuuuauua

SEQ ID NO: 2229077 - RNA, 22 nt, Streptococcus pyogenes MGAS8232
cuucuuuucagagaugcuucuu

SEQ ID NO: 2229078 - RNA, 22 nt, Streptococcus pyogenes MGAS8232
cuucuuugcagagaugcuucuu

SEQ ID NO: 2229079 - RNA, 22 nt, Streptococcus pyogenes MGAS8232
cuugaauaucgccaauaaaaaa

SEQ ID NO: 2229080 - RNA, 18 nt, Streptococcus pyogenes MGAS8232
cgccuaggaauaaaaugc

SEQ ID NO: 2229081 - RNA, 12 nt, Streptococcus pyogenes MGAS8232
cgauuaaaagau

SEQ ID NO: 2229082 - RNA, 14 nt, Streptococcus pyogenes MGAS8232
cgauuaucuuuuuu

SEQ ID NO: 2229083 - RNA, 22 nt, Streptococcus pyogenes MGAS8232
cgccaguaaagucacgaguguu

SEQ ID NO: 2229084 - RNA, 20 nt, Streptococcus pyogenes MGAS8232
cgcugaccaccggugccuca

SEQ ID NO: 2229085 - RNA, 18 nt, Streptococcus pyogenes MGAS8232
cgcucuaauuuagucauu

SEQ ID NO: 2229086 - RNA, 18 nt, Streptococcus pyogenes MGAS8232
cgucaacgcuagcauaau

SEQ ID NO: 2229087 - RNA, 18 nt, Streptococcus pyogenes MGAS8232
cccgucuuacaauuaaua

SEQ ID NO: 2229088 - RNA, 16 nt, Streptococcus pyogenes MGAS8232
ccauuuccuacaaaau

SEQ ID NO: 2229089 - RNA, 22 nt, Streptococcus pyogenes MGAS8232
ccauuucuuugcaaaagaaaac

SEQ ID NO: 2229090 - RNA, 14 nt, Streptococcus pyogenes MGAS8232
ccauuuuuuauaau

SEQ ID NO: 2229091 - RNA, 11 nt, Streptococcus pyogenes MGAS8232
ccccacaaaag

SEQ ID NO: 2229092 - RNA, 19 nt, Streptococcus pyogenes MGAS8232
ccaucaggcuuaaacauau

SEQ ID NO: 2229093 - RNA, 20 nt, Streptococcus pyogenes MGAS8232
ccaguugagccuuuucuuuu

SEQ ID NO: 2229094 - RNA, 16 nt, Streptococcus pyogenes MGAS8232
ccagaugcuugcucaa

SEQ ID NO: 2229095 - RNA, 16 nt, Streptococcus pyogenes MGAS8232
ccacuucaagcauaau

SEQ ID NO: 2229096 - RNA, 15 nt, Streptococcus pyogenes MGAS8232
ccacugcacgugcuc

SEQ ID NO: 2229097 - RNA, 20 nt, Streptococcus pyogenes MGAS8232
cauuuuuugcaauucagcau

SEQ ID NO: 2229098 - RNA, 20 nt, Streptococcus pyogenes MGAS8232
ccgcgaauaugauauaaaaa

SEQ ID NO: 2229099 - RNA, 23 nt, Streptococcus pyogenes MGAS8232
ccgccaacauagcuaauccagua

SEQ ID NO: 2229100 - RNA, 17 nt, Streptococcus pyogenes MGAS8232
ccugaucccuucauuuu

SEQ ID NO: 2229101 - RNA, 18 nt, Streptococcus pyogenes MGAS8232
ccuuaugcagguguuuaa

SEQ ID NO: 2229102 - RNA, 17 nt, Streptococcus pyogenes MGAS8232
ccuuauguauuuuucaa

SEQ ID NO: 2229103 - RNA, 13 nt, Streptococcus pyogenes MGAS8232
ccuuaucucaguu

SEQ ID NO: 2229104 - RNA, 20 nt, Streptococcus pyogenes MGAS8232
ccuuaggcagacaauuauuu

SEQ ID NO: 2229105 - RNA, 14 nt, Streptococcus pyogenes MGAS8232
ccuuaaaggccucc

SEQ ID NO: 2229106 - RNA, 15 nt, Streptococcus pyogenes MGAS8232
ccuuaaaggccuccu

SEQ ID NO: 2229107 - RNA, 16 nt, Streptococcus pyogenes MGAS8232
ccuacuagcacaaaau

SEQ ID NO: 2229108 - RNA, 21 nt, Streptococcus pyogenes MGAS8232
ccuauagaaaguuauaaagaa

SEQ ID NO: 2229109 - RNA, 21 nt, Streptococcus pyogenes MGAS8232
ccucaaacacguauuuuucga

SEQ ID NO: 2229110 - RNA, 22 nt, Streptococcus pyogenes MGAS8232
ccuaaauccuuuugaaaaauua

SEQ ID NO: 2229111 - RNA, 19 nt, Streptococcus pyogenes MGAS8232
ccuaauaaaauagcaccua

SEQ ID NO: 2229112 - RNA, 14 nt, Streptococcus pyogenes MGAS8232
ccuaaaaaauaacu

SEQ ID NO: 2229113 - RNA, 22 nt, Streptococcus pyogenes MGAS8232
cauccuaauggugucguuuuuu

SEQ ID NO: 2229114 - RNA, 22 nt, Streptococcus pyogenes MGAS8232
caucgagauuccuucuuuuucc

SEQ ID NO: 2229115 - RNA, 17 nt, Streptococcus pyogenes MGAS8232
caucaggcuuaaacaua

SEQ ID NO: 2229116 - RNA, 13 nt, Streptococcus pyogenes MGAS8232
caucauauuguua

SEQ ID NO: 2229117 - RNA, 19 nt, Streptococcus pyogenes MGAS8232
cauauuuuugaaaaaaaug

SEQ ID NO: 2229118 - RNA, 21 nt, Streptococcus pyogenes MGAS8232
caucaaaagaccauaaaaaac

SEQ ID NO: 2229119 - RNA, 20 nt, Streptococcus pyogenes MGAS8232
caucaagaauagcuuuugua

SEQ ID NO: 2229120 - RNA, 23 nt, Streptococcus pyogenes MGAS8232
cauuucuugaggugauucuuuuu

SEQ ID NO: 2229121 - RNA, 13 nt, Streptococcus pyogenes MGAS8232
cauuucuugaggu

SEQ ID NO: 2229122 - RNA, 18 nt, Streptococcus pyogenes MGAS8232
cauuucuuugcaaaagaa

SEQ ID NO: 2229123 - RNA, 19 nt, Streptococcus pyogenes MGAS8232
cauuucuucagguuucuuu

SEQ ID NO: 2229124 - RNA, 16 nt, Streptococcus pyogenes MGAS8232
cauuuaaucaugucca

SEQ ID NO: 2229125 - RNA, 14 nt, Streptococcus pyogenes MGAS8232
cauuugccauggca

SEQ ID NO: 2229126 - RNA, 22 nt, Streptococcus pyogenes MGAS8232
cauuuguaacuccuuaaauuau

SEQ ID NO: 2229127 - RNA, 17 nt, Streptococcus pyogenes MGAS8232
cauuuuuaucuguauau

SEQ ID NO: 2229128 - RNA, 21 nt, Streptococcus pyogenes MGAS8232
cauuuuuuauaaugguuuuuu

SEQ ID NO: 2229129 - RNA, 15 nt, Streptococcus pyogenes MGAS8232
cauuaauaauauuaa

SEQ ID NO: 2229130 - RNA, 19 nt, Streptococcus pyogenes MGAS8232
cauuaaggauuaugaaaaa

SEQ ID NO: 2229131 - RNA, 16 nt, Streptococcus pyogenes MGAS8232
cauuaaaaaaaccagc

SEQ ID NO: 2229132 - RNA, 13 nt, Streptococcus pyogenes MGAS8232
cauguuuaaaaaa

SEQ ID NO: 2229133 - RNA, 18 nt, Streptococcus pyogenes MGAS8232
cauggagucaaugaaaag

SEQ ID NO: 2229134 - RNA, 22 nt, Streptococcus pyogenes MGAS8232
cauacuuuauuaaucaaaaaac

SEQ ID NO: 2229135 - RNA, 14 nt, Streptococcus pyogenes MGAS8232
cauacucuauuuac

SEQ ID NO: 2229136 - RNA, 14 nt, Streptococcus pyogenes MGAS8232
cauaccaucaauga

SEQ ID NO: 2229137 - RNA, 16 nt, Streptococcus pyogenes MGAS8232
cauaaccuuugccauu

SEQ ID NO: 2229138 - RNA, 20 nt, Streptococcus pyogenes MGAS8232
caguugcgaucauaaauaaa

SEQ ID NO: 2229139 - RNA, 23 nt, Streptococcus pyogenes MGAS8232
caguucugagauauucauuuucu

SEQ ID NO: 2229140 - RNA, 20 nt, Streptococcus pyogenes MGAS8232
caguucugagauauucauuu

SEQ ID NO: 2229141 - RNA, 19 nt, Streptococcus pyogenes MGAS8232
caguuaaaaauaacuuuaa

SEQ ID NO: 2229142 - RNA, 14 nt, Streptococcus pyogenes MGAS8232
caguuaaaaauaac

SEQ ID NO: 2229143 - RNA, 12 nt, Streptococcus pyogenes MGAS8232
cauaaaaaagaa

SEQ ID NO: 2229144 - RNA, 13 nt, Streptococcus pyogenes MGAS8232
cauaaaaaagaac

SEQ ID NO: 2229145 - RNA, 15 nt, Streptococcus pyogenes MGAS8232
cauaaaaaagaacuu

SEQ ID NO: 2229146 - RNA, 15 nt, Streptococcus pyogenes MGAS8232
cauaacauacucuau

SEQ ID NO: 2229147 - RNA, 20 nt, Streptococcus pyogenes MGAS8232
cauaacauacucuauuuacu

SEQ ID NO: 2229148 - RNA, 21 nt, Streptococcus pyogenes MGAS8232
caguauaaccgccaucuaagc

SEQ ID NO: 2229149 - RNA, 20 nt, Streptococcus pyogenes MGAS8232
caguaguaaccguuggcaua

SEQ ID NO: 2229150 - RNA, 18 nt, Streptococcus pyogenes MGAS8232
caguauaacuguuuuucu

SEQ ID NO: 2229151 - RNA, 14 nt, Streptococcus pyogenes MGAS8232
cagugcuuuaacaa

SEQ ID NO: 2229152 - RNA, 19 nt, Streptococcus pyogenes MGAS8232
cagucugauuggugcgucu

SEQ ID NO: 2229153 - RNA, 23 nt, Streptococcus pyogenes MGAS8232
caggaggguuuuucuuuuggccu

SEQ ID NO: 2229154 - RNA, 16 nt, Streptococcus pyogenes MGAS8232
caggauugccaucaau

SEQ ID NO: 2229155 - RNA, 14 nt, Streptococcus pyogenes MGAS8232
cacuuaaaugcaaa

SEQ ID NO: 2229156 - RNA, 22 nt, Streptococcus pyogenes MGAS8232
caauuaaaaaagcuuuuuaucu

SEQ ID NO: 2229157 - RNA, 23 nt, Streptococcus pyogenes MGAS8232
caauguuuugcucgacagugcgc

SEQ ID NO: 2229158 - RNA, 23 nt, Streptococcus pyogenes MGAS8232
cagacaaaagggaagagagaagc

SEQ ID NO: 2229159 - RNA, 14 nt, Streptococcus pyogenes MGAS8232
cagaaaugaaaaga

SEQ ID NO: 2229160 - RNA, 22 nt, Streptococcus pyogenes MGAS8232
cagaaauuaauaaauuuuuguc

SEQ ID NO: 2229161 - RNA, 16 nt, Streptococcus pyogenes MGAS8232
cagagcaguucagcag

SEQ ID NO: 2229162 - RNA, 15 nt, Streptococcus pyogenes MGAS8232
cagaguacaaggcaa

SEQ ID NO: 2229163 - RNA, 21 nt, Streptococcus pyogenes MGAS8232
cagagcucgucuuuguccauu

SEQ ID NO: 2229164 - RNA, 16 nt, Streptococcus pyogenes MGAS8232
cagccauaccaacaau

SEQ ID NO: 2229165 - RNA, 19 nt, Streptococcus pyogenes MGAS8232
cagcagcacuggcuuuuuu

SEQ ID NO: 2229166 - RNA, 20 nt, Streptococcus pyogenes MGAS8232
cagcaguugcgaucauaaau

SEQ ID NO: 2229167 - RNA, 17 nt, Streptococcus pyogenes MGAS8232
caacuuaccagcaccuu

SEQ ID NO: 2229168 - RNA, 22 nt, Streptococcus pyogenes MGAS8232
caacugcaauaccguagaaagu

SEQ ID NO: 2229169 - RNA, 21 nt, Streptococcus pyogenes MGAS8232
caacaauacuaugaucuccaa

SEQ ID NO: 2229170 - RNA, 23 nt, Streptococcus pyogenes MGAS8232
caaauuguuugauugauuugucu

SEQ ID NO: 2229171 - RNA, 22 nt, Streptococcus pyogenes MGAS8232
caaauuuauccugaucccuuca

SEQ ID NO: 2229172 - RNA, 17 nt, Streptococcus pyogenes MGAS8232
caaauuucagauaagac

SEQ ID NO: 2229173 - RNA, 14 nt, Streptococcus pyogenes MGAS8232
caaauucuuuuuga

SEQ ID NO: 2229174 - RNA, 13 nt, Streptococcus pyogenes MGAS8232
caaaagcuaaacu

SEQ ID NO: 2229175 - RNA, 18 nt, Streptococcus pyogenes MGAS8232
caaauacagaagaaagcu

SEQ ID NO: 2229176 - RNA, 19 nt, Streptococcus pyogenes MGAS8232
caacuucuauauguguaau

SEQ ID NO: 2229177 - RNA, 23 nt, Streptococcus pyogenes MGAS8232
caagcauuuugcaagucucuugc

SEQ ID NO: 2229178 - RNA, 13 nt, Streptococcus pyogenes MGAS8232
caagcguccauau

SEQ ID NO: 2229179 - RNA, 21 nt, Streptococcus pyogenes MGAS8232
caagcguccauauaguaagua

SEQ ID NO: 2229180 - RNA, 15 nt, Streptococcus pyogenes MGAS8232
caauagcugcugcua

SEQ ID NO: 2229181 - RNA, 20 nt, Streptococcus pyogenes MGAS8232
caauagcugcugcuaaagca

SEQ ID NO: 2229182 - RNA, 23 nt, Streptococcus pyogenes MGAS8232
caauagcugcugcuaaagcaauc

SEQ ID NO: 2229183 - RNA, 19 nt, Streptococcus pyogenes MGAS8232
caauacucccuucucuagu

SEQ ID NO: 2229184 - RNA, 15 nt, Streptococcus pyogenes MGAS8232
caauagcgaaaaagg

SEQ ID NO: 2229185 - RNA, 22 nt, Streptococcus pyogenes MGAS8232
caauacaaaaaaccuuccugua

SEQ ID NO: 2229186 - RNA, 18 nt, Streptococcus pyogenes MGAS8232
caauacgauagugugugu

SEQ ID NO: 2229187 - RNA, 23 nt, Streptococcus pyogenes MGAS8232
caauaaaauaucuagaacagcug

SEQ ID NO: 2229188 - RNA, 16 nt, Streptococcus pyogenes MGAS8232
caaguaugcuuuuaau

SEQ ID NO: 2229189 - RNA, 19 nt, Streptococcus pyogenes MGAS8232
caagguuaaguaaaagcga

SEQ ID NO: 2229190 - RNA, 16 nt, Streptococcus pyogenes MGAS8232
caauaaggucaucaga

SEQ ID NO: 2229191 - RNA, 12 nt, Streptococcus pyogenes MGAS8232
caauaauauaau

SEQ ID NO: 2229192 - RNA, 13 nt, Streptococcus pyogenes MGAS8232
caauggaaauuuu

SEQ ID NO: 2229193 - RNA, 15 nt, Streptococcus pyogenes MGAS8232
caaugguuaaaaaga

SEQ ID NO: 2229194 - RNA, 19 nt, Streptococcus pyogenes MGAS8232
caaucuuaaguuagggucu

SEQ ID NO: 2229195 - RNA, 14 nt, Streptococcus pyogenes MGAS8232
caaugaaaaguuau

SEQ ID NO: 2229196 - RNA, 20 nt, Streptococcus pyogenes MGAS8232
caaucgaaaugauagcaccu

SEQ ID NO: 2229197 - RNA, 13 nt, Streptococcus pyogenes MGAS8232
caaucgaaaugau

SEQ ID NO: 2229198 - RNA, 12 nt, Streptococcus pyogenes MGAS8232
auuuuuuaaagc

SEQ ID NO: 2229199 - RNA, 20 nt, Streptococcus pyogenes MGAS8232
auuuuuuaccguaacguuug

SEQ ID NO: 2229200 - RNA, 21 nt, Streptococcus pyogenes MGAS8232
auuuuucgaccaauucuaaaa

SEQ ID NO: 2229201 - RNA, 13 nt, Streptococcus pyogenes MGAS8232
auuuuuuucauga

SEQ ID NO: 2229202 - RNA, 20 nt, Streptococcus pyogenes MGAS8232
auuuuuuucaugauguuuau

SEQ ID NO: 2229203 - RNA, 20 nt, Streptococcus pyogenes MGAS8232
auuuuuugcaauucagcauc

SEQ ID NO: 2229204 - RNA, 17 nt, Streptococcus pyogenes MGAS8232
caaaaaggcuaagaugg

SEQ ID NO: 2229205 - RNA, 18 nt, Streptococcus pyogenes MGAS8232
caaaaagucgucaacgcu

SEQ ID NO: 2229206 - RNA, 17 nt, Streptococcus pyogenes MGAS8232
caaaaauaaguauagca

SEQ ID NO: 2229207 - RNA, 16 nt, Streptococcus pyogenes MGAS8232
caaaaagccuauuuaa

SEQ ID NO: 2229208 - RNA, 18 nt, Streptococcus pyogenes MGAS8232
caaaaagccuauuuaaua

SEQ ID NO: 2229209 - RNA, 20 nt, Streptococcus pyogenes MGAS8232
caaaaacugugaacaaaaca

SEQ ID NO: 2229210 - RNA, 22 nt, Streptococcus pyogenes MGAS8232
caaaaacugugaacaaaacaaa

SEQ ID NO: 2229211 - RNA, 15 nt, Streptococcus pyogenes MGAS8232
caaaacccuuucgua

SEQ ID NO: 2229212 - RNA, 11 nt, Streptococcus pyogenes MGAS8232
caaaacaaaac

SEQ ID NO: 2229213 - RNA, 14 nt, Streptococcus pyogenes MGAS8232
caaaacaaaacaaa

SEQ ID NO: 2229214 - RNA, 15 nt, Streptococcus pyogenes MGAS8232
caaaacaaaacaaaa

SEQ ID NO: 2229215 - RNA, 16 nt, Streptococcus pyogenes MGAS8232
caaaacaaaacaaaac

SEQ ID NO: 2229216 - RNA, 18 nt, Streptococcus pyogenes MGAS8232
caaaacaaaacaaaacaa

SEQ ID NO: 2229217 - RNA, 19 nt, Streptococcus pyogenes MGAS8232
auuucuugaggugauucuu

SEQ ID NO: 2229218 - RNA, 14 nt, Streptococcus pyogenes MGAS8232
auuucuucagguuu

SEQ ID NO: 2229219 - RNA, 14 nt, Streptococcus pyogenes MGAS8232
auuucguuuuacgg

SEQ ID NO: 2229220 - RNA, 15 nt, Streptococcus pyogenes MGAS8232
auuucguugacaaag

SEQ ID NO: 2229221 - RNA, 14 nt, Streptococcus pyogenes MGAS8232
auuucguugacaaa

SEQ ID NO: 2229222 - RNA, 15 nt, Streptococcus pyogenes MGAS8232
auuuugucuaaaaua

SEQ ID NO: 2229223 - RNA, 18 nt, Streptococcus pyogenes MGAS8232
auuuugucuaaaauaaag

SEQ ID NO: 2229224 - RNA, 13 nt, Streptococcus pyogenes MGAS8232
auuuucaucauca

SEQ ID NO: 2229225 - RNA, 13 nt, Streptococcus pyogenes MGAS8232
auuuuaagacaac

SEQ ID NO: 2229226 - RNA, 16 nt, Streptococcus pyogenes MGAS8232
auuuuacuauggcuuc

SEQ ID NO: 2229227 - RNA, 19 nt, Streptococcus pyogenes MGAS8232
auuuuaugagaaaaauaag

SEQ ID NO: 2229228 - RNA, 21 nt, Streptococcus pyogenes MGAS8232
auuguagggauuuuuuuaacu

SEQ ID NO: 2229229 - RNA, 15 nt, Streptococcus pyogenes MGAS8232
auugucaaauaaaau

SEQ ID NO: 2229230 - RNA, 20 nt, Streptococcus pyogenes MGAS8232
auuguaauaacaaaaugaag

SEQ ID NO: 2229231 - RNA, 23 nt, Streptococcus pyogenes MGAS8232
auuguaauaacaaaaugaagcaa

SEQ ID NO: 2229232 - RNA, 19 nt, Streptococcus pyogenes MGAS8232
auuguaauaacaaaaugaa

SEQ ID NO: 2229233 - RNA, 20 nt, Streptococcus pyogenes MGAS8232
auuuaaccauaucgacauuu

SEQ ID NO: 2229234 - RNA, 21 nt, Streptococcus pyogenes MGAS8232
auuuaaucuuauuaaagagaa

SEQ ID NO: 2229235 - RNA, 22 nt, Streptococcus pyogenes MGAS8232
auuuagaugguagcaagaaguu

SEQ ID NO: 2229236 - RNA, 16 nt, Streptococcus pyogenes MGAS8232
auuuaguuauuuuuga

SEQ ID NO: 2229237 - RNA, 20 nt, Streptococcus pyogenes MGAS8232
auuuauaaauauuuuauauu

SEQ ID NO: 2229238 - RNA, 16 nt, Streptococcus pyogenes MGAS8232
auuucaauaauaccau

SEQ ID NO: 2229239 - RNA, 22 nt, Streptococcus pyogenes MGAS8232
auugagguaaucguaaugucuu

SEQ ID NO: 2229240 - RNA, 16 nt, Streptococcus pyogenes MGAS8232
auugaguaagcagcau

SEQ ID NO: 2229241 - RNA, 23 nt, Streptococcus pyogenes MGAS8232
auugacuugguucugaaaauaaa

SEQ ID NO: 2229242 - RNA, 17 nt, Streptococcus pyogenes MGAS8232
auucuuauccauuauaa

SEQ ID NO: 2229243 - RNA, 14 nt, Streptococcus pyogenes MGAS8232
auucuuuuuuaccu

SEQ ID NO: 2229244 - RNA, 18 nt, Streptococcus pyogenes MGAS8232
auucuuaaaaaaaucccu

SEQ ID NO: 2229245 - RNA, 23 nt, Streptococcus pyogenes MGAS8232
augagauaccuucauagacaagc

SEQ ID NO: 2229246 - RNA, 14 nt, Streptococcus pyogenes MGAS8232
augagaguaaacga

SEQ ID NO: 2229247 - RNA, 15 nt, Streptococcus pyogenes MGAS8232
augagaguaaacgaa

SEQ ID NO: 2229248 - RNA, 18 nt, Streptococcus pyogenes MGAS8232
augagaguaaacgaaaau

SEQ ID NO: 2229249 - RNA, 22 nt, Streptococcus pyogenes MGAS8232
augagguauuuauaaauauuuu

SEQ ID NO: 2229250 - RNA, 18 nt, Streptococcus pyogenes MGAS8232
augacgccuccaaauacu

SEQ ID NO: 2229251 - RNA, 20 nt, Streptococcus pyogenes MGAS8232
augaccuuugauaagauauu

SEQ ID NO: 2229252 - RNA, 17 nt, Streptococcus pyogenes MGAS8232
augacuucaaaaucacc

SEQ ID NO: 2229253 - RNA, 15 nt, Streptococcus pyogenes MGAS8232
augagaaaaauaagu

SEQ ID NO: 2229254 - RNA, 20 nt, Streptococcus pyogenes MGAS8232
augaaacguuauuaaagaca

SEQ ID NO: 2229255 - RNA, 15 nt, Streptococcus pyogenes MGAS8232
augaaaaucuguauu

SEQ ID NO: 2229256 - RNA, 16 nt, Streptococcus pyogenes MGAS8232
auccuuuugaaaaauu

SEQ ID NO: 2229257 - RNA, 15 nt, Streptococcus pyogenes MGAS8232
aucgcaaacagaugc

SEQ ID NO: 2229258 - RNA, 16 nt, Streptococcus pyogenes MGAS8232
aucuaaagcaucagca

SEQ ID NO: 2229259 - RNA, 16 nt, Streptococcus pyogenes MGAS8232
aucuagaacagcugcu

SEQ ID NO: 2229260 - RNA, 17 nt, Streptococcus pyogenes MGAS8232
aucuacucuauuuugag

SEQ ID NO: 2229261 - RNA, 16 nt, Streptococcus pyogenes MGAS8232
aucucccaucaacaag

SEQ ID NO: 2229262 - RNA, 21 nt, Streptococcus pyogenes MGAS8232
aucucaguuuuuuugauuuuc

SEQ ID NO: 2229263 - RNA, 13 nt, Streptococcus pyogenes MGAS8232
aucucauaaaaaa

SEQ ID NO: 2229264 - RNA, 17 nt, Streptococcus pyogenes MGAS8232
aucucauaaaaaagaac

SEQ ID NO: 2229265 - RNA, 19 nt, Streptococcus pyogenes MGAS8232
aucucguaauccuugauuu

SEQ ID NO: 2229266 - RNA, 14 nt, Streptococcus pyogenes MGAS8232
aucugcagauuuua

SEQ ID NO: 2229267 - RNA, 21 nt, Streptococcus pyogenes MGAS8232
aucugcagauuuuaagacaac

SEQ ID NO: 2229268 - RNA, 16 nt, Streptococcus pyogenes MGAS8232
aucugcacaugcuuga

SEQ ID NO: 2229269 - RNA, 17 nt, Streptococcus pyogenes MGAS8232
augguuaaaaagagagc

SEQ ID NO: 2229270 - RNA, 17 nt, Streptococcus pyogenes MGAS8232
augguagcaagaaguuu

SEQ ID NO: 2229271 - RNA, 22 nt, Streptococcus pyogenes MGAS8232
auguaugcuguccaugauuuuc

SEQ ID NO: 2229272 - RNA, 16 nt, Streptococcus pyogenes MGAS8232
auuaaccguuccuguc

SEQ ID NO: 2229273 - RNA, 14 nt, Streptococcus pyogenes MGAS8232
auuaauaauauuaa

SEQ ID NO: 2229274 - RNA, 15 nt, Streptococcus pyogenes MGAS8232
auuaauaaauuuuug

SEQ ID NO: 2229275 - RNA, 12 nt, Streptococcus pyogenes MGAS8232
auuaauaaauuu

SEQ ID NO: 2229276 - RNA, 19 nt, Streptococcus pyogenes MGAS8232
auuaaggauuaugaaaaag

SEQ ID NO: 2229277 - RNA, 17 nt, Streptococcus pyogenes MGAS8232
auuaaacuuacaaaaag

SEQ ID NO: 2229278 - RNA, 23 nt, Streptococcus pyogenes MGAS8232
auuaaauaauacagcauacauca

SEQ ID NO: 2229279 - RNA, 22 nt, Streptococcus pyogenes MGAS8232
auuaaaagaugucgcaaaggcu

SEQ ID NO: 2229280 - RNA, 21 nt, Streptococcus pyogenes MGAS8232
auguuuauuccaaacauccaa

SEQ ID NO: 2229281 - RNA, 20 nt, Streptococcus pyogenes MGAS8232
auuagcauaccuaaaagaac

SEQ ID NO: 2229282 - RNA, 17 nt, Streptococcus pyogenes MGAS8232
auuagcgccagcauuug

SEQ ID NO: 2229283 - RNA, 15 nt, Streptococcus pyogenes MGAS8232
auuauaguauaccua

SEQ ID NO: 2229284 - RNA, 14 nt, Streptococcus pyogenes MGAS8232
auuaguaaccauag

SEQ ID NO: 2229285 - RNA, 14 nt, Streptococcus pyogenes MGAS8232
auuacucaauuaau

SEQ ID NO: 2229286 - RNA, 14 nt, Streptococcus pyogenes MGAS8232
auuacgauuaaaag

SEQ ID NO: 2229287 - RNA, 14 nt, Streptococcus pyogenes MGAS8232
auuaauuguuuuag

SEQ ID NO: 2229288 - RNA, 17 nt, Streptococcus pyogenes MGAS8232
auuacaagcauuuugca

SEQ ID NO: 2229289 - RNA, 13 nt, Streptococcus pyogenes MGAS8232
auucaauaucaca

SEQ ID NO: 2229290 - RNA, 18 nt, Streptococcus pyogenes MGAS8232
auucaauaucacauuuua

SEQ ID NO: 2229291 - RNA, 13 nt, Streptococcus pyogenes MGAS8232
auucaaaugaagc

SEQ ID NO: 2229292 - RNA, 19 nt, Streptococcus pyogenes MGAS8232
auuaugccaaauuucagau

SEQ ID NO: 2229293 - RNA, 13 nt, Streptococcus pyogenes MGAS8232
auuauguucuaaa

SEQ ID NO: 2229294 - RNA, 22 nt, Streptococcus pyogenes MGAS8232
auuauuaaccaauuccucccua

SEQ ID NO: 2229295 - RNA, 18 nt, Streptococcus pyogenes MGAS8232
auuauuaaccaauuccuc

SEQ ID NO: 2229296 - RNA, 16 nt, Streptococcus pyogenes MGAS8232
auuauucuaaaugaca

SEQ ID NO: 2229297 - RNA, 18 nt, Streptococcus pyogenes MGAS8232
auuauugucacugaaaaa

SEQ ID NO: 2229298 - RNA, 20 nt, Streptococcus pyogenes MGAS8232
auuaugaaggugauugacuu

SEQ ID NO: 2229299 - RNA, 14 nt, Streptococcus pyogenes MGAS8232
auuaugaaaaagaa

SEQ ID NO: 2229300 - RNA, 23 nt, Streptococcus pyogenes MGAS8232
auuaucugaauuauuaguaacca

SEQ ID NO: 2229301 - RNA, 17 nt, Streptococcus pyogenes MGAS8232
auuaucugaauuauuag

SEQ ID NO: 2229302 - RNA, 17 nt, Streptococcus pyogenes MGAS8232
auuaucaauaacagaaa

SEQ ID NO: 2229303 - RNA, 13 nt, Streptococcus pyogenes MGAS8232
auauaaauuauua

SEQ ID NO: 2229304 - RNA, 22 nt, Streptococcus pyogenes MGAS8232
auauaagaaggucucaaauuuu

SEQ ID NO: 2229305 - RNA, 13 nt, Streptococcus pyogenes MGAS8232
auaguauaccuau

SEQ ID NO: 2229306 - RNA, 12 nt, Streptococcus pyogenes MGAS8232
auaggcuuuuuu

SEQ ID NO: 2229307 - RNA, 13 nt, Streptococcus pyogenes MGAS8232
auagggguaauuu

SEQ ID NO: 2229308 - RNA, 18 nt, Streptococcus pyogenes MGAS8232
auaguaaccauugccauu

SEQ ID NO: 2229309 - RNA, 12 nt, Streptococcus pyogenes MGAS8232
auaucuagaaca

SEQ ID NO: 2229310 - RNA, 17 nt, Streptococcus pyogenes MGAS8232
auaucgccaauaaaaaa

SEQ ID NO: 2229311 - RNA, 14 nt, Streptococcus pyogenes MGAS8232
auaucgacauuuau

SEQ ID NO: 2229312 - RNA, 20 nt, Streptococcus pyogenes MGAS8232
auaucuuucaguuguuuuaa

SEQ ID NO: 2229313 - RNA, 21 nt, Streptococcus pyogenes MGAS8232
auaucuuuuuuacuuuuaaaa

SEQ ID NO: 2229314 - RNA, 12 nt, Streptococcus pyogenes MGAS8232
auagcugcugcu

SEQ ID NO: 2229315 - RNA, 15 nt, Streptococcus pyogenes MGAS8232
auagcugauuuguuu

SEQ ID NO: 2229316 - RNA, 20 nt, Streptococcus pyogenes MGAS8232
auagagccaagauuuuaagg

SEQ ID NO: 2229317 - RNA, 21 nt, Streptococcus pyogenes MGAS8232
auacuuuaaacacuaccuuaa

SEQ ID NO: 2229318 - RNA, 17 nt, Streptococcus pyogenes MGAS8232
auagcaaugguuaaaaa

SEQ ID NO: 2229319 - RNA, 19 nt, Streptococcus pyogenes MGAS8232
auagcaaugguuaaaaaga

SEQ ID NO: 2229320 - RNA, 14 nt, Streptococcus pyogenes MGAS8232
auacgguaaaaacu

SEQ ID NO: 2229321 - RNA, 15 nt, Streptococcus pyogenes MGAS8232
auacugguauguuga

SEQ ID NO: 2229322 - RNA, 23 nt, Streptococcus pyogenes MGAS8232
auacugguauguugauugccauu

SEQ ID NO: 2229323 - RNA, 22 nt, Streptococcus pyogenes MGAS8232
auacuggucaauggaaauuuua

SEQ ID NO: 2229324 - RNA, 16 nt, Streptococcus pyogenes MGAS8232
auacuucgguauucuu

SEQ ID NO: 2229325 - RNA, 22 nt, Streptococcus pyogenes MGAS8232
auacuucgguauucuuuuuccg

SEQ ID NO: 2229326 - RNA, 16 nt, Streptococcus pyogenes MGAS8232
auacuuccaucuaauc

SEQ ID NO: 2229327 - RNA, 21 nt, Streptococcus pyogenes MGAS8232
auacuuccaucuaaucgaaca

SEQ ID NO: 2229328 - RNA, 18 nt, Streptococcus pyogenes MGAS8232
auacucaauauaauaaaa

SEQ ID NO: 2229329 - RNA, 19 nt, Streptococcus pyogenes MGAS8232
auacucuauuuacucaucu

SEQ ID NO: 2229330 - RNA, 15 nt, Streptococcus pyogenes MGAS8232
auauuuuaaaauagu

SEQ ID NO: 2229331 - RNA, 17 nt, Streptococcus pyogenes MGAS8232
auauuuuauauuauguu

SEQ ID NO: 2229332 - RNA, 14 nt, Streptococcus pyogenes MGAS8232
auauuguuaauaua

SEQ ID NO: 2229333 - RNA, 18 nt, Streptococcus pyogenes MGAS8232
auauuguuuuucuuuguc

SEQ ID NO: 2229334 - RNA, 22 nt, Streptococcus pyogenes MGAS8232
auauuguuuuucuuugucaugu

SEQ ID NO: 2229335 - RNA, 18 nt, Streptococcus pyogenes MGAS8232
auauuuuuucucaaaaau

SEQ ID NO: 2229336 - RNA, 12 nt, Streptococcus pyogenes MGAS8232
auaugauauaaa

SEQ ID NO: 2229337 - RNA, 14 nt, Streptococcus pyogenes MGAS8232
auaugauauaaaaa

SEQ ID NO: 2229338 - RNA, 19 nt, Streptococcus pyogenes MGAS8232
auauuauguucuaaaaaag

SEQ ID NO: 2229339 - RNA, 16 nt, Streptococcus pyogenes MGAS8232
auauugaucucugcaa

SEQ ID NO: 2229340 - RNA, 18 nt, Streptococcus pyogenes MGAS8232
aucaacauggcuaaugau

SEQ ID NO: 2229341 - RNA, 18 nt, Streptococcus pyogenes MGAS8232
aucaaaccaagguauuua

SEQ ID NO: 2229342 - RNA, 17 nt, Streptococcus pyogenes MGAS8232
aucaaccucucagcugu

SEQ ID NO: 2229343 - RNA, 14 nt, Streptococcus pyogenes MGAS8232
aucaaguaugcuuu

SEQ ID NO: 2229344 - RNA, 14 nt, Streptococcus pyogenes MGAS8232
aucaaggaauugca

SEQ ID NO: 2229345 - RNA, 20 nt, Streptococcus pyogenes MGAS8232
aucaaugacuugaccaaaua

SEQ ID NO: 2229346 - RNA, 21 nt, Streptococcus pyogenes MGAS8232
aucagcauaaccuuugccauu

SEQ ID NO: 2229347 - RNA, 16 nt, Streptococcus pyogenes MGAS8232
aucacauuuuaaucuu

SEQ ID NO: 2229348 - RNA, 16 nt, Streptococcus pyogenes MGAS8232
aguuuucucagagaca

SEQ ID NO: 2229349 - RNA, 23 nt, Streptococcus pyogenes MGAS8232
aguuuuuagcagcagaagcaaau

SEQ ID NO: 2229350 - RNA, 13 nt, Streptococcus pyogenes MGAS8232
aguguuuugaaug

SEQ ID NO: 2229351 - RNA, 20 nt, Streptococcus pyogenes MGAS8232
aguuauagcuccuaaaacca

SEQ ID NO: 2229352 - RNA, 20 nt, Streptococcus pyogenes MGAS8232
aguuauaaagaaacaaaaau

SEQ ID NO: 2229353 - RNA, 12 nt, Streptococcus pyogenes MGAS8232
aguuauuuuuga

SEQ ID NO: 2229354 - RNA, 19 nt, Streptococcus pyogenes MGAS8232
aguucaauggauauaacaa

SEQ ID NO: 2229355 - RNA, 17 nt, Streptococcus pyogenes MGAS8232
aguuccucgguuuuuuu

SEQ ID NO: 2229356 - RNA, 16 nt, Streptococcus pyogenes MGAS8232
aguuccucgguuuuuu

SEQ ID NO: 2229357 - RNA, 19 nt, Streptococcus pyogenes MGAS8232
aguuccugcauguaacaag

SEQ ID NO: 2229358 - RNA, 15 nt, Streptococcus pyogenes MGAS8232
agucugcaugaagug

SEQ ID NO: 2229359 - RNA, 15 nt, Streptococcus pyogenes MGAS8232
agucugagcaaucau

SEQ ID NO: 2229360 - RNA, 14 nt, Streptococcus pyogenes MGAS8232
auaacucuucggug

SEQ ID NO: 2229361 - RNA, 19 nt, Streptococcus pyogenes MGAS8232
auaaacuguauacaaaaag

SEQ ID NO: 2229362 - RNA, 22 nt, Streptococcus pyogenes MGAS8232
auaaaaaaccuuaucaaaccaa

SEQ ID NO: 2229363 - RNA, 18 nt, Streptococcus pyogenes MGAS8232
auaaagcuuuaaaaaaua

SEQ ID NO: 2229364 - RNA, 16 nt, Streptococcus pyogenes MGAS8232
auaaaucuuacuaacu

SEQ ID NO: 2229365 - RNA, 22 nt, Streptococcus pyogenes MGAS8232
auaauguuauaauaauauuaua

SEQ ID NO: 2229366 - RNA, 13 nt, Streptococcus pyogenes MGAS8232
auaauauaaugau

SEQ ID NO: 2229367 - RNA, 23 nt, Streptococcus pyogenes MGAS8232
auaauauuauaguauuaucucau

SEQ ID NO: 2229368 - RNA, 12 nt, Streptococcus pyogenes MGAS8232
auaauaaaaaga

SEQ ID NO: 2229369 - RNA, 13 nt, Streptococcus pyogenes MGAS8232
auaauaaagugcg

SEQ ID NO: 2229370 - RNA, 19 nt, Streptococcus pyogenes MGAS8232
auaaguauuuuaaaauccu

SEQ ID NO: 2229371 - RNA, 23 nt, Streptococcus pyogenes MGAS8232
auaagucauuuuaaguagucaaa

SEQ ID NO: 2229372 - RNA, 15 nt, Streptococcus pyogenes MGAS8232
auaagacuuauauga

SEQ ID NO: 2229373 - RNA, 18 nt, Streptococcus pyogenes MGAS8232
auaagacuuauaugaaag

SEQ ID NO: 2229374 - RNA, 15 nt, Streptococcus pyogenes MGAS8232
auaagaccuucaaaa

SEQ ID NO: 2229375 - RNA, 17 nt, Streptococcus pyogenes MGAS8232
aggcaauccaaaucaac

SEQ ID NO: 2229376 - RNA, 22 nt, Streptococcus pyogenes MGAS8232
aggcaacucuaaucuuuauaaa

SEQ ID NO: 2229377 - RNA, 14 nt, Streptococcus pyogenes MGAS8232
aggauuuaguuuug

SEQ ID NO: 2229378 - RNA, 17 nt, Streptococcus pyogenes MGAS8232
aggauuuagcuguuauu

SEQ ID NO: 2229379 - RNA, 13 nt, Streptococcus pyogenes MGAS8232
aggauuaugaaaa

SEQ ID NO: 2229380 - RNA, 19 nt, Streptococcus pyogenes MGAS8232
aggaauaucaugaaguaua

SEQ ID NO: 2229381 - RNA, 20 nt, Streptococcus pyogenes MGAS8232
aggaauaucaggcaaaacaa

SEQ ID NO: 2229382 - RNA, 22 nt, Streptococcus pyogenes MGAS8232
aggaauugcagcuaaaaacaau

SEQ ID NO: 2229383 - RNA, 20 nt, Streptococcus pyogenes MGAS8232
aggaauugcagcuaaaaaca

SEQ ID NO: 2229384 - RNA, 21 nt, Streptococcus pyogenes MGAS8232
aggaauugcagcuaaaaacaa

SEQ ID NO: 2229385 - RNA, 16 nt, Streptococcus pyogenes MGAS8232
aggaaaaagccagagc

SEQ ID NO: 2229386 - RNA, 16 nt, Streptococcus pyogenes MGAS8232
aggauauugagaagaa

SEQ ID NO: 2229387 - RNA, 18 nt, Streptococcus pyogenes MGAS8232
aggauauugagaagaaaa

SEQ ID NO: 2229388 - RNA, 22 nt, Streptococcus pyogenes MGAS8232
agcuuauaguuugacuucaaaa

SEQ ID NO: 2229389 - RNA, 13 nt, Streptococcus pyogenes MGAS8232
agcuuaucaaggu

SEQ ID NO: 2229390 - RNA, 15 nt, Streptococcus pyogenes MGAS8232
agcuuaucaagguug

SEQ ID NO: 2229391 - RNA, 20 nt, Streptococcus pyogenes MGAS8232
agcugguugaccaauauagc

SEQ ID NO: 2229392 - RNA, 22 nt, Streptococcus pyogenes MGAS8232
agcugguugaccaauauagcaa

SEQ ID NO: 2229393 - RNA, 15 nt, Streptococcus pyogenes MGAS8232
agcuguucucuuugg

SEQ ID NO: 2229394 - RNA, 22 nt, Streptococcus pyogenes MGAS8232
agcugucgcguuucgaaaaagg

SEQ ID NO: 2229395 - RNA, 15 nt, Streptococcus pyogenes MGAS8232
agcucuaucaucuuu

SEQ ID NO: 2229396 - RNA, 21 nt, Streptococcus pyogenes MGAS8232
aggcuuguucuuuauuuugau

SEQ ID NO: 2229397 - RNA, 17 nt, Streptococcus pyogenes MGAS8232
aggcuuacgacagcagc

SEQ ID NO: 2229398 - RNA, 23 nt, Streptococcus pyogenes MGAS8232
agggguaauuugguggaagagua

SEQ ID NO: 2229399 - RNA, 21 nt, Streptococcus pyogenes MGAS8232
aggggaauuuccuaaugcaac

SEQ ID NO: 2229400 - RNA, 15 nt, Streptococcus pyogenes MGAS8232
agggcaaugccaucu

SEQ ID NO: 2229401 - RNA, 13 nt, Streptococcus pyogenes MGAS8232
aggccuugugccu

SEQ ID NO: 2229402 - RNA, 23 nt, Streptococcus pyogenes MGAS8232
aguaagauggugcuuuaaaaagu

SEQ ID NO: 2229403 - RNA, 19 nt, Streptococcus pyogenes MGAS8232
aguaaggaaaucaauccug

SEQ ID NO: 2229404 - RNA, 18 nt, Streptococcus pyogenes MGAS8232
aguaaggguuaacaauga

SEQ ID NO: 2229405 - RNA, 21 nt, Streptococcus pyogenes MGAS8232
aguaaugugggauauuuagau

SEQ ID NO: 2229406 - RNA, 16 nt, Streptococcus pyogenes MGAS8232
aguaaaaucuuauuuu

SEQ ID NO: 2229407 - RNA, 18 nt, Streptococcus pyogenes MGAS8232
aguaaagccuuauccauu

SEQ ID NO: 2229408 - RNA, 19 nt, Streptococcus pyogenes MGAS8232
aggguguuuuuuauauguc

SEQ ID NO: 2229409 - RNA, 19 nt, Streptococcus pyogenes MGAS8232
agguaauagcguaaagcaa

SEQ ID NO: 2229410 - RNA, 18 nt, Streptococcus pyogenes MGAS8232
aggucaaccucuaggcca

SEQ ID NO: 2229411 - RNA, 16 nt, Streptococcus pyogenes MGAS8232
aggugauugacuugug

SEQ ID NO: 2229412 - RNA, 22 nt, Streptococcus pyogenes MGAS8232
agguggagcuuuaguugcuucu

SEQ ID NO: 2229413 - RNA, 23 nt, Streptococcus pyogenes MGAS8232
aggucugcuucuuacuaugaaaa

SEQ ID NO: 2229414 - RNA, 15 nt, Streptococcus pyogenes MGAS8232
aggucucaaauuuuu

SEQ ID NO: 2229415 - RNA, 15 nt, Streptococcus pyogenes MGAS8232
aggucaucagaauaa

SEQ ID NO: 2229416 - RNA, 16 nt, Streptococcus pyogenes MGAS8232
acguaaccaauuguug

SEQ ID NO: 2229417 - RNA, 16 nt, Streptococcus pyogenes MGAS8232
acguaagcaucauuau

SEQ ID NO: 2229418 - RNA, 22 nt, Streptococcus pyogenes MGAS8232
acggucauuaauaaaagauuuc

SEQ ID NO: 2229419 - RNA, 23 nt, Streptococcus pyogenes MGAS8232
acgguguaauccccucguuuaaa

SEQ ID NO: 2229420 - RNA, 13 nt, Streptococcus pyogenes MGAS8232
acuauuuugugac

SEQ ID NO: 2229421 - RNA, 23 nt, Streptococcus pyogenes MGAS8232
acuauuuugugacuauauccgua

SEQ ID NO: 2229422 - RNA, 16 nt, Streptococcus pyogenes MGAS8232
acucaaaaaauacaau

SEQ ID NO: 2229423 - RNA, 14 nt, Streptococcus pyogenes MGAS8232
acucaaaaaauaca

SEQ ID NO: 2229424 - RNA, 19 nt, Streptococcus pyogenes MGAS8232
acuauuguagaggugauga

SEQ ID NO: 2229425 - RNA, 19 nt, Streptococcus pyogenes MGAS8232
acuauggcuucuaaaaaaa

SEQ ID NO: 2229426 - RNA, 23 nt, Streptococcus pyogenes MGAS8232
acuauuagcauaccuaaaagaac

SEQ ID NO: 2229427 - RNA, 21 nt, Streptococcus pyogenes MGAS8232
acuaguuuauuacaaaacugu

SEQ ID NO: 2229428 - RNA, 16 nt, Streptococcus pyogenes MGAS8232
acuaccuuaaauguau

SEQ ID NO: 2229429 - RNA, 13 nt, Streptococcus pyogenes MGAS8232
acuaaacaaacgg

SEQ ID NO: 2229430 - RNA, 22 nt, Streptococcus pyogenes MGAS8232
acguuauuaaagacaaaaaaac

SEQ ID NO: 2229431 - RNA, 23 nt, Streptococcus pyogenes MGAS8232
acgucuaccgcaauuaaaccauu

SEQ ID NO: 2229432 - RNA, 20 nt, Streptococcus pyogenes MGAS8232
acuuauaugaaagaacuauu

SEQ ID NO: 2229433 - RNA, 16 nt, Streptococcus pyogenes MGAS8232
acuucaaggaaggcuu

SEQ ID NO: 2229434 - RNA, 18 nt, Streptococcus pyogenes MGAS8232
acugugaacaaaacaaaa

SEQ ID NO: 2229435 - RNA, 18 nt, Streptococcus pyogenes MGAS8232
acugagccccaaaaguug

SEQ ID NO: 2229436 - RNA, 16 nt, Streptococcus pyogenes MGAS8232
acugagccuuuuuuug

SEQ ID NO: 2229437 - RNA, 17 nt, Streptococcus pyogenes MGAS8232
acucaauagcugcugcu

SEQ ID NO: 2229438 - RNA, 23 nt, Streptococcus pyogenes MGAS8232
acucaagaggucuggccagcuac

SEQ ID NO: 2229439 - RNA, 17 nt, Streptococcus pyogenes MGAS8232
agauuaaacuuacaaaa

SEQ ID NO: 2229440 - RNA, 18 nt, Streptococcus pyogenes MGAS8232
agaugguuuugauuaaau

SEQ ID NO: 2229441 - RNA, 16 nt, Streptococcus pyogenes MGAS8232
agauuggauuucgacu

SEQ ID NO: 2229442 - RNA, 17 nt, Streptococcus pyogenes MGAS8232
agaucauuaaauugauu

SEQ ID NO: 2229443 - RNA, 14 nt, Streptococcus pyogenes MGAS8232
agauccuacaagag

SEQ ID NO: 2229444 - RNA, 23 nt, Streptococcus pyogenes MGAS8232
agaucucgauuaucuuuuuuuaa

SEQ ID NO: 2229445 - RNA, 16 nt, Streptococcus pyogenes MGAS8232
agaugaaaaucuguau

SEQ ID NO: 2229446 - RNA, 15 nt, Streptococcus pyogenes MGAS8232
agaugacgguaaaua

SEQ ID NO: 2229447 - RNA, 23 nt, Streptococcus pyogenes MGAS8232
agaugauuauauuaggauauaga

SEQ ID NO: 2229448 - RNA, 16 nt, Streptococcus pyogenes MGAS8232
agauagucaaaaagac

SEQ ID NO: 2229449 - RNA, 23 nt, Streptococcus pyogenes MGAS8232
agauacuucgguauucuuuuucc

SEQ ID NO: 2229450 - RNA, 21 nt, Streptococcus pyogenes MGAS8232
agagucuuaguuuaggaauca

SEQ ID NO: 2229451 - RNA, 17 nt, Streptococcus pyogenes MGAS8232
agagagguugguaaaaa

SEQ ID NO: 2229452 - RNA, 18 nt, Streptococcus pyogenes MGAS8232
agagauaaaaaguaaaau

SEQ ID NO: 2229453 - RNA, 20 nt, Streptococcus pyogenes MGAS8232
agagagaagcuguucucuuu

SEQ ID NO: 2229454 - RNA, 15 nt, Streptococcus pyogenes MGAS8232
agaaagcuugucuau

SEQ ID NO: 2229455 - RNA, 21 nt, Streptococcus pyogenes MGAS8232
agaaagcggaagaacagcauu

SEQ ID NO: 2229456 - RNA, 19 nt, Streptococcus pyogenes MGAS8232
agaaaaucuaaucagaacu

SEQ ID NO: 2229457 - RNA, 18 nt, Streptococcus pyogenes MGAS8232
agaaaaauaaguguguga

SEQ ID NO: 2229458 - RNA, 15 nt, Streptococcus pyogenes MGAS8232
agaacagcauuuuca

SEQ ID NO: 2229459 - RNA, 21 nt, Streptococcus pyogenes MGAS8232
agaaauuguaaccacagcaau

SEQ ID NO: 2229460 - RNA, 15 nt, Streptococcus pyogenes MGAS8232
agaaauuuuauugca

SEQ ID NO: 2229461 - RNA, 17 nt, Streptococcus pyogenes MGAS8232
agaacgagucaauuuag

SEQ ID NO: 2229462 - RNA, 22 nt, Streptococcus pyogenes MGAS8232
agaacgaauugugucauuucuu

SEQ ID NO: 2229463 - RNA, 20 nt, Streptococcus pyogenes MGAS8232
agacaucacgauuugcugag

SEQ ID NO: 2229464 - RNA, 19 nt, Streptococcus pyogenes MGAS8232
agacaaggugaauauaaga

SEQ ID NO: 2229465 - RNA, 23 nt, Streptococcus pyogenes MGAS8232
agaaggucucaaauuuuuuucau

SEQ ID NO: 2229466 - RNA, 16 nt, Streptococcus pyogenes MGAS8232
acaguauguaaauaua

SEQ ID NO: 2229467 - RNA, 15 nt, Streptococcus pyogenes MGAS8232
acaguuaaaaauaac

SEQ ID NO: 2229468 - RNA, 18 nt, Streptococcus pyogenes MGAS8232
acaguccaaacucaaacu

SEQ ID NO: 2229469 - RNA, 14 nt, Streptococcus pyogenes MGAS8232
acagucaagagcac

SEQ ID NO: 2229470 - RNA, 16 nt, Streptococcus pyogenes MGAS8232
acacuuaaaugcaaaa

SEQ ID NO: 2229471 - RNA, 20 nt, Streptococcus pyogenes MGAS8232
acagaugcucaaacuauauu

SEQ ID NO: 2229472 - RNA, 17 nt, Streptococcus pyogenes MGAS8232
acagcaauuuguuccau

SEQ ID NO: 2229473 - RNA, 18 nt, Streptococcus pyogenes MGAS8232
acagcaccuucaaccgcu

SEQ ID NO: 2229474 - RNA, 15 nt, Streptococcus pyogenes MGAS8232
accauuguagaguuu

SEQ ID NO: 2229475 - RNA, 13 nt, Streptococcus pyogenes MGAS8232
accauucuaaaca

SEQ ID NO: 2229476 - RNA, 18 nt, Streptococcus pyogenes MGAS8232
acccccuagacugugaaa

SEQ ID NO: 2229477 - RNA, 16 nt, Streptococcus pyogenes MGAS8232
accauaucgacauuua

SEQ ID NO: 2229478 - RNA, 16 nt, Streptococcus pyogenes MGAS8232
accauaucacaaaacc

SEQ ID NO: 2229479 - RNA, 14 nt, Streptococcus pyogenes MGAS8232
accagccacuacaa

SEQ ID NO: 2229480 - RNA, 15 nt, Streptococcus pyogenes MGAS8232
accagaugcuugcuc

SEQ ID NO: 2229481 - RNA, 18 nt, Streptococcus pyogenes MGAS8232
accaacuuggacgaaggc

SEQ ID NO: 2229482 - RNA, 18 nt, Streptococcus pyogenes MGAS8232
accaauauagcaaucuuc

SEQ ID NO: 2229483 - RNA, 15 nt, Streptococcus pyogenes MGAS8232
accaaaaccaagugc

SEQ ID NO: 2229484 - RNA, 18 nt, Streptococcus pyogenes MGAS8232
acauguccauugaugagu

SEQ ID NO: 2229485 - RNA, 20 nt, Streptococcus pyogenes MGAS8232
acauuuaugcugauuuugga

SEQ ID NO: 2229486 - RNA, 12 nt, Streptococcus pyogenes MGAS8232
acgacagcagca

SEQ ID NO: 2229487 - RNA, 23 nt, Streptococcus pyogenes MGAS8232
accuuugauaagauauuguuaau

SEQ ID NO: 2229488 - RNA, 13 nt, Streptococcus pyogenes MGAS8232
accuuugccauuu

SEQ ID NO: 2229489 - RNA, 12 nt, Streptococcus pyogenes MGAS8232
accuuugccauu

SEQ ID NO: 2229490 - RNA, 14 nt, Streptococcus pyogenes MGAS8232
accuuaaaggccuc

SEQ ID NO: 2229491 - RNA, 22 nt, Streptococcus pyogenes MGAS8232
accuuaggcagacaauuauuuu

SEQ ID NO: 2229492 - RNA, 21 nt, Streptococcus pyogenes MGAS8232
accuuaggcagacaauuauuu

SEQ ID NO: 2229493 - RNA, 18 nt, Streptococcus pyogenes MGAS8232
accuuagugguuugcaaa

SEQ ID NO: 2229494 - RNA, 18 nt, Streptococcus pyogenes MGAS8232
accuucaaccgcuucuuu

SEQ ID NO: 2229495 - RNA, 19 nt, Streptococcus pyogenes MGAS8232
accucucaugggcaaauaa

SEQ ID NO: 2229496 - RNA, 18 nt, Streptococcus pyogenes MGAS8232
accugagccgccaacaua

SEQ ID NO: 2229497 - RNA, 19 nt, Streptococcus pyogenes MGAS8232
accuccuaaacuaauaaga

SEQ ID NO: 2229498 - RNA, 18 nt, Streptococcus pyogenes MGAS8232
accuccuaaauugguuuu

SEQ ID NO: 2229499 - RNA, 16 nt, Streptococcus pyogenes MGAS8232
accuauugagucuuuu

SEQ ID NO: 2229500 - RNA, 15 nt, Streptococcus pyogenes MGAS8232
accgucacuauugaa

SEQ ID NO: 2229501 - RNA, 18 nt, Streptococcus pyogenes MGAS8232
accguuccugucgcagau

SEQ ID NO: 2229502 - RNA, 15 nt, Streptococcus pyogenes MGAS8232
accuaaaagaacgag

SEQ ID NO: 2229503 - RNA, 16 nt, Streptococcus pyogenes MGAS8232
accuacgauaaaacaa

SEQ ID NO: 2229504 - RNA, 13 nt, Streptococcus pyogenes MGAS8232
accuaauaaaaua

SEQ ID NO: 2229505 - RNA, 15 nt, Streptococcus pyogenes MGAS8232
accguaacuugcuuu

SEQ ID NO: 2229506 - RNA, 13 nt, Streptococcus pyogenes MGAS8232
aaccauugccauu

SEQ ID NO: 2229507 - RNA, 20 nt, Streptococcus pyogenes MGAS8232
aaccauuuuaugagaaaaau

SEQ ID NO: 2229508 - RNA, 14 nt, Streptococcus pyogenes MGAS8232
aaccauagaagcca

SEQ ID NO: 2229509 - RNA, 17 nt, Streptococcus pyogenes MGAS8232
aaccauagaagccaauu

SEQ ID NO: 2229510 - RNA, 19 nt, Streptococcus pyogenes MGAS8232
aaccauaucacaaaacccu

SEQ ID NO: 2229511 - RNA, 20 nt, Streptococcus pyogenes MGAS8232
aaccauaucacaaaacccuu

SEQ ID NO: 2229512 - RNA, 16 nt, Streptococcus pyogenes MGAS8232
aaccagcuuacagcug

SEQ ID NO: 2229513 - RNA, 17 nt, Streptococcus pyogenes MGAS8232
aaccgcuucuuuugcau

SEQ ID NO: 2229514 - RNA, 21 nt, Streptococcus pyogenes MGAS8232
aacccucauugucaaagcuga

SEQ ID NO: 2229515 - RNA, 17 nt, Streptococcus pyogenes MGAS8232
aacaucuugauuguaag

SEQ ID NO: 2229516 - RNA, 22 nt, Streptococcus pyogenes MGAS8232
aaccaagugccaguaaggaaau

SEQ ID NO: 2229517 - RNA, 19 nt, Streptococcus pyogenes MGAS8232
aaccaauuguugaauaagu

SEQ ID NO: 2229518 - RNA, 12 nt, Streptococcus pyogenes MGAS8232
aacaguuccagu

SEQ ID NO: 2229519 - RNA, 12 nt, Streptococcus pyogenes MGAS8232
aacauaacaauc

SEQ ID NO: 2229520 - RNA, 22 nt, Streptococcus pyogenes MGAS8232
aacagcugcuugaaaagaugca

SEQ ID NO: 2229521 - RNA, 15 nt, Streptococcus pyogenes MGAS8232
aacagauaagugcca

SEQ ID NO: 2229522 - RNA, 19 nt, Streptococcus pyogenes MGAS8232
aacagauagucaaaaagac

SEQ ID NO: 2229523 - RNA, 18 nt, Streptococcus pyogenes MGAS8232
aacagauagucaaaaaga

SEQ ID NO: 2229524 - RNA, 13 nt, Streptococcus pyogenes MGAS8232
aacacucaucaua

SEQ ID NO: 2229525 - RNA, 14 nt, Streptococcus pyogenes MGAS8232
aacacguauuuuuc

SEQ ID NO: 2229526 - RNA, 20 nt, Streptococcus pyogenes MGAS8232
aacaccaccaauaaugagca

SEQ ID NO: 2229527 - RNA, 20 nt, Streptococcus pyogenes MGAS8232
aacaccccccccgcuuuuaa

SEQ ID NO: 2229528 - RNA, 23 nt, Streptococcus pyogenes MGAS8232
aacaccccccccgcuuuuaagcu

SEQ ID NO: 2229529 - RNA, 15 nt, Streptococcus pyogenes MGAS8232
aacaauaacacagaa

SEQ ID NO: 2229530 - RNA, 23 nt, Streptococcus pyogenes MGAS8232
aacaauacuaugaucuccaaaga

SEQ ID NO: 2229531 - RNA, 18 nt, Streptococcus pyogenes MGAS8232
aacaaugagaucuucuuu

SEQ ID NO: 2229532 - RNA, 14 nt, Streptococcus pyogenes MGAS8232
aacaaaaugaagca

SEQ ID NO: 2229533 - RNA, 16 nt, Streptococcus pyogenes MGAS8232
aacaaaacaaaacaaa

SEQ ID NO: 2229534 - RNA, 11 nt, Streptococcus pyogenes MGAS8232
aacaaaacaua

SEQ ID NO: 2229535 - RNA, 14 nt, Streptococcus pyogenes MGAS8232
aacaaauaauuccu

SEQ ID NO: 2229536 - RNA, 13 nt, Streptococcus pyogenes MGAS8232
aacaaauccuuuu

SEQ ID NO: 2229537 - RNA, 16 nt, Streptococcus pyogenes MGAS8232
aacaaauccuuuugcu

SEQ ID NO: 2229538 - RNA, 13 nt, Streptococcus pyogenes MGAS8232
aacaagccauaaa

SEQ ID NO: 2229539 - RNA, 20 nt, Streptococcus pyogenes MGAS8232
aaauuuauccugaucccuuc

SEQ ID NO: 2229540 - RNA, 12 nt, Streptococcus pyogenes MGAS8232
aaauuuuaaaug

SEQ ID NO: 2229541 - RNA, 22 nt, Streptococcus pyogenes MGAS8232
aaauugguccucugaaaaguug

SEQ ID NO: 2229542 - RNA, 17 nt, Streptococcus pyogenes MGAS8232
aaauuguaaccacagca

SEQ ID NO: 2229543 - RNA, 23 nt, Streptococcus pyogenes MGAS8232
aagaacuccuggauuaaaugccc

SEQ ID NO: 2229544 - RNA, 12 nt, Streptococcus pyogenes MGAS8232
aagaagcaaaau

SEQ ID NO: 2229545 - RNA, 22 nt, Streptococcus pyogenes MGAS8232
aagaaggaacucuccaaaguuc

SEQ ID NO: 2229546 - RNA, 17 nt, Streptococcus pyogenes MGAS8232
aacuugggaaugaugcu

SEQ ID NO: 2229547 - RNA, 18 nt, Streptococcus pyogenes MGAS8232
aacuugggagaguuccug

SEQ ID NO: 2229548 - RNA, 21 nt, Streptococcus pyogenes MGAS8232
aacuugggagaguuccugcau

SEQ ID NO: 2229549 - RNA, 22 nt, Streptococcus pyogenes MGAS8232
aacuugaauaucgccaauaaaa

SEQ ID NO: 2229550 - RNA, 22 nt, Streptococcus pyogenes MGAS8232
aacuugcaucgcaaacagaugc

SEQ ID NO: 2229551 - RNA, 17 nt, Streptococcus pyogenes MGAS8232
aacuucaaauuucauga

SEQ ID NO: 2229552 - RNA, 14 nt, Streptococcus pyogenes MGAS8232
aacuuacaaaaagc

SEQ ID NO: 2229553 - RNA, 22 nt, Streptococcus pyogenes MGAS8232
aacuguuuuucuuauauugugc

SEQ ID NO: 2229554 - RNA, 17 nt, Streptococcus pyogenes MGAS8232
aacuguuuuucuuauau

SEQ ID NO: 2229555 - RNA, 19 nt, Streptococcus pyogenes MGAS8232
aacucuccaaaguucuucu

SEQ ID NO: 2229556 - RNA, 15 nt, Streptococcus pyogenes MGAS8232
aacucucauaaaauu

SEQ ID NO: 2229557 - RNA, 20 nt, Streptococcus pyogenes MGAS8232
aacuccuggauuaaaugccc

SEQ ID NO: 2229558 - RNA, 19 nt, Streptococcus pyogenes MGAS8232
aacucgauaaaaacgauca

SEQ ID NO: 2229559 - RNA, 16 nt, Streptococcus pyogenes MGAS8232
aacuccuuaaauuaua

SEQ ID NO: 2229560 - RNA, 16 nt, Streptococcus pyogenes MGAS8232
aacucaaacuaaacaa

SEQ ID NO: 2229561 - RNA, 14 nt, Streptococcus pyogenes MGAS8232
aacuauuuaacuua

SEQ ID NO: 2229562 - RNA, 18 nt, Streptococcus pyogenes MGAS8232
aacuaucaaguaugcuuu

SEQ ID NO: 2229563 - RNA, 20 nt, Streptococcus pyogenes MGAS8232
aacuauauuguuaguuuuau

SEQ ID NO: 2229564 - RNA, 21 nt, Streptococcus pyogenes MGAS8232
aacuauauuguuaguuuuauc

SEQ ID NO: 2229565 - RNA, 20 nt, Streptococcus pyogenes MGAS8232
aacguguauucuuaaaaaaa

SEQ ID NO: 2229566 - RNA, 15 nt, Streptococcus pyogenes MGAS8232
aacguuaacaaaaau

SEQ ID NO: 2229567 - RNA, 17 nt, Streptococcus pyogenes MGAS8232
aacguuauuaaagacaa

SEQ ID NO: 2229568 - RNA, 16 nt, Streptococcus pyogenes MGAS8232
aacgugagaaaauuuu

SEQ ID NO: 2229569 - RNA, 20 nt, Streptococcus pyogenes MGAS8232
aacgucagcggcugcucuuu

SEQ ID NO: 2229570 - RNA, 13 nt, Streptococcus pyogenes MGAS8232
aacggaguuccuc

SEQ ID NO: 2229571 - RNA, 22 nt, Streptococcus pyogenes MGAS8232
aacgcuaugcucguaggacacu

SEQ ID NO: 2229572 - RNA, 22 nt, Streptococcus pyogenes MGAS8232
aaccguuccugucgcagauggg

SEQ ID NO: 2229573 - RNA, 19 nt, Streptococcus pyogenes MGAS8232
aaccugucccuaaccgcuu

SEQ ID NO: 2229574 - RNA, 11 nt, Streptococcus pyogenes MGAS8232
aaccuuaaaga

SEQ ID NO: 2229575 - RNA, 13 nt, Streptococcus pyogenes MGAS8232
aaccuuugccauu

SEQ ID NO: 2229576 - RNA, 23 nt, Streptococcus pyogenes MGAS8232
aaugaaacguuauuaaagacaaa

SEQ ID NO: 2229577 - RNA, 21 nt, Streptococcus pyogenes MGAS8232
aaucuuuucuauuuaaccuuc

SEQ ID NO: 2229578 - RNA, 14 nt, Streptococcus pyogenes MGAS8232
aaugaaaaaacuca

SEQ ID NO: 2229579 - RNA, 18 nt, Streptococcus pyogenes MGAS8232
aaucuguauuccauacuu

SEQ ID NO: 2229580 - RNA, 20 nt, Streptococcus pyogenes MGAS8232
aaugagcaaggcaagaggag

SEQ ID NO: 2229581 - RNA, 13 nt, Streptococcus pyogenes MGAS8232
aaugagcaaggca

SEQ ID NO: 2229582 - RNA, 19 nt, Streptococcus pyogenes MGAS8232
aaugauuuuuaauucuucu

SEQ ID NO: 2229583 - RNA, 16 nt, Streptococcus pyogenes MGAS8232
aaugcaaaaaagcucu

SEQ ID NO: 2229584 - RNA, 20 nt, Streptococcus pyogenes MGAS8232
aauggaaauuuuaaaugaca

SEQ ID NO: 2229585 - RNA, 18 nt, Streptococcus pyogenes MGAS8232
aaugguuuuuugucuucu

SEQ ID NO: 2229586 - RNA, 21 nt, Streptococcus pyogenes MGAS8232
aaucccuugcuuugauuuuuc

SEQ ID NO: 2229587 - RNA, 14 nt, Streptococcus pyogenes MGAS8232
aauccucucacaaa

SEQ ID NO: 2229588 - RNA, 21 nt, Streptococcus pyogenes MGAS8232
aauaugugauuauuauucuaa

SEQ ID NO: 2229589 - RNA, 22 nt, Streptococcus pyogenes MGAS8232
aauaugugauuauuauucuaaa

SEQ ID NO: 2229590 - RNA, 20 nt, Streptococcus pyogenes MGAS8232
aaucauuacuccuuugacca

SEQ ID NO: 2229591 - RNA, 22 nt, Streptococcus pyogenes MGAS8232
aauuauuaacguuaacaaaaau

SEQ ID NO: 2229592 - RNA, 18 nt, Streptococcus pyogenes MGAS8232
aauuaucugaauuauuag

SEQ ID NO: 2229593 - RNA, 19 nt, Streptococcus pyogenes MGAS8232
aauuagcauauuuugauua

SEQ ID NO: 2229594 - RNA, 23 nt, Streptococcus pyogenes MGAS8232
aauuguagggauuuuuuuaacua

SEQ ID NO: 2229595 - RNA, 17 nt, Streptococcus pyogenes MGAS8232
aauuguaaccacagcaa

SEQ ID NO: 2229596 - RNA, 14 nt, Streptococcus pyogenes MGAS8232
aauugugucauuuc

SEQ ID NO: 2229597 - RNA, 19 nt, Streptococcus pyogenes MGAS8232
aauuguuuuaguaaagccu

SEQ ID NO: 2229598 - RNA, 13 nt, Streptococcus pyogenes MGAS8232
aauuguugaauaa

SEQ ID NO: 2229599 - RNA, 16 nt, Streptococcus pyogenes MGAS8232
aauuuauuccauuuau

SEQ ID NO: 2229600 - RNA, 18 nt, Streptococcus pyogenes MGAS8232
aauuucaauaauaccauu

SEQ ID NO: 2229601 - RNA, 20 nt, Streptococcus pyogenes MGAS8232
aauucuuuuauuaauguaaa

SEQ ID NO: 2229602 - RNA, 23 nt, Streptococcus pyogenes MGAS8232
aauucuuccuuagcgaaagcuuc

SEQ ID NO: 2229603 - RNA, 14 nt, Streptococcus pyogenes MGAS8232
aagggaagaagauc

SEQ ID NO: 2229604 - RNA, 23 nt, Streptococcus pyogenes MGAS8232
aagggaagaagauccuacaagag

SEQ ID NO: 2229605 - RNA, 19 nt, Streptococcus pyogenes MGAS8232
aaggcuaaggcuuacgaca

SEQ ID NO: 2229606 - RNA, 15 nt, Streptococcus pyogenes MGAS8232
aaggaugaaaugauu

SEQ ID NO: 2229607 - RNA, 16 nt, Streptococcus pyogenes MGAS8232
aagggugaaucauuac

SEQ ID NO: 2229608 - RNA, 14 nt, Streptococcus pyogenes MGAS8232
aaguaaaggauuua

SEQ ID NO: 2229609 - RNA, 14 nt, Streptococcus pyogenes MGAS8232
aaguagauacuucg

SEQ ID NO: 2229610 - RNA, 16 nt, Streptococcus pyogenes MGAS8232
aaguauaguuauguua

SEQ ID NO: 2229611 - RNA, 17 nt, Streptococcus pyogenes MGAS8232
aaguagcguacauggau

SEQ ID NO: 2229612 - RNA, 19 nt, Streptococcus pyogenes MGAS8232
aaguagcguacauggaugc

SEQ ID NO: 2229613 - RNA, 16 nt, Streptococcus pyogenes MGAS8232
aaguagucaaaauagg

SEQ ID NO: 2229614 - RNA, 13 nt, Streptococcus pyogenes MGAS8232
aagucucuugcaa

SEQ ID NO: 2229615 - RNA, 20 nt, Streptococcus pyogenes MGAS8232
aaguuauaaagaaacaaaaa

SEQ ID NO: 2229616 - RNA, 21 nt, Streptococcus pyogenes MGAS8232
aagugugacuaguuuauuaca

SEQ ID NO: 2229617 - RNA, 23 nt, Streptococcus pyogenes MGAS8232
aagucuuagcaccgcuuacccua

SEQ ID NO: 2229618 - RNA, 16 nt, Streptococcus pyogenes MGAS8232
aagugauacuugguau

SEQ ID NO: 2229619 - RNA, 21 nt, Streptococcus pyogenes MGAS8232
aagcguugacaguuaaaaaua

SEQ ID NO: 2229620 - RNA, 18 nt, Streptococcus pyogenes MGAS8232
aaggaccaagauucauga

SEQ ID NO: 2229621 - RNA, 22 nt, Streptococcus pyogenes MGAS8232
aagcuuggauugccgccaugcu

SEQ ID NO: 2229622 - RNA, 18 nt, Streptococcus pyogenes MGAS8232
aagcuuuuuuauaacugu

SEQ ID NO: 2229623 - RNA, 17 nt, Streptococcus pyogenes MGAS8232
aagcugagcaaaacaau

SEQ ID NO: 2229624 - RNA, 15 nt, Streptococcus pyogenes MGAS8232
aagcugagcaaaaca

SEQ ID NO: 2229625 - RNA, 15 nt, Streptococcus pyogenes MGAS8232
aagaaggucaugaug

SEQ ID NO: 2229626 - RNA, 15 nt, Streptococcus pyogenes MGAS8232
aagaaggucucaaau

SEQ ID NO: 2229627 - RNA, 15 nt, Streptococcus pyogenes MGAS8232
aagaaguugagacua

SEQ ID NO: 2229628 - RNA, 22 nt, Streptococcus pyogenes MGAS8232
aagccagagcaguucagcagca

SEQ ID NO: 2229629 - RNA, 16 nt, Streptococcus pyogenes MGAS8232
aagccauaaacaagug

SEQ ID NO: 2229630 - RNA, 22 nt, Streptococcus pyogenes MGAS8232
aagccgugaggacuuauuuuuu

SEQ ID NO: 2229631 - RNA, 15 nt, Streptococcus pyogenes MGAS8232
aagccgugaggacuu

SEQ ID NO: 2229632 - RNA, 17 nt, Streptococcus pyogenes MGAS8232
aauagcaaugguuaaaa

SEQ ID NO: 2229633 - RNA, 20 nt, Streptococcus pyogenes MGAS8232
aauagcaaugguuaaaaaga

SEQ ID NO: 2229634 - RNA, 21 nt, Streptococcus pyogenes MGAS8232
aauagcaaugguuaaaaagag

SEQ ID NO: 2229635 - RNA, 18 nt, Streptococcus pyogenes MGAS8232
aauagguaaagauuuuaa

SEQ ID NO: 2229636 - RNA, 14 nt, Streptococcus pyogenes MGAS8232
aauaucaggcaaaa

SEQ ID NO: 2229637 - RNA, 13 nt, Streptococcus pyogenes MGAS8232
aauaagaaaaccu

SEQ ID NO: 2229638 - RNA, 13 nt, Streptococcus pyogenes MGAS8232
aauaacuuuaaaa

SEQ ID NO: 2229639 - RNA, 19 nt, Streptococcus pyogenes MGAS8232
aauaagauucaauaugaaa

SEQ ID NO: 2229640 - RNA, 22 nt, Streptococcus pyogenes MGAS8232
aauaacagaaauuaauaaauuu

SEQ ID NO: 2229641 - RNA, 18 nt, Streptococcus pyogenes MGAS8232
aauaacagaaauuaauaa

SEQ ID NO: 2229642 - RNA, 12 nt, Streptococcus pyogenes MGAS8232
aauaacaucaaa

SEQ ID NO: 2229643 - RNA, 20 nt, Streptococcus pyogenes MGAS8232
aauaacaucuugauuguaag

SEQ ID NO: 2229644 - RNA, 24 nt, Streptococcus pyogenes MGAS8232
aauaacccgucuuacaauuaauag

SEQ ID NO: 2229645 - RNA, 20 nt, Streptococcus pyogenes MGAS8232
aaguugagacuaaaggucug

SEQ ID NO: 2229646 - RNA, 19 nt, Streptococcus pyogenes MGAS8232
aauaauacagcauacauca

SEQ ID NO: 2229647 - RNA, 15 nt, Streptococcus pyogenes MGAS8232
aauaaguauuuuaaa

SEQ ID NO: 2229648 - RNA, 18 nt, Streptococcus pyogenes MGAS8232
aauaaguauuuuaaaauc

SEQ ID NO: 2229649 - RNA, 21 nt, Streptococcus pyogenes MGAS8232
aauaaguauagcauaaaauag

SEQ ID NO: 2229650 - RNA, 22 nt, Streptococcus pyogenes MGAS8232
aauaaugagcaaggcaagagga

SEQ ID NO: 2229651 - RNA, 20 nt, Streptococcus pyogenes MGAS8232
uuggugacaauagcgaaaaa

SEQ ID NO: 2229652 - RNA, 14 nt, Streptococcus pyogenes MGAS8232
uugguaaaaaggca

SEQ ID NO: 2229653 - RNA, 20 nt, Streptococcus pyogenes MGAS8232
uuggccuacuagcacaaaau

SEQ ID NO: 2229654 - RNA, 23 nt, Streptococcus pyogenes MGAS8232
uuggccaauaaaauaucuagaac

SEQ ID NO: 2229655 - RNA, 23 nt, Streptococcus pyogenes MGAS8232
uugggacuuuucagucuucugua

SEQ ID NO: 2229656 - RNA, 22 nt, Streptococcus pyogenes MGAS8232
uuggcuacucuauuugaaguaa

SEQ ID NO: 2229657 - RNA, 15 nt, Streptococcus pyogenes MGAS8232
uugcuuaaugaccuu

SEQ ID NO: 2229658 - RNA, 17 nt, Streptococcus pyogenes MGAS8232
uugcuuauagcuaccua

SEQ ID NO: 2229659 - RNA, 14 nt, Streptococcus pyogenes MGAS8232
uugcuuuuuaauug

SEQ ID NO: 2229660 - RNA, 12 nt, Streptococcus pyogenes MGAS8232
uuggauccuuua

SEQ ID NO: 2229661 - RNA, 13 nt, Streptococcus pyogenes MGAS8232
uuggaaaaggaau

SEQ ID NO: 2229662 - RNA, 13 nt, Streptococcus pyogenes MGAS8232
uugccauuuaauu

SEQ ID NO: 2229663 - RNA, 14 nt, Streptococcus pyogenes MGAS8232
uugccuuuaacaug

SEQ ID NO: 2229664 - RNA, 16 nt, Streptococcus pyogenes MGAS8232
uugcaucgcaaacaga

SEQ ID NO: 2229665 - RNA, 20 nt, Streptococcus pyogenes MGAS8232
uugcagaggcuugcauuuuu

SEQ ID NO: 2229666 - RNA, 15 nt, Streptococcus pyogenes MGAS8232
uugagccuuuucuuu

SEQ ID NO: 2229667 - RNA, 17 nt, Streptococcus pyogenes MGAS8232
uucuuggaaaacagaaa

SEQ ID NO: 2229668 - RNA, 19 nt, Streptococcus pyogenes MGAS8232
uucuugugcuaaucuaucu

SEQ ID NO: 2229669 - RNA, 18 nt, Streptococcus pyogenes MGAS8232
uuuauauuauguucuaaa

SEQ ID NO: 2229670 - RNA, 18 nt, Streptococcus pyogenes MGAS8232
uuuacuauggcuucuaaa

SEQ ID NO: 2229671 - RNA, 19 nt, Streptococcus pyogenes MGAS8232
uuuacggcuucuacacaaa

SEQ ID NO: 2229672 - RNA, 22 nt, Streptococcus pyogenes MGAS8232
uuuaauagcauugucaaauaaa

SEQ ID NO: 2229673 - RNA, 14 nt, Streptococcus pyogenes MGAS8232
uuuaagacaacaua

SEQ ID NO: 2229674 - RNA, 17 nt, Streptococcus pyogenes MGAS8232
uuuaagcugagcaaaac

SEQ ID NO: 2229675 - RNA, 14 nt, Streptococcus pyogenes MGAS8232
uuuaaguagucaaa

SEQ ID NO: 2229676 - RNA, 22 nt, Streptococcus pyogenes MGAS8232
uuguauuacucaauuaauguua

SEQ ID NO: 2229677 - RNA, 12 nt, Streptococcus pyogenes MGAS8232
uuguauagguag

SEQ ID NO: 2229678 - RNA, 22 nt, Streptococcus pyogenes MGAS8232
uuguacaagagcuuaaaaguua

SEQ ID NO: 2229679 - RNA, 18 nt, Streptococcus pyogenes MGAS8232
uuguaguaggugacacua

SEQ ID NO: 2229680 - RNA, 20 nt, Streptococcus pyogenes MGAS8232
uuguagggauuuuuuuaacu

SEQ ID NO: 2229681 - RNA, 14 nt, Streptococcus pyogenes MGAS8232
uuguaaaaugaucc

SEQ ID NO: 2229682 - RNA, 19 nt, Streptococcus pyogenes MGAS8232
uuguuuuaguaaagccuua

SEQ ID NO: 2229683 - RNA, 22 nt, Streptococcus pyogenes MGAS8232
uuguggcgggccuucuaucaaa

SEQ ID NO: 2229684 - RNA, 14 nt, Streptococcus pyogenes MGAS8232
uugucuuauagaau

SEQ ID NO: 2229685 - RNA, 12 nt, Streptococcus pyogenes MGAS8232
uugugacuauau

SEQ ID NO: 2229686 - RNA, 22 nt, Streptococcus pyogenes MGAS8232
uugugauuaguuuuuagcagca

SEQ ID NO: 2229687 - RNA, 15 nt, Streptococcus pyogenes MGAS8232
uucuacuauugcaug

SEQ ID NO: 2229688 - RNA, 12 nt, Streptococcus pyogenes MGAS8232
uucuaaaaaaaa

SEQ ID NO: 2229689 - RNA, 12 nt, Streptococcus pyogenes MGAS8232
uucucaaaaaua

SEQ ID NO: 2229690 - RNA, 18 nt, Streptococcus pyogenes MGAS8232
uucugucuacuuauuuga

SEQ ID NO: 2229691 - RNA, 14 nt, Streptococcus pyogenes MGAS8232
uucuggugcaaggc

SEQ ID NO: 2229692 - RNA, 18 nt, Streptococcus pyogenes MGAS8232
uucguugacaaagccauu

SEQ ID NO: 2229693 - RNA, 21 nt, Streptococcus pyogenes MGAS8232
uucguugacaacaauauguga

SEQ ID NO: 2229694 - RNA, 19 nt, Streptococcus pyogenes MGAS8232
uucgacucaugauauccca

SEQ ID NO: 2229695 - RNA, 18 nt, Streptococcus pyogenes MGAS8232
uucccuuaauaaacugua

SEQ ID NO: 2229696 - RNA, 19 nt, Streptococcus pyogenes MGAS8232
uucaugauguuauuaaaua

SEQ ID NO: 2229697 - RNA, 13 nt, Streptococcus pyogenes MGAS8232
uucauguuuaaaa

SEQ ID NO: 2229698 - RNA, 15 nt, Streptococcus pyogenes MGAS8232
uucaucuugcauuac

SEQ ID NO: 2229699 - RNA, 13 nt, Streptococcus pyogenes MGAS8232
uucauuuucuucu

SEQ ID NO: 2229700 - RNA, 23 nt, Streptococcus pyogenes MGAS8232
uucauuuguaacuccuuaaauua

SEQ ID NO: 2229701 - RNA, 15 nt, Streptococcus pyogenes MGAS8232
uucauagaagacgga

SEQ ID NO: 2229702 - RNA, 22 nt, Streptococcus pyogenes MGAS8232
uucauagaagacggaguauuuu

SEQ ID NO: 2229703 - RNA, 18 nt, Streptococcus pyogenes MGAS8232
uucaucgaugauagcuuu

SEQ ID NO: 2229704 - RNA, 14 nt, Streptococcus pyogenes MGAS8232
uucaguuaaacuga

SEQ ID NO: 2229705 - RNA, 23 nt, Streptococcus pyogenes MGAS8232
uucagauaagaccuucaaaaaag

SEQ ID NO: 2229706 - RNA, 13 nt, Streptococcus pyogenes MGAS8232
uuauuauucuaaa

SEQ ID NO: 2229707 - RNA, 21 nt, Streptococcus pyogenes MGAS8232
uuauuuugcagguaauuaucu

SEQ ID NO: 2229708 - RNA, 20 nt, Streptococcus pyogenes MGAS8232
uuauuuucuagguuaaaaua

SEQ ID NO: 2229709 - RNA, 18 nt, Streptococcus pyogenes MGAS8232
uucaaagggagauucuua

SEQ ID NO: 2229710 - RNA, 19 nt, Streptococcus pyogenes MGAS8232
uucaacaaauccuuuugcu

SEQ ID NO: 2229711 - RNA, 13 nt, Streptococcus pyogenes MGAS8232
uggauuuccucua

SEQ ID NO: 2229712 - RNA, 18 nt, Streptococcus pyogenes MGAS8232
ugggauauuuagauggua

SEQ ID NO: 2229713 - RNA, 21 nt, Streptococcus pyogenes MGAS8232
uggcuuuuuugcuuuuuaauu

SEQ ID NO: 2229714 - RNA, 15 nt, Streptococcus pyogenes MGAS8232
uggcuucuaaaaaaa

SEQ ID NO: 2229715 - RNA, 20 nt, Streptococcus pyogenes MGAS8232
ugugccuaauccucucacaa

SEQ ID NO: 2229716 - RNA, 21 nt, Streptococcus pyogenes MGAS8232
ugucuuagccuuuuuuugucu

SEQ ID NO: 2229717 - RNA, 13 nt, Streptococcus pyogenes MGAS8232
ugucuacuuauuu

SEQ ID NO: 2229718 - RNA, 15 nt, Streptococcus pyogenes MGAS8232
uguaugcuguccaug

SEQ ID NO: 2229719 - RNA, 14 nt, Streptococcus pyogenes MGAS8232
ugucaaauaaaauc

SEQ ID NO: 2229720 - RNA, 19 nt, Streptococcus pyogenes MGAS8232
uguagggauuuuuuuaacu

SEQ ID NO: 2229721 - RNA, 21 nt, Streptococcus pyogenes MGAS8232
uguagguaauagcguaaagca

SEQ ID NO: 2229722 - RNA, 13 nt, Streptococcus pyogenes MGAS8232
uguauagguagau

SEQ ID NO: 2229723 - RNA, 18 nt, Streptococcus pyogenes MGAS8232
uguauacaaaaaggcuaa

SEQ ID NO: 2229724 - RNA, 14 nt, Streptococcus pyogenes MGAS8232
ugguuuuuuuaauu

SEQ ID NO: 2229725 - RNA, 14 nt, Streptococcus pyogenes MGAS8232
ugguuuuuuugucu

SEQ ID NO: 2229726 - RNA, 12 nt, Streptococcus pyogenes MGAS8232
uguaaaauuuau

SEQ ID NO: 2229727 - RNA, 20 nt, Streptococcus pyogenes MGAS8232
uguaacgcuuguuuaugaaa

SEQ ID NO: 2229728 - RNA, 19 nt, Streptococcus pyogenes MGAS8232
uguaacgcuuguuuaugaa

SEQ ID NO: 2229729 - RNA, 21 nt, Streptococcus pyogenes MGAS8232
uguaacuguagcguuuguguu

SEQ ID NO: 2229730 - RNA, 22 nt, Streptococcus pyogenes MGAS8232
uguaacuccuuaaauuauagua

SEQ ID NO: 2229731 - RNA, 24 nt, Streptococcus pyogenes MGAS8232
uguaauuucuugugcuaaucuauc

SEQ ID NO: 2229732 - RNA, 14 nt, Streptococcus pyogenes MGAS8232
uguaaugaccaccc

SEQ ID NO: 2229733 - RNA, 18 nt, Streptococcus pyogenes MGAS8232
uguuuaaucuuuguuucu

SEQ ID NO: 2229734 - RNA, 16 nt, Streptococcus pyogenes MGAS8232
uguugucucagacucu

SEQ ID NO: 2229735 - RNA, 15 nt, Streptococcus pyogenes MGAS8232
uguugucaaacauaa

SEQ ID NO: 2229736 - RNA, 16 nt, Streptococcus pyogenes MGAS8232
uguucuuuauuuugau

SEQ ID NO: 2229737 - RNA, 17 nt, Streptococcus pyogenes MGAS8232
uguucuuuauuuugaua

SEQ ID NO: 2229738 - RNA, 18 nt, Streptococcus pyogenes MGAS8232
uguucugguuuaucauuu

SEQ ID NO: 2229739 - RNA, 17 nt, Streptococcus pyogenes MGAS8232
uguucauuuagugguau

SEQ ID NO: 2229740 - RNA, 22 nt, Streptococcus pyogenes MGAS8232
uguucuaaaaaagcucuaucau

SEQ ID NO: 2229741 - RNA, 22 nt, Streptococcus pyogenes MGAS8232
uguuauuggaaaguaaggguua

SEQ ID NO: 2229742 - RNA, 21 nt, Streptococcus pyogenes MGAS8232
uguuaucccuggaccauuauc

SEQ ID NO: 2229743 - RNA, 21 nt, Streptococcus pyogenes MGAS8232
uguuauaagauaaguaauauu

SEQ ID NO: 2229744 - RNA, 18 nt, Streptococcus pyogenes MGAS8232
uuaaaagaaaaucuaauc

SEQ ID NO: 2229745 - RNA, 12 nt, Streptococcus pyogenes MGAS8232
uuaaaagaaaau

SEQ ID NO: 2229746 - RNA, 20 nt, Streptococcus pyogenes MGAS8232
uuaaaaaauauuguaaauca

SEQ ID NO: 2229747 - RNA, 14 nt, Streptococcus pyogenes MGAS8232
uuaaagacaaaaaa

SEQ ID NO: 2229748 - RNA, 15 nt, Streptococcus pyogenes MGAS8232
uuaaagacaaaaaaa

SEQ ID NO: 2229749 - RNA, 18 nt, Streptococcus pyogenes MGAS8232
uuaaagagaaagaggaaa

SEQ ID NO: 2229750 - RNA, 17 nt, Streptococcus pyogenes MGAS8232
uuaaacuuccaaaccau

SEQ ID NO: 2229751 - RNA, 16 nt, Streptococcus pyogenes MGAS8232
uguuuugucuuauaga

SEQ ID NO: 2229752 - RNA, 23 nt, Streptococcus pyogenes MGAS8232
uuaaugaccuuugauaagauauu

SEQ ID NO: 2229753 - RNA, 18 nt, Streptococcus pyogenes MGAS8232
uuaaucuuuguuucuaua

SEQ ID NO: 2229754 - RNA, 14 nt, Streptococcus pyogenes MGAS8232
uuaccuuauuuucu

SEQ ID NO: 2229755 - RNA, 17 nt, Streptococcus pyogenes MGAS8232
uuacgauuaaaagaugu

SEQ ID NO: 2229756 - RNA, 14 nt, Streptococcus pyogenes MGAS8232
uuacgauuaaaaga

SEQ ID NO: 2229757 - RNA, 12 nt, Streptococcus pyogenes MGAS8232
uuagccuuuuuu

SEQ ID NO: 2229758 - RNA, 17 nt, Streptococcus pyogenes MGAS8232
uuagccguccuuaaaag

SEQ ID NO: 2229759 - RNA, 14 nt, Streptococcus pyogenes MGAS8232
uuagccugccagcc

SEQ ID NO: 2229760 - RNA, 19 nt, Streptococcus pyogenes MGAS8232
uuagcaaaaugcuguuugu

SEQ ID NO: 2229761 - RNA, 14 nt, Streptococcus pyogenes MGAS8232
uuagaauagucuau

SEQ ID NO: 2229762 - RNA, 21 nt, Streptococcus pyogenes MGAS8232
uuacuucuaagagccaaaaua

SEQ ID NO: 2229763 - RNA, 19 nt, Streptococcus pyogenes MGAS8232
uuacuguauaaacuuguug

SEQ ID NO: 2229764 - RNA, 21 nt, Streptococcus pyogenes MGAS8232
uuacuauggcuucuaaaaaaa

SEQ ID NO: 2229765 - RNA, 17 nt, Streptococcus pyogenes MGAS8232
uuacuaugaaaaaagaa

SEQ ID NO: 2229766 - RNA, 19 nt, Streptococcus pyogenes MGAS8232
uuacguccuguuugugaug

SEQ ID NO: 2229767 - RNA, 20 nt, Streptococcus pyogenes MGAS8232
uuaauaaacuguauacaaaa

SEQ ID NO: 2229768 - RNA, 13 nt, Streptococcus pyogenes MGAS8232
uuaauaaaagauu

SEQ ID NO: 2229769 - RNA, 20 nt, Streptococcus pyogenes MGAS8232
uuaaggauuaugaaaaagaa

SEQ ID NO: 2229770 - RNA, 15 nt, Streptococcus pyogenes MGAS8232
uuaaggauuuagcug

SEQ ID NO: 2229771 - RNA, 20 nt, Streptococcus pyogenes MGAS8232
uuaaguaaaggauuuaguuu

SEQ ID NO: 2229772 - RNA, 16 nt, Streptococcus pyogenes MGAS8232
uuaaguagucaaaaua

SEQ ID NO: 2229773 - RNA, 21 nt, Streptococcus pyogenes MGAS8232
uuaagauuaaacuuacaaaaa

SEQ ID NO: 2229774 - RNA, 15 nt, Streptococcus pyogenes MGAS8232
uuaacugguaaagca

SEQ ID NO: 2229775 - RNA, 17 nt, Streptococcus pyogenes MGAS8232
uuaacuuauuauuuugg

SEQ ID NO: 2229776 - RNA, 17 nt, Streptococcus pyogenes MGAS8232
uuaacaaugaaacguua

SEQ ID NO: 2229777 - RNA, 19 nt, Streptococcus pyogenes MGAS8232
uuaaauguccgaaaaaaac

SEQ ID NO: 2229778 - RNA, 12 nt, Streptococcus pyogenes MGAS8232
ucuaucugcaga

SEQ ID NO: 2229779 - RNA, 15 nt, Streptococcus pyogenes MGAS8232
ucuaucaaaacguua

SEQ ID NO: 2229780 - RNA, 18 nt, Streptococcus pyogenes MGAS8232
ucuauauguguaauuucu

SEQ ID NO: 2229781 - RNA, 22 nt, Streptococcus pyogenes MGAS8232
ucuauagcauuaaggauuauga

SEQ ID NO: 2229782 - RNA, 13 nt, Streptococcus pyogenes MGAS8232
aaaugauagcacc

SEQ ID NO: 2229783 - RNA, 13 nt, Streptococcus pyogenes MGAS8232
aaaugauccuuuc

SEQ ID NO: 2229784 - RNA, 20 nt, Streptococcus pyogenes MGAS8232
ucuagucagaucauuaaauu

SEQ ID NO: 2229785 - RNA, 13 nt, Streptococcus pyogenes MGAS8232
aaaugcaaaaaag

SEQ ID NO: 2229786 - RNA, 17 nt, Streptococcus pyogenes MGAS8232
aaaugccaaucuuugug

SEQ ID NO: 2229787 - RNA, 20 nt, Streptococcus pyogenes MGAS8232
aaaugccuccgacaaucgaa

SEQ ID NO: 2229788 - RNA, 14 nt, Streptococcus pyogenes MGAS8232
ucucauaacaaauu

SEQ ID NO: 2229789 - RNA, 16 nt, Streptococcus pyogenes MGAS8232
ucucauaacaaauuua

SEQ ID NO: 2229790 - RNA, 15 nt, Streptococcus pyogenes MGAS8232
ucucauaaacaauga

SEQ ID NO: 2229791 - RNA, 22 nt, Streptococcus pyogenes MGAS8232
ucuauuugaaguaaaggauuua

SEQ ID NO: 2229792 - RNA, 15 nt, Streptococcus pyogenes MGAS8232
ucuauuuuaaguaaa

SEQ ID NO: 2229793 - RNA, 20 nt, Streptococcus pyogenes MGAS8232
ucucaaaaauauauucuaau

SEQ ID NO: 2229794 - RNA, 16 nt, Streptococcus pyogenes MGAS8232
ucuauuuuugguguua

SEQ ID NO: 2229795 - RNA, 18 nt, Streptococcus pyogenes MGAS8232
ucuaauuuagucauuucu

SEQ ID NO: 2229796 - RNA, 19 nt, Streptococcus pyogenes MGAS8232
ucuaauuagcauauuuuga

SEQ ID NO: 2229797 - RNA, 14 nt, Streptococcus pyogenes MGAS8232
aaaugacuucaaaa

SEQ ID NO: 2229798 - RNA, 17 nt, Streptococcus pyogenes MGAS8232
aaaugacuucaaaauca

SEQ ID NO: 2229799 - RNA, 19 nt, Streptococcus pyogenes MGAS8232
ucuacuaaaacgugagaaa

SEQ ID NO: 2229800 - RNA, 19 nt, Streptococcus pyogenes MGAS8232
ucuaagcuauagaaacuuu

SEQ ID NO: 2229801 - RNA, 19 nt, Streptococcus pyogenes MGAS8232
aaaugaagcaaaauaaacu

SEQ ID NO: 2229802 - RNA, 17 nt, Streptococcus pyogenes MGAS8232
aaaugaagcugaagcua

SEQ ID NO: 2229803 - RNA, 13 nt, Streptococcus pyogenes MGAS8232
aaaugaaaaaacu

SEQ ID NO: 2229804 - RNA, 23 nt, Streptococcus pyogenes MGAS8232
aaaugaaaaaacucaagaggucu

SEQ ID NO: 2229805 - RNA, 19 nt, Streptococcus pyogenes MGAS8232
ucguuuuuugcuuuugaua

SEQ ID NO: 2229806 - RNA, 21 nt, Streptococcus pyogenes MGAS8232
ucguuuuacggcuucuacaca

SEQ ID NO: 2229807 - RNA, 18 nt, Streptococcus pyogenes MGAS8232
ucuaaaauaaagaugaga

SEQ ID NO: 2229808 - RNA, 21 nt, Streptococcus pyogenes MGAS8232
ucuaaaugacaguauacauca

SEQ ID NO: 2229809 - RNA, 22 nt, Streptococcus pyogenes MGAS8232
ucuaaaugacaguauacaucaa

SEQ ID NO: 2229810 - RNA, 16 nt, Streptococcus pyogenes MGAS8232
ucugguuuuaauauug

SEQ ID NO: 2229811 - RNA, 13 nt, Streptococcus pyogenes MGAS8232
ucuguauuccaua

SEQ ID NO: 2229812 - RNA, 21 nt, Streptococcus pyogenes MGAS8232
ucugugaugaaucauuuugga

SEQ ID NO: 2229813 - RNA, 17 nt, Streptococcus pyogenes MGAS8232
ucuuauagaauaaccag

SEQ ID NO: 2229814 - RNA, 20 nt, Streptococcus pyogenes MGAS8232
ucuuauagcacguuggaaaa

SEQ ID NO: 2229815 - RNA, 20 nt, Streptococcus pyogenes MGAS8232
ucuuaucuuuuccgagauga

SEQ ID NO: 2229816 - RNA, 15 nt, Streptococcus pyogenes MGAS8232
ucuucaagcucgguu

SEQ ID NO: 2229817 - RNA, 14 nt, Streptococcus pyogenes MGAS8232
ucuuacaauuaaua

SEQ ID NO: 2229818 - RNA, 15 nt, Streptococcus pyogenes MGAS8232
ucuuacuaugaaaaa

SEQ ID NO: 2229819 - RNA, 20 nt, Streptococcus pyogenes MGAS8232
aaauggacaaucuuaaguua

SEQ ID NO: 2229820 - RNA, 18 nt, Streptococcus pyogenes MGAS8232
ucugagcgguuuugucuu

SEQ ID NO: 2229821 - RNA, 23 nt, Streptococcus pyogenes MGAS8232
ucugaaaauaaaauauuuuucca

SEQ ID NO: 2229822 - RNA, 14 nt, Streptococcus pyogenes MGAS8232
ucugaaaauaaaau

SEQ ID NO: 2229823 - RNA, 20 nt, Streptococcus pyogenes MGAS8232
ucugaaaaguugauaucccc

SEQ ID NO: 2229824 - RNA, 20 nt, Streptococcus pyogenes MGAS8232
ucugacaccacccgaagcua

SEQ ID NO: 2229825 - RNA, 12 nt, Streptococcus pyogenes MGAS8232
ucucauguuuua

SEQ ID NO: 2229826 - RNA, 15 nt, Streptococcus pyogenes MGAS8232
ucucauguuuuauua

SEQ ID NO: 2229827 - RNA, 21 nt, Streptococcus pyogenes MGAS8232
ucucauguuuuauuaccagua

SEQ ID NO: 2229828 - RNA, 19 nt, Streptococcus pyogenes MGAS8232
ucuccauaacauacucuau

SEQ ID NO: 2229829 - RNA, 21 nt, Streptococcus pyogenes MGAS8232
ucuccauaacauacucuauuu

SEQ ID NO: 2229830 - RNA, 15 nt, Streptococcus pyogenes MGAS8232
ucguauacuuuaaac

SEQ ID NO: 2229831 - RNA, 23 nt, Streptococcus pyogenes MGAS8232
ucgucaacgcuagcauaaugcau

SEQ ID NO: 2229832 - RNA, 20 nt, Streptococcus pyogenes MGAS8232
ucgucaucgagauuccuucu

SEQ ID NO: 2229833 - RNA, 17 nt, Streptococcus pyogenes MGAS8232
ucgucuuuguccauuuu

SEQ ID NO: 2229834 - RNA, 21 nt, Streptococcus pyogenes MGAS8232
ucggaccaugccuaaauccca

SEQ ID NO: 2229835 - RNA, 15 nt, Streptococcus pyogenes MGAS8232
ucgccaauaaaaaag

SEQ ID NO: 2229836 - RNA, 19 nt, Streptococcus pyogenes MGAS8232
ugaaacuugcugccauauu

SEQ ID NO: 2229837 - RNA, 12 nt, Streptococcus pyogenes MGAS8232
ugaaaugauugu

SEQ ID NO: 2229838 - RNA, 11 nt, Streptococcus pyogenes MGAS8232
ugaacaaaaca

SEQ ID NO: 2229839 - RNA, 13 nt, Streptococcus pyogenes MGAS8232
ugaacaaaacaaa

SEQ ID NO: 2229840 - RNA, 17 nt, Streptococcus pyogenes MGAS8232
ugaacaaaacaaaacaa

SEQ ID NO: 2229841 - RNA, 13 nt, Streptococcus pyogenes MGAS8232
ugaauuauuagua

SEQ ID NO: 2229842 - RNA, 17 nt, Streptococcus pyogenes MGAS8232
ugaauuauuaguaacca

SEQ ID NO: 2229843 - RNA, 17 nt, Streptococcus pyogenes MGAS8232
ugaauuuugucuaaaau

SEQ ID NO: 2229844 - RNA, 19 nt, Streptococcus pyogenes MGAS8232
ugaauuuugucuaaaauaa

SEQ ID NO: 2229845 - RNA, 16 nt, Streptococcus pyogenes MGAS8232
ugacaguuaaaaauaa

SEQ ID NO: 2229846 - RNA, 13 nt, Streptococcus pyogenes MGAS8232
ugacauaguguuu

SEQ ID NO: 2229847 - RNA, 19 nt, Streptococcus pyogenes MGAS8232
ugacagacaccaaaaaaag

SEQ ID NO: 2229848 - RNA, 12 nt, Streptococcus pyogenes MGAS8232
ugacaacaauau

SEQ ID NO: 2229849 - RNA, 22 nt, Streptococcus pyogenes MGAS8232
ugacaacaauaugugauuauua

SEQ ID NO: 2229850 - RNA, 14 nt, Streptococcus pyogenes MGAS8232
ugauguuauuaaau

SEQ ID NO: 2229851 - RNA, 15 nt, Streptococcus pyogenes MGAS8232
ugauguuauuaaaua

SEQ ID NO: 2229852 - RNA, 19 nt, Streptococcus pyogenes MGAS8232
ugauuacugauaaacuuga

SEQ ID NO: 2229853 - RNA, 21 nt, Streptococcus pyogenes MGAS8232
ugauuagaauccuccucuuuu

SEQ ID NO: 2229854 - RNA, 12 nt, Streptococcus pyogenes MGAS8232
ugauuacugaua

SEQ ID NO: 2229855 - RNA, 16 nt, Streptococcus pyogenes MGAS8232
ugauguaccaauuuaa

SEQ ID NO: 2229856 - RNA, 12 nt, Streptococcus pyogenes MGAS8232
ugauuauuauuc

SEQ ID NO: 2229857 - RNA, 16 nt, Streptococcus pyogenes MGAS8232
ugauuauuauucuaaa

SEQ ID NO: 2229858 - RNA, 21 nt, Streptococcus pyogenes MGAS8232
ugauuuaugaccauuuuuacu

SEQ ID NO: 2229859 - RNA, 15 nt, Streptococcus pyogenes MGAS8232
ugaugcguuuauaaa

SEQ ID NO: 2229860 - RNA, 17 nt, Streptococcus pyogenes MGAS8232
ugauggcuuuccauucu

SEQ ID NO: 2229861 - RNA, 23 nt, Streptococcus pyogenes MGAS8232
ugauauuuuuucucaaaaauaua

SEQ ID NO: 2229862 - RNA, 23 nt, Streptococcus pyogenes MGAS8232
ugauaaaggccuguauuucuuug

SEQ ID NO: 2229863 - RNA, 17 nt, Streptococcus pyogenes MGAS8232
ugaguaagcagcaucac

SEQ ID NO: 2229864 - RNA, 16 nt, Streptococcus pyogenes MGAS8232
ugacuuguuacaaaaa

SEQ ID NO: 2229865 - RNA, 21 nt, Streptococcus pyogenes MGAS8232
ugacuugguucugaaaauaaa

SEQ ID NO: 2229866 - RNA, 18 nt, Streptococcus pyogenes MGAS8232
ugacuguaauuaugcaaa

SEQ ID NO: 2229867 - RNA, 15 nt, Streptococcus pyogenes MGAS8232
ugagacaaguugccu

SEQ ID NO: 2229868 - RNA, 12 nt, Streptococcus pyogenes MGAS8232
ugagaaaauuuu

SEQ ID NO: 2229869 - RNA, 15 nt, Streptococcus pyogenes MGAS8232
ugagaucuucuuuug

SEQ ID NO: 2229870 - RNA, 16 nt, Streptococcus pyogenes MGAS8232
ugagccgccaacauag

SEQ ID NO: 2229871 - RNA, 19 nt, Streptococcus pyogenes MGAS8232
ugagccgccaacauagcua

SEQ ID NO: 2229872 - RNA, 23 nt, Streptococcus pyogenes MGAS8232
ugagccgccaacauagcuaaucc

SEQ ID NO: 2229873 - RNA, 22 nt, Streptococcus pyogenes MGAS8232
ugagccuuuucuuuuuggcuga

SEQ ID NO: 2229874 - RNA, 20 nt, Streptococcus pyogenes MGAS8232
ugagccugcauuuaaucuua

SEQ ID NO: 2229875 - RNA, 14 nt, Streptococcus pyogenes MGAS8232
ugcguagauagcaa

SEQ ID NO: 2229876 - RNA, 13 nt, Streptococcus pyogenes MGAS8232
ugccuaaauccca

SEQ ID NO: 2229877 - RNA, 22 nt, Streptococcus pyogenes MGAS8232
ugccaguaaggaaaucaauccu

SEQ ID NO: 2229878 - RNA, 19 nt, Streptococcus pyogenes MGAS8232
ugccauggguaaaaugacu

SEQ ID NO: 2229879 - RNA, 17 nt, Streptococcus pyogenes MGAS8232
ugccauggguaaaauga

SEQ ID NO: 2229880 - RNA, 18 nt, Streptococcus pyogenes MGAS8232
ugccauuuccuacaaaau

SEQ ID NO: 2229881 - RNA, 17 nt, Streptococcus pyogenes MGAS8232
ugccauuuaaaagggca

SEQ ID NO: 2229882 - RNA, 21 nt, Streptococcus pyogenes MGAS8232
ugccaucugcuuggauuuccu

SEQ ID NO: 2229883 - RNA, 22 nt, Streptococcus pyogenes MGAS8232
ugccaucaggcuuaaacauauu

SEQ ID NO: 2229884 - RNA, 14 nt, Streptococcus pyogenes MGAS8232
ugcauuaccuuauu

SEQ ID NO: 2229885 - RNA, 13 nt, Streptococcus pyogenes MGAS8232
ugcagguaauuau

SEQ ID NO: 2229886 - RNA, 14 nt, Streptococcus pyogenes MGAS8232
ugcagcauaaucau

SEQ ID NO: 2229887 - RNA, 14 nt, Streptococcus pyogenes MGAS8232
ugauuuguuuucuu

SEQ ID NO: 2229888 - RNA, 22 nt, Streptococcus pyogenes MGAS8232
ucaugacgccuccaaauacugg

SEQ ID NO: 2229889 - RNA, 20 nt, Streptococcus pyogenes MGAS8232
ucaugacgccuccaaauacu

SEQ ID NO: 2229890 - RNA, 20 nt, Streptococcus pyogenes MGAS8232
ucauuuuaaguagucaaaau

SEQ ID NO: 2229891 - RNA, 14 nt, Streptococcus pyogenes MGAS8232
ucaggcaaaacaaa

SEQ ID NO: 2229892 - RNA, 20 nt, Streptococcus pyogenes MGAS8232
ucaggauugccaucaauguu

SEQ ID NO: 2229893 - RNA, 16 nt, Streptococcus pyogenes MGAS8232
ucauaaacaaugaguc

SEQ ID NO: 2229894 - RNA, 21 nt, Streptococcus pyogenes MGAS8232
ucauaaacaaugagucaccug

SEQ ID NO: 2229895 - RNA, 15 nt, Streptococcus pyogenes MGAS8232
ucauaacuugucaag

SEQ ID NO: 2229896 - RNA, 21 nt, Streptococcus pyogenes MGAS8232
ucaucaaaagaccauaaaaaa

SEQ ID NO: 2229897 - RNA, 16 nt, Streptococcus pyogenes MGAS8232
ucaucaaaagaccaua

SEQ ID NO: 2229898 - RNA, 21 nt, Streptococcus pyogenes MGAS8232
ucauacucaauagcugcugcu

SEQ ID NO: 2229899 - RNA, 19 nt, Streptococcus pyogenes MGAS8232
ucauacucaauagcugcug

SEQ ID NO: 2229900 - RNA, 17 nt, Streptococcus pyogenes MGAS8232
ucaccuuucuauauaac

SEQ ID NO: 2229901 - RNA, 21 nt, Streptococcus pyogenes MGAS8232
ucaauuaauguuaggagcaca

SEQ ID NO: 2229902 - RNA, 20 nt, Streptococcus pyogenes MGAS8232
ucaaugaaaaguuauuccca

SEQ ID NO: 2229903 - RNA, 14 nt, Streptococcus pyogenes MGAS8232
ucaaugaaaaguua

SEQ ID NO: 2229904 - RNA, 23 nt, Streptococcus pyogenes MGAS8232
ucaaggaauugcagcuaaaaaca

SEQ ID NO: 2229905 - RNA, 21 nt, Streptococcus pyogenes MGAS8232
ucaagcucgguuuuaaacuuc

SEQ ID NO: 2229906 - RNA, 22 nt, Streptococcus pyogenes MGAS8232
ucaaauccgcuugcagcauaau

SEQ ID NO: 2229907 - RNA, 15 nt, Streptococcus pyogenes MGAS8232
uauuagcaaaaugcu

SEQ ID NO: 2229908 - RNA, 13 nt, Streptococcus pyogenes MGAS8232
uauuauucuaaau

SEQ ID NO: 2229909 - RNA, 14 nt, Streptococcus pyogenes MGAS8232
uauuauucuaacau

SEQ ID NO: 2229910 - RNA, 15 nt, Streptococcus pyogenes MGAS8232
uauccauuauaaauc

SEQ ID NO: 2229911 - RNA, 13 nt, Streptococcus pyogenes MGAS8232
uauucauuuucuu

SEQ ID NO: 2229912 - RNA, 19 nt, Streptococcus pyogenes MGAS8232
uauuccaaacauccaauca

SEQ ID NO: 2229913 - RNA, 16 nt, Streptococcus pyogenes MGAS8232
uauucucuauuuuugg

SEQ ID NO: 2229914 - RNA, 15 nt, Streptococcus pyogenes MGAS8232
uauuuacugggucaa

SEQ ID NO: 2229915 - RNA, 14 nt, Streptococcus pyogenes MGAS8232
uauuucacuagaca

SEQ ID NO: 2229916 - RNA, 21 nt, Streptococcus pyogenes MGAS8232
uauugguugccugaaauauaa

SEQ ID NO: 2229917 - RNA, 20 nt, Streptococcus pyogenes MGAS8232
aaauccuuuugaaaaauuau

SEQ ID NO: 2229918 - RNA, 22 nt, Streptococcus pyogenes MGAS8232
aaauccuuuugcuucuagcucu

SEQ ID NO: 2229919 - RNA, 17 nt, Streptococcus pyogenes MGAS8232
uauugagucuuuuucua

SEQ ID NO: 2229920 - RNA, 18 nt, Streptococcus pyogenes MGAS8232
uauugagucuuuuucuaa

SEQ ID NO: 2229921 - RNA, 19 nt, Streptococcus pyogenes MGAS8232
ucaaaaaauuaagaaggaa

SEQ ID NO: 2229922 - RNA, 12 nt, Streptococcus pyogenes MGAS8232
ucaaaaagucgu

SEQ ID NO: 2229923 - RNA, 20 nt, Streptococcus pyogenes MGAS8232
ucaaaaagucgucaacgcua

SEQ ID NO: 2229924 - RNA, 13 nt, Streptococcus pyogenes MGAS8232
ucaaaaaagggaa

SEQ ID NO: 2229925 - RNA, 17 nt, Streptococcus pyogenes MGAS8232
uauuuuuucucaaaaau

SEQ ID NO: 2229926 - RNA, 20 nt, Streptococcus pyogenes MGAS8232
uauuuuucgaccaauucuaa

SEQ ID NO: 2229927 - RNA, 23 nt, Streptococcus pyogenes MGAS8232
uauuuuucgaccaauucuaaaac

SEQ ID NO: 2229928 - RNA, 22 nt, Streptococcus pyogenes MGAS8232
ucaaauaaaaucguuauuaauu

SEQ ID NO: 2229929 - RNA, 21 nt, Streptococcus pyogenes MGAS8232
ucaaaggguguuuuuuauaug

SEQ ID NO: 2229930 - RNA, 21 nt, Streptococcus pyogenes MGAS8232
uauuuucuagguuaaaauaga

SEQ ID NO: 2229931 - RNA, 16 nt, Streptococcus pyogenes MGAS8232
uauuuugugacuauau

SEQ ID NO: 2229932 - RNA, 15 nt, Streptococcus pyogenes MGAS8232
uauuuuauuaauaag

SEQ ID NO: 2229933 - RNA, 23 nt, Streptococcus pyogenes MGAS8232
uauuuuauauuauguucuaaaaa

SEQ ID NO: 2229934 - RNA, 22 nt, Streptococcus pyogenes MGAS8232
uauuuuaaaauccucuuuuaau

SEQ ID NO: 2229935 - RNA, 17 nt, Streptococcus pyogenes MGAS8232
uauuuuaaguaaaggau

SEQ ID NO: 2229936 - RNA, 14 nt, Streptococcus pyogenes MGAS8232
uauuucggccacuu

SEQ ID NO: 2229937 - RNA, 18 nt, Streptococcus pyogenes MGAS8232
uacacgugauaaaugccg

SEQ ID NO: 2229938 - RNA, 19 nt, Streptococcus pyogenes MGAS8232
uacauaaaaugacuucaaa

SEQ ID NO: 2229939 - RNA, 22 nt, Streptococcus pyogenes MGAS8232
uacaggauauugagaagaaaaa

SEQ ID NO: 2229940 - RNA, 18 nt, Streptococcus pyogenes MGAS8232
uaaucguaaugucuuguu

SEQ ID NO: 2229941 - RNA, 20 nt, Streptococcus pyogenes MGAS8232
uaaucguaaugucuuguucu

SEQ ID NO: 2229942 - RNA, 14 nt, Streptococcus pyogenes MGAS8232
uaaucgaaaaugcu

SEQ ID NO: 2229943 - RNA, 15 nt, Streptococcus pyogenes MGAS8232
uaaucgaaaaugcuu

SEQ ID NO: 2229944 - RNA, 15 nt, Streptococcus pyogenes MGAS8232
uaaugaccuuugaua

SEQ ID NO: 2229945 - RNA, 18 nt, Streptococcus pyogenes MGAS8232
uaaugaccacccucaaca

SEQ ID NO: 2229946 - RNA, 18 nt, Streptococcus pyogenes MGAS8232
uaaucuuugacaauguca

SEQ ID NO: 2229947 - RNA, 20 nt, Streptococcus pyogenes MGAS8232
uaaucuuguugggcacuuac

SEQ ID NO: 2229948 - RNA, 20 nt, Streptococcus pyogenes MGAS8232
uaaucuuuuugugauauauu

SEQ ID NO: 2229949 - RNA, 11 nt, Streptococcus pyogenes MGAS8232
uaaucuuuuug

SEQ ID NO: 2229950 - RNA, 15 nt, Streptococcus pyogenes MGAS8232
uaauuagcauauuuu

SEQ ID NO: 2229951 - RNA, 22 nt, Streptococcus pyogenes MGAS8232
uaauggugucguuuuuuuuauu

SEQ ID NO: 2229952 - RNA, 16 nt, Streptococcus pyogenes MGAS8232
uaauucuuuaauaguu

SEQ ID NO: 2229953 - RNA, 19 nt, Streptococcus pyogenes MGAS8232
uaauuuagucauuucuuca

SEQ ID NO: 2229954 - RNA, 20 nt, Streptococcus pyogenes MGAS8232
uacuccguuucuaguuucau

SEQ ID NO: 2229955 - RNA, 16 nt, Streptococcus pyogenes MGAS8232
uacuucgguauucuuu

SEQ ID NO: 2229956 - RNA, 22 nt, Streptococcus pyogenes MGAS8232
uagaaauagucuccauaacaua

SEQ ID NO: 2229957 - RNA, 12 nt, Streptococcus pyogenes MGAS8232
uagaaaguuaua

SEQ ID NO: 2229958 - RNA, 13 nt, Streptococcus pyogenes MGAS8232
uagaauaaaaaga

SEQ ID NO: 2229959 - RNA, 15 nt, Streptococcus pyogenes MGAS8232
uagaauaaaaagacu

SEQ ID NO: 2229960 - RNA, 16 nt, Streptococcus pyogenes MGAS8232
uagaaauuguaaccac

SEQ ID NO: 2229961 - RNA, 23 nt, Streptococcus pyogenes MGAS8232
uacgguaaaaacucaaaaaauac

SEQ ID NO: 2229962 - RNA, 20 nt, Streptococcus pyogenes MGAS8232
uacgcuccaacgauagcugg

SEQ ID NO: 2229963 - RNA, 14 nt, Streptococcus pyogenes MGAS8232
uacguuuauuuagu

SEQ ID NO: 2229964 - RNA, 15 nt, Streptococcus pyogenes MGAS8232
uacuaugaaaaaaga

SEQ ID NO: 2229965 - RNA, 18 nt, Streptococcus pyogenes MGAS8232
uacucaucuacucuauuu

SEQ ID NO: 2229966 - RNA, 21 nt, Streptococcus pyogenes MGAS8232
uaccuauagaaaguuauaaag

SEQ ID NO: 2229967 - RNA, 13 nt, Streptococcus pyogenes MGAS8232
uaccuaaaagaac

SEQ ID NO: 2229968 - RNA, 15 nt, Streptococcus pyogenes MGAS8232
uagagucucuagucu

SEQ ID NO: 2229969 - RNA, 15 nt, Streptococcus pyogenes MGAS8232
uagauaaacugguua

SEQ ID NO: 2229970 - RNA, 14 nt, Streptococcus pyogenes MGAS8232
uagcaagaaguuuu

SEQ ID NO: 2229971 - RNA, 15 nt, Streptococcus pyogenes MGAS8232
uagcaagaaguuuua

SEQ ID NO: 2229972 - RNA, 21 nt, Streptococcus pyogenes MGAS8232
uagcaaguccugcuuuugaug

SEQ ID NO: 2229973 - RNA, 19 nt, Streptococcus pyogenes MGAS8232
uagcaaugguuaaaaagag

SEQ ID NO: 2229974 - RNA, 18 nt, Streptococcus pyogenes MGAS8232
uagcacguuggaaaagga

SEQ ID NO: 2229975 - RNA, 19 nt, Streptococcus pyogenes MGAS8232
uagcacguuggaaaaggaa

SEQ ID NO: 2229976 - RNA, 12 nt, Streptococcus pyogenes MGAS8232
uagcauaaaaua

SEQ ID NO: 2229977 - RNA, 19 nt, Streptococcus pyogenes MGAS8232
uagcaguuauaauuaguau

SEQ ID NO: 2229978 - RNA, 16 nt, Streptococcus pyogenes MGAS8232
uagcagcagaagcaaa

SEQ ID NO: 2229979 - RNA, 20 nt, Streptococcus pyogenes MGAS8232
uagcauugucaaauaaaauc

SEQ ID NO: 2229980 - RNA, 18 nt, Streptococcus pyogenes MGAS8232
uagccaagcaaucuaaga

SEQ ID NO: 2229981 - RNA, 23 nt, Streptococcus pyogenes MGAS8232
uagcauuaaggauuaugaaaaag

SEQ ID NO: 2229982 - RNA, 13 nt, Streptococcus pyogenes MGAS8232
uagccugccagcc

SEQ ID NO: 2229983 - RNA, 17 nt, Streptococcus pyogenes MGAS8232
uagcguaaagcaaggga

SEQ ID NO: 2229984 - RNA, 13 nt, Streptococcus pyogenes MGAS8232
uaggaauaaaaug

SEQ ID NO: 2229985 - RNA, 13 nt, Streptococcus pyogenes MGAS8232
uagcuuuuaauug

SEQ ID NO: 2229986 - RNA, 20 nt, Streptococcus pyogenes MGAS8232
uagcugcugcuaaagcaauc

SEQ ID NO: 2229987 - RNA, 21 nt, Streptococcus pyogenes MGAS8232
uagcucaucccuacuaggcuu

SEQ ID NO: 2229988 - RNA, 17 nt, Streptococcus pyogenes MGAS8232
uagcugauuuguuuucu

SEQ ID NO: 2229989 - RNA, 15 nt, Streptococcus pyogenes MGAS8232
uauaccuaaaaaaua

SEQ ID NO: 2229990 - RNA, 16 nt, Streptococcus pyogenes MGAS8232
uauaacuguuuuucuu

SEQ ID NO: 2229991 - RNA, 14 nt, Streptococcus pyogenes MGAS8232
uauacuuuaaacac

SEQ ID NO: 2229992 - RNA, 21 nt, Streptococcus pyogenes MGAS8232
uauacgguaaaaacucaaaaa

SEQ ID NO: 2229993 - RNA, 22 nt, Streptococcus pyogenes MGAS8232
uauacgguaaaaacucaaaaaa

SEQ ID NO: 2229994 - RNA, 13 nt, Streptococcus pyogenes MGAS8232
uauagcauaaaau

SEQ ID NO: 2229995 - RNA, 14 nt, Streptococcus pyogenes MGAS8232
uauagaauagguaa

SEQ ID NO: 2229996 - RNA, 16 nt, Streptococcus pyogenes MGAS8232
uauaguauaccuauau

SEQ ID NO: 2229997 - RNA, 19 nt, Streptococcus pyogenes MGAS8232
uauaguauaccuauauuau

SEQ ID NO: 2229998 - RNA, 20 nt, Streptococcus pyogenes MGAS8232
uaucaauaacagaaauuaau

SEQ ID NO: 2229999 - RNA, 21 nt, Streptococcus pyogenes MGAS8232
uaucagucuguccaauaccua

SEQ ID NO: 2230000 - RNA, 16 nt, Streptococcus pyogenes MGAS8232
uauccaaugaaaacuc

SEQ ID NO: 2230001 - RNA, 18 nt, Streptococcus pyogenes MGAS8232
uauccaaugaaaacucca

SEQ ID NO: 2230002 - RNA, 16 nt, Streptococcus pyogenes MGAS8232
uauccaacuuuuauca

SEQ ID NO: 2230003 - RNA, 14 nt, Streptococcus pyogenes MGAS8232
uauaaagaaacaaa

SEQ ID NO: 2230004 - RNA, 14 nt, Streptococcus pyogenes MGAS8232
uauaacaacucccu

SEQ ID NO: 2230005 - RNA, 23 nt, Streptococcus pyogenes MGAS8232
uauaaauuauuaacguuaacaaa

SEQ ID NO: 2230006 - RNA, 20 nt, Streptococcus pyogenes MGAS8232
uauaaacuuguugacucuga

SEQ ID NO: 2230007 - RNA, 21 nt, Streptococcus pyogenes MGAS8232
uaguuuauuacaaaacugucu

SEQ ID NO: 2230008 - RNA, 16 nt, Streptococcus pyogenes MGAS8232
uaguuuuauuuugaua

SEQ ID NO: 2230009 - RNA, 16 nt, Streptococcus pyogenes MGAS8232
uaguugugauauaaaa

SEQ ID NO: 2230010 - RNA, 15 nt, Streptococcus pyogenes MGAS8232
uaguuuauuacaaaa

SEQ ID NO: 2230011 - RNA, 14 nt, Streptococcus pyogenes MGAS8232
uaguuuauuacaaa

SEQ ID NO: 2230012 - RNA, 23 nt, Streptococcus pyogenes MGAS8232
uagguacucguaagcauuuugag

SEQ ID NO: 2230013 - RNA, 22 nt, Streptococcus pyogenes MGAS8232
uagguaaagauuuuaaauaucu

SEQ ID NO: 2230014 - RNA, 18 nt, Streptococcus pyogenes MGAS8232
uagggauuuuuuuaacua

SEQ ID NO: 2230015 - RNA, 18 nt, Streptococcus pyogenes MGAS8232
uaaauuauaguauaccua

SEQ ID NO: 2230016 - RNA, 15 nt, Streptococcus pyogenes MGAS8232
uaaccuccuaaacua

SEQ ID NO: 2230017 - RNA, 14 nt, Streptococcus pyogenes MGAS8232
uaaccuuugccauu

SEQ ID NO: 2230018 - RNA, 17 nt, Streptococcus pyogenes MGAS8232
uaaccaauuccucccua

SEQ ID NO: 2230019 - RNA, 19 nt, Streptococcus pyogenes MGAS8232
uaacaaugagaucuucuuu

SEQ ID NO: 2230020 - RNA, 16 nt, Streptococcus pyogenes MGAS8232
uaaacuuccaaaccau

SEQ ID NO: 2230021 - RNA, 18 nt, Streptococcus pyogenes MGAS8232
uaaagaaacaaaaaugaa

SEQ ID NO: 2230022 - RNA, 23 nt, Streptococcus pyogenes MGAS8232
uaaacauauuauaguaaccauug

SEQ ID NO: 2230023 - RNA, 13 nt, Streptococcus pyogenes MGAS8232
uaaacaauugguu

SEQ ID NO: 2230024 - RNA, 17 nt, Streptococcus pyogenes MGAS8232
uaaaauuccccacaaaa

SEQ ID NO: 2230025 - RNA, 13 nt, Streptococcus pyogenes MGAS8232
uaaauauuuuaua

SEQ ID NO: 2230026 - RNA, 15 nt, Streptococcus pyogenes MGAS8232
uaaagaccucucaug

SEQ ID NO: 2230027 - RNA, 22 nt, Streptococcus pyogenes MGAS8232
uaaagagaaagaggaaacaaaa

SEQ ID NO: 2230028 - RNA, 16 nt, Streptococcus pyogenes MGAS8232
uaaagccuuauccauu

SEQ ID NO: 2230029 - RNA, 13 nt, Streptococcus pyogenes MGAS8232
uaaagcaagggaa

SEQ ID NO: 2230030 - RNA, 18 nt, Streptococcus pyogenes MGAS8232
uaaagauuuuaaauaucu

SEQ ID NO: 2230031 - RNA, 16 nt, Streptococcus pyogenes MGAS8232
uaaagauuuuaaauau

SEQ ID NO: 2230032 - RNA, 13 nt, Streptococcus pyogenes MGAS8232
uaaagauuuuaaa

SEQ ID NO: 2230033 - RNA, 18 nt, Streptococcus pyogenes MGAS8232
uaaaggugccuguuuuug

SEQ ID NO: 2230034 - RNA, 20 nt, Streptococcus pyogenes MGAS8232
uaaaggugccuguuuuugcu

SEQ ID NO: 2230035 - RNA, 23 nt, Streptococcus pyogenes MGAS8232
uaaagcguugacaguuaaaaaua

SEQ ID NO: 2230036 - RNA, 17 nt, Streptococcus pyogenes MGAS8232
uaaaggauuuaguuuug

SEQ ID NO: 2230037 - RNA, 14 nt, Streptococcus pyogenes MGAS8232
uaaagcuacagaug

SEQ ID NO: 2230038 - RNA, 16 nt, Streptococcus pyogenes MGAS8232
uaaaauauuuuuccau

SEQ ID NO: 2230039 - RNA, 22 nt, Streptococcus pyogenes MGAS8232
uaaaauaucuagaacagcugcu

SEQ ID NO: 2230040 - RNA, 14 nt, Streptococcus pyogenes MGAS8232
uaaaauaucuagaa

SEQ ID NO: 2230041 - RNA, 16 nt, Streptococcus pyogenes MGAS8232
uaaaaucguuauuaau

SEQ ID NO: 2230042 - RNA, 23 nt, Streptococcus pyogenes MGAS8232
uaaaaucaugggaaaagcuaagu

SEQ ID NO: 2230043 - RNA, 15 nt, Streptococcus pyogenes MGAS8232
uaaaaugacugacaa

SEQ ID NO: 2230044 - RNA, 13 nt, Streptococcus pyogenes MGAS8232
uaaaauagcaccu

SEQ ID NO: 2230045 - RNA, 18 nt, Streptococcus pyogenes MGAS8232
uaaaaguuagccaagcaa

SEQ ID NO: 2230046 - RNA, 18 nt, Streptococcus pyogenes MGAS8232
uaaaagauauuuuaaaau

SEQ ID NO: 2230047 - RNA, 18 nt, Streptococcus pyogenes MGAS8232
guuuucucagagacaaua

SEQ ID NO: 2230048 - RNA, 21 nt, Streptococcus pyogenes MGAS8232
aaaucaugggaaaagcuaagu

SEQ ID NO: 2230049 - RNA, 19 nt, Streptococcus pyogenes MGAS8232
aaaucaguagugaugagua

SEQ ID NO: 2230050 - RNA, 14 nt, Streptococcus pyogenes MGAS8232
guuuguaaaauuua

SEQ ID NO: 2230051 - RNA, 19 nt, Streptococcus pyogenes MGAS8232
guuuuuuugucuccuucuu

SEQ ID NO: 2230052 - RNA, 19 nt, Streptococcus pyogenes MGAS8232
uaaaaaaaaguuaucacua

SEQ ID NO: 2230053 - RNA, 19 nt, Streptococcus pyogenes MGAS8232
uaaaaaccgcucauuugau

SEQ ID NO: 2230054 - RNA, 17 nt, Streptococcus pyogenes MGAS8232
uaaaaacucaaaaaaua

SEQ ID NO: 2230055 - RNA, 19 nt, Streptococcus pyogenes MGAS8232
uaaaaacaaugcucuuaac

SEQ ID NO: 2230056 - RNA, 12 nt, Streptococcus pyogenes MGAS8232
uaaaaacaaugc

SEQ ID NO: 2230057 - RNA, 16 nt, Streptococcus pyogenes MGAS8232
uaaaaaguaaaaucuu

SEQ ID NO: 2230058 - RNA, 23 nt, Streptococcus pyogenes MGAS8232
guuuauuuguugaagugucuuga

SEQ ID NO: 2230059 - RNA, 21 nt, Streptococcus pyogenes MGAS8232
guuuaaauguccgaaaaaaac

SEQ ID NO: 2230060 - RNA, 18 nt, Streptococcus pyogenes MGAS8232
guugacaguuaaaaauaa

SEQ ID NO: 2230061 - RNA, 14 nt, Streptococcus pyogenes MGAS8232
guugacaacaauau

SEQ ID NO: 2230062 - RNA, 14 nt, Streptococcus pyogenes MGAS8232
guugauauaaaauu

SEQ ID NO: 2230063 - RNA, 15 nt, Streptococcus pyogenes MGAS8232
guucugaaaauaaaa

SEQ ID NO: 2230064 - RNA, 21 nt, Streptococcus pyogenes MGAS8232
guucugaaaauaaaauauuuu

SEQ ID NO: 2230065 - RNA, 22 nt, Streptococcus pyogenes MGAS8232
guucugagauauucauuuucuu

SEQ ID NO: 2230066 - RNA, 17 nt, Streptococcus pyogenes MGAS8232
guucuaaaaaagcucua

SEQ ID NO: 2230067 - RNA, 18 nt, Streptococcus pyogenes MGAS8232
guucuaaaaaagcucuau

SEQ ID NO: 2230068 - RNA, 16 nt, Streptococcus pyogenes MGAS8232
guucaauacucccuuc

SEQ ID NO: 2230069 - RNA, 12 nt, Streptococcus pyogenes MGAS8232
guucauuuagug

SEQ ID NO: 2230070 - RNA, 16 nt, Streptococcus pyogenes MGAS8232
guuagagcccauucuu

SEQ ID NO: 2230071 - RNA, 14 nt, Streptococcus pyogenes MGAS8232
guuauuaaagacaa

SEQ ID NO: 2230072 - RNA, 21 nt, Streptococcus pyogenes MGAS8232
guguaauccccucguuuaaau

SEQ ID NO: 2230073 - RNA, 20 nt, Streptococcus pyogenes MGAS8232
gugccaguaaggaaaucaau

SEQ ID NO: 2230074 - RNA, 22 nt, Streptococcus pyogenes MGAS8232
gugccuaauccucucacaaaua

SEQ ID NO: 2230075 - RNA, 20 nt, Streptococcus pyogenes MGAS8232
gucuaugcauguagaugaau

SEQ ID NO: 2230076 - RNA, 21 nt, Streptococcus pyogenes MGAS8232
gugaugaguaggcgaacuuua

SEQ ID NO: 2230077 - RNA, 15 nt, Streptococcus pyogenes MGAS8232
gugcaccgacauaca

SEQ ID NO: 2230078 - RNA, 16 nt, Streptococcus pyogenes MGAS8232
gugcaccgacauacaa

SEQ ID NO: 2230079 - RNA, 20 nt, Streptococcus pyogenes MGAS8232
gugcaccgacauacaaagca

SEQ ID NO: 2230080 - RNA, 17 nt, Streptococcus pyogenes MGAS8232
guccauugaugaguuua

SEQ ID NO: 2230081 - RNA, 22 nt, Streptococcus pyogenes MGAS8232
guccauuuuuuauaaugguuuu

SEQ ID NO: 2230082 - RNA, 13 nt, Streptococcus pyogenes MGAS8232
guccgaaaaaaac

SEQ ID NO: 2230083 - RNA, 20 nt, Streptococcus pyogenes MGAS8232
gucauacucaauagcugcug

SEQ ID NO: 2230084 - RNA, 21 nt, Streptococcus pyogenes MGAS8232
gucauuucuucagguuucuuu

SEQ ID NO: 2230085 - RNA, 23 nt, Streptococcus pyogenes MGAS8232
gucauuucuucagguuucuuuug

SEQ ID NO: 2230086 - RNA, 15 nt, Streptococcus pyogenes MGAS8232
gucaauuuuaucaga

SEQ ID NO: 2230087 - RNA, 13 nt, Streptococcus pyogenes MGAS8232
gucguuuuuugcu

SEQ ID NO: 2230088 - RNA, 13 nt, Streptococcus pyogenes MGAS8232
gucuaaaauaaag

SEQ ID NO: 2230089 - RNA, 14 nt, Streptococcus pyogenes MGAS8232
gucuaccgcuagga

SEQ ID NO: 2230090 - RNA, 17 nt, Streptococcus pyogenes MGAS8232
guccuuaaaagaaaauc

SEQ ID NO: 2230091 - RNA, 18 nt, Streptococcus pyogenes MGAS8232
guccuuaaaagaaaaucu

SEQ ID NO: 2230092 - RNA, 20 nt, Streptococcus pyogenes MGAS8232
gucgaaauugguccucugaa

SEQ ID NO: 2230093 - RNA, 20 nt, Streptococcus pyogenes MGAS8232
guauuguagaggacuaaguc

SEQ ID NO: 2230094 - RNA, 22 nt, Streptococcus pyogenes MGAS8232
gucaaaaaauuaagaaggaacu

SEQ ID NO: 2230095 - RNA, 23 nt, Streptococcus pyogenes MGAS8232
guauucuuuuuccguuugagaua

SEQ ID NO: 2230096 - RNA, 12 nt, Streptococcus pyogenes MGAS8232
guauuccauacu

SEQ ID NO: 2230097 - RNA, 19 nt, Streptococcus pyogenes MGAS8232
guauuccauacuuccaucu

SEQ ID NO: 2230098 - RNA, 21 nt, Streptococcus pyogenes MGAS8232
guauuccauacuuccaucuaa

SEQ ID NO: 2230099 - RNA, 15 nt, Streptococcus pyogenes MGAS8232
guaugccugaagccg

SEQ ID NO: 2230100 - RNA, 14 nt, Streptococcus pyogenes MGAS8232
guauagcauaaaau

SEQ ID NO: 2230101 - RNA, 22 nt, Streptococcus pyogenes MGAS8232
guagcguuuguguugaagaagg

SEQ ID NO: 2230102 - RNA, 16 nt, Streptococcus pyogenes MGAS8232
guaguaggugacacua

SEQ ID NO: 2230103 - RNA, 22 nt, Streptococcus pyogenes MGAS8232
guagcaccuuuuuuauugauga

SEQ ID NO: 2230104 - RNA, 14 nt, Streptococcus pyogenes MGAS8232
guagauagcaagga

SEQ ID NO: 2230105 - RNA, 11 nt, Streptococcus pyogenes MGAS8232
guaaaaugacu

SEQ ID NO: 2230106 - RNA, 13 nt, Streptococcus pyogenes MGAS8232
guaaaauuuaucu

SEQ ID NO: 2230107 - RNA, 19 nt, Streptococcus pyogenes MGAS8232
guaaaggauuuaguucugu

SEQ ID NO: 2230108 - RNA, 18 nt, Streptococcus pyogenes MGAS8232
guaaaggauuuaguuuug

SEQ ID NO: 2230109 - RNA, 24 nt, Streptococcus pyogenes MGAS8232
guaauacgagcuagggcaacugca

SEQ ID NO: 2230110 - RNA, 20 nt, Streptococcus pyogenes MGAS8232
guaacguaauagaauaaaaa

SEQ ID NO: 2230111 - RNA, 19 nt, Streptococcus pyogenes MGAS8232
guaacgcuuguuuaugaaa

SEQ ID NO: 2230112 - RNA, 14 nt, Streptococcus pyogenes MGAS8232
guaagcaucauuau

SEQ ID NO: 2230113 - RNA, 19 nt, Streptococcus pyogenes MGAS8232
guaauuuauuccauuuauc

SEQ ID NO: 2230114 - RNA, 19 nt, Streptococcus pyogenes MGAS8232
guaauuugguggaagagua

SEQ ID NO: 2230115 - RNA, 17 nt, Streptococcus pyogenes MGAS8232
ggcucauauuagcaaaa

SEQ ID NO: 2230116 - RNA, 22 nt, Streptococcus pyogenes MGAS8232
ggugcaacugccaguugagccu

SEQ ID NO: 2230117 - RNA, 11 nt, Streptococcus pyogenes MGAS8232
gguuucuuuug

SEQ ID NO: 2230118 - RNA, 11 nt, Streptococcus pyogenes MGAS8232
guaaaaacuca

SEQ ID NO: 2230119 - RNA, 14 nt, Streptococcus pyogenes MGAS8232
gguuuuuuuaagua

SEQ ID NO: 2230120 - RNA, 13 nt, Streptococcus pyogenes MGAS8232
gguuaaaaagaga

SEQ ID NO: 2230121 - RNA, 15 nt, Streptococcus pyogenes MGAS8232
ggugucuacuaaaac

SEQ ID NO: 2230122 - RNA, 21 nt, Streptococcus pyogenes MGAS8232
gguguaauccccucguuuaaa

SEQ ID NO: 2230123 - RNA, 21 nt, Streptococcus pyogenes MGAS8232
gccuugugccuaauccucuca

SEQ ID NO: 2230124 - RNA, 13 nt, Streptococcus pyogenes MGAS8232
gcgauaauaaagu

SEQ ID NO: 2230125 - RNA, 17 nt, Streptococcus pyogenes MGAS8232
gccaguaaggaaaucaa

SEQ ID NO: 2230126 - RNA, 15 nt, Streptococcus pyogenes MGAS8232
gcauugucaaauaaa

SEQ ID NO: 2230127 - RNA, 16 nt, Streptococcus pyogenes MGAS8232
gcauugucaaauaaaa

SEQ ID NO: 2230128 - RNA, 17 nt, Streptococcus pyogenes MGAS8232
gcauuuuuugcaauuca

SEQ ID NO: 2230129 - RNA, 17 nt, Streptococcus pyogenes MGAS8232
gcaucacguacagaaau

SEQ ID NO: 2230130 - RNA, 14 nt, Streptococcus pyogenes MGAS8232
gcagcagaagcaaa

SEQ ID NO: 2230131 - RNA, 19 nt, Streptococcus pyogenes MGAS8232
gcagcacuggcuuuuuugc

SEQ ID NO: 2230132 - RNA, 22 nt, Streptococcus pyogenes MGAS8232
gcagauggggugucaggggaau

SEQ ID NO: 2230133 - RNA, 23 nt, Streptococcus pyogenes MGAS8232
gcagaggcuugcauuuuuugcaa

SEQ ID NO: 2230134 - RNA, 24 nt, Streptococcus pyogenes MGAS8232
gcagccugucaagcccugcuggcu

SEQ ID NO: 2230135 - RNA, 20 nt, Streptococcus pyogenes MGAS8232
gcagguaauuaucugaauua

SEQ ID NO: 2230136 - RNA, 19 nt, Streptococcus pyogenes MGAS8232
gcaauuguuuuuucaacaa

SEQ ID NO: 2230137 - RNA, 18 nt, Streptococcus pyogenes MGAS8232
gcaaugguuaaaaagaga

SEQ ID NO: 2230138 - RNA, 13 nt, Streptococcus pyogenes MGAS8232
gcaauucagcauc

SEQ ID NO: 2230139 - RNA, 16 nt, Streptococcus pyogenes MGAS8232
gcaaugguuaaaaaga

SEQ ID NO: 2230140 - RNA, 17 nt, Streptococcus pyogenes MGAS8232
gcaaugguuaaaaagag

SEQ ID NO: 2230141 - RNA, 15 nt, Streptococcus pyogenes MGAS8232
gcaauccaaaucaac

SEQ ID NO: 2230142 - RNA, 14 nt, Streptococcus pyogenes MGAS8232
gcaauccaaaucaa

SEQ ID NO: 2230143 - RNA, 20 nt, Streptococcus pyogenes MGAS8232
aaagcggaagaacagcauuu

SEQ ID NO: 2230144 - RNA, 16 nt, Streptococcus pyogenes MGAS8232
gcaacucuaaucuuua

SEQ ID NO: 2230145 - RNA, 21 nt, Streptococcus pyogenes MGAS8232
gcaaccuuaccuacugcugga

SEQ ID NO: 2230146 - RNA, 19 nt, Streptococcus pyogenes MGAS8232
gcaauaaucgaugauaaua

SEQ ID NO: 2230147 - RNA, 20 nt, Streptococcus pyogenes MGAS8232
gcaccgacauacaaagcauc

SEQ ID NO: 2230148 - RNA, 13 nt, Streptococcus pyogenes MGAS8232
gcaccuucuuuua

SEQ ID NO: 2230149 - RNA, 13 nt, Streptococcus pyogenes MGAS8232
gcaccuucaaccg

SEQ ID NO: 2230150 - RNA, 12 nt, Streptococcus pyogenes MGAS8232
gcacguuuucug

SEQ ID NO: 2230151 - RNA, 17 nt, Streptococcus pyogenes MGAS8232
gcugaccaccggugccu

SEQ ID NO: 2230152 - RNA, 13 nt, Streptococcus pyogenes MGAS8232
gcucuuuaucacc

SEQ ID NO: 2230153 - RNA, 15 nt, Streptococcus pyogenes MGAS8232
gcucuuuaucaccug

SEQ ID NO: 2230154 - RNA, 18 nt, Streptococcus pyogenes MGAS8232
gcucuuaacucucauaaa

SEQ ID NO: 2230155 - RNA, 15 nt, Streptococcus pyogenes MGAS8232
aaagcuucaucgaug

SEQ ID NO: 2230156 - RNA, 22 nt, Streptococcus pyogenes MGAS8232
aaagcuucaucgaugauagcuu

SEQ ID NO: 2230157 - RNA, 17 nt, Streptococcus pyogenes MGAS8232
gcuagggcaacugcaau

SEQ ID NO: 2230158 - RNA, 21 nt, Streptococcus pyogenes MGAS8232
gcuauagaaacuuuuuauaag

SEQ ID NO: 2230159 - RNA, 12 nt, Streptococcus pyogenes MGAS8232
gcucauuugaug

SEQ ID NO: 2230160 - RNA, 18 nt, Streptococcus pyogenes MGAS8232
gcuaaaacaguuccaguu

SEQ ID NO: 2230161 - RNA, 22 nt, Streptococcus pyogenes MGAS8232
gcuaagauuuccacuuggucca

SEQ ID NO: 2230162 - RNA, 14 nt, Streptococcus pyogenes MGAS8232
gcuacaaggcacca

SEQ ID NO: 2230163 - RNA, 14 nt, Streptococcus pyogenes MGAS8232
gcgugguggagguc

SEQ ID NO: 2230164 - RNA, 23 nt, Streptococcus pyogenes MGAS8232
gcguagauagcaaggaugaaaug

SEQ ID NO: 2230165 - RNA, 23 nt, Streptococcus pyogenes MGAS8232
gcgucuggcauuugucuguggcu

SEQ ID NO: 2230166 - RNA, 20 nt, Streptococcus pyogenes MGAS8232
gcuuuuuaauuguugcaacc

SEQ ID NO: 2230167 - RNA, 23 nt, Streptococcus pyogenes MGAS8232
gcuuuuuuauaacuguugucuca

SEQ ID NO: 2230168 - RNA, 15 nt, Streptococcus pyogenes MGAS8232
gcuuuuuuuguaucu

SEQ ID NO: 2230169 - RNA, 11 nt, Streptococcus pyogenes MGAS8232
ggaaaacagaa

SEQ ID NO: 2230170 - RNA, 15 nt, Streptococcus pyogenes MGAS8232
ggaaaacagaaagcg

SEQ ID NO: 2230171 - RNA, 22 nt, Streptococcus pyogenes MGAS8232
ggaaaacagaaagcggaagaac

SEQ ID NO: 2230172 - RNA, 22 nt, Streptococcus pyogenes MGAS8232
gcuuugacaaagcagugcuuua

SEQ ID NO: 2230173 - RNA, 18 nt, Streptococcus pyogenes MGAS8232
gcuuucucaucuacucau

SEQ ID NO: 2230174 - RNA, 20 nt, Streptococcus pyogenes MGAS8232
gcuuucucaucuacucauga

SEQ ID NO: 2230175 - RNA, 22 nt, Streptococcus pyogenes MGAS8232
ggaaaguaaggguuaacaauga

SEQ ID NO: 2230176 - RNA, 14 nt, Streptococcus pyogenes MGAS8232
ggaagaacagcauu

SEQ ID NO: 2230177 - RNA, 19 nt, Streptococcus pyogenes MGAS8232
ggagggacugucaaaaaau

SEQ ID NO: 2230178 - RNA, 12 nt, Streptococcus pyogenes MGAS8232
aaaguaaaaucu

SEQ ID NO: 2230179 - RNA, 20 nt, Streptococcus pyogenes MGAS8232
ggaccaugccuaaaucccau

SEQ ID NO: 2230180 - RNA, 22 nt, Streptococcus pyogenes MGAS8232
ggaccaugccuaaaucccaucg

SEQ ID NO: 2230181 - RNA, 13 nt, Streptococcus pyogenes MGAS8232
ggaccaagauuca

SEQ ID NO: 2230182 - RNA, 19 nt, Streptococcus pyogenes MGAS8232
ggcuacucuauuugaagua

SEQ ID NO: 2230183 - RNA, 18 nt, Streptococcus pyogenes MGAS8232
aaauaaagaugagaguaa

SEQ ID NO: 2230184 - RNA, 14 nt, Streptococcus pyogenes MGAS8232
aaauaaaauauuuu

SEQ ID NO: 2230185 - RNA, 23 nt, Streptococcus pyogenes MGAS8232
aaaguuuucucagagacaauaag

SEQ ID NO: 2230186 - RNA, 16 nt, Streptococcus pyogenes MGAS8232
aaaguuuucucagaga

SEQ ID NO: 2230187 - RNA, 18 nt, Streptococcus pyogenes MGAS8232
ggccguaggugucuacua

SEQ ID NO: 2230188 - RNA, 15 nt, Streptococcus pyogenes MGAS8232
aaaguuauaaagaaa

SEQ ID NO: 2230189 - RNA, 22 nt, Streptococcus pyogenes MGAS8232
aaaguuggcuacucuauuugaa

SEQ ID NO: 2230190 - RNA, 22 nt, Streptococcus pyogenes MGAS8232
aaaguuggcuacucuauuuuaa

SEQ ID NO: 2230191 - RNA, 15 nt, Streptococcus pyogenes MGAS8232
aaaguuggcuacucu

SEQ ID NO: 2230192 - RNA, 17 nt, Streptococcus pyogenes MGAS8232
gagggacugucaaaaaa

SEQ ID NO: 2230193 - RNA, 18 nt, Streptococcus pyogenes MGAS8232
gaggcuugcauuuuuugc

SEQ ID NO: 2230194 - RNA, 17 nt, Streptococcus pyogenes MGAS8232
gaggucuggccagcuac

SEQ ID NO: 2230195 - RNA, 23 nt, Streptococcus pyogenes MGAS8232
gaggucuggccagcuacaaggca

SEQ ID NO: 2230196 - RNA, 15 nt, Streptococcus pyogenes MGAS8232
gauaaaacaaauaau

SEQ ID NO: 2230197 - RNA, 19 nt, Streptococcus pyogenes MGAS8232
gauaaaggccuguauuucu

SEQ ID NO: 2230198 - RNA, 23 nt, Streptococcus pyogenes MGAS8232
gauaaaggccuguauuucuuugg

SEQ ID NO: 2230199 - RNA, 11 nt, Streptococcus pyogenes MGAS8232
gaguuuugcug

SEQ ID NO: 2230200 - RNA, 21 nt, Streptococcus pyogenes MGAS8232
gaguugaaccgcuaaaacagu

SEQ ID NO: 2230201 - RNA, 18 nt, Streptococcus pyogenes MGAS8232
gagguugguaaaaaggca

SEQ ID NO: 2230202 - RNA, 14 nt, Streptococcus pyogenes MGAS8232
gagucucuagucuu

SEQ ID NO: 2230203 - RNA, 17 nt, Streptococcus pyogenes MGAS8232
gauacguuuauuguugc

SEQ ID NO: 2230204 - RNA, 13 nt, Streptococcus pyogenes MGAS8232
gauagcaccuaau

SEQ ID NO: 2230205 - RNA, 20 nt, Streptococcus pyogenes MGAS8232
gauaagcuuacuucuaagag

SEQ ID NO: 2230206 - RNA, 22 nt, Streptococcus pyogenes MGAS8232
gauaagcuuacuucuaagagcc

SEQ ID NO: 2230207 - RNA, 16 nt, Streptococcus pyogenes MGAS8232
aaagcauaaaaauauu

SEQ ID NO: 2230208 - RNA, 19 nt, Streptococcus pyogenes MGAS8232
aaagcaucaggauugccau

SEQ ID NO: 2230209 - RNA, 24 nt, Streptococcus pyogenes MGAS8232
gauacaguccaaacucaaacuaaa

SEQ ID NO: 2230210 - RNA, 15 nt, Streptococcus pyogenes MGAS8232
gagccuuaaaaaguu

SEQ ID NO: 2230211 - RNA, 13 nt, Streptococcus pyogenes MGAS8232
gagcccauucuua

SEQ ID NO: 2230212 - RNA, 19 nt, Streptococcus pyogenes MGAS8232
gagauaccuucauagacaa

SEQ ID NO: 2230213 - RNA, 18 nt, Streptococcus pyogenes MGAS8232
gagagauuuuuaaaaccu

SEQ ID NO: 2230214 - RNA, 22 nt, Streptococcus pyogenes MGAS8232
gagacaaguugccuuaucucag

SEQ ID NO: 2230215 - RNA, 14 nt, Streptococcus pyogenes MGAS8232
aaagauuuuaaaua

SEQ ID NO: 2230216 - RNA, 19 nt, Streptococcus pyogenes MGAS8232
aaagcaagggaaacaccac

SEQ ID NO: 2230217 - RNA, 18 nt, Streptococcus pyogenes MGAS8232
gagaaauucaaauacuuc

SEQ ID NO: 2230218 - RNA, 15 nt, Streptococcus pyogenes MGAS8232
gacuucaaaaucacc

SEQ ID NO: 2230219 - RNA, 21 nt, Streptococcus pyogenes MGAS8232
gacuugguucugaaaauaaaa

SEQ ID NO: 2230220 - RNA, 13 nt, Streptococcus pyogenes MGAS8232
gacuuucuacuau

SEQ ID NO: 2230221 - RNA, 20 nt, Streptococcus pyogenes MGAS8232
gacuuucuacuauugcauga

SEQ ID NO: 2230222 - RNA, 19 nt, Streptococcus pyogenes MGAS8232
gacugacaaaacuucaaau

SEQ ID NO: 2230223 - RNA, 22 nt, Streptococcus pyogenes MGAS8232
gacugcaauagcaugacuguau

SEQ ID NO: 2230224 - RNA, 14 nt, Streptococcus pyogenes MGAS8232
gaccuuaaaggccu

SEQ ID NO: 2230225 - RNA, 23 nt, Streptococcus pyogenes MGAS8232
gaccuuauuggucgcccuuuuua

SEQ ID NO: 2230226 - RNA, 15 nt, Streptococcus pyogenes MGAS8232
gacggaguauuuuuu

SEQ ID NO: 2230227 - RNA, 15 nt, Streptococcus pyogenes MGAS8232
gacgguaaauaaagu

SEQ ID NO: 2230228 - RNA, 17 nt, Streptococcus pyogenes MGAS8232
gacauacaaagcaucag

SEQ ID NO: 2230229 - RNA, 19 nt, Streptococcus pyogenes MGAS8232
gaauaugauauaaaaaugg

SEQ ID NO: 2230230 - RNA, 22 nt, Streptococcus pyogenes MGAS8232
gaauagguaaagauuuuaaaua

SEQ ID NO: 2230231 - RNA, 16 nt, Streptococcus pyogenes MGAS8232
gaauauaauucauguu

SEQ ID NO: 2230232 - RNA, 17 nt, Streptococcus pyogenes MGAS8232
gaauccuccucuuuuuu

SEQ ID NO: 2230233 - RNA, 21 nt, Streptococcus pyogenes MGAS8232
gacaacaauaugugauuauua

SEQ ID NO: 2230234 - RNA, 17 nt, Streptococcus pyogenes MGAS8232
gacaauagcgaaaaagg

SEQ ID NO: 2230235 - RNA, 18 nt, Streptococcus pyogenes MGAS8232
gacaauagcgaaaaaggg

SEQ ID NO: 2230236 - RNA, 23 nt, Streptococcus pyogenes MGAS8232
gacaaucgaaaugauagcaccua

SEQ ID NO: 2230237 - RNA, 15 nt, Streptococcus pyogenes MGAS8232
gaaggcuuguucuuu

SEQ ID NO: 2230238 - RNA, 15 nt, Streptococcus pyogenes MGAS8232
gaagcuguucucuuu

SEQ ID NO: 2230239 - RNA, 17 nt, Streptococcus pyogenes MGAS8232
aaagauaauuucuuuuu

SEQ ID NO: 2230240 - RNA, 19 nt, Streptococcus pyogenes MGAS8232
gaagaaggucaugaugcca

SEQ ID NO: 2230241 - RNA, 15 nt, Streptococcus pyogenes MGAS8232
gaagcaaauucuucc

SEQ ID NO: 2230242 - RNA, 23 nt, Streptococcus pyogenes MGAS8232
gaagcuaagauuuccacuugguc

SEQ ID NO: 2230243 - RNA, 15 nt, Streptococcus pyogenes MGAS8232
gaaagaggaaacaaa

SEQ ID NO: 2230244 - RNA, 23 nt, Streptococcus pyogenes MGAS8232
gaaauaucuuucaguuguuuuaa

SEQ ID NO: 2230245 - RNA, 23 nt, Streptococcus pyogenes MGAS8232
gaaaguuauagcuccuaaaacca

SEQ ID NO: 2230246 - RNA, 17 nt, Streptococcus pyogenes MGAS8232
gaaagcuucaucgauga

SEQ ID NO: 2230247 - RNA, 17 nt, Streptococcus pyogenes MGAS8232
aaagaggaaacaaaaac

SEQ ID NO: 2230248 - RNA, 19 nt, Streptococcus pyogenes MGAS8232
cuuuuggccuacuagcaca

SEQ ID NO: 2230249 - RNA, 22 nt, Streptococcus pyogenes MGAS8232
cuuuuggccuacuagcacaaaa

SEQ ID NO: 2230250 - RNA, 14 nt, Streptococcus pyogenes MGAS8232
cuuuuaguuuuauu

SEQ ID NO: 2230251 - RNA, 20 nt, Streptococcus pyogenes MGAS8232
cuuuuuaucuaugauuguuu

SEQ ID NO: 2230252 - RNA, 17 nt, Streptococcus pyogenes MGAS8232
cuuuuuccguuugagau

SEQ ID NO: 2230253 - RNA, 19 nt, Streptococcus pyogenes MGAS8232
gaaacaccaccaauaauga

SEQ ID NO: 2230254 - RNA, 13 nt, Streptococcus pyogenes MGAS8232
gaaaauaaaauau

SEQ ID NO: 2230255 - RNA, 16 nt, Streptococcus pyogenes MGAS8232
gaaaaguugauauccc

SEQ ID NO: 2230256 - RNA, 16 nt, Streptococcus pyogenes MGAS8232
gaaaaggaauaucagg

SEQ ID NO: 2230257 - RNA, 19 nt, Streptococcus pyogenes MGAS8232
cuuuaucuuauuuuaagaa

SEQ ID NO: 2230258 - RNA, 19 nt, Streptococcus pyogenes MGAS8232
cuuuauaaagcuuuaaaaa

SEQ ID NO: 2230259 - RNA, 20 nt, Streptococcus pyogenes MGAS8232
cuuuauaaagcuuuaaaaaa

SEQ ID NO: 2230260 - RNA, 15 nt, Streptococcus pyogenes MGAS8232
cuuuaacaugaugua

SEQ ID NO: 2230261 - RNA, 21 nt, Streptococcus pyogenes MGAS8232
cuuuuaagcugagcaaaacaa

SEQ ID NO: 2230262 - RNA, 20 nt, Streptococcus pyogenes MGAS8232
cuuuuaagcugagcaaaaca

SEQ ID NO: 2230263 - RNA, 22 nt, Streptococcus pyogenes MGAS8232
cuuuuaagcugagcaaaacaau

SEQ ID NO: 2230264 - RNA, 20 nt, Streptococcus pyogenes MGAS8232
cuuuuaauuuuauuuuuuaa

SEQ ID NO: 2230265 - RNA, 14 nt, Streptococcus pyogenes MGAS8232
cuuuuaauuuggag

SEQ ID NO: 2230266 - RNA, 18 nt, Streptococcus pyogenes MGAS8232
cuugguucugaaaauaaa

SEQ ID NO: 2230267 - RNA, 16 nt, Streptococcus pyogenes MGAS8232
cuugggagaguuccug

SEQ ID NO: 2230268 - RNA, 13 nt, Streptococcus pyogenes MGAS8232
cuuguuacaaaaa

SEQ ID NO: 2230269 - RNA, 16 nt, Streptococcus pyogenes MGAS8232
cuuuaaaaaauauugu

SEQ ID NO: 2230270 - RNA, 20 nt, Streptococcus pyogenes MGAS8232
cuuuaaaaaguuucugaguu

SEQ ID NO: 2230271 - RNA, 22 nt, Streptococcus pyogenes MGAS8232
cuuuaaaaaguuucugaguuga

SEQ ID NO: 2230272 - RNA, 12 nt, Streptococcus pyogenes MGAS8232
cuuuaaaaaguu

SEQ ID NO: 2230273 - RNA, 21 nt, Streptococcus pyogenes MGAS8232
cuuauaguuugacuucaaaaa

SEQ ID NO: 2230274 - RNA, 17 nt, Streptococcus pyogenes MGAS8232
cuuauaugaaagaacua

SEQ ID NO: 2230275 - RNA, 19 nt, Streptococcus pyogenes MGAS8232
cuuaggcagacaauuauuu

SEQ ID NO: 2230276 - RNA, 19 nt, Streptococcus pyogenes MGAS8232
cuuagguggagcuuuaguu

SEQ ID NO: 2230277 - RNA, 18 nt, Streptococcus pyogenes MGAS8232
cuuauuugacauuagucc

SEQ ID NO: 2230278 - RNA, 15 nt, Streptococcus pyogenes MGAS8232
cuuauuuuaagaagc

SEQ ID NO: 2230279 - RNA, 14 nt, Streptococcus pyogenes MGAS8232
cuuacuaugaaaaa

SEQ ID NO: 2230280 - RNA, 17 nt, Streptococcus pyogenes MGAS8232
cuuacuagugaagacau

SEQ ID NO: 2230281 - RNA, 19 nt, Streptococcus pyogenes MGAS8232
cuuacgacagcagcaguug

SEQ ID NO: 2230282 - RNA, 10 nt, Streptococcus pyogenes MGAS8232
cuuaaaaagu

SEQ ID NO: 2230283 - RNA, 20 nt, Streptococcus pyogenes MGAS8232
cuuaaaugcaaaaaagcucu

SEQ ID NO: 2230284 - RNA, 14 nt, Streptococcus pyogenes MGAS8232
cuuaacgaaaagca

SEQ ID NO: 2230285 - RNA, 14 nt, Streptococcus pyogenes MGAS8232
cuucauuuuacuau

SEQ ID NO: 2230286 - RNA, 17 nt, Streptococcus pyogenes MGAS8232
cuucagguuucuuuugg

SEQ ID NO: 2230287 - RNA, 12 nt, Streptococcus pyogenes MGAS8232
cuucaaaaauac

SEQ ID NO: 2230288 - RNA, 21 nt, Streptococcus pyogenes MGAS8232
cuucaaaaauacuaccuuuag

SEQ ID NO: 2230289 - RNA, 11 nt, Streptococcus pyogenes MGAS8232
cuuauuuuuuu

SEQ ID NO: 2230290 - RNA, 16 nt, Streptococcus pyogenes MGAS8232
aaacuuucaguuaucu

SEQ ID NO: 2230291 - RNA, 19 nt, Streptococcus pyogenes MGAS8232
cuugcguagauagcaagga

SEQ ID NO: 2230292 - RNA, 16 nt, Streptococcus pyogenes MGAS8232
cuugcagcauaaucau

SEQ ID NO: 2230293 - RNA, 17 nt, Streptococcus pyogenes MGAS8232
cuugaggugauucuuuu

SEQ ID NO: 2230294 - RNA, 13 nt, Streptococcus pyogenes MGAS8232
cuugacuuucuac

SEQ ID NO: 2230295 - RNA, 15 nt, Streptococcus pyogenes MGAS8232
cuugacuuucuacua

SEQ ID NO: 2230296 - RNA, 19 nt, Streptococcus pyogenes MGAS8232
cuucuuggaaaacagaaag

SEQ ID NO: 2230297 - RNA, 22 nt, Streptococcus pyogenes MGAS8232
cuucuuacuaugaaaaaagaac

SEQ ID NO: 2230298 - RNA, 16 nt, Streptococcus pyogenes MGAS8232
cuucuuacuaugaaaa

SEQ ID NO: 2230299 - RNA, 23 nt, Streptococcus pyogenes MGAS8232
cuucuucaagcucgguuuuaaac

SEQ ID NO: 2230300 - RNA, 15 nt, Streptococcus pyogenes MGAS8232
cuucuacacaaaagc

SEQ ID NO: 2230301 - RNA, 17 nt, Streptococcus pyogenes MGAS8232
cuucuaaaaaaaaguua

SEQ ID NO: 2230302 - RNA, 15 nt, Streptococcus pyogenes MGAS8232
cuucuggcaauaagu

SEQ ID NO: 2230303 - RNA, 13 nt, Streptococcus pyogenes MGAS8232
cuucugacaugau

SEQ ID NO: 2230304 - RNA, 13 nt, Streptococcus pyogenes MGAS8232
cgguaaaaacuca

SEQ ID NO: 2230305 - RNA, 12 nt, Streptococcus pyogenes MGAS8232
cgguauucuuuu

SEQ ID NO: 2230306 - RNA, 20 nt, Streptococcus pyogenes MGAS8232
cuaaauccuuuugaaaaauu

SEQ ID NO: 2230307 - RNA, 15 nt, Streptococcus pyogenes MGAS8232
cuaaaugacaguaua

SEQ ID NO: 2230308 - RNA, 23 nt, Streptococcus pyogenes MGAS8232
cuaaaaucaugggaaaagcuaag

SEQ ID NO: 2230309 - RNA, 15 nt, Streptococcus pyogenes MGAS8232
cuaaaauauauuggu

SEQ ID NO: 2230310 - RNA, 21 nt, Streptococcus pyogenes MGAS8232
cguuuaaauguccgaaaaaaa

SEQ ID NO: 2230311 - RNA, 14 nt, Streptococcus pyogenes MGAS8232
cgugacaaugugac

SEQ ID NO: 2230312 - RNA, 17 nt, Streptococcus pyogenes MGAS8232
cgucuuacaauuaauag

SEQ ID NO: 2230313 - RNA, 15 nt, Streptococcus pyogenes MGAS8232
cguaagcauuuugag

SEQ ID NO: 2230314 - RNA, 16 nt, Streptococcus pyogenes MGAS8232
cguaacguaauagaau

SEQ ID NO: 2230315 - RNA, 17 nt, Streptococcus pyogenes MGAS8232
cguaaagcaagggaaac

SEQ ID NO: 2230316 - RNA, 13 nt, Streptococcus pyogenes MGAS8232
cguauacuuuaaa

SEQ ID NO: 2230317 - RNA, 14 nt, Streptococcus pyogenes MGAS8232
cucuaucaucuuug

SEQ ID NO: 2230318 - RNA, 14 nt, Streptococcus pyogenes MGAS8232
cucugcaacaucaa

SEQ ID NO: 2230319 - RNA, 17 nt, Streptococcus pyogenes MGAS8232
cucgguuuuuuuaagua

SEQ ID NO: 2230320 - RNA, 19 nt, Streptococcus pyogenes MGAS8232
cuccuucuuugcagagaug

SEQ ID NO: 2230321 - RNA, 13 nt, Streptococcus pyogenes MGAS8232
cucaguaaucuaa

SEQ ID NO: 2230322 - RNA, 15 nt, Streptococcus pyogenes MGAS8232
cucauaacaaauuua

SEQ ID NO: 2230323 - RNA, 22 nt, Streptococcus pyogenes MGAS8232
cucaacaguauaacuguuuuuc

SEQ ID NO: 2230324 - RNA, 16 nt, Streptococcus pyogenes MGAS8232
cuauuaccuauagaaa

SEQ ID NO: 2230325 - RNA, 12 nt, Streptococcus pyogenes MGAS8232
cucaagaggucu

SEQ ID NO: 2230326 - RNA, 16 nt, Streptococcus pyogenes MGAS8232
cuaucacgccaguaaa

SEQ ID NO: 2230327 - RNA, 20 nt, Streptococcus pyogenes MGAS8232
cuauguugcuuaaugaccuu

SEQ ID NO: 2230328 - RNA, 20 nt, Streptococcus pyogenes MGAS8232
cuaugaucuguuuaaaaaca

SEQ ID NO: 2230329 - RNA, 15 nt, Streptococcus pyogenes MGAS8232
cuauaauuucaauaa

SEQ ID NO: 2230330 - RNA, 14 nt, Streptococcus pyogenes MGAS8232
cuauaccuaaaaaa

SEQ ID NO: 2230331 - RNA, 15 nt, Streptococcus pyogenes MGAS8232
cuauaccuaaaaaau

SEQ ID NO: 2230332 - RNA, 13 nt, Streptococcus pyogenes MGAS8232
cuacuucacuggc

SEQ ID NO: 2230333 - RNA, 13 nt, Streptococcus pyogenes MGAS8232
cuagcgggaacac

SEQ ID NO: 2230334 - RNA, 14 nt, Streptococcus pyogenes MGAS8232
cuagcgggaacacu

SEQ ID NO: 2230335 - RNA, 22 nt, Streptococcus pyogenes MGAS8232
cuagcucuuuaucaccugucaa

SEQ ID NO: 2230336 - RNA, 15 nt, Streptococcus pyogenes MGAS8232
cuacuaggcuuucau

SEQ ID NO: 2230337 - RNA, 21 nt, Streptococcus pyogenes MGAS8232
cuacuaggcuuucauuauagg

SEQ ID NO: 2230338 - RNA, 17 nt, Streptococcus pyogenes MGAS8232
cuacucuauuuuaagua

SEQ ID NO: 2230339 - RNA, 23 nt, Streptococcus pyogenes MGAS8232
cugccaguugagccuuuucuuuu

SEQ ID NO: 2230340 - RNA, 21 nt, Streptococcus pyogenes MGAS8232
aaacucaaaaaauacaauaaa

SEQ ID NO: 2230341 - RNA, 18 nt, Streptococcus pyogenes MGAS8232
aaacucaaaaaauacaau

SEQ ID NO: 2230342 - RNA, 16 nt, Streptococcus pyogenes MGAS8232
aaacucaaaaaauaca

SEQ ID NO: 2230343 - RNA, 18 nt, Streptococcus pyogenes MGAS8232
cuggaccauuaucaauaa

SEQ ID NO: 2230344 - RNA, 17 nt, Streptococcus pyogenes MGAS8232
cugcaauagcaugacug

SEQ ID NO: 2230345 - RNA, 15 nt, Streptococcus pyogenes MGAS8232
cugcaauauccauag

SEQ ID NO: 2230346 - RNA, 15 nt, Streptococcus pyogenes MGAS8232
cugaguucuuuuucg

SEQ ID NO: 2230347 - RNA, 22 nt, Streptococcus pyogenes MGAS8232
cugagcaaucauguugucucag

SEQ ID NO: 2230348 - RNA, 15 nt, Streptococcus pyogenes MGAS8232
cugaaauauaaccuc

SEQ ID NO: 2230349 - RNA, 12 nt, Streptococcus pyogenes MGAS8232
cugaaaauaaaa

SEQ ID NO: 2230350 - RNA, 20 nt, Streptococcus pyogenes MGAS8232
cugaaaauaaaauauuuuuc

SEQ ID NO: 2230351 - RNA, 22 nt, Streptococcus pyogenes MGAS8232
cucuugcaaggugcuuuuuuug

SEQ ID NO: 2230352 - RNA, 15 nt, Streptococcus pyogenes MGAS8232
aaaaaauauuguaaa

SEQ ID NO: 2230353 - RNA, 12 nt, Streptococcus pyogenes MGAS8232
aaaaaagcuuuu

SEQ ID NO: 2230354 - RNA, 22 nt, Streptococcus pyogenes MGAS8232
aaaaauaaguauagcauaaaau

SEQ ID NO: 2230355 - RNA, 15 nt, Streptococcus pyogenes MGAS8232
aaaaauaacuuuaaa

SEQ ID NO: 2230356 - RNA, 19 nt, Streptococcus pyogenes MGAS8232
aaaaauacaauaaagcguu

SEQ ID NO: 2230357 - RNA, 18 nt, Streptococcus pyogenes MGAS8232
aaaaauauauucuaauuu

SEQ ID NO: 2230358 - RNA, 20 nt, Streptococcus pyogenes MGAS8232
aaaacaauaacacagaagcc

SEQ ID NO: 2230359 - RNA, 12 nt, Streptococcus pyogenes MGAS8232
aaaaauuaagaa

SEQ ID NO: 2230360 - RNA, 22 nt, Streptococcus pyogenes MGAS8232
aaaacagaaagcggaagaacag

SEQ ID NO: 2230361 - RNA, 15 nt, Streptococcus pyogenes MGAS8232
aaaagauauuuuaaa

SEQ ID NO: 2230362 - RNA, 19 nt, Streptococcus pyogenes MGAS8232
aaaagaugcacacaaaucu

SEQ ID NO: 2230363 - RNA, 15 nt, Streptococcus pyogenes MGAS8232
aaaagaacaaagauu

SEQ ID NO: 2230364 - RNA, 20 nt, Streptococcus pyogenes MGAS8232
aaaagaagcaaaauuauuau

SEQ ID NO: 2230365 - RNA, 18 nt, Streptococcus pyogenes MGAS8232
aaaacugugaacaaaaca

SEQ ID NO: 2230366 - RNA, 22 nt, Streptococcus pyogenes MGAS8232
aaaacuuuugacuugguuuaau

SEQ ID NO: 2230367 - RNA, 16 nt, Streptococcus pyogenes MGAS8232
aaaacuucaaauuuca

SEQ ID NO: 2230368 - RNA, 22 nt, Streptococcus pyogenes MGAS8232
aaaacuugcaucgcaaacagau

SEQ ID NO: 2230369 - RNA, 19 nt, Streptococcus pyogenes MGAS8232
aaaagcgauaauaaagugc

SEQ ID NO: 2230370 - RNA, 15 nt, Streptococcus pyogenes MGAS8232
aaaauaaaauauuuu

SEQ ID NO: 2230371 - RNA, 18 nt, Streptococcus pyogenes MGAS8232
aaaauccucuuuuaauuu

SEQ ID NO: 2230372 - RNA, 16 nt, Streptococcus pyogenes MGAS8232
aaacaaaacaaaacaa

SEQ ID NO: 2230373 - RNA, 19 nt, Streptococcus pyogenes MGAS8232
aaaauuccccacaaaagac

SEQ ID NO: 2230374 - RNA, 17 nt, Streptococcus pyogenes MGAS8232
aaaucuguauuccauac

SEQ ID NO: 2230375 - RNA, 23 nt, Streptococcus pyogenes MGAS8232
aaaucuaaucagaacucgucuuu

SEQ ID NO: 2230376 - RNA, 22 nt, Streptococcus pyogenes MGAS8232
aaaucuuacuaacuagcaagug

SEQ ID NO: 2230377 - RNA, 17 nt, Streptococcus pyogenes MGAS8232
aaaucuuacuaacuagc

SEQ ID NO: 2230378 - RNA, 14 nt, Streptococcus pyogenes MGAS8232
aaaugauccuuucg

SEQ ID NO: 2230379 - RNA, 15 nt, Streptococcus pyogenes MGAS8232
aaaugauccuuucgu

SEQ ID NO: 2230380 - RNA, 21 nt, Streptococcus pyogenes MGAS8232
aaauggacaaucuuaaguuag

SEQ ID NO: 2230381 - RNA, 17 nt, Streptococcus pyogenes MGAS8232
aaaaaggcaaagaaagc

SEQ ID NO: 2230382 - RNA, 13 nt, Streptococcus pyogenes MGAS8232
aaaaagccuauuu

SEQ ID NO: 2230383 - RNA, 17 nt, Streptococcus pyogenes MGAS8232
aaauuccccacaaaaga

SEQ ID NO: 2230384 - RNA, 18 nt, Streptococcus pyogenes MGAS8232
aaauuccccacaaaagac

SEQ ID NO: 2230385 - RNA, 19 nt, Streptococcus pyogenes MGAS8232
aaauuccccacaaaagaca

SEQ ID NO: 2230386 - RNA, 17 nt, Streptococcus pyogenes MGAS8232
aaauuauuauuuugcuu

SEQ ID NO: 2230387 - RNA, 13 nt, Streptococcus pyogenes MGAS8232
aaauaaaaucguu

SEQ ID NO: 2230388 - RNA, 15 nt, Streptococcus pyogenes MGAS8232
aaauaacuuucuauu

SEQ ID NO: 2230389 - RNA, 17 nt, Streptococcus pyogenes MGAS8232
aaauacugguauguuga

SEQ ID NO: 2230390 - RNA, 18 nt, Streptococcus pyogenes MGAS8232
aaauaucuuuuuuacuuu

SEQ ID NO: 2230391 - RNA, 23 nt, Streptococcus pyogenes MGAS8232
aaauaggcagagccuuaaaaagu

SEQ ID NO: 2230392 - RNA, 21 nt, Streptococcus pyogenes MGAS8232
aaauauuuuauauuauguucu

SEQ ID NO: 2230393 - RNA, 13 nt, Streptococcus pyogenes MGAS8232
aaagggaagaaga

SEQ ID NO: 2230394 - RNA, 15 nt, Streptococcus pyogenes MGAS8232
aaagcuaaacuaggc

SEQ ID NO: 2230395 - RNA, 17 nt, Streptococcus pyogenes MGAS8232
aaagcuaaguaagcuuc

SEQ ID NO: 2230396 - RNA, 20 nt, Streptococcus pyogenes MGAS8232
aaagcguugacaguuaaaaa

SEQ ID NO: 2230397 - RNA, 22 nt, Streptococcus pyogenes MGAS8232
aaaggaauaucaggcaaaacaa

SEQ ID NO: 2230398 - RNA, 15 nt, Streptococcus pyogenes MGAS8232
aaaggcaaagaaagc

SEQ ID NO: 2230399 - RNA, 16 nt, Streptococcus pyogenes MGAS8232
aaagcuguaguuagaa

SEQ ID NO: 2230400 - RNA, 20 nt, Streptococcus pyogenes MGAS8232
aaagauauuuuaaaauaguu

SEQ ID NO: 2230401 - RNA, 16 nt, Streptococcus pyogenes MGAS8232
aaagauauuuuaaaau

SEQ ID NO: 2230402 - RNA, 13 nt, Streptococcus pyogenes MGAS8232
aaagauauuuuaa

SEQ ID NO: 2230403 - RNA, 23 nt, Streptococcus pyogenes MGAS8232
aaagcauuuuaugacaaauucuu

SEQ ID NO: 2230404 - RNA, 13 nt, Streptococcus pyogenes MGAS8232
aaacuuuugacuu

SEQ ID NO: 2230405 - RNA, 14 nt, Streptococcus pyogenes MGAS8232
aaagaccucucaug

SEQ ID NO: 2230406 - RNA, 14 nt, Streptococcus pyogenes MGAS8232
aaagacuucuuccu

SEQ ID NO: 2230407 - RNA, 16 nt, Streptococcus pyogenes MGAS8232
aaacuggucaaaagcu

SEQ ID NO: 2230408 - RNA, 15 nt, Streptococcus pyogenes MGAS8232
aaacugugaacaaaa

SEQ ID NO: 2230409 - RNA, 18 nt, Streptococcus pyogenes MGAS8232
aaacugugaacaaaacaa

SEQ ID NO: 2230410 - RNA, 14 nt, Streptococcus pyogenes MGAS8232
aaacugagacaagu

SEQ ID NO: 2230411 - RNA, 21 nt, Streptococcus pyogenes MGAS8232
aaacuuauguuuauccucuua

SEQ ID NO: 2230412 - RNA, 18 nt, Streptococcus pyogenes MGAS8232
aaacucaaacuaaacaaa

SEQ ID NO: 2230413 - RNA, 20 nt, Streptococcus pyogenes MGAS8232
aaacgcuauaccuaaaaaau

SEQ ID NO: 2230414 - RNA, 22 nt, Streptococcus pyogenes MGAS8232
aaacguguauucuuaaaaaaau

SEQ ID NO: 2230415 - RNA, 18 nt, Streptococcus pyogenes MGAS8232
aaacguguauucuuaaaa

SEQ ID NO: 2230416 - RNA, 14 nt, Streptococcus pyogenes MGAS8232
aaacgugagaaaau

SEQ ID NO: 2230417 - RNA, 17 nt, Streptococcus pyogenes MGAS8232
aaacguuauuaaagaca

SEQ ID NO: 2230418 - RNA, 16 nt, Streptococcus pyogenes MGAS8232
auuucguugacaaagc

SEQ ID NO: 2230419 - RNA, 20 nt, Streptococcus pyogenes MGAS8232
auuucuugaggugauucuuu

SEQ ID NO: 2230420 - RNA, 20 nt, Streptococcus pyogenes MGAS8232
auuucuuuuucauuuguaac

SEQ ID NO: 2230421 - RNA, 18 nt, Streptococcus pyogenes MGAS8232
auuuuaaucuuuuuguga

SEQ ID NO: 2230422 - RNA, 23 nt, Streptococcus pyogenes MGAS8232
auuuuacuauggcuucuaaaaaa

SEQ ID NO: 2230423 - RNA, 22 nt, Streptococcus pyogenes MGAS8232
auuuuacuauggcuucuaaaaa

SEQ ID NO: 2230424 - RNA, 21 nt, Streptococcus pyogenes MGAS8232
auuuuaaaauccucuuuuaau

SEQ ID NO: 2230425 - RNA, 14 nt, Streptococcus pyogenes MGAS8232
auuuuaaaauaguu

SEQ ID NO: 2230426 - RNA, 13 nt, Streptococcus pyogenes MGAS8232
caaaaaaagcaug

SEQ ID NO: 2230427 - RNA, 13 nt, Streptococcus pyogenes MGAS8232
caaaaaagggaag

SEQ ID NO: 2230428 - RNA, 20 nt, Streptococcus pyogenes MGAS8232
caaaaaauuaagaaggaacu

SEQ ID NO: 2230429 - RNA, 16 nt, Streptococcus pyogenes MGAS8232
auuuuuucucaaaaau

SEQ ID NO: 2230430 - RNA, 20 nt, Streptococcus pyogenes MGAS8232
auuuuucgaccaauucuaaa

SEQ ID NO: 2230431 - RNA, 21 nt, Streptococcus pyogenes MGAS8232
auuuuugauuuuaauuuuucu

SEQ ID NO: 2230432 - RNA, 15 nt, Streptococcus pyogenes MGAS8232
auuuuuuauaauggu

SEQ ID NO: 2230433 - RNA, 22 nt, Streptococcus pyogenes MGAS8232
auuuucuagguuaaaauagaag

SEQ ID NO: 2230434 - RNA, 16 nt, Streptococcus pyogenes MGAS8232
auuuugucuaaaauaa

SEQ ID NO: 2230435 - RNA, 22 nt, Streptococcus pyogenes MGAS8232
auuuugucuaaaauaaagauga

SEQ ID NO: 2230436 - RNA, 13 nt, Streptococcus pyogenes MGAS8232
auuuuuaauucuu

SEQ ID NO: 2230437 - RNA, 15 nt, Streptococcus pyogenes MGAS8232
auuguaaccacagca

SEQ ID NO: 2230438 - RNA, 15 nt, Streptococcus pyogenes MGAS8232
auuguagggauuuuu

SEQ ID NO: 2230439 - RNA, 22 nt, Streptococcus pyogenes MGAS8232
auucuuuuuccguuugagauaa

SEQ ID NO: 2230440 - RNA, 12 nt, Streptococcus pyogenes MGAS8232
auucuuuuuccg

SEQ ID NO: 2230441 - RNA, 13 nt, Streptococcus pyogenes MGAS8232
auucuuuuuuacc

SEQ ID NO: 2230442 - RNA, 21 nt, Streptococcus pyogenes MGAS8232
auugaugaguuuauguaugcu

SEQ ID NO: 2230443 - RNA, 15 nt, Streptococcus pyogenes MGAS8232
auugcagcuaaaaac

SEQ ID NO: 2230444 - RNA, 19 nt, Streptococcus pyogenes MGAS8232
auugcaugaggcaaaugaa

SEQ ID NO: 2230445 - RNA, 10 nt, Streptococcus pyogenes MGAS8232
auucuugcag

SEQ ID NO: 2230446 - RNA, 15 nt, Streptococcus pyogenes MGAS8232
auuccuucuuuuucc

SEQ ID NO: 2230447 - RNA, 15 nt, Streptococcus pyogenes MGAS8232
auuccaaacauccaa

SEQ ID NO: 2230448 - RNA, 14 nt, Streptococcus pyogenes MGAS8232
auuccaaacaucca

SEQ ID NO: 2230449 - RNA, 13 nt, Streptococcus pyogenes MGAS8232
auucauuuucuuc

SEQ ID NO: 2230450 - RNA, 14 nt, Streptococcus pyogenes MGAS8232
auucauguuuaaaa

SEQ ID NO: 2230451 - RNA, 19 nt, Streptococcus pyogenes MGAS8232
auuagcauaccuaaaagaa

SEQ ID NO: 2230452 - RNA, 20 nt, Streptococcus pyogenes MGAS8232
aaaagccuauuuaauaggcu

SEQ ID NO: 2230453 - RNA, 15 nt, Streptococcus pyogenes MGAS8232
auuagcaaaaugcug

SEQ ID NO: 2230454 - RNA, 16 nt, Streptococcus pyogenes MGAS8232
aaaagccagagcaguu

SEQ ID NO: 2230455 - RNA, 21 nt, Streptococcus pyogenes MGAS8232
auuauuaacguuaacaaaaau

SEQ ID NO: 2230456 - RNA, 17 nt, Streptococcus pyogenes MGAS8232
auuauuuuaauuuuucc

SEQ ID NO: 2230457 - RNA, 18 nt, Streptococcus pyogenes MGAS8232
auuauuuuaauuuuuccu

SEQ ID NO: 2230458 - RNA, 20 nt, Streptococcus pyogenes MGAS8232
auuauuuugggacuaggaau

SEQ ID NO: 2230459 - RNA, 13 nt, Streptococcus pyogenes MGAS8232
auuauuuugcuuc

SEQ ID NO: 2230460 - RNA, 14 nt, Streptococcus pyogenes MGAS8232
auuauguucuaaaa

SEQ ID NO: 2230461 - RNA, 17 nt, Streptococcus pyogenes MGAS8232
auuaguccaaaauguac

SEQ ID NO: 2230462 - RNA, 13 nt, Streptococcus pyogenes MGAS8232
auuauauuaaauu

SEQ ID NO: 2230463 - RNA, 16 nt, Streptococcus pyogenes MGAS8232
auuauauuaaauuaau

SEQ ID NO: 2230464 - RNA, 13 nt, Streptococcus pyogenes MGAS8232
auuauauuaggau

SEQ ID NO: 2230465 - RNA, 14 nt, Streptococcus pyogenes MGAS8232
auuauauuaggaua

SEQ ID NO: 2230466 - RNA, 13 nt, Streptococcus pyogenes MGAS8232
auguuuuauuacc

SEQ ID NO: 2230467 - RNA, 19 nt, Streptococcus pyogenes MGAS8232
auguucucauaaacaauga

SEQ ID NO: 2230468 - RNA, 21 nt, Streptococcus pyogenes MGAS8232
auuaaagcccuuauguauuuu

SEQ ID NO: 2230469 - RNA, 18 nt, Streptococcus pyogenes MGAS8232
auuaacguuaacaaaaau

SEQ ID NO: 2230470 - RNA, 19 nt, Streptococcus pyogenes MGAS8232
auuaauaaguauuuuaaaa

SEQ ID NO: 2230471 - RNA, 23 nt, Streptococcus pyogenes MGAS8232
auuaagauuugaccacaccuaau

SEQ ID NO: 2230472 - RNA, 15 nt, Streptococcus pyogenes MGAS8232
augucucgaauauaa

SEQ ID NO: 2230473 - RNA, 16 nt, Streptococcus pyogenes MGAS8232
auguuauuaaauaaua

SEQ ID NO: 2230474 - RNA, 18 nt, Streptococcus pyogenes MGAS8232
augcuucuuucaaacgga

SEQ ID NO: 2230475 - RNA, 19 nt, Streptococcus pyogenes MGAS8232
augcuugcucaauuuuuga

SEQ ID NO: 2230476 - RNA, 16 nt, Streptococcus pyogenes MGAS8232
augcuuuuaauuuuau

SEQ ID NO: 2230477 - RNA, 20 nt, Streptococcus pyogenes MGAS8232
augcuguccaugauuuucau

SEQ ID NO: 2230478 - RNA, 22 nt, Streptococcus pyogenes MGAS8232
auggaugcuccuccaccaaaac

SEQ ID NO: 2230479 - RNA, 16 nt, Streptococcus pyogenes MGAS8232
auggagucaaugaaaa

SEQ ID NO: 2230480 - RNA, 11 nt, Streptococcus pyogenes MGAS8232
augcuuuuucg

SEQ ID NO: 2230481 - RNA, 14 nt, Streptococcus pyogenes MGAS8232
auguaauugucucu

SEQ ID NO: 2230482 - RNA, 15 nt, Streptococcus pyogenes MGAS8232
augguaaaggccuua

SEQ ID NO: 2230483 - RNA, 15 nt, Streptococcus pyogenes MGAS8232
auggguuguuuuguu

SEQ ID NO: 2230484 - RNA, 13 nt, Streptococcus pyogenes MGAS8232
augagcaaggcaa

SEQ ID NO: 2230485 - RNA, 14 nt, Streptococcus pyogenes MGAS8232
augagcaaggcaag

SEQ ID NO: 2230486 - RNA, 18 nt, Streptococcus pyogenes MGAS8232
augauuauauuaggauau

SEQ ID NO: 2230487 - RNA, 14 nt, Streptococcus pyogenes MGAS8232
augaugucucgaau

SEQ ID NO: 2230488 - RNA, 17 nt, Streptococcus pyogenes MGAS8232
augauuuaguuuuuaaa

SEQ ID NO: 2230489 - RNA, 21 nt, Streptococcus pyogenes MGAS8232
augauugaguaagcagcauca

SEQ ID NO: 2230490 - RNA, 15 nt, Streptococcus pyogenes MGAS8232
augcacacaaaucuu

SEQ ID NO: 2230491 - RNA, 23 nt, Streptococcus pyogenes MGAS8232
augcacacaaaucuucuagaauc

SEQ ID NO: 2230492 - RNA, 14 nt, Streptococcus pyogenes MGAS8232
augauuuuuaauuc

SEQ ID NO: 2230493 - RNA, 16 nt, Streptococcus pyogenes MGAS8232
augauuuuuaauucuu

SEQ ID NO: 2230494 - RNA, 13 nt, Streptococcus pyogenes MGAS8232
augcaaaagauga

SEQ ID NO: 2230495 - RNA, 23 nt, Streptococcus pyogenes MGAS8232
augccaagauaccggguuguuuu

SEQ ID NO: 2230496 - RNA, 20 nt, Streptococcus pyogenes MGAS8232
cacacauaaugauuuuuaau

SEQ ID NO: 2230497 - RNA, 14 nt, Streptococcus pyogenes MGAS8232
cacaacucaagaua

SEQ ID NO: 2230498 - RNA, 22 nt, Streptococcus pyogenes MGAS8232
cacaaggagaucucgauuaucu

SEQ ID NO: 2230499 - RNA, 21 nt, Streptococcus pyogenes MGAS8232
caauggaaauuuuaaaugaca

SEQ ID NO: 2230500 - RNA, 15 nt, Streptococcus pyogenes MGAS8232
caauggaaauuuuaa

SEQ ID NO: 2230501 - RNA, 10 nt, Streptococcus pyogenes MGAS8232
caccaccaau

SEQ ID NO: 2230502 - RNA, 13 nt, Streptococcus pyogenes MGAS8232
caccaccaauaau

SEQ ID NO: 2230503 - RNA, 15 nt, Streptococcus pyogenes MGAS8232
caccagccacuacaa

SEQ ID NO: 2230504 - RNA, 21 nt, Streptococcus pyogenes MGAS8232
cacauacuggucaauggaaau

SEQ ID NO: 2230505 - RNA, 20 nt, Streptococcus pyogenes MGAS8232
caccuuagugguuugcaaau

SEQ ID NO: 2230506 - RNA, 18 nt, Streptococcus pyogenes MGAS8232
aaaauaaacuuucaguua

SEQ ID NO: 2230507 - RNA, 19 nt, Streptococcus pyogenes MGAS8232
aaaauaaacuuucaguuau

SEQ ID NO: 2230508 - RNA, 13 nt, Streptococcus pyogenes MGAS8232
aaaauaacaaucu

SEQ ID NO: 2230509 - RNA, 17 nt, Streptococcus pyogenes MGAS8232
caccgacauacaaagca

SEQ ID NO: 2230510 - RNA, 13 nt, Streptococcus pyogenes MGAS8232
caaaggcuuuuuu

SEQ ID NO: 2230511 - RNA, 14 nt, Streptococcus pyogenes MGAS8232
caaacggaguucuc

SEQ ID NO: 2230512 - RNA, 19 nt, Streptococcus pyogenes MGAS8232
caaaccauuuuaugagaaa

SEQ ID NO: 2230513 - RNA, 18 nt, Streptococcus pyogenes MGAS8232
caaaagaccauaaaaaac

SEQ ID NO: 2230514 - RNA, 16 nt, Streptococcus pyogenes MGAS8232
caaaacuucaaauuuc

SEQ ID NO: 2230515 - RNA, 12 nt, Streptococcus pyogenes MGAS8232
caaaaagacuuc

SEQ ID NO: 2230516 - RNA, 19 nt, Streptococcus pyogenes MGAS8232
caaaaacugugaacaaaac

SEQ ID NO: 2230517 - RNA, 21 nt, Streptococcus pyogenes MGAS8232
caaaaacugugaacaaaacaa

SEQ ID NO: 2230518 - RNA, 18 nt, Streptococcus pyogenes MGAS8232
caaaauuauuauuuugcu

SEQ ID NO: 2230519 - RNA, 18 nt, Streptococcus pyogenes MGAS8232
caacauccauaccaucaa

SEQ ID NO: 2230520 - RNA, 14 nt, Streptococcus pyogenes MGAS8232
caaccgcuucuuuu

SEQ ID NO: 2230521 - RNA, 15 nt, Streptococcus pyogenes MGAS8232
caaccgcuucuuuug

SEQ ID NO: 2230522 - RNA, 15 nt, Streptococcus pyogenes MGAS8232
caaauuuauccugau

SEQ ID NO: 2230523 - RNA, 14 nt, Streptococcus pyogenes MGAS8232
caaauuuauccuga

SEQ ID NO: 2230524 - RNA, 14 nt, Streptococcus pyogenes MGAS8232
caaauuguuugauu

SEQ ID NO: 2230525 - RNA, 16 nt, Streptococcus pyogenes MGAS8232
caaaugaaaaaacuca

SEQ ID NO: 2230526 - RNA, 18 nt, Streptococcus pyogenes MGAS8232
caaauaguagcaaauaac

SEQ ID NO: 2230527 - RNA, 23 nt, Streptococcus pyogenes MGAS8232
caacuaucaaguaugcuuuuaau

SEQ ID NO: 2230528 - RNA, 13 nt, Streptococcus pyogenes MGAS8232
caaccugaaaagu

SEQ ID NO: 2230529 - RNA, 17 nt, Streptococcus pyogenes MGAS8232
caagcauaauaaaaaga

SEQ ID NO: 2230530 - RNA, 21 nt, Streptococcus pyogenes MGAS8232
caagcauaauaaaaagagucu

SEQ ID NO: 2230531 - RNA, 15 nt, Streptococcus pyogenes MGAS8232
caagaaguuuuauag

SEQ ID NO: 2230532 - RNA, 20 nt, Streptococcus pyogenes MGAS8232
caagagcaccgcgaauauga

SEQ ID NO: 2230533 - RNA, 12 nt, Streptococcus pyogenes MGAS8232
caauauccauag

SEQ ID NO: 2230534 - RNA, 15 nt, Streptococcus pyogenes MGAS8232
caauauccauagaaa

SEQ ID NO: 2230535 - RNA, 16 nt, Streptococcus pyogenes MGAS8232
caauauccauagaaau

SEQ ID NO: 2230536 - RNA, 15 nt, Streptococcus pyogenes MGAS8232
caauauagcaaucuu

SEQ ID NO: 2230537 - RNA, 22 nt, Streptococcus pyogenes MGAS8232
caauacgauagugugugugaug

SEQ ID NO: 2230538 - RNA, 21 nt, Streptococcus pyogenes MGAS8232
caaucauacccgcguuaucuc

SEQ ID NO: 2230539 - RNA, 17 nt, Streptococcus pyogenes MGAS8232
caaucgaaaugauagca

SEQ ID NO: 2230540 - RNA, 17 nt, Streptococcus pyogenes MGAS8232
caauaauaccauuuuua

SEQ ID NO: 2230541 - RNA, 22 nt, Streptococcus pyogenes MGAS8232
caaguguuuugucuuauagaau

SEQ ID NO: 2230542 - RNA, 23 nt, Streptococcus pyogenes MGAS8232
caagugccaguaaggaaaucaau

SEQ ID NO: 2230543 - RNA, 19 nt, Streptococcus pyogenes MGAS8232
caagugauacuugguauug

SEQ ID NO: 2230544 - RNA, 20 nt, Streptococcus pyogenes MGAS8232
caaguccugcuuuugaugca

SEQ ID NO: 2230545 - RNA, 20 nt, Streptococcus pyogenes MGAS8232
aaaacgagcuggugcaccga

SEQ ID NO: 2230546 - RNA, 16 nt, Streptococcus pyogenes MGAS8232
aucaggcaaaacaaaa

SEQ ID NO: 2230547 - RNA, 15 nt, Streptococcus pyogenes MGAS8232
auauuagcaaaaugc

SEQ ID NO: 2230548 - RNA, 17 nt, Streptococcus pyogenes MGAS8232
auauuagcaaaaugcug

SEQ ID NO: 2230549 - RNA, 17 nt, Streptococcus pyogenes MGAS8232
auauuauguucuaaaaa

SEQ ID NO: 2230550 - RNA, 18 nt, Streptococcus pyogenes MGAS8232
auauuauguucuaaaaaa

SEQ ID NO: 2230551 - RNA, 14 nt, Streptococcus pyogenes MGAS8232
auauuagcaaaaug

SEQ ID NO: 2230552 - RNA, 21 nt, Streptococcus pyogenes MGAS8232
auauuaaccggcucuaaaaua

SEQ ID NO: 2230553 - RNA, 18 nt, Streptococcus pyogenes MGAS8232
auaugguggguaaaacca

SEQ ID NO: 2230554 - RNA, 20 nt, Streptococcus pyogenes MGAS8232
auauuuuuucucaaaaauau

SEQ ID NO: 2230555 - RNA, 16 nt, Streptococcus pyogenes MGAS8232
auauuuuuucucaaaa

SEQ ID NO: 2230556 - RNA, 19 nt, Streptococcus pyogenes MGAS8232
auaguuauguuauaagaua

SEQ ID NO: 2230557 - RNA, 15 nt, Streptococcus pyogenes MGAS8232
auaucacauuuuaau

SEQ ID NO: 2230558 - RNA, 15 nt, Streptococcus pyogenes MGAS8232
auaguauaccuauau

SEQ ID NO: 2230559 - RNA, 16 nt, Streptococcus pyogenes MGAS8232
auaguauuaucucauu

SEQ ID NO: 2230560 - RNA, 17 nt, Streptococcus pyogenes MGAS8232
auagguaaagauuuuaa

SEQ ID NO: 2230561 - RNA, 19 nt, Streptococcus pyogenes MGAS8232
auagguaaagauuuuaaau

SEQ ID NO: 2230562 - RNA, 12 nt, Streptococcus pyogenes MGAS8232
auaccauuucuu

SEQ ID NO: 2230563 - RNA, 16 nt, Streptococcus pyogenes MGAS8232
auaccaucaaugacuu

SEQ ID NO: 2230564 - RNA, 22 nt, Streptococcus pyogenes MGAS8232
auacaguccaaacucaaacuaa

SEQ ID NO: 2230565 - RNA, 21 nt, Streptococcus pyogenes MGAS8232
auaauuccugugacaacccaa

SEQ ID NO: 2230566 - RNA, 20 nt, Streptococcus pyogenes MGAS8232
auagaaacuuuuuauaagca

SEQ ID NO: 2230567 - RNA, 18 nt, Streptococcus pyogenes MGAS8232
auagaaacuuuuuauaag

SEQ ID NO: 2230568 - RNA, 17 nt, Streptococcus pyogenes MGAS8232
auagaagacaaggugaa

SEQ ID NO: 2230569 - RNA, 19 nt, Streptococcus pyogenes MGAS8232
auagaagacggaguauuuu

SEQ ID NO: 2230570 - RNA, 21 nt, Streptococcus pyogenes MGAS8232
auagaagacggaguauuuuuu

SEQ ID NO: 2230571 - RNA, 14 nt, Streptococcus pyogenes MGAS8232
auagacaagcuuuu

SEQ ID NO: 2230572 - RNA, 23 nt, Streptococcus pyogenes MGAS8232
auagacaagcuuuuuuauaacug

SEQ ID NO: 2230573 - RNA, 14 nt, Streptococcus pyogenes MGAS8232
auagaauaaaaaga

SEQ ID NO: 2230574 - RNA, 12 nt, Streptococcus pyogenes MGAS8232
auacgguaaaaa

SEQ ID NO: 2230575 - RNA, 23 nt, Streptococcus pyogenes MGAS8232
auaccguagaaaguagcaccuuu

SEQ ID NO: 2230576 - RNA, 23 nt, Streptococcus pyogenes MGAS8232
auacguuuauuuaguuauuuuug

SEQ ID NO: 2230577 - RNA, 22 nt, Streptococcus pyogenes MGAS8232
auacguuuauuguugcaauaau

SEQ ID NO: 2230578 - RNA, 15 nt, Streptococcus pyogenes MGAS8232
aucuuuauaaagcuu

SEQ ID NO: 2230579 - RNA, 18 nt, Streptococcus pyogenes MGAS8232
aucuuuuccgagaugacg

SEQ ID NO: 2230580 - RNA, 17 nt, Streptococcus pyogenes MGAS8232
augaagcaaaauaaacu

SEQ ID NO: 2230581 - RNA, 21 nt, Streptococcus pyogenes MGAS8232
augaaacguuauuaaagacaa

SEQ ID NO: 2230582 - RNA, 20 nt, Streptococcus pyogenes MGAS8232
augacacuuaaaugcaaaaa

SEQ ID NO: 2230583 - RNA, 21 nt, Streptococcus pyogenes MGAS8232
augacacuuaaaugcaaaaaa

SEQ ID NO: 2230584 - RNA, 22 nt, Streptococcus pyogenes MGAS8232
augacgccuccaaauacuggua

SEQ ID NO: 2230585 - RNA, 16 nt, Streptococcus pyogenes MGAS8232
augacgguaaauaaag

SEQ ID NO: 2230586 - RNA, 17 nt, Streptococcus pyogenes MGAS8232
augagaguaaacgaaaa

SEQ ID NO: 2230587 - RNA, 19 nt, Streptococcus pyogenes MGAS8232
aucuacucuauuuugaguu

SEQ ID NO: 2230588 - RNA, 15 nt, Streptococcus pyogenes MGAS8232
aucuaaucagagcuc

SEQ ID NO: 2230589 - RNA, 15 nt, Streptococcus pyogenes MGAS8232
auccuccuaaauaua

SEQ ID NO: 2230590 - RNA, 22 nt, Streptococcus pyogenes MGAS8232
auccuuuacuguaauauuuccu

SEQ ID NO: 2230591 - RNA, 13 nt, Streptococcus pyogenes MGAS8232
auccuuuugcuuc

SEQ ID NO: 2230592 - RNA, 13 nt, Streptococcus pyogenes MGAS8232
aucgaaaaugcuu

SEQ ID NO: 2230593 - RNA, 20 nt, Streptococcus pyogenes MGAS8232
aaaagaacuuuacaaucauu

SEQ ID NO: 2230594 - RNA, 19 nt, Streptococcus pyogenes MGAS8232
aaaacugugaacaaaacaa

SEQ ID NO: 2230595 - RNA, 17 nt, Streptococcus pyogenes MGAS8232
aucauggagucaaugaa

SEQ ID NO: 2230596 - RNA, 15 nt, Streptococcus pyogenes MGAS8232
aaaacuccagcugga

SEQ ID NO: 2230597 - RNA, 22 nt, Streptococcus pyogenes MGAS8232
aaaacguguauucuuaaaaaaa

SEQ ID NO: 2230598 - RNA, 14 nt, Streptococcus pyogenes MGAS8232
aaaacucaaaaaau

SEQ ID NO: 2230599 - RNA, 14 nt, Streptococcus pyogenes MGAS8232
auaaauauuuuaua

SEQ ID NO: 2230600 - RNA, 22 nt, Streptococcus pyogenes MGAS8232
auaaauauuuuauauuauguuc

SEQ ID NO: 2230601 - RNA, 23 nt, Streptococcus pyogenes MGAS8232
auaaagcguugacaguuaaaaau

SEQ ID NO: 2230602 - RNA, 15 nt, Streptococcus pyogenes MGAS8232
auaaagcuuuaaaaa

SEQ ID NO: 2230603 - RNA, 19 nt, Streptococcus pyogenes MGAS8232
auaaagcuuuaaaaaauau

SEQ ID NO: 2230604 - RNA, 17 nt, Streptococcus pyogenes MGAS8232
auaaagauaauuucuuu

SEQ ID NO: 2230605 - RNA, 18 nt, Streptococcus pyogenes MGAS8232
auaaagaaacaaaaauga

SEQ ID NO: 2230606 - RNA, 23 nt, Streptococcus pyogenes MGAS8232
aguuuucucagagacaauaaggu

SEQ ID NO: 2230607 - RNA, 16 nt, Streptococcus pyogenes MGAS8232
aguugguauauagcuc

SEQ ID NO: 2230608 - RNA, 18 nt, Streptococcus pyogenes MGAS8232
auaaaaaagaagcaaaau

SEQ ID NO: 2230609 - RNA, 18 nt, Streptococcus pyogenes MGAS8232
auaaaagauauuuuaaaa

SEQ ID NO: 2230610 - RNA, 14 nt, Streptococcus pyogenes MGAS8232
auaaaacaaauaau

SEQ ID NO: 2230611 - RNA, 15 nt, Streptococcus pyogenes MGAS8232
auaaaacaaauaauu

SEQ ID NO: 2230612 - RNA, 13 nt, Streptococcus pyogenes MGAS8232
auaagguuuuuuu

SEQ ID NO: 2230613 - RNA, 12 nt, Streptococcus pyogenes MGAS8232
auaagguuuuuu

SEQ ID NO: 2230614 - RNA, 12 nt, Streptococcus pyogenes MGAS8232
auaaguaauauu

SEQ ID NO: 2230615 - RNA, 15 nt, Streptococcus pyogenes MGAS8232
auaaguauuuuaaaa

SEQ ID NO: 2230616 - RNA, 20 nt, Streptococcus pyogenes MGAS8232
auaagucauuuuaaguaguc

SEQ ID NO: 2230617 - RNA, 21 nt, Streptococcus pyogenes MGAS8232
auaaguauagcauaaaauagu

SEQ ID NO: 2230618 - RNA, 21 nt, Streptococcus pyogenes MGAS8232
auaaguagcguacauggaugc

SEQ ID NO: 2230619 - RNA, 14 nt, Streptococcus pyogenes MGAS8232
auaaugauuuuuaa

SEQ ID NO: 2230620 - RNA, 17 nt, Streptococcus pyogenes MGAS8232
auaagaccuucaaaaaa

SEQ ID NO: 2230621 - RNA, 20 nt, Streptococcus pyogenes MGAS8232
auaagaccuucaaaaaaggg

SEQ ID NO: 2230622 - RNA, 17 nt, Streptococcus pyogenes MGAS8232
auaagauaaguaauauu

SEQ ID NO: 2230623 - RNA, 20 nt, Streptococcus pyogenes MGAS8232
auaagacuuauaugaaagaa

SEQ ID NO: 2230624 - RNA, 12 nt, Streptococcus pyogenes MGAS8232
auaacuuucuau

SEQ ID NO: 2230625 - RNA, 16 nt, Streptococcus pyogenes MGAS8232
auaagauucaauauga

SEQ ID NO: 2230626 - RNA, 20 nt, Streptococcus pyogenes MGAS8232
auaaggcugcgaugauuuug

SEQ ID NO: 2230627 - RNA, 23 nt, Streptococcus pyogenes MGAS8232
aguuauaaagaaacaaaaaugaa

SEQ ID NO: 2230628 - RNA, 16 nt, Streptococcus pyogenes MGAS8232
aguucaauggauauaa

SEQ ID NO: 2230629 - RNA, 21 nt, Streptococcus pyogenes MGAS8232
aguucccuuaauaaacuguau

SEQ ID NO: 2230630 - RNA, 14 nt, Streptococcus pyogenes MGAS8232
aguucgauuauuaa

SEQ ID NO: 2230631 - RNA, 14 nt, Streptococcus pyogenes MGAS8232
aguugcuucuuuua

SEQ ID NO: 2230632 - RNA, 16 nt, Streptococcus pyogenes MGAS8232
agugguuugcaaauag

SEQ ID NO: 2230633 - RNA, 20 nt, Streptococcus pyogenes MGAS8232
aguuaaaaauaacuuuaaaa

SEQ ID NO: 2230634 - RNA, 16 nt, Streptococcus pyogenes MGAS8232
aguguagauaaacugg

SEQ ID NO: 2230635 - RNA, 23 nt, Streptococcus pyogenes MGAS8232
aguguguugucaaacauaacaau

SEQ ID NO: 2230636 - RNA, 20 nt, Streptococcus pyogenes MGAS8232
agucuaugcauguagaugaa

SEQ ID NO: 2230637 - RNA, 16 nt, Streptococcus pyogenes MGAS8232
agucuuagcaccgcuu

SEQ ID NO: 2230638 - RNA, 13 nt, Streptococcus pyogenes MGAS8232
agucuuagaaaua

SEQ ID NO: 2230639 - RNA, 16 nt, Streptococcus pyogenes MGAS8232
aguccaaacucaaacu

SEQ ID NO: 2230640 - RNA, 20 nt, Streptococcus pyogenes MGAS8232
aguccaaaauguacauccua

SEQ ID NO: 2230641 - RNA, 22 nt, Streptococcus pyogenes MGAS8232
agucagaucauuaaauugauua

SEQ ID NO: 2230642 - RNA, 16 nt, Streptococcus pyogenes MGAS8232
agucaauuuagccguc

SEQ ID NO: 2230643 - RNA, 14 nt, Streptococcus pyogenes MGAS8232
agucaaugaaaagu

SEQ ID NO: 2230644 - RNA, 23 nt, Streptococcus pyogenes MGAS8232
aggugaaaauaucuuuuuuacuu

SEQ ID NO: 2230645 - RNA, 22 nt, Streptococcus pyogenes MGAS8232
aggucugcaauauccauagaaa

SEQ ID NO: 2230646 - RNA, 23 nt, Streptococcus pyogenes MGAS8232
aggucugcgcgacuaaaaucaug

SEQ ID NO: 2230647 - RNA, 16 nt, Streptococcus pyogenes MGAS8232
aggucugcuucuuacu

SEQ ID NO: 2230648 - RNA, 18 nt, Streptococcus pyogenes MGAS8232
aggucugugaugaaucau

SEQ ID NO: 2230649 - RNA, 16 nt, Streptococcus pyogenes MGAS8232
agguaaagauuuuaaa

SEQ ID NO: 2230650 - RNA, 15 nt, Streptococcus pyogenes MGAS8232
agguauuuauaaaua

SEQ ID NO: 2230651 - RNA, 18 nt, Streptococcus pyogenes MGAS8232
aggugccuguuuuugcug

SEQ ID NO: 2230652 - RNA, 15 nt, Streptococcus pyogenes MGAS8232
agguuaaguaaaagc

SEQ ID NO: 2230653 - RNA, 16 nt, Streptococcus pyogenes MGAS8232
aguaaggaccaagauu

SEQ ID NO: 2230654 - RNA, 15 nt, Streptococcus pyogenes MGAS8232
aguaaggaaaucaau

SEQ ID NO: 2230655 - RNA, 16 nt, Streptococcus pyogenes MGAS8232
aguacaaggcaaucca

SEQ ID NO: 2230656 - RNA, 14 nt, Streptococcus pyogenes MGAS8232
aguaagcagcauca

SEQ ID NO: 2230657 - RNA, 21 nt, Streptococcus pyogenes MGAS8232
aggggagacggauuuaaccau

SEQ ID NO: 2230658 - RNA, 16 nt, Streptococcus pyogenes MGAS8232
aggcuuacgacagcag

SEQ ID NO: 2230659 - RNA, 13 nt, Streptococcus pyogenes MGAS8232
aggcucauauuag

SEQ ID NO: 2230660 - RNA, 20 nt, Streptococcus pyogenes MGAS8232
aggcaauccaaaucaacaug

SEQ ID NO: 2230661 - RNA, 19 nt, Streptococcus pyogenes MGAS8232
aggcagagccuuaaaaagu

SEQ ID NO: 2230662 - RNA, 17 nt, Streptococcus pyogenes MGAS8232
aggcaguucgauuauua

SEQ ID NO: 2230663 - RNA, 22 nt, Streptococcus pyogenes MGAS8232
aggcaaauagcaaugguuaaaa

SEQ ID NO: 2230664 - RNA, 20 nt, Streptococcus pyogenes MGAS8232
aggcaaaugaaaaaacucaa

SEQ ID NO: 2230665 - RNA, 16 nt, Streptococcus pyogenes MGAS8232
aggaucauuauccuuu

SEQ ID NO: 2230666 - RNA, 20 nt, Streptococcus pyogenes MGAS8232
aggauauugagaagaaaaaa

SEQ ID NO: 2230667 - RNA, 14 nt, Streptococcus pyogenes MGAS8232
aggaggcaacugug

SEQ ID NO: 2230668 - RNA, 11 nt, Streptococcus pyogenes MGAS8232
aggaauaaaau

SEQ ID NO: 2230669 - RNA, 13 nt, Streptococcus pyogenes MGAS8232
aggaauaaaaugc

SEQ ID NO: 2230670 - RNA, 15 nt, Streptococcus pyogenes MGAS8232
agcugauaggucugc

SEQ ID NO: 2230671 - RNA, 14 nt, Streptococcus pyogenes MGAS8232
agcuggaguuuuuu

SEQ ID NO: 2230672 - RNA, 23 nt, Streptococcus pyogenes MGAS8232
agcuuuuuuuguuuuggccaaua

SEQ ID NO: 2230673 - RNA, 17 nt, Streptococcus pyogenes MGAS8232
agcuuuaguugcuucuu

SEQ ID NO: 2230674 - RNA, 12 nt, Streptococcus pyogenes MGAS8232
agcuuuaaaaaa

SEQ ID NO: 2230675 - RNA, 16 nt, Streptococcus pyogenes MGAS8232
agcucugucagcaaua

SEQ ID NO: 2230676 - RNA, 13 nt, Streptococcus pyogenes MGAS8232
agcucuaucaucu

SEQ ID NO: 2230677 - RNA, 14 nt, Streptococcus pyogenes MGAS8232
agcucuaucaucuu

SEQ ID NO: 2230678 - RNA, 18 nt, Streptococcus pyogenes MGAS8232
agcucuaucaucuuugua

SEQ ID NO: 2230679 - RNA, 14 nt, Streptococcus pyogenes MGAS8232
agcucuuuaucacc

SEQ ID NO: 2230680 - RNA, 17 nt, Streptococcus pyogenes MGAS8232
accgcuaggauuuuucc

SEQ ID NO: 2230681 - RNA, 19 nt, Streptococcus pyogenes MGAS8232
accuaauugugagaaacua

SEQ ID NO: 2230682 - RNA, 22 nt, Streptococcus pyogenes MGAS8232
accuacgauaaaacaaauaauu

SEQ ID NO: 2230683 - RNA, 23 nt, Streptococcus pyogenes MGAS8232
accuacugccauggguaaaauga

SEQ ID NO: 2230684 - RNA, 13 nt, Streptococcus pyogenes MGAS8232
accagcaccuucu

SEQ ID NO: 2230685 - RNA, 16 nt, Streptococcus pyogenes MGAS8232
accgaagucucuuuug

SEQ ID NO: 2230686 - RNA, 14 nt, Streptococcus pyogenes MGAS8232
accccaaaggcuga

SEQ ID NO: 2230687 - RNA, 20 nt, Streptococcus pyogenes MGAS8232
accccaaaggcugaugcgau

SEQ ID NO: 2230688 - RNA, 18 nt, Streptococcus pyogenes MGAS8232
acguguauucuuaaaaaa

SEQ ID NO: 2230689 - RNA, 19 nt, Streptococcus pyogenes MGAS8232
acgucuaccgcaauuaaac

SEQ ID NO: 2230690 - RNA, 13 nt, Streptococcus pyogenes MGAS8232
acuguaauauuuc

SEQ ID NO: 2230691 - RNA, 16 nt, Streptococcus pyogenes MGAS8232
acuguaauuaugcaaa

SEQ ID NO: 2230692 - RNA, 13 nt, Streptococcus pyogenes MGAS8232
acuguuuuucuua

SEQ ID NO: 2230693 - RNA, 18 nt, Streptococcus pyogenes MGAS8232
acuggcauagaaauaguu

SEQ ID NO: 2230694 - RNA, 21 nt, Streptococcus pyogenes MGAS8232
acugggucaacuccaaucuca

SEQ ID NO: 2230695 - RNA, 13 nt, Streptococcus pyogenes MGAS8232
acuggucaaaagc

SEQ ID NO: 2230696 - RNA, 20 nt, Streptococcus pyogenes MGAS8232
acucuauuuuaaguaaagga

SEQ ID NO: 2230697 - RNA, 13 nt, Streptococcus pyogenes MGAS8232
acucuauuuacuc

SEQ ID NO: 2230698 - RNA, 13 nt, Streptococcus pyogenes MGAS8232
acucguaagcauu

SEQ ID NO: 2230699 - RNA, 16 nt, Streptococcus pyogenes MGAS8232
acugccucauuugcug

SEQ ID NO: 2230700 - RNA, 19 nt, Streptococcus pyogenes MGAS8232
acugccauggguaaaauga

SEQ ID NO: 2230701 - RNA, 17 nt, Streptococcus pyogenes MGAS8232
acugccaguugagccuu

SEQ ID NO: 2230702 - RNA, 19 nt, Streptococcus pyogenes MGAS8232
acuccuggauuaaaugccc

SEQ ID NO: 2230703 - RNA, 23 nt, Streptococcus pyogenes MGAS8232
acucaugauaucccaucuuuguu

SEQ ID NO: 2230704 - RNA, 16 nt, Streptococcus pyogenes MGAS8232
acuaugaaaaaagaac

SEQ ID NO: 2230705 - RNA, 19 nt, Streptococcus pyogenes MGAS8232
acuaguuuauuacaaaacu

SEQ ID NO: 2230706 - RNA, 20 nt, Streptococcus pyogenes MGAS8232
acucaauauaauaaaaagua

SEQ ID NO: 2230707 - RNA, 21 nt, Streptococcus pyogenes MGAS8232
acuauggcuucuaaaaaaaag

SEQ ID NO: 2230708 - RNA, 22 nt, Streptococcus pyogenes MGAS8232
agcaaucauacccgcguuaucu

SEQ ID NO: 2230709 - RNA, 15 nt, Streptococcus pyogenes MGAS8232
agcaaucauguuguc

SEQ ID NO: 2230710 - RNA, 14 nt, Streptococcus pyogenes MGAS8232
agcaaucuucaaca

SEQ ID NO: 2230711 - RNA, 18 nt, Streptococcus pyogenes MGAS8232
agcaaugguuaaaaagag

SEQ ID NO: 2230712 - RNA, 16 nt, Streptococcus pyogenes MGAS8232
agcaauuguuuuuuca

SEQ ID NO: 2230713 - RNA, 21 nt, Streptococcus pyogenes MGAS8232
agcaagaaguuuuauagcuga

SEQ ID NO: 2230714 - RNA, 17 nt, Streptococcus pyogenes MGAS8232
agcaaggaugaaaugau

SEQ ID NO: 2230715 - RNA, 23 nt, Streptococcus pyogenes MGAS8232
agcagacaaaagggaagagagaa

SEQ ID NO: 2230716 - RNA, 22 nt, Streptococcus pyogenes MGAS8232
agcacuggcuuuuuugcuuuuu

SEQ ID NO: 2230717 - RNA, 19 nt, Streptococcus pyogenes MGAS8232
agcauuuucaucaucaaga

SEQ ID NO: 2230718 - RNA, 16 nt, Streptococcus pyogenes MGAS8232
agcauuugccauggca

SEQ ID NO: 2230719 - RNA, 22 nt, Streptococcus pyogenes MGAS8232
agcauuaaggauuaugaaaaag

SEQ ID NO: 2230720 - RNA, 18 nt, Streptococcus pyogenes MGAS8232
agcagccugucaagcccu

SEQ ID NO: 2230721 - RNA, 14 nt, Streptococcus pyogenes MGAS8232
agcauaauaaaaag

SEQ ID NO: 2230722 - RNA, 21 nt, Streptococcus pyogenes MGAS8232
agcauaauaaaaagagucuga

SEQ ID NO: 2230723 - RNA, 21 nt, Streptococcus pyogenes MGAS8232
agcauauugaaacuugcugcc

SEQ ID NO: 2230724 - RNA, 23 nt, Streptococcus pyogenes MGAS8232
agcauaaaagauauuuuaaaaua

SEQ ID NO: 2230725 - RNA, 23 nt, Streptococcus pyogenes MGAS8232
agcaguugcgaucauaaauaaag

SEQ ID NO: 2230726 - RNA, 21 nt, Streptococcus pyogenes MGAS8232
agcgcacuuuauuaugccaaa

SEQ ID NO: 2230727 - RNA, 13 nt, Streptococcus pyogenes MGAS8232
agccuuauccauu

SEQ ID NO: 2230728 - RNA, 18 nt, Streptococcus pyogenes MGAS8232
agccgcucuaauuuaguc

SEQ ID NO: 2230729 - RNA, 17 nt, Streptococcus pyogenes MGAS8232
acuugguucugaaaaua

SEQ ID NO: 2230730 - RNA, 17 nt, Streptococcus pyogenes MGAS8232
acuugggagaguuccug

SEQ ID NO: 2230731 - RNA, 14 nt, Streptococcus pyogenes MGAS8232
acuugggagaguuc

SEQ ID NO: 2230732 - RNA, 16 nt, Streptococcus pyogenes MGAS8232
acuuguuacaaaaaac

SEQ ID NO: 2230733 - RNA, 18 nt, Streptococcus pyogenes MGAS8232
acuuguuacaaaaaacaa

SEQ ID NO: 2230734 - RNA, 19 nt, Streptococcus pyogenes MGAS8232
acuuguuacaaaaaacaag

SEQ ID NO: 2230735 - RNA, 16 nt, Streptococcus pyogenes MGAS8232
acuugcuuugacaaag

SEQ ID NO: 2230736 - RNA, 15 nt, Streptococcus pyogenes MGAS8232
acuuuaaacacuacc

SEQ ID NO: 2230737 - RNA, 21 nt, Streptococcus pyogenes MGAS8232
acuuuaaacacuaccuuaaau

SEQ ID NO: 2230738 - RNA, 22 nt, Streptococcus pyogenes MGAS8232
acuuuauugaugauaaaggccu

SEQ ID NO: 2230739 - RNA, 17 nt, Streptococcus pyogenes MGAS8232
acuuuauugaugauaaa

SEQ ID NO: 2230740 - RNA, 21 nt, Streptococcus pyogenes MGAS8232
acuuugacagacaccaaaaaa

SEQ ID NO: 2230741 - RNA, 23 nt, Streptococcus pyogenes MGAS8232
acuuucuauuaccuauagaaagu

SEQ ID NO: 2230742 - RNA, 22 nt, Streptococcus pyogenes MGAS8232
agaaaauuuuccgucguuuuuu

SEQ ID NO: 2230743 - RNA, 16 nt, Streptococcus pyogenes MGAS8232
agaauagguaaagauu

SEQ ID NO: 2230744 - RNA, 22 nt, Streptococcus pyogenes MGAS8232
agaauagucuaugcauguagau

SEQ ID NO: 2230745 - RNA, 22 nt, Streptococcus pyogenes MGAS8232
agaaguugagacuaaaggucug

SEQ ID NO: 2230746 - RNA, 14 nt, Streptococcus pyogenes MGAS8232
agaagccaauuacu

SEQ ID NO: 2230747 - RNA, 14 nt, Streptococcus pyogenes MGAS8232
agaaucaaggggau

SEQ ID NO: 2230748 - RNA, 17 nt, Streptococcus pyogenes MGAS8232
agaacuuuacaaucauu

SEQ ID NO: 2230749 - RNA, 19 nt, Streptococcus pyogenes MGAS8232
agaagacaaggugaauaua

SEQ ID NO: 2230750 - RNA, 14 nt, Streptococcus pyogenes MGAS8232
agaaauuaauaaau

SEQ ID NO: 2230751 - RNA, 15 nt, Streptococcus pyogenes MGAS8232
agaaauuaauaaauu

SEQ ID NO: 2230752 - RNA, 15 nt, Streptococcus pyogenes MGAS8232
agaaacuaaaggcaa

SEQ ID NO: 2230753 - RNA, 11 nt, Streptococcus pyogenes MGAS8232
aaaacagaaag

SEQ ID NO: 2230754 - RNA, 18 nt, Streptococcus pyogenes MGAS8232
agauagucaaaaagacuu

SEQ ID NO: 2230755 - RNA, 16 nt, Streptococcus pyogenes MGAS8232
agagucugagcaauca

SEQ ID NO: 2230756 - RNA, 15 nt, Streptococcus pyogenes MGAS8232
agagucauuugacua

SEQ ID NO: 2230757 - RNA, 20 nt, Streptococcus pyogenes MGAS8232
agauaagaccuucaaaaaag

SEQ ID NO: 2230758 - RNA, 19 nt, Streptococcus pyogenes MGAS8232
agauaagaccuucaaaaaa

SEQ ID NO: 2230759 - RNA, 19 nt, Streptococcus pyogenes MGAS8232
agaguuugaggugauguuc

SEQ ID NO: 2230760 - RNA, 18 nt, Streptococcus pyogenes MGAS8232
agauuaaacuuacaaaaa

SEQ ID NO: 2230761 - RNA, 23 nt, Streptococcus pyogenes MGAS8232
agaugcuugcucaauuuuugauu

SEQ ID NO: 2230762 - RNA, 20 nt, Streptococcus pyogenes MGAS8232
agaugcuugcucaauuuuug

SEQ ID NO: 2230763 - RNA, 15 nt, Streptococcus pyogenes MGAS8232
agaugguagcaagaa

SEQ ID NO: 2230764 - RNA, 17 nt, Streptococcus pyogenes MGAS8232
agauggguuagcucugu

SEQ ID NO: 2230765 - RNA, 13 nt, Streptococcus pyogenes MGAS8232
agaucuucuuuug

SEQ ID NO: 2230766 - RNA, 22 nt, Streptococcus pyogenes MGAS8232
agagagguugguaaaaaggcag

SEQ ID NO: 2230767 - RNA, 14 nt, Streptococcus pyogenes MGAS8232
agagccaaaauaac

SEQ ID NO: 2230768 - RNA, 21 nt, Streptococcus pyogenes MGAS8232
agagacaauaaggucaucaga

SEQ ID NO: 2230769 - RNA, 15 nt, Streptococcus pyogenes MGAS8232
agacuuuuaauguau

SEQ ID NO: 2230770 - RNA, 19 nt, Streptococcus pyogenes MGAS8232
agacucaauugaaagaggu

SEQ ID NO: 2230771 - RNA, 23 nt, Streptococcus pyogenes MGAS8232
agacucaauugaaagaggugcaa

SEQ ID NO: 2230772 - RNA, 19 nt, Streptococcus pyogenes MGAS8232
agacucugacuguaauuau

SEQ ID NO: 2230773 - RNA, 22 nt, Streptococcus pyogenes MGAS8232
agacuuauaugaaagaacuauu

SEQ ID NO: 2230774 - RNA, 14 nt, Streptococcus pyogenes MGAS8232
acaguuaaaaauaa

SEQ ID NO: 2230775 - RNA, 13 nt, Streptococcus pyogenes MGAS8232
acacguauuuuuc

SEQ ID NO: 2230776 - RNA, 24 nt, Streptococcus pyogenes MGAS8232
acagcaauuuguuccaucugcaca

SEQ ID NO: 2230777 - RNA, 19 nt, Streptococcus pyogenes MGAS8232
acagccguucuuaaaagaa

SEQ ID NO: 2230778 - RNA, 14 nt, Streptococcus pyogenes MGAS8232
acauuuuuacaaua

SEQ ID NO: 2230779 - RNA, 17 nt, Streptococcus pyogenes MGAS8232
acauuuaaucaugucca

SEQ ID NO: 2230780 - RNA, 15 nt, Streptococcus pyogenes MGAS8232
acaugaccaaaaaau

SEQ ID NO: 2230781 - RNA, 13 nt, Streptococcus pyogenes MGAS8232
acauguccaaauc

SEQ ID NO: 2230782 - RNA, 18 nt, Streptococcus pyogenes MGAS8232
acauaauguuauaauaau

SEQ ID NO: 2230783 - RNA, 19 nt, Streptococcus pyogenes MGAS8232
acauaauguuauaauaaua

SEQ ID NO: 2230784 - RNA, 15 nt, Streptococcus pyogenes MGAS8232
acaucacguaaccaa

SEQ ID NO: 2230785 - RNA, 13 nt, Streptococcus pyogenes MGAS8232
acaaauccuuuug

SEQ ID NO: 2230786 - RNA, 14 nt, Streptococcus pyogenes MGAS8232
acaaauacagaaga

SEQ ID NO: 2230787 - RNA, 19 nt, Streptococcus pyogenes MGAS8232
acaaauacagaagaaagcu

SEQ ID NO: 2230788 - RNA, 13 nt, Streptococcus pyogenes MGAS8232
acaaaagggaaga

SEQ ID NO: 2230789 - RNA, 16 nt, Streptococcus pyogenes MGAS8232
acaaaacccuuucgua

SEQ ID NO: 2230790 - RNA, 10 nt, Streptococcus pyogenes MGAS8232
acaaaacaaa

SEQ ID NO: 2230791 - RNA, 15 nt, Streptococcus pyogenes MGAS8232
acaaaacaaaacaua

SEQ ID NO: 2230792 - RNA, 21 nt, Streptococcus pyogenes MGAS8232
acaaaaacugugaacaaaaca

SEQ ID NO: 2230793 - RNA, 13 nt, Streptococcus pyogenes MGAS8232
acaaaaagagacc

SEQ ID NO: 2230794 - RNA, 15 nt, Streptococcus pyogenes MGAS8232
aauuuagucauuucu

SEQ ID NO: 2230795 - RNA, 14 nt, Streptococcus pyogenes MGAS8232
acaaagcaucagga

SEQ ID NO: 2230796 - RNA, 14 nt, Streptococcus pyogenes MGAS8232
acaccaaaaaaagc

SEQ ID NO: 2230797 - RNA, 15 nt, Streptococcus pyogenes MGAS8232
acaccaaaaaaagca

SEQ ID NO: 2230798 - RNA, 21 nt, Streptococcus pyogenes MGAS8232
acaccuaauaaaauagcaccu

SEQ ID NO: 2230799 - RNA, 14 nt, Streptococcus pyogenes MGAS8232
acaccuaauaaaau

SEQ ID NO: 2230800 - RNA, 20 nt, Streptococcus pyogenes MGAS8232
acaaggcaauccaaaucaac

SEQ ID NO: 2230801 - RNA, 19 nt, Streptococcus pyogenes MGAS8232
acaauacaaaaaaccuucc

SEQ ID NO: 2230802 - RNA, 19 nt, Streptococcus pyogenes MGAS8232
acaaguaaucgaaaaugcu

SEQ ID NO: 2230803 - RNA, 21 nt, Streptococcus pyogenes MGAS8232
acaaucgaaaugauagcaccu

SEQ ID NO: 2230804 - RNA, 22 nt, Streptococcus pyogenes MGAS8232
acaaugagaucuucuuuugguu

SEQ ID NO: 2230805 - RNA, 16 nt, Streptococcus pyogenes MGAS8232
aaucuucaacaccuuc

SEQ ID NO: 2230806 - RNA, 12 nt, Streptococcus pyogenes MGAS8232
aauauuuccuuu

SEQ ID NO: 2230807 - RNA, 16 nt, Streptococcus pyogenes MGAS8232
aauauuuccuuuuaaa

SEQ ID NO: 2230808 - RNA, 20 nt, Streptococcus pyogenes MGAS8232
aauauuuccuuuuaaagaca

SEQ ID NO: 2230809 - RNA, 14 nt, Streptococcus pyogenes MGAS8232
aauauuuuauuaau

SEQ ID NO: 2230810 - RNA, 14 nt, Streptococcus pyogenes MGAS8232
aauauuuuuacauu

SEQ ID NO: 2230811 - RNA, 17 nt, Streptococcus pyogenes MGAS8232
aauaugauauaaaaaug

SEQ ID NO: 2230812 - RNA, 22 nt, Streptococcus pyogenes MGAS8232
aauagcauugucaaauaaaauc

SEQ ID NO: 2230813 - RNA, 21 nt, Streptococcus pyogenes MGAS8232
aauagcauugucaaauaaaau

SEQ ID NO: 2230814 - RNA, 13 nt, Streptococcus pyogenes MGAS8232
aauaugugauuau

SEQ ID NO: 2230815 - RNA, 21 nt, Streptococcus pyogenes MGAS8232
aauauuauaguauuaucucau

SEQ ID NO: 2230816 - RNA, 19 nt, Streptococcus pyogenes MGAS8232
aauauuauauuaaauuaau

SEQ ID NO: 2230817 - RNA, 12 nt, Streptococcus pyogenes MGAS8232
aaucagaacucg

SEQ ID NO: 2230818 - RNA, 19 nt, Streptococcus pyogenes MGAS8232
aauucuuuuauuaauguaa

SEQ ID NO: 2230819 - RNA, 16 nt, Streptococcus pyogenes MGAS8232
aaaacaauaacacaga

SEQ ID NO: 2230820 - RNA, 14 nt, Streptococcus pyogenes MGAS8232
aauuuagucauuuc

SEQ ID NO: 2230821 - RNA, 14 nt, Streptococcus pyogenes MGAS8232
aauuauuaguaacc

SEQ ID NO: 2230822 - RNA, 18 nt, Streptococcus pyogenes MGAS8232
aauuccccacaaaagaca

SEQ ID NO: 2230823 - RNA, 13 nt, Streptococcus pyogenes MGAS8232
aauuaaaccauuc

SEQ ID NO: 2230824 - RNA, 15 nt, Streptococcus pyogenes MGAS8232
aauuaaaccauucua

SEQ ID NO: 2230825 - RNA, 16 nt, Streptococcus pyogenes MGAS8232
aauguccgaaaaaaac

SEQ ID NO: 2230826 - RNA, 21 nt, Streptococcus pyogenes MGAS8232
aaugugacaauuggugauuaa

SEQ ID NO: 2230827 - RNA, 17 nt, Streptococcus pyogenes MGAS8232
aaugauuuuuaauucuu

SEQ ID NO: 2230828 - RNA, 23 nt, Streptococcus pyogenes MGAS8232
aaugcccaagauggguuagcucu

SEQ ID NO: 2230829 - RNA, 15 nt, Streptococcus pyogenes MGAS8232
aaugccaaucuuugu

SEQ ID NO: 2230830 - RNA, 23 nt, Streptococcus pyogenes MGAS8232
aauggaaauuuuaaaugacauga

SEQ ID NO: 2230831 - RNA, 24 nt, Streptococcus pyogenes MGAS8232
aaugcuguuugucauacucaauag

SEQ ID NO: 2230832 - RNA, 18 nt, Streptococcus pyogenes MGAS8232
aacacucaucauauuguu

SEQ ID NO: 2230833 - RNA, 22 nt, Streptococcus pyogenes MGAS8232
aacagauaagugccaucaggcu

SEQ ID NO: 2230834 - RNA, 11 nt, Streptococcus pyogenes MGAS8232
aacagaaagcg

SEQ ID NO: 2230835 - RNA, 19 nt, Streptococcus pyogenes MGAS8232
aacagaaagcggaagaaca

SEQ ID NO: 2230836 - RNA, 12 nt, Streptococcus pyogenes MGAS8232
aacagcauuuuc

SEQ ID NO: 2230837 - RNA, 18 nt, Streptococcus pyogenes MGAS8232
aacagcauuuucaucauc

SEQ ID NO: 2230838 - RNA, 18 nt, Streptococcus pyogenes MGAS8232
aaaaaguaaaaucuuauu

SEQ ID NO: 2230839 - RNA, 15 nt, Streptococcus pyogenes MGAS8232
aaaaaguaaaaucuu

SEQ ID NO: 2230840 - RNA, 16 nt, Streptococcus pyogenes MGAS8232
aaaaagggaagaagau

SEQ ID NO: 2230841 - RNA, 22 nt, Streptococcus pyogenes MGAS8232
aacaaugaaacguuauuaaaga

SEQ ID NO: 2230842 - RNA, 18 nt, Streptococcus pyogenes MGAS8232
aacaauaacacagaagcc

SEQ ID NO: 2230843 - RNA, 15 nt, Streptococcus pyogenes MGAS8232
aaccgcuaaaacagu

SEQ ID NO: 2230844 - RNA, 18 nt, Streptococcus pyogenes MGAS8232
aaccauaucgacauuuau

SEQ ID NO: 2230845 - RNA, 17 nt, Streptococcus pyogenes MGAS8232
aaccauaucacaaaacc

SEQ ID NO: 2230846 - RNA, 16 nt, Streptococcus pyogenes MGAS8232
aaccauaucacaaaac

SEQ ID NO: 2230847 - RNA, 17 nt, Streptococcus pyogenes MGAS8232
aaccauuuuaugagaaa

SEQ ID NO: 2230848 - RNA, 15 nt, Streptococcus pyogenes MGAS8232
aacaucuugauugua

SEQ ID NO: 2230849 - RNA, 20 nt, Streptococcus pyogenes MGAS8232
aacauauuauaguaaccauu

SEQ ID NO: 2230850 - RNA, 12 nt, Streptococcus pyogenes MGAS8232
aaccaagugcca

SEQ ID NO: 2230851 - RNA, 20 nt, Streptococcus pyogenes MGAS8232
aagaaggucucaaauuuuuu

SEQ ID NO: 2230852 - RNA, 14 nt, Streptococcus pyogenes MGAS8232
aagaaggucaugau

SEQ ID NO: 2230853 - RNA, 11 nt, Streptococcus pyogenes MGAS8232
aagaaaaccuu

SEQ ID NO: 2230854 - RNA, 16 nt, Streptococcus pyogenes MGAS8232
aagaaagacuuaagga

SEQ ID NO: 2230855 - RNA, 21 nt, Streptococcus pyogenes MGAS8232
aacuguuuuucuuauauugug

SEQ ID NO: 2230856 - RNA, 18 nt, Streptococcus pyogenes MGAS8232
aacucaaaaaauacaaua

SEQ ID NO: 2230857 - RNA, 19 nt, Streptococcus pyogenes MGAS8232
aacucaagaggucuggcca

SEQ ID NO: 2230858 - RNA, 21 nt, Streptococcus pyogenes MGAS8232
aacugcacugagccccaaaag

SEQ ID NO: 2230859 - RNA, 17 nt, Streptococcus pyogenes MGAS8232
aacguaauagaauaaaa

SEQ ID NO: 2230860 - RNA, 13 nt, Streptococcus pyogenes MGAS8232
aacgugagaaaau

SEQ ID NO: 2230861 - RNA, 14 nt, Streptococcus pyogenes MGAS8232
aacgaucaaaaauc

SEQ ID NO: 2230862 - RNA, 21 nt, Streptococcus pyogenes MGAS8232
aagcugaagcuagagcuaaag

SEQ ID NO: 2230863 - RNA, 14 nt, Streptococcus pyogenes MGAS8232
aagcucuaucaucu

SEQ ID NO: 2230864 - RNA, 16 nt, Streptococcus pyogenes MGAS8232
aagcggaagaacagca

SEQ ID NO: 2230865 - RNA, 15 nt, Streptococcus pyogenes MGAS8232
aaggcaaagaaagcc

SEQ ID NO: 2230866 - RNA, 15 nt, Streptococcus pyogenes MGAS8232
aaggauuuagcuguu

SEQ ID NO: 2230867 - RNA, 13 nt, Streptococcus pyogenes MGAS8232
aaggcaaagaaag

SEQ ID NO: 2230868 - RNA, 21 nt, Streptococcus pyogenes MGAS8232
aagggugaaucauuacuccuu

SEQ ID NO: 2230869 - RNA, 14 nt, Streptococcus pyogenes MGAS8232
aagggcaaugccau

SEQ ID NO: 2230870 - RNA, 17 nt, Streptococcus pyogenes MGAS8232
aaggucaucagaauaag

SEQ ID NO: 2230871 - RNA, 15 nt, Streptococcus pyogenes MGAS8232
aaggucucaaauuuu

SEQ ID NO: 2230872 - RNA, 20 nt, Streptococcus pyogenes MGAS8232
aagcccuuauguauuuuuca

SEQ ID NO: 2230873 - RNA, 17 nt, Streptococcus pyogenes MGAS8232
aagccagagcaguucag

SEQ ID NO: 2230874 - RNA, 12 nt, Streptococcus pyogenes MGAS8232
aagcauuuugag

SEQ ID NO: 2230875 - RNA, 15 nt, Streptococcus pyogenes MGAS8232
aagcauaaaaauauu

SEQ ID NO: 2230876 - RNA, 13 nt, Streptococcus pyogenes MGAS8232
aagcauaaaaaua

SEQ ID NO: 2230877 - RNA, 19 nt, Streptococcus pyogenes MGAS8232
aagcagugcuuuaacaaug

SEQ ID NO: 2230878 - RNA, 16 nt, Streptococcus pyogenes MGAS8232
aagcagugcuuuaaca

SEQ ID NO: 2230879 - RNA, 12 nt, Streptococcus pyogenes MGAS8232
aagauuggauuu

SEQ ID NO: 2230880 - RNA, 13 nt, Streptococcus pyogenes MGAS8232
aagcaaucuaaga

SEQ ID NO: 2230881 - RNA, 17 nt, Streptococcus pyogenes MGAS8232
aagcaaucuaagaauug

SEQ ID NO: 2230882 - RNA, 19 nt, Streptococcus pyogenes MGAS8232
aagauuaaacuuacaaaaa

SEQ ID NO: 2230883 - RNA, 18 nt, Streptococcus pyogenes MGAS8232
aagauuaaacuuacaaaa

SEQ ID NO: 2230884 - RNA, 19 nt, Streptococcus pyogenes MGAS8232
aauaccguagaaaguagca

SEQ ID NO: 2230885 - RNA, 23 nt, Streptococcus pyogenes MGAS8232
aauaauauuauaguauuaucuca

SEQ ID NO: 2230886 - RNA, 13 nt, Streptococcus pyogenes MGAS8232
aaaaauauauucu

SEQ ID NO: 2230887 - RNA, 20 nt, Streptococcus pyogenes MGAS8232
aauacagccguucuuaaaag

SEQ ID NO: 2230888 - RNA, 23 nt, Streptococcus pyogenes MGAS8232
aagugugacuaguuuauuacaaa

SEQ ID NO: 2230889 - RNA, 23 nt, Streptococcus pyogenes MGAS8232
aaguuagggucugagugacuaaa

SEQ ID NO: 2230890 - RNA, 20 nt, Streptococcus pyogenes MGAS8232
aaguugccuuaucucaguuu

SEQ ID NO: 2230891 - RNA, 19 nt, Streptococcus pyogenes MGAS8232
aaguuggcuacucuauuuu

SEQ ID NO: 2230892 - RNA, 17 nt, Streptococcus pyogenes MGAS8232
aaguuggcuacucuauu

SEQ ID NO: 2230893 - RNA, 11 nt, Streptococcus pyogenes MGAS8232
aaguucuuugc

SEQ ID NO: 2230894 - RNA, 21 nt, Streptococcus pyogenes MGAS8232
aaguuugcggcucggugcuga

SEQ ID NO: 2230895 - RNA, 16 nt, Streptococcus pyogenes MGAS8232
aaguaagauggugcuu

SEQ ID NO: 2230896 - RNA, 24 nt, Streptococcus pyogenes MGAS8232
aaguaauaaguagcguacauggau

SEQ ID NO: 2230897 - RNA, 18 nt, Streptococcus pyogenes MGAS8232
aagucuuagaaauagucu

SEQ ID NO: 2230898 - RNA, 13 nt, Streptococcus pyogenes MGAS8232
aauaacaucaaag

SEQ ID NO: 2230899 - RNA, 17 nt, Streptococcus pyogenes MGAS8232
aauaaagugcgcuucca

SEQ ID NO: 2230900 - RNA, 22 nt, Streptococcus pyogenes MGAS8232
aauaaagcguugacaguuaaaa

SEQ ID NO: 2230901 - RNA, 15 nt, Streptococcus pyogenes MGAS8232
aauaaaauagcaccu

SEQ ID NO: 2230902 - RNA, 19 nt, Streptococcus pyogenes MGAS8232
aauaaaaucguuauuaauu

SEQ ID NO: 2230903 - RNA, 21 nt, Streptococcus pyogenes MGAS8232
aaguuuucucagagacaauaa

SEQ ID NO: 2230904 - RNA, 14 nt, Streptococcus pyogenes MGAS8232
cgcuaaaacaguuc

SEQ ID NO: 2230905 - RNA, 23 nt, Streptococcus pyogenes MGAS8232
cgcuuuaggaauaucaugaagua

SEQ ID NO: 2230906 - RNA, 14 nt, Streptococcus pyogenes MGAS8232
cggaguauuuuuua

SEQ ID NO: 2230907 - RNA, 14 nt, Streptococcus pyogenes MGAS8232
cgauaaaacaaaua

SEQ ID NO: 2230908 - RNA, 19 nt, Streptococcus pyogenes MGAS8232
cgauaaaaacgaucaaaaa

SEQ ID NO: 2230909 - RNA, 18 nt, Streptococcus pyogenes MGAS8232
cgauaaucuuugacaaug

SEQ ID NO: 2230910 - RNA, 19 nt, Streptococcus pyogenes MGAS8232
cgagaugacgguaaauaaa

SEQ ID NO: 2230911 - RNA, 18 nt, Streptococcus pyogenes MGAS8232
cgacucaugauaucccau

SEQ ID NO: 2230912 - RNA, 21 nt, Streptococcus pyogenes MGAS8232
cgauuugcugagcuaaagcca

SEQ ID NO: 2230913 - RNA, 21 nt, Streptococcus pyogenes MGAS8232
cgcauacuggguaucaguccu

SEQ ID NO: 2230914 - RNA, 20 nt, Streptococcus pyogenes MGAS8232
aaacguguauucuuaaaaaa

SEQ ID NO: 2230915 - RNA, 12 nt, Streptococcus pyogenes MGAS8232
aaacgugagaaa

SEQ ID NO: 2230916 - RNA, 22 nt, Streptococcus pyogenes MGAS8232
aaacguuauuaaagacaaaaaa

SEQ ID NO: 2230917 - RNA, 19 nt, Streptococcus pyogenes MGAS8232
aaacguaacguaauagaau

SEQ ID NO: 2230918 - RNA, 15 nt, Streptococcus pyogenes MGAS8232
ccguaacuugcuuug

SEQ ID NO: 2230919 - RNA, 15 nt, Streptococcus pyogenes MGAS8232
ccggcucuaaaauau

SEQ ID NO: 2230920 - RNA, 17 nt, Streptococcus pyogenes MGAS8232
ccgcuaaaacaguucca

SEQ ID NO: 2230921 - RNA, 18 nt, Streptococcus pyogenes MGAS8232
ccgugaggacuuauuuuu

SEQ ID NO: 2230922 - RNA, 16 nt, Streptococcus pyogenes MGAS8232
ccuaugaucuguuuaa

SEQ ID NO: 2230923 - RNA, 17 nt, Streptococcus pyogenes MGAS8232
ccucauugucaaagcug

SEQ ID NO: 2230924 - RNA, 17 nt, Streptococcus pyogenes MGAS8232
ccuuugaccacacgauu

SEQ ID NO: 2230925 - RNA, 20 nt, Streptococcus pyogenes MGAS8232
ccuuuuugccuuuaacauga

SEQ ID NO: 2230926 - RNA, 12 nt, Streptococcus pyogenes MGAS8232
cgaaaaaaacuu

SEQ ID NO: 2230927 - RNA, 17 nt, Streptococcus pyogenes MGAS8232
ccuucauagacaagcuu

SEQ ID NO: 2230928 - RNA, 13 nt, Streptococcus pyogenes MGAS8232
ccuuaaaaaguuu

SEQ ID NO: 2230929 - RNA, 13 nt, Streptococcus pyogenes MGAS8232
ccuguuuuugcug

SEQ ID NO: 2230930 - RNA, 22 nt, Streptococcus pyogenes MGAS8232
aaaccaagugccaguaaggaaa

SEQ ID NO: 2230931 - RNA, 23 nt, Streptococcus pyogenes MGAS8232
aaaccaagugccaguaaggaaau

SEQ ID NO: 2230932 - RNA, 18 nt, Streptococcus pyogenes MGAS8232
ccccuauucaauauuuua

SEQ ID NO: 2230933 - RNA, 15 nt, Streptococcus pyogenes MGAS8232
ccauagaagccaauu

SEQ ID NO: 2230934 - RNA, 11 nt, Streptococcus pyogenes MGAS8232
ccaugauuuuc

SEQ ID NO: 2230935 - RNA, 16 nt, Streptococcus pyogenes MGAS8232
ccaucaucgaguggau

SEQ ID NO: 2230936 - RNA, 18 nt, Streptococcus pyogenes MGAS8232
aaacaagucuaucugcag

SEQ ID NO: 2230937 - RNA, 14 nt, Streptococcus pyogenes MGAS8232
aaacaagugauacu

SEQ ID NO: 2230938 - RNA, 13 nt, Streptococcus pyogenes MGAS8232
ccauucuuaaacg

SEQ ID NO: 2230939 - RNA, 22 nt, Streptococcus pyogenes MGAS8232
ccagcgucugauauugaucucu

SEQ ID NO: 2230940 - RNA, 23 nt, Streptococcus pyogenes MGAS8232
cauuuuacuauggcuucuaaaaa

SEQ ID NO: 2230941 - RNA, 18 nt, Streptococcus pyogenes MGAS8232
cauuugcacauaauguua

SEQ ID NO: 2230942 - RNA, 22 nt, Streptococcus pyogenes MGAS8232
cauuucuugaggugauucuuuu

SEQ ID NO: 2230943 - RNA, 15 nt, Streptococcus pyogenes MGAS8232
cauuucuuugcaaaa

SEQ ID NO: 2230944 - RNA, 17 nt, Streptococcus pyogenes MGAS8232
cauuucuucagguuucu

SEQ ID NO: 2230945 - RNA, 16 nt, Streptococcus pyogenes MGAS8232
cauuuccuacaaaaua

SEQ ID NO: 2230946 - RNA, 15 nt, Streptococcus pyogenes MGAS8232
cauugccauuaauaa

SEQ ID NO: 2230947 - RNA, 18 nt, Streptococcus pyogenes MGAS8232
cauuaaggauuaugaaaa

SEQ ID NO: 2230948 - RNA, 23 nt, Streptococcus pyogenes MGAS8232
cauuaaggauuaugaaaaagaag

SEQ ID NO: 2230949 - RNA, 14 nt, Streptococcus pyogenes MGAS8232
cauuacuccuuuga

SEQ ID NO: 2230950 - RNA, 20 nt, Streptococcus pyogenes MGAS8232
cauggguguuuaaucuuugu

SEQ ID NO: 2230951 - RNA, 14 nt, Streptococcus pyogenes MGAS8232
caugggaaaagcua

SEQ ID NO: 2230952 - RNA, 22 nt, Streptococcus pyogenes MGAS8232
cauguccaaggggugucugaca

SEQ ID NO: 2230953 - RNA, 21 nt, Streptococcus pyogenes MGAS8232
cauguccauugaugaguuuau

SEQ ID NO: 2230954 - RNA, 23 nt, Streptococcus pyogenes MGAS8232
cauggcaagagcaccgcgaauau

SEQ ID NO: 2230955 - RNA, 20 nt, Streptococcus pyogenes MGAS8232
ccaagugccaguaaggaaau

SEQ ID NO: 2230956 - RNA, 16 nt, Streptococcus pyogenes MGAS8232
ccaagugccaguaagg

SEQ ID NO: 2230957 - RNA, 22 nt, Streptococcus pyogenes MGAS8232
ccaaucaccuuucuauauaacu

SEQ ID NO: 2230958 - RNA, 17 nt, Streptococcus pyogenes MGAS8232
ccacaccaccagccacu

SEQ ID NO: 2230959 - RNA, 16 nt, Streptococcus pyogenes MGAS8232
cauuuuaugagaaaaa

SEQ ID NO: 2230960 - RNA, 17 nt, Streptococcus pyogenes MGAS8232
cauuuuaugagaaaaau

SEQ ID NO: 2230961 - RNA, 18 nt, Streptococcus pyogenes MGAS8232
ccaccaucaaaggucacc

SEQ ID NO: 2230962 - RNA, 12 nt, Streptococcus pyogenes MGAS8232
caucauauuguu

SEQ ID NO: 2230963 - RNA, 18 nt, Streptococcus pyogenes MGAS8232
caucaggcuuaaacauau

SEQ ID NO: 2230964 - RNA, 22 nt, Streptococcus pyogenes MGAS8232
caucaucgaguggauacaaggu

SEQ ID NO: 2230965 - RNA, 20 nt, Streptococcus pyogenes MGAS8232
caucaucaagaauagcuuuu

SEQ ID NO: 2230966 - RNA, 21 nt, Streptococcus pyogenes MGAS8232
caucaucaagaauagcuuuug

SEQ ID NO: 2230967 - RNA, 19 nt, Streptococcus pyogenes MGAS8232
caucaucaagaauagcuuu

SEQ ID NO: 2230968 - RNA, 15 nt, Streptococcus pyogenes MGAS8232
caucacguacagaaa

SEQ ID NO: 2230969 - RNA, 18 nt, Streptococcus pyogenes MGAS8232
cauacucaauagcugcug

SEQ ID NO: 2230970 - RNA, 19 nt, Streptococcus pyogenes MGAS8232
cauauuagcaaaaugcugu

SEQ ID NO: 2230971 - RNA, 20 nt, Streptococcus pyogenes MGAS8232
caucaaaagaccauaaaaaa

SEQ ID NO: 2230972 - RNA, 17 nt, Streptococcus pyogenes MGAS8232
caucaaaagaccauaaa

SEQ ID NO: 2230973 - RNA, 18 nt, Streptococcus pyogenes MGAS8232
caucuuaacgaaaagcau

SEQ ID NO: 2230974 - RNA, 22 nt, Streptococcus pyogenes MGAS8232
cauacccgcguuaucuccacag

SEQ ID NO: 2230975 - RNA, 16 nt, Streptococcus pyogenes MGAS8232
cauaccugagccgcca

SEQ ID NO: 2230976 - RNA, 22 nt, Streptococcus pyogenes MGAS8232
cauaaucauagguugcaccacc

SEQ ID NO: 2230977 - RNA, 23 nt, Streptococcus pyogenes MGAS8232
cauaaucauagguugcaccacca

SEQ ID NO: 2230978 - RNA, 16 nt, Streptococcus pyogenes MGAS8232
cauaaugcauguaaug

SEQ ID NO: 2230979 - RNA, 12 nt, Streptococcus pyogenes MGAS8232
caguuuuuucug

SEQ ID NO: 2230980 - RNA, 20 nt, Streptococcus pyogenes MGAS8232
cauaaaaaaccuuaucaaac

SEQ ID NO: 2230981 - RNA, 22 nt, Streptococcus pyogenes MGAS8232
caguucugagauauucauuuuc

SEQ ID NO: 2230982 - RNA, 21 nt, Streptococcus pyogenes MGAS8232
caguugcgaucauaaauaaag

SEQ ID NO: 2230983 - RNA, 16 nt, Streptococcus pyogenes MGAS8232
cagagccuuaaaaagu

SEQ ID NO: 2230984 - RNA, 20 nt, Streptococcus pyogenes MGAS8232
aaaaucacaccauuaaaaaa

SEQ ID NO: 2230985 - RNA, 17 nt, Streptococcus pyogenes MGAS8232
cagauagucaaaaagac

SEQ ID NO: 2230986 - RNA, 21 nt, Streptococcus pyogenes MGAS8232
aaaauccucuuuuaauuugga

SEQ ID NO: 2230987 - RNA, 17 nt, Streptococcus pyogenes MGAS8232
cagaauaagaaaaccuu

SEQ ID NO: 2230988 - RNA, 16 nt, Streptococcus pyogenes MGAS8232
cagaauaagaaaaccu

SEQ ID NO: 2230989 - RNA, 18 nt, Streptococcus pyogenes MGAS8232
cagcaccuucaaccgcuu

SEQ ID NO: 2230990 - RNA, 23 nt, Streptococcus pyogenes MGAS8232
cagcaccuucaaccgcuucuuuu

SEQ ID NO: 2230991 - RNA, 14 nt, Streptococcus pyogenes MGAS8232
cagcaccuucuuuu

SEQ ID NO: 2230992 - RNA, 19 nt, Streptococcus pyogenes MGAS8232
cagaucauuaaauugauua

SEQ ID NO: 2230993 - RNA, 22 nt, Streptococcus pyogenes MGAS8232
cacuacucguuacauaaaauga

SEQ ID NO: 2230994 - RNA, 16 nt, Streptococcus pyogenes MGAS8232
cacuacucguuacaua

SEQ ID NO: 2230995 - RNA, 13 nt, Streptococcus pyogenes MGAS8232
cacuacaagcauu

SEQ ID NO: 2230996 - RNA, 18 nt, Streptococcus pyogenes MGAS8232
cacuacaagcauuuuugc

SEQ ID NO: 2230997 - RNA, 15 nt, Streptococcus pyogenes MGAS8232
cacuucaagcauaau

SEQ ID NO: 2230998 - RNA, 18 nt, Streptococcus pyogenes MGAS8232
cacuucaagcauaauaaa

SEQ ID NO: 2230999 - RNA, 22 nt, Streptococcus pyogenes MGAS8232
cacuucaagcauaauaaaaaga

SEQ ID NO: 2231000 - RNA, 16 nt, Streptococcus pyogenes MGAS8232
cagcuaaaaacaaugc

SEQ ID NO: 2231001 - RNA, 15 nt, Streptococcus pyogenes MGAS8232
cagcugcuugaaaag

SEQ ID NO: 2231002 - RNA, 16 nt, Streptococcus pyogenes MGAS8232
cagcugcuugaaaaga

SEQ ID NO: 2231003 - RNA, 23 nt, Streptococcus pyogenes MGAS8232
cagcuucuacgggauuuaguucu

SEQ ID NO: 2231004 - RNA, 12 nt, Streptococcus pyogenes MGAS8232
aaacaaaaagag

SEQ ID NO: 2231005 - RNA, 23 nt, Streptococcus pyogenes MGAS8232
aaacaaaaacugugaacaaaaca

SEQ ID NO: 2231006 - RNA, 12 nt, Streptococcus pyogenes MGAS8232
aaacaaaacaaa

SEQ ID NO: 2231007 - RNA, 14 nt, Streptococcus pyogenes MGAS8232
aaacaaaacaaaac

SEQ ID NO: 2231008 - RNA, 15 nt, Streptococcus pyogenes MGAS8232
aaacaaaacaaaaca

SEQ ID NO: 2231009 - RNA, 16 nt, Streptococcus pyogenes MGAS8232
cagcgucugauauuga

SEQ ID NO: 2231010 - RNA, 22 nt, Human
ugauguuuagaaacacaacuau

SEQ ID NO: 2231011 - RNA, 16 nt, Human
ucauggaauuggagcu

SEQ ID NO: 2231012 - RNA, 12 nt, Human
ucaccucaugga

SEQ ID NO: 2231013 - RNA, 12 nt, Human
ugcuaagcauuc

SEQ ID NO: 2231014 - RNA, 20 nt, Human
uauauuuacaaaugggaaac

SEQ ID NO: 2231015 - RNA, 15 nt, Human
uaaaacaagcacuaa

SEQ ID NO: 2231016 - RNA, 15 nt, Human
uagaacucccuuuca

SEQ ID NO: 2231017 - RNA, 21 nt, Human
uaacgaaguauccuucagccu

SEQ ID NO: 2231018 - RNA, 14 nt, Human
gcagauaaacagua

SEQ ID NO: 2231019 - RNA, 13 nt, Human
gcagaagacagua

SEQ ID NO: 2231020 - RNA, 21 nt, Human
gauuuuccugaaaacccuugc

SEQ ID NO: 2231021 - RNA, 22 nt, Human
gacagugagacucugucucagu

SEQ ID NO: 2231022 - RNA, 17 nt, Human
uuaaucaccaaggcuga

SEQ ID NO: 2231023 - RNA, 15 nt, Human
ccuuaccugggaaag

SEQ ID NO: 2231024 - RNA, 15 nt, Human
aagugaaaaucuaca

SEQ ID NO: 2231025 - RNA, 12 nt, Human
aaguucugcaga

SEQ ID NO: 2231026 - RNA, 15 nt, Human
ugaaguccaagcauu

SEQ ID NO: 2231027 - RNA, 22 nt, Human
uguuggagaagaacugaaauca

SEQ ID NO: 2231028 - RNA, 16 nt, Human
uccagauccuggaaau

SEQ ID NO: 2231029 - RNA, 15 nt, Human
uaaaauaugcucuaa

SEQ ID NO: 2231030 - RNA, 24 nt, Human
uaaggggaauugaggacacugaua

SEQ ID NO: 2231031 - RNA, 16 nt, Human
uaagcauuccaacuau

SEQ ID NO: 2231032 - RNA, 18 nt, Human
gucaauaaaauccauaca

SEQ ID NO: 2231033 - RNA, 16 nt, Human
gcucucuggccuucgg

SEQ ID NO: 2231034 - RNA, 17 nt, Human
gaggcagagguugcagu

SEQ ID NO: 2231035 - RNA, 19 nt, Human
cuaaacaaagagugaagga

SEQ ID NO: 2231036 - RNA, 17 nt, Human
cuguaaucacagcuacu

SEQ ID NO: 2231037 - RNA, 22 nt, Human
cuugauaaauggcuuccuggca

SEQ ID NO: 2231038 - RNA, 15 nt, Human
cgaggauugggaaaa

SEQ ID NO: 2231039 - RNA, 12 nt, Human
ccaugaaucacc

SEQ ID NO: 2231040 - RNA, 18 nt, Human
caugauccugcaauucca

SEQ ID NO: 2231041 - RNA, 19 nt, Human
caugauguuuagaaacaca

SEQ ID NO: 2231042 - RNA, 16 nt, Human
agugccuguaaucaca

SEQ ID NO: 2231043 - RNA, 22 nt, Human
acaauaacgauaaaagacagug

SEQ ID NO: 2231044 - RNA, 12 nt, Human
acaccaggcuug

SEQ ID NO: 2231045 - RNA, 16 nt, Human
accuagggugauauua

SEQ ID NO: 2231046 - RNA, 16 nt, Human
uucucaacuccaaacu

SEQ ID NO: 2231047 - RNA, 18 nt, Human
gguacuucaaauccuuga

SEQ ID NO: 2231048 - RNA, 16 nt, Human
gucacauuccaagccu

SEQ ID NO: 2231049 - RNA, 21 nt, Human
uaauuuuuauauuugaaauau

SEQ ID NO: 2231050 - RNA, 12 nt, Human
uaaguaaugaua

SEQ ID NO: 2231051 - RNA, 16 nt, Human
uauuucuaugaaauau

SEQ ID NO: 2231052 - RNA, 20 nt, Human
uauuauuuuauagcuacuaa

SEQ ID NO: 2231053 - RNA, 18 nt, Human
ucaaauccuugaagauuu

SEQ ID NO: 2231054 - RNA, 20 nt, Human
uacaguucggugagcuacaa

SEQ ID NO: 2231055 - RNA, 15 nt, Human
uaauguuucaaacau

SEQ ID NO: 2231056 - RNA, 18 nt, Human
uaauguuucaaacauaua

SEQ ID NO: 2231057 - RNA, 23 nt, Human
ucaacucccugccccccagcccu

SEQ ID NO: 2231058 - RNA, 15 nt, Human
ucaggaggaaggcuu

SEQ ID NO: 2231059 - RNA, 12 nt, Human
gcacuccagccu

SEQ ID NO: 2231060 - RNA, 17 nt, Human
cucauggaauuggagcu

SEQ ID NO: 2231061 - RNA, 22 nt, Human
cucaauauuucagauaaucaca

SEQ ID NO: 2231062 - RNA, 23 nt, Human
cacacagauuugagcucagcccu

SEQ ID NO: 2231063 - RNA, 22 nt, Human
cauauuuguacaccaauauuca

SEQ ID NO: 2231064 - RNA, 22 nt, Human
augagaacucugagcagugcuu

SEQ ID NO: 2231065 - RNA, 13 nt, Human
auaaaagacagug

SEQ ID NO: 2231066 - RNA, 21 nt, Human
auauuguuugcuaagcauucc

SEQ ID NO: 2231067 - RNA, 11 nt, Human
aguugauaugc

SEQ ID NO: 2231068 - RNA, 15 nt, Human
agguacugagaguga

SEQ ID NO: 2231069 - RNA, 16 nt, Human
uuuguaguguuggaga

SEQ ID NO: 2231070 - RNA, 18 nt, Human
agcuacuugggaggcuga

SEQ ID NO: 2231071 - RNA, 15 nt, Human
acauuugcucaugga

SEQ ID NO: 2231072 - RNA, 14 nt, Human
acauucagagcuua

SEQ ID NO: 2231073 - RNA, 15 nt, Human
aggacacugauaugg

SEQ ID NO: 2231074 - RNA, 21 nt, Human
cacaugaaguccaagcauuua

SEQ ID NO: 2231075 - RNA, 18 nt, Human
aaugccacuaaauugaca

SEQ ID NO: 2231076 - RNA, 19 nt, Human
acaaauuuacagagacaga

SEQ ID NO: 2231077 - RNA, 18 nt, Human
acagugaccauacuaauu

SEQ ID NO: 2231078 - RNA, 22 nt, Human
aaucguguccccuauccuacuu

SEQ ID NO: 2231079 - RNA, 17 nt, Human
caagacccaaaaggcag

SEQ ID NO: 2231080 - RNA, 14 nt, Human
cagugaaagaaaau

SEQ ID NO: 2231081 - RNA, 20 nt, Human
aggcugagaugggagaauca

SEQ ID NO: 2231082 - RNA, 17 nt, Human
ccuacuuccccuuccua

SEQ ID NO: 2231083 - RNA, 17 nt, Human
gaacucugagcagugcu

SEQ ID NO: 2231084 - RNA, 23 nt, Human
cucagucucccucccuuggggcc

SEQ ID NO: 2231085 - RNA, 17 nt, Human
ccauagucauucugccu

SEQ ID NO: 2231086 - RNA, 14 nt, Human
auuuaaauauaugc

SEQ ID NO: 2231087 - RNA, 21 nt, Human
aauuuacagagacagaaagca

SEQ ID NO: 2231088 - RNA, 22 nt, Human
aacucccugccccccagcccuc

SEQ ID NO: 2231089 - RNA, 13 nt, Human
cugccuccccagc

SEQ ID NO: 2231090 - RNA, 22 nt, Human
ggcuaagcuucacuguaaaaua

SEQ ID NO: 2231091 - RNA, 21 nt, Human
cacuaaaacaccucagcugcc

SEQ ID NO: 2231092 - RNA, 12 nt, Human
acacuuaaaaau

SEQ ID NO: 2231093 - RNA, 19 nt, Human
gguuuaauaauuuuuaauu

SEQ ID NO: 2231094 - RNA, 19 nt, Human
cgcccacuagacccacugg

SEQ ID NO: 2231095 - RNA, 18 nt, Human
acucuuaagaagacugca

SEQ ID NO: 2231096 - RNA, 19 nt, Human
cucuguucugcacacagca

SEQ ID NO: 2231097 - RNA, 20 nt, Human
uggaauaauccuaaacauau

SEQ ID NO: 2231098 - RNA, 17 nt, Human
uaaaagacaaggaaaaa

SEQ ID NO: 2231099 - RNA, 15 nt, Human
aaauauaaauaaaaa

SEQ ID NO: 2231100 - RNA, 19 nt, Human
ccuucccagcuagaauuca

SEQ ID NO: 2231101 - RNA, 19 nt, Human
cuuccuaauuccacagcug

SEQ ID NO: 2231102 - RNA, 16 nt, Human
ccucagucucccuccc

SEQ ID NO: 2231103 - RNA, 14 nt, Human
cuugagguaaaagc

SEQ ID NO: 2231104 - RNA, 17 nt, Human
gaacuuuccacauucag

SEQ ID NO: 2231105 - RNA, 18 nt, Human
ugggcacaggguuuaugu

SEQ ID NO: 2231106 - RNA, 12 nt, Human
cagugaaagaaa

SEQ ID NO: 2231107 - RNA, 15 nt, Human
gccuaagugcagccc

SEQ ID NO: 2231108 - RNA, 19 nt, Human
gcacuaguauuucuaugaa

SEQ ID NO: 2231109 - RNA, 20 nt, Human
aauaucuuuuuuuuaauaaa

SEQ ID NO: 2231110 - RNA, 15 nt, Human
uauuuauuuuaauaa

SEQ ID NO: 2231111 - RNA, 17 nt, Human
acaaguccagccuggca

SEQ ID NO: 2231112 - RNA, 21 nt, Human
ccuuuuuuugaaaaaaagcuu

SEQ ID NO: 2231113 - RNA, 16 nt, Human
accaggcuugccugca

SEQ ID NO: 2231114 - RNA, 19 nt, Human
gcauccuuccucacaccag

SEQ ID NO: 2231115 - RNA, 13 nt, Human
caauccaagaacu

SEQ ID NO: 2231116 - RNA, 19 nt, Human
agacagugaaagaaaauaa

SEQ ID NO: 2231117 - RNA, 15 nt, Human
uagauaggccauggg

SEQ ID NO: 2231118 - RNA, 16 nt, Human
gugcugcagccccugg

SEQ ID NO: 2231119 - RNA, 15 nt, Human
ccgucccccucuggc

SEQ ID NO: 2231120 - RNA, 17 nt, Human
uacaaaugcauuucuaa

SEQ ID NO: 2231121 - RNA, 19 nt, Human
accucagcugccuccccag

SEQ ID NO: 2231122 - RNA, 15 nt, Human
gacaguauggcagcu

SEQ ID NO: 2231123 - RNA, 15 nt, Human
cucccuuggggccua

SEQ ID NO: 2231124 - RNA, 13 nt, Human
cuucucaacucca

SEQ ID NO: 2231125 - RNA, 17 nt, Human
uuauaaucuuucacagg

SEQ ID NO: 2231126 - RNA, 20 nt, Human
aguuuuuuuuuaaaaaagaa

SEQ ID NO: 2231127 - RNA, 16 nt, Human
ccugcaaagcccagcu

SEQ ID NO: 2231128 - RNA, 16 nt, Human
gccucagucucccucc

SEQ ID NO: 2231129 - RNA, 22 nt, Human
aaaaaaccugagccccaaaagg

SEQ ID NO: 2231130 - RNA, 19 nt, Human
auauugcaaggcaaagacu

SEQ ID NO: 2231131 - RNA, 21 nt, Human
ugcccugaaagucccagauca

SEQ ID NO: 2231132 - RNA, 13 nt, Human
aaaugaaagcagg

SEQ ID NO: 2231133 - RNA, 15 nt, Human
auaucaauuuaaaaa

SEQ ID NO: 2231134 - RNA, 22 nt, Human
auuuucuucucacauuuauauu

SEQ ID NO: 2231135 - RNA, 16 nt, Human
acugauggguuucucc

SEQ ID NO: 2231136 - RNA, 16 nt, Human
agagguccacaacaca

SEQ ID NO: 2231137 - RNA, 22 nt, Human
gccauagucauucugccugccc

SEQ ID NO: 2231138 - RNA, 20 nt, Human
aaauccuugaagauuuacca

SEQ ID NO: 2231139 - RNA, 13 nt, Human
acuguaaaauaau

SEQ ID NO: 2231140 - RNA, 20 nt, Human
aaggagccaaacauccuaca

SEQ ID NO: 2231141 - RNA, 13 nt, Human
uuuaaaaaaaaac

SEQ ID NO: 2231142 - RNA, 17 nt, Human
uaaaagacagugaaaga

SEQ ID NO: 2231143 - RNA, 17 nt, Human
gccuaagugcagccccg

SEQ ID NO: 2231144 - RNA, 14 nt, Human
gccucagucucccu

SEQ ID NO: 2231145 - RNA, 23 nt, Human
gauagauaggucagugcaaauac

SEQ ID NO: 2231146 - RNA, 14 nt, Human
gcugauuaaaccaa

SEQ ID NO: 2231147 - RNA, 15 nt, Human
aagccuccuuuuaaa

SEQ ID NO: 2231148 - RNA, 21 nt, Human
uuuauagccagguaccuucuc

SEQ ID NO: 2231149 - RNA, 19 nt, Human
ugggccccagauaccauga

SEQ ID NO: 2231150 - RNA, 21 nt, Human
accaccugccuauauuuuuug

SEQ ID NO: 2231151 - RNA, 18 nt, Human
agucauucugccugcccu

SEQ ID NO: 2231152 - RNA, 15 nt, Human
cucccugccccccag

SEQ ID NO: 2231153 - RNA, 23 nt, Human
acgaggauugggaaaaaguaauu

SEQ ID NO: 2231154 - RNA, 21 nt, Human
cagagguccacaacacacaga

SEQ ID NO: 2231155 - RNA, 18 nt, Human
gaagcaccaaucaugaau

SEQ ID NO: 2231156 - RNA, 17 nt, Human
gacaaggaaaaaauaac

SEQ ID NO: 2231157 - RNA, 14 nt, Human
accauuuuuacuug

SEQ ID NO: 2231158 - RNA, 13 nt, Human
cugcacuccagcc

SEQ ID NO: 2231159 - RNA, 12 nt, Human
uaguacacacuu

SEQ ID NO: 2231160 - RNA, 14 nt, Human
ccaaugaaaugagu

SEQ ID NO: 2231161 - RNA, 16 nt, Human
cacgggggccaaggau

SEQ ID NO: 2231162 - RNA, 16 nt, Human
uacaaaugggaaacaa

SEQ ID NO: 2231163 - RNA, 22 nt, Human
auaacaaugcuguauuuuaaaa

SEQ ID NO: 2231164 - RNA, 17 nt, Human
ugaucaccugcccugcu

SEQ ID NO: 2231165 - RNA, 19 nt, Human
aaaacuaggugcugcagcc

SEQ ID NO: 2231166 - RNA, 19 nt, Human
gcacacagcacgggggcca

SEQ ID NO: 2231167 - RNA, 22 nt, Human
cuggcaaggguucaccugggcu

SEQ ID NO: 2231168 - RNA, 19 nt, Human
cccacuggacucaccuccc

SEQ ID NO: 2231169 - RNA, 21 nt, Human
cucaaaacuucagacauagaa

SEQ ID NO: 2231170 - RNA, 14 nt, Human
cucauccugcaggc

SEQ ID NO: 2231171 - RNA, 14 nt, Human
aaagagaacuucca

SEQ ID NO: 2231172 - RNA, 11 nt, Human
ugcagugagcc

SEQ ID NO: 2231173 - RNA, 22 nt, Human
cacuuggacaugggccccagau

SEQ ID NO: 2231174 - RNA, 12 nt, Human
gguuuauauaag

SEQ ID NO: 2231175 - RNA, 22 nt, Human
caugaguaacugauuuguaaca

SEQ ID NO: 2231176 - RNA, 15 nt, Human
auuucuaugaaauau

SEQ ID NO: 2231177 - RNA, 14 nt, Human
cugcugagucccag

SEQ ID NO: 2231178 - RNA, 21 nt, Human
gaaaacaauaacgauaaaaga

SEQ ID NO: 2231179 - RNA, 13 nt, Human
ccagcccuccuua

SEQ ID NO: 2231180 - RNA, 15 nt, Human
caggcacccccagaa

SEQ ID NO: 2231181 - RNA, 23 nt, Human
caucaacagauaaauaguuuaug

SEQ ID NO: 2231182 - RNA, 16 nt, Human
cuggccuucggccucc

SEQ ID NO: 2231183 - RNA, 14 nt, Human
cgcuaccuuuugcu

SEQ ID NO: 2231184 - RNA, 15 nt, Human
uaggaaauauuuauu

SEQ ID NO: 2231185 - RNA, 20 nt, Human
gaccauacuaauuauacccc

SEQ ID NO: 2231186 - RNA, 21 nt, Human
cccccucuggcuccagcuggc

SEQ ID NO: 2231187 - RNA, 13 nt, Human
gccuccccagcuc

SEQ ID NO: 2231188 - RNA, 14 nt, Human
uacuaauuuuaaaa

SEQ ID NO: 2231189 - RNA, 16 nt, Human
caaaaggauaaugaau

SEQ ID NO: 2231190 - RNA, 13 nt, Human
auuuuaaaagaau

SEQ ID NO: 2231191 - RNA, 17 nt, Human
agagacagaaagcagaa

SEQ ID NO: 2231192 - RNA, 14 nt, Human
cuccagugagacag

SEQ ID NO: 2231193 - RNA, 20 nt, Human
gccgggcgugguggugagug

SEQ ID NO: 2231194 - RNA, 22 nt, Human
gaggcggauugagaaggagcuc

SEQ ID NO: 2231195 - RNA, 20 nt, Human
gaaaauaacaauaaaagaca

SEQ ID NO: 2231196 - RNA, 18 nt, Human
ucugaugagaacucugag

SEQ ID NO: 2231197 - RNA, 19 nt, Human
aagucuuucacauuuaaau

SEQ ID NO: 2231198 - RNA, 16 nt, Human
ccaggcacccccagaa

SEQ ID NO: 2231199 - RNA, 14 nt, Human
cacuaaacaaagag

SEQ ID NO: 2231200 - RNA, 16 nt, Human
gacauagaauuaacac

SEQ ID NO: 2231201 - RNA, 16 nt, Human
ccuccuuaucaaagga

SEQ ID NO: 2231202 - RNA, 19 nt, Human
agaaaauaacgauaaaaga

SEQ ID NO: 2231203 - RNA, 22 nt, Human
aaacauccuacaagacacagug

SEQ ID NO: 2231204 - RNA, 21 nt, Human
cuucucaccugugagaccaaa

SEQ ID NO: 2231205 - RNA, 18 nt, Human
auggcuugaguuuaaauu

SEQ ID NO: 2231206 - RNA, 21 nt, Human
aacuuguaaaggaauuuaaaa

SEQ ID NO: 2231207 - RNA, 22 nt, Human
agcacagccucuuagaugcagu

SEQ ID NO: 2231208 - RNA, 17 nt, Human
gcuucucauccugcagg

SEQ ID NO: 2231209 - RNA, 11 nt, Human
ucaccugcccu

SEQ ID NO: 2231210 - RNA, 15 nt, Human
cuaagcaaaauguga

SEQ ID NO: 2231211 - RNA, 24 nt, Human
cauucuggaauaauccuaaacaua

SEQ ID NO: 2231212 - RNA, 14 nt, Human
caugagucagucug

SEQ ID NO: 2231213 - RNA, 20 nt, Human
ucuucuggguuccuuccucu

SEQ ID NO: 2231214 - RNA, 21 nt, Human
auccccaagccuggcaaggga

SEQ ID NO: 2231215 - RNA, 15 nt, Human
agucaccucauggaa

SEQ ID NO: 2231216 - RNA, 16 nt, Human
auaaugaauacuuuau

SEQ ID NO: 2231217 - RNA, 16 nt, Human
agugucaaugcagccc

SEQ ID NO: 2231218 - RNA, 23 nt, Human
aacuuguaaaggaauuuaaaaau

SEQ ID NO: 2231219 - RNA, 19 nt, Human
uccauccugaggcuccacu

SEQ ID NO: 2231220 - RNA, 19 nt, Human
uccagaaagugacaagcuc

SEQ ID NO: 2231221 - RNA, 11 nt, Human
gagguaaaagc

SEQ ID NO: 2231222 - RNA, 16 nt, Human
uuuauauuugaaauau

SEQ ID NO: 2231223 - RNA, 14 nt, Human
aauauuauguuaaa

SEQ ID NO: 2231224 - RNA, 16 nt, Human
auagucauucugccug

SEQ ID NO: 2231225 - RNA, 22 nt, Human
auauuuacaaaugggaaacaaa

SEQ ID NO: 2231226 - RNA, 19 nt, Human
agcuucucauccugcaggc

SEQ ID NO: 2231227 - RNA, 16 nt, Human
uguaguccuguaaugg

SEQ ID NO: 2231228 - RNA, 14 nt, Human
ugacacuaaaacac

SEQ ID NO: 2231229 - RNA, 15 nt, Human
ugccccgucccccuc

SEQ ID NO: 2231230 - RNA, 22 nt, Human
gacucaccucccccaucucuuc

SEQ ID NO: 2231231 - RNA, 14 nt, Human
cuaagcauuccaac

SEQ ID NO: 2231232 - RNA, 14 nt, Human
cagaccgggguucc

SEQ ID NO: 2231233 - RNA, 15 nt, Human
ccacaagaaaugaaa

SEQ ID NO: 2231234 - RNA, 11 nt, Human
ucaccuccccc

SEQ ID NO: 2231235 - RNA, 12 nt, Human
uugccugcaggc

SEQ ID NO: 2231236 - RNA, 17 nt, Human
aaagacaaggaaaaaau

SEQ ID NO: 2231237 - RNA, 22 nt, Human
ccucccuuggggccuaugcaga

SEQ ID NO: 2231238 - RNA, 20 nt, Human
ccagcuggccgggagccuga

SEQ ID NO: 2231239 - RNA, 18 nt, Human
agggugcacacaggaugg

SEQ ID NO: 2231240 - RNA, 22 nt, Human
uuguaacaagccuccuuuuaaa

SEQ ID NO: 2231241 - RNA, 13 nt, Human
aucaagccugccu

SEQ ID NO: 2231242 - RNA, 14 nt, Human
uaaaagacaaggaa

SEQ ID NO: 2231243 - RNA, 16 nt, Human
uauaucaauuuaaaaa

SEQ ID NO: 2231244 - RNA, 14 nt, Human
guaacuaauuuuaa

SEQ ID NO: 2231245 - RNA, 15 nt, Human
uuuaauaauuuuuaa

SEQ ID NO: 2231246 - RNA, 15 nt, Human
uauaauuuaaauaua

SEQ ID NO: 2231247 - RNA, 20 nt, Human
accucugccucagaaaacaa

SEQ ID NO: 2231248 - RNA, 14 nt, Human
uccacuuggucugu

SEQ ID NO: 2231249 - RNA, 16 nt, Human
uaucaaaagaaagaaa

SEQ ID NO: 2231250 - RNA, 17 nt, Human
ccugagcggaccuuccc

SEQ ID NO: 2231251 - RNA, 15 nt, Human
auauaaauaaaaaua

SEQ ID NO: 2231252 - RNA, 22 nt, Human
cucagcccuggugggcagagag

SEQ ID NO: 2231253 - RNA, 12 nt, Human
cauagaaguaaa

SEQ ID NO: 2231254 - RNA, 17 nt, Human
ucuggcguuguggggau

SEQ ID NO: 2231255 - RNA, 16 nt, Human
ccauuuuuagugaaau

SEQ ID NO: 2231256 - RNA, 17 nt, Human
cugaucaccugcccugc

SEQ ID NO: 2231257 - RNA, 15 nt, Human
ucugcagauaaacag

SEQ ID NO: 2231258 - RNA, 14 nt, Human
agaguacuggcuga

SEQ ID NO: 2231259 - RNA, 22 nt, Human
cagcccuggugggcagagaggu

SEQ ID NO: 2231260 - RNA, 15 nt, Human
aucuuauaauuuaaa

SEQ ID NO: 2231261 - RNA, 21 nt, Human
acagcccuucuuuccacagaa

SEQ ID NO: 2231262 - RNA, 16 nt, Human
gacaagcucacagacc

SEQ ID NO: 2231263 - RNA, 17 nt, Human
aaauaacaauaaaagac

SEQ ID NO: 2231264 - RNA, 14 nt, Human
auugucuagugaaa

SEQ ID NO: 2231265 - RNA, 23 nt, Human
cugggccauagucauucugccug

SEQ ID NO: 2231266 - RNA, 18 nt, Human
agcaaaauuuuuucucua

SEQ ID NO: 2231267 - RNA, 20 nt, Human
acuaaauugacacuuaaaaa

SEQ ID NO: 2231268 - RNA, 23 nt, Human
cagaccgggguucccgugugccu

SEQ ID NO: 2231269 - RNA, 21 nt, Human
cuuguuggacgagaaaacaau

SEQ ID NO: 2231270 - RNA, 21 nt, Human
acaguuaccucugccucagaa

SEQ ID NO: 2231271 - RNA, 13 nt, Human
uggcuccagcugg

SEQ ID NO: 2231272 - RNA, 19 nt, Human
aaacaaaaggauaaugaau

SEQ ID NO: 2231273 - RNA, 11 nt, Human
caucuagugag

SEQ ID NO: 2231274 - RNA, 19 nt, Human
auuguauuuuaguaagaga

SEQ ID NO: 2231275 - RNA, 20 nt, Human
auucccagccagcacagccu

SEQ ID NO: 2231276 - RNA, 19 nt, Human
auuuucuauaauuuaaaua

SEQ ID NO: 2231277 - RNA, 16 nt, Human
ugacuuaaugccacua

SEQ ID NO: 2231278 - RNA, 13 nt, Human
aggauuugaaauu

SEQ ID NO: 2231279 - RNA, 13 nt, Human
caacaucuaguga

SEQ ID NO: 2231280 - RNA, 21 nt, Human
auucauagcagcuuauucaca

SEQ ID NO: 2231281 - RNA, 19 nt, Human
uccccuauccuacuucccc

SEQ ID NO: 2231282 - RNA, 15 nt, Human
acucugagcagugcu

SEQ ID NO: 2231283 - RNA, 13 nt, Human
ccucuggcuccag

SEQ ID NO: 2231284 - RNA, 14 nt, Human
aaucucaauauuuc

SEQ ID NO: 2231285 - RNA, 15 nt, Human
gucccaggcugagcc

SEQ ID NO: 2231286 - RNA, 22 nt, Human
gagccucagucucccucccuug

SEQ ID NO: 2231287 - RNA, 22 nt, Human
cuuguaaaggaauuuaaaaauc

SEQ ID NO: 2231288 - RNA, 16 nt, Human
ccuaugcagaggucca

SEQ ID NO: 2231289 - RNA, 20 nt, Human
cagccugagcgacagugaga

SEQ ID NO: 2231290 - RNA, 15 nt, Human
aagccagauuuuccu

SEQ ID NO: 2231291 - RNA, 11 nt, Human
aauuuaaauau

SEQ ID NO: 2231292 - RNA, 15 nt, Human
caggauggcaggagg

SEQ ID NO: 2231293 - RNA, 21 nt, Human
cacuugaacccgggaggcaga

SEQ ID NO: 2231294 - RNA, 19 nt, Human
agucaaauugugugaaagg

SEQ ID NO: 2231295 - RNA, 21 nt, Human
aggcaugagucagucugauga

SEQ ID NO: 2231296 - RNA, 21 nt, Human
auaugcucuaaacauguuuau

SEQ ID NO: 2231297 - RNA, 16 nt, Human
agaacucugagcagug

SEQ ID NO: 2231298 - RNA, 18 nt, Human
auagucaaauugugugaa

SEQ ID NO: 2231299 - RNA, 13 nt, Human
aucucaauauuuc

SEQ ID NO: 2231300 - RNA, 23 nt, Human
ucuagcaugucgucaaagcugaa

SEQ ID NO: 2231301 - RNA, 23 nt, Human
cagagguugcagugagccgagau

SEQ ID NO: 2231302 - RNA, 20 nt, Human
agugaggcggauugagaagg

SEQ ID NO: 2231303 - RNA, 18 nt, Human
caagccucauguccacug

SEQ ID NO: 2231304 - RNA, 22 nt, Human
guacacugccuucucaacucca

SEQ ID NO: 2231305 - RNA, 20 nt, Human
caggaggggcuucugggcag

SEQ ID NO: 2231306 - RNA, 20 nt, Human
augguuuagaaagcuugccc

SEQ ID NO: 2231307 - RNA, 23 nt, Human
gggccuaugcagagguccacaac

SEQ ID NO: 2231308 - RNA, 22 nt, Human
uuuauagcuacuaauuuuaaaa

SEQ ID NO: 2231309 - RNA, 14 nt, Human
aguuuuuuuuuaaa

SEQ ID NO: 2231310 - RNA, 13 nt, Human
agacagcucugca

SEQ ID NO: 2231311 - RNA, 16 nt, Human
aauaaaguguuugaaa

SEQ ID NO: 2231312 - RNA, 17 nt, Human
agccagguaccuucuca

SEQ ID NO: 2231313 - RNA, 20 nt, Human
cacuagacccacuggacuca

SEQ ID NO: 2231314 - RNA, 13 nt, Human
uuggacgagaaaa

SEQ ID NO: 2231315 - RNA, 12 nt, Human
ucaauaaaacuu

SEQ ID NO: 2231316 - RNA, 14 nt, Human
ggcaauagucaaau

SEQ ID NO: 2231317 - RNA, 19 nt, Human
acuaucucauuuccaagca

SEQ ID NO: 2231318 - RNA, 15 nt, Human
acagugaaagaaaau

SEQ ID NO: 2231319 - RNA, 18 nt, Human
aaaguaacccuacaaaac

SEQ ID NO: 2231320 - RNA, 16 nt, Human
ugacacuuaaaaaugg

SEQ ID NO: 2231321 - RNA, 12 nt, Human
uuaauaaaccau

SEQ ID NO: 2231322 - RNA, 23 nt, Human
agucccagaucaagccugccuca

SEQ ID NO: 2231323 - RNA, 13 nt, Human
uccccagcucuau

SEQ ID NO: 2231324 - RNA, 14 nt, Human
agacaucaacagau

SEQ ID NO: 2231325 - RNA, 11 nt, Human
gccaugggaca

SEQ ID NO: 2231326 - RNA, 22 nt, Human
uucauucacucaacaaacauaa

SEQ ID NO: 2231327 - RNA, 20 nt, Human
auaaauggcuuccuggcaau

SEQ ID NO: 2231328 - RNA, 15 nt, Human
uccaaugacauuuug

SEQ ID NO: 2231329 - RNA, 19 nt, Human
agcuacuaauuuuaaaaug

SEQ ID NO: 2231330 - RNA, 22 nt, Human
agccugccucaaucaguauuca

SEQ ID NO: 2231331 - RNA, 22 nt, Human
aggauggcuaguaucaaaagaa

SEQ ID NO: 2231332 - RNA, 21 nt, Human
gacagcuucucauccugcagg

SEQ ID NO: 2231333 - RNA, 23 nt, Human
aaaauaucacuugucaauaaaau

SEQ ID NO: 2231334 - RNA, 11 nt, Human
agccagguacc

SEQ ID NO: 2231335 - RNA, 15 nt, Human
gaaaugaaagcaggg

SEQ ID NO: 2231336 - RNA, 19 nt, Human
ggacucaccucccccaucu

SEQ ID NO: 2231337 - RNA, 21 nt, Human
cuucucacauuuauauuuuug

SEQ ID NO: 2231338 - RNA, 15 nt, Human
gaagauguagaggag

SEQ ID NO: 2231339 - RNA, 23 nt, Human
cuggccgggagccugaucaccug

SEQ ID NO: 2231340 - RNA, 15 nt, Human
uguuaaaugauuuca

SEQ ID NO: 2231341 - RNA, 22 nt, Human
cugcucaauaaaguacaagagc

SEQ ID NO: 2231342 - RNA, 15 nt, Human
uacaaaugcauuucu

SEQ ID NO: 2231343 - RNA, 15 nt, Human
ucuaugaaauauuau

SEQ ID NO: 2231344 - RNA, 16 nt, Human
gccuaagugcagcccc

SEQ ID NO: 2231345 - RNA, 13 nt, Human
cagcugccucccc

SEQ ID NO: 2231346 - RNA, 19 nt, Human
uguuggacgagaaaacaau

SEQ ID NO: 2231347 - RNA, 17 nt, Human
acuugaacccauauuug

SEQ ID NO: 2231348 - RNA, 19 nt, Human
gaaggagcucccaggaggg

SEQ ID NO: 2231349 - RNA, 22 nt, Human
auagccagguaccuucucaccu

SEQ ID NO: 2231350 - RNA, 14 nt, Human
acccaaaaggcaga

SEQ ID NO: 2231351 - RNA, 19 nt, Human
ugcacacagcacgggggcc

SEQ ID NO: 2231352 - RNA, 12 nt, Human
uauuauuuuuua

SEQ ID NO: 2231353 - RNA, 19 nt, Human
ggugcugcagccccuggga

SEQ ID NO: 2231354 - RNA, 16 nt, Human
ugagaugcuagaacuc

SEQ ID NO: 2231355 - RNA, 16 nt, Human
acaaggaugaauuaag

SEQ ID NO: 2231356 - RNA, 19 nt, Human
accauuuuggcaagcucua

SEQ ID NO: 2231357 - RNA, 15 nt, Human
auuucauucaauauc

SEQ ID NO: 2231358 - RNA, 18 nt, Human
auugagaaggagcuccca

SEQ ID NO: 2231359 - RNA, 18 nt, Human
agguccacaacacacaga

SEQ ID NO: 2231360 - RNA, 21 nt, Human
gcccauccugccccugagccc

SEQ ID NO: 2231361 - RNA, 20 nt, Human
cuacuuccccuuccuaauuc

SEQ ID NO: 2231362 - RNA, 20 nt, Human
ugagagacacacugaagaag

SEQ ID NO: 2231363 - RNA, 20 nt, Human
ucgugucuggcguugugggg

SEQ ID NO: 2231364 - RNA, 18 nt, Human
ugagcucagcccuggugg

SEQ ID NO: 2231365 - RNA, 18 nt, Human
acauuugcucauggaauu

SEQ ID NO: 2231366 - RNA, 13 nt, Human
aagacagugaaag

SEQ ID NO: 2231367 - RNA, 13 nt, Human
aggagcucccagg

SEQ ID NO: 2231368 - RNA, 14 nt, Human
cuuggucugugaga

SEQ ID NO: 2231369 - RNA, 21 nt, Human
aaucaccaaggcugauuaaac

SEQ ID NO: 2231370 - RNA, 15 nt, Human
uccagauccuggaaa

SEQ ID NO: 2231371 - RNA, 20 nt, Human
uguaagaaaauaucacuugu

SEQ ID NO: 2231372 - RNA, 11 nt, Human
uuauauuuauu

SEQ ID NO: 2231373 - RNA, 22 nt, Human
cugggacaggggagaaccuagg

SEQ ID NO: 2231374 - RNA, 21 nt, Human
uguauaaaauaauuuuuauau

SEQ ID NO: 2231375 - RNA, 17 nt, Human
agugagacagcucugca

SEQ ID NO: 2231376 - RNA, 15 nt, Human
cccaaccucucccaa

SEQ ID NO: 2231377 - RNA, 14 nt, Human
ccagcuagaauuca

SEQ ID NO: 2231378 - RNA, 16 nt, Human
caugggacagggagga

SEQ ID NO: 2231379 - RNA, 16 nt, Human
cagggacuugaaccca

SEQ ID NO: 2231380 - RNA, 14 nt, Human
cagauccuggaaau

SEQ ID NO: 2231381 - RNA, 24 nt, Human
aacuauaaaacuaggugcugcagc

SEQ ID NO: 2231382 - RNA, 17 nt, Human
acuaggugcugcagccc

SEQ ID NO: 2231383 - RNA, 19 nt, Human
cugcaaagcccagcuugaa

SEQ ID NO: 2231384 - RNA, 20 nt, Human
ccugccuaagugcagccccg

SEQ ID NO: 2231385 - RNA, 18 nt, Human
cccaagccuggcaaggga

SEQ ID NO: 2231386 - RNA, 12 nt, Human
ucccaaccucuc

SEQ ID NO: 2231387 - RNA, 19 nt, Human
aaagacagugaaagaaaau

SEQ ID NO: 2231388 - RNA, 21 nt, Human
auuuacaaaugggaaacaaaa

SEQ ID NO: 2231389 - RNA, 11 nt, Human
ccugagcccca

SEQ ID NO: 2231390 - RNA, 12 nt, Human
gucccaggcuga

SEQ ID NO: 2231391 - RNA, 22 nt, Human
aauaauccuaaacauaugaauu

SEQ ID NO: 2231392 - RNA, 18 nt, Human
cuccauuuuuagugaaau

SEQ ID NO: 2231393 - RNA, 18 nt, Human
gaacucugagcagugcuu

SEQ ID NO: 2231394 - RNA, 18 nt, Human
ccaaaggcuccugagaca

SEQ ID NO: 2231395 - RNA, 21 nt, Human
cuaccaaaaaucucaauauuu

SEQ ID NO: 2231396 - RNA, 18 nt, Human
auccuucagccugaaaga

SEQ ID NO: 2231397 - RNA, 18 nt, Human
ugaacuugguuuuaauua

SEQ ID NO: 2231398 - RNA, 13 nt, Human
aaaauaacgauaa

SEQ ID NO: 2231399 - RNA, 16 nt, Human
aauugacccacaagaa

SEQ ID NO: 2231400 - RNA, 20 nt, Human
accuuuugcuguggcaaaug

SEQ ID NO: 2231401 - RNA, 17 nt, Human
gaagcaccaaucaugaa

SEQ ID NO: 2231402 - RNA, 15 nt, Human
ugggacagggaggac

SEQ ID NO: 2231403 - RNA, 18 nt, Human
cucuauguucuaagaagu

SEQ ID NO: 2231404 - RNA, 16 nt, Human
cauagaaguaaaaaca

SEQ ID NO: 2231405 - RNA, 16 nt, Human
aauuucuucaacuccc

SEQ ID NO: 2231406 - RNA, 23 nt, Human
gaccccugagcuugcagagauga

SEQ ID NO: 2231407 - RNA, 13 nt, Human
cucaccuccccca

SEQ ID NO: 2231408 - RNA, 17 nt, Human
ugaaauggugaaaugca

SEQ ID NO: 2231409 - RNA, 16 nt, Human
caauccaagaacuuau

SEQ ID NO: 2231410 - RNA, 23 nt, Human
auguuaaaacugggacaggggag

SEQ ID NO: 2231411 - RNA, 20 nt, Human
aaaaucuuauaauuuaaaau

SEQ ID NO: 2231412 - RNA, 12 nt, Human
gaagaccucauu

SEQ ID NO: 2231413 - RNA, 15 nt, Human
aucaaaggacaccau

SEQ ID NO: 2231414 - RNA, 20 nt, Human
uaaaacaagcacuaaacaaa

SEQ ID NO: 2231415 - RNA, 12 nt, Human
aguguuugaaag

SEQ ID NO: 2231416 - RNA, 17 nt, Human
gacagugaaagaaaaua

SEQ ID NO: 2231417 - RNA, 16 nt, Human
aauuuuuaauuauaug

SEQ ID NO: 2231418 - RNA, 22 nt, Human
uuugaaacgaggauugggaaaa

SEQ ID NO: 2231419 - RNA, 21 nt, Human
ugccugagcggaccuucccag

SEQ ID NO: 2231420 - RNA, 22 nt, Human
gcuaaaacaagcacuaaacaaa

SEQ ID NO: 2231421 - RNA, 19 nt, Human
gucaaucagccuaguugau

SEQ ID NO: 2231422 - RNA, 21 nt, Human
uuauguuuaauucugaaagca

SEQ ID NO: 2231423 - RNA, 15 nt, Human
gagauuccugagcca

SEQ ID NO: 2231424 - RNA, 20 nt, Human
cacuguggguagacacacau

SEQ ID NO: 2231425 - RNA, 17 nt, Human
agcucuaucccaaccuc

SEQ ID NO: 2231426 - RNA, 20 nt, Human
accugauuucugagcauuua

SEQ ID NO: 2231427 - RNA, 16 nt, Human
aggguguguaaguaga

SEQ ID NO: 2231428 - RNA, 14 nt, Human
uauaaauaaaaaua

SEQ ID NO: 2231429 - RNA, 18 nt, Human
caaggcugauuaaaccaa

SEQ ID NO: 2231430 - RNA, 20 nt, Human
acuccagugagacagcucug

SEQ ID NO: 2231431 - RNA, 14 nt, Human
gaucaagccugccu

SEQ ID NO: 2231432 - RNA, 17 nt, Human
ucuuucacauuuaaaua

SEQ ID NO: 2231433 - RNA, 21 nt, Human
acaugagguacugagagugaa

SEQ ID NO: 2231434 - RNA, 23 nt, Human
caugcugucuacacuaagagaga

SEQ ID NO: 2231435 - RNA, 20 nt, Human
ugccccccagcccuccuuau

SEQ ID NO: 2231436 - RNA, 23 nt, Human
cugaaaucauacuucuuaggguu

SEQ ID NO: 2231437 - RNA, 15 nt, Human
cuggguuccuuccuc

SEQ ID NO: 2231438 - RNA, 19 nt, Human
aauaaaacuuuuccaauga

SEQ ID NO: 2231439 - RNA, 16 nt, Human
ugaaauuguauuacaa

SEQ ID NO: 2231440 - RNA, 20 nt, Human
gaaacgaggauugggaaaaa

SEQ ID NO: 2231441 - RNA, 18 nt, Human
guuaguauuguccagguc

SEQ ID NO: 2231442 - RNA, 22 nt, Human
agcuuguauuccuuuuucucuc

SEQ ID NO: 2231443 - RNA, 20 nt, Human
uccacuuggacaugggcccc

SEQ ID NO: 2231444 - RNA, 15 nt, Human
aagaagugaaaaucu

SEQ ID NO: 2231445 - RNA, 13 nt, Human
gaagaacugaaau

SEQ ID NO: 2231446 - RNA, 20 nt, Human
aauucuugccaaauauaaau

SEQ ID NO: 2231447 - RNA, 22 nt, Human
aaugaaauggugaaaugcagag

SEQ ID NO: 2231448 - RNA, 22 nt, Human
cugagcagugcuugaaugaagu

SEQ ID NO: 2231449 - RNA, 19 nt, Human
acucugucucaguccauga

SEQ ID NO: 2231450 - RNA, 20 nt, Human
acagcuucucauccugcagg

SEQ ID NO: 2231451 - RNA, 16 nt, Human
cccccagcccuccuua

SEQ ID NO: 2231452 - RNA, 19 nt, Human
cccauggcacucuauguuc

SEQ ID NO: 2231453 - RNA, 21 nt, Human
aaaagguauuuuaaucaccaa

SEQ ID NO: 2231454 - RNA, 22 nt, Human
ggguggaaaaacagaccggggu

SEQ ID NO: 2231455 - RNA, 22 nt, Human
auggaaauguuuacagaucccc

SEQ ID NO: 2231456 - RNA, 22 nt, Human
aaacaaggaugaauuaaguuuu

SEQ ID NO: 2231457 - RNA, 21 nt, Human
gccuuuucccaacuccagaaa

SEQ ID NO: 2231458 - RNA, 20 nt, Human
auaagccagacaucaacaga

SEQ ID NO: 2231459 - RNA, 19 nt, Human
uaguuuaugauuccaccua

SEQ ID NO: 2231460 - RNA, 23 nt, Human
uguugcccacagcuguaugauuc

SEQ ID NO: 2231461 - RNA, 18 nt, Human
auguuaaaacugggacag

SEQ ID NO: 2231462 - RNA, 22 nt, Human
cccccugcaaagcccagcuuga

SEQ ID NO: 2231463 - RNA, 14 nt, Human
ccucagucucccuc

SEQ ID NO: 2231464 - RNA, 17 nt, Human
uccacaacacacagauu

SEQ ID NO: 2231465 - RNA, 18 nt, Human
ccacuuggucugugagau

SEQ ID NO: 2231466 - RNA, 22 nt, Human
aucucuucuggguuccuuccuc

SEQ ID NO: 2231467 - RNA, 15 nt, Human
cagugucaggaggaa

SEQ ID NO: 2231468 - RNA, 22 nt, Human
gucacaggaaguagaggaggcc

SEQ ID NO: 2231469 - RNA, 22 nt, Human
caaauuuacagagacagaaagc

SEQ ID NO: 2231470 - RNA, 18 nt, Human
aaagaaaaucaggcuggc

SEQ ID NO: 2231471 - RNA, 18 nt, Human
aauaaaacuuuuccaaug

SEQ ID NO: 2231472 - RNA, 19 nt, Human
augaaguacucauacaugu

SEQ ID NO: 2231473 - RNA, 14 nt, Human
aucaaaagaaagaa

SEQ ID NO: 2231474 - RNA, 20 nt, Human
gagccucagucucccucccu

SEQ ID NO: 2231475 - RNA, 21 nt, Human
uccuacaagacacagugacca

SEQ ID NO: 2231476 - RNA, 16 nt, Human
cauagucauucugccu

SEQ ID NO: 2231477 - RNA, 20 nt, Human
auacugugugcuaaaacaag

SEQ ID NO: 2231478 - RNA, 15 nt, Human
ugagcggaccuuccc

SEQ ID NO: 2231479 - RNA, 15 nt, Human
ucccccaucucuucu

SEQ ID NO: 2231480 - RNA, 14 nt, Human
gauuaguacacacu

SEQ ID NO: 2231481 - RNA, 22 nt, Human
cuucagccugaaagaggaauga

SEQ ID NO: 2231482 - RNA, 14 nt, Human
ggacucaccucccc

SEQ ID NO: 2231483 - RNA, 16 nt, Human
gugagacagcucugca

SEQ ID NO: 2231484 - RNA, 17 nt, Human
ccucuggcuccagcugg

SEQ ID NO: 2231485 - RNA, 22 nt, Human
gaaauaagccagacaucaacag

SEQ ID NO: 2231486 - RNA, 22 nt, Human
gcuugcagagaugaggccgcca

SEQ ID NO: 2231487 - RNA, 21 nt, Human
ccucuguucugcacacagcac

SEQ ID NO: 2231488 - RNA, 17 nt, Human
aggguguguaaguagau

SEQ ID NO: 2231489 - RNA, 17 nt, Human
uuaauaauuuuuaauua

SEQ ID NO: 2231490 - RNA, 20 nt, Human
ucaaaacuucagacauagaa

SEQ ID NO: 2231491 - RNA, 15 nt, Human
aaauaauuuuuauau

SEQ ID NO: 2231492 - RNA, 12 nt, Human
ggaggggcuucu

SEQ ID NO: 2231493 - RNA, 12 nt, Human
cuaagaagugaa

SEQ ID NO: 2231494 - RNA, 12 nt, Human
cauuauauuuau

SEQ ID NO: 2231495 - RNA, 19 nt, Human
guacugagagugaacaaau

SEQ ID NO: 2231496 - RNA, 19 nt, Human
agaugcuagaacucccuuu

SEQ ID NO: 2231497 - RNA, 16 nt, Human
gcuucacuguaaaaua

SEQ ID NO: 2231498 - RNA, 13 nt, Human
uuuugaaucauca

SEQ ID NO: 2231499 - RNA, 14 nt, Human
ugagcuaggggggu

SEQ ID NO: 2231500 - RNA, 15 nt, Human
cuuaagaagacugca

SEQ ID NO: 2231501 - RNA, 14 nt, Human
aagagugaaggauu

SEQ ID NO: 2231502 - RNA, 20 nt, Human
acuucuuaggguuaugauua

SEQ ID NO: 2231503 - RNA, 22 nt, Human
ccugggaccaggcacccccaga

SEQ ID NO: 2231504 - RNA, 17 nt, Human
cugagaugggagaauca

SEQ ID NO: 2231505 - RNA, 18 nt, Human
acugacucuuaagaagac

SEQ ID NO: 2231506 - RNA, 12 nt, Human
cacaacacacag

SEQ ID NO: 2231507 - RNA, 17 nt, Human
cuaagcuucacuguaaa

SEQ ID NO: 2231508 - RNA, 13 nt, Human
cuuaucaaaggac

SEQ ID NO: 2231509 - RNA, 18 nt, Human
ccugcccugaaaguccca

SEQ ID NO: 2231510 - RNA, 12 nt, Human
ccccugggacca

SEQ ID NO: 2231511 - RNA, 15 nt, Human
cacaggacagcccuu

SEQ ID NO: 2231512 - RNA, 20 nt, Human
acaguggaaagacagcuucu

SEQ ID NO: 2231513 - RNA, 21 nt, Human
auuccuuuuucucuccucucc

SEQ ID NO: 2231514 - RNA, 21 nt, Human
gcaaaauuuuuucucuaggaa

SEQ ID NO: 2231515 - RNA, 22 nt, Human
accauuucuugagguaaaagca

SEQ ID NO: 2231516 - RNA, 16 nt, Human
cucaauaaaguacaag

SEQ ID NO: 2231517 - RNA, 17 nt, Human
cuacacuccagugagac

SEQ ID NO: 2231518 - RNA, 20 nt, Human
caagcucuaucaccaaggag

SEQ ID NO: 2231519 - RNA, 23 nt, Human
cacuggacucaccucccccaucu

SEQ ID NO: 2231520 - RNA, 16 nt, Human
cugcugagucccaggc

SEQ ID NO: 2231521 - RNA, 14 nt, Human
gagguaccagccuu

SEQ ID NO: 2231522 - RNA, 21 nt, Human
auguuuacagauccccaagcc

SEQ ID NO: 2231523 - RNA, 21 nt, Human
ccacauccugugggaccuggg

SEQ ID NO: 2231524 - RNA, 18 nt, Human
uccugugggaccugggcc

SEQ ID NO: 2231525 - RNA, 17 nt, Human
acacuaagagagaauga

SEQ ID NO: 2231526 - RNA, 17 nt, Human
agucccaggcugagccu

SEQ ID NO: 2231527 - RNA, 15 nt, Human
auauuuuuuguuaaa

SEQ ID NO: 2231528 - RNA, 16 nt, Human
acaaauccaaugaaau

SEQ ID NO: 2231529 - RNA, 21 nt, Human
gccucagggugcacacaggau

SEQ ID NO: 2231530 - RNA, 16 nt, Human
cacuggacucaccucc

SEQ ID NO: 2231531 - RNA, 13 nt, Human
aaauaaaaauaau

SEQ ID NO: 2231532 - RNA, 23 nt, Human
aagagccuuuuuuugaaaaaaag

SEQ ID NO: 2231533 - RNA, 17 nt, Human
ggagcucguggaacagu

SEQ ID NO: 2231534 - RNA, 22 nt, Human
caucucuucuggguuccuuccu

SEQ ID NO: 2231535 - RNA, 17 nt, Human
agccuuggauacuccau

SEQ ID NO: 2231536 - RNA, 16 nt, Human
uauguucuaagaagug

SEQ ID NO: 2231537 - RNA, 22 nt, Human
gugucuggcguuguggggauga

SEQ ID NO: 2231538 - RNA, 17 nt, Human
ucauccugcaggcagcu

SEQ ID NO: 2231539 - RNA, 16 nt, Human
ugcacaucaaaauaug

SEQ ID NO: 2231540 - RNA, 19 nt, Human
auuguaguccuguaaugga

SEQ ID NO: 2231541 - RNA, 18 nt, Human
cuccauccugaggcucca

SEQ ID NO: 2231542 - RNA, 20 nt, Human
aaagagugaaggauuuaugu

SEQ ID NO: 2231543 - RNA, 19 nt, Human
uaucacuugucaauaaaau

SEQ ID NO: 2231544 - RNA, 20 nt, Human
aaagacaaggaaaaaauaac

SEQ ID NO: 2231545 - RNA, 19 nt, Human
uacuucuuaggguuaugau

SEQ ID NO: 2231546 - RNA, 19 nt, Human
cagcuuuuucucucccacu

SEQ ID NO: 2231547 - RNA, 18 nt, Human
ccugaaagaggaaugaag

SEQ ID NO: 2231548 - RNA, 22 nt, Human
aggaugccccgucccccucugg

SEQ ID NO: 2231549 - RNA, 18 nt, Human
auuauuuuuuaaaaaaau

SEQ ID NO: 2231550 - RNA, 18 nt, Human
gaggcuccacuuggucug

SEQ ID NO: 2231551 - RNA, 13 nt, Human
gcagaacagugau

SEQ ID NO: 2231552 - RNA, 12 nt, Human
cuuccucugagc

SEQ ID NO: 2231553 - RNA, 23 nt, Human
ccccucuggcuccagcuggccgg

SEQ ID NO: 2231554 - RNA, 15 nt, Human
cucguggaacaguua

SEQ ID NO: 2231555 - RNA, 22 nt, Human
acaccuuguacuuuauuuucua

SEQ ID NO: 2231556 - RNA, 12 nt, Human
caacccaaaugu

SEQ ID NO: 2231557 - RNA, 16 nt, Human
auaauccuaaacauau

SEQ ID NO: 2231558 - RNA, 19 nt, Human
uguaguguuggagaagaac

SEQ ID NO: 2231559 - RNA, 22 nt, Human
cuccagccugagcgacagugag

SEQ ID NO: 2231560 - RNA, 13 nt, Human
ccagcacagccuc

SEQ ID NO: 2231561 - RNA, 15 nt, Human
ugagcucagcccugg

SEQ ID NO: 2231562 - RNA, 17 nt, Human
uaacgauaaaagacagu

SEQ ID NO: 2231563 - RNA, 22 nt, Human
cuaagcuucacuguaaaauaau

SEQ ID NO: 2231564 - RNA, 18 nt, Human
cagcugcucaauaaagua

SEQ ID NO: 2231565 - RNA, 16 nt, Human
ccugaucaccugcccu

SEQ ID NO: 2231566 - RNA, 23 nt, Human
uuagaugcaguucugaagaagau

SEQ ID NO: 2231567 - RNA, 24 nt, Human
uaauuuaaaauaugcucuaaacau

SEQ ID NO: 2231568 - RNA, 21 nt, Human
guauacugugugcuaaaacaa

SEQ ID NO: 2231569 - RNA, 12 nt, Human
gaaagucccaga

SEQ ID NO: 2231570 - RNA, 15 nt, Human
ugcuguauuuuaaaa

SEQ ID NO: 2231571 - RNA, 16 nt, Human
ugcuaagucuuauaua

SEQ ID NO: 2231572 - RNA, 18 nt, Human
gaagcaaaauuuuuucuc

SEQ ID NO: 2231573 - RNA, 18 nt, Human
cuuuccacagaagcucca

SEQ ID NO: 2231574 - RNA, 16 nt, Human
auugucuagugaaacu

SEQ ID NO: 2231575 - RNA, 17 nt, Human
uaucaauuuaaaaaaaa

SEQ ID NO: 2231576 - RNA, 17 nt, Human
cuggagggaagccuugg

SEQ ID NO: 2231577 - RNA, 22 nt, Human
cugaggcauccuuccucacacc

SEQ ID NO: 2231578 - RNA, 16 nt, Human
caggcuugccugcagg

SEQ ID NO: 2231579 - RNA, 15 nt, Human
auaaauaaaaauaau

SEQ ID NO: 2231580 - RNA, 14 nt, Human
cucuggcuccagcu

SEQ ID NO: 2231581 - RNA, 22 nt, Human
agcagcauaaauguugacaugg

SEQ ID NO: 2231582 - RNA, 17 nt, Human
ccugccccccagcccuc

SEQ ID NO: 2231583 - RNA, 22 nt, Human
uugacccacaagaaaugaaagc

SEQ ID NO: 2231584 - RNA, 19 nt, Human
ucugagcauuuaauaugga

SEQ ID NO: 2231585 - RNA, 19 nt, Human
gagccugaucaccugcccu

SEQ ID NO: 2231586 - RNA, 18 nt, Human
ugagcuaggggggucagc

SEQ ID NO: 2231587 - RNA, 15 nt, Human
gccccugcacuccag

SEQ ID NO: 2231588 - RNA, 22 nt, Human
uuaccucugccucagaaaacaa

SEQ ID NO: 2231589 - RNA, 17 nt, Human
aagacaaggaaaaaaua

SEQ ID NO: 2231590 - RNA, 16 nt, Human
aagcuucacuguaaaa

SEQ ID NO: 2231591 - RNA, 16 nt, Human
ucaguuuuugugaaaa

SEQ ID NO: 2231592 - RNA, 19 nt, Human
auacuaauuauacccccug

SEQ ID NO: 2231593 - RNA, 21 nt, Human
acagugauuaccagggacuga

SEQ ID NO: 2231594 - RNA, 19 nt, Human
cucacauuuauauuuuugu

SEQ ID NO: 2231595 - RNA, 16 nt, Human
gcugcagccccuggga

SEQ ID NO: 2231596 - RNA, 16 nt, Human
gaagauguagaggaga

SEQ ID NO: 2231597 - RNA, 21 nt, Human
uauuacuguaagaaaauauca

SEQ ID NO: 2231598 - RNA, 19 nt, Human
cccagcuagaauucacucc

SEQ ID NO: 2231599 - RNA, 22 nt, Human
caguauggcagcuuuccucaaa

SEQ ID NO: 2231600 - RNA, 12 nt, Human
caggacagcccu

SEQ ID NO: 2231601 - RNA, 23 nt, Human
ugaaaaucuuauaauuuaaaaua

SEQ ID NO: 2231602 - RNA, 23 nt, Human
gagcucccaggaggggcuucugg

SEQ ID NO: 2231603 - RNA, 17 nt, Human
aauauugcaaggcaaag

SEQ ID NO: 2231604 - RNA, 18 nt, Human
cuaucccaaccucuccca

SEQ ID NO: 2231605 - RNA, 12 nt, Human
accccugagcuu

SEQ ID NO: 2231606 - RNA, 17 nt, Human
auggcuaguaucaaaag

SEQ ID NO: 2231607 - RNA, 20 nt, Human
uccaaaggcuccugagacac

SEQ ID NO: 2231608 - RNA, 15 nt, Human
uucugcacacagcac

SEQ ID NO: 2231609 - RNA, 13 nt, Human
augacauuuuguu

SEQ ID NO: 2231610 - RNA, 14 nt, Human
uaaaggaauuuaaa

SEQ ID NO: 2231611 - RNA, 22 nt, Human
cagcuagaauucacuccacuug

SEQ ID NO: 2231612 - RNA, 14 nt, Human
aauauaaauaaaaa

SEQ ID NO: 2231613 - RNA, 18 nt, Human
cuuccucugagccuuggg

SEQ ID NO: 2231614 - RNA, 19 nt, Human
agcagcuuauucacaagac

SEQ ID NO: 2231615 - RNA, 14 nt, Human
cuccugagacacau

SEQ ID NO: 2231616 - RNA, 17 nt, Human
cucagucucccucccuu

SEQ ID NO: 2231617 - RNA, 15 nt, Human
aguucugaagaagau

SEQ ID NO: 2231618 - RNA, 19 nt, Human
uguauacugugugcuaaaa

SEQ ID NO: 2231619 - RNA, 14 nt, Human
ugcucauggaauug

SEQ ID NO: 2231620 - RNA, 19 nt, Human
augaauuacauuuguauaa

SEQ ID NO: 2231621 - RNA, 11 nt, Human
ggguugggggg

SEQ ID NO: 2231622 - RNA, 15 nt, Human
gccucagucucccuc

SEQ ID NO: 2231623 - RNA, 22 nt, Human
cugccuccccagcucuauccca

SEQ ID NO: 2231624 - RNA, 18 nt, Human
agucagucugaugagaac

SEQ ID NO: 2231625 - RNA, 19 nt, Human
caaggaugccccguccccc

SEQ ID NO: 2231626 - RNA, 18 nt, Human
auuuuuagugaaauauua

SEQ ID NO: 2231627 - RNA, 16 nt, Human
agaucaagccugccuc

SEQ ID NO: 2231628 - RNA, 21 nt, Human
ucaccugggcugaggcauccu

SEQ ID NO: 2231629 - RNA, 18 nt, Human
uacuuuauuuucuauaau

SEQ ID NO: 2231630 - RNA, 18 nt, Human
uuggggccuaugcagagg

SEQ ID NO: 2231631 - RNA, 14 nt, Human
cuaaacauaugaau

SEQ ID NO: 2231632 - RNA, 22 nt, Human
aagagccuuuuuuugaaaaaaa

SEQ ID NO: 2231633 - RNA, 23 nt, Human
agccuugggaccccugagcuugc

SEQ ID NO: 2231634 - RNA, 15 nt, Human
gcagagguugcagug

SEQ ID NO: 2231635 - RNA, 20 nt, Human
ugaaaaucuuauaauuuaaa

SEQ ID NO: 2231636 - RNA, 17 nt, Human
agcucccaggaggggcu

SEQ ID NO: 2231637 - RNA, 15 nt, Human
agccucagucucccu

SEQ ID NO: 2231638 - RNA, 16 nt, Human
uucugacacuaaaaca

SEQ ID NO: 2231639 - RNA, 15 nt, Human
cccugccccccagcc

SEQ ID NO: 2231640 - RNA, 23 nt, Human
ggucuaucuuugagcgcccacua

SEQ ID NO: 2231641 - RNA, 14 nt, Human
aucaccaaggcuga

SEQ ID NO: 2231642 - RNA, 21 nt, Human
cugauauuggacaguaaaauc

SEQ ID NO: 2231643 - RNA, 15 nt, Human
cugacucuuaagaag

SEQ ID NO: 2231644 - RNA, 15 nt, Human
cccucuucugacacu

SEQ ID NO: 2231645 - RNA, 14 nt, Human
acaaauccaaugaa

SEQ ID NO: 2231646 - RNA, 19 nt, Human
cuuggggccuaugcagagg

SEQ ID NO: 2231647 - RNA, 15 nt, Human
ugagcgcccacuaga

SEQ ID NO: 2231648 - RNA, 21 nt, Human
ccaaauauaaauaaaaauaau

SEQ ID NO: 2231649 - RNA, 13 nt, Human
ccaccugccuaua

SEQ ID NO: 2231650 - RNA, 16 nt, Human
ucauucugccugcccu

SEQ ID NO: 2231651 - RNA, 14 nt, Human
aagcucuaucacca

SEQ ID NO: 2231652 - RNA, 14 nt, Human
ggaaacuccacauc

SEQ ID NO: 2231653 - RNA, 15 nt, Human
ugguuuagaaagcuu

SEQ ID NO: 2231654 - RNA, 22 nt, Human
aucaucaagucuuucacauuua

SEQ ID NO: 2231655 - RNA, 20 nt, Human
agaggagaaacuggaacucu

SEQ ID NO: 2231656 - RNA, 22 nt, Human
cuuccuaauuccacagcugcuc

SEQ ID NO: 2231657 - RNA, 16 nt, Human
uagcuacuaauuuuaa

SEQ ID NO: 2231658 - RNA, 15 nt, Human
ggcagcuuuuucucu

SEQ ID NO: 2231659 - RNA, 19 nt, Human
uggugaacuugguuuuaau

SEQ ID NO: 2231660 - RNA, 13 nt, Human
auugauuauaugu

SEQ ID NO: 2231661 - RNA, 21 nt, Human
ccucccuuggggccuaugcag

SEQ ID NO: 2231662 - RNA, 17 nt, Human
ggugcugcagccccugg

SEQ ID NO: 2231663 - RNA, 12 nt, Human
guagacacacau

SEQ ID NO: 2231664 - RNA, 14 nt, Human
cagugucaggagga

SEQ ID NO: 2231665 - RNA, 14 nt, Human
uucagccugaaaga

SEQ ID NO: 2231666 - RNA, 13 nt, Human
aaaaauccuacuu

SEQ ID NO: 2231667 - RNA, 20 nt, Human
cccuuccuaauuccacagcu

SEQ ID NO: 2231668 - RNA, 15 nt, Human
gacaugggccccaga

SEQ ID NO: 2231669 - RNA, 15 nt, Human
aaaauaacaaugaaa

SEQ ID NO: 2231670 - RNA, 16 nt, Human
agugaaauauuauuuu

SEQ ID NO: 2231671 - RNA, 16 nt, Human
ccaaauugagcuaggg

SEQ ID NO: 2231672 - RNA, 20 nt, Human
gccagcccucuucugacacu

SEQ ID NO: 2231673 - RNA, 20 nt, Human
uccagagggaauugcagagu

SEQ ID NO: 2231674 - RNA, 23 nt, Human
ugaauuauguuugcauguucacu

SEQ ID NO: 2231675 - RNA, 18 nt, Human
cuuuucccaacuccagaa

SEQ ID NO: 2231676 - RNA, 12 nt, Human
uucucuaggaaa

SEQ ID NO: 2231677 - RNA, 18 nt, Human
aggaaggcuuacacccac

SEQ ID NO: 2231678 - RNA, 16 nt, Human
acaugaaguccaagca

SEQ ID NO: 2231679 - RNA, 17 nt, Human
gauaaaagacagugaaa

SEQ ID NO: 2231680 - RNA, 16 nt, Human
auaacuggaaacuuca

SEQ ID NO: 2231681 - RNA, 20 nt, Human
ccugagcggaccuucccagc

SEQ ID NO: 2231682 - RNA, 14 nt, Human
uuucuaugaaauau

SEQ ID NO: 2231683 - RNA, 20 nt, Human
uuaaguuuuuuuuuaaaaaa

SEQ ID NO: 2231684 - RNA, 17 nt, Human
cucgugggacagucacc

SEQ ID NO: 2231685 - RNA, 17 nt, Human
aaagaaacauuugguaa

SEQ ID NO: 2231686 - RNA, 20 nt, Human
acaagacccaaaaggcagaa

SEQ ID NO: 2231687 - RNA, 22 nt, Human
agaaugagagacacacugaaga

SEQ ID NO: 2231688 - RNA, 19 nt, Human
augaguaacugauuuguaa

SEQ ID NO: 2231689 - RNA, 15 nt, Human
gauuccugagccagu

SEQ ID NO: 2231690 - RNA, 21 nt, Human
aaugugacuuaaugccacuaa

SEQ ID NO: 2231691 - RNA, 18 nt, Human
aaauauuuauuuuaauaa

SEQ ID NO: 2231692 - RNA, 13 nt, Human
cucagaaaacaag

SEQ ID NO: 2231693 - RNA, 13 nt, Human
uaacgauaaaaga

SEQ ID NO: 2231694 - RNA, 14 nt, Human
uaaauaguuuauga

SEQ ID NO: 2231695 - RNA, 16 nt, Human
caggaggcauccaaag

SEQ ID NO: 2231696 - RNA, 19 nt, Human
uaucucauuuccaagcaag

SEQ ID NO: 2231697 - RNA, 17 nt, Human
uuaaauggucaauuuug

SEQ ID NO: 2231698 - RNA, 22 nt, Human
gcacagccucuuagaugcaguu

SEQ ID NO: 2231699 - RNA, 23 nt, Human
cucauguccacugguucuucuug

SEQ ID NO: 2231700 - RNA, 16 nt, Human
agaugcuagaacuccc

SEQ ID NO: 2231701 - RNA, 16 nt, Human
cuucaacucccugccc

SEQ ID NO: 2231702 - RNA, 19 nt, Human
cugagcccggaaacuccac

SEQ ID NO: 2231703 - RNA, 20 nt, Human
guaucaaaagaaagaaaauc

SEQ ID NO: 2231704 - RNA, 20 nt, Human
uuaaauggucaauuuuguua

SEQ ID NO: 2231705 - RNA, 13 nt, Human
aaaaaugguuuaa

SEQ ID NO: 2231706 - RNA, 20 nt, Human
gagccugaucaccugcccug

SEQ ID NO: 2231707 - RNA, 22 nt, Human
aggacaccauuuuggcaagcuc

SEQ ID NO: 2231708 - RNA, 15 nt, Human
auaaaguguuugaaa

SEQ ID NO: 2231709 - RNA, 17 nt, Human
aaucuuucacaggggac

SEQ ID NO: 2231710 - RNA, 14 nt, Human
uaguuucccuugca

SEQ ID NO: 2231711 - RNA, 12 nt, Human
auuuuaaaagaa

SEQ ID NO: 2231712 - RNA, 16 nt, Human
uucacauuuaaauaaa

SEQ ID NO: 2231713 - RNA, 14 nt, Human
uggacucaccuccc

SEQ ID NO: 2231714 - RNA, 14 nt, Human
ugagcuugcagaga

SEQ ID NO: 2231715 - RNA, 16 nt, Human
uccucacaccaggcuu

SEQ ID NO: 2231716 - RNA, 14 nt, Human
gaaaaaauaacaau

SEQ ID NO: 2231717 - RNA, 14 nt, Human
acuggacucaccuc

SEQ ID NO: 2231718 - RNA, 21 nt, Human
auaauuuuuauauuugaaaua

SEQ ID NO: 2231719 - RNA, 18 nt, Human
ucaaggguacacugccuu

SEQ ID NO: 2231720 - RNA, 19 nt, Human
gucuuucacauuuaaauaa

SEQ ID NO: 2231721 - RNA, 22 nt, Human
gaugcaguucugaagaagaugg

SEQ ID NO: 2231722 - RNA, 18 nt, Human
uaaauugacacuuaaaaa

SEQ ID NO: 2231723 - RNA, 19 nt, Human
cagguaccuucucaccugu

SEQ ID NO: 2231724 - RNA, 21 nt, Human
aagucuuucacauuuaaauaa

SEQ ID NO: 2231725 - RNA, 23 nt, Human
uuuccaucaaggguacacugccu

SEQ ID NO: 2231726 - RNA, 22 nt, Human
ugaauggcuaagcaaaauguga

SEQ ID NO: 2231727 - RNA, 20 nt, Human
ucaggaggaaggcuuacacc

SEQ ID NO: 2231728 - RNA, 16 nt, Human
uauccuacuuccccuu

SEQ ID NO: 2231729 - RNA, 22 nt, Human
ugucucuacuaaaaauacaaaa

SEQ ID NO: 2231730 - RNA, 14 nt, Human
agaucaagccugcc

SEQ ID NO: 2231731 - RNA, 13 nt, Human
caguuauuauauu

SEQ ID NO: 2231732 - RNA, 21 nt, Human
gccugaucaccugcccugcug

SEQ ID NO: 2231733 - RNA, 22 nt, Human
uugaaaaucuuauaauuuaaaa

SEQ ID NO: 2231734 - RNA, 15 nt, Human
ucucauccugcaggc

SEQ ID NO: 2231735 - RNA, 15 nt, Human
augauaacuggaaac

SEQ ID NO: 2231736 - RNA, 20 nt, Human
agcccuggugggcagagagg

SEQ ID NO: 2231737 - RNA, 17 nt, Human
ucucuggccuucggccu

SEQ ID NO: 2231738 - RNA, 17 nt, Human
ccccagaaugaccuggc

SEQ ID NO: 2231739 - RNA, 16 nt, Human
agauagggagggaagg

SEQ ID NO: 2231740 - RNA, 15 nt, Human
caaggaaaaaauaac

SEQ ID NO: 2231741 - RNA, 21 nt, Human
uuuuauggcacuaguauuucu

SEQ ID NO: 2231742 - RNA, 23 nt, Human
gaaaaucuuauaauuuaaaauau

SEQ ID NO: 2231743 - RNA, 15 nt, Human
gucaaugcagccccc

SEQ ID NO: 2231744 - RNA, 15 nt, Human
ucacaggacagcccu

SEQ ID NO: 2231745 - RNA, 15 nt, Human
aaaaaagaaacauuu

SEQ ID NO: 2231746 - RNA, 21 nt, Human
cugagccucagucucccuccc

SEQ ID NO: 2231747 - RNA, 19 nt, Human
uggugagugccuguaauca

SEQ ID NO: 2231748 - RNA, 18 nt, Human
cucccuuggggccuaugc

SEQ ID NO: 2231749 - RNA, 18 nt, Human
cuggaaacuucagcgguu

SEQ ID NO: 2231750 - RNA, 17 nt, Human
cucguggaacaguuacc

SEQ ID NO: 2231751 - RNA, 19 nt, Human
aggggggucagccagcccu

SEQ ID NO: 2231752 - RNA, 16 nt, Human
cuucacuguaaaauaa

SEQ ID NO: 2231753 - RNA, 19 nt, Human
agagccuuuuuuugaaaaa

SEQ ID NO: 2231754 - RNA, 17 nt, Human
aauaaaguguuugaaag

SEQ ID NO: 2231755 - RNA, 14 nt, Human
uucuggaauaaucc

SEQ ID NO: 2231756 - RNA, 12 nt, Human
cauucugccugc

SEQ ID NO: 2231757 - RNA, 23 nt, Human
aauauugcaaggcaaagacuauu

SEQ ID NO: 2231758 - RNA, 19 nt, Human
gcuuguauuccuuuuucuc

SEQ ID NO: 2231759 - RNA, 19 nt, Human
augcagagguccacaacac

SEQ ID NO: 2231760 - RNA, 16 nt, Human
ccagaucaagccugcc

SEQ ID NO: 2231761 - RNA, 14 nt, Human
acacugaagaagca

SEQ ID NO: 2231762 - RNA, 13 nt, Human
cccaaaaggcaga

SEQ ID NO: 2231763 - RNA, 17 nt, Human
cccccugcaaagcccag

SEQ ID NO: 2231764 - RNA, 17 nt, Human
cuuauuuguacauuuuu

SEQ ID NO: 2231765 - RNA, 13 nt, Human
ugagcggaccuuc

SEQ ID NO: 2231766 - RNA, 15 nt, Human
uccaagccucauguc

SEQ ID NO: 2231767 - RNA, 17 nt, Human
cguaaucguguccccua

SEQ ID NO: 2231768 - RNA, 17 nt, Human
ugagcggaccuucccag

SEQ ID NO: 2231769 - RNA, 23 nt, Human
auaucuuuuuuuuaauaaaccau

SEQ ID NO: 2231770 - RNA, 17 nt, Human
cuuccuaauuccacagc

SEQ ID NO: 2231771 - RNA, 13 nt, Human
ucuaagaagugaa

SEQ ID NO: 2231772 - RNA, 18 nt, Human
gccccgucccccucuggc

SEQ ID NO: 2231773 - RNA, 14 nt, Human
agguugcagugagc

SEQ ID NO: 2231774 - RNA, 18 nt, Human
aaauaacgauaaaagaca

SEQ ID NO: 2231775 - RNA, 18 nt, Human
uaucccaaccucucccaa

SEQ ID NO: 2231776 - RNA, 16 nt, Human
ccccugcacuccagcc

SEQ ID NO: 2231777 - RNA, 20 nt, Human
ggaggcauccaaaggcuccu

SEQ ID NO: 2231778 - RNA, 19 nt, Human
uuugccaaguucuccacua

SEQ ID NO: 2231779 - RNA, 17 nt, Human
gacagucaccucaugga

SEQ ID NO: 2231780 - RNA, 20 nt, Human
uugauaaguacaugauaagc

SEQ ID NO: 2231781 - RNA, 18 nt, Human
uguggucacaggaaguag

SEQ ID NO: 2231782 - RNA, 22 nt, Human
ucuacuaaaaauacaaaaaaaa

SEQ ID NO: 2231783 - RNA, 13 nt, Human
gcuugccugcagg

SEQ ID NO: 2231784 - RNA, 17 nt, Human
ugaaggauuuauguuua

SEQ ID NO: 2231785 - RNA, 23 nt, Human
ggaggcagagguugcagugagcc

SEQ ID NO: 2231786 - RNA, 19 nt, Human
cugagccucagucucccuc

SEQ ID NO: 2231787 - RNA, 23 nt, Human
ucuuagaugcaguucugaagaag

SEQ ID NO: 2231788 - RNA, 16 nt, Human
cugcucucaguucacu

SEQ ID NO: 2231789 - RNA, 17 nt, Human
gaagaccucauuuugaa

SEQ ID NO: 2231790 - RNA, 16 nt, Human
uggauacuccaugggg

SEQ ID NO: 2231791 - RNA, 18 nt, Human
agcuagaauucacuccac

SEQ ID NO: 2231792 - RNA, 13 nt, Human
aguuaccucugcc

SEQ ID NO: 2231793 - RNA, 19 nt, Human
ucccagaucaagccugccu

SEQ ID NO: 2231794 - RNA, 20 nt, Human
agccuuggggcugaugcagu

SEQ ID NO: 2231795 - RNA, 22 nt, Human
gaugcaguuguugcccacagcu

SEQ ID NO: 2231796 - RNA, 14 nt, Human
gagccagugucagg

SEQ ID NO: 2231797 - RNA, 23 nt, Human
uagucauucugccugcccugaaa

SEQ ID NO: 2231798 - RNA, 17 nt, Human
gcaagcucuaucaccaa

SEQ ID NO: 2231799 - RNA, 15 nt, Human
gcacagccucuuaga

SEQ ID NO: 2231800 - RNA, 22 nt, Human
ucuccagagggaauugcagagu

SEQ ID NO: 2231801 - RNA, 17 nt, Human
uauauuguagauaauac

SEQ ID NO: 2231802 - RNA, 16 nt, Human
accagccuuggauacu

SEQ ID NO: 2231803 - RNA, 23 nt, Human
ugcauagguuuaauaauuuuuaa

SEQ ID NO: 2231804 - RNA, 22 nt, Human
aauuacauuuguauaaaauaau

SEQ ID NO: 2231805 - RNA, 15 nt, Human
cugcacuccagccug

SEQ ID NO: 2231806 - RNA, 20 nt, Human
ggccuaugcagagguccaca

SEQ ID NO: 2231807 - RNA, 23 nt, Human
aaauuuacagagacagaaagcag

SEQ ID NO: 2231808 - RNA, 10 nt, Human
accugagccc

SEQ ID NO: 2231809 - RNA, 15 nt, Human
aaugaauggcuaagc

SEQ ID NO: 2231810 - RNA, 20 nt, Human
uaggaauugacccacaagaa

SEQ ID NO: 2231811 - RNA, 14 nt, Human
acagaauuuuaugc

SEQ ID NO: 2231812 - RNA, 17 nt, Human
auguugacaugggacau

SEQ ID NO: 2231813 - RNA, 23 nt, Human
cagccagcccucuucugacacua

SEQ ID NO: 2231814 - RNA, 18 nt, Human
gaauaauccuaaacauau

SEQ ID NO: 2231815 - RNA, 13 nt, Human
uuauucacaagac

SEQ ID NO: 2231816 - RNA, 21 nt, Human
acacuaaaacaccucagcugc

SEQ ID NO: 2231817 - RNA, 15 nt, Human
ugcuucuguuuuaua

SEQ ID NO: 2231818 - RNA, 18 nt, Human
cacuccagugagacagcu

SEQ ID NO: 2231819 - RNA, 22 nt, Human
uagacacacaugaaguccaagc

SEQ ID NO: 2231820 - RNA, 21 nt, Human
ugggaggcugagaugggagaa

SEQ ID NO: 2231821 - RNA, 14 nt, Human
aauaguuuaugauu

SEQ ID NO: 2231822 - RNA, 21 nt, Human
gaagugaaaaucuacacucca

SEQ ID NO: 2231823 - RNA, 20 nt, Human
cccugcacuccagccugagc

SEQ ID NO: 2231824 - RNA, 14 nt, Human
guauuuuaaaagaa

SEQ ID NO: 2231825 - RNA, 22 nt, Human
aaugggcacaggguuuauguuu

SEQ ID NO: 2231826 - RNA, 13 nt, Human
uuauguuuaauuc

SEQ ID NO: 2231827 - RNA, 16 nt, Human
ccuggugggcagagag

SEQ ID NO: 2231828 - RNA, 14 nt, Human
aauggcuaagcaaa

SEQ ID NO: 2231829 - RNA, 20 nt, Human
ccauuguggucacaggaagu

SEQ ID NO: 2231830 - RNA, 15 nt, Human
ccuugccaugugcua

SEQ ID NO: 2231831 - RNA, 14 nt, Human
ugcuagaacucccu

SEQ ID NO: 2231832 - RNA, 13 nt, Human
ccccagcccuccu

SEQ ID NO: 2231833 - RNA, 20 nt, Human
ugauuauaugucacuuugcu

SEQ ID NO: 2231834 - RNA, 16 nt, Human
uaacaauaaaagacaa

SEQ ID NO: 2231835 - RNA, 16 nt, Human
ccacuuggucugugag

SEQ ID NO: 2231836 - RNA, 14 nt, Human
uaguaucaaaagaa

SEQ ID NO: 2231837 - RNA, 17 nt, Human
ccucagucucccucccu

SEQ ID NO: 2231838 - RNA, 19 nt, Human
uugagaaggagcucccagg

SEQ ID NO: 2231839 - RNA, 18 nt, Human
acagcuucucauccugca

SEQ ID NO: 2231840 - RNA, 16 nt, Human
ugcuguauuuuaaaag

SEQ ID NO: 2231841 - RNA, 12 nt, Human
aucguguccccu

SEQ ID NO: 2231842 - RNA, 17 nt, Human
uccucugagccuuggga

SEQ ID NO: 2231843 - RNA, 18 nt, Human
agcuuacuuaaaauugua

SEQ ID NO: 2231844 - RNA, 20 nt, Human
cuuuuuuaguucuucaaaga

SEQ ID NO: 2231845 - RNA, 19 nt, Human
gcuaccuuuugcuguggca

SEQ ID NO: 2231846 - RNA, 16 nt, Human
gcuugccugcaggcau

SEQ ID NO: 2231847 - RNA, 15 nt, Human
agaaaacaauaacga

SEQ ID NO: 2231848 - RNA, 16 nt, Human
aguaagagauuccuga

SEQ ID NO: 2231849 - RNA, 18 nt, Human
aaauauaaauaaaaauaa

SEQ ID NO: 2231850 - RNA, 15 nt, Human
cacuuggucugugag

SEQ ID NO: 2231851 - RNA, 22 nt, Human
uaauaggcguaacuaauuuuaa

SEQ ID NO: 2231852 - RNA, 18 nt, Human
auccugugggaccugggc

SEQ ID NO: 2231853 - RNA, 19 nt, Human
uccugugggaccugggcca

SEQ ID NO: 2231854 - RNA, 16 nt, Human
agggaggacgcucucu

SEQ ID NO: 2231855 - RNA, 15 nt, Human
augaauuaaguuuuu

SEQ ID NO: 2231856 - RNA, 15 nt, Human
gcaagcucuaucacc

SEQ ID NO: 2231857 - RNA, 12 nt, Human
agacagugaaag

SEQ ID NO: 2231858 - RNA, 23 nt, Human
uacaaaugggaaacaaaaggaua

SEQ ID NO: 2231859 - RNA, 17 nt, Human
ucauauuuauagccagg

SEQ ID NO: 2231860 - RNA, 18 nt, Human
uucucuaggaaauauuua

SEQ ID NO: 2231861 - RNA, 23 nt, Human
acguaaucguguccccuauccua

SEQ ID NO: 2231862 - RNA, 16 nt, Human
uuaauaauuuuuaauu

SEQ ID NO: 2231863 - RNA, 15 nt, Human
cuuuucccaacucca

SEQ ID NO: 2231864 - RNA, 16 nt, Human
acaugaacuuguaaag

SEQ ID NO: 2231865 - RNA, 20 nt, Human
agcuuauugucuagugaaac

SEQ ID NO: 2231866 - RNA, 20 nt, Human
uuguagguaauauugcaagg

SEQ ID NO: 2231867 - RNA, 20 nt, Human
cccagcuagaauucacucca

SEQ ID NO: 2231868 - RNA, 23 nt, Human
cuagacccacuggacucaccucc

SEQ ID NO: 2231869 - RNA, 22 nt, Human
cucuggucaagaagcaucgugu

SEQ ID NO: 2231870 - RNA, 22 nt, Human
aauuuaaaaaaaaaccugagcc

SEQ ID NO: 2231871 - RNA, 12 nt, Human
ucuacacuccag

SEQ ID NO: 2231872 - RNA, 12 nt, Human
uuuuuuuuaaaa

SEQ ID NO: 2231873 - RNA, 14 nt, Human
auucugccugcccu

SEQ ID NO: 2231874 - RNA, 15 nt, Human
auagaaguaaaaaca

SEQ ID NO: 2231875 - RNA, 17 nt, Human
ccugugggaccugggcc

SEQ ID NO: 2231876 - RNA, 22 nt, Human
gaacuuuccacauucagagcuu

SEQ ID NO: 2231877 - RNA, 15 nt, Human
aaaaauaacaaugaa

SEQ ID NO: 2231878 - RNA, 16 nt, Human
aauauaaauaaaaaua

SEQ ID NO: 2231879 - RNA, 16 nt, Human
acauccuacaagacac

SEQ ID NO: 2231880 - RNA, 13 nt, Human
cuaugaaauauua

SEQ ID NO: 2231881 - RNA, 21 nt, Human
ugcaggcagcuuuuucucucc

SEQ ID NO: 2231882 - RNA, 15 nt, Human
ccagauccuggaaau

SEQ ID NO: 2231883 - RNA, 20 nt, Human
aauuuuuucucuaggaaaua

SEQ ID NO: 2231884 - RNA, 23 nt, Human
cuugauaaauggcuuccuggcaa

SEQ ID NO: 2231885 - RNA, 16 nt, Human
uaaaauccauacauuu

SEQ ID NO: 2231886 - RNA, 16 nt, Human
ucuuggucucaguguc

SEQ ID NO: 2231887 - RNA, 12 nt, Human
ugagagacacac

SEQ ID NO: 2231888 - RNA, 17 nt, Human
aaucuuauaauuuaaaa

SEQ ID NO: 2231889 - RNA, 14 nt, Human
cccugccccccagc

SEQ ID NO: 2231890 - RNA, 21 nt, Human
auuuguauaaaauaauuuuua

SEQ ID NO: 2231891 - RNA, 15 nt, Human
uuagugaaauauuau

SEQ ID NO: 2231892 - RNA, 20 nt, Human
ugagcgcccacuagacccac

SEQ ID NO: 2231893 - RNA, 14 nt, Human
cagauuugagcuca

SEQ ID NO: 2231894 - RNA, 13 nt, Human
cgggaggcagagg

SEQ ID NO: 2231895 - RNA, 17 nt, Human
caaauccaaugaaauga

SEQ ID NO: 2231896 - RNA, 14 nt, Human
auaaaauaauuuuu

SEQ ID NO: 2231897 - RNA, 22 nt, Human
cccuauccuacuuccccuuccu

SEQ ID NO: 2231898 - RNA, 14 nt, Human
ccuugaugaagaag

SEQ ID NO: 2231899 - RNA, 15 nt, Human
agcucuaucaccaag

SEQ ID NO: 2231900 - RNA, 17 nt, Human
uuauuuguacauuuuuu

SEQ ID NO: 2231901 - RNA, 23 nt, Human
gccagguaccuucucaccuguga

SEQ ID NO: 2231902 - RNA, 15 nt, Human
cuaguaauuggaaag

SEQ ID NO: 2231903 - RNA, 20 nt, Human
acagcccuucuuuccacaga

SEQ ID NO: 2231904 - RNA, 13 nt, Human
ccaaauugagcua

SEQ ID NO: 2231905 - RNA, 18 nt, Human
cauccaaaggcuccugag

SEQ ID NO: 2231906 - RNA, 15 nt, Human
ucaaaggacaccauu

SEQ ID NO: 2231907 - RNA, 20 nt, Human
ggccaugggacagggaggac

SEQ ID NO: 2231908 - RNA, 17 nt, Human
ucuuauaauuuaaaaua

SEQ ID NO: 2231909 - RNA, 17 nt, Human
agaaaugaaagcaggga

SEQ ID NO: 2231910 - RNA, 13 nt, Human
aaaugggaaacaa

SEQ ID NO: 2231911 - RNA, 20 nt, Human
auuacuguaagaaaauauca

SEQ ID NO: 2231912 - RNA, 18 nt, Human
cagggaggacgcucucug

SEQ ID NO: 2231913 - RNA, 14 nt, Human
aaaagacagugaaa

SEQ ID NO: 2231914 - RNA, 18 nt, Human
auuaaguuuuuuuuuaaa

SEQ ID NO: 2231915 - RNA, 23 nt, Human
aaaaacagaccgggguucccgug

SEQ ID NO: 2231916 - RNA, 16 nt, Human
ggggcuucugggcaga

SEQ ID NO: 2231917 - RNA, 15 nt, Human
uauaaauaaaaauaa

SEQ ID NO: 2231918 - RNA, 15 nt, Human
aauauaaauaaaaau

SEQ ID NO: 2231919 - RNA, 19 nt, Human
uggaacaguuaccucugcc

SEQ ID NO: 2231920 - RNA, 15 nt, Human
ugcaauuccacuuau

SEQ ID NO: 2231921 - RNA, 23 nt, Human
gggagccugaucaccugcccugc

SEQ ID NO: 2231922 - RNA, 14 nt, Human
caggaggggcuucu

SEQ ID NO: 2231923 - RNA, 16 nt, Human
cugagcgacagugaga

SEQ ID NO: 2231924 - RNA, 13 nt, Human
uuaaaaaagaaac

SEQ ID NO: 2231925 - RNA, 14 nt, Human
ucugccugcccuga

SEQ ID NO: 2231926 - RNA, 13 nt, Human
ucuacuaaaaaua

SEQ ID NO: 2231927 - RNA, 11 nt, Human
auuuaaaaauc

SEQ ID NO: 2231928 - RNA, 20 nt, Human
uuucuucaacucccugcccc

SEQ ID NO: 2231929 - RNA, 22 nt, Human
cagcacgggggccaaggaugcc

SEQ ID NO: 2231930 - RNA, 16 nt, Human
aggccaugggacaggg

SEQ ID NO: 2231931 - RNA, 17 nt, Human
guguccccuauccuacu

SEQ ID NO: 2231932 - RNA, 13 nt, Human
cacauccuguggg

SEQ ID NO: 2231933 - RNA, 13 nt, Human
gggggaggugagg

SEQ ID NO: 2231934 - RNA, 18 nt, Human
gaaaauaucacuugucaa

SEQ ID NO: 2231935 - RNA, 16 nt, Human
cagcuuuuucucuccc

SEQ ID NO: 2231936 - RNA, 17 nt, Human
ccugcaggcaugaguca

SEQ ID NO: 2231937 - RNA, 18 nt, Human
ugugaccacugcagaaga

SEQ ID NO: 2231938 - RNA, 21 nt, Human
ccaggaggggcuucugggcag

SEQ ID NO: 2231939 - RNA, 18 nt, Human
cauagguuuaauaauuuu

SEQ ID NO: 2231940 - RNA, 22 nt, Human
agugagcagucaggaaagagaa

SEQ ID NO: 2231941 - RNA, 13 nt, Human
agcgacagugaga

SEQ ID NO: 2231942 - RNA, 15 nt, Human
ugaaacccugucucu

SEQ ID NO: 2231943 - RNA, 23 nt, Human
agaguuuagcuggaaaaguaugu

SEQ ID NO: 2231944 - RNA, 22 nt, Human
uguucugauauuggacaguaaa

SEQ ID NO: 2231945 - RNA, 20 nt, Human
gaacguaaucguguccccua

SEQ ID NO: 2231946 - RNA, 13 nt, Human
ugaaaugcagagu

SEQ ID NO: 2231947 - RNA, 13 nt, Human
uacagagacagaa

SEQ ID NO: 2231948 - RNA, 20 nt, Human
gcccauccugccccugagcc

SEQ ID NO: 2231949 - RNA, 14 nt, Human
ccaaauauaaauaa

SEQ ID NO: 2231950 - RNA, 21 nt, Human
acaugggugcuauugggguug

SEQ ID NO: 2231951 - RNA, 12 nt, Human
gcaaagcccagc

SEQ ID NO: 2231952 - RNA, 18 nt, Human
agccugaucaccugcccu

SEQ ID NO: 2231953 - RNA, 21 nt, Human
aguuguugcccacagcuguau

SEQ ID NO: 2231954 - RNA, 21 nt, Human
uuccuaauuccacagcugcuc

SEQ ID NO: 2231955 - RNA, 13 nt, Human
ucauucugccugc

SEQ ID NO: 2231956 - RNA, 18 nt, Human
gccccugcacuccagccu

SEQ ID NO: 2231957 - RNA, 15 nt, Human
accugggcugaggca

SEQ ID NO: 2231958 - RNA, 14 nt, Human
uugcuggagcucug

SEQ ID NO: 2231959 - RNA, 12 nt, Human
gugggaccuggg

SEQ ID NO: 2231960 - RNA, 15 nt, Human
ucagucucccucccu

SEQ ID NO: 2231961 - RNA, 22 nt, Human
aauaugccccauucaacaucua

SEQ ID NO: 2231962 - RNA, 19 nt, Human
agcucugcccauccugccc

SEQ ID NO: 2231963 - RNA, 18 nt, Human
aaggaugccccguccccc

SEQ ID NO: 2231964 - RNA, 23 nt, Human
ccugggaccaggcacccccagaa

SEQ ID NO: 2231965 - RNA, 23 nt, Human
aauaauccucaguuuuugugaaa

SEQ ID NO: 2231966 - RNA, 21 nt, Human
auucagagcuuacuuaaaauu

SEQ ID NO: 2231967 - RNA, 12 nt, Human
acaugagguacu

SEQ ID NO: 2231968 - RNA, 17 nt, Human
acaagaaaugaaagcag

SEQ ID NO: 2231969 - RNA, 18 nt, Human
gagcgacagugagacucu

SEQ ID NO: 2231970 - RNA, 21 nt, Human
aaaauaugccccauucaacau

SEQ ID NO: 2231971 - RNA, 12 nt, Human
auccugugggac

SEQ ID NO: 2231972 - RNA, 16 nt, Human
cagauccccaagccug

SEQ ID NO: 2231973 - RNA, 17 nt, Human
uucugagcauuuaauau

SEQ ID NO: 2231974 - RNA, 22 nt, Human
aaacaccucagcugccucccca

SEQ ID NO: 2231975 - RNA, 17 nt, Human
acucaccucccccaucu

SEQ ID NO: 2231976 - RNA, 21 nt, Human
ccugaucaccugcccugcuga

SEQ ID NO: 2231977 - RNA, 20 nt, Human
accaggcacccccagaauga

SEQ ID NO: 2231978 - RNA, 16 nt, Human
uucucaccugugagac

SEQ ID NO: 2231979 - RNA, 13 nt, Human
agaaguaaaaaca

SEQ ID NO: 2231980 - RNA, 18 nt, Human
ccuucggccuccauccug

SEQ ID NO: 2231981 - RNA, 17 nt, Human
uuccaagccucaugucc

SEQ ID NO: 2231982 - RNA, 21 nt, Human
gcacuguggguagacacacau

SEQ ID NO: 2231983 - RNA, 19 nt, Human
auaaaagacaaggaaaaaa

SEQ ID NO: 2231984 - RNA, 22 nt, Human
aggcuccugagacacaugggug

SEQ ID NO: 2231985 - RNA, 19 nt, Human
auccugugggaccugggcc

SEQ ID NO: 2231986 - RNA, 12 nt, Human
acucccugcccc

SEQ ID NO: 2231987 - RNA, 13 nt, Human
uuuaaaaaagaaa

SEQ ID NO: 2231988 - RNA, 22 nt, Human
uguauacugugugcuaaaacaa

SEQ ID NO: 2231989 - RNA, 17 nt, Human
uaacugauuuguaacaa

SEQ ID NO: 2231990 - RNA, 23 nt, Human
aggcuuacacccacaguggaaag

SEQ ID NO: 2231991 - RNA, 23 nt, Human
ggcuaagcuucacuguaaaauaa

SEQ ID NO: 2231992 - RNA, 13 nt, Human
augaacuuuccac

SEQ ID NO: 2231993 - RNA, 19 nt, Human
agacucgggauuaguacac

SEQ ID NO: 2231994 - RNA, 19 nt, Human
uugugccccugcacuccag

SEQ ID NO: 2231995 - RNA, 15 nt, Human
acugaagaagcacca

SEQ ID NO: 2231996 - RNA, 24 nt, Human
uggccgggagccugaucaccugcc

SEQ ID NO: 2231997 - RNA, 19 nt, Human
cagagaugaggccgccaug

SEQ ID NO: 2231998 - RNA, 17 nt, Human
aaauccuacuuucauaa

SEQ ID NO: 2231999 - RNA, 21 nt, Human
aggcucuuuugggauuuuuga

SEQ ID NO: 2232000 - RNA, 21 nt, Human
auuauauuuauuacuguaaga

SEQ ID NO: 2232001 - RNA, 12 nt, Human
caagccugccuc

SEQ ID NO: 2232002 - RNA, 14 nt, Human
auuuauuuuaauaa

SEQ ID NO: 2232003 - RNA, 22 nt, Human
ggccauagucauucugccugcc

SEQ ID NO: 2232004 - RNA, 14 nt, Human
cagccccugggacc

SEQ ID NO: 2232005 - RNA, 20 nt, Human
cuaggggggucagccagccc

SEQ ID NO: 2232006 - RNA, 13 nt, Human
agccucagucucc

SEQ ID NO: 2232007 - RNA, 19 nt, Human
aaucuacacuccagugaga

SEQ ID NO: 2232008 - RNA, 14 nt, Human
ugaagauguagagg

SEQ ID NO: 2232009 - RNA, 11 nt, Human
caacucccugc

SEQ ID NO: 2232010 - RNA, 22 nt, Human
caccagucugacuguuuccauc

SEQ ID NO: 2232011 - RNA, 13 nt, Human
augcuagaacucc

SEQ ID NO: 2232012 - RNA, 14 nt, Human
cugaaagucccaga

SEQ ID NO: 2232013 - RNA, 20 nt, Human
ccaaauguucaucaaugaau

SEQ ID NO: 2232014 - RNA, 12 nt, Human
aaacuccacauc

SEQ ID NO: 2232015 - RNA, 12 nt, Human
gccccugagccc

SEQ ID NO: 2232016 - RNA, 13 nt, Human
acuauaaaacuag

SEQ ID NO: 2232017 - RNA, 17 nt, Human
cccaggcugagccucag

SEQ ID NO: 2232018 - RNA, 17 nt, Human
agaaucacuugaacccg

SEQ ID NO: 2232019 - RNA, 18 nt, Human
uuacaaaugggaaacaaa

SEQ ID NO: 2232020 - RNA, 23 nt, Human
uuuguauaaaauaauuuuuauau

SEQ ID NO: 2232021 - RNA, 22 nt, Human
accccugagcuugcagagauga

SEQ ID NO: 2232022 - RNA, 16 nt, Human
ugacaagcucacagac

SEQ ID NO: 2232023 - RNA, 16 nt, Human
cagaucaagccugccu

SEQ ID NO: 2232024 - RNA, 23 nt, Human
acugucuuguuggacgagaaaac

SEQ ID NO: 2232025 - RNA, 19 nt, Human
agccugaucaccugcccug

SEQ ID NO: 2232026 - RNA, 14 nt, Human
cagucugaugagaa

SEQ ID NO: 2232027 - RNA, 19 nt, Human
aagcuuguauuccuuuuuc

SEQ ID NO: 2232028 - RNA, 19 nt, Human
ccaggcacccccagaauga

SEQ ID NO: 2232029 - RNA, 15 nt, Human
acuuuuccaaugaca

SEQ ID NO: 2232030 - RNA, 20 nt, Human
ucaagucuuucacauuuaaa

SEQ ID NO: 2232031 - RNA, 24 nt, Human
gccugcccugaaagucccagauca

SEQ ID NO: 2232032 - RNA, 16 nt, Human
cucucccaacuauaaa

SEQ ID NO: 2232033 - RNA, 19 nt, Human
acuuauuuguacauuuuuu

SEQ ID NO: 2232034 - RNA, 13 nt, Human
agguaccagccuu

SEQ ID NO: 2232035 - RNA, 18 nt, Human
cccacuagacccacugga

SEQ ID NO: 2232036 - RNA, 23 nt, Human
agggaagggggaacaugagccuu

SEQ ID NO: 2232037 - RNA, 16 nt, Human
uuucuauaauuuaaau

SEQ ID NO: 2232038 - RNA, 19 nt, Human
ccugccuaagugcagcccc

SEQ ID NO: 2232039 - RNA, 23 nt, Human
uguagguagaucuggucuuuaga

SEQ ID NO: 2232040 - RNA, 23 nt, Human
cuacacgagauacagaauuuuau

SEQ ID NO: 2232041 - RNA, 14 nt, Human
cuggaaaucagggu

SEQ ID NO: 2232042 - RNA, 20 nt, Human
cugacacuaaaacaccucag

SEQ ID NO: 2232043 - RNA, 14 nt, Human
ucagucucccuccc

SEQ ID NO: 2232044 - RNA, 15 nt, Human
cauguccacugguuc

SEQ ID NO: 2232045 - RNA, 21 nt, Human
aucuuuuuuuuaauaaaccau

SEQ ID NO: 2232046 - RNA, 18 nt, Human
aggcggauugagaaggag

SEQ ID NO: 2232047 - RNA, 19 nt, Human
ugggccauagucauucugc

SEQ ID NO: 2232048 - RNA, 20 nt, Human
aagaugguaccaccagucug

SEQ ID NO: 2232049 - RNA, 23 nt, Human
ucaauaucuuuuuuuuaauaaac

SEQ ID NO: 2232050 - RNA, 20 nt, Human
accucauggaauuggagcuc

SEQ ID NO: 2232051 - RNA, 23 nt, Human
uuauagcuacuaauuuuaaaaug

SEQ ID NO: 2232052 - RNA, 17 nt, Human
aauucuugccaaauaua

SEQ ID NO: 2232053 - RNA, 17 nt, Human
uucucuaggaaauauuu

SEQ ID NO: 2232054 - RNA, 20 nt, Human
ccuucucaccugugagacca

SEQ ID NO: 2232055 - RNA, 18 nt, Human
gaaaauaacgauaaaaga

SEQ ID NO: 2232056 - RNA, 22 nt, Human
ugggcacuguggguagacacac

SEQ ID NO: 2232057 - RNA, 20 nt, Human
gauugugccccugcacucca

SEQ ID NO: 2232058 - RNA, 16 nt, Human
uguccccuauccuacu

SEQ ID NO: 2232059 - RNA, 18 nt, Human
aaaaucuuauaauuuaaa

SEQ ID NO: 2232060 - RNA, 12 nt, Human
aauaaaguacaa

SEQ ID NO: 2232061 - RNA, 14 nt, Human
gggaccugggccau

SEQ ID NO: 2232062 - RNA, 19 nt, Human
uuauggcacuaguauuucu

SEQ ID NO: 2232063 - RNA, 22 nt, Human
uauuccuuuuucucuccucucc

SEQ ID NO: 2232064 - RNA, 13 nt, Human
uccugugggaccu

SEQ ID NO: 2232065 - RNA, 19 nt, Human
cagcuacuugggaggcuga

SEQ ID NO: 2232066 - RNA, 23 nt, Human
cccagcccuccuuaucaaaggac

SEQ ID NO: 2232067 - RNA, 22 nt, Human
gagucccaggcugagccucagu

SEQ ID NO: 2232068 - RNA, 21 nt, Human
aggcauccaaaggcuccugag

SEQ ID NO: 2232069 - RNA, 19 nt, Human
aagcauuccaacuaucuca

SEQ ID NO: 2232070 - RNA, 14 nt, Human
agcccucuucugac

SEQ ID NO: 2232071 - RNA, 13 nt, Human
acacuuaaaaaug

SEQ ID NO: 2232072 - RNA, 13 nt, Human
auugucuagugaa

SEQ ID NO: 2232073 - RNA, 16 nt, Human
auccaaugaaaugagu

SEQ ID NO: 2232074 - RNA, 15 nt, Human
cuucaacucccugcc

SEQ ID NO: 2232075 - RNA, 22 nt, Human
augcugagcccggaaacuccac

SEQ ID NO: 2232076 - RNA, 19 nt, Human
gaggcauccaaaggcuccu

SEQ ID NO: 2232077 - RNA, 16 nt, Human
cagcuucucauccugc

SEQ ID NO: 2232078 - RNA, 19 nt, Human
aauguuuacagauccccaa

SEQ ID NO: 2232079 - RNA, 12 nt, Human
ggcugaugcagu

SEQ ID NO: 2232080 - RNA, 15 nt, Human
ccaaggagccaaaca

SEQ ID NO: 2232081 - RNA, 21 nt, Human
cgacagugagacucugucuca

SEQ ID NO: 2232082 - RNA, 15 nt, Human
agccccugggaccag

SEQ ID NO: 2232083 - RNA, 20 nt, Human
auaacaaugcuguauuuuaa

SEQ ID NO: 2232084 - RNA, 15 nt, Human
auaauccuaaacaua

SEQ ID NO: 2232085 - RNA, 17 nt, Human
agaugggagaaucacuu

SEQ ID NO: 2232086 - RNA, 15 nt, Human
aauucugaaagcaac

SEQ ID NO: 2232087 - RNA, 18 nt, Human
ggaggacgcucucuggcc

SEQ ID NO: 2232088 - RNA, 22 nt, Human
aaauguugacaugggacauuug

SEQ ID NO: 2232089 - RNA, 15 nt, Human
gccagugucaggagg

SEQ ID NO: 2232090 - RNA, 20 nt, Human
augucgucaaagcugaaaug

SEQ ID NO: 2232091 - RNA, 16 nt, Human
cuucuggguuccuucc

SEQ ID NO: 2232092 - RNA, 16 nt, Human
cuucugggcagacucu

SEQ ID NO: 2232093 - RNA, 11 nt, Human
auuuuugaagc

SEQ ID NO: 2232094 - RNA, 22 nt, Human
guguccccuauccuacuucccc

SEQ ID NO: 2232095 - RNA, 18 nt, Human
uccagcuggccgggagcc

SEQ ID NO: 2232096 - RNA, 16 nt, Human
gagcucgugggacagu

SEQ ID NO: 2232097 - RNA, 21 nt, Human
ugaaauggacuuuuguacaua

SEQ ID NO: 2232098 - RNA, 18 nt, Human
cucauccugcaggcagcu

SEQ ID NO: 2232099 - RNA, 22 nt, Human
ugaagcaaaauuuuuucucuag

SEQ ID NO: 2232100 - RNA, 21 nt, Human
caaagcccagcuugaaaccuu

SEQ ID NO: 2232101 - RNA, 22 nt, Human
cccagaaugaccuggccgcagu

SEQ ID NO: 2232102 - RNA, 15 nt, Human
guucugcagauaaac

SEQ ID NO: 2232103 - RNA, 21 nt, Human
gauaaaagacagugaaagaaa

SEQ ID NO: 2232104 - RNA, 23 nt, Human
uggcuugaguuuaaauuguaaua

SEQ ID NO: 2232105 - RNA, 17 nt, Human
gccccagauaccaugau

SEQ ID NO: 2232106 - RNA, 23 nt, Human
auuauauggcuugaguuuaaauu

SEQ ID NO: 2232107 - RNA, 21 nt, Human
cucuaucccaaccucucccaa

SEQ ID NO: 2232108 - RNA, 12 nt, Human
auaacuggaaac

SEQ ID NO: 2232109 - RNA, 17 nt, Human
acccacuggacucaccu

SEQ ID NO: 2232110 - RNA, 23 nt, Human
gccugagcggaccuucccagcua

SEQ ID NO: 2232111 - RNA, 12 nt, Human
gggggucagcca

SEQ ID NO: 2232112 - RNA, 20 nt, Human
cugcacacagcacgggggcc

SEQ ID NO: 2232113 - RNA, 18 nt, Human
ccuuccuaauuccacagc

SEQ ID NO: 2232114 - RNA, 22 nt, Human
uuuauggcacuaguauuucuau

SEQ ID NO: 2232115 - RNA, 14 nt, Human
ugagacucugucuc

SEQ ID NO: 2232116 - RNA, 22 nt, Human
ugugccugagcggaccuuccca

SEQ ID NO: 2232117 - RNA, 20 nt, Human
aaaaaccugagccccaaaag

SEQ ID NO: 2232118 - RNA, 14 nt, Human
ccccugagcuugca

SEQ ID NO: 2232119 - RNA, 22 nt, Human
cugagcggaccuucccagcuag

SEQ ID NO: 2232120 - RNA, 16 nt, Human
aggcuugccugcaggc

SEQ ID NO: 2232121 - RNA, 14 nt, Human
auccaaugaaauga

SEQ ID NO: 2232122 - RNA, 15 nt, Human
gacucaccuccccca

SEQ ID NO: 2232123 - RNA, 14 nt, Human
gcuggagcucugcc

SEQ ID NO: 2232124 - RNA, 19 nt, Human
cggccuccauccugaggcu

SEQ ID NO: 2232125 - RNA, 18 nt, Human
acaggauggcaggaggca

SEQ ID NO: 2232126 - RNA, 15 nt, Human
acauccuacaagaca

SEQ ID NO: 2232127 - RNA, 12 nt, Human
cuugguuuuaau

SEQ ID NO: 2232128 - RNA, 21 nt, Human
agcccuucuuuccacagaagc

SEQ ID NO: 2232129 - RNA, 12 nt, Human
cucauggaauug

SEQ ID NO: 2232130 - RNA, 18 nt, Human
uaguaucaaaagaaagaa

SEQ ID NO: 2232131 - RNA, 16 nt, Human
uguucuaagaagugaa

SEQ ID NO: 2232132 - RNA, 14 nt, Human
ggccgggagccuga

SEQ ID NO: 2232133 - RNA, 14 nt, Human
accugggccauagu

SEQ ID NO: 2232134 - RNA, 17 nt, Human
aagacagugaaagaaaa

SEQ ID NO: 2232135 - RNA, 23 nt, Human
ccagaucaagccugccucaauca

SEQ ID NO: 2232136 - RNA, 13 nt, Human
auccugaggcucc

SEQ ID NO: 2232137 - RNA, 19 nt, Human
ccaccugccuauauuuuuu

SEQ ID NO: 2232138 - RNA, 16 nt, Human
aaacuuuuccaaugac

SEQ ID NO: 2232139 - RNA, 17 nt, Human
caggaggggcuucuggg

SEQ ID NO: 2232140 - RNA, 18 nt, Human
agauccccaagccuggca

SEQ ID NO: 2232141 - RNA, 14 nt, Human
cauagaaguaaaaa

SEQ ID NO: 2232142 - RNA, 22 nt, Human
cucuggccuucggccuccaucc

SEQ ID NO: 2232143 - RNA, 23 nt, Human
aggcaugagucagucugaugaga

SEQ ID NO: 2232144 - RNA, 21 nt, Human
cuaccuuuugcuguggcaaau

SEQ ID NO: 2232145 - RNA, 13 nt, Human
gagcuaggggggu

SEQ ID NO: 2232146 - RNA, 17 nt, Human
cuauccuacuuccccuu

SEQ ID NO: 2232147 - RNA, 16 nt, Human
uggggaugaacuuuuu

SEQ ID NO: 2232148 - RNA, 20 nt, Human
ccuccugccuaagugcagcc

SEQ ID NO: 2232149 - RNA, 24 nt, Human
aaagacagcuucucauccugcagg

SEQ ID NO: 2232150 - RNA, 20 nt, Human
agaagaacugaaaucauacu

SEQ ID NO: 2232151 - RNA, 22 nt, Human
aagacccaaaaggcagaagcaa

SEQ ID NO: 2232152 - RNA, 20 nt, Human
ugaggcuccacuuggucugu

SEQ ID NO: 2232153 - RNA, 18 nt, Human
ccacauucagagcuuacu

SEQ ID NO: 2232154 - RNA, 21 nt, Human
cccuauccuacuuccccuucc

SEQ ID NO: 2232155 - RNA, 20 nt, Human
uaaaagacaaggaaaaaaua

SEQ ID NO: 2232156 - RNA, 19 nt, Human
aguauuucuaugaaauauu

SEQ ID NO: 2232157 - RNA, 14 nt, Human
uuccugagccagug

SEQ ID NO: 2232158 - RNA, 15 nt, Human
gggucagccagcccu

SEQ ID NO: 2232159 - RNA, 16 nt, Human
acuaggugcugcagcc

SEQ ID NO: 2232160 - RNA, 14 nt, Human
aauugcagaguacu

SEQ ID NO: 2232161 - RNA, 15 nt, Human
gaaaacaaggaugaa

SEQ ID NO: 2232162 - RNA, 21 nt, Human
ugagcucagcccuggugggca

SEQ ID NO: 2232163 - RNA, 13 nt, Human
agggggaacauga

SEQ ID NO: 2232164 - RNA, 17 nt, Human
cugagcggaccuuccca

SEQ ID NO: 2232165 - RNA, 14 nt, Human
caguucugaagaag

SEQ ID NO: 2232166 - RNA, 14 nt, Human
cuaucaauccaaga

SEQ ID NO: 2232167 - RNA, 17 nt, Human
cccacuggacucaccuc

SEQ ID NO: 2232168 - RNA, 16 nt, Human
cagcuuuccucaaaac

SEQ ID NO: 2232169 - RNA, 14 nt, Human
agcucuaucaccaa

SEQ ID NO: 2232170 - RNA, 12 nt, Human
accaggcacccc

SEQ ID NO: 2232171 - RNA, 21 nt, Human
cacaugaacuuguaaaggaau

SEQ ID NO: 2232172 - RNA, 16 nt, Human
aaaugggaaacaaaag

SEQ ID NO: 2232173 - RNA, 16 nt, Human
augccccgucccccuc

SEQ ID NO: 2232174 - RNA, 19 nt, Human
auuaaguuuuuuuuuaaaa

SEQ ID NO: 2232175 - RNA, 16 nt, Human
uauugggguugggggg

SEQ ID NO: 2232176 - RNA, 14 nt, Human
gaaaacaauaacga

SEQ ID NO: 2232177 - RNA, 17 nt, Human
auuuucuauaauuuaaa

SEQ ID NO: 2232178 - RNA, 16 nt, Human
ugaaguccaagcauuu

SEQ ID NO: 2232179 - RNA, 14 nt, Human
augggccauaugaa

SEQ ID NO: 2232180 - RNA, 12 nt, Human
gaugcugagccc

SEQ ID NO: 2232181 - RNA, 23 nt, Human
uggaaauguuuacagauccccaa

SEQ ID NO: 2232182 - RNA, 22 nt, Human
gaagugaaaaucuacacuccag

SEQ ID NO: 2232183 - RNA, 16 nt, Human
caugguuuagaaagcu

SEQ ID NO: 2232184 - RNA, 22 nt, Human
aauuguauuuuaguaagagauu

SEQ ID NO: 2232185 - RNA, 18 nt, Human
gccuucggccuccauccu

SEQ ID NO: 2232186 - RNA, 18 nt, Human
guaauauugcaaggcaaa

SEQ ID NO: 2232187 - RNA, 21 nt, Human
ugagcuaggggggucagccag

SEQ ID NO: 2232188 - RNA, 22 nt, Human
agcucuaucccaaccucuccca

SEQ ID NO: 2232189 - RNA, 17 nt, Human
uggugaaaugcagaguc

SEQ ID NO: 2232190 - RNA, 13 nt, Human
aaacauccuacaa

SEQ ID NO: 2232191 - RNA, 15 nt, Human
cuugaaaacuuuaug

SEQ ID NO: 2232192 - RNA, 21 nt, Human
aaacgaggauugggaaaaagu

SEQ ID NO: 2232193 - RNA, 13 nt, Human
aaaguguuugaaa

SEQ ID NO: 2232194 - RNA, 19 nt, Human
cacauccugugggaccugg

SEQ ID NO: 2232195 - RNA, 17 nt, Human
uuucacauuuaaauaaa

SEQ ID NO: 2232196 - RNA, 16 nt, Human
ccacuuauaggaauug

SEQ ID NO: 2232197 - RNA, 12 nt, Human
uaauuccacagc

SEQ ID NO: 2232198 - RNA, 14 nt, Human
agucucccucccuu

SEQ ID NO: 2232199 - RNA, 13 nt, Human
cccugcacuccag

SEQ ID NO: 2232200 - RNA, 18 nt, Human
gcccuggugggcagagag

SEQ ID NO: 2232201 - RNA, 23 nt, Human
gcuuuggucuaucuuugagcgcc

SEQ ID NO: 2232202 - RNA, 21 nt, Human
auauaugcuaagucuuauaua

SEQ ID NO: 2232203 - RNA, 15 nt, Human
ggcaauagucaaauu

SEQ ID NO: 2232204 - RNA, 16 nt, Human
cauuuguauaaaauaa

SEQ ID NO: 2232205 - RNA, 16 nt, Human
cuuuaugcuaagugaa

SEQ ID NO: 2232206 - RNA, 15 nt, Human
ggcaagcucuaucac

SEQ ID NO: 2232207 - RNA, 10 nt, Human
ccugagcccc

SEQ ID NO: 2232208 - RNA, 23 nt, Human
augucaauucuugccaaauauaa

SEQ ID NO: 2232209 - RNA, 20 nt, Human
uuaacacaugauccugcaau

SEQ ID NO: 2232210 - RNA, 15 nt, Human
uguauuuuaaaagaa

SEQ ID NO: 2232211 - RNA, 23 nt, Human
auuucugagcauuuaauauggau

SEQ ID NO: 2232212 - RNA, 15 nt, Human
auauugacuuuuuau

SEQ ID NO: 2232213 - RNA, 17 nt, Human
ucucauccugcaggcag

SEQ ID NO: 2232214 - RNA, 14 nt, Human
gaaagcagaacagu

SEQ ID NO: 2232215 - RNA, 17 nt, Human
ggaaauauuuauuuuaa

SEQ ID NO: 2232216 - RNA, 14 nt, Human
ugcugcagccccug

SEQ ID NO: 2232217 - RNA, 14 nt, Human
gagcucagcccugg

SEQ ID NO: 2232218 - RNA, 16 nt, Human
aaauaguuuaugauuc

SEQ ID NO: 2232219 - RNA, 17 nt, Human
gcuauugggguuggggg

SEQ ID NO: 2232220 - RNA, 16 nt, Human
agccucagucucccuc

SEQ ID NO: 2232221 - RNA, 21 nt, Human
cccugggaccaggcaccccca

SEQ ID NO: 2232222 - RNA, 13 nt, Human
acaagagcuuaac

SEQ ID NO: 2232223 - RNA, 15 nt, Human
acgagauacagaauu

SEQ ID NO: 2232224 - RNA, 19 nt, Human
gaaaauaacgauaaaagac

SEQ ID NO: 2232225 - RNA, 18 nt, Human
ccucuggcuccagcuggc

SEQ ID NO: 2232226 - RNA, 16 nt, Human
auuuuaauaauguuuc

SEQ ID NO: 2232227 - RNA, 13 nt, Human
uccuacuuccccu

SEQ ID NO: 2232228 - RNA, 16 nt, Human
auuccaccuacaugag

SEQ ID NO: 2232229 - RNA, 22 nt, Human
ccauagucauucugccugcccu

SEQ ID NO: 2232230 - RNA, 20 nt, Human
acggacgaaccuugaaaacu

SEQ ID NO: 2232231 - RNA, 18 nt, Human
auuuguauaaaauaauuu

SEQ ID NO: 2232232 - RNA, 15 nt, Human
uaauauugcaaggca

SEQ ID NO: 2232233 - RNA, 16 nt, Human
acuaguuucccuugca

SEQ ID NO: 2232234 - RNA, 15 nt, Human
uucacuguaaaauaa

SEQ ID NO: 2232235 - RNA, 17 nt, Human
ccaaggaugccccgucc

SEQ ID NO: 2232236 - RNA, 21 nt, Human
aaaaaguucugcagauaaaca

SEQ ID NO: 2232237 - RNA, 17 nt, Human
auaaaguacaagagcuu

SEQ ID NO: 2232238 - RNA, 23 nt, Human
augaauuaaguuuuuuuuuaaaa

SEQ ID NO: 2232239 - RNA, 15 nt, Human
ggccuccauccugag

SEQ ID NO: 2232240 - RNA, 23 nt, Human
ugagucagucugaugagaacucu

SEQ ID NO: 2232241 - RNA, 16 nt, Human
ugagcucagcccuggu

SEQ ID NO: 2232242 - RNA, 14 nt, Human
ucuauaauuuaaau

SEQ ID NO: 2232243 - RNA, 14 nt, Human
aauauuuauuuuaa

SEQ ID NO: 2232244 - RNA, 21 nt, Human
aauaauguuucaaacauauau

SEQ ID NO: 2232245 - RNA, 16 nt, Human
aaaagcaucacaugaa

SEQ ID NO: 2232246 - RNA, 16 nt, Human
gucccagaucaagccu

SEQ ID NO: 2232247 - RNA, 17 nt, Human
caaauauaaauaaaaau

SEQ ID NO: 2232248 - RNA, 18 nt, Human
caugaauuaguuuuauau

SEQ ID NO: 2232249 - RNA, 23 nt, Human
ucacaccaggcuugccugcaggc

SEQ ID NO: 2232250 - RNA, 22 nt, Human
auuacuguaagaaaauaucacu

SEQ ID NO: 2232251 - RNA, 23 nt, Human
aaagcccagcuugaaaccuucac

SEQ ID NO: 2232252 - RNA, 20 nt, Human
uauaugcuaagucuuauaua

SEQ ID NO: 2232253 - RNA, 17 nt, Human
augccccgucccccucu

SEQ ID NO: 2232254 - RNA, 17 nt, Human
ucaauccaagaacuuau

SEQ ID NO: 2232255 - RNA, 14 nt, Human
cucaccccuugcca

SEQ ID NO: 2232256 - RNA, 18 nt, Human
caguuguugcccacagcu

SEQ ID NO: 2232257 - RNA, 22 nt, Human
ucuagcaugucgucaaagcuga

SEQ ID NO: 2232258 - RNA, 21 nt, Human
auuuuaguaagagauuccuga

SEQ ID NO: 2232259 - RNA, 16 nt, Human
acauuugcucauggaa

SEQ ID NO: 2232260 - RNA, 13 nt, Human
gauggcaggaggc

SEQ ID NO: 2232261 - RNA, 18 nt, Human
uccuaauuccacagcugc

SEQ ID NO: 2232262 - RNA, 22 nt, Human
cuuuccacagaagcuccaggua

SEQ ID NO: 2232263 - RNA, 18 nt, Human
uaaugaauacuuuauaaa

SEQ ID NO: 2232264 - RNA, 18 nt, Human
uauaacaaugcuguauuu

SEQ ID NO: 2232265 - RNA, 14 nt, Human
cagauccccaagcc

SEQ ID NO: 2232266 - RNA, 18 nt, Human
auuuuaacucuauaaugu

SEQ ID NO: 2232267 - RNA, 23 nt, Human
aguacucauacauguuacaacac

SEQ ID NO: 2232268 - RNA, 18 nt, Human
acugauggguuucuccag

SEQ ID NO: 2232269 - RNA, 13 nt, Human
acaaggaaaaaau

SEQ ID NO: 2232270 - RNA, 17 nt, Human
cuuccucugagccuugg

SEQ ID NO: 2232271 - RNA, 20 nt, Human
aauaauuuuuauauuugaaa

SEQ ID NO: 2232272 - RNA, 20 nt, Human
acuaaaacaccucagcugcc

SEQ ID NO: 2232273 - RNA, 16 nt, Human
ucucuaggaaauauuu

SEQ ID NO: 2232274 - RNA, 17 nt, Human
uugccaaauauaaauaa

SEQ ID NO: 2232275 - RNA, 13 nt, Human
acacacaugaagu

SEQ ID NO: 2232276 - RNA, 14 nt, Human
uaaaauccauacau

SEQ ID NO: 2232277 - RNA, 13 nt, Human
gcuggagcucugc

SEQ ID NO: 2232278 - RNA, 15 nt, Human
gagaugcuagaacuc

SEQ ID NO: 2232279 - RNA, 23 nt, Human
aucgugucuggcguuguggggau

SEQ ID NO: 2232280 - RNA, 16 nt, Human
cagaagcaacccaaau

SEQ ID NO: 2232281 - RNA, 18 nt, Human
cagccucuuagaugcagu

SEQ ID NO: 2232282 - RNA, 17 nt, Human
caagccuccuuuuaaag

SEQ ID NO: 2232283 - RNA, 22 nt, Human
ggacaguaaaauccacagacca

SEQ ID NO: 2232284 - RNA, 13 nt, Human
auaaauaaaaaua

SEQ ID NO: 2232285 - RNA, 20 nt, Human
uaagugaaauaagccagaca

SEQ ID NO: 2232286 - RNA, 13 nt, Human
ccagaucaagccu

SEQ ID NO: 2232287 - RNA, 19 nt, Human
ggaauuucuucaacucccu

SEQ ID NO: 2232288 - RNA, 20 nt, Human
guucugcagauaaacaguag

SEQ ID NO: 2232289 - RNA, 15 nt, Human
aagugaaaaucuaca

SEQ ID NO: 2232290 - RNA, 18 nt, Human
gcuccauuuuuagugaaa

SEQ ID NO: 2232291 - RNA, 13 nt, Human
gcucucuggccuu

SEQ ID NO: 2232292 - RNA, 18 nt, Human
acagagacagaaagcaga

SEQ ID NO: 2232293 - RNA, 17 nt, Human
cuggacucaccuccccc

SEQ ID NO: 2232294 - RNA, 22 nt, Human
cauaaauguugacaugggacau

SEQ ID NO: 2232295 - RNA, 15 nt, Human
uggacucaccucccc

SEQ ID NO: 2232296 - RNA, 12 nt, Human
acagagacagaa

SEQ ID NO: 2232297 - RNA, 18 nt, Human
uauagcuacuaauuuuaa

SEQ ID NO: 2232298 - RNA, 16 nt, Human
auacauguuacaacac

SEQ ID NO: 2232299 - RNA, 17 nt, Human
guauuauuuuuuaaaaa

SEQ ID NO: 2232300 - RNA, 16 nt, Human
uaaauaaaaauaaucc

SEQ ID NO: 2232301 - RNA, 22 nt, Human
gugaacaaauuuacagagacag

SEQ ID NO: 2232302 - RNA, 21 nt, Human
cugagcccggaaacuccacau

SEQ ID NO: 2232303 - RNA, 18 nt, Human
ugccauaauuacuauguc

SEQ ID NO: 2232304 - RNA, 20 nt, Human
aaacuuuaugcuaagugaaa

SEQ ID NO: 2232305 - RNA, 19 nt, Human
cauggaauuggagcucgug

SEQ ID NO: 2232306 - RNA, 21 nt, Human
uauaaaauaauuuuuauauuu

SEQ ID NO: 2232307 - RNA, 12 nt, Human
aacuuauuugua

SEQ ID NO: 2232308 - RNA, 12 nt, Human
ucuuaagaagac

SEQ ID NO: 2232309 - RNA, 14 nt, Human
uugugauugauuau

SEQ ID NO: 2232310 - RNA, 21 nt, Human
gagcuaggggggucagccagc

SEQ ID NO: 2232311 - RNA, 10 nt, Human
caacucccug

SEQ ID NO: 2232312 - RNA, 14 nt, Human
auggcaggaggcau

SEQ ID NO: 2232313 - RNA, 22 nt, Human
agcccuccuuaucaaaggacac

SEQ ID NO: 2232314 - RNA, 20 nt, Human
cugauauuggacaguaaaau

SEQ ID NO: 2232315 - RNA, 15 nt, Human
gcuguauuuuaaaag

SEQ ID NO: 2232316 - RNA, 17 nt, Human
cagacaucaacagauaa

SEQ ID NO: 2232317 - RNA, 16 nt, Human
aagacugcacaucaaa

SEQ ID NO: 2232318 - RNA, 16 nt, Human
auuugaugcuacagga

SEQ ID NO: 2232319 - RNA, 16 nt, Human
agagggaauugcagag

SEQ ID NO: 2232320 - RNA, 19 nt, Human
ugcccugaaagucccagau

SEQ ID NO: 2232321 - RNA, 21 nt, Human
ugaacaaauuuacagagacag

SEQ ID NO: 2232322 - RNA, 17 nt, Human
cauuuguauaaaauaau

SEQ ID NO: 2232323 - RNA, 13 nt, Human
aucuacacuccag

SEQ ID NO: 2232324 - RNA, 14 nt, Human
aaacuuuuccaaug

SEQ ID NO: 2232325 - RNA, 16 nt, Human
aaauaacaaugaaagu

SEQ ID NO: 2232326 - RNA, 12 nt, Human
gauaaaagacag

SEQ ID NO: 2232327 - RNA, 20 nt, Human
auuacauuuguauaaaauaa

SEQ ID NO: 2232328 - RNA, 19 nt, Human
augaaagcagggacuugaa

SEQ ID NO: 2232329 - RNA, 19 nt, Human
acaauaacgauaaaagaca

SEQ ID NO: 2232330 - RNA, 15 nt, Human
cugggaccaggcacc

SEQ ID NO: 2232331 - RNA, 16 nt, Human
aaauauuuauuuuaau

SEQ ID NO: 2232332 - RNA, 16 nt, Human
aagcauuuagauguau

SEQ ID NO: 2232333 - RNA, 13 nt, Human
ugaaauuguauua

SEQ ID NO: 2232334 - RNA, 15 nt, Human
aaggcuccugagaca

SEQ ID NO: 2232335 - RNA, 11 nt, Human
aauuccacagc

SEQ ID NO: 2232336 - RNA, 19 nt, Human
cuggacucaccucccccau

SEQ ID NO: 2232337 - RNA, 18 nt, Human
ccauccugccccugagcc

SEQ ID NO: 2232338 - RNA, 14 nt, Human
caugggccccagau

SEQ ID NO: 2232339 - RNA, 15 nt, Human
guuuuucuuuucauu

SEQ ID NO: 2232340 - RNA, 19 nt, Human
cccccucuggcuccagcug

SEQ ID NO: 2232341 - RNA, 15 nt, Human
cuucucuucacaguc

SEQ ID NO: 2232342 - RNA, 18 nt, Human
cagucucccucccuuggg

SEQ ID NO: 2232343 - RNA, 15 nt, Human
aaggguacacugccu

SEQ ID NO: 2232344 - RNA, 22 nt, Human
ugggccccagauaccaugaugc

SEQ ID NO: 2232345 - RNA, 17 nt, Human
ugaacuugguuuuaauu

SEQ ID NO: 2232346 - RNA, 19 nt, Human
ggagccugaucaccugccc

SEQ ID NO: 2232347 - RNA, 14 nt, Human
ucuuuuuuuuaaua

SEQ ID NO: 2232348 - RNA, 17 nt, Human
aauaacgauaaaagaca

SEQ ID NO: 2232349 - RNA, 19 nt, Human
uccagccuggcaaggguuc

SEQ ID NO: 2232350 - RNA, 14 nt, Human
agagacagaaagca

SEQ ID NO: 2232351 - RNA, 17 nt, Human
cugagcagugcuugaau

SEQ ID NO: 2232352 - RNA, 15 nt, Human
gccagcccucuucug

SEQ ID NO: 2232353 - RNA, 16 nt, Human
auccuugaagauuuac

SEQ ID NO: 2232354 - RNA, 16 nt, Human
cuucggccuccauccu

SEQ ID NO: 2232355 - RNA, 15 nt, Human
uaacgauaaaagaca

SEQ ID NO: 2232356 - RNA, 14 nt, Human
gagagugaacaaau

SEQ ID NO: 2232357 - RNA, 14 nt, Human
agaauucauucacu

SEQ ID NO: 2232358 - RNA, 20 nt, Human
cuucaacucccugcccccca

SEQ ID NO: 2232359 - RNA, 21 nt, Human
caccagucugacuguuuccau

SEQ ID NO: 2232360 - RNA, 19 nt, Human
caauucuugccaaauauaa

SEQ ID NO: 2232361 - RNA, 23 nt, Human
gaaaacaauaacgauaaaagaca

SEQ ID NO: 2232362 - RNA, 12 nt, Human
uucagccugaaa

SEQ ID NO: 2232363 - RNA, 14 nt, Human
uugggaaaaaguaa

SEQ ID NO: 2232364 - RNA, 23 nt, Human
gggaaacaaaaggauaaugaaua

SEQ ID NO: 2232365 - RNA, 21 nt, Human
guccccuauccuacuuccccu

SEQ ID NO: 2232366 - RNA, 16 nt, Human
cagccagcccucuucu

SEQ ID NO: 2232367 - RNA, 19 nt, Human
agggaauugcagaguacug

SEQ ID NO: 2232368 - RNA, 22 nt, Human
ggcagcuuuccucaaaacuuca

SEQ ID NO: 2232369 - RNA, 20 nt, Human
cuaaaugucaaucagccuag

SEQ ID NO: 2232370 - RNA, 14 nt, Human
ugcuggagcucugc

SEQ ID NO: 2232371 - RNA, 20 nt, Human
acuagaguuuagcuggaaaa

SEQ ID NO: 2232372 - RNA, 15 nt, Human
uuaauucugaaagca

SEQ ID NO: 2232373 - RNA, 16 nt, Human
gaaaaaauaacaauga

SEQ ID NO: 2232374 - RNA, 19 nt, Human
ucaguccaugaagauguag

SEQ ID NO: 2232375 - RNA, 15 nt, Human
cuggacucaccuccc

SEQ ID NO: 2232376 - RNA, 16 nt, Human
auuauacccccugcaa

SEQ ID NO: 2232377 - RNA, 17 nt, Human
ugcccugaaagucccag

SEQ ID NO: 2232378 - RNA, 13 nt, Human
acaagaaaugaaa

SEQ ID NO: 2232379 - RNA, 20 nt, Human
agagacacacugaagaagca

SEQ ID NO: 2232380 - RNA, 13 nt, Human
acaauaaaagaca

SEQ ID NO: 2232381 - RNA, 16 nt, Human
ugaaguacucauacau

SEQ ID NO: 2232382 - RNA, 13 nt, Human
cccagauaccaug

SEQ ID NO: 2232383 - RNA, 19 nt, Human
auuucuucaacucccugcc

SEQ ID NO: 2232384 - RNA, 23 nt, Human
ggaacaguuaccucugccucaga

SEQ ID NO: 2232385 - RNA, 11 nt, Human
ggguuucucca

SEQ ID NO: 2232386 - RNA, 17 nt, Human
gaaaaucaggcuggcca

SEQ ID NO: 2232387 - RNA, 16 nt, Human
ggccuccauccugagg

SEQ ID NO: 2232388 - RNA, 15 nt, Human
aaugauuaugaauua

SEQ ID NO: 2232389 - RNA, 14 nt, Human
ccagcuggccggga

SEQ ID NO: 2232390 - RNA, 15 nt, Human
ccucuucugacacua

SEQ ID NO: 2232391 - RNA, 16 nt, Human
cuccauccugaggcuc

SEQ ID NO: 2232392 - RNA, 14 nt, Human
aaaauacaaaaaaa

SEQ ID NO: 2232393 - RNA, 17 nt, Human
aaacaccucagcugccu

SEQ ID NO: 2232394 - RNA, 12 nt, Human
cuccauuuuuag

SEQ ID NO: 2232395 - RNA, 16 nt, Human
cuugccugcaggcaug

SEQ ID NO: 2232396 - RNA, 17 nt, Human
ucuauaauguguucauu

SEQ ID NO: 2232397 - RNA, 21 nt, Human
gaccaggcacccccagaauga

SEQ ID NO: 2232398 - RNA, 12 nt, Human
aauacuuuauaa

SEQ ID NO: 2232399 - RNA, 14 nt, Human
uuuguauaaaauaa

SEQ ID NO: 2232400 - RNA, 22 nt, Human
cccagcccuccuuaucaaagga

SEQ ID NO: 2232401 - RNA, 15 nt, Human
acucaacaaacauaa

SEQ ID NO: 2232402 - RNA, 22 nt, Human
gcucuaucccaaccucucccaa

SEQ ID NO: 2232403 - RNA, 18 nt, Human
uaucaaaagaaagaaaau

SEQ ID NO: 2232404 - RNA, 18 nt, Human
acauuuauauuuuuguga

SEQ ID NO: 2232405 - RNA, 19 nt, Human
gcucauggaauuggagcuc

SEQ ID NO: 2232406 - RNA, 22 nt, Human
acaggauggcaggaggcaucca

SEQ ID NO: 2232407 - RNA, 18 nt, Human
cagaguacuggcugaugg

SEQ ID NO: 2232408 - RNA, 16 nt, Human
agcuugaaaccuucac

SEQ ID NO: 2232409 - RNA, 16 nt, Human
cagucucccucccuug

SEQ ID NO: 2232410 - RNA, 15 nt, Human
uugacacuuaaaaau

SEQ ID NO: 2232411 - RNA, 17 nt, Human
gaggcauccuuccucac

SEQ ID NO: 2232412 - RNA, 22 nt, Human
ugauaguuguaccgcaauguga

SEQ ID NO: 2232413 - RNA, 13 nt, Human
ugaaagaaaauaa

SEQ ID NO: 2232414 - RNA, 12 nt, Human
aagaaaauaacg

SEQ ID NO: 2232415 - RNA, 12 nt, Human
aauugcagagua

SEQ ID NO: 2232416 - RNA, 12 nt, Human
aaaagaaagaaa

SEQ ID NO: 2232417 - RNA, 15 nt, Human
gcaggcaugagucag

SEQ ID NO: 2232418 - RNA, 19 nt, Human
ucagugucaaugcagcccc

SEQ ID NO: 2232419 - RNA, 18 nt, Human
acaccucagcugccuccc

SEQ ID NO: 2232420 - RNA, 22 nt, Human
cccaugauguuuagaaacacaa

SEQ ID NO: 2232421 - RNA, 17 nt, Human
aaauauaaauaaaaaua

SEQ ID NO: 2232422 - RNA, 22 nt, Human
aaaucaggguuaguauugucca

SEQ ID NO: 2232423 - RNA, 19 nt, Human
ccccugcaaagcccagcuu

SEQ ID NO: 2232424 - RNA, 20 nt, Human
aagucuuucacauuuaaaua

SEQ ID NO: 2232425 - RNA, 14 nt, Human
gauugagaaggagc

SEQ ID NO: 2232426 - RNA, 17 nt, Human
ugaccacugcagaagac

SEQ ID NO: 2232427 - RNA, 13 nt, Human
cacaacuauauug

SEQ ID NO: 2232428 - RNA, 19 nt, Human
cagaaagcagaacagugau

SEQ ID NO: 2232429 - RNA, 16 nt, Human
cagggcucacagaauu

SEQ ID NO: 2232430 - RNA, 15 nt, Human
uccauccugaggcuc

SEQ ID NO: 2232431 - RNA, 12 nt, Human
aauuuaaauaua

SEQ ID NO: 2232432 - RNA, 18 nt, Human
gaaacaaaaggauaauga

SEQ ID NO: 2232433 - RNA, 19 nt, Human
cucaccucccccaucucuu

SEQ ID NO: 2232434 - RNA, 20 nt, Human
augggccccagauaccauga

SEQ ID NO: 2232435 - RNA, 19 nt, Human
ugaucaccugcccugcuga

SEQ ID NO: 2232436 - RNA, 15 nt, Human
cuaggugcugcagcc

SEQ ID NO: 2232437 - RNA, 16 nt, Human
gaaggcuuacacccac

SEQ ID NO: 2232438 - RNA, 15 nt, Human
uugacccacaagaaa

SEQ ID NO: 2232439 - RNA, 15 nt, Human
acaaggaaaaaauaa

SEQ ID NO: 2232440 - RNA, 17 nt, Human
gccuccuuuuaaaguaa

SEQ ID NO: 2232441 - RNA, 22 nt, Human
uuuuauagcuacuaauuuuaaa

SEQ ID NO: 2232442 - RNA, 19 nt, Human
cuagaguuuagcuggaaaa

SEQ ID NO: 2232443 - RNA, 20 nt, Human
aaggaugccccgucccccuc

SEQ ID NO: 2232444 - RNA, 13 nt, Human
uguauauuuuaua

SEQ ID NO: 2232445 - RNA, 20 nt, Human
cucuucugacacuaaaacac

SEQ ID NO: 2232446 - RNA, 13 nt, Human
ccugccccccagc

SEQ ID NO: 2232447 - RNA, 17 nt, Human
uuauaucaauuuaaaaa

SEQ ID NO: 2232448 - RNA, 13 nt, Human
ccaaaagguauuu

SEQ ID NO: 2232449 - RNA, 20 nt, Human
acuccacuuggacaugggcc

SEQ ID NO: 2232450 - RNA, 23 nt, Human
aacuuuuccaaugacauuuuguu

SEQ ID NO: 2232451 - RNA, 16 nt, Human
cuagaaccaccugccu

SEQ ID NO: 2232452 - RNA, 16 nt, Human
cugagccucagucucc

SEQ ID NO: 2232453 - RNA, 18 nt, Human
uuuuauaucaauuuaaaa

SEQ ID NO: 2232454 - RNA, 17 nt, Human
ugguucccuugaugaag

SEQ ID NO: 2232455 - RNA, 19 nt, Human
uuguggggaugaacuuuuu

SEQ ID NO: 2232456 - RNA, 13 nt, Human
ucacuguaaaaua

SEQ ID NO: 2232457 - RNA, 13 nt, Human
gaaccuaggguga

SEQ ID NO: 2232458 - RNA, 16 nt, Human
ccuacaugagguacug

SEQ ID NO: 2232459 - RNA, 23 nt, Human
agcagugcuugaaugaaguugua

SEQ ID NO: 2232460 - RNA, 18 nt, Human
cagcuuauugucuaguga

SEQ ID NO: 2232461 - RNA, 21 nt, Human
ugcucaauaaaguacaagagc

SEQ ID NO: 2232462 - RNA, 22 nt, Human
gugccucaccccuugccauaau

SEQ ID NO: 2232463 - RNA, 15 nt, Human
ccacaggaaccacaa

SEQ ID NO: 2232464 - RNA, 21 nt, Human
caagacccaaaaggcagaagc

SEQ ID NO: 2232465 - RNA, 15 nt, Human
uucacauuuaaauaa

SEQ ID NO: 2232466 - RNA, 19 nt, Human
guccaggucuaccaaaaau

SEQ ID NO: 2232467 - RNA, 22 nt, Human
ccccuuccuaauuccacagcug

SEQ ID NO: 2232468 - RNA, 15 nt, Human
auccugccccugagc

SEQ ID NO: 2232469 - RNA, 20 nt, Human
uuuaaauaaaguguuugaaa

SEQ ID NO: 2232470 - RNA, 21 nt, Human
cucaguccaugaagauguaga

SEQ ID NO: 2232471 - RNA, 18 nt, Human
ccaggaggggcuucuggg

SEQ ID NO: 2232472 - RNA, 17 nt, Human
ccagaucaagccugccu

SEQ ID NO: 2232473 - RNA, 18 nt, Human
gcuaucaauccaagaacu

SEQ ID NO: 2232474 - RNA, 18 nt, Human
cagguaccuucucaccug

SEQ ID NO: 2232475 - RNA, 18 nt, Human
uguacuuuauuuucuaua

SEQ ID NO: 2232476 - RNA, 20 nt, Human
aacaaugcuguauuuuaaaa

SEQ ID NO: 2232477 - RNA, 18 nt, Human
agagaaugagagacacac

SEQ ID NO: 2232478 - RNA, 18 nt, Human
cuccagccugagcgacag

SEQ ID NO: 2232479 - RNA, 16 nt, Human
uucaauaaaacuuuuc

SEQ ID NO: 2232480 - RNA, 22 nt, Human
uacaugagguacugagagugaa

SEQ ID NO: 2232481 - RNA, 18 nt, Human
gacccacuggacucaccu

SEQ ID NO: 2232482 - RNA, 19 nt, Human
guuauuauauuuacaaaug

SEQ ID NO: 2232483 - RNA, 17 nt, Human
ccaugaugcugagcccg

SEQ ID NO: 2232484 - RNA, 20 nt, Human
ugagucccaggcugagccuc

SEQ ID NO: 2232485 - RNA, 14 nt, Human
cauccugugggacc

SEQ ID NO: 2232486 - RNA, 22 nt, Human
accucagcugccuccccagcuc

SEQ ID NO: 2232487 - RNA, 14 nt, Human
acuaauuuuaaaau

SEQ ID NO: 2232488 - RNA, 18 nt, Human
cagaaagcagaacaguga

SEQ ID NO: 2232489 - RNA, 13 nt, Human
agagguccacaac

SEQ ID NO: 2232490 - RNA, 19 nt, Human
caacucccugccccccagc

SEQ ID NO: 2232491 - RNA, 17 nt, Human
uucugacacuaaaacac

SEQ ID NO: 2232492 - RNA, 20 nt, Human
aauaagccagacaucaacag

SEQ ID NO: 2232493 - RNA, 23 nt, Human
uccaacuaucucauuuccaagca

SEQ ID NO: 2232494 - RNA, 21 nt, Human
auuuuuucucuaggaaauauu

SEQ ID NO: 2232495 - RNA, 16 nt, Human
guuccuuccucugagc

SEQ ID NO: 2232496 - RNA, 19 nt, Human
ugagcgcccacuagaccca

SEQ ID NO: 2232497 - RNA, 16 nt, Human
gcccugaaagucccag

SEQ ID NO: 2232498 - RNA, 16 nt, Human
ccugagcgacagugag

SEQ ID NO: 2232499 - RNA, 20 nt, Human
gcuugcagagaugaggccgc

SEQ ID NO: 2232500 - RNA, 13 nt, Human
uauuucuaugaaa

SEQ ID NO: 2232501 - RNA, 19 nt, Human
cuuccagauccuggaaauc

SEQ ID NO: 2232502 - RNA, 20 nt, Human
gauugagaaggagcucccag

SEQ ID NO: 2232503 - RNA, 19 nt, Human
ccccucuggcuccagcugg

SEQ ID NO: 2232504 - RNA, 22 nt, Human
ccacuuggacaugggccccaga

SEQ ID NO: 2232505 - RNA, 20 nt, Human
accuacacgagauacagaau

SEQ ID NO: 2232506 - RNA, 14 nt, Human
cucccucccuuggg

SEQ ID NO: 2232507 - RNA, 23 nt, Human
cacaagaaaugaaagcagggacu

SEQ ID NO: 2232508 - RNA, 18 nt, Human
ccugagcggaccuuccca

SEQ ID NO: 2232509 - RNA, 18 nt, Human
auagcuacuaauuuuaaa

SEQ ID NO: 2232510 - RNA, 15 nt, Human
cucgugggacaguca

SEQ ID NO: 2232511 - RNA, 11 nt, Human
uucacagggga

SEQ ID NO: 2232512 - RNA, 22 nt, Human
caucgcaauguaagacucggga

SEQ ID NO: 2232513 - RNA, 16 nt, Human
augcuguauuuuaaaa

SEQ ID NO: 2232514 - RNA, 21 nt, Human
aggacagcccuucuuuccaca

SEQ ID NO: 2232515 - RNA, 20 nt, Human
uagaugcaguucugaagaag

SEQ ID NO: 2232516 - RNA, 12 nt, Human
acuauaaaacua

SEQ ID NO: 2232517 - RNA, 12 nt, Human
acacuaaaacac

SEQ ID NO: 2232518 - RNA, 15 nt, Human
cauccugcaggcagc

SEQ ID NO: 2232519 - RNA, 17 nt, Human
aagcuuuuuuugaauca

SEQ ID NO: 2232520 - RNA, 12 nt, Human
cucccugccccc

SEQ ID NO: 2232521 - RNA, 15 nt, Human
cauuccaagccucau

SEQ ID NO: 2232522 - RNA, 18 nt, Human
uauuuucaguuauuauau

SEQ ID NO: 2232523 - RNA, 23 nt, Human
cuuaagaagacugcauuauauuu

SEQ ID NO: 2232524 - RNA, 23 nt, Human
aggcacccccagaaugaccuggc

SEQ ID NO: 2232525 - RNA, 19 nt, Human
uggaaauguuuacagaucc

SEQ ID NO: 2232526 - RNA, 21 nt, Human
uuacauuuguauaaaauaauu

SEQ ID NO: 2232527 - RNA, 16 nt, Human
aaagacaaggaaaaaa

SEQ ID NO: 2232528 - RNA, 12 nt, Human
auauaaauaaaa

SEQ ID NO: 2232529 - RNA, 16 nt, Human
auuuuuagugaaauau

SEQ ID NO: 2232530 - RNA, 22 nt, Human
ugguuguauuauuuuuuaaaaa

SEQ ID NO: 2232531 - RNA, 23 nt, Human
uaacgauaaaagacagugaaaga

SEQ ID NO: 2232532 - RNA, 21 nt, Human
cagagucaaugaacuuuccac

SEQ ID NO: 2232533 - RNA, 22 nt, Human
cuuuuccaaugacauuuuguug

SEQ ID NO: 2232534 - RNA, 14 nt, Human
ugcuguauuuuaaa

SEQ ID NO: 2232535 - RNA, 14 nt, Human
cuacaagacacagu

SEQ ID NO: 2232536 - RNA, 12 nt, Human
uaagaagacugc

SEQ ID NO: 2232537 - RNA, 17 nt, Human
aauaugcucuaaacaug

SEQ ID NO: 2232538 - RNA, 22 nt, Human
cucccacuagacaaguccagcc

SEQ ID NO: 2232539 - RNA, 14 nt, Human
caaggaaaaaauaa

SEQ ID NO: 2232540 - RNA, 16 nt, Human
ccuaagugcagccccg

SEQ ID NO: 2232541 - RNA, 16 nt, Human
cugauggguuucucca

SEQ ID NO: 2232542 - RNA, 22 nt, Human
cuggguuccuuccucugagccu

SEQ ID NO: 2232543 - RNA, 11 nt, Human
aauugcagagu

SEQ ID NO: 2232544 - RNA, 23 nt, Human
cuucaacucccugccccccagcc

SEQ ID NO: 2232545 - RNA, 22 nt, Human
uggguuccuuccucugagccuu

SEQ ID NO: 2232546 - RNA, 13 nt, Human
aggaaaaaauaac

SEQ ID NO: 2232547 - RNA, 14 nt, Human
auuguccaggucua

SEQ ID NO: 2232548 - RNA, 14 nt, Human
uucacauuuaaaua

SEQ ID NO: 2232549 - RNA, 22 nt, Human
aaccuacacgagauacagaauu

SEQ ID NO: 2232550 - RNA, 14 nt, Human
gaaugauuaugaau

SEQ ID NO: 2232551 - RNA, 23 nt, Human
ugaauuacauuuguauaaaauaa

SEQ ID NO: 2232552 - RNA, 21 nt, Human
augcuacaggauuugaaauug

SEQ ID NO: 2232553 - RNA, 14 nt, Human
cuagaauucacucc

SEQ ID NO: 2232554 - RNA, 20 nt, Human
ugguuguauuauuuuuuaaa

SEQ ID NO: 2232555 - RNA, 21 nt, Human
gggagccugaucaccugcccu

SEQ ID NO: 2232556 - RNA, 13 nt, Human
aagugcagccccg

SEQ ID NO: 2232557 - RNA, 19 nt, Human
ucaauucuugccaaauaua

SEQ ID NO: 2232558 - RNA, 14 nt, Human
ugacacuuaaaaau

SEQ ID NO: 2232559 - RNA, 18 nt, Human
acaaaugcauuucuaaag

SEQ ID NO: 2232560 - RNA, 22 nt, Human
auauaugcuaagucuuauauau

SEQ ID NO: 2232561 - RNA, 13 nt, Human
cauuuguauaaaa

SEQ ID NO: 2232562 - RNA, 19 nt, Human
ucaccaaggcugauuaaac

SEQ ID NO: 2232563 - RNA, 23 nt, Human
gaacaugagccuuuguugcuauc

SEQ ID NO: 2232564 - RNA, 17 nt, Human
cugagcgacagugagac

SEQ ID NO: 2232565 - RNA, 18 nt, Human
acaaauccaaugaaauga

SEQ ID NO: 2232566 - RNA, 15 nt, Human
ccaugaugcugagcc

SEQ ID NO: 2232567 - RNA, 17 nt, Human
cacuagacaaguccagc

SEQ ID NO: 2232568 - RNA, 13 nt, Human
ggcacccccagaa

SEQ ID NO: 2232569 - RNA, 21 nt, Human
aaugaauggcuaagcaaaaug

SEQ ID NO: 2232570 - RNA, 15 nt, Human
gugaacuugguuuua

SEQ ID NO: 2232571 - RNA, 16 nt, Human
aaugaaagcagggacu

SEQ ID NO: 2232572 - RNA, 17 nt, Human
aaagcagggacuugaac

SEQ ID NO: 2232573 - RNA, 20 nt, Human
acaugagguacugagaguga

SEQ ID NO: 2232574 - RNA, 18 nt, Human
auaaaguguuugaaagcu

SEQ ID NO: 2232575 - RNA, 16 nt, Human
agugaaggauuuaugu

SEQ ID NO: 2232576 - RNA, 15 nt, Human
auggugaaaugcaga

SEQ ID NO: 2232577 - RNA, 19 nt, Human
auccuacaagacacaguga

SEQ ID NO: 2232578 - RNA, 18 nt, Human
ccaagccuggcaagggaa

SEQ ID NO: 2232579 - RNA, 18 nt, Human
gaggcggauugagaagga

SEQ ID NO: 2232580 - RNA, 19 nt, Human
uggauacuccauggggugg

SEQ ID NO: 2232581 - RNA, 21 nt, Human
aaaauuuuuucucuaggaaau

SEQ ID NO: 2232582 - RNA, 13 nt, Human
ucuauaauuuaaa

SEQ ID NO: 2232583 - RNA, 16 nt, Human
ccuccuuuuaaaguaa

SEQ ID NO: 2232584 - RNA, 11 nt, Human
cuguuuuauaa

SEQ ID NO: 2232585 - RNA, 18 nt, Human
uuuguuaaaugauuucau

SEQ ID NO: 2232586 - RNA, 21 nt, Human
ccauccugccccugagcccau

SEQ ID NO: 2232587 - RNA, 23 nt, Human
cccacuggacucaccucccccau

SEQ ID NO: 2232588 - RNA, 12 nt, Human
uccugcaggcag

SEQ ID NO: 2232589 - RNA, 13 nt, Human
ccugagcuugcag

SEQ ID NO: 2232590 - RNA, 20 nt, Human
uuacaaauccaaugaaauga

SEQ ID NO: 2232591 - RNA, 22 nt, Human
uguugcccacagcuguaugauu

SEQ ID NO: 2232592 - RNA, 19 nt, Human
guaguccuguaauggaagc

SEQ ID NO: 2232593 - RNA, 19 nt, Human
agauaccaugaugcugagc

SEQ ID NO: 2232594 - RNA, 22 nt, Human
uucccagcuagaauucacucca

SEQ ID NO: 2232595 - RNA, 20 nt, Human
auaauccuaaacauaugaau

SEQ ID NO: 2232596 - RNA, 22 nt, Human
caaaugggaaacaaaaggauaa

SEQ ID NO: 2232597 - RNA, 17 nt, Human
uggccgcagugaggcgg

SEQ ID NO: 2232598 - RNA, 13 nt, Human
guggaaaaacaga

SEQ ID NO: 2232599 - RNA, 17 nt, Human
cucuggucaagaagcau

SEQ ID NO: 2232600 - RNA, 15 nt, Human
ugccugcaggcauga

SEQ ID NO: 2232601 - RNA, 14 nt, Human
ccacuggacucacc

SEQ ID NO: 2232602 - RNA, 17 nt, Human
auaauuuaaauauaugc

SEQ ID NO: 2232603 - RNA, 12 nt, Human
uauaauuuaaaa

SEQ ID NO: 2232604 - RNA, 14 nt, Human
uugacccacaagaa

SEQ ID NO: 2232605 - RNA, 18 nt, Human
ugcauagguuuaauaauu

SEQ ID NO: 2232606 - RNA, 14 nt, Human
aaccugagccccaa

SEQ ID NO: 2232607 - RNA, 13 nt, Human
auaacuggaaacu

SEQ ID NO: 2232608 - RNA, 19 nt, Human
aaugaaauggugaaaugca

SEQ ID NO: 2232609 - RNA, 22 nt, Human
ggcauuuaggccaugggacagg

SEQ ID NO: 2232610 - RNA, 19 nt, Human
gagguacugagagugaaca

SEQ ID NO: 2232611 - RNA, 20 nt, Human
gggaggcagagguugcagug

SEQ ID NO: 2232612 - RNA, 19 nt, Human
gugaacuugguuuuaauua

SEQ ID NO: 2232613 - RNA, 23 nt, Human
uuuuauagcuacuaauuuuaaaa

SEQ ID NO: 2232614 - RNA, 23 nt, Human
caggcaugagucagucugaugag

SEQ ID NO: 2232615 - RNA, 21 nt, Human
auccugugggaccugggccau

SEQ ID NO: 2232616 - RNA, 12 nt, Human
gaaaauaacaau

SEQ ID NO: 2232617 - RNA, 15 nt, Human
auuauuuuuuaaaaa

SEQ ID NO: 2232618 - RNA, 11 nt, Human
accauuuuuac

SEQ ID NO: 2232619 - RNA, 20 nt, Human
agcccucuucugacacuaaa

SEQ ID NO: 2232620 - RNA, 18 nt, Human
ggggucagccagcccucu

SEQ ID NO: 2232621 - RNA, 23 nt, Human
uagacacacaugaaguccaagca

SEQ ID NO: 2232622 - RNA, 12 nt, Human
ucaagaagcauc

SEQ ID NO: 2232623 - RNA, 18 nt, Human
aggaaaaaauaacaauga

SEQ ID NO: 2232624 - RNA, 17 nt, Human
uucacuguaaaauaaua

SEQ ID NO: 2232625 - RNA, 16 nt, Human
uucuauaauuuaaaua

SEQ ID NO: 2232626 - RNA, 20 nt, Human
ucacaugaacuuguaaagga

SEQ ID NO: 2232627 - RNA, 21 nt, Human
aggguuaugauuaaguaauga

SEQ ID NO: 2232628 - RNA, 21 nt, Human
aggcagcuuuuucucucccac

SEQ ID NO: 2232629 - RNA, 21 nt, Human
caacacacagauuugagcuca

SEQ ID NO: 2232630 - RNA, 12 nt, Human
cagaacagugau

SEQ ID NO: 2232631 - RNA, 15 nt, Human
aggauggcaggaggc

SEQ ID NO: 2232632 - RNA, 13 nt, Human
aagacaaggaaaa

SEQ ID NO: 2232633 - RNA, 21 nt, Human
cccacuggacucaccuccccc

SEQ ID NO: 2232634 - RNA, 15 nt, Human
caagcucacagaccu

SEQ ID NO: 2232635 - RNA, 18 nt, Human
aaggagcucccaggaggg

SEQ ID NO: 2232636 - RNA, 13 nt, Human
aacacaacuauau

SEQ ID NO: 2232637 - RNA, 19 nt, Human
gacagucaccucauggaau

SEQ ID NO: 2232638 - RNA, 15 nt, Human
ccugccccccagccc

SEQ ID NO: 2232639 - RNA, 16 nt, Human
agugaaagaaaauaac

SEQ ID NO: 2232640 - RNA, 20 nt, Human
guuccuuccucugagccuug

SEQ ID NO: 2232641 - RNA, 16 nt, Human
ucccugccccccagcc

SEQ ID NO: 2232642 - RNA, 14 nt, Human
aaauauaaauaaaa

SEQ ID NO: 2232643 - RNA, 14 nt, Human
auaaauaaaaauaa

SEQ ID NO: 2232644 - RNA, 14 nt, Human
uugccaugugcuag

SEQ ID NO: 2232645 - RNA, 17 nt, Human
agggcauagaaguaaaa

SEQ ID NO: 2232646 - RNA, 21 nt, Human
ucacaugaacuuguaaaggaa

SEQ ID NO: 2232647 - RNA, 18 nt, Human
ucuucuggguuccuuccu

SEQ ID NO: 2232648 - RNA, 21 nt, Human
cucagugucaaugcagccccc

SEQ ID NO: 2232649 - RNA, 20 nt, Human
cagguaccuucucaccugug

SEQ ID NO: 2232650 - RNA, 18 nt, Human
acaaaugggaaacaaaag

SEQ ID NO: 2232651 - RNA, 22 nt, Human
aucaccaaggcugauuaaacca

SEQ ID NO: 2232652 - RNA, 22 nt, Human
guauucauauuuauagccaggu

SEQ ID NO: 2232653 - RNA, 15 nt, Human
aauaacgauaaaaga

SEQ ID NO: 2232654 - RNA, 16 nt, Human
cacuaguauuucuaug

SEQ ID NO: 2232655 - RNA, 14 nt, Human
uccacaacacacag

SEQ ID NO: 2232656 - RNA, 20 nt, Human
guccccuauccuacuucccc

SEQ ID NO: 2232657 - RNA, 13 nt, Human
ccuucucaccugu

SEQ ID NO: 2232658 - RNA, 14 nt, Human
acauauauaacaau

SEQ ID NO: 2232659 - RNA, 18 nt, Human
gcaaagcccagcuugaaa

SEQ ID NO: 2232660 - RNA, 15 nt, Human
aaagaaagaaaauca

SEQ ID NO: 2232661 - RNA, 19 nt, Human
aauauuauguuaaaacugg

SEQ ID NO: 2232662 - RNA, 20 nt, Human
uuccacagaagcuccaggua

SEQ ID NO: 2232663 - RNA, 20 nt, Human
agcuucacuguaaaauaaua

SEQ ID NO: 2232664 - RNA, 17 nt, Human
uuacagagacagaaagc

SEQ ID NO: 2232665 - RNA, 20 nt, Human
cugagccucagucucccucc

SEQ ID NO: 2232666 - RNA, 22 nt, Human
cucugagccuugggaccccuga

SEQ ID NO: 2232667 - RNA, 23 nt, Human
caacggggugaaacccugucucu

SEQ ID NO: 2232668 - RNA, 14 nt, Human
ccugccccugagcc

SEQ ID NO: 2232669 - RNA, 15 nt, Human
aagccuggcaaggga

SEQ ID NO: 2232670 - RNA, 21 nt, Human
ccugagcggaccuucccagcu

SEQ ID NO: 2232671 - RNA, 14 nt, Human
caccucagcugccu

SEQ ID NO: 2232672 - RNA, 19 nt, Human
agucaaugaacuuuccaca

SEQ ID NO: 2232673 - RNA, 13 nt, Human
agagauuccugag

SEQ ID NO: 2232674 - RNA, 17 nt, Human
acuuccagauccuggaa

SEQ ID NO: 2232675 - RNA, 14 nt, Human
ugagcucagcccug

SEQ ID NO: 2232676 - RNA, 22 nt, Human
ggacagcccuucuuuccacaga

SEQ ID NO: 2232677 - RNA, 15 nt, Human
gccccauucaacauc

SEQ ID NO: 2232678 - RNA, 22 nt, Human
uauagccagguaccuucucacc

SEQ ID NO: 2232679 - RNA, 14 nt, Human
uauuugaaauauug

SEQ ID NO: 2232680 - RNA, 22 nt, Human
uggaaaguuuaugguuguauua

SEQ ID NO: 2232681 - RNA, 21 nt, Human
cgaaguauccuucagccugaa

SEQ ID NO: 2232682 - RNA, 18 nt, Human
uacauuuguauaaaauaa

SEQ ID NO: 2232683 - RNA, 18 nt, Human
auagaauuaacacaugau

SEQ ID NO: 2232684 - RNA, 12 nt, Human
aauaauuuuuaa

SEQ ID NO: 2232685 - RNA, 22 nt, Human
augcagagguccacaacacaca

SEQ ID NO: 2232686 - RNA, 22 nt, Human
ccgggaggcagagguugcagug

SEQ ID NO: 2232687 - RNA, 16 nt, Human
uucaguuauuauauuu

SEQ ID NO: 2232688 - RNA, 20 nt, Human
uuaaugccacuaaauugaca

SEQ ID NO: 2232689 - RNA, 18 nt, Human
uuuuaaaaaagaaacauu

SEQ ID NO: 2232690 - RNA, 22 nt, Human
agacucgggauuaguacacacu

SEQ ID NO: 2232691 - RNA, 21 nt, Human
gaaagcagggacuugaaccca

SEQ ID NO: 2232692 - RNA, 20 nt, Human
accuucccagcuagaauuca

SEQ ID NO: 2232693 - RNA, 21 nt, Human
gagaaggagcucccaggaggg

SEQ ID NO: 2232694 - RNA, 18 nt, Human
gagucccaggcugagccu

SEQ ID NO: 2232695 - RNA, 22 nt, Human
gaauuucuucaacucccugccc

SEQ ID NO: 2232696 - RNA, 21 nt, Human
ugcccauccugccccugagcc

SEQ ID NO: 2232697 - RNA, 10 nt, Human
aauaaaacuu

SEQ ID NO: 2232698 - RNA, 14 nt, Human
cuaagucuuauaua

SEQ ID NO: 2232699 - RNA, 16 nt, Human
ggcagagagguaggga

SEQ ID NO: 2232700 - RNA, 21 nt, Human
agccuuggauacuccaugggg

SEQ ID NO: 2232701 - RNA, 23 nt, Human
ccccugggaccaggcacccccag

SEQ ID NO: 2232702 - RNA, 17 nt, Human
augcagagguccacaac

SEQ ID NO: 2232703 - RNA, 14 nt, Human
uccagauccuggaa

SEQ ID NO: 2232704 - RNA, 20 nt, Human
gauaccaugaugcugagccc

SEQ ID NO: 2232705 - RNA, 14 nt, Human
ugcuucuguuuuau

SEQ ID NO: 2232706 - RNA, 13 nt, Human
cccuccuuaucaa

SEQ ID NO: 2232707 - RNA, 15 nt, Human
ccagaaugaccuggc

SEQ ID NO: 2232708 - RNA, 12 nt, Human
gcucagcccugg

SEQ ID NO: 2232709 - RNA, 18 nt, Human
cugagucccaggcugagc

SEQ ID NO: 2232710 - RNA, 17 nt, Human
ugcacaucaaaauaugc

SEQ ID NO: 2232711 - RNA, 12 nt, Human
accuucucaccu

SEQ ID NO: 2232712 - RNA, 11 nt, Human
cauaugaaaag

SEQ ID NO: 2232713 - RNA, 16 nt, Human
cugaucaccugcccug

SEQ ID NO: 2232714 - RNA, 20 nt, Human
acuuuauuuucuauaauuua

SEQ ID NO: 2232715 - RNA, 23 nt, Human
cacagauuugagcucagcccugg

SEQ ID NO: 2232716 - RNA, 21 nt, Human
acagugaaagaaaauaacaau

SEQ ID NO: 2232717 - RNA, 18 nt, Human
gccuuggauacuccaugg

SEQ ID NO: 2232718 - RNA, 22 nt, Human
ugaaaaaguucugcagauaaac

SEQ ID NO: 2232719 - RNA, 20 nt, Human
uauacugugugcuaaaacaa

SEQ ID NO: 2232720 - RNA, 18 nt, Human
gagccucagucucccucc

SEQ ID NO: 2232721 - RNA, 21 nt, Human
aggguucaccugggcugaggc

SEQ ID NO: 2232722 - RNA, 19 nt, Human
uaggggggucagccagccc

SEQ ID NO: 2232723 - RNA, 17 nt, Human
ccucagcugccucccca

SEQ ID NO: 2232724 - RNA, 21 nt, Human
gaaaaguauguuagugcaaau

SEQ ID NO: 2232725 - RNA, 20 nt, Human
ccagugagacagcucugcau

SEQ ID NO: 2232726 - RNA, 17 nt, Human
auaaguacaugauaagc

SEQ ID NO: 2232727 - RNA, 17 nt, Human
gaaugagagacacacug

SEQ ID NO: 2232728 - RNA, 14 nt, Human
uuauuauauuuaca

SEQ ID NO: 2232729 - RNA, 22 nt, Human
cuccagagggaauugcagagua

SEQ ID NO: 2232730 - RNA, 17 nt, Human
uccaaaggcuccugaga

SEQ ID NO: 2232731 - RNA, 23 nt, Human
aauauuuauuuuaauaauguuuc

SEQ ID NO: 2232732 - RNA, 12 nt, Human
acacugaagaag

SEQ ID NO: 2232733 - RNA, 14 nt, Human
acaagagcuuaaca

SEQ ID NO: 2232734 - RNA, 18 nt, Human
cuucucacauuuauauuu

SEQ ID NO: 2232735 - RNA, 20 nt, Human
auauuuuauaucaauuuaaa

SEQ ID NO: 2232736 - RNA, 17 nt, Human
cugcacuccagccugag

SEQ ID NO: 2232737 - RNA, 21 nt, Human
cuggccuucggccuccauccu

SEQ ID NO: 2232738 - RNA, 19 nt, Human
acagugauuaccagggacu

SEQ ID NO: 2232739 - RNA, 20 nt, Human
uaugcuucuguuuuauaauu

SEQ ID NO: 2232740 - RNA, 14 nt, Human
uuuuuguuuuguuu

SEQ ID NO: 2232741 - RNA, 23 nt, Human
agaaugauuaugaauuacauuug

SEQ ID NO: 2232742 - RNA, 19 nt, Human
ugaaauggacuuuuguaca

SEQ ID NO: 2232743 - RNA, 21 nt, Human
ugaugcuacaggauuugaaau

SEQ ID NO: 2232744 - RNA, 23 nt, Human
uaaguuuuuuuuuaaaaaagaaa

SEQ ID NO: 2232745 - RNA, 19 nt, Human
ggcaaggguucaccugggc

SEQ ID NO: 2232746 - RNA, 11 nt, Human
gcaugguuuag

SEQ ID NO: 2232747 - RNA, 23 nt, Human
agcucugcccauccugccccuga

SEQ ID NO: 2232748 - RNA, 17 nt, Human
agacacacugaagaagc

SEQ ID NO: 2232749 - RNA, 13 nt, Human
cacaggauggcag

SEQ ID NO: 2232750 - RNA, 14 nt, Human
aaagaggaaugaag

SEQ ID NO: 2232751 - RNA, 23 nt, Human
cuaguaauuggaaaggcagcucu

SEQ ID NO: 2232752 - RNA, 16 nt, Human
acaggauggcaggagg

SEQ ID NO: 2232753 - RNA, 23 nt, Human
agcaugucgucaaagcugaaaug

SEQ ID NO: 2232754 - RNA, 20 nt, Human
cagcuggccgggagccugau

SEQ ID NO: 2232755 - RNA, 11 nt, Human
auaauuuaaau

SEQ ID NO: 2232756 - RNA, 18 nt, Human
acagaaagcagaacagug

SEQ ID NO: 2232757 - RNA, 15 nt, Human
cccccagcccuccuu

SEQ ID NO: 2232758 - RNA, 13 nt, Human
uuuagugaaauau

SEQ ID NO: 2232759 - RNA, 18 nt, Human
gaaaugaaagcagggacu

SEQ ID NO: 2232760 - RNA, 18 nt, Human
ugagaaggagcucccagg

SEQ ID NO: 2232761 - RNA, 21 nt, Human
aagcuccauuuuuagugaaau

SEQ ID NO: 2232762 - RNA, 15 nt, Human
ggacucaccuccccc

SEQ ID NO: 2232763 - RNA, 16 nt, Human
ucagucucccucccuu

SEQ ID NO: 2232764 - RNA, 18 nt, Human
ugcugcagccccugggac

SEQ ID NO: 2232765 - RNA, 22 nt, Human
agacucugucucaguccaugaa

SEQ ID NO: 2232766 - RNA, 14 nt, Human
auuauuuuuuaaaa

SEQ ID NO: 2232767 - RNA, 14 nt, Human
uauaauuuaaaaua

SEQ ID NO: 2232768 - RNA, 16 nt, Human
agugagacagcucugc

SEQ ID NO: 2232769 - RNA, 13 nt, Human
uuccucugagccu

SEQ ID NO: 2232770 - RNA, 14 nt, Human
ugugaaaagcucca

SEQ ID NO: 2232771 - RNA, 23 nt, Human
cucagcccuggugggcagagagg

SEQ ID NO: 2232772 - RNA, 16 nt, Human
uggucugugagaugcu

SEQ ID NO: 2232773 - RNA, 15 nt, Human
auuuuaaaagaauga

SEQ ID NO: 2232774 - RNA, 19 nt, Human
ccucagcugccuccccagc

SEQ ID NO: 2232775 - RNA, 18 nt, Human
uuacuguaagaaaauauc

SEQ ID NO: 2232776 - RNA, 19 nt, Human
aaaauaacgauaaaagaca

SEQ ID NO: 2232777 - RNA, 14 nt, Human
ggccuucggccucc

SEQ ID NO: 2232778 - RNA, 20 nt, Human
uauuuauuacuguaagaaaa

SEQ ID NO: 2232779 - RNA, 19 nt, Human
auagcuacuaauuuuaaaa

SEQ ID NO: 2232780 - RNA, 18 nt, Human
ccugcaaagcccagcuug

SEQ ID NO: 2232781 - RNA, 15 nt, Human
accucccccaucucu

SEQ ID NO: 2232782 - RNA, 18 nt, Human
agcugccuccccagcucu

SEQ ID NO: 2232783 - RNA, 19 nt, Human
ccccuauccuacuuccccu

SEQ ID NO: 2232784 - RNA, 20 nt, Human
aaagacagugaaagaaaaua

SEQ ID NO: 2232785 - RNA, 16 nt, Human
aaaaauuccaagugau

SEQ ID NO: 2232786 - RNA, 23 nt, Human
ugaaaugaguuuuucuuuucauu

SEQ ID NO: 2232787 - RNA, 21 nt, Human
cucuucuggguuccuuccucu

SEQ ID NO: 2232788 - RNA, 22 nt, Human
aguauguuagugcaaauuguca

SEQ ID NO: 2232789 - RNA, 22 nt, Human
aauugacccacaagaaaugaaa

SEQ ID NO: 2232790 - RNA, 13 nt, Human
uacuuuauuuucu

SEQ ID NO: 2232791 - RNA, 22 nt, Human
uuccccuuccuaauuccacagc

SEQ ID NO: 2232792 - RNA, 19 nt, Human
uccacauccugugggaccu

SEQ ID NO: 2232793 - RNA, 21 nt, Human
gcccugcugagucccaggcug

SEQ ID NO: 2232794 - RNA, 20 nt, Human
ucaauaaaauccauacauuu

SEQ ID NO: 2232795 - RNA, 15 nt, Human
ugucaauaaaaucca

SEQ ID NO: 2232796 - RNA, 19 nt, Human
acagucaccucauggaauu

SEQ ID NO: 2232797 - RNA, 12 nt, Human
ucccccucuggc

SEQ ID NO: 2232798 - RNA, 14 nt, Human
cugaggcuccacuu

SEQ ID NO: 2232799 - RNA, 20 nt, Human
caggcugagccucagucucc

SEQ ID NO: 2232800 - RNA, 19 nt, Human
cugccccccagcccuccuu

SEQ ID NO: 2232801 - RNA, 22 nt, Human
gcagagagguagggauggggcu

SEQ ID NO: 2232802 - RNA, 20 nt, Human
uaacaagccuccuuuuaaag

SEQ ID NO: 2232803 - RNA, 20 nt, Human
ggguuccuuccucugagccu

SEQ ID NO: 2232804 - RNA, 15 nt, Human
cuacuaauuuuaaaa

SEQ ID NO: 2232805 - RNA, 17 nt, Human
cagugcuugaaugaagu

SEQ ID NO: 2232806 - RNA, 18 nt, Human
aaaagacaaggaaaaaau

SEQ ID NO: 2232807 - RNA, 20 nt, Human
cuggccuucggccuccaucc

SEQ ID NO: 2232808 - RNA, 21 nt, Human
ucaagucuuucacauuuaaau

SEQ ID NO: 2232809 - RNA, 23 nt, Human
uauguuaaaacugggacagggga

SEQ ID NO: 2232810 - RNA, 23 nt, Human
gaaugagagacacacugaagaag

SEQ ID NO: 2232811 - RNA, 22 nt, Human
ucaacuccaaacugacucuuaa

SEQ ID NO: 2232812 - RNA, 21 nt, Human
caucuagcaugucgucaaagc

SEQ ID NO: 2232813 - RNA, 21 nt, Human
aaauaauuuuuauauuugaaa

SEQ ID NO: 2232814 - RNA, 15 nt, Human
caggaaguagaggag

SEQ ID NO: 2232815 - RNA, 13 nt, Human
acagcccuucuuu

SEQ ID NO: 2232816 - RNA, 17 nt, Human
aaauguucaucaaugaa

SEQ ID NO: 2232817 - RNA, 15 nt, Human
uuuuuaguucuucaa

SEQ ID NO: 2232818 - RNA, 21 nt, Human
gacagugaaagaaaauaacaa

SEQ ID NO: 2232819 - RNA, 15 nt, Human
aaaauacaaaaaaaa

SEQ ID NO: 2232820 - RNA, 16 nt, Human
agguacuucaaauccu

SEQ ID NO: 2232821 - RNA, 18 nt, Human
agaagcaacccaaauguu

SEQ ID NO: 2232822 - RNA, 13 nt, Human
ggaccuucccagc

SEQ ID NO: 2232823 - RNA, 15 nt, Human
caggcagcuuuuucu

SEQ ID NO: 2232824 - RNA, 16 nt, Human
uugccauaauuacuau

SEQ ID NO: 2232825 - RNA, 15 nt, Human
agacaaggaaaaaau

SEQ ID NO: 2232826 - RNA, 19 nt, Human
cccugcaaagcccagcuug

SEQ ID NO: 2232827 - RNA, 21 nt, Human
auggcagcuuuccucaaaacu

SEQ ID NO: 2232828 - RNA, 19 nt, Human
accccugagcuugcagaga

SEQ ID NO: 2232829 - RNA, 19 nt, Human
gccauagucauucugccug

SEQ ID NO: 2232830 - RNA, 14 nt, Human
ugcagccccuggga

SEQ ID NO: 2232831 - RNA, 18 nt, Human
ucccaacuauaaaacuag

SEQ ID NO: 2232832 - RNA, 15 nt, Human
aauugacccacaaga

SEQ ID NO: 2232833 - RNA, 14 nt, Human
auuugaaauuguau

SEQ ID NO: 2232834 - RNA, 17 nt, Human
acucuggucaagaagca

SEQ ID NO: 2232835 - RNA, 23 nt, Human
cucuacuaaaaauacaaaaaaaa

SEQ ID NO: 2232836 - RNA, 16 nt, Human
guuuuguuucuuccuu

SEQ ID NO: 2232837 - RNA, 21 nt, Human
uaauaggcguaacuaauuuua

SEQ ID NO: 2232838 - RNA, 16 nt, Human
gucuaucuuugagcgc

SEQ ID NO: 2232839 - RNA, 20 nt, Human
uccagccugagcgacaguga

SEQ ID NO: 2232840 - RNA, 18 nt, Human
uucugauauuggacagua

SEQ ID NO: 2232841 - RNA, 15 nt, Human
acaggguuuauguuu

SEQ ID NO: 2232842 - RNA, 14 nt, Human
ucccuugaugaaga

SEQ ID NO: 2232843 - RNA, 14 nt, Human
acgagaaaacaaua

SEQ ID NO: 2232844 - RNA, 16 nt, Human
ucaaaagaaagaaaau

SEQ ID NO: 2232845 - RNA, 15 nt, Human
ggccuucggccucca

SEQ ID NO: 2232846 - RNA, 21 nt, Human
acaggauggcaggaggcaucc

SEQ ID NO: 2232847 - RNA, 22 nt, Human
cuaucaauccaagaacuuauuu

SEQ ID NO: 2232848 - RNA, 17 nt, Human
agacagugaaagaaaau

SEQ ID NO: 2232849 - RNA, 14 nt, Human
ucugggcagacucu

SEQ ID NO: 2232850 - RNA, 14 nt, Human
ucaagccugccuca

SEQ ID NO: 2232851 - RNA, 21 nt, Human
caauuuuguuauguauauuuu

SEQ ID NO: 2232852 - RNA, 15 nt, Human
ugauuucauucaaua

SEQ ID NO: 2232853 - RNA, 12 nt, Human
agaaaacaauaa

SEQ ID NO: 2232854 - RNA, 14 nt, Human
cugccccccagccc

SEQ ID NO: 2232855 - RNA, 23 nt, Human
ugauggguuucuccagagggaau

SEQ ID NO: 2232856 - RNA, 18 nt, Human
cccacuggacucaccucc

SEQ ID NO: 2232857 - RNA, 14 nt, Human
guaacugauuugua

SEQ ID NO: 2232858 - RNA, 22 nt, Human
gaggggagcaugggaagugacg

SEQ ID NO: 2232859 - RNA, 22 nt, Human
uugagaaggagcucccaggagg

SEQ ID NO: 2232860 - RNA, 21 nt, Human
gcaucgugucuggcguugugg

SEQ ID NO: 2232861 - RNA, 23 nt, Human
uaauuuguaguguuggagaagaa

SEQ ID NO: 2232862 - RNA, 19 nt, Human
aaugaauggcuaagcaaaa

SEQ ID NO: 2232863 - RNA, 13 nt, Human
uaagugcagcccc

SEQ ID NO: 2232864 - RNA, 17 nt, Human
ccuauccuacuuccccu

SEQ ID NO: 2232865 - RNA, 16 nt, Human
ucugcagauaaacagu

SEQ ID NO: 2232866 - RNA, 19 nt, Human
aaauaugccccauucaaca

SEQ ID NO: 2232867 - RNA, 12 nt, Human
ccccuugccaua

SEQ ID NO: 2232868 - RNA, 16 nt, Human
agcggaccuucccagc

SEQ ID NO: 2232869 - RNA, 13 nt, Human
aguguuugaaagc

SEQ ID NO: 2232870 - RNA, 21 nt, Human
agucucccucccuuggggccu

SEQ ID NO: 2232871 - RNA, 16 nt, Human
ggcagcuuuuucucuc

SEQ ID NO: 2232872 - RNA, 19 nt, Human
ugcuauugggguugggggg

SEQ ID NO: 2232873 - RNA, 17 nt, Human
uuuccacauucagagcu

SEQ ID NO: 2232874 - RNA, 23 nt, Human
gaaaaaguucugcagauaaacag

SEQ ID NO: 2232875 - RNA, 22 nt, Human
agucuuucacauuuaaauaaag

SEQ ID NO: 2232876 - RNA, 13 nt, Human
ccucauggaauug

SEQ ID NO: 2232877 - RNA, 13 nt, Human
agguaccuucuca

SEQ ID NO: 2232878 - RNA, 15 nt, Human
acaagacccaaaagg

SEQ ID NO: 2232879 - RNA, 15 nt, Human
auagucauucugccu

SEQ ID NO: 2232880 - RNA, 18 nt, Human
uuuucaauaaaacuuuuc

SEQ ID NO: 2232881 - RNA, 21 nt, Human
uauacugugugcuaaaacaag

SEQ ID NO: 2232882 - RNA, 15 nt, Human
ccuggugggcagaga

SEQ ID NO: 2232883 - RNA, 22 nt, Human
ggguuccuuccucugagccuug

SEQ ID NO: 2232884 - RNA, 15 nt, Human
ugaaauuguauuaca

SEQ ID NO: 2232885 - RNA, 16 nt, Human
ugugagaugcuagaac

SEQ ID NO: 2232886 - RNA, 18 nt, Human
aucuacacuccagugaga

SEQ ID NO: 2232887 - RNA, 17 nt, Human
uccauccugaggcucca

SEQ ID NO: 2232888 - RNA, 15 nt, Human
uaaaagacaaggaaa

SEQ ID NO: 2232889 - RNA, 19 nt, Human
auaauuuuuauauuugaaa

SEQ ID NO: 2232890 - RNA, 16 nt, Human
gagaaacuggaacucu

SEQ ID NO: 2232891 - RNA, 14 nt, Human
aaauauuauuuuau

SEQ ID NO: 2232892 - RNA, 12 nt, Human
ggggugggggug

SEQ ID NO: 2232893 - RNA, 16 nt, Human
caggaaguagaggagg

SEQ ID NO: 2232894 - RNA, 16 nt, Human
cucauccugcaggcag

SEQ ID NO: 2232895 - RNA, 23 nt, Human
ggaugaauuaaguuuuuuuuuaa

SEQ ID NO: 2232896 - RNA, 18 nt, Human
cagugaaagaaaauaaca

SEQ ID NO: 2232897 - RNA, 11 nt, Human
augggacaggg

SEQ ID NO: 2232898 - RNA, 18 nt, Human
uuauuacuguaagaaaau

SEQ ID NO: 2232899 - RNA, 23 nt, Human
cauuuuuuuuuucaauaaaacuu

SEQ ID NO: 2232900 - RNA, 20 nt, Human
ccagaaugaccuggccgcag

SEQ ID NO: 2232901 - RNA, 15 nt, Human
gaaagaaaauaacga

SEQ ID NO: 2232902 - RNA, 15 nt, Human
agaauaccacaggaa

SEQ ID NO: 2232903 - RNA, 15 nt, Human
aagcacuaaacaaag

SEQ ID NO: 2232904 - RNA, 17 nt, Human
ucugugagaugcuagaa

SEQ ID NO: 2232905 - RNA, 22 nt, Human
aauuuuuucucuaggaaauauu

SEQ ID NO: 2232906 - RNA, 16 nt, Human
uauuuuugugauuuug

SEQ ID NO: 2232907 - RNA, 21 nt, Human
ugaacugauggguuucuccag

SEQ ID NO: 2232908 - RNA, 15 nt, Human
uuaauuuguaguguu

SEQ ID NO: 2232909 - RNA, 13 nt, Human
aacucuauaaugu

SEQ ID NO: 2232910 - RNA, 23 nt, Human
ucuaccaaaaaucucaauauuuc

SEQ ID NO: 2232911 - RNA, 13 nt, Human
guaacuaauuuua

SEQ ID NO: 2232912 - RNA, 19 nt, Human
ugaacaaauuuacagagac

SEQ ID NO: 2232913 - RNA, 17 nt, Human
caaacauauauaacaau

SEQ ID NO: 2232914 - RNA, 17 nt, Human
aaaaauccuacuuucau

SEQ ID NO: 2232915 - RNA, 23 nt, Human
gccccugcacuccagccugagcg

SEQ ID NO: 2232916 - RNA, 18 nt, Human
uggucaauuuuguuaugu

SEQ ID NO: 2232917 - RNA, 21 nt, Human
cagcucuaucccaaccucucc

SEQ ID NO: 2232918 - RNA, 13 nt, Human
uuaaauuguaaua

SEQ ID NO: 2232919 - RNA, 18 nt, Human
aaaucuuauaauuuaaaa

SEQ ID NO: 2232920 - RNA, 13 nt, Human
uaauuuuuauauu

SEQ ID NO: 2232921 - RNA, 19 nt, Human
acaaauuuacagagacaga

SEQ ID NO: 2232922 - RNA, 17 nt, Human
uaauuccacagcugcuc

SEQ ID NO: 2232923 - RNA, 21 nt, Human
uuuauauaagcuuguauuccu

SEQ ID NO: 2232924 - RNA, 23 nt, Human
uaggauggcuaguaucaaaagaa

SEQ ID NO: 2232925 - RNA, 18 nt, Human
uggagggaagccuugggg

SEQ ID NO: 2232926 - RNA, 17 nt, Human
ccaaaaaucucaauauu

SEQ ID NO: 2232927 - RNA, 15 nt, Human
cugcagauaaacagu

SEQ ID NO: 2232928 - RNA, 21 nt, Human
cuccccagcucuaucccaacc

SEQ ID NO: 2232929 - RNA, 15 nt, Human
uucggccuccauccu

SEQ ID NO: 2232930 - RNA, 14 nt, Human
cugcaaagcccagc

SEQ ID NO: 2232931 - RNA, 14 nt, Human
accugugagaccaa

SEQ ID NO: 2232932 - RNA, 18 nt, Human
aacaaugcuguauuuuaa

SEQ ID NO: 2232933 - RNA, 21 nt, Human
uuauuuucuauaauuuaaaua

SEQ ID NO: 2232934 - RNA, 19 nt, Human
ccccugagcuugcagagau

SEQ ID NO: 2232935 - RNA, 15 nt, Human
uccuacaagacacag

SEQ ID NO: 2232936 - RNA, 17 nt, Human
agucugacuguuuccau

SEQ ID NO: 2232937 - RNA, 19 nt, Human
agaaaauaacaauaaaaga

SEQ ID NO: 2232938 - RNA, 17 nt, Human
caagaaaugaaagcagg

SEQ ID NO: 2232939 - RNA, 21 nt, Human
uaaaagacagugaaagaaaau

SEQ ID NO: 2232940 - RNA, 20 nt, Human
augcaguuguugcccacagc

SEQ ID NO: 2232941 - RNA, 17 nt, Human
agcuacuaauuuuaaaa

SEQ ID NO: 2232942 - RNA, 23 nt, Human
ccuuuguugcuaucaauccaaga

SEQ ID NO: 2232943 - RNA, 17 nt, Human
accugagccccaaaagg

SEQ ID NO: 2232944 - RNA, 16 nt, Human
acuaaacaaagaguga

SEQ ID NO: 2232945 - RNA, 23 nt, Human
aaguauccuucagccugaaagag

SEQ ID NO: 2232946 - RNA, 23 nt, Human
aucaccaaggcugauuaaaccaa

SEQ ID NO: 2232947 - RNA, 16 nt, Human
ucccagaucaagccug

SEQ ID NO: 2232948 - RNA, 14 nt, Human
agucugacuguuuc

SEQ ID NO: 2232949 - RNA, 18 nt, Human
aucuuauaauuuaaaaua

SEQ ID NO: 2232950 - RNA, 21 nt, Human
cuccagcuggccgggagccug

SEQ ID NO: 2232951 - RNA, 20 nt, Human
cucccugccccccagcccuc

SEQ ID NO: 2232952 - RNA, 19 nt, Human
gaaagaaaauaacaauaaa

SEQ ID NO: 2232953 - RNA, 20 nt, Human
cugagcggaccuucccagcu

SEQ ID NO: 2232954 - RNA, 19 nt, Human
agugaggagcuuugaaacg

SEQ ID NO: 2232955 - RNA, 23 nt, Human
aagucccagaucaagccugccuc

SEQ ID NO: 2232956 - RNA, 22 nt, Human
ccauuucuugagguaaaagcau

SEQ ID NO: 2232957 - RNA, 12 nt, Human
uauucacaagac

SEQ ID NO: 2232958 - RNA, 18 nt, Human
ucucuaggaaauauuuau

SEQ ID NO: 2232959 - RNA, 13 nt, Human
agcccagcuugaa

SEQ ID NO: 2232960 - RNA, 19 nt, Human
ugaaauuguauuacaaauc

SEQ ID NO: 2232961 - RNA, 19 nt, Human
ccacuuggacaugggcccc

SEQ ID NO: 2232962 - RNA, 14 nt, Human
ccugccccccagcc

SEQ ID NO: 2232963 - RNA, 17 nt, Human
agugauuaccagggacu

SEQ ID NO: 2232964 - RNA, 18 nt, Human
auucuugccaaauauaaa

SEQ ID NO: 2232965 - RNA, 16 nt, Human
aauuccacagcugcuc

SEQ ID NO: 2232966 - RNA, 21 nt, Human
gacagaaagcagaacagugau

SEQ ID NO: 2232967 - RNA, 19 nt, Human
uauauuuuuuguuaaauga

SEQ ID NO: 2232968 - RNA, 17 nt, Human
cgauaaaagacagugaa

SEQ ID NO: 2232969 - RNA, 19 nt, Human
gagccucagucucccuccc

SEQ ID NO: 2232970 - RNA, 18 nt, Human
uaaaagacagugaaagaa

SEQ ID NO: 2232971 - RNA, 14 nt, Human
caugaacuuguaaa

SEQ ID NO: 2232972 - RNA, 18 nt, Human
aagucuuucacauuuaaa

SEQ ID NO: 2232973 - RNA, 19 nt, Human
ugagucccaggcugagccu

SEQ ID NO: 2232974 - RNA, 21 nt, Human
agccucuuagaugcaguucug

SEQ ID NO: 2232975 - RNA, 12 nt, Human
aaaugaaagcag

SEQ ID NO: 2232976 - RNA, 12 nt, Human
cagauuuuccug

SEQ ID NO: 2232977 - RNA, 13 nt, Human
uaacaauaaaaga

SEQ ID NO: 2232978 - RNA, 17 nt, Human
gccaugggacagggagg

SEQ ID NO: 2232979 - RNA, 21 nt, Human
aagacucgggauuaguacaca

SEQ ID NO: 2232980 - RNA, 22 nt, Human
agaaagugacaagcucacagac

SEQ ID NO: 2232981 - RNA, 13 nt, Human
agcucugcccauc

SEQ ID NO: 2232982 - RNA, 21 nt, Human
ccaaggaugccccgucccccu

SEQ ID NO: 2232983 - RNA, 15 nt, Human
cuaucuuugagcgcc

SEQ ID NO: 2232984 - RNA, 17 nt, Human
guuuaauucugaaagca

SEQ ID NO: 2232985 - RNA, 21 nt, Human
uguaaaauggugugaccacug

SEQ ID NO: 2232986 - RNA, 14 nt, Human
uauaauuuaaauau

SEQ ID NO: 2232987 - RNA, 23 nt, Human
caaagcugaaauggacuuuugua

SEQ ID NO: 2232988 - RNA, 19 nt, Human
acuggacucaccuccccca

SEQ ID NO: 2232989 - RNA, 19 nt, Human
uggcaagcucuaucaccaa

SEQ ID NO: 2232990 - RNA, 15 nt, Human
agccugaaagaggaa

SEQ ID NO: 2232991 - RNA, 15 nt, Human
aacgauaaaagacag

SEQ ID NO: 2232992 - RNA, 19 nt, Human
cuccagcuggccgggagcc

SEQ ID NO: 2232993 - RNA, 19 nt, Human
aaaauaacaauaaaagaca

SEQ ID NO: 2232994 - RNA, 17 nt, Human
guuuaauaauuuuuaau

SEQ ID NO: 2232995 - RNA, 21 nt, Human
agggugauauuaaccaggggc

SEQ ID NO: 2232996 - RNA, 14 nt, Human
auauuuauuuuaau

SEQ ID NO: 2232997 - RNA, 18 nt, Human
uucaauaucuuuuuuuua

SEQ ID NO: 2232998 - RNA, 19 nt, Human
ugggacaggggagaaccua

SEQ ID NO: 2232999 - RNA, 17 nt, Human
cccacuagacccacugg

SEQ ID NO: 2233000 - RNA, 14 nt, Human
ugagaugcuagaac

SEQ ID NO: 2233001 - RNA, 16 nt, Human
aucaagccugccucaa

SEQ ID NO: 2233002 - RNA, 17 nt, Human
gacacaugggugcuauu

SEQ ID NO: 2233003 - RNA, 13 nt, Human
cacaacacacaga

SEQ ID NO: 2233004 - RNA, 22 nt, Human
aggcuccacuuggucugugaga

SEQ ID NO: 2233005 - RNA, 13 nt, Human
uuuugcuguggca

SEQ ID NO: 2233006 - RNA, 18 nt, Human
gcacuccagccugagcga

SEQ ID NO: 2233007 - RNA, 17 nt, Human
gauacuccauggggugg

SEQ ID NO: 2233008 - RNA, 16 nt, Human
aaaauaauccucaguu

SEQ ID NO: 2233009 - RNA, 20 nt, Human
uacaucccuuaccugggaaa

SEQ ID NO: 2233010 - RNA, 16 nt, Human
cuagaauucacuccac

SEQ ID NO: 2233011 - RNA, 18 nt, Human
acugugugcuaaaacaag

SEQ ID NO: 2233012 - RNA, 22 nt, Human
aaagacagugaaagaaaauaac

SEQ ID NO: 2233013 - RNA, 22 nt, Human
gaugguucccuugaugaagaag

SEQ ID NO: 2233014 - RNA, 17 nt, Human
auccugugggaccuggg

SEQ ID NO: 2233015 - RNA, 16 nt, Human
uuucacauuuaaauaa

SEQ ID NO: 2233016 - RNA, 15 nt, Human
aucaauuuaaaaaaa

SEQ ID NO: 2233017 - RNA, 15 nt, Human
gaccacugcagaaga

SEQ ID NO: 2233018 - RNA, 16 nt, Human
uugucaauaaaaucca

SEQ ID NO: 2233019 - RNA, 19 nt, Human
cagauccccaagccuggca

SEQ ID NO: 2233020 - RNA, 20 nt, Human
gcagagaugaggccgccaug

SEQ ID NO: 2233021 - RNA, 14 nt, Human
ggaaguagaggagg

SEQ ID NO: 2233022 - RNA, 17 nt, Human
ccccaguuguuucuacu

SEQ ID NO: 2233023 - RNA, 21 nt, Human
ucagccagcccucuucugaca

SEQ ID NO: 2233024 - RNA, 17 nt, Human
cagugaaagaaaauaac

SEQ ID NO: 2233025 - RNA, 20 nt, Human
agcuacuaauuuuaaaaugu

SEQ ID NO: 2233026 - RNA, 22 nt, Human
uacugagagugaacaaauuuac

SEQ ID NO: 2233027 - RNA, 19 nt, Human
auuuucaguuauuauauuu

SEQ ID NO: 2233028 - RNA, 19 nt, Human
acuagacaaguccagccug

SEQ ID NO: 2233029 - RNA, 18 nt, Human
agugucaaugcagccccc

SEQ ID NO: 2233030 - RNA, 21 nt, Human
gcucccaggaggggcuucugg

SEQ ID NO: 2233031 - RNA, 19 nt, Human
guuguauuauuuuuuaaaa

SEQ ID NO: 2233032 - RNA, 15 nt, Human
agugacaagcucaca

SEQ ID NO: 2233033 - RNA, 22 nt, Human
gagcuaggggggucagccagcc

SEQ ID NO: 2233034 - RNA, 20 nt, Human
caaauauaaauaaaaauaau

SEQ ID NO: 2233035 - RNA, 22 nt, Human
gauaaaagacagugaaagaaaa

SEQ ID NO: 2233036 - RNA, 17 nt, Human
aaagcuccauuuuuagu

SEQ ID NO: 2233037 - RNA, 22 nt, Human
caagcucuaucaccaaggagcc

SEQ ID NO: 2233038 - RNA, 17 nt, Human
uugggguugggggggag

SEQ ID NO: 2233039 - RNA, 19 nt, Human
agauuugagcucagcccug

SEQ ID NO: 2233040 - RNA, 14 nt, Human
ccuuaucaaaggac

SEQ ID NO: 2233041 - RNA, 23 nt, Human
auuuuauagcuacuaauuuuaaa

SEQ ID NO: 2233042 - RNA, 24 nt, Human
ccagguaccuucucaccugugaga

SEQ ID NO: 2233043 - RNA, 15 nt, Human
gugaccacugcagaa

SEQ ID NO: 2233044 - RNA, 14 nt, Human
auacaaaaaaaaaa

SEQ ID NO: 2233045 - RNA, 13 nt, Human
aacaagccuccuu

SEQ ID NO: 2233046 - RNA, 14 nt, Human
ugcuaagucuuaua

SEQ ID NO: 2233047 - RNA, 20 nt, Human
caagagccuuuuuuugaaaa

SEQ ID NO: 2233048 - RNA, 22 nt, Human
cuccugccuaagugcagccccg

SEQ ID NO: 2233049 - RNA, 14 nt, Human
aaugauuaugaauu

SEQ ID NO: 2233050 - RNA, 23 nt, Human
uagauguauagguugaugguggu

SEQ ID NO: 2233051 - RNA, 14 nt, Human
ccacauccuguggg

SEQ ID NO: 2233052 - RNA, 14 nt, Human
cuguaaucacagcu

SEQ ID NO: 2233053 - RNA, 14 nt, Human
cuuucauaauaagu

SEQ ID NO: 2233054 - RNA, 17 nt, Human
uugugaagcaaaauuuu

SEQ ID NO: 2233055 - RNA, 15 nt, Human
accuucccagcuaga

SEQ ID NO: 2233056 - RNA, 12 nt, Human
uuuuauauuuga

SEQ ID NO: 2233057 - RNA, 18 nt, Human
cugcucaauaaaguacaa

SEQ ID NO: 2233058 - RNA, 14 nt, Human
ucccaacuauaaaa

SEQ ID NO: 2233059 - RNA, 14 nt, Human
agcaaguauuagaa

SEQ ID NO: 2233060 - RNA, 17 nt, Human
cucuuuugggauuuuug

SEQ ID NO: 2233061 - RNA, 20 nt, Human
ccccuauccuacuuccccuu

SEQ ID NO: 2233062 - RNA, 15 nt, Human
ccucagucucccucc

SEQ ID NO: 2233063 - RNA, 13 nt, Human
cucugagccuugg

SEQ ID NO: 2233064 - RNA, 16 nt, Human
augcuaagugaaauaa

SEQ ID NO: 2233065 - RNA, 16 nt, Human
ugccucaccccuugcc

SEQ ID NO: 2233066 - RNA, 21 nt, Human
ccccugcaaagcccagcuuga

SEQ ID NO: 2233067 - RNA, 21 nt, Human
gaacuuuccacauucagagcu

SEQ ID NO: 2233068 - RNA, 14 nt, Human
ugaaagucccagau

SEQ ID NO: 2233069 - RNA, 13 nt, Human
ggaaguagaggag

SEQ ID NO: 2233070 - RNA, 18 nt, Human
agaucaagccugccucaa

SEQ ID NO: 2233071 - RNA, 17 nt, Human
gccccccagcccuccuu

SEQ ID NO: 2233072 - RNA, 13 nt, Human
uaaacauguuuau

SEQ ID NO: 2233073 - RNA, 22 nt, Human
aaauaacaaugaaaguugauaa

SEQ ID NO: 2233074 - RNA, 15 nt, Human
agggcucacagaauu

SEQ ID NO: 2233075 - RNA, 23 nt, Human
auucaauaucuuuuuuuuaauaa

SEQ ID NO: 2233076 - RNA, 18 nt, Human
acuggacucaccuccccc

SEQ ID NO: 2233077 - RNA, 15 nt, Human
auaauuuugugaagc

SEQ ID NO: 2233078 - RNA, 13 nt, Human
agggagggaaggg

SEQ ID NO: 2233079 - RNA, 16 nt, Human
ccaggcugagccucag

SEQ ID NO: 2233080 - RNA, 13 nt, Human
uggacgagaaaac

SEQ ID NO: 2233081 - RNA, 17 nt, Human
ccacugcagaagacagu

SEQ ID NO: 2233082 - RNA, 22 nt, Human
cauuuaaauaaaguguuugaaa

SEQ ID NO: 2233083 - RNA, 17 nt, Human
uuuuuaauuauauggcu

SEQ ID NO: 2233084 - RNA, 17 nt, Human
agggaagggggaacaug

SEQ ID NO: 2233085 - RNA, 12 nt, Human
gacgagaaaaca

SEQ ID NO: 2233086 - RNA, 12 nt, Human
cagccccuggga

SEQ ID NO: 2233087 - RNA, 16 nt, Human
caauaacgauaaaaga

SEQ ID NO: 2233088 - RNA, 23 nt, Human
uuuaguaagagauuccugagcca

SEQ ID NO: 2233089 - RNA, 16 nt, Human
aaaagcuccauuuuua

SEQ ID NO: 2233090 - RNA, 18 nt, Human
gccugagcgacagugaga

SEQ ID NO: 2233091 - RNA, 12 nt, Human
cuucaacucccu

SEQ ID NO: 2233092 - RNA, 13 nt, Human
gacaaggaaaaaa

SEQ ID NO: 2233093 - RNA, 13 nt, Human
gugcugcagcccc

SEQ ID NO: 2233094 - RNA, 20 nt, Human
uccaagccucauguccacug

SEQ ID NO: 2233095 - RNA, 15 nt, Human
guuucuuccuuuuuu

SEQ ID NO: 2233096 - RNA, 18 nt, Human
gaugcaguucugaagaag

SEQ ID NO: 2233097 - RNA, 16 nt, Human
ugcaaauugucacagg

SEQ ID NO: 2233098 - RNA, 15 nt, Human
cagccagcacagccu

SEQ ID NO: 2233099 - RNA, 14 nt, Human
auaccaugaugcug

SEQ ID NO: 2233100 - RNA, 12 nt, Human
acaagaaaugaa

SEQ ID NO: 2233101 - RNA, 19 nt, Human
auugaggacacugauaugg

SEQ ID NO: 2233102 - RNA, 17 nt, Human
aaacauccuacaagaca

SEQ ID NO: 2233103 - RNA, 15 nt, Human
ccaacuauaaaacua

SEQ ID NO: 2233104 - RNA, 13 nt, Human
auuggacaguaaa

SEQ ID NO: 2233105 - RNA, 16 nt, Human
ggaugccccguccccc

SEQ ID NO: 2233106 - RNA, 19 nt, Human
uuuccugaaaacccuugcc

SEQ ID NO: 2233107 - RNA, 16 nt, Human
ccucaaucaguauuca

SEQ ID NO: 2233108 - RNA, 22 nt, Human
ucuggguuccuuccucugagcc

SEQ ID NO: 2233109 - RNA, 16 nt, Human
cuagaacucccuuuca

SEQ ID NO: 2233110 - RNA, 13 nt, Human
auugcaaggcaaa

SEQ ID NO: 2233111 - RNA, 22 nt, Human
cagcucuaucccaaccucuccc

SEQ ID NO: 2233112 - RNA, 13 nt, Human
aauuuuuauauuu

SEQ ID NO: 2233113 - RNA, 22 nt, Human
cuucaacucccugccccccagc

SEQ ID NO: 2233114 - RNA, 15 nt, Human
caaauugagcuaggg

SEQ ID NO: 2233115 - RNA, 15 nt, Human
uuuagugaaauauua

SEQ ID NO: 2233116 - RNA, 15 nt, Human
ccgugugccugagcg

SEQ ID NO: 2233117 - RNA, 12 nt, Human
ccuucagccuga

SEQ ID NO: 2233118 - RNA, 21 nt, Human
cauuucuugagguaaaagcau

SEQ ID NO: 2233119 - RNA, 14 nt, Human
aaaagaaagaaaau

SEQ ID NO: 2233120 - RNA, 22 nt, Human
auauaaauaaaaauaauccuca

SEQ ID NO: 2233121 - RNA, 16 nt, Human
cacuuaaaaaugguuu

SEQ ID NO: 2233122 - RNA, 18 nt, Human
ucuaugaaauauuauguu

SEQ ID NO: 2233123 - RNA, 21 nt, Human
uauuauuuuauagcuacuaau

SEQ ID NO: 2233124 - RNA, 23 nt, Human
aguaauuggaaaggcagcucuaa

SEQ ID NO: 2233125 - RNA, 14 nt, Human
gucccaggcugagc

SEQ ID NO: 2233126 - RNA, 19 nt, Human
auuuugugaagcaaaauuu

SEQ ID NO: 2233127 - RNA, 15 nt, Human
acuuuauaaaggauu

SEQ ID NO: 2233128 - RNA, 12 nt, Human
aaugcagccccc

SEQ ID NO: 2233129 - RNA, 19 nt, Human
auuuacagagacagaaagc

SEQ ID NO: 2233130 - RNA, 22 nt, Human
ugaccauacuaauuauaccccc

SEQ ID NO: 2233131 - RNA, 22 nt, Human
ugccugagcggaccuucccagc

SEQ ID NO: 2233132 - RNA, 17 nt, Human
uggcuaagcaaaaugug

SEQ ID NO: 2233133 - RNA, 15 nt, Human
uacuaauuuuaaaau

SEQ ID NO: 2233134 - RNA, 23 nt, Human
guaauuccguagguuauuuucag

SEQ ID NO: 2233135 - RNA, 22 nt, Human
uuuaauaauguuucaaacauau

SEQ ID NO: 2233136 - RNA, 11 nt, Human
aaccugagccc

SEQ ID NO: 2233137 - RNA, 19 nt, Human
aaacaccucagcugccucc

SEQ ID NO: 2233138 - RNA, 14 nt, Human
gugagcuacaaaug

SEQ ID NO: 2233139 - RNA, 13 nt, Human
ccaggcugagccu

SEQ ID NO: 2233140 - RNA, 16 nt, Human
cuccaugggguggggg

SEQ ID NO: 2233141 - RNA, 18 nt, Human
gcugagcccggaaacucc

SEQ ID NO: 2233142 - RNA, 14 nt, Human
ggggaacaugagcc

SEQ ID NO: 2233143 - RNA, 12 nt, Human
ggaggcugagau

SEQ ID NO: 2233144 - RNA, 16 nt, Human
aaacuaggugcugcag

SEQ ID NO: 2233145 - RNA, 14 nt, Human
auuuucuauaauuu

SEQ ID NO: 2233146 - RNA, 17 nt, Human
uauuuguacauuuuuuu

SEQ ID NO: 2233147 - RNA, 15 nt, Human
ugcagauaaacagua

SEQ ID NO: 2233148 - RNA, 22 nt, Human
ccacagcuguaugauucccagc

SEQ ID NO: 2233149 - RNA, 19 nt, Human
ccauccugccccugagccc

SEQ ID NO: 2233150 - RNA, 15 nt, Human
cagaauucauucacu

SEQ ID NO: 2233151 - RNA, 20 nt, Human
ccacuuggacaugggcccca

SEQ ID NO: 2233152 - RNA, 18 nt, Human
auuuaggccaugggacag

SEQ ID NO: 2233153 - RNA, 20 nt, Human
gacauuugcucauggaauug

SEQ ID NO: 2233154 - RNA, 14 nt, Human
aaaacuucagacau

SEQ ID NO: 2233155 - RNA, 16 nt, Human
uuuucucuaggaaaua

SEQ ID NO: 2233156 - RNA, 14 nt, Human
cguguccccuaucc

SEQ ID NO: 2233157 - RNA, 11 nt, Human
ggucacaggaa

SEQ ID NO: 2233158 - RNA, 20 nt, Human
ugagcagugcuugaaugaag

SEQ ID NO: 2233159 - RNA, 21 nt, Human
aauaauccucaguuuuuguga

SEQ ID NO: 2233160 - RNA, 17 nt, Human
guugcugggggggauug

SEQ ID NO: 2233161 - RNA, 14 nt, Human
cucugccucagaaa

SEQ ID NO: 2233162 - RNA, 23 nt, Human
ccucuucugacacuaaaacaccu

SEQ ID NO: 2233163 - RNA, 23 nt, Human
uagauaggucagugcaaauacuc

SEQ ID NO: 2233164 - RNA, 14 nt, Human
aacgauaaaagaca

SEQ ID NO: 2233165 - RNA, 19 nt, Human
ccuccauccugaggcucca

SEQ ID NO: 2233166 - RNA, 12 nt, Human
agggauggggcu

SEQ ID NO: 2233167 - RNA, 13 nt, Human
ggcuccugagaca

SEQ ID NO: 2233168 - RNA, 13 nt, Human
auaacgauaaaag

SEQ ID NO: 2233169 - RNA, 19 nt, Human
cagcacgggggccaaggau

SEQ ID NO: 2233170 - RNA, 21 nt, Human
cugggaccaggcacccccaga

SEQ ID NO: 2233171 - RNA, 15 nt, Human
aagaaaauaacaaua

SEQ ID NO: 2233172 - RNA, 15 nt, Human
caaauccaaugaaau

SEQ ID NO: 2233173 - RNA, 14 nt, Human
aauauuauuuuaua

SEQ ID NO: 2233174 - RNA, 17 nt, Human
cuucacuguaaaauaau

SEQ ID NO: 2233175 - RNA, 12 nt, Human
ucagcugccucc

SEQ ID NO: 2233176 - RNA, 20 nt, Human
aaauaauuuuuauauuugaa

SEQ ID NO: 2233177 - RNA, 15 nt, Human
aaggaauuuaaaaau

SEQ ID NO: 2233178 - RNA, 17 nt, Human
caccucccccaucucuu

SEQ ID NO: 2233179 - RNA, 22 nt, Human
ugagacucugucucaguccaug

SEQ ID NO: 2233180 - RNA, 17 nt, Human
uguucuaagaagugaaa

SEQ ID NO: 2233181 - RNA, 19 nt, Human
uucccuugaugaagaaguu

SEQ ID NO: 2233182 - RNA, 14 nt, Human
gaaggcuuacaccc

SEQ ID NO: 2233183 - RNA, 18 nt, Human
auuuauuacuguaagaaa

SEQ ID NO: 2233184 - RNA, 20 nt, Human
aauuuugugaagcaaaauuu

SEQ ID NO: 2233185 - RNA, 16 nt, Human
auaucaauuuaaaaaa

SEQ ID NO: 2233186 - RNA, 18 nt, Human
aagggaauuucuucaacu

SEQ ID NO: 2233187 - RNA, 19 nt, Human
uuccucccuucucuucaca

SEQ ID NO: 2233188 - RNA, 17 nt, Human
aaaguacaagagcuuaa

SEQ ID NO: 2233189 - RNA, 15 nt, Human
acaaaugggaaacaa

SEQ ID NO: 2233190 - RNA, 13 nt, Human
aggcuagauguau

SEQ ID NO: 2233191 - RNA, 16 nt, Human
cugagcauuuaauaug

SEQ ID NO: 2233192 - RNA, 17 nt, Human
agguccacaacacacag

SEQ ID NO: 2233193 - RNA, 20 nt, Human
cuuauucacaagacccaaaa

SEQ ID NO: 2233194 - RNA, 16 nt, Human
uuuuagugaaauauua

SEQ ID NO: 2233195 - RNA, 18 nt, Human
acaagccuccuuuuaaag

SEQ ID NO: 2233196 - RNA, 19 nt, Human
aggucuaccaaaaaucuca

SEQ ID NO: 2233197 - RNA, 16 nt, Human
gccaaggaugccccgu

SEQ ID NO: 2233198 - RNA, 22 nt, Human
accuaacgaaguauccuucagc

SEQ ID NO: 2233199 - RNA, 13 nt, Human
aacaauaaaagac

SEQ ID NO: 2233200 - RNA, 14 nt, Human
ggccgcagugaggc

SEQ ID NO: 2233201 - RNA, 18 nt, Human
gaaauggugaaaugcaga

SEQ ID NO: 2233202 - RNA, 15 nt, Human
cuagaauucacucca

SEQ ID NO: 2233203 - RNA, 23 nt, Human
ggccuccauccugaggcuccacu

SEQ ID NO: 2233204 - RNA, 16 nt, Human
cucagcccuggugggc

SEQ ID NO: 2233205 - RNA, 17 nt, Human
agcuucacuguaaaaua

SEQ ID NO: 2233206 - RNA, 19 nt, Human
auucccagccagcacagcc

SEQ ID NO: 2233207 - RNA, 16 nt, Human
ucuucaacucccugcc

SEQ ID NO: 2233208 - RNA, 18 nt, Human
cuucacuguaaaauaaua

SEQ ID NO: 2233209 - RNA, 18 nt, Human
cccaggcugagccucagu

SEQ ID NO: 2233210 - RNA, 16 nt, Human
guucugcacacagcac

SEQ ID NO: 2233211 - RNA, 18 nt, Human
cccucuggcuccagcugg

SEQ ID NO: 2233212 - RNA, 19 nt, Human
uagugagcagucaggaaag

SEQ ID NO: 2233213 - RNA, 15 nt, Human
aggagcucccaggag

SEQ ID NO: 2233214 - RNA, 14 nt, Human
caaggcuagaacca

SEQ ID NO: 2233215 - RNA, 16 nt, Human
auccuacaagacacag

SEQ ID NO: 2233216 - RNA, 22 nt, Human
caagcacuaaacaaagagugaa

SEQ ID NO: 2233217 - RNA, 14 nt, Human
ccucagcugccucc

SEQ ID NO: 2233218 - RNA, 14 nt, Human
accacaagacugca

SEQ ID NO: 2233219 - RNA, 20 nt, Human
gcacccccagaaugaccugg

SEQ ID NO: 2233220 - RNA, 21 nt, Human
uccuucagccugaaagaggaa

SEQ ID NO: 2233221 - RNA, 13 nt, Human
aacucccugcccc

SEQ ID NO: 2233222 - RNA, 14 nt, Human
cuucugacacuaaa

SEQ ID NO: 2233223 - RNA, 20 nt, Human
gaauucauucacucaacaaa

SEQ ID NO: 2233224 - RNA, 16 nt, Human
gaauggcuaagcaaaa

SEQ ID NO: 2233225 - RNA, 16 nt, Human
aauuacauuuguauaa

SEQ ID NO: 2233226 - RNA, 15 nt, Human
uacaggauuugaaau

SEQ ID NO: 2233227 - RNA, 14 nt, Human
acuuggucugugag

SEQ ID NO: 2233228 - RNA, 23 nt, Human
ggcaaagacuauucccuucuaac

SEQ ID NO: 2233229 - RNA, 21 nt, Human
ggguucccgugugccugagcg

SEQ ID NO: 2233230 - RNA, 20 nt, Human
cagugaaagaaaauaacgau

SEQ ID NO: 2233231 - RNA, 18 nt, Human
aagaccucauuuugaagg

SEQ ID NO: 2233232 - RNA, 15 nt, Human
aaaagacaaggaaaa

SEQ ID NO: 2233233 - RNA, 17 nt, Human
cacuuggacaugggccc

SEQ ID NO: 2233234 - RNA, 13 nt, Human
aacuauaaaacua

SEQ ID NO: 2233235 - RNA, 16 nt, Human
accucugccucagaaa

SEQ ID NO: 2233236 - RNA, 14 nt, Human
cacuuauaggaauu

SEQ ID NO: 2233237 - RNA, 17 nt, Human
aacaguuaccucugccu

SEQ ID NO: 2233238 - RNA, 15 nt, Human
accaaggcugauuaa

SEQ ID NO: 2233239 - RNA, 20 nt, Human
aaaacaagcacuaaacaaag

SEQ ID NO: 2233240 - RNA, 16 nt, Human
ccugccccccagcccu

SEQ ID NO: 2233241 - RNA, 18 nt, Human
uaauaauguuucaaacau

SEQ ID NO: 2233242 - RNA, 19 nt, Human
gaggcagagguugcaguga

SEQ ID NO: 2233243 - RNA, 17 nt, Human
ccagguaccuucucacc

SEQ ID NO: 2233244 - RNA, 16 nt, Human
caggcugagccucagu

SEQ ID NO: 2233245 - RNA, 14 nt, Human
cucagcugccuccc

SEQ ID NO: 2233246 - RNA, 14 nt, Human
aagaagugaaaauc

SEQ ID NO: 2233247 - RNA, 18 nt, Human
caugaagauguagaggag

SEQ ID NO: 2233248 - RNA, 17 nt, Human
aguauuucuaugaaaua

SEQ ID NO: 2233249 - RNA, 18 nt, Human
ugaaaaaguucugcagau

SEQ ID NO: 2233250 - RNA, 21 nt, Human
gaggugagguaccagccuugg

SEQ ID NO: 2233251 - RNA, 20 nt, Human
aacaagccuccuuuuaaagu

SEQ ID NO: 2233252 - RNA, 19 nt, Human
acauuuguauaaaauaauu

SEQ ID NO: 2233253 - RNA, 18 nt, Human
cauggaauuggagcucgu

SEQ ID NO: 2233254 - RNA, 17 nt, Human
agaacucccuuucaaca

SEQ ID NO: 2233255 - RNA, 19 nt, Human
caucaaggguacacugccu

SEQ ID NO: 2233256 - RNA, 15 nt, Human
cgggagccugaucac

SEQ ID NO: 2233257 - RNA, 17 nt, Human
gccugagcgacagugag

SEQ ID NO: 2233258 - RNA, 20 nt, Human
cugcacuccagccugagcga

SEQ ID NO: 2233259 - RNA, 20 nt, Human
cucuguucugcacacagcac

SEQ ID NO: 2233260 - RNA, 22 nt, Human
gaauuaaguuuuuuuuuaaaaa

SEQ ID NO: 2233261 - RNA, 14 nt, Human
agagguccacaaca

SEQ ID NO: 2233262 - RNA, 22 nt, Human
gaaaaucuuauaauuuaaaaua

SEQ ID NO: 2233263 - RNA, 18 nt, Human
cccagaaugaccuggccg

SEQ ID NO: 2233264 - RNA, 17 nt, Human
uuauauuugaaauauug

SEQ ID NO: 2233265 - RNA, 15 nt, Human
aauacuuuauaaagg

SEQ ID NO: 2233266 - RNA, 12 nt, Human
cuacaagacaca

SEQ ID NO: 2233267 - RNA, 15 nt, Human
uugcucauggaauug

SEQ ID NO: 2233268 - RNA, 18 nt, Human
auaauccuaaacauauga

SEQ ID NO: 2233269 - RNA, 19 nt, Human
auuauuuuuuaaaaaaauu

SEQ ID NO: 2233270 - RNA, 22 nt, Human
cacuaguauuucuaugaaauau

SEQ ID NO: 2233271 - RNA, 18 nt, Human
auggugaaaugcagaguc

SEQ ID NO: 2233272 - RNA, 22 nt, Human
cacagauuugagcucagcccug

SEQ ID NO: 2233273 - RNA, 17 nt, Human
ucuauaauuuaaauaua

SEQ ID NO: 2233274 - RNA, 21 nt, Human
cucccaggaggggcuucuggg

SEQ ID NO: 2233275 - RNA, 21 nt, Human
augucauuugcuggagcucug

SEQ ID NO: 2233276 - RNA, 22 nt, Human
agaauuuuaugcggcauuuucu

SEQ ID NO: 2233277 - RNA, 14 nt, Human
uauuuauuuuaaua

SEQ ID NO: 2233278 - RNA, 15 nt, Human
augguuguauuauuu

SEQ ID NO: 2233279 - RNA, 20 nt, Human
ccagcuugaaaccuucacuu

SEQ ID NO: 2233280 - RNA, 14 nt, Human
auuuguauaaaaua

SEQ ID NO: 2233281 - RNA, 15 nt, Human
uggacgagaaaacaa

SEQ ID NO: 2233282 - RNA, 23 nt, Human
gucucccucccuuggggccuaug

SEQ ID NO: 2233283 - RNA, 14 nt, Human
uuuuaaaaaagaaa

SEQ ID NO: 2233284 - RNA, 12 nt, Human
agugcagccccg

SEQ ID NO: 2233285 - RNA, 13 nt, Human
ucagccagcccuc

SEQ ID NO: 2233286 - RNA, 12 nt, Human
aauuuuaaaaug

SEQ ID NO: 2233287 - RNA, 17 nt, Human
gcaugguuuagaaagcu

SEQ ID NO: 2233288 - RNA, 20 nt, Human
auagucauucugccugcccu

SEQ ID NO: 2233289 - RNA, 20 nt, Human
auuuucaguuauuauauuua

SEQ ID NO: 2233290 - RNA, 16 nt, Human
uaaaggaauuuaaaaa

SEQ ID NO: 2233291 - RNA, 17 nt, Human
ccaaaagguauuuuaau

SEQ ID NO: 2233292 - RNA, 11 nt, Human
caauaaaagac

SEQ ID NO: 2233293 - RNA, 21 nt, Human
uuuucaggcuagauguaugua

SEQ ID NO: 2233294 - RNA, 18 nt, Human
uaauuuuaacucuauaau

SEQ ID NO: 2233295 - RNA, 14 nt, Human
agcucguggaacag

SEQ ID NO: 2233296 - RNA, 15 nt, Human
ggugcugcagccccu

SEQ ID NO: 2233297 - RNA, 23 nt, Human
uaaaagacagugaaagaaaauaa

SEQ ID NO: 2233298 - RNA, 23 nt, Human
ucuccauguacuggcaagaccug

SEQ ID NO: 2233299 - RNA, 17 nt, Human
auuuuaauaauguuuca

SEQ ID NO: 2233300 - RNA, 16 nt, Human
ucaucaaugaaugaau

SEQ ID NO: 2233301 - RNA, 17 nt, Human
gacucaccucccccauc

SEQ ID NO: 2233302 - RNA, 15 nt, Human
guacuggcugaugga

SEQ ID NO: 2233303 - RNA, 13 nt, Human
ugccugcaggcau

SEQ ID NO: 2233304 - RNA, 22 nt, Human
aaacauguuuaucguauuugau

SEQ ID NO: 2233305 - RNA, 13 nt, Human
cugagagugaaca

SEQ ID NO: 2233306 - RNA, 19 nt, Human
cauccaaaggcuccugaga

SEQ ID NO: 2233307 - RNA, 21 nt, Human
cuaaauugacacuuaaaaaug

SEQ ID NO: 2233308 - RNA, 16 nt, Human
gaaucacuugaacccg

SEQ ID NO: 2233309 - RNA, 16 nt, Human
ugcaugguuuagaaag

SEQ ID NO: 2233310 - RNA, 22 nt, Human
uaaaacaagcacuaaacaaaga

SEQ ID NO: 2233311 - RNA, 22 nt, Human
caccucccccaucucuucuggg

SEQ ID NO: 2233312 - RNA, 17 nt, Human
cugauggguuucuccag

SEQ ID NO: 2233313 - RNA, 15 nt, Human
ccugagcggaccuuc

SEQ ID NO: 2233314 - RNA, 13 nt, Human
auccugcaggcag

SEQ ID NO: 2233315 - RNA, 22 nt, Human
acagauuugagcucagcccugg

SEQ ID NO: 2233316 - RNA, 19 nt, Human
cagcuucucauccugcagg

SEQ ID NO: 2233317 - RNA, 17 nt, Human
aaaacaccucagcugcc

SEQ ID NO: 2233318 - RNA, 21 nt, Human
ucccaggaggggcuucugggc

SEQ ID NO: 2233319 - RNA, 20 nt, Human
caccucagcugccuccccag

SEQ ID NO: 2233320 - RNA, 12 nt, Human
ggugcugcagcc

SEQ ID NO: 2233321 - RNA, 21 nt, Human
acgcucucuggccuucggccu

SEQ ID NO: 2233322 - RNA, 14 nt, Human
cugucucaguccau

SEQ ID NO: 2233323 - RNA, 18 nt, Human
cccucuucugacacuaaa

SEQ ID NO: 2233324 - RNA, 15 nt, Human
gauccugcaauucca

SEQ ID NO: 2233325 - RNA, 15 nt, Human
aaaaaauaacaauga

SEQ ID NO: 2233326 - RNA, 17 nt, Human
gucaaagcugaaaugga

SEQ ID NO: 2233327 - RNA, 16 nt, Human
ggcugagccucagucu

SEQ ID NO: 2233328 - RNA, 18 nt, Human
aaguugauaugccuuuuc

SEQ ID NO: 2233329 - RNA, 13 nt, Human
ugggaggcugaga

SEQ ID NO: 2233330 - RNA, 17 nt, Human
accucagcugccucccc

SEQ ID NO: 2233331 - RNA, 22 nt, Human
cugaggcuccacuuggucugug

SEQ ID NO: 2233332 - RNA, 14 nt, Human
ucuaucccaaccuc

SEQ ID NO: 2233333 - RNA, 20 nt, Human
cuugccauaauuacuauguc

SEQ ID NO: 2233334 - RNA, 15 nt, Human
ccucauguccacugg

SEQ ID NO: 2233335 - RNA, 14 nt, Human
auuuauguuuaauu

SEQ ID NO: 2233336 - RNA, 16 nt, Human
ccucaaaacuucagac

SEQ ID NO: 2233337 - RNA, 18 nt, Human
uagugaaauauuauuuua

SEQ ID NO: 2233338 - RNA, 15 nt, Human
gccuugggaccccug

SEQ ID NO: 2233339 - RNA, 20 nt, Human
agaugcaguucugaagaaga

SEQ ID NO: 2233340 - RNA, 16 nt, Human
ugaauuaguuuuauau

SEQ ID NO: 2233341 - RNA, 15 nt, Human
cuacaagacacagug

SEQ ID NO: 2233342 - RNA, 23 nt, Human
aggaugguucccuugaugaagaa

SEQ ID NO: 2233343 - RNA, 14 nt, Human
gucauucugccugc

SEQ ID NO: 2233344 - RNA, 19 nt, Human
cuugccugcaggcaugagu

SEQ ID NO: 2233345 - RNA, 22 nt, Human
ccauacuaauuauacccccugc

SEQ ID NO: 2233346 - RNA, 13 nt, Human
cacauuuaaauaa

SEQ ID NO: 2233347 - RNA, 18 nt, Human
uuuugugaagcaaaauuu

SEQ ID NO: 2233348 - RNA, 14 nt, Human
aaaagaaacauuug

SEQ ID NO: 2233349 - RNA, 16 nt, Human
cuuauaauuuaaaaua

SEQ ID NO: 2233350 - RNA, 14 nt, Human
cucccuuggggccu

SEQ ID NO: 2233351 - RNA, 14 nt, Human
augaacuuuuuguu

SEQ ID NO: 2233352 - RNA, 18 nt, Human
gggggucagccagcccuc

SEQ ID NO: 2233353 - RNA, 20 nt, Human
uaacgauaaaagacagugaa

SEQ ID NO: 2233354 - RNA, 21 nt, Human
accaaggagccaaacauccua

SEQ ID NO: 2233355 - RNA, 15 nt, Human
cuaagugcagccccg

SEQ ID NO: 2233356 - RNA, 15 nt, Human
cagccccugggacca

SEQ ID NO: 2233357 - RNA, 17 nt, Human
ccugagcuugcagagau

SEQ ID NO: 2233358 - RNA, 18 nt, Human
uauuuucuauaauuuaaa

SEQ ID NO: 2233359 - RNA, 13 nt, Human
ccaaggaugcccc

SEQ ID NO: 2233360 - RNA, 20 nt, Human
uuuccaaugacauuuuguug

SEQ ID NO: 2233361 - RNA, 13 nt, Human
aagcauuccaacu

SEQ ID NO: 2233362 - RNA, 15 nt, Human
ggggcuucugggcag

SEQ ID NO: 2233363 - RNA, 12 nt, Human
ccaggcugagcc

SEQ ID NO: 2233364 - RNA, 14 nt, Human
ggcuccagcuggcc

SEQ ID NO: 2233365 - RNA, 12 nt, Human
auucugaaagca

SEQ ID NO: 2233366 - RNA, 23 nt, Human
ucugacacuaaaacaccucagcu

SEQ ID NO: 2233367 - RNA, 18 nt, Human
aaaaguucugcagauaaa

SEQ ID NO: 2233368 - RNA, 13 nt, Human
uauuuauuuuaau

SEQ ID NO: 2233369 - RNA, 13 nt, Human
uucuauaauuuaa

SEQ ID NO: 2233370 - RNA, 18 nt, Human
cuuugagcgcccacuaga

SEQ ID NO: 2233371 - RNA, 16 nt, Human
ggugcugcagccccug

SEQ ID NO: 2233372 - RNA, 12 nt, Human
aaggaugccccg

SEQ ID NO: 2233373 - RNA, 20 nt, Human
guauuauuuuuuaaaaaaau

SEQ ID NO: 2233374 - RNA, 15 nt, Human
aaggaaaaaauaaca

SEQ ID NO: 2233375 - RNA, 17 nt, Human
cauccugugggaccugg

SEQ ID NO: 2233376 - RNA, 21 nt, Human
auguuuaauucugaaagcaac

SEQ ID NO: 2233377 - RNA, 12 nt, Human
gacagugaaaga

SEQ ID NO: 2233378 - RNA, 14 nt, Human
agauguagaggaga

SEQ ID NO: 2233379 - RNA, 13 nt, Human
uuuuuuuuuucaa

SEQ ID NO: 2233380 - RNA, 16 nt, Human
gggucagccagcccuc

SEQ ID NO: 2233381 - RNA, 22 nt, Human
agaaaacaauaacgauaaaaga

SEQ ID NO: 2233382 - RNA, 20 nt, Human
uaauaaguugcauagguuua

SEQ ID NO: 2233383 - RNA, 19 nt, Human
auaaaagacagugaaagaa

SEQ ID NO: 2233384 - RNA, 20 nt, Human
aagggcuguuauaaucuuuc

SEQ ID NO: 2233385 - RNA, 17 nt, Human
gugccuguaaucacagc

SEQ ID NO: 2233386 - RNA, 16 nt, Human
ucuuauaauuuaaaau

SEQ ID NO: 2233387 - RNA, 21 nt, Human
ugaccauacuaauuauacccc

SEQ ID NO: 2233388 - RNA, 20 nt, Human
uaugaaaaggcuaagcuuca

SEQ ID NO: 2233389 - RNA, 23 nt, Human
ugucaauucuugccaaauauaaa

SEQ ID NO: 2233390 - RNA, 11 nt, Human
ccgugugccug

SEQ ID NO: 2233391 - RNA, 19 nt, Human
ccgggcgugguggugagug

SEQ ID NO: 2233392 - RNA, 16 nt, Human
aucaaaagaaagaaaa

SEQ ID NO: 2233393 - RNA, 15 nt, Human
cugaaagaggaauga

SEQ ID NO: 2233394 - RNA, 18 nt, Human
ccucagcugccuccccag

SEQ ID NO: 2233395 - RNA, 16 nt, Human
uuauaauuuaaaauau

SEQ ID NO: 2233396 - RNA, 16 nt, Human
ucaccugggcugaggc

SEQ ID NO: 2233397 - RNA, 22 nt, Human
aaagagugaaggauuuauguuu

SEQ ID NO: 2233398 - RNA, 21 nt, Human
guggggaugaacuuuuuguuu

SEQ ID NO: 2233399 - RNA, 18 nt, Human
cagagacagaaagcagaa

SEQ ID NO: 2233400 - RNA, 15 nt, Human
ucaguauucauauuu

SEQ ID NO: 2233401 - RNA, 23 nt, Human
ccacuuggacaugggccccagau

SEQ ID NO: 2233402 - RNA, 14 nt, Human
cugagucccaggcu

SEQ ID NO: 2233403 - RNA, 21 nt, Human
cagccccugggaccaggcacc

SEQ ID NO: 2233404 - RNA, 21 nt, Human
ucuuaggguuaugauuaagua

SEQ ID NO: 2233405 - RNA, 21 nt, Human
gaaauguuuacagauccccaa

SEQ ID NO: 2233406 - RNA, 15 nt, Human
uaacaauaaaagaca

SEQ ID NO: 2233407 - RNA, 19 nt, Human
cucugccucagaaaacaag

SEQ ID NO: 2233408 - RNA, 13 nt, Human
ccaaccucuccca

SEQ ID NO: 2233409 - RNA, 18 nt, Human
auucacuccacuuggaca

SEQ ID NO: 2233410 - RNA, 16 nt, Human
cugcacuccagccuga

SEQ ID NO: 2233411 - RNA, 23 nt, Human
uuguaacaagccuccuuuuaaag

SEQ ID NO: 2233412 - RNA, 17 nt, Human
aauaacaauaaaagaca

SEQ ID NO: 2233413 - RNA, 19 nt, Human
auagugaggagcuuugaaa

SEQ ID NO: 2233414 - RNA, 13 nt, Human
ugagcgacaguga

SEQ ID NO: 2233415 - RNA, 23 nt, Human
uuuauaugcuucuguuuuauaau

SEQ ID NO: 2233416 - RNA, 21 nt, Human
aggauggcaggaggcauccaa

SEQ ID NO: 2233417 - RNA, 16 nt, Human
uaaaagacaaggaaaa

SEQ ID NO: 2233418 - RNA, 18 nt, Human
uaaaauccauacauuugu

SEQ ID NO: 2233419 - RNA, 19 nt, Human
cuggccuucggccuccauc

SEQ ID NO: 2233420 - RNA, 20 nt, Human
caauaaaacuuuuccaauga

SEQ ID NO: 2233421 - RNA, 15 nt, Human
ucugucucaguccau

SEQ ID NO: 2233422 - RNA, 13 nt, Human
ccucccccaucuc

SEQ ID NO: 2233423 - RNA, 14 nt, Human
agaaaauaacaaua

SEQ ID NO: 2233424 - RNA, 14 nt, Human
aauuguauuacaaa

SEQ ID NO: 2233425 - RNA, 24 nt, Human
gcuucugggcagacucuggucaag

SEQ ID NO: 2233426 - RNA, 13 nt, Human
cuccccagcucua

SEQ ID NO: 2233427 - RNA, 17 nt, Human
agcgacagugagacucu

SEQ ID NO: 2233428 - RNA, 17 nt, Human
aggccaugggacaggga

SEQ ID NO: 2233429 - RNA, 17 nt, Human
auguuuacagaucccca

SEQ ID NO: 2233430 - RNA, 19 nt, Human
ccugagcggaccuucccag

SEQ ID NO: 2233431 - RNA, 22 nt, Human
uauccuacuuccccuuccuaau

SEQ ID NO: 2233432 - RNA, 14 nt, Human
augauguuuagaaa

SEQ ID NO: 2233433 - RNA, 13 nt, Human
caugggccccaga

SEQ ID NO: 2233434 - RNA, 15 nt, Human
agagacagaaagcag

SEQ ID NO: 2233435 - RNA, 20 nt, Human
cacagcacgggggccaagga

SEQ ID NO: 2233436 - RNA, 22 nt, Human
agacccacuggacucaccuccc

SEQ ID NO: 2233437 - RNA, 17 nt, Human
ugaaaaucuuauaauuu

SEQ ID NO: 2233438 - RNA, 23 nt, Human
gcugccuccccagcucuauccca

SEQ ID NO: 2233439 - RNA, 21 nt, Human
gucucagugucaaugcagccc

SEQ ID NO: 2233440 - RNA, 23 nt, Human
agcuaggggggucagccagcccu

SEQ ID NO: 2233441 - RNA, 18 nt, Human
cugagccuugggaccccu

SEQ ID NO: 2233442 - RNA, 18 nt, Human
auccccaagccuggcaag

SEQ ID NO: 2233443 - RNA, 18 nt, Human
cuuucacauuuaaauaaa

SEQ ID NO: 2233444 - RNA, 20 nt, Human
ggagccugaucaccugcccu

SEQ ID NO: 2233445 - RNA, 16 nt, Human
cccacuggacucaccu

SEQ ID NO: 2233446 - RNA, 17 nt, Human
aggcaugagucagucug

SEQ ID NO: 2233447 - RNA, 14 nt, Human
cuucucuucacagu

SEQ ID NO: 2233448 - RNA, 18 nt, Human
cagaucaagccugccuca

SEQ ID NO: 2233449 - RNA, 20 nt, Human
aaaagacagugaaagaaaau

SEQ ID NO: 2233450 - RNA, 13 nt, Human
ugauuauauguca

SEQ ID NO: 2233451 - RNA, 20 nt, Human
ucauucacucaacaaacaua

SEQ ID NO: 2233452 - RNA, 19 nt, Human
cuaguaucaaaagaaagaa

SEQ ID NO: 2233453 - RNA, 13 nt, Human
uuuaaaaauccua

SEQ ID NO: 2233454 - RNA, 15 nt, Human
acucaccucccccau

SEQ ID NO: 2233455 - RNA, 19 nt, Human
caugaguaacugauuugua

SEQ ID NO: 2233456 - RNA, 15 nt, Human
augggacagggagga

SEQ ID NO: 2233457 - RNA, 15 nt, Human
caggaggaaggcuua

SEQ ID NO: 2233458 - RNA, 14 nt, Human
cagucucccucccu

SEQ ID NO: 2233459 - RNA, 21 nt, Human
cagugagacagcucugcauac

SEQ ID NO: 2233460 - RNA, 17 nt, Human
cuccuuaucaaaggaca

SEQ ID NO: 2233461 - RNA, 22 nt, Human
cacuuccaagagccuuuuuuug

SEQ ID NO: 2233462 - RNA, 15 nt, Human
cagucucccucccuu

SEQ ID NO: 2233463 - RNA, 23 nt, Human
aucacagcuacuugggaggcuga

SEQ ID NO: 2233464 - RNA, 21 nt, Human
ggucaagaagcaucgugucug

SEQ ID NO: 2233465 - RNA, 17 nt, Human
aucaaggguacacugcc

SEQ ID NO: 2233466 - RNA, 14 nt, Human
ucaaugcagccccc

SEQ ID NO: 2233467 - RNA, 23 nt, Human
ccagagggaauugcagaguacug

SEQ ID NO: 2233468 - RNA, 18 nt, Human
gaugccccgucccccucu

SEQ ID NO: 2233469 - RNA, 17 nt, Human
ucagacauagaauuaac

SEQ ID NO: 2233470 - RNA, 16 nt, Human
uucucuaggaaauauu

SEQ ID NO: 2233471 - RNA, 14 nt, Human
cacuuggacauggg

SEQ ID NO: 2233472 - RNA, 13 nt, Human
ucucccucccuug

SEQ ID NO: 2233473 - RNA, 22 nt, Human
caaugcuguauuuuaaaagaau

SEQ ID NO: 2233474 - RNA, 14 nt, Human
aaaggaauuuaaaa

SEQ ID NO: 2233475 - RNA, 12 nt, Human
ucaccccuugcc

SEQ ID NO: 2233476 - RNA, 13 nt, Human
caagccugccuca

SEQ ID NO: 2233477 - RNA, 22 nt, Human
uuuccaagcaaguauuagaaua

SEQ ID NO: 2233478 - RNA, 14 nt, Human
cagaaugaccuggc

SEQ ID NO: 2233479 - RNA, 23 nt, Human
uugccugcaggcaugagucaguc

SEQ ID NO: 2233480 - RNA, 24 nt, Human
cauaugaaaaggcuaagcuucacu

SEQ ID NO: 2233481 - RNA, 23 nt, Human
caucucuucuggguuccuuccuc

SEQ ID NO: 2233482 - RNA, 19 nt, Human
gucaaauugugugaaaggu

SEQ ID NO: 2233483 - RNA, 15 nt, Human
aguucuucaaagaua

SEQ ID NO: 2233484 - RNA, 21 nt, Human
gaaaaaaagcuuuuuuugaau

SEQ ID NO: 2233485 - RNA, 16 nt, Human
cccuauccuacuuccc

SEQ ID NO: 2233486 - RNA, 22 nt, Human
agccaaacauccuacaagacac

SEQ ID NO: 2233487 - RNA, 14 nt, Human
ccaugggacaggga

SEQ ID NO: 2233488 - RNA, 20 nt, Human
aauuaaguuuuuuuuuaaaa

SEQ ID NO: 2233489 - RNA, 16 nt, Human
ucuucugacacuaaaa

SEQ ID NO: 2233490 - RNA, 16 nt, Human
acagagacagaaagca

SEQ ID NO: 2233491 - RNA, 23 nt, Human
gaggcauuuaggccaugggacag

SEQ ID NO: 2233492 - RNA, 16 nt, Human
aacaauaaaagacaag

SEQ ID NO: 2233493 - RNA, 10 nt, Human
auguuuucag

SEQ ID NO: 2233494 - RNA, 21 nt, Human
caaggaaaaaauaacaaugaa

SEQ ID NO: 2233495 - RNA, 14 nt, Human
caacuauaaaacua

SEQ ID NO: 2233496 - RNA, 16 nt, Human
gacaaggaaaaaauaa

SEQ ID NO: 2233497 - RNA, 19 nt, Human
ucaguuauuauauuuacaa

SEQ ID NO: 2233498 - RNA, 18 nt, Human
acugccuucucaacucca

SEQ ID NO: 2233499 - RNA, 15 nt, Human
ucaguuuuugugaaa

SEQ ID NO: 2233500 - RNA, 18 nt, Human
aaagagugaaggauuuau

SEQ ID NO: 2233501 - RNA, 19 nt, Human
cccugccccccagcccucc

SEQ ID NO: 2233502 - RNA, 23 nt, Human
uccaaacugacucuuaagaagac

SEQ ID NO: 2233503 - RNA, 16 nt, Human
uacauuuguauaaaau

SEQ ID NO: 2233504 - RNA, 18 nt, Human
guauuauuuuuuaaaaaa

SEQ ID NO: 2233505 - RNA, 18 nt, Human
cugcagccccugggacca

SEQ ID NO: 2233506 - RNA, 21 nt, Human
gacagucaccucauggaauug

SEQ ID NO: 2233507 - RNA, 14 nt, Human
auauuugaaauauu

SEQ ID NO: 2233508 - RNA, 20 nt, Human
caaacauccuacaagacaca

SEQ ID NO: 2233509 - RNA, 12 nt, Human
acaagacacagu

SEQ ID NO: 2233510 - RNA, 15 nt, Human
ugagaaggagcuccc

SEQ ID NO: 2233511 - RNA, 15 nt, Human
aaucucaauauuuca

SEQ ID NO: 2233512 - RNA, 18 nt, Human
uuuucucuccucucccca

SEQ ID NO: 2233513 - RNA, 19 nt, Human
uacaaaaaaaaaaaaaaau

SEQ ID NO: 2233514 - RNA, 15 nt, Human
acaucaacagauaaa

SEQ ID NO: 2233515 - RNA, 17 nt, Human
caauaacgauaaaagac

SEQ ID NO: 2233516 - RNA, 14 nt, Human
uugccugcaggcau

SEQ ID NO: 2233517 - RNA, 20 nt, Human
augcuucuguuuuauaauuu

SEQ ID NO: 2233518 - RNA, 18 nt, Human
guuuaugguuguauuauu

SEQ ID NO: 2233519 - RNA, 16 nt, Human
ugcauagguuuaauaa

SEQ ID NO: 2233520 - RNA, 21 nt, Human
aauucauucacucaacaaaca

SEQ ID NO: 2233521 - RNA, 22 nt, Human
gugugaccacugcagaagacag

SEQ ID NO: 2233522 - RNA, 20 nt, Human
aaucuuucacaggggacagg

SEQ ID NO: 2233523 - RNA, 19 nt, Human
ggaaaaaauaacaaugaaa

SEQ ID NO: 2233524 - RNA, 21 nt, Human
auuauauggcuugaguuuaaa

SEQ ID NO: 2233525 - RNA, 14 nt, Human
ucuaggaaauauuu

SEQ ID NO: 2233526 - RNA, 14 nt, Human
auuucuaugaaaua

SEQ ID NO: 2233527 - RNA, 15 nt, Human
gccucuuagaugcag

SEQ ID NO: 2233528 - RNA, 16 nt, Human
uggggauagugaggca

SEQ ID NO: 2233529 - RNA, 15 nt, Human
ccccagaaugaccug

SEQ ID NO: 2233530 - RNA, 20 nt, Human
caagccuccuuuuaaaguaa

SEQ ID NO: 2233531 - RNA, 14 nt, Human
cacaacacacagau

SEQ ID NO: 2233532 - RNA, 15 nt, Human
cccugcaaagcccag

SEQ ID NO: 2233533 - RNA, 12 nt, Human
ucugcacacagc

SEQ ID NO: 2233534 - RNA, 21 nt, Human
caccucagcugccuccccagc

SEQ ID NO: 2233535 - RNA, 20 nt, Human
agccuuuuuuugaaaaaaag

SEQ ID NO: 2233536 - RNA, 16 nt, Human
aaaaugugauauguac

SEQ ID NO: 2233537 - RNA, 23 nt, Human
ugcagagguccacaacacacaga

SEQ ID NO: 2233538 - RNA, 21 nt, Human
aauuaaguuuuuuuuuaaaaa

SEQ ID NO: 2233539 - RNA, 14 nt, Human
uaaauaaaaauaau

SEQ ID NO: 2233540 - RNA, 21 nt, Human
caagacugcacaucaaaauau

SEQ ID NO: 2233541 - RNA, 14 nt, Human
gagcccauggcacu

SEQ ID NO: 2233542 - RNA, 18 nt, Human
agcuucucauccugcagg

SEQ ID NO: 2233543 - RNA, 15 nt, Human
cucaacaaacauaau

SEQ ID NO: 2233544 - RNA, 23 nt, Human
aucucuucuggguuccuuccucu

SEQ ID NO: 2233545 - RNA, 14 nt, Human
cuggagcucugccc

SEQ ID NO: 2233546 - RNA, 22 nt, Human
uaaaauaauuuuuauauuugaa

SEQ ID NO: 2233547 - RNA, 15 nt, Human
auuugguaaggggaa

SEQ ID NO: 2233548 - RNA, 15 nt, Human
gccccugggaccagg

SEQ ID NO: 2233549 - RNA, 16 nt, Human
uuguaaaggaauuuaa

SEQ ID NO: 2233550 - RNA, 23 nt, Human
gauauuaaccaggggccaugaau

SEQ ID NO: 2233551 - RNA, 12 nt, Human
aagagcuuaaca

SEQ ID NO: 2233552 - RNA, 18 nt, Human
gacauuugcucauggaau

SEQ ID NO: 2233553 - RNA, 21 nt, Human
cuaagcuucacuguaaaauaa

SEQ ID NO: 2233554 - RNA, 14 nt, Human
uugaaauuguauua

SEQ ID NO: 2233555 - RNA, 16 nt, Human
aagaaaauaacaauaa

SEQ ID NO: 2233556 - RNA, 19 nt, Human
aaauggugaaaugcagagu

SEQ ID NO: 2233557 - RNA, 19 nt, Human
aaaagacagugaaagaaaa

SEQ ID NO: 2233558 - RNA, 15 nt, Human
cuccacauccugugg

SEQ ID NO: 2233559 - RNA, 20 nt, Human
uaaaagacagugaaagaaaa

SEQ ID NO: 2233560 - RNA, 12 nt, Human
gaauuggagcuc

SEQ ID NO: 2233561 - RNA, 22 nt, Human
uauuucagauaaucacaauaca

SEQ ID NO: 2233562 - RNA, 20 nt, Human
aguuguuucuacuacaugga

SEQ ID NO: 2233563 - RNA, 14 nt, Human
ggugcugcagcccc

SEQ ID NO: 2233564 - RNA, 19 nt, Human
gguuccuuccucugagccu

SEQ ID NO: 2233565 - RNA, 19 nt, Human
uuggcaagcucuaucacca

SEQ ID NO: 2233566 - RNA, 22 nt, Human
ugaguuuuucuuuucauuuacc

SEQ ID NO: 2233567 - RNA, 12 nt, Human
cuuccucacacc

SEQ ID NO: 2233568 - RNA, 19 nt, Human
aaaaucuuauaauuuaaaa

SEQ ID NO: 2233569 - RNA, 20 nt, Human
gaaacauuugguaaggggaa

SEQ ID NO: 2233570 - RNA, 19 nt, Human
acuucagcgguuuauauaa

SEQ ID NO: 2233571 - RNA, 19 nt, Human
gagggaauugcagaguacu

SEQ ID NO: 2233572 - RNA, 16 nt, Human
cauuucuaaagccauu

SEQ ID NO: 2233573 - RNA, 14 nt, Human
acccgggaggcaga

SEQ ID NO: 2233574 - RNA, 18 nt, Human
acauguuacaacacggac

SEQ ID NO: 2233575 - RNA, 21 nt, Human
ugccuguaaucacagcuacuu

SEQ ID NO: 2233576 - RNA, 13 nt, Human
agaaaugaaagca

SEQ ID NO: 2233577 - RNA, 18 nt, Human
aguucuccacuagcuaug

SEQ ID NO: 2233578 - RNA, 18 nt, Human
ucuucaacucccugcccc

SEQ ID NO: 2233579 - RNA, 20 nt, Human
ugagagugaacaaauuuaca

SEQ ID NO: 2233580 - RNA, 15 nt, Human
gacagggaggacgcu

SEQ ID NO: 2233581 - RNA, 19 nt, Human
guacaagagcuuaacagug

SEQ ID NO: 2233582 - RNA, 16 nt, Human
uggcaagcucuaucac

SEQ ID NO: 2233583 - RNA, 21 nt, Human
cuauguucuaagaagugaaaa

SEQ ID NO: 2233584 - RNA, 13 nt, Human
acggggugaaacc

SEQ ID NO: 2233585 - RNA, 18 nt, Human
acaaaaggauaaugaaua

SEQ ID NO: 2233586 - RNA, 22 nt, Human
caaggaugccccgucccccucu

SEQ ID NO: 2233587 - RNA, 14 nt, Human
uauguauauuuuau

SEQ ID NO: 2233588 - RNA, 14 nt, Human
caaaugcauuucua

SEQ ID NO: 2233589 - RNA, 15 nt, Human
uagggugauauuaac

SEQ ID NO: 2233590 - RNA, 13 nt, Human
auuuuuuaaaaaa

SEQ ID NO: 2233591 - RNA, 12 nt, Human
gagcucccagga

SEQ ID NO: 2233592 - RNA, 15 nt, Human
uucccgugugccuga

SEQ ID NO: 2233593 - RNA, 16 nt, Human
cagcucuaucccaacc

SEQ ID NO: 2233594 - RNA, 21 nt, Human
aaguuuaugguuguauuauuu

SEQ ID NO: 2233595 - RNA, 20 nt, Human
ccauacuaauuauacccccu

SEQ ID NO: 2233596 - RNA, 22 nt, Human
gucucuacuaaaaauacaaaaa

SEQ ID NO: 2233597 - RNA, 15 nt, Human
ugccccccagcccuc

SEQ ID NO: 2233598 - RNA, 21 nt, Human
gaaaugaguuuuucuuuucau

SEQ ID NO: 2233599 - RNA, 18 nt, Human
uuuauggcacuaguauuu

SEQ ID NO: 2233600 - RNA, 15 nt, Human
uuuaugguuguauua

SEQ ID NO: 2233601 - RNA, 16 nt, Human
aaauauaaauaaaaau

SEQ ID NO: 2233602 - RNA, 13 nt, Human
cacuguaaaauaa

SEQ ID NO: 2233603 - RNA, 17 nt, Human
aggcuagaaccaccugc

SEQ ID NO: 2233604 - RNA, 18 nt, Human
cagauuugagcucagccc

SEQ ID NO: 2233605 - RNA, 14 nt, Human
cucccugcccccca

SEQ ID NO: 2233606 - RNA, 13 nt, Human
cugagacacaugg

SEQ ID NO: 2233607 - RNA, 18 nt, Human
uaagcuucacuguaaaau

SEQ ID NO: 2233608 - RNA, 22 nt, Human
gaaugaccuggccgcagugagg

SEQ ID NO: 2233609 - RNA, 19 nt, Human
cucauggaauuggagcucg

SEQ ID NO: 2233610 - RNA, 20 nt, Human
auuuugugauugauuauaug

SEQ ID NO: 2233611 - RNA, 21 nt, Human
ugaaacgaggauugggaaaaa

SEQ ID NO: 2233612 - RNA, 17 nt, Human
cuaucucauuuccaagc

SEQ ID NO: 2233613 - RNA, 17 nt, Human
auauuugaaauauugac

SEQ ID NO: 2233614 - RNA, 21 nt, Human
cuuuuccaaugacauuuuguu

SEQ ID NO: 2233615 - RNA, 21 nt, Human
cugcccugcugagucccaggc

SEQ ID NO: 2233616 - RNA, 19 nt, Human
cuucuggguuccuuccucu

SEQ ID NO: 2233617 - RNA, 16 nt, Human
cuccacauccuguggg

SEQ ID NO: 2233618 - RNA, 18 nt, Human
uuguaaaggaauuuaaaa

SEQ ID NO: 2233619 - RNA, 14 nt, Human
ugguauguuuucag

SEQ ID NO: 2233620 - RNA, 18 nt, Human
uguauuauuuuuuaaaaa

SEQ ID NO: 2233621 - RNA, 16 nt, Human
uccugcaauuccacuu

SEQ ID NO: 2233622 - RNA, 15 nt, Human
ucauaauaaguugca

SEQ ID NO: 2233623 - RNA, 17 nt, Human
augauuaaguaaugaua

SEQ ID NO: 2233624 - RNA, 23 nt, Human
agacagcuucucauccugcaggc

SEQ ID NO: 2233625 - RNA, 14 nt, Human
cucaacaaacauaa

SEQ ID NO: 2233626 - RNA, 15 nt, Human
ccugaaagucccaga

SEQ ID NO: 2233627 - RNA, 22 nt, Human
augguuguauuauuuuuuaaaa

SEQ ID NO: 2233628 - RNA, 21 nt, Human
gugccugagcggaccuuccca

SEQ ID NO: 2233629 - RNA, 16 nt, Human
auuuguauaaaauaau

SEQ ID NO: 2233630 - RNA, 16 nt, Human
cugagcuugcagagau

SEQ ID NO: 2233631 - RNA, 13 nt, Human
aaauccuugaaga

SEQ ID NO: 2233632 - RNA, 18 nt, Human
gaaaauaacaauaaaaga

SEQ ID NO: 2233633 - RNA, 14 nt, Human
uaauccuaaacaua

SEQ ID NO: 2233634 - RNA, 13 nt, Human
gagacagcucugc

SEQ ID NO: 2233635 - RNA, 17 nt, Human
gcaaauugucacaggac

SEQ ID NO: 2233636 - RNA, 15 nt, Human
uaucaauuuaaaaaa

SEQ ID NO: 2233637 - RNA, 13 nt, Human
cagucugaugaga

SEQ ID NO: 2233638 - RNA, 18 nt, Human
uuuuagugaaauauuauu

SEQ ID NO: 2233639 - RNA, 14 nt, Human
uucuaugaaauauu

SEQ ID NO: 2233640 - RNA, 23 nt, Human
auugcagaguacuggcugaugga

SEQ ID NO: 2233641 - RNA, 23 nt, Human
caccaaggagccaaacauccuac

SEQ ID NO: 2233642 - RNA, 17 nt, Human
acaaaugggaaacaaaa

SEQ ID NO: 2233643 - RNA, 22 nt, Human
caauaaaagacaaggaaaaaau

SEQ ID NO: 2233644 - RNA, 14 nt, Human
uaacuaauuuuaac

SEQ ID NO: 2233645 - RNA, 13 nt, Human
aagaaaauaacga

SEQ ID NO: 2233646 - RNA, 17 nt, Human
uuauuacuguaagaaaa

SEQ ID NO: 2233647 - RNA, 16 nt, Human
aacuugguuuuaauua

SEQ ID NO: 2233648 - RNA, 20 nt, Human
uugaacccgggaggcagagg

SEQ ID NO: 2233649 - RNA, 14 nt, Human
aacaccucagcugc

SEQ ID NO: 2233650 - RNA, 21 nt, Human
augaauacuuuauaaaggauu

SEQ ID NO: 2233651 - RNA, 16 nt, Human
uaggugcugcagcccc

SEQ ID NO: 2233652 - RNA, 17 nt, Human
cugccucagaaaacaag

SEQ ID NO: 2233653 - RNA, 13 nt, Human
agacacagugacc

SEQ ID NO: 2233654 - RNA, 21 nt, Human
cuccacuuggacaugggcccc

SEQ ID NO: 2233655 - RNA, 16 nt, Human
gccaugugcuaguaau

SEQ ID NO: 2233656 - RNA, 14 nt, Human
ccccagaaugaccu

SEQ ID NO: 2233657 - RNA, 21 nt, Human
uuuguauaaaauaauuuuuau

SEQ ID NO: 2233658 - RNA, 23 nt, Human
ggaugguucccuugaugaagaag

SEQ ID NO: 2233659 - RNA, 16 nt, Human
cauccuuccucacacc

SEQ ID NO: 2233660 - RNA, 13 nt, Human
accuggccgcagu

SEQ ID NO: 2233661 - RNA, 21 nt, Human
uccauccugaggcuccacuug

SEQ ID NO: 2233662 - RNA, 21 nt, Human
uaguauuucuaugaaauauua

SEQ ID NO: 2233663 - RNA, 15 nt, Human
cuguaaaauaauaac

SEQ ID NO: 2233664 - RNA, 18 nt, Human
ccugccuaagugcagccc

SEQ ID NO: 2233665 - RNA, 14 nt, Human
cuggccgggagccu

SEQ ID NO: 2233666 - RNA, 22 nt, Human
ccaaacauccuacaagacacag

SEQ ID NO: 2233667 - RNA, 19 nt, Human
aaguugcauagguuuaaua

SEQ ID NO: 2233668 - RNA, 17 nt, Human
uuccaagugauugaaac

SEQ ID NO: 2233669 - RNA, 13 nt, Human
acuaauuuuaaaa

SEQ ID NO: 2233670 - RNA, 14 nt, Human
caggaggcauccaa

SEQ ID NO: 2233671 - RNA, 18 nt, Human
auagggagggaaggggga

SEQ ID NO: 2233672 - RNA, 17 nt, Human
uccagcuggccgggagc

SEQ ID NO: 2233673 - RNA, 12 nt, Human
aagaaaauaaca

SEQ ID NO: 2233674 - RNA, 18 nt, Human
gaccccugagcuugcaga

SEQ ID NO: 2233675 - RNA, 14 nt, Human
aagcaucacaugaa

SEQ ID NO: 2233676 - RNA, 20 nt, Human
gccugagcggaccuucccag

SEQ ID NO: 2233677 - RNA, 20 nt, Human
uguaaaggaauuuaaaaauc

SEQ ID NO: 2233678 - RNA, 13 nt, Human
aaaauaacaauga

SEQ ID NO: 2233679 - RNA, 19 nt, Human
gugacuuaaugccacuaaa

SEQ ID NO: 2233680 - RNA, 15 nt, Human
uaaaacuuuuccaau

SEQ ID NO: 2233681 - RNA, 13 nt, Human
ccacaacacacag

SEQ ID NO: 2233682 - RNA, 13 nt, Human
cugccuucucaac

SEQ ID NO: 2233683 - RNA, 22 nt, Human
uauuucuaugaaauauuauguu

SEQ ID NO: 2233684 - RNA, 14 nt, Human
gauaaaagacagug

SEQ ID NO: 2233685 - RNA, 13 nt, Human
ucauccugcaggc

SEQ ID NO: 2233686 - RNA, 19 nt, Human
cuaagcuucacuguaaaau

SEQ ID NO: 2233687 - RNA, 20 nt, Human
agccuaguugaucagcuuau

SEQ ID NO: 2233688 - RNA, 23 nt, Human
gagguaccagccuuggauacucc

SEQ ID NO: 2233689 - RNA, 16 nt, Human
uauaugucacuuugcu

SEQ ID NO: 2233690 - RNA, 15 nt, Human
agucugaugagaacu

SEQ ID NO: 2233691 - RNA, 14 nt, Human
ccucuucugacacu

SEQ ID NO: 2233692 - RNA, 17 nt, Human
uaucuuuuuuuuaauaa

SEQ ID NO: 2233693 - RNA, 13 nt, Human
augauuccaccua

SEQ ID NO: 2233694 - RNA, 15 nt, Human
ccugcaaagcccagc

SEQ ID NO: 2233695 - RNA, 20 nt, Human
aaugaauacuuuauaaagga

SEQ ID NO: 2233696 - RNA, 15 nt, Human
uuacagagacagaaa

SEQ ID NO: 2233697 - RNA, 18 nt, Human
guuucaaacauauauaac

SEQ ID NO: 2233698 - RNA, 14 nt, Human
cgucccccucuggc

SEQ ID NO: 2233699 - RNA, 20 nt, Human
aagcuucacuguaaaauaau

SEQ ID NO: 2233700 - RNA, 17 nt, Human
cuggcaaggguucaccu

SEQ ID NO: 2233701 - RNA, 15 nt, Human
aaauauuuauuuuaa

SEQ ID NO: 2233702 - RNA, 22 nt, Human
agaagcaccaaucaugaauuag

SEQ ID NO: 2233703 - RNA, 23 nt, Human
ggucucagugucaaugcagcccc

SEQ ID NO: 2233704 - RNA, 23 nt, Human
gcagacucuggucaagaagcauc

SEQ ID NO: 2233705 - RNA, 21 nt, Human
aaaugucuugcuugauuguau

SEQ ID NO: 2233706 - RNA, 12 nt, Human
uguuugaaagcu

SEQ ID NO: 2233707 - RNA, 21 nt, Human
ucuucaacucccugcccccca

SEQ ID NO: 2233708 - RNA, 12 nt, Human
acugaaaucaua

SEQ ID NO: 2233709 - RNA, 18 nt, Human
ccuugggaccccugagcu

SEQ ID NO: 2233710 - RNA, 12 nt, Human
caugggaaguga

SEQ ID NO: 2233711 - RNA, 11 nt, Human
acugggacagg

SEQ ID NO: 2233712 - RNA, 18 nt, Human
cucuggccuucggccucc

SEQ ID NO: 2233713 - RNA, 14 nt, Human
acauagugaggagc

SEQ ID NO: 2233714 - RNA, 15 nt, Human
agacagcucugcaua

SEQ ID NO: 2233715 - RNA, 19 nt, Human
cuuggacaugggccccaga

SEQ ID NO: 2233716 - RNA, 14 nt, Human
auccuugaagauuu

SEQ ID NO: 2233717 - RNA, 18 nt, Human
gccuuggggcugaugcag

SEQ ID NO: 2233718 - RNA, 19 nt, Human
cucugcauacucauuagga

SEQ ID NO: 2233719 - RNA, 17 nt, Human
uaauuuuuauauuugaa

SEQ ID NO: 2233720 - RNA, 11 nt, Human
gggaccugggc

SEQ ID NO: 2233721 - RNA, 20 nt, Human
uuugcaagccagauuuuccu

SEQ ID NO: 2233722 - RNA, 22 nt, Human
cagaguacuggcugauggagua

SEQ ID NO: 2233723 - RNA, 24 nt, Human
ccccugagcuugcagagaugaggc

SEQ ID NO: 2233724 - RNA, 20 nt, Human
augaaguuguagguaauauu

SEQ ID NO: 2233725 - RNA, 12 nt, Human
cuggcuccagcu

SEQ ID NO: 2233726 - RNA, 21 nt, Human
auuuuccugaaaacccuugcc

SEQ ID NO: 2233727 - RNA, 18 nt, Human
ggaaagacagcuucucau

SEQ ID NO: 2233728 - RNA, 13 nt, Human
aucaaugaaugaa

SEQ ID NO: 2233729 - RNA, 17 nt, Human
ucgggauuaguacacac

SEQ ID NO: 2233730 - RNA, 16 nt, Human
uccuguaauggaagca

SEQ ID NO: 2233731 - RNA, 22 nt, Human
uucaauaucuuuuuuuuaauaa

SEQ ID NO: 2233732 - RNA, 23 nt, Human
ucggccuccauccugaggcucca

SEQ ID NO: 2233733 - RNA, 20 nt, Human
aagacagugaaagaaaauaa

SEQ ID NO: 2233734 - RNA, 13 nt, Human
uuaugcuaaguga

SEQ ID NO: 2233735 - RNA, 21 nt, Human
aaagaaaauaacgauaaaaga

SEQ ID NO: 2233736 - RNA, 23 nt, Human
gaggcauccaaaggcuccugaga

SEQ ID NO: 2233737 - RNA, 19 nt, Human
auuggagcucgugggacag

SEQ ID NO: 2233738 - RNA, 15 nt, Human
guaaggggaauugag

SEQ ID NO: 2233739 - RNA, 16 nt, Human
cccaaccucucccaac

SEQ ID NO: 2233740 - RNA, 15 nt, Human
caccucagcugccuc

SEQ ID NO: 2233741 - RNA, 17 nt, Human
uccuacaagacacagug

SEQ ID NO: 2233742 - RNA, 13 nt, Human
cggauugagaagg

SEQ ID NO: 2233743 - RNA, 20 nt, Human
acaagacacagugaccauac

SEQ ID NO: 2233744 - RNA, 20 nt, Human
ugggccccagauaccaugau

SEQ ID NO: 2233745 - RNA, 11 nt, Human
cgauaaaagac

SEQ ID NO: 2233746 - RNA, 21 nt, Human
cuucuaaccugaacugauggg

SEQ ID NO: 2233747 - RNA, 21 nt, Human
ccuggugccucaccccuugcc

SEQ ID NO: 2233748 - RNA, 16 nt, Human
augaauacuuuauaaa

SEQ ID NO: 2233749 - RNA, 13 nt, Human
caacucccugccc

SEQ ID NO: 2233750 - RNA, 13 nt, Human
cacaccaggcuug

SEQ ID NO: 2233751 - RNA, 14 nt, Human
ugaucaccugcccu

SEQ ID NO: 2233752 - RNA, 14 nt, Human
aagcaacccaaaug

SEQ ID NO: 2233753 - RNA, 13 nt, Human
uuuucuuuucauu

SEQ ID NO: 2233754 - RNA, 18 nt, Human
accaccugccuauauuuu

SEQ ID NO: 2233755 - RNA, 15 nt, Human
uggaguaaaucgcua

SEQ ID NO: 2233756 - RNA, 20 nt, Human
ugauuucugagcauuuaaua

SEQ ID NO: 2233757 - RNA, 16 nt, Human
gcuuuuucucucccac

SEQ ID NO: 2233758 - RNA, 21 nt, Human
uuauagcuacuaauuuuaaaa

SEQ ID NO: 2233759 - RNA, 19 nt, Human
agaguuuagcuggaaaagu

SEQ ID NO: 2233760 - RNA, 19 nt, Human
gccugaucaccugcccugc

SEQ ID NO: 2233761 - RNA, 17 nt, Human
ucauacuucuuaggguu

SEQ ID NO: 2233762 - RNA, 17 nt, Human
uccugccccugagccca

SEQ ID NO: 2233763 - RNA, 20 nt, Human
uguaauaggcguaacuaauu

SEQ ID NO: 2233764 - RNA, 13 nt, Human
ccuccuuuuaaag

SEQ ID NO: 2233765 - RNA, 21 nt, Human
uacaugagguacugagaguga

SEQ ID NO: 2233766 - RNA, 15 nt, Human
cauucugccugcccu

SEQ ID NO: 2233767 - RNA, 22 nt, Human
uggacgagaaaacaauaacgau

SEQ ID NO: 2233768 - RNA, 14 nt, Human
agaugcuagaacuc

SEQ ID NO: 2233769 - RNA, 22 nt, Human
auauauaacaaugcuguauuuu

SEQ ID NO: 2233770 - RNA, 16 nt, Human
aaaauaacaauaaaag

SEQ ID NO: 2233771 - RNA, 17 nt, Human
ugaaauaagccagacau

SEQ ID NO: 2233772 - RNA, 17 nt, Human
ggauacuccauggggug

SEQ ID NO: 2233773 - RNA, 16 nt, Human
ccugagcuugcagaga

SEQ ID NO: 2233774 - RNA, 19 nt, Human
auagucauucugccugccc

SEQ ID NO: 2233775 - RNA, 21 nt, Human
cuaguaucaaaagaaagaaaa

SEQ ID NO: 2233776 - RNA, 23 nt, Human
cauuguggucacaggaaguagag

SEQ ID NO: 2233777 - RNA, 13 nt, Human
aucaggcuggcca

SEQ ID NO: 2233778 - RNA, 18 nt, Human
acaugaacuuguaaagga

SEQ ID NO: 2233779 - RNA, 14 nt, Human
gcaaagcccagcuu

SEQ ID NO: 2233780 - RNA, 16 nt, Human
agggagggaaggggga

SEQ ID NO: 2233781 - RNA, 17 nt, Human
aaauaacgauaaaagac

SEQ ID NO: 2233782 - RNA, 22 nt, Human
auaucuuuuuuuuaauaaacca

SEQ ID NO: 2233783 - RNA, 22 nt, Human
uuugaugcuacaggauuugaaa

SEQ ID NO: 2233784 - RNA, 17 nt, Human
auaucaauuuaaaaaaa

SEQ ID NO: 2233785 - RNA, 16 nt, Human
guuuuuuuuuaaaaaa

SEQ ID NO: 2233786 - RNA, 19 nt, Human
aaacaauaacgauaaaaga

SEQ ID NO: 2233787 - RNA, 16 nt, Human
ucuugagguaaaagca

SEQ ID NO: 2233788 - RNA, 23 nt, Human
caauaacgauaaaagacagugaa

SEQ ID NO: 2233789 - RNA, 22 nt, Human
accaaucaugaauuaguuuuau

SEQ ID NO: 2233790 - RNA, 21 nt, Human
auaguuguaccgcaaugugac

SEQ ID NO: 2233791 - RNA, 21 nt, Human
ugcagaguacuggcugaugga

SEQ ID NO: 2233792 - RNA, 16 nt, Human
uaggauguugaaaaag

SEQ ID NO: 2233793 - RNA, 17 nt, Human
aguugauaaguacauga

SEQ ID NO: 2233794 - RNA, 14 nt, Human
gacaugggccccag

SEQ ID NO: 2233795 - RNA, 12 nt, Human
agaucaagccug

SEQ ID NO: 2233796 - RNA, 23 nt, Human
agcccuccuuaucaaaggacacc

SEQ ID NO: 2233797 - RNA, 18 nt, Human
auuugcuggagcucugcc

SEQ ID NO: 2233798 - RNA, 15 nt, Human
ccagcacagccucuu

SEQ ID NO: 2233799 - RNA, 21 nt, Human
acuuuuccaaugacauuuugu

SEQ ID NO: 2233800 - RNA, 21 nt, Human
ucccagaucaagccugccuca

SEQ ID NO: 2233801 - RNA, 15 nt, Human
ccccugagcuugcag

SEQ ID NO: 2233802 - RNA, 17 nt, Human
ggccaugggacagggag

SEQ ID NO: 2233803 - RNA, 17 nt, Human
uguaaaggaauuuaaaa

SEQ ID NO: 2233804 - RNA, 23 nt, Human
acucuauguucuaagaagugaaa

SEQ ID NO: 2233805 - RNA, 23 nt, Human
auaauguguucauucuggaauaa

SEQ ID NO: 2233806 - RNA, 14 nt, Human
agaaaugaaagcag

SEQ ID NO: 2233807 - RNA, 21 nt, Human
cauuuucuucucacauuuaua

SEQ ID NO: 2233808 - RNA, 22 nt, Human
agaccaaauugagcuagggggg

SEQ ID NO: 2233809 - RNA, 16 nt, Human
aaauauuauguuaaaa

SEQ ID NO: 2233810 - RNA, 21 nt, Human
uagggugauauuaaccagggg

SEQ ID NO: 2233811 - RNA, 19 nt, Human
uauuuuaauaauguuucaa

SEQ ID NO: 2233812 - RNA, 18 nt, Human
caaucaguauucauauuu

SEQ ID NO: 2233813 - RNA, 13 nt, Human
uuuuaaaaaagaa

SEQ ID NO: 2233814 - RNA, 13 nt, Human
gguccacaacaca

SEQ ID NO: 2233815 - RNA, 20 nt, Human
caaauguucaucaaugaaug

SEQ ID NO: 2233816 - RNA, 22 nt, Human
acauccuacaagacacagugac

SEQ ID NO: 2233817 - RNA, 14 nt, Human
cucagucucccucc

SEQ ID NO: 2233818 - RNA, 16 nt, Human
aucaauuuaaaaaaaa

SEQ ID NO: 2233819 - RNA, 21 nt, Human
gcugagucccaggcugagccu

SEQ ID NO: 2233820 - RNA, 12 nt, Human
gcugaugcaguu

SEQ ID NO: 2233821 - RNA, 18 nt, Human
ccaaccuggaguugaaaa

SEQ ID NO: 2233822 - RNA, 21 nt, Human
ugagccagugucaggaggaag

SEQ ID NO: 2233823 - RNA, 17 nt, Human
ugaaauauuauuuuaua

SEQ ID NO: 2233824 - RNA, 22 nt, Human
gucaagaagcaucgugucuggc

SEQ ID NO: 2233825 - RNA, 18 nt, Human
gaaggagcucccaggagg

SEQ ID NO: 2233826 - RNA, 16 nt, Human
ccccaucucuucuggg

SEQ ID NO: 2233827 - RNA, 15 nt, Human
cagugaaagaaaaua

SEQ ID NO: 2233828 - RNA, 14 nt, Human
uuucaauaaaacuu

SEQ ID NO: 2233829 - RNA, 16 nt, Human
acauuuauauuuuugu

SEQ ID NO: 2233830 - RNA, 16 nt, Human
cuacacuccagugaga

SEQ ID NO: 2233831 - RNA, 21 nt, Human
ucauucacucaacaaacauaa

SEQ ID NO: 2233832 - RNA, 23 nt, Human
caauccaagaacuuauuuguaca

SEQ ID NO: 2233833 - RNA, 17 nt, Human
gacgagaaaacaauaac

SEQ ID NO: 2233834 - RNA, 13 nt, Human
cuugccugcaggc

SEQ ID NO: 2233835 - RNA, 21 nt, Human
cuauaaaacuaggugcugcag

SEQ ID NO: 2233836 - RNA, 15 nt, Human
gcccacuagacccac

SEQ ID NO: 2233837 - RNA, 21 nt, Human
gccaaauauaaauaaaaauaa

SEQ ID NO: 2233838 - RNA, 14 nt, Human
agcggaccuuccca

SEQ ID NO: 2233839 - RNA, 22 nt, Human
aaguuguagguaauauugcaag

SEQ ID NO: 2233840 - RNA, 12 nt, Human
aaaauaacaaua

SEQ ID NO: 2233841 - RNA, 20 nt, Human
gaaaauaacgauaaaagaca

SEQ ID NO: 2233842 - RNA, 19 nt, Human
gccccccagcccuccuuau

SEQ ID NO: 2233843 - RNA, 15 nt, Human
uuauagcuacuaauu

SEQ ID NO: 2233844 - RNA, 14 nt, Human
uaugaauuacauuu

SEQ ID NO: 2233845 - RNA, 17 nt, Human
uaugcuaagugaaauaa

SEQ ID NO: 2233846 - RNA, 14 nt, Human
uggcuugaguuuaa

SEQ ID NO: 2233847 - RNA, 12 nt, Human
cccccagcccuc

SEQ ID NO: 2233848 - RNA, 23 nt, Human
uccagguagaggguguguaagua

SEQ ID NO: 2233849 - RNA, 19 nt, Human
aauuuuuauauuugaaaua

SEQ ID NO: 2233850 - RNA, 22 nt, Human
gcuucucauccugcaggcagcu

SEQ ID NO: 2233851 - RNA, 16 nt, Human
uucccaacuccagaaa

SEQ ID NO: 2233852 - RNA, 16 nt, Human
cucagcugccucccca

SEQ ID NO: 2233853 - RNA, 20 nt, Human
cacccccagaaugaccuggc

SEQ ID NO: 2233854 - RNA, 16 nt, Human
gauggcaggaggcauc

SEQ ID NO: 2233855 - RNA, 11 nt, Human
uuuuuuuucaa

SEQ ID NO: 2233856 - RNA, 17 nt, Human
cugggaccaggcacccc

SEQ ID NO: 2233857 - RNA, 23 nt, Human
ccagguaccuucucaccugugag

SEQ ID NO: 2233858 - RNA, 19 nt, Human
aauuuuguuauguauauuu

SEQ ID NO: 2233859 - RNA, 18 nt, Human
acuuuaugcuaagugaaa

SEQ ID NO: 2233860 - RNA, 18 nt, Human
caaggcuagaaccaccug

SEQ ID NO: 2233861 - RNA, 12 nt, Human
gguauuuuaauc

SEQ ID NO: 2233862 - RNA, 19 nt, Human
uauacugugugcuaaaaca

SEQ ID NO: 2233863 - RNA, 21 nt, Human
aaacaauaacgauaaaagaca

SEQ ID NO: 2233864 - RNA, 17 nt, Human
acaaaugcauuucuaaa

SEQ ID NO: 2233865 - RNA, 17 nt, Human
ccacuggacucaccucc

SEQ ID NO: 2233866 - RNA, 23 nt, Human
caccucauggaauuggagcucgu

SEQ ID NO: 2233867 - RNA, 19 nt, Human
auguuuacagauccccaag

SEQ ID NO: 2233868 - RNA, 22 nt, Human
ccgggagccugaucaccugccc

SEQ ID NO: 2233869 - RNA, 14 nt, Human
cacaagaaaugaaa

SEQ ID NO: 2233870 - RNA, 17 nt, Human
auuauuuuuuaaaaaaa

SEQ ID NO: 2233871 - RNA, 22 nt, Human
gaaaacaauaacgauaaaagac

SEQ ID NO: 2233872 - RNA, 13 nt, Human
uaugaaauauuau

SEQ ID NO: 2233873 - RNA, 14 nt, Human
cagagguugcagug

SEQ ID NO: 2233874 - RNA, 19 nt, Human
uauauuuuugugauuuugu

SEQ ID NO: 2233875 - RNA, 18 nt, Human
cugagggcauagaaguaa

SEQ ID NO: 2233876 - RNA, 13 nt, Human
ucuuauaauuuaa

SEQ ID NO: 2233877 - RNA, 21 nt, Human
aauuuuuauauuugaaauauu

SEQ ID NO: 2233878 - RNA, 18 nt, Human
agcugcucaauaaaguac

SEQ ID NO: 2233879 - RNA, 18 nt, Human
uaaguuuuuuuuuaaaaa

SEQ ID NO: 2233880 - RNA, 18 nt, Human
uguaaaggaauuuaaaaa

SEQ ID NO: 2233881 - RNA, 23 nt, Human
ccucagcugccuccccagcucua

SEQ ID NO: 2233882 - RNA, 16 nt, Human
uuaaauuguaauaggc

SEQ ID NO: 2233883 - RNA, 16 nt, Human
uaccuuuugcuguggc

SEQ ID NO: 2233884 - RNA, 16 nt, Human
aaaguguuugaaagcu

SEQ ID NO: 2233885 - RNA, 22 nt, Human
ucuuccuuuuuuaguucuucaa

SEQ ID NO: 2233886 - RNA, 23 nt, Human
gcccuggugccucaccccuugcc

SEQ ID NO: 2233887 - RNA, 16 nt, Human
uaaugaauacuuuaua

SEQ ID NO: 2233888 - RNA, 20 nt, Human
ccaaccucucccaacuauaa

SEQ ID NO: 2233889 - RNA, 13 nt, Human
caccaaggagcca

SEQ ID NO: 2233890 - RNA, 21 nt, Human
cccccauuguggucacaggaa

SEQ ID NO: 2233891 - RNA, 15 nt, Human
ucuuauaauuuaaaa

SEQ ID NO: 2233892 - RNA, 17 nt, Human
agcucugcccauccugc

SEQ ID NO: 2233893 - RNA, 17 nt, Human
ucccagaucaagccugc

SEQ ID NO: 2233894 - RNA, 18 nt, Human
uuuauguuuaauucugaa

SEQ ID NO: 2233895 - RNA, 20 nt, Human
cccugccccccagcccuccu

SEQ ID NO: 2233896 - RNA, 14 nt, Human
uuaugauuaaguaa

SEQ ID NO: 2233897 - RNA, 18 nt, Human
accaggcuugccugcagg

SEQ ID NO: 2233898 - RNA, 17 nt, Human
aaccuagggugauauua

SEQ ID NO: 2233899 - RNA, 17 nt, Human
cauauuuauagccaggu

SEQ ID NO: 2233900 - RNA, 22 nt, Human
ccaaaggcuccugagacacaug

SEQ ID NO: 2233901 - RNA, 22 nt, Human
acaugagguacugagagugaac

SEQ ID NO: 2233902 - RNA, 13 nt, Human
cacacugaagaag

SEQ ID NO: 2233903 - RNA, 15 nt, Human
ggauacuccaugggg

SEQ ID NO: 2233904 - RNA, 13 nt, Human
ugcauuucuaaag

SEQ ID NO: 2233905 - RNA, 16 nt, Human
agguugcagugagccg

SEQ ID NO: 2233906 - RNA, 18 nt, Human
uaaaagacaaggaaaaaa

SEQ ID NO: 2233907 - RNA, 13 nt, Human
ugaaaaucuuaua

SEQ ID NO: 2233908 - RNA, 15 nt, Human
ucuggcuccagcugg

SEQ ID NO: 2233909 - RNA, 20 nt, Human
uuuaguaagagauuccugag

SEQ ID NO: 2233910 - RNA, 15 nt, Human
aaacauaugaauuau

SEQ ID NO: 2233911 - RNA, 13 nt, Human
gauuguaaaaugg

SEQ ID NO: 2233912 - RNA, 21 nt, Human
aaagcugaaauggacuuuugu

SEQ ID NO: 2233913 - RNA, 16 nt, Human
gacauuugcucaugga

SEQ ID NO: 2233914 - RNA, 15 nt, Human
gcaacccaaauguuc

SEQ ID NO: 2233915 - RNA, 16 nt, Human
aaaauccauacauuug

SEQ ID NO: 2233916 - RNA, 19 nt, Human
uuuauaucaauuuaaaaaa

SEQ ID NO: 2233917 - RNA, 20 nt, Human
uguuggugaacuugguuuua

SEQ ID NO: 2233918 - RNA, 19 nt, Human
cacaggaaccacaagacug

SEQ ID NO: 2233919 - RNA, 14 nt, Human
ccugggcugaggca

SEQ ID NO: 2233920 - RNA, 23 nt, Human
auauaacaaugcuguauuuuaaa

SEQ ID NO: 2233921 - RNA, 20 nt, Human
acuagaguuuagcuggaaaa

SEQ ID NO: 2233922 - RNA, 16 nt, Human
acgaggauugggaaaa

SEQ ID NO: 2233923 - RNA, 15 nt, Human
acuaauaaaauacau

SEQ ID NO: 2233924 - RNA, 15 nt, Human
ccaacuccagaaagu

SEQ ID NO: 2233925 - RNA, 20 nt, Human
cauagauucccugagcagga

SEQ ID NO: 2233926 - RNA, 20 nt, Human
cagccugugcugcccgucuu

SEQ ID NO: 2233927 - RNA, 19 nt, Human
cagccgcuccugucugcca

SEQ ID NO: 2233928 - RNA, 23 nt, Human
caacugaggcagacagcagcuca

SEQ ID NO: 2233929 - RNA, 17 nt, Human
ccagcagccagcucuca

SEQ ID NO: 2233930 - RNA, 21 nt, Human
cuucuaaguaaaaccacagca

SEQ ID NO: 2233931 - RNA, 13 nt, Human
gaauuggagcucg

SEQ ID NO: 2233932 - RNA, 21 nt, Human
cuaagcauuccaacuaucuca

SEQ ID NO: 2233933 - RNA, 16 nt, Human
gaugaauuaaguuuuu

SEQ ID NO: 2233934 - RNA, 22 nt, Human
gucuucagccuagccgaccuca

SEQ ID NO: 2233935 - RNA, 17 nt, Human
gugaagcaaaauuuuuu

SEQ ID NO: 2233936 - RNA, 20 nt, Human
uauugucuagugaaacucgu

SEQ ID NO: 2233937 - RNA, 22 nt, Human
ugguaaggggaauugaggacac

SEQ ID NO: 2233938 - RNA, 13 nt, Human
ugaaagaaaauaa

SEQ ID NO: 2233939 - RNA, 14 nt, Human
ugaaagguacuuca

SEQ ID NO: 2233940 - RNA, 12 nt, Human
aaauauaaauaa

SEQ ID NO: 2233941 - RNA, 22 nt, Human
aagugguauagaaaugcugguu

SEQ ID NO: 2233942 - RNA, 18 nt, Human
aaggaguccuugcaucaa

SEQ ID NO: 2233943 - RNA, 14 nt, Human
aacaacucgaauca

SEQ ID NO: 2233944 - RNA, 17 nt, Human
uuaaauggagaaaggac

SEQ ID NO: 2233945 - RNA, 17 nt, Human
uucuauggcauauugau

SEQ ID NO: 2233946 - RNA, 21 nt, Human
uucccaacuccagaaagugac

SEQ ID NO: 2233947 - RNA, 16 nt, Human
cuacaaaaacacagca

SEQ ID NO: 2233948 - RNA, 19 nt, Human
cuacaguguacagucuugu

SEQ ID NO: 2233949 - RNA, 14 nt, Human
cugaggcagacagc

SEQ ID NO: 2233950 - RNA, 12 nt, Human
cucaauauuuca

SEQ ID NO: 2233951 - RNA, 15 nt, Human
gaauacuaauaaaau

SEQ ID NO: 2233952 - RNA, 19 nt, Human
gaacguuuuuccuguucuu

SEQ ID NO: 2233953 - RNA, 21 nt, Human
cuuaguugcuguaugucucgu

SEQ ID NO: 2233954 - RNA, 17 nt, Human
gauuaaugucaauucuu

SEQ ID NO: 2233955 - RNA, 17 nt, Human
gauggugguauguuuuc

SEQ ID NO: 2233956 - RNA, 14 nt, Human
gauaaugaauacuu

SEQ ID NO: 2233957 - RNA, 23 nt, Human
gaguuaauauauagaaggguacc

SEQ ID NO: 2233958 - RNA, 14 nt, Human
gagccaaggguuca

SEQ ID NO: 2233959 - RNA, 21 nt, Human
gcaccuuuagaauauuaaaaa

SEQ ID NO: 2233960 - RNA, 18 nt, Human
uagaauaccacaggaacc

SEQ ID NO: 2233961 - RNA, 19 nt, Human
ucacaggacagcccuucuu

SEQ ID NO: 2233962 - RNA, 22 nt, Human
gcuacuaauuuuaaaaugucuu

SEQ ID NO: 2233963 - RNA, 18 nt, Human
uggagaaaggacccucaa

SEQ ID NO: 2233964 - RNA, 15 nt, Human
uccaagugauugaaa

SEQ ID NO: 2233965 - RNA, 12 nt, Human
uccacagaagcu

SEQ ID NO: 2233966 - RNA, 18 nt, Human
ugauuuugugauugauua

SEQ ID NO: 2233967 - RNA, 16 nt, Human
uuaccugggaaagggc

SEQ ID NO: 2233968 - RNA, 17 nt, Human
aaguaugcacuaaucaa

SEQ ID NO: 2233969 - RNA, 15 nt, Human
acaacucgaaucacu

SEQ ID NO: 2233970 - RNA, 13 nt, Human
acaaaugggaaac

SEQ ID NO: 2233971 - RNA, 19 nt, Human
aauuguauuacaaauccaa

SEQ ID NO: 2233972 - RNA, 14 nt, Human
aauguagauaaagc

SEQ ID NO: 2233973 - RNA, 18 nt, Human
aaucauaugggauacugc

SEQ ID NO: 2233974 - RNA, 14 nt, Human
aagcuuauuaaaac

SEQ ID NO: 2233975 - RNA, 23 nt, Human
aauacaucccuuaccugggaaag

SEQ ID NO: 2233976 - RNA, 24 nt, Human
augaauuacauuuguauaaaauaa

SEQ ID NO: 2233977 - RNA, 14 nt, Human
auuguguguuauuu

SEQ ID NO: 2233978 - RNA, 14 nt, Human
auuccuuuuucucu

SEQ ID NO: 2233979 - RNA, 16 nt, Human
aggcacacuucuucuu

SEQ ID NO: 2233980 - RNA, 20 nt, Human
aguugauaugccuuuuccca

SEQ ID NO: 2233981 - RNA, 19 nt, Human
acaguuuuuauugcuuguu

SEQ ID NO: 2233982 - RNA, 14 nt, Human
agccagauuuuccu

SEQ ID NO: 2233983 - RNA, 19 nt, Human
aaaaucauuucugcaucag

SEQ ID NO: 2233984 - RNA, 19 nt, Human
uuugugaagaaacauuuau

SEQ ID NO: 2233985 - RNA, 12 nt, Human
auaacuggaaac

SEQ ID NO: 2233986 - RNA, 22 nt, Human
auaauguuucaaacauauauaa

SEQ ID NO: 2233987 - RNA, 11 nt, Human
cauauuaaaau

SEQ ID NO: 2233988 - RNA, 15 nt, Human
ccagauccuggaaau

SEQ ID NO: 2233989 - RNA, 15 nt, Human
ccaacacgagcaggc

SEQ ID NO: 2233990 - RNA, 22 nt, Human
cagcagcucaggcacacuucuu

SEQ ID NO: 2233991 - RNA, 21 nt, Human
cacuucuucuuggucuuauuu

SEQ ID NO: 2233992 - RNA, 19 nt, Human
caagacugcacaucaaaau

SEQ ID NO: 2233993 - RNA, 13 nt, Human
caguaaaauccac

SEQ ID NO: 2233994 - RNA, 13 nt, Human
cagaauucugcua

SEQ ID NO: 2233995 - RNA, 17 nt, Human
agcaaauuccaauacau

SEQ ID NO: 2233996 - RNA, 19 nt, Human
gauuuuccugaaaacccuu

SEQ ID NO: 2233997 - RNA, 14 nt, Human
gcaaguauuagaau

SEQ ID NO: 2233998 - RNA, 19 nt, Human
gaccuguggccaaguucuu

SEQ ID NO: 2233999 - RNA, 21 nt, Human
cuuguuggauuuuugucuugu

SEQ ID NO: 2234000 - RNA, 16 nt, Human
ucaggcacacuucuuc

SEQ ID NO: 2234001 - RNA, 16 nt, Human
ugaguuuaaauuguaa

SEQ ID NO: 2234002 - RNA, 21 nt, Human
ucaaggguacacugccuucuc

SEQ ID NO: 2234003 - RNA, 12 nt, Human
ucaaaacugcac

SEQ ID NO: 2234004 - RNA, 20 nt, Human
guucacagccagacuggcac

SEQ ID NO: 2234005 - RNA, 23 nt, Human
gcucaacaagagacuggaaggac

SEQ ID NO: 2234006 - RNA, 15 nt, Human
gugggccuccucugu

SEQ ID NO: 2234007 - RNA, 16 nt, Human
gugucuuaauuaaaag

SEQ ID NO: 2234008 - RNA, 23 nt, Human
guguacagaauucugcuaccuca

SEQ ID NO: 2234009 - RNA, 17 nt, Human
guaagggaaacugccag

SEQ ID NO: 2234010 - RNA, 17 nt, Human
uguguacagaauucugc

SEQ ID NO: 2234011 - RNA, 13 nt, Human
ucugccagccagc

SEQ ID NO: 2234012 - RNA, 14 nt, Human
ugucacaggacagc

SEQ ID NO: 2234013 - RNA, 22 nt, Human
agcacagccucuuagaugcagu

SEQ ID NO: 2234014 - RNA, 14 nt, Human
cacuagggcaggga

SEQ ID NO: 2234015 - RNA, 23 nt, Human
ucaacaagagacuggaaggacca

SEQ ID NO: 2234016 - RNA, 18 nt, Human
cauggaauuggagcucgu

SEQ ID NO: 2234017 - RNA, 13 nt, Human
acuguaaaauaau

SEQ ID NO: 2234018 - RNA, 14 nt, Human
auauaaauuuuuuu

SEQ ID NO: 2234019 - RNA, 16 nt, Human
aacuuaagguuaccuu

SEQ ID NO: 2234020 - RNA, 19 nt, Human
cucagccuuccccuugccc

SEQ ID NO: 2234021 - RNA, 23 nt, Human
cagcaucucugaacauuucucug

SEQ ID NO: 2234022 - RNA, 18 nt, Human
gcaguagcagcagcaucu

SEQ ID NO: 2234023 - RNA, 22 nt, Human
ccucauccgaggcagggucagg

SEQ ID NO: 2234024 - RNA, 18 nt, Human
uuuuagugaaauauuauu

SEQ ID NO: 2234025 - RNA, 21 nt, Human
aguaugcacuaaucaauacuu

SEQ ID NO: 2234026 - RNA, 22 nt, Human
uuauacgauaaauaacuuuuuu

SEQ ID NO: 2234027 - RNA, 15 nt, Human
uaggaaauauuuauu

SEQ ID NO: 2234028 - RNA, 18 nt, Human
agcuuagaccucagccug

SEQ ID NO: 2234029 - RNA, 15 nt, Human
agaauacuaauaaaa

SEQ ID NO: 2234030 - RNA, 20 nt, Human
agcccaaagugguauagaaa

SEQ ID NO: 2234031 - RNA, 16 nt, Human
auguaagggaaacugc

SEQ ID NO: 2234032 - RNA, 11 nt, Human
cgauaaaagac

SEQ ID NO: 2234033 - RNA, 19 nt, Human
ccgcuccugucugccagcc

SEQ ID NO: 2234034 - RNA, 20 nt, Human
uuccacagaagcuccaggua

SEQ ID NO: 2234035 - RNA, 12 nt, Human
aauaauuuuuaa

SEQ ID NO: 2234036 - RNA, 16 nt, Human
auguagauaaagcacu

SEQ ID NO: 2234037 - RNA, 13 nt, Human
uuuaaaaaagaaa

SEQ ID NO: 2234038 - RNA, 14 nt, Human
aauauuuauuuuaa

SEQ ID NO: 2234039 - RNA, 16 nt, Human
aaauauuuauuuuaau

SEQ ID NO: 2234040 - RNA, 16 nt, Human
aagcauuuagauguau

SEQ ID NO: 2234041 - RNA, 13 nt, Human
ugcuuuuaaaaaa

SEQ ID NO: 2234042 - RNA, 14 nt, Human
aaagcuuauuaaaa

SEQ ID NO: 2234043 - RNA, 18 nt, Human
cuccucuguccagggccc

SEQ ID NO: 2234044 - RNA, 14 nt, Human
cuaagcauuccaac

SEQ ID NO: 2234045 - RNA, 20 nt, Human
agagacacacugaagaagca

SEQ ID NO: 2234046 - RNA, 16 nt, Human
agccuggugggccucc

SEQ ID NO: 2234047 - RNA, 14 nt, Human
gcuguagaagaugg

SEQ ID NO: 2234048 - RNA, 20 nt, Human
uauaugcuaagucuuauaua

SEQ ID NO: 2234049 - RNA, 14 nt, Human
agauguaaaagacu

SEQ ID NO: 2234050 - RNA, 22 nt, Human
accaaucaugaauuaguuuuau

SEQ ID NO: 2234051 - RNA, 23 nt, Human
aaugcugguuuuucaguuuucag

SEQ ID NO: 2234052 - RNA, 18 nt, Human
auauuuuaacuuccuugg

SEQ ID NO: 2234053 - RNA, 20 nt, Human
uuagaugacugaauuucuau

SEQ ID NO: 2234054 - RNA, 23 nt, Human
cacagcaguugaaaagacuccaa

SEQ ID NO: 2234055 - RNA, 16 nt, Human
auuguacaguuuuuau

SEQ ID NO: 2234056 - RNA, 20 nt, Human
auuacauuuguauaaaauaa

SEQ ID NO: 2234057 - RNA, 17 nt, Human
gaagagcuguucacagc

SEQ ID NO: 2234058 - RNA, 13 nt, Human
uuuuaaaaaagaa

SEQ ID NO: 2234059 - RNA, 19 nt, Human
auuaaaaucacaaacucau

SEQ ID NO: 2234060 - RNA, 15 nt, Human
aaggguacacugccu

SEQ ID NO: 2234061 - RNA, 14 nt, Human
cuuuauuagugaag

SEQ ID NO: 2234062 - RNA, 21 nt, Human
auuuuccugaaaacccuugcc

SEQ ID NO: 2234063 - RNA, 19 nt, Human
gugaacuugguuuuaauua

SEQ ID NO: 2234064 - RNA, 16 nt, Human
auccuugaagauuuac

SEQ ID NO: 2234065 - RNA, 17 nt, Human
auauuugaaauauugac

SEQ ID NO: 2234066 - RNA, 21 nt, Human
ccaacgaguaauuuauuguuu

SEQ ID NO: 2234067 - RNA, 15 nt, Human
agccagcucucagcc

SEQ ID NO: 2234068 - RNA, 12 nt, Human
gucuucagccua

SEQ ID NO: 2234069 - RNA, 21 nt, Human
caguagcagcagcaucucuga

SEQ ID NO: 2234070 - RNA, 17 nt, Human
uaaaagacagugaaaga

SEQ ID NO: 2234071 - RNA, 15 nt, Human
aaaagacaaggaaaa

SEQ ID NO: 2234072 - RNA, 21 nt, Human
acuguagaaaagggaacugaa

SEQ ID NO: 2234073 - RNA, 20 nt, Human
uguaauaggcguaacuaauu

SEQ ID NO: 2234074 - RNA, 13 nt, Human
aaaauaacaauga

SEQ ID NO: 2234075 - RNA, 16 nt, Human
cacuaguauuucuaug

SEQ ID NO: 2234076 - RNA, 16 nt, Human
aauuacauuuguauaa

SEQ ID NO: 2234077 - RNA, 21 nt, Human
cagcuugcccuguuaaaagau

SEQ ID NO: 2234078 - RNA, 22 nt, Human
aaaugugcuuuuaaaaaaaaau

SEQ ID NO: 2234079 - RNA, 12 nt, Human
gauaaaagacag

SEQ ID NO: 2234080 - RNA, 22 nt, Human
caccagucugacuguuuccauc

SEQ ID NO: 2234081 - RNA, 16 nt, Human
uaaugaauacuuuaua

SEQ ID NO: 2234082 - RNA, 15 nt, Human
uguacaguuuuuauu

SEQ ID NO: 2234083 - RNA, 16 nt, Human
auuuuaauaauguuuc

SEQ ID NO: 2234084 - RNA, 17 nt, Human
ggcaacugaggcagaca

SEQ ID NO: 2234085 - RNA, 15 nt, Human
gcagggucaggagag

SEQ ID NO: 2234086 - RNA, 13 nt, Human
cugcuaccucacu

SEQ ID NO: 2234087 - RNA, 17 nt, Human
uccuguucuuaagacgu

SEQ ID NO: 2234088 - RNA, 18 nt, Human
uuguaaaggaauuuaaaa

SEQ ID NO: 2234089 - RNA, 21 nt, Human
auagauaaucucuccauuccc

SEQ ID NO: 2234090 - RNA, 14 nt, Human
ugguauguuuucag

SEQ ID NO: 2234091 - RNA, 17 nt, Human
aauaugcucuaaacaug

SEQ ID NO: 2234092 - RNA, 14 nt, Human
agcagccagcucuc

SEQ ID NO: 2234093 - RNA, 17 nt, Human
ccucggagccucauccg

SEQ ID NO: 2234094 - RNA, 23 nt, Human
uacagucuuguauuaaguuguua

SEQ ID NO: 2234095 - RNA, 23 nt, Human
gaaaacaauaacgauaaaagaca

SEQ ID NO: 2234096 - RNA, 17 nt, Human
ugaaucacguaaagcua

SEQ ID NO: 2234097 - RNA, 13 nt, Human
ucuauaauuuaaa

SEQ ID NO: 2234098 - RNA, 21 nt, Human
acagccagacuggcacaguuu

SEQ ID NO: 2234099 - RNA, 15 nt, Human
acucaacaaacauaa

SEQ ID NO: 2234100 - RNA, 21 nt, Human
aaacaauaacgauaaaagaca

SEQ ID NO: 2234101 - RNA, 22 nt, Human
uuugaugcuacaggauuugaaa

SEQ ID NO: 2234102 - RNA, 17 nt, Human
uaauuuuuauauuugaa

SEQ ID NO: 2234103 - RNA, 13 nt, Human
aauacacacucaa

SEQ ID NO: 2234104 - RNA, 12 nt, Human
gcuuuuaaaaaa

SEQ ID NO: 2234105 - RNA, 15 nt, Human
acucauuuuaaaaaa

SEQ ID NO: 2234106 - RNA, 21 nt, Human
cauuuucuucucacauuuaua

SEQ ID NO: 2234107 - RNA, 18 nt, Human
acccagggaugacauguc

SEQ ID NO: 2234108 - RNA, 15 nt, Human
ucuaugaaauauuau

SEQ ID NO: 2234109 - RNA, 16 nt, Human
uuuccuuguauuuaaa

SEQ ID NO: 2234110 - RNA, 13 nt, Human
uauuucuaugaaa

SEQ ID NO: 2234111 - RNA, 21 nt, Human
uagggugauauuaaccagggg

SEQ ID NO: 2234112 - RNA, 16 nt, Human
aaauaacaaugaaagu

SEQ ID NO: 2234113 - RNA, 21 nt, Human
ccuacaguguacagucuugua

SEQ ID NO: 2234114 - RNA, 22 nt, Human
ggacuucugucuucacaacaga

SEQ ID NO: 2234115 - RNA, 15 nt, Human
aaaaaauaacaauga

SEQ ID NO: 2234116 - RNA, 17 nt, Human
uccugucugccagccag

SEQ ID NO: 2234117 - RNA, 17 nt, Human
uauaggugcuacaaaaa

SEQ ID NO: 2234118 - RNA, 12 nt, Human
aagaaaauaacg

SEQ ID NO: 2234119 - RNA, 18 nt, Human
uagugaaauauuauuuua

SEQ ID NO: 2234120 - RNA, 17 nt, Human
aagcuuuuuuugaauca

SEQ ID NO: 2234121 - RNA, 16 nt, Human
ccuccuuuuaaaguaa

SEQ ID NO: 2234122 - RNA, 11 nt, Human
caucuagugag

SEQ ID NO: 2234123 - RNA, 22 nt, Human
gggccuccucuguccagggccc

SEQ ID NO: 2234124 - RNA, 13 nt, Human
cuacaguguacag

SEQ ID NO: 2234125 - RNA, 15 nt, Human
cagcaguugaaaaga

SEQ ID NO: 2234126 - RNA, 14 nt, Human
aaucacucauuuau

SEQ ID NO: 2234127 - RNA, 14 nt, Human
uguauuuaaauauu

SEQ ID NO: 2234128 - RNA, 13 nt, Human
acuaauuuuaaaa

SEQ ID NO: 2234129 - RNA, 20 nt, Human
agccuaguugaucagcuuau

SEQ ID NO: 2234130 - RNA, 15 nt, Human
uauuucauuucuuug

SEQ ID NO: 2234131 - RNA, 18 nt, Human
uuacaaaugggaaacaaa

SEQ ID NO: 2234132 - RNA, 14 nt, Human
agggauggcaagau

SEQ ID NO: 2234133 - RNA, 22 nt, Human
agucuuguauuaaguuguuaau

SEQ ID NO: 2234134 - RNA, 11 nt, Human
uugaaacugag

SEQ ID NO: 2234135 - RNA, 19 nt, Human
gguggacccagggaugaca

SEQ ID NO: 2234136 - RNA, 16 nt, Human
uauuuccauauuaaaa

SEQ ID NO: 2234137 - RNA, 17 nt, Human
auguuccuagugaaaga

SEQ ID NO: 2234138 - RNA, 17 nt, Human
aagggauggcaagaugu

SEQ ID NO: 2234139 - RNA, 17 nt, Human
cauuuguauaaaauaau

SEQ ID NO: 2234140 - RNA, 14 nt, Human
aaagagaacuucca

SEQ ID NO: 2234141 - RNA, 20 nt, Human
cuucugucuucacaacagau

SEQ ID NO: 2234142 - RNA, 12 nt, Human
auuccaauacau

SEQ ID NO: 2234143 - RNA, 12 nt, Human
aucuaauuuuua

SEQ ID NO: 2234144 - RNA, 17 nt, Human
gccuagccgaccucagc

SEQ ID NO: 2234145 - RNA, 20 nt, Human
caggugccaguuauggcuau

SEQ ID NO: 2234146 - RNA, 21 nt, Human
acaaaucuuaacuugaaggag

SEQ ID NO: 2234147 - RNA, 18 nt, Human
uagugaaguaugcacuaa

SEQ ID NO: 2234148 - RNA, 18 nt, Human
uguacuuuauuuucuaua

SEQ ID NO: 2234149 - RNA, 18 nt, Human
aguauauucaaaaauuau

SEQ ID NO: 2234150 - RNA, 17 nt, Human
gugaagaaacauuuauc

SEQ ID NO: 2234151 - RNA, 23 nt, Human
ucaggagaggggcagaacagccg

SEQ ID NO: 2234152 - RNA, 20 nt, Human
uaacaagccuccuuuuaaag

SEQ ID NO: 2234153 - RNA, 18 nt, Human
cuugcccagggcucagcc

SEQ ID NO: 2234154 - RNA, 15 nt, Human
uagauucccugagca

SEQ ID NO: 2234155 - RNA, 15 nt, Human
acaaaucuuaacuug

SEQ ID NO: 2234156 - RNA, 20 nt, Human
gaaagcaucauuauuugcag

SEQ ID NO: 2234157 - RNA, 18 nt, Human
uucagcaccuacagugua

SEQ ID NO: 2234158 - RNA, 13 nt, Human
cugcccuagagca

SEQ ID NO: 2234159 - RNA, 21 nt, Human
aaaagacuccaaagaaaugua

SEQ ID NO: 2234160 - RNA, 15 nt, Human
aggcagacagcagcu

SEQ ID NO: 2234161 - RNA, 16 nt, Human
aaguaaaaccacagca

SEQ ID NO: 2234162 - RNA, 11 nt, Human
uuuuuuuguuu

SEQ ID NO: 2234163 - RNA, 18 nt, Human
acaaauccaaugaaauga

SEQ ID NO: 2234164 - RNA, 17 nt, Human
cgagcaggcuacuguca

SEQ ID NO: 2234165 - RNA, 14 nt, Human
uuucugaugucaaa

SEQ ID NO: 2234166 - RNA, 18 nt, Human
uaauaauguuucaaacau

SEQ ID NO: 2234167 - RNA, 17 nt, Human
agauucccugagcagga

SEQ ID NO: 2234168 - RNA, 14 nt, Human
auuauuuuuuaaaa

SEQ ID NO: 2234169 - RNA, 14 nt, Human
uauaauuuaaaaua

SEQ ID NO: 2234170 - RNA, 18 nt, Human
agccgcuccugucugcca

SEQ ID NO: 2234171 - RNA, 13 nt, Human
auuuuuuaaaaaa

SEQ ID NO: 2234172 - RNA, 21 nt, Human
caaaaguauauucaaaaauua

SEQ ID NO: 2234173 - RNA, 16 nt, Human
uuguguguuauuuaaa

SEQ ID NO: 2234174 - RNA, 19 nt, Human
agccgcuccugucugccag

SEQ ID NO: 2234175 - RNA, 14 nt, Human
uagccgaccucagc

SEQ ID NO: 2234176 - RNA, 22 nt, Human
gaccaauauuguacaguuuuua

SEQ ID NO: 2234177 - RNA, 19 nt, Human
uaacauaagcuagaaaaau

SEQ ID NO: 2234178 - RNA, 16 nt, Human
ggcagggucaggagag

SEQ ID NO: 2234179 - RNA, 15 nt, Human
cucgugggacaguca

SEQ ID NO: 2234180 - RNA, 13 nt, Human
aaaugggaaacaa

SEQ ID NO: 2234181 - RNA, 12 nt, Human
aauacuuuauaa

SEQ ID NO: 2234182 - RNA, 20 nt, Human
cauuuuucagauauaaaaga

SEQ ID NO: 2234183 - RNA, 22 nt, Human
aauuuucuagaauacuaauaaa

SEQ ID NO: 2234184 - RNA, 17 nt, Human
aucaaggguacacugcc

SEQ ID NO: 2234185 - RNA, 15 nt, Human
aucacaaaucuuaac

SEQ ID NO: 2234186 - RNA, 23 nt, Human
uccaacuaucucauuuccaagca

SEQ ID NO: 2234187 - RNA, 22 nt, Human
agcuuguauuccuuuuucucuc

SEQ ID NO: 2234188 - RNA, 15 nt, Human
ucuuauaauuuaaaa

SEQ ID NO: 2234189 - RNA, 23 nt, Human
uguucucuucuuuaaagggaugg

SEQ ID NO: 2234190 - RNA, 18 nt, Human
auuaaguuuuuuuuuaaa

SEQ ID NO: 2234191 - RNA, 12 nt, Human
cuugguuuuaau

SEQ ID NO: 2234192 - RNA, 14 nt, Human
aaagaugaaaauau

SEQ ID NO: 2234193 - RNA, 14 nt, Human
acauagugaggagc

SEQ ID NO: 2234194 - RNA, 13 nt, Human
aacaauaaaagac

SEQ ID NO: 2234195 - RNA, 19 nt, Human
guuauuauauuuacaaaug

SEQ ID NO: 2234196 - RNA, 21 nt, Human
gggcucagccuggugggccuc

SEQ ID NO: 2234197 - RNA, 20 nt, Human
gccauuuaaagcuuauuaaa

SEQ ID NO: 2234198 - RNA, 15 nt, Human
aaucacaaacucauc

SEQ ID NO: 2234199 - RNA, 13 nt, Human
uuggacgagaaaa

SEQ ID NO: 2234200 - RNA, 15 nt, Human
uucagauauaaaaga

SEQ ID NO: 2234201 - RNA, 12 nt, Human
ugcuuuuaaaaa

SEQ ID NO: 2234202 - RNA, 16 nt, Human
aaagacaaggaaaaaa

SEQ ID NO: 2234203 - RNA, 23 nt, Human
auuccuuagcuuagaccucagcc

SEQ ID NO: 2234204 - RNA, 19 nt, Human
aaagacagugaaagaaaau

SEQ ID NO: 2234205 - RNA, 20 nt, Human
ucucccagucauuuaauaaa

SEQ ID NO: 2234206 - RNA, 20 nt, Human
gaaaauaacgauaaaagaca

SEQ ID NO: 2234207 - RNA, 16 nt, Human
ugaaguccaagcauuu

SEQ ID NO: 2234208 - RNA, 14 nt, Human
ucccuugaugaaga

SEQ ID NO: 2234209 - RNA, 21 nt, Human
aaguuuaugguuguauuauuu

SEQ ID NO: 2234210 - RNA, 12 nt, Human
uguuugaaagcu

SEQ ID NO: 2234211 - RNA, 21 nt, Human
uuguuuuuccuuguauuuaaa

SEQ ID NO: 2234212 - RNA, 15 nt, Human
accccuccccugccc

SEQ ID NO: 2234213 - RNA, 12 nt, Human
acauaaaauaca

SEQ ID NO: 2234214 - RNA, 18 nt, Human
ugcauagguuuaauaauu

SEQ ID NO: 2234215 - RNA, 15 nt, Human
acaaggaaaaaauaa

SEQ ID NO: 2234216 - RNA, 15 nt, Human
gauauaaaagacuga

SEQ ID NO: 2234217 - RNA, 21 nt, Human
aggcagacagcagcucaggca

SEQ ID NO: 2234218 - RNA, 18 nt, Human
gccuuggggcugaugcag

SEQ ID NO: 2234219 - RNA, 14 nt, Human
augggccauaugaa

SEQ ID NO: 2234220 - RNA, 11 nt, Human
uucacagggga

SEQ ID NO: 2234221 - RNA, 15 nt, Human
ccagcacagccucuu

SEQ ID NO: 2234222 - RNA, 15 nt, Human
uuauacgauaaauaa

SEQ ID NO: 2234223 - RNA, 14 nt, Human
guaacugauuugua

SEQ ID NO: 2234224 - RNA, 12 nt, Human
cauuuuaaaaaa

SEQ ID NO: 2234225 - RNA, 18 nt, Human
aaagacuuuuuuuuauac

SEQ ID NO: 2234226 - RNA, 24 nt, Human
aaaauuccuuagcuuagaccucag

SEQ ID NO: 2234227 - RNA, 22 nt, Human
aaagacugaccaauauuguaca

SEQ ID NO: 2234228 - RNA, 16 nt, Human
cacagccagacuggca

SEQ ID NO: 2234229 - RNA, 15 nt, Human
uuauagcuacuaauu

SEQ ID NO: 2234230 - RNA, 15 nt, Human
ugacuucuaaguaaa

SEQ ID NO: 2234231 - RNA, 17 nt, Human
uguuuaaaaucauuucu

SEQ ID NO: 2234232 - RNA, 16 nt, Human
aacuugguuuuaauua

SEQ ID NO: 2234233 - RNA, 20 nt, Human
auacauuauuggacuuccau

SEQ ID NO: 2234234 - RNA, 17 nt, Human
uccuugcaucaauuuuu

SEQ ID NO: 2234235 - RNA, 14 nt, Human
cagagacaggaccu

SEQ ID NO: 2234236 - RNA, 15 nt, Human
ggagagaagauagca

SEQ ID NO: 2234237 - RNA, 16 nt, Human
auugcuuguuggauuu

SEQ ID NO: 2234238 - RNA, 15 nt, Human
auuggacuuccauuu

SEQ ID NO: 2234239 - RNA, 16 nt, Human
ucacaaaucuuaacuu

SEQ ID NO: 2234240 - RNA, 24 nt, Human
gacccacuucacacacaggcaacu

SEQ ID NO: 2234241 - RNA, 18 nt, Human
ucacaaaaguauauucaa

SEQ ID NO: 2234242 - RNA, 22 nt, Human
ugaguuuuucuuuucauuuacc

SEQ ID NO: 2234243 - RNA, 18 nt, Human
gaaacugccagcaacgca

SEQ ID NO: 2234244 - RNA, 16 nt, Human
agucucaggaaaucaa

SEQ ID NO: 2234245 - RNA, 18 nt, Human
gugaaguaugcacuaauc

SEQ ID NO: 2234246 - RNA, 15 nt, Human
uauuuaaauauuaaa

SEQ ID NO: 2234247 - RNA, 16 nt, Human
aagaaaauaacaauaa

SEQ ID NO: 2234248 - RNA, 18 nt, Human
uaaaagacaaggaaaaaa

SEQ ID NO: 2234249 - RNA, 23 nt, Human
uauguuaaaacugggacagggga

SEQ ID NO: 2234250 - RNA, 18 nt, Human
uauuuucaguuauuauau

SEQ ID NO: 2234251 - RNA, 17 nt, Human
cuuguguuucuuuaguu

SEQ ID NO: 2234252 - RNA, 12 nt, Human
ggcugaugcagu

SEQ ID NO: 2234253 - RNA, 22 nt, Human
agugagcagucaggaaagagaa

SEQ ID NO: 2234254 - RNA, 21 nt, Human
ccuuuuuuugaaaaaaagcuu

SEQ ID NO: 2234255 - RNA, 17 nt, Human
uuaucucaaaacugcac

SEQ ID NO: 2234256 - RNA, 18 nt, Human
uagaaggguaccuugaac

SEQ ID NO: 2234257 - RNA, 12 nt, Human
gcaguugaaaag

SEQ ID NO: 2234258 - RNA, 20 nt, Human
cagacuggcacaguuuucug

SEQ ID NO: 2234259 - RNA, 19 nt, Human
auaaaauacauacuauaga

SEQ ID NO: 2234260 - RNA, 18 nt, Human
auggggguaauaagagca

SEQ ID NO: 2234261 - RNA, 15 nt, Human
aagccuccuuuuaaa

SEQ ID NO: 2234262 - RNA, 22 nt, Human
caaaugggaaacaaaaggauaa

SEQ ID NO: 2234263 - RNA, 17 nt, Human
agagacucagggcccca

SEQ ID NO: 2234264 - RNA, 15 nt, Human
aaggaauuuaaaaau

SEQ ID NO: 2234265 - RNA, 16 nt, Human
augcuguauuuuaaaa

SEQ ID NO: 2234266 - RNA, 20 nt, Human
aggcagggucaggagagggg

SEQ ID NO: 2234267 - RNA, 21 nt, Human
caucuagcaugucgucaaagc

SEQ ID NO: 2234268 - RNA, 19 nt, Human
acuaucucauuuccaagca

SEQ ID NO: 2234269 - RNA, 15 nt, Human
ccacaggaaccacaa

SEQ ID NO: 2234270 - RNA, 22 nt, Human
ggacccagggaugacauguccc

SEQ ID NO: 2234271 - RNA, 21 nt, Human
uguucacagccagacuggcac

SEQ ID NO: 2234272 - RNA, 14 nt, Human
uuccauauuaaaau

SEQ ID NO: 2234273 - RNA, 16 nt, Human
aagacugcacaucaaa

SEQ ID NO: 2234274 - RNA, 17 nt, Human
augauuaaguaaugaua

SEQ ID NO: 2234275 - RNA, 19 nt, Human
gcugaaacaacaaauagga

SEQ ID NO: 2234276 - RNA, 18 nt, Human
ugagugucuuaauuaaaa

SEQ ID NO: 2234277 - RNA, 17 nt, Human
uuauauuugaaauauug

SEQ ID NO: 2234278 - RNA, 22 nt, Human
gcucagccuggugggccuccuc

SEQ ID NO: 2234279 - RNA, 17 nt, Human
aacucgaaucacucauu

SEQ ID NO: 2234280 - RNA, 11 nt, Human
agccagcagcc

SEQ ID NO: 2234281 - RNA, 16 nt, Human
auuccaauacauuauu

SEQ ID NO: 2234282 - RNA, 17 nt, Human
ugguaggacuguagaaa

SEQ ID NO: 2234283 - RNA, 15 nt, Human
auaauaaaauucauu

SEQ ID NO: 2234284 - RNA, 17 nt, Human
ucauuuuaaaaaaugga

SEQ ID NO: 2234285 - RNA, 16 nt, Human
cuccugucugccagcc

SEQ ID NO: 2234286 - RNA, 20 nt, Human
aguuguuucuacuacaugga

SEQ ID NO: 2234287 - RNA, 16 nt, Human
uuucuauaauuuaaau

SEQ ID NO: 2234288 - RNA, 14 nt, Human
gaccacaagcaggc

SEQ ID NO: 2234289 - RNA, 14 nt, Human
caaggaaaaaauaa

SEQ ID NO: 2234290 - RNA, 17 nt, Human
acucagggccccagcac

SEQ ID NO: 2234291 - RNA, 15 nt, Human
gucugccagccagca

SEQ ID NO: 2234292 - RNA, 17 nt, Human
ugcuacaaaaacacagc

SEQ ID NO: 2234293 - RNA, 19 nt, Human
gccuagccgaccucagccu

SEQ ID NO: 2234294 - RNA, 16 nt, Human
uauaugucacuuugcu

SEQ ID NO: 2234295 - RNA, 23 nt, Human
uugacuuauuuauauaaauuuuu

SEQ ID NO: 2234296 - RNA, 20 nt, Human
auacugugugcuaaaacaag

SEQ ID NO: 2234297 - RNA, 13 nt, Human
aacucauccauua

SEQ ID NO: 2234298 - RNA, 13 nt, Human
uuaaaaaagaaac

SEQ ID NO: 2234299 - RNA, 20 nt, Human
aaugaauacuuuauaaagga

SEQ ID NO: 2234300 - RNA, 23 nt, Human
agcccaaagugguauagaaaugc

SEQ ID NO: 2234301 - RNA, 13 nt, Human
ugaaagaaaauaa

SEQ ID NO: 2234302 - RNA, 21 nt, Human
ucagccuuccccuugcccagg

SEQ ID NO: 2234303 - RNA, 13 nt, Human
uaaguuguuaaua

SEQ ID NO: 2234304 - RNA, 15 nt, Human
ccucagccuuccccu

SEQ ID NO: 2234305 - RNA, 13 nt, Human
gaacauaaaauac

SEQ ID NO: 2234306 - RNA, 15 nt, Human
ucauuuauuuccaua

SEQ ID NO: 2234307 - RNA, 17 nt, Human
uaaaagacaaggaaaaa

SEQ ID NO: 2234308 - RNA, 14 nt, Human
uuagaauauuaaaa

SEQ ID NO: 2234309 - RNA, 18 nt, Human
acaguuuucugagaaaga

SEQ ID NO: 2234310 - RNA, 22 nt, Human
acugauguuccuagugaaagag

SEQ ID NO: 2234311 - RNA, 14 nt, Human
gaugugggcaguga

SEQ ID NO: 2234312 - RNA, 15 nt, Human
uucugagaaagacua

SEQ ID NO: 2234313 - RNA, 12 nt, Human
gagagaagauag

SEQ ID NO: 2234314 - RNA, 22 nt, Human
auuuucuucucacauuuauauu

SEQ ID NO: 2234315 - RNA, 17 nt, Human
agcuugcccuguuaaaa

SEQ ID NO: 2234316 - RNA, 14 nt, Human
ugucuuaauuaaaa

SEQ ID NO: 2234317 - RNA, 17 nt, Human
uuaccuuuguucccaaa

SEQ ID NO: 2234318 - RNA, 21 nt, Human
gaaaugaguuuuucuuuucau

SEQ ID NO: 2234319 - RNA, 17 nt, Human
caaauccaaugaaauga

SEQ ID NO: 2234320 - RNA, 15 nt, Human
acaaaugggaaacaa

SEQ ID NO: 2234321 - RNA, 17 nt, Human
uaacugauuuguaacaa

SEQ ID NO: 2234322 - RNA, 12 nt, Human
acagggacccac

SEQ ID NO: 2234323 - RNA, 14 nt, Human
cucaacaaacauaa

SEQ ID NO: 2234324 - RNA, 23 nt, Human
uaacgauaaaagacagugaaaga

SEQ ID NO: 2234325 - RNA, 13 nt, Human
aucauccucaggc

SEQ ID NO: 2234326 - RNA, 15 nt, Human
auauucaaaaauuau

SEQ ID NO: 2234327 - RNA, 14 nt, Human
cuacaccccucccc

SEQ ID NO: 2234328 - RNA, 17 nt, Human
uguaaaggaauuuaaaa

SEQ ID NO: 2234329 - RNA, 23 nt, Human
auaauguguucauucuggaauaa

SEQ ID NO: 2234330 - RNA, 17 nt, Human
augcugguuuuucaguu

SEQ ID NO: 2234331 - RNA, 13 nt, Human
aggauaagaggga

SEQ ID NO: 2234332 - RNA, 16 nt, Human
uaaaugugcuuuuaaa

SEQ ID NO: 2234333 - RNA, 19 nt, Human
ugaacacugggggagggga

SEQ ID NO: 2234334 - RNA, 18 nt, Human
aagucuuucacauuuaaa

SEQ ID NO: 2234335 - RNA, 15 nt, Human
cuuaagaagacugca

SEQ ID NO: 2234336 - RNA, 21 nt, Human
acucauuuauuuccauauuaa

SEQ ID NO: 2234337 - RNA, 17 nt, Human
uaccuugaacacugggg

SEQ ID NO: 2234338 - RNA, 14 nt, Human
cuuauuuauauaaa

SEQ ID NO: 2234339 - RNA, 15 nt, Human
agcauuacagugggu

SEQ ID NO: 2234340 - RNA, 18 nt, Human
cauagguuuaauaauuuu

SEQ ID NO: 2234341 - RNA, 14 nt, Human
uaaaauccauacau

SEQ ID NO: 2234342 - RNA, 18 nt, Human
gaaaauaucacuugucaa

SEQ ID NO: 2234343 - RNA, 20 nt, Human
ugagagacacacugaagaag

SEQ ID NO: 2234344 - RNA, 17 nt, Human
agcuuauuaaaacucau

SEQ ID NO: 2234345 - RNA, 23 nt, Human
caccucaaaauaccaugccauuu

SEQ ID NO: 2234346 - RNA, 14 nt, Human
gucuucacaacaga

SEQ ID NO: 2234347 - RNA, 16 nt, Human
aaaauccauacauuug

SEQ ID NO: 2234348 - RNA, 15 nt, Human
uagauaggccauggg

SEQ ID NO: 2234349 - RNA, 23 nt, Human
uauggcauauugauaauaaaauu

SEQ ID NO: 2234350 - RNA, 15 nt, Human
ggucaggagaggggc

SEQ ID NO: 2234351 - RNA, 14 nt, Human
aauacauacuauag

SEQ ID NO: 2234352 - RNA, 15 nt, Human
uagccgaccucagcc

SEQ ID NO: 2234353 - RNA, 16 nt, Human
cauuguaaaugugcuu

SEQ ID NO: 2234354 - RNA, 21 nt, Human
auuuauuuccauauuaaaauc

SEQ ID NO: 2234355 - RNA, 21 nt, Human
auuuguauaaaauaauuuuua

SEQ ID NO: 2234356 - RNA, 11 nt, Human
caauaaaagac

SEQ ID NO: 2234357 - RNA, 22 nt, Human
cuuuccacagaagcuccaggua

SEQ ID NO: 2234358 - RNA, 13 nt, Human
cagggcucagccu

SEQ ID NO: 2234359 - RNA, 18 nt, Human
gaugaucuuuaaaauaca

SEQ ID NO: 2234360 - RNA, 21 nt, Human
aacagucucaggaaaucaaau

SEQ ID NO: 2234361 - RNA, 13 nt, Human
ugaaacaacaaau

SEQ ID NO: 2234362 - RNA, 23 nt, Human
agaaugauuaugaauuacauuug

SEQ ID NO: 2234363 - RNA, 17 nt, Human
uuaauaauuuuuaauua

SEQ ID NO: 2234364 - RNA, 14 nt, Human
ugcccuguuaaaag

SEQ ID NO: 2234365 - RNA, 11 nt, Human
cauuucucugg

SEQ ID NO: 2234366 - RNA, 14 nt, Human
auuuauguuuaauu

SEQ ID NO: 2234367 - RNA, 17 nt, Human
aacugccagcaacgcag

SEQ ID NO: 2234368 - RNA, 18 nt, Human
ugucuuaauuaaaagaau

SEQ ID NO: 2234369 - RNA, 22 nt, Human
uguagugaaucacguaaagcua

SEQ ID NO: 2234370 - RNA, 19 nt, Human
cuugcccuguuaaaagaug

SEQ ID NO: 2234371 - RNA, 12 nt, Human
cgggaaggaggg

SEQ ID NO: 2234372 - RNA, 13 nt, Human
uuaaauuguaaua

SEQ ID NO: 2234373 - RNA, 15 nt, Human
aagacgugauuuugc

SEQ ID NO: 2234374 - RNA, 19 nt, Human
aucauuauuugcagagaca

SEQ ID NO: 2234375 - RNA, 20 nt, Human
accucugccucagaaaacaa

SEQ ID NO: 2234376 - RNA, 14 nt, Human
caugccauuuaaag

SEQ ID NO: 2234377 - RNA, 17 nt, Human
acaaaugggaaacaaaa

SEQ ID NO: 2234378 - RNA, 22 nt, Human
augguuguauuauuuuuuaaaa

SEQ ID NO: 2234379 - RNA, 16 nt, Human
uugucaauaaaaucca

SEQ ID NO: 2234380 - RNA, 21 nt, Human
cauacuauagauucuuuauua

SEQ ID NO: 2234381 - RNA, 22 nt, Human
augccauuuaaagcuuauuaaa

SEQ ID NO: 2234382 - RNA, 22 nt, Human
uuguaacaagccuccuuuuaaa

SEQ ID NO: 2234383 - RNA, 23 nt, Human
aaaauaucacuugucaauaaaau

SEQ ID NO: 2234384 - RNA, 21 nt, Human
caccagucugacuguuuccau

SEQ ID NO: 2234385 - RNA, 13 nt, Human
ucaaacagucuca

SEQ ID NO: 2234386 - RNA, 17 nt, Human
uucucuaggaaauauuu

SEQ ID NO: 2234387 - RNA, 23 nt, Human
acugucuuguuggacgagaaaac

SEQ ID NO: 2234388 - RNA, 22 nt, Human
agaaaacaauaacgauaaaaga

SEQ ID NO: 2234389 - RNA, 13 nt, Human
gcuacaaaaacac

SEQ ID NO: 2234390 - RNA, 19 nt, Human
aaaagacagugaaagaaaa

SEQ ID NO: 2234391 - RNA, 16 nt, Human
auaauccuaaacauau

SEQ ID NO: 2234392 - RNA, 19 nt, Human
cacagcaguugaaaagacu

SEQ ID NO: 2234393 - RNA, 22 nt, Human
acaccuuguacuuuauuuucua

SEQ ID NO: 2234394 - RNA, 15 nt, Human
agugucuuaauuaaa

SEQ ID NO: 2234395 - RNA, 19 nt, Human
gauucccugagcaggauuu

SEQ ID NO: 2234396 - RNA, 19 nt, Human
aagcuuguauuccuuuuuc

SEQ ID NO: 2234397 - RNA, 20 nt, Human
aauuuuucuuauuucauuuc

SEQ ID NO: 2234398 - RNA, 17 nt, Human
guaaaugugcuuuuaaa

SEQ ID NO: 2234399 - RNA, 19 nt, Human
caucaaggguacacugccu

SEQ ID NO: 2234400 - RNA, 13 nt, Human
aaucaauacuuug

SEQ ID NO: 2234401 - RNA, 18 nt, Human
auuauuggacuuccauuu

SEQ ID NO: 2234402 - RNA, 19 nt, Human
acuuaagguuaccuuuguu

SEQ ID NO: 2234403 - RNA, 23 nt, Human
auuuuaaaaaauggaacauaaaa

SEQ ID NO: 2234404 - RNA, 23 nt, Human
caaagcugaaauggacuuuugua

SEQ ID NO: 2234405 - RNA, 21 nt, Human
aaaugucuugcuugauuguau

SEQ ID NO: 2234406 - RNA, 15 nt, Human
aaagaggcagcuuga

SEQ ID NO: 2234407 - RNA, 16 nt, Human
caaacugaagccagaa

SEQ ID NO: 2234408 - RNA, 18 nt, Human
caguuguugcccacagcu

SEQ ID NO: 2234409 - RNA, 22 nt, Human
uacagaauucugcuaccucacu

SEQ ID NO: 2234410 - RNA, 15 nt, Human
gacugaauuucuaug

SEQ ID NO: 2234411 - RNA, 14 nt, Human
ccuugaugaagaag

SEQ ID NO: 2234412 - RNA, 23 nt, Human
ugauaauaaaauucauuccauuu

SEQ ID NO: 2234413 - RNA, 16 nt, Human
cucgugguaggacugu

SEQ ID NO: 2234414 - RNA, 18 nt, Human
uaaauauguuagcaaaga

SEQ ID NO: 2234415 - RNA, 23 nt, Human
uaaguuuuuuuuuaaaaaagaaa

SEQ ID NO: 2234416 - RNA, 15 nt, Human
aauucugaaagcaac

SEQ ID NO: 2234417 - RNA, 18 nt, Human
gcuccauuuuuagugaaa

SEQ ID NO: 2234418 - RNA, 14 nt, Human
ucauccgaggcagg

SEQ ID NO: 2234419 - RNA, 21 nt, Human
ggcucagccuggugggccucc

SEQ ID NO: 2234420 - RNA, 14 nt, Human
uugugauugauuau

SEQ ID NO: 2234421 - RNA, 20 nt, Human
aaaagacagugaaagaaaau

SEQ ID NO: 2234422 - RNA, 17 nt, Human
cuagccgaccucagccu

SEQ ID NO: 2234423 - RNA, 16 nt, Human
uguacaguuuuuauug

SEQ ID NO: 2234424 - RNA, 18 nt, Human
uauagcuacuaauuuuaa

SEQ ID NO: 2234425 - RNA, 20 nt, Human
auagcagggcauggcuggga

SEQ ID NO: 2234426 - RNA, 20 nt, Human
agcuucacuguaaaauaaua

SEQ ID NO: 2234427 - RNA, 23 nt, Human
guggugggacagggacccacuuc

SEQ ID NO: 2234428 - RNA, 17 nt, Human
cugucugccagccagca

SEQ ID NO: 2234429 - RNA, 20 nt, Human
aguaugcacuaaucaauacu

SEQ ID NO: 2234430 - RNA, 13 nt, Human
uggacgagaaaac

SEQ ID NO: 2234431 - RNA, 17 nt, Human
aauucuugccaaauaua

SEQ ID NO: 2234432 - RNA, 20 nt, Human
cagugggugccccccuugcc

SEQ ID NO: 2234433 - RNA, 23 nt, Human
aagagccuuuuuuugaaaaaaag

SEQ ID NO: 2234434 - RNA, 13 nt, Human
cuccugucugcca

SEQ ID NO: 2234435 - RNA, 16 nt, Human
aaauauaaauaaaaau

SEQ ID NO: 2234436 - RNA, 16 nt, Human
uuguaaaggaauuuaa

SEQ ID NO: 2234437 - RNA, 22 nt, Human
uuuauggcacuaguauuucuau

SEQ ID NO: 2234438 - RNA, 17 nt, Human
gacagugaaagaaaaua

SEQ ID NO: 2234439 - RNA, 20 nt, Human
aagacagugaaagaaaauaa

SEQ ID NO: 2234440 - RNA, 21 nt, Human
uuuucaggcuagauguaugua

SEQ ID NO: 2234441 - RNA, 22 nt, Human
ucaacuccaaacugacucuuaa

SEQ ID NO: 2234442 - RNA, 22 nt, Human
caaugcuguauuuuaaaagaau

SEQ ID NO: 2234443 - RNA, 16 nt, Human
auuuguauaaaauaau

SEQ ID NO: 2234444 - RNA, 21 nt, Human
aggcucuuuugggauuuuuga

SEQ ID NO: 2234445 - RNA, 20 nt, Human
guuaaacuuacuuaguguua

SEQ ID NO: 2234446 - RNA, 16 nt, Human
agugaaauauuauuuu

SEQ ID NO: 2234447 - RNA, 12 nt, Human
cagacagcagcu

SEQ ID NO: 2234448 - RNA, 16 nt, Human
auaaugaauacuuuau

SEQ ID NO: 2234449 - RNA, 19 nt, Human
gaaaauauuuguaucacaa

SEQ ID NO: 2234450 - RNA, 14 nt, Human
uuuguauaaaauaa

SEQ ID NO: 2234451 - RNA, 12 nt, Human
auucugaaagca

SEQ ID NO: 2234452 - RNA, 13 nt, Human
aaaaguauauuca

SEQ ID NO: 2234453 - RNA, 14 nt, Human
aaaggaauuuaaaa

SEQ ID NO: 2234454 - RNA, 16 nt, Human
ggauuuuugucuugug

SEQ ID NO: 2234455 - RNA, 20 nt, Human
cagauguaaaagacuuuuuu

SEQ ID NO: 2234456 - RNA, 17 nt, Human
guauuauuuuuuaaaaa

SEQ ID NO: 2234457 - RNA, 16 nt, Human
uuuuaaaaaaaaauac

SEQ ID NO: 2234458 - RNA, 14 nt, Human
ugugccuucauuuu

SEQ ID NO: 2234459 - RNA, 15 nt, Human
aguaugcacuaauca

SEQ ID NO: 2234460 - RNA, 16 nt, Human
uuaaagcuuauuaaaa

SEQ ID NO: 2234461 - RNA, 22 nt, Human
aaucacucauuuauuuccauau

SEQ ID NO: 2234462 - RNA, 23 nt, Human
aagggaacugaacauuccagagc

SEQ ID NO: 2234463 - RNA, 12 nt, Human
aagaaaauaaca

SEQ ID NO: 2234464 - RNA, 15 nt, Human
acuccaaagaaaugu

SEQ ID NO: 2234465 - RNA, 16 nt, Human
cagagacucagggccc

SEQ ID NO: 2234466 - RNA, 18 nt, Human
gccagacuggcacaguuu

SEQ ID NO: 2234467 - RNA, 21 nt, Human
aauaauccucaguuuuuguga

SEQ ID NO: 2234468 - RNA, 23 nt, Human
ggcuaagcuucacuguaaaauaa

SEQ ID NO: 2234469 - RNA, 17 nt, Human
aaagcuccauuuuuagu

SEQ ID NO: 2234470 - RNA, 22 nt, Human
aaacauguuuaucguauuugau

SEQ ID NO: 2234471 - RNA, 19 nt, Human
gaaaauaacgauaaaagac

SEQ ID NO: 2234472 - RNA, 18 nt, Human
cugaccaauauuguacag

SEQ ID NO: 2234473 - RNA, 16 nt, Human
gcuuagaccucagccu

SEQ ID NO: 2234474 - RNA, 19 nt, Human
caaaucuuaacuugaagga

SEQ ID NO: 2234475 - RNA, 14 nt, Human
aaaagaaacauuug

SEQ ID NO: 2234476 - RNA, 15 nt, Human
acucagggccccagc

SEQ ID NO: 2234477 - RNA, 14 nt, Human
auuaauuuguaaga

SEQ ID NO: 2234478 - RNA, 23 nt, Human
uccaaacugacucuuaagaagac

SEQ ID NO: 2234479 - RNA, 15 nt, Human
ccugucugccagcca

SEQ ID NO: 2234480 - RNA, 16 nt, Human
ucuugagguaaaagca

SEQ ID NO: 2234481 - RNA, 22 nt, Human
gaugguucccuugaugaagaag

SEQ ID NO: 2234482 - RNA, 14 nt, Human
caggcuacugucag

SEQ ID NO: 2234483 - RNA, 13 nt, Human
guaacuaauuuua

SEQ ID NO: 2234484 - RNA, 17 nt, Human
cuagaauacuaauaaaa

SEQ ID NO: 2234485 - RNA, 18 nt, Human
uuuuauuguuuaaaauca

SEQ ID NO: 2234486 - RNA, 20 nt, Human
ggagaagagcuguucacagc

SEQ ID NO: 2234487 - RNA, 15 nt, Human
auuucuaugaaauau

SEQ ID NO: 2234488 - RNA, 22 nt, Human
aaagagugaaggauuuauguuu

SEQ ID NO: 2234489 - RNA, 20 nt, Human
ucauucacucaacaaacaua

SEQ ID NO: 2234490 - RNA, 13 nt, Human
uuugcuguagaag

SEQ ID NO: 2234491 - RNA, 14 nt, Human
uauuuauuuuaaua

SEQ ID NO: 2234492 - RNA, 16 nt, Human
auuguuuaaaaucauu

SEQ ID NO: 2234493 - RNA, 16 nt, Human
aagaugaaaauauuug

SEQ ID NO: 2234494 - RNA, 12 nt, Human
ucuuuaaaauac

SEQ ID NO: 2234495 - RNA, 12 nt, Human
gcuuucuaucua

SEQ ID NO: 2234496 - RNA, 17 nt, Human
aagagggauuagggaga

SEQ ID NO: 2234497 - RNA, 15 nt, Human
gcaaauuccaauaca

SEQ ID NO: 2234498 - RNA, 19 nt, Human
aggucuaccaaaaaucuca

SEQ ID NO: 2234499 - RNA, 13 nt, Human
aggauuugaaauu

SEQ ID NO: 2234500 - RNA, 18 nt, Human
cagcuuauugucuaguga

SEQ ID NO: 2234501 - RNA, 20 nt, Human
uuguuucauugacuaucaaa

SEQ ID NO: 2234502 - RNA, 15 nt, Human
agaaacauuuaucuu

SEQ ID NO: 2234503 - RNA, 21 nt, Human
uaauaggcguaacuaauuuua

SEQ ID NO: 2234504 - RNA, 17 nt, Human
cucgugggacagucacc

SEQ ID NO: 2234505 - RNA, 13 nt, Human
ccagcacagccuc

SEQ ID NO: 2234506 - RNA, 17 nt, Human
uuccuuagcuuagaccu

SEQ ID NO: 2234507 - RNA, 15 nt, Human
cucaacaaacauaau

SEQ ID NO: 2234508 - RNA, 11 nt, Human
acugggacagg

SEQ ID NO: 2234509 - RNA, 12 nt, Human
aacacaucagcu

SEQ ID NO: 2234510 - RNA, 16 nt, Human
aaaagcuccauuuuua

SEQ ID NO: 2234511 - RNA, 18 nt, Human
uucugauauuggacagua

SEQ ID NO: 2234512 - RNA, 12 nt, Human
ggccccagcacu

SEQ ID NO: 2234513 - RNA, 15 nt, Human
cagagacucagggcc

SEQ ID NO: 2234514 - RNA, 14 nt, Human
uuucuaugaaauau

SEQ ID NO: 2234515 - RNA, 13 nt, Human
agggcucagccug

SEQ ID NO: 2234516 - RNA, 12 nt, Human
ggaaaucaaaua

SEQ ID NO: 2234517 - RNA, 12 nt, Human
aaaauuaauucu

SEQ ID NO: 2234518 - RNA, 13 nt, Human
caaaaacacagca

SEQ ID NO: 2234519 - RNA, 18 nt, Human
uugcaucaauuuuucuua

SEQ ID NO: 2234520 - RNA, 13 nt, Human
uauuuauuuuaau

SEQ ID NO: 2234521 - RNA, 15 nt, Human
uucacacacaggcaa

SEQ ID NO: 2234522 - RNA, 16 nt, Human
gcccagggcucagccu

SEQ ID NO: 2234523 - RNA, 19 nt, Human
ccugagcaggauuuuaauc

SEQ ID NO: 2234524 - RNA, 21 nt, Human
aguuguugcccacagcuguau

SEQ ID NO: 2234525 - RNA, 22 nt, Human
augacaugucccuacaccccuc

SEQ ID NO: 2234526 - RNA, 22 nt, Human
auacauuauuggacuuccauuu

SEQ ID NO: 2234527 - RNA, 22 nt, Human
uaaaauacacacucaaaucaag

SEQ ID NO: 2234528 - RNA, 16 nt, Human
ucucuaggaaauauuu

SEQ ID NO: 2234529 - RNA, 14 nt, Human
cuaagucuuauaua

SEQ ID NO: 2234530 - RNA, 17 nt, Human
cagcucaggcacacuuc

SEQ ID NO: 2234531 - RNA, 14 nt, Human
ugaaacaacaaaua

SEQ ID NO: 2234532 - RNA, 14 nt, Human
aaauguaagggaaa

SEQ ID NO: 2234533 - RNA, 19 nt, Human
uuauggcacuaguauuucu

SEQ ID NO: 2234534 - RNA, 16 nt, Human
augccauuuaaagcuu

SEQ ID NO: 2234535 - RNA, 16 nt, Human
agacucagggccccag

SEQ ID NO: 2234536 - RNA, 15 nt, Human
ucucccagucauuua

SEQ ID NO: 2234537 - RNA, 23 nt, Human
agggacuucugucuucacaacag

SEQ ID NO: 2234538 - RNA, 17 nt, Human
ugaugaucuuuaaaaua

SEQ ID NO: 2234539 - RNA, 16 nt, Human
auaacuggaaacuuca

SEQ ID NO: 2234540 - RNA, 20 nt, Human
uugauaaguacaugauaagc

SEQ ID NO: 2234541 - RNA, 23 nt, Human
cuacacgagauacagaauuuuau

SEQ ID NO: 2234542 - RNA, 19 nt, Human
agagccuuuuuuugaaaaa

SEQ ID NO: 2234543 - RNA, 16 nt, Human
agcuuagaccucagcc

SEQ ID NO: 2234544 - RNA, 16 nt, Human
aacaauaaaagacaag

SEQ ID NO: 2234545 - RNA, 17 nt, Human
ggaaauauuuauuuuaa

SEQ ID NO: 2234546 - RNA, 18 nt, Human
gaaucauaugggauacug

SEQ ID NO: 2234547 - RNA, 21 nt, Human
augaauacuuuauaaaggauu

SEQ ID NO: 2234548 - RNA, 14 nt, Human
cucugccucagaaa

SEQ ID NO: 2234549 - RNA, 13 nt, Human
gggcucagccugg

SEQ ID NO: 2234550 - RNA, 19 nt, Human
uauuuccauauuaaaauca

SEQ ID NO: 2234551 - RNA, 17 nt, Human
agucugacuguuuccau

SEQ ID NO: 2234552 - RNA, 18 nt, Human
aguucuccacuagcuaug

SEQ ID NO: 2234553 - RNA, 21 nt, Human
uauaaaauaauuuuuauauuu

SEQ ID NO: 2234554 - RNA, 13 nt, Human
acacacaugaagu

SEQ ID NO: 2234555 - RNA, 20 nt, Human
uguggugggacagggaccca

SEQ ID NO: 2234556 - RNA, 21 nt, Human
ccuugcccagggcucagccug

SEQ ID NO: 2234557 - RNA, 15 nt, Human
caaauaugcaaagca

SEQ ID NO: 2234558 - RNA, 20 nt, Human
auuuauuuccauauuaaaau

SEQ ID NO: 2234559 - RNA, 17 nt, Human
uuccccuugcccagggc

SEQ ID NO: 2234560 - RNA, 16 nt, Human
guuuuuuuuuaaaaaa

SEQ ID NO: 2234561 - RNA, 22 nt, Human
gaauuaaguuuuuuuuuaaaaa

SEQ ID NO: 2234562 - RNA, 18 nt, Human
ccaaccuggaguugaaaa

SEQ ID NO: 2234563 - RNA, 22 nt, Human
acugaggcagacagcagcucag

SEQ ID NO: 2234564 - RNA, 17 nt, Human
aaaaauccuacuuucau

SEQ ID NO: 2234565 - RNA, 20 nt, Human
aucacguaaagcuagaaaug

SEQ ID NO: 2234566 - RNA, 21 nt, Human
auguuuaauucugaaagcaac

SEQ ID NO: 2234567 - RNA, 23 nt, Human
ucuccauucccguggaacguuuu

SEQ ID NO: 2234568 - RNA, 16 nt, Human
agugguauagaaaugc

SEQ ID NO: 2234569 - RNA, 19 nt, Human
ugggacaggggagaaccua

SEQ ID NO: 2234570 - RNA, 20 nt, Human
uaaaugugcuuuuaaaaaaa

SEQ ID NO: 2234571 - RNA, 21 nt, Human
uguuggauuuuugucuugugu

SEQ ID NO: 2234572 - RNA, 14 nt, Human
acacaucagcuugc

SEQ ID NO: 2234573 - RNA, 19 nt, Human
cuaagcuucacuguaaaau

SEQ ID NO: 2234574 - RNA, 18 nt, Human
ucuaauuuuuauuaauuu

SEQ ID NO: 2234575 - RNA, 19 nt, Human
uucccuugaugaagaaguu

SEQ ID NO: 2234576 - RNA, 16 nt, Human
aguuguuaauaaaagu

SEQ ID NO: 2234577 - RNA, 24 nt, Human
cauaugaaaaggcuaagcuucacu

SEQ ID NO: 2234578 - RNA, 13 nt, Human
agccagcagccag

SEQ ID NO: 2234579 - RNA, 21 nt, Human
uuauuuucuauaauuuaaaua

SEQ ID NO: 2234580 - RNA, 20 nt, Human
augcaguuguugcccacagc

SEQ ID NO: 2234581 - RNA, 21 nt, Human
gccuuccccuugcccagggcu

SEQ ID NO: 2234582 - RNA, 15 nt, Human
uugcucauggaauug

SEQ ID NO: 2234583 - RNA, 17 nt, Human
caaacauauauaacaau

SEQ ID NO: 2234584 - RNA, 21 nt, Human
aggacagcccuucuuuccaca

SEQ ID NO: 2234585 - RNA, 16 nt, Human
aaaugggaaacaaaag

SEQ ID NO: 2234586 - RNA, 18 nt, Human
auucuugccaaauauaaa

SEQ ID NO: 2234587 - RNA, 15 nt, Human
uaaaagacaaggaaa

SEQ ID NO: 2234588 - RNA, 21 nt, Human
agcucgguggacccagggaug

SEQ ID NO: 2234589 - RNA, 13 nt, Human
cauccgaggcagg

SEQ ID NO: 2234590 - RNA, 19 nt, Human
gucaaauugugugaaaggu

SEQ ID NO: 2234591 - RNA, 21 nt, Human
cugaggcagacagcagcucag

SEQ ID NO: 2234592 - RNA, 13 nt, Human
uaauuuuuauauu

SEQ ID NO: 2234593 - RNA, 20 nt, Human
cagugaaagaaaauaacgau

SEQ ID NO: 2234594 - RNA, 20 nt, Human
aauaaaugugccuucauuuu

SEQ ID NO: 2234595 - RNA, 21 nt, Human
aagaaacuuaagguuaccuuu

SEQ ID NO: 2234596 - RNA, 15 nt, Human
aaguuggugacagau

SEQ ID NO: 2234597 - RNA, 19 nt, Human
aaagggauggcaagaugug

SEQ ID NO: 2234598 - RNA, 15 nt, Human
cacaggacagcccuu

SEQ ID NO: 2234599 - RNA, 19 nt, Human
auuguaguccuguaaugga

SEQ ID NO: 2234600 - RNA, 17 nt, Human
cucuuuugggauuuuug

SEQ ID NO: 2234601 - RNA, 18 nt, Human
auaauccuaaacauauga

SEQ ID NO: 2234602 - RNA, 15 nt, Human
gaaagaaaauaacga

SEQ ID NO: 2234603 - RNA, 22 nt, Human
uaaaaucauuucugcaucagcu

SEQ ID NO: 2234604 - RNA, 17 nt, Human
cucgguggacccaggga

SEQ ID NO: 2234605 - RNA, 13 nt, Human
caacugaggcaga

SEQ ID NO: 2234606 - RNA, 15 nt, Human
aaggaaaaaauaaca

SEQ ID NO: 2234607 - RNA, 23 nt, Human
auuuaaagcuuauuaaaacucau

SEQ ID NO: 2234608 - RNA, 13 nt, Human
aagcauuccaacu

SEQ ID NO: 2234609 - RNA, 18 nt, Human
uauugauaauaaaauuca

SEQ ID NO: 2234610 - RNA, 21 nt, Human
agccucuuagaugcaguucug

SEQ ID NO: 2234611 - RNA, 14 nt, Human
cuuucauaauaagu

SEQ ID NO: 2234612 - RNA, 13 nt, Human
agauagcagggca

SEQ ID NO: 2234613 - RNA, 14 nt, Human
accacaagacugca

SEQ ID NO: 2234614 - RNA, 14 nt, Human
acuaauuuuaaaau

SEQ ID NO: 2234615 - RNA, 16 nt, Human
gacuuuuuuuuauacg

SEQ ID NO: 2234616 - RNA, 19 nt, Human
guccaggucuaccaaaaau

SEQ ID NO: 2234617 - RNA, 15 nt, Human
ugucaauaaaaucca

SEQ ID NO: 2234618 - RNA, 14 nt, Human
aaauuaauucuuua

SEQ ID NO: 2234619 - RNA, 18 nt, Human
aaaacacagcaaggguga

SEQ ID NO: 2234620 - RNA, 20 nt, Human
caaauauaaauaaaaauaau

SEQ ID NO: 2234621 - RNA, 13 nt, Human
uauagaaaugcug

SEQ ID NO: 2234622 - RNA, 18 nt, Human
ucuagaauacuaauaaaa

SEQ ID NO: 2234623 - RNA, 13 nt, Human
uguacaguuuuua

SEQ ID NO: 2234624 - RNA, 20 nt, Human
ugauuauaugucacuuugcu

SEQ ID NO: 2234625 - RNA, 15 nt, Human
ugcugguuuuucagu

SEQ ID NO: 2234626 - RNA, 18 nt, Human
ucagauauaaaagacuga

SEQ ID NO: 2234627 - RNA, 17 nt, Human
agcacuaaagcagugga

SEQ ID NO: 2234628 - RNA, 13 nt, Human
ugugcuuuuaaaa

SEQ ID NO: 2234629 - RNA, 23 nt, Human
auaccuaucaucuuaaguaggga

SEQ ID NO: 2234630 - RNA, 15 nt, Human
auuuuuuuuguuuca

SEQ ID NO: 2234631 - RNA, 11 nt, Human
gaccucagccu

SEQ ID NO: 2234632 - RNA, 14 nt, Human
aaugauuaugaauu

SEQ ID NO: 2234633 - RNA, 22 nt, Human
uaagcaccuuuagaauauuaaa

SEQ ID NO: 2234634 - RNA, 13 nt, Human
cacauuuaaauaa

SEQ ID NO: 2234635 - RNA, 12 nt, Human
caguugaaaaga

SEQ ID NO: 2234636 - RNA, 22 nt, Human
auauaugcuaagucuuauauau

SEQ ID NO: 2234637 - RNA, 23 nt, Human
aguaauuggaaaggcagcucuaa

SEQ ID NO: 2234638 - RNA, 20 nt, Human
ucuuaauuaaaagaauauuu

SEQ ID NO: 2234639 - RNA, 22 nt, Human
auauaaauaaaaauaauccuca

SEQ ID NO: 2234640 - RNA, 19 nt, Human
aauauuuuaacuuccuugg

SEQ ID NO: 2234641 - RNA, 20 nt, Human
cacgagcaggcuacugucag

SEQ ID NO: 2234642 - RNA, 17 nt, Human
ccucacugggguccugg

SEQ ID NO: 2234643 - RNA, 18 nt, Human
acugugugcuaaaacaag

SEQ ID NO: 2234644 - RNA, 19 nt, Human
uguauacugugugcuaaaa

SEQ ID NO: 2234645 - RNA, 19 nt, Human
guuguauuauuuuuuaaaa

SEQ ID NO: 2234646 - RNA, 19 nt, Human
cauauuaaaaucacaaacu

SEQ ID NO: 2234647 - RNA, 19 nt, Human
uucuauugugcuuucuauc

SEQ ID NO: 2234648 - RNA, 16 nt, Human
ccagucauuuaauaaa

SEQ ID NO: 2234649 - RNA, 12 nt, Human
aauuuuaaaaug

SEQ ID NO: 2234650 - RNA, 19 nt, Human
auguaagggaaacugccag

SEQ ID NO: 2234651 - RNA, 15 nt, Human
cagaauucauucacu

SEQ ID NO: 2234652 - RNA, 16 nt, Human
acuuuuuuuuaaguua

SEQ ID NO: 2234653 - RNA, 17 nt, Human
ccaaaaaucucaauauu

SEQ ID NO: 2234654 - RNA, 15 nt, Human
ggaggguuagggagg

SEQ ID NO: 2234655 - RNA, 19 nt, Human
ugacuucuaaguaaaacca

SEQ ID NO: 2234656 - RNA, 20 nt, Human
uagggacuucugucuucaca

SEQ ID NO: 2234657 - RNA, 17 nt, Human
agggcauagaaguaaaa

SEQ ID NO: 2234658 - RNA, 22 nt, Human
ggugccccccuugccagacaug

SEQ ID NO: 2234659 - RNA, 14 nt, Human
caaaaauuauauuu

SEQ ID NO: 2234660 - RNA, 14 nt, Human
ugcucauggaauug

SEQ ID NO: 2234661 - RNA, 14 nt, Human
cuugagguaaaagc

SEQ ID NO: 2234662 - RNA, 20 nt, Human
uuuugugaagaaacauuuau

SEQ ID NO: 2234663 - RNA, 19 nt, Human
ucucagccaacgaguaauu

SEQ ID NO: 2234664 - RNA, 13 nt, Human
ucuuuaguuuuug

SEQ ID NO: 2234665 - RNA, 11 nt, Human
uuaaaaucauu

SEQ ID NO: 2234666 - RNA, 17 nt, Human
uaaaaguacauguuaaa

SEQ ID NO: 2234667 - RNA, 14 nt, Human
acaaauccaaugaa

SEQ ID NO: 2234668 - RNA, 21 nt, Human
agacuggcacaguuuucugag

SEQ ID NO: 2234669 - RNA, 23 nt, Human
uccuagugaaagaggcagcuuga

SEQ ID NO: 2234670 - RNA, 12 nt, Human
uacacauuuuuc

SEQ ID NO: 2234671 - RNA, 22 nt, Human
aucaucaagucuuucacauuua

SEQ ID NO: 2234672 - RNA, 21 nt, Human
augggaaagcauuguaaaugu

SEQ ID NO: 2234673 - RNA, 18 nt, Human
cagcuugcccuguuaaaa

SEQ ID NO: 2234674 - RNA, 19 nt, Human
ucugagcauuuaauaugga

SEQ ID NO: 2234675 - RNA, 20 nt, Human
aaagagugaaggauuuaugu

SEQ ID NO: 2234676 - RNA, 20 nt, Human
aauuuuuucucuaggaaaua

SEQ ID NO: 2234677 - RNA, 13 nt, Human
agcuugaaacuga

SEQ ID NO: 2234678 - RNA, 17 nt, Human
ccccaguuguuucuacu

SEQ ID NO: 2234679 - RNA, 17 nt, Human
gaggguuagggaggggu

SEQ ID NO: 2234680 - RNA, 16 nt, Human
uuuuauuguuuaaaau

SEQ ID NO: 2234681 - RNA, 16 nt, Human
cuuauaauuuaaaaua

SEQ ID NO: 2234682 - RNA, 16 nt, Human
aucaaauaugcaaagc

SEQ ID NO: 2234683 - RNA, 16 nt, Human
gcaguugaaaagacuc

SEQ ID NO: 2234684 - RNA, 15 nt, Human
caaggaaaaaauaac

SEQ ID NO: 2234685 - RNA, 19 nt, Human
agaaaauaacgauaaaaga

SEQ ID NO: 2234686 - RNA, 19 nt, Human
uuagcuuagaccucagccu

SEQ ID NO: 2234687 - RNA, 13 nt, Human
aagaauauuuuaa

SEQ ID NO: 2234688 - RNA, 19 nt, Human
aaaauaacaauaaaagaca

SEQ ID NO: 2234689 - RNA, 15 nt, Human
aaauuauauuuugaa

SEQ ID NO: 2234690 - RNA, 18 nt, Human
guuuuauuguuuaaaauc

SEQ ID NO: 2234691 - RNA, 16 nt, Human
auuagggagagaagau

SEQ ID NO: 2234692 - RNA, 13 nt, Human
gcccuguuaaaag

SEQ ID NO: 2234693 - RNA, 16 nt, Human
aacuggacugguucaa

SEQ ID NO: 2234694 - RNA, 13 nt, Human
cauuuuaaaaaau

SEQ ID NO: 2234695 - RNA, 16 nt, Human
ucaguuuuugugaaaa

SEQ ID NO: 2234696 - RNA, 11 nt, Human
gcucaggcaca

SEQ ID NO: 2234697 - RNA, 17 nt, Human
cugcuaccucacugggg

SEQ ID NO: 2234698 - RNA, 18 nt, Human
caccuuuagaauauuaaa

SEQ ID NO: 2234699 - RNA, 22 nt, Human
uuuaauaauguuucaaacauau

SEQ ID NO: 2234700 - RNA, 13 nt, Human
uaauaaaauucau

SEQ ID NO: 2234701 - RNA, 14 nt, Human
ccagggcucagccu

SEQ ID NO: 2234702 - RNA, 16 nt, Human
uagcuuagaccucagc

SEQ ID NO: 2234703 - RNA, 14 nt, Human
auaaauaaaaauaa

SEQ ID NO: 2234704 - RNA, 15 nt, Human
uguguguuauuuaaa

SEQ ID NO: 2234705 - RNA, 14 nt, Human
agcacuuggagcca

SEQ ID NO: 2234706 - RNA, 14 nt, Human
aaagacuccaaaga

SEQ ID NO: 2234707 - RNA, 23 nt, Human
aguacauguuaaacuuacuuagu

SEQ ID NO: 2234708 - RNA, 14 nt, Human
aaauauaaauaaaa

SEQ ID NO: 2234709 - RNA, 20 nt, Human
uguagaagauggcacuuaua

SEQ ID NO: 2234710 - RNA, 20 nt, Human
uuuuuauacgauaaauaacu

SEQ ID NO: 2234711 - RNA, 20 nt, Human
uucauugacuaucaaacuga

SEQ ID NO: 2234712 - RNA, 23 nt, Human
ugaauuauguuugcauguucacu

SEQ ID NO: 2234713 - RNA, 19 nt, Human
uaucucauuuccaagcaag

SEQ ID NO: 2234714 - RNA, 22 nt, Human
uguauuauuauucccauucuac

SEQ ID NO: 2234715 - RNA, 19 nt, Human
auaauuuuuauauuugaaa

SEQ ID NO: 2234716 - RNA, 21 nt, Human
gagcucgguggacccagggau

SEQ ID NO: 2234717 - RNA, 13 nt, Human
cucgguggaccca

SEQ ID NO: 2234718 - RNA, 17 nt, Human
gacaaggaaaaaauaac

SEQ ID NO: 2234719 - RNA, 19 nt, Human
auaaaagacaaggaaaaaa

SEQ ID NO: 2234720 - RNA, 13 nt, Human
uuaauuaaaagaa

SEQ ID NO: 2234721 - RNA, 12 nt, Human
gacagugaaaga

SEQ ID NO: 2234722 - RNA, 20 nt, Human
uuaaguuuuuuuuuaaaaaa

SEQ ID NO: 2234723 - RNA, 12 nt, Human
cauagaaguaaa

SEQ ID NO: 2234724 - RNA, 18 nt, Human
aaauuuucuagaauacua

SEQ ID NO: 2234725 - RNA, 18 nt, Human
aaauauuuauuuuaauaa

SEQ ID NO: 2234726 - RNA, 22 nt, Human
agaaugagagacacacugaaga

SEQ ID NO: 2234727 - RNA, 19 nt, Human
acauuuguauaaaauaauu

SEQ ID NO: 2234728 - RNA, 12 nt, Human
gaaaauaacaau

SEQ ID NO: 2234729 - RNA, 19 nt, Human
aaaagacuuuuuuuuauac

SEQ ID NO: 2234730 - RNA, 19 nt, Human
cccuacaccccuccccugc

SEQ ID NO: 2234731 - RNA, 15 nt, Human
auuauuuuuuaaaaa

SEQ ID NO: 2234732 - RNA, 21 nt, Human
auaaaugugccuucauuuuuu

SEQ ID NO: 2234733 - RNA, 15 nt, Human
auauuaaaaauuaau

SEQ ID NO: 2234734 - RNA, 13 nt, Human
ccuuccccuugcc

SEQ ID NO: 2234735 - RNA, 23 nt, Human
gcacaguuuucugagaaagacua

SEQ ID NO: 2234736 - RNA, 22 nt, Human
caagcauaccaacacgagcagg

SEQ ID NO: 2234737 - RNA, 20 nt, Human
uaaagcuuauuaaaacucau

SEQ ID NO: 2234738 - RNA, 13 nt, Human
ccagccagcagcc

SEQ ID NO: 2234739 - RNA, 15 nt, Human
gcuacaaaaacacag

SEQ ID NO: 2234740 - RNA, 18 nt, Human
acaaauaggaauuguuuu

SEQ ID NO: 2234741 - RNA, 16 nt, Human
ucauuuaauaaaugug

SEQ ID NO: 2234742 - RNA, 14 nt, Human
ugccccccuugcca

SEQ ID NO: 2234743 - RNA, 14 nt, Human
agcaaguauuagaa

SEQ ID NO: 2234744 - RNA, 21 nt, Human
uauuacuguaagaaaauauca

SEQ ID NO: 2234745 - RNA, 24 nt, Human
uaauuuaaaauaugcucuaaacau

SEQ ID NO: 2234746 - RNA, 14 nt, Human
uuaacuuccuugga

SEQ ID NO: 2234747 - RNA, 15 nt, Human
augguuguauuauuu

SEQ ID NO: 2234748 - RNA, 14 nt, Human
gcuacaaaaacaca

SEQ ID NO: 2234749 - RNA, 12 nt, Human
ccuguuaaaaga

SEQ ID NO: 2234750 - RNA, 14 nt, Human
uauuugaaauauug

SEQ ID NO: 2234751 - RNA, 22 nt, Human
uugaaaaucuuauaauuuaaaa

SEQ ID NO: 2234752 - RNA, 21 nt, Human
cuucuuuaaagggauggcaag

SEQ ID NO: 2234753 - RNA, 23 nt, Human
uaacuuuuuuuuaaguuacacau

SEQ ID NO: 2234754 - RNA, 23 nt, Human
uuagaugcaguucugaagaagau

SEQ ID NO: 2234755 - RNA, 15 nt, Human
uagaccucagccugu

SEQ ID NO: 2234756 - RNA, 12 nt, Human
cauuauauuuau

SEQ ID NO: 2234757 - RNA, 19 nt, Human
agggacaggauaagaggga

SEQ ID NO: 2234758 - RNA, 20 nt, Human
guacauguuaaacuuacuua

SEQ ID NO: 2234759 - RNA, 21 nt, Human
ucaauuuuucuuauuucauuu

SEQ ID NO: 2234760 - RNA, 19 nt, Human
gaugucacuagggcaggga

SEQ ID NO: 2234761 - RNA, 12 nt, Human
ugagaaagacua

SEQ ID NO: 2234762 - RNA, 21 nt, Human
uaaauaacuuuuuuuuaaguu

SEQ ID NO: 2234763 - RNA, 13 nt, Human
auaacuggaaacu

SEQ ID NO: 2234764 - RNA, 16 nt, Human
aagaaauguaagggaa

SEQ ID NO: 2234765 - RNA, 15 nt, Human
uuacacauuuuucag

SEQ ID NO: 2234766 - RNA, 23 nt, Human
cuugauaaauggcuuccuggcaa

SEQ ID NO: 2234767 - RNA, 22 nt, Human
ggguucagagacucagggcccc

SEQ ID NO: 2234768 - RNA, 16 nt, Human
auuuccauauuaaaau

SEQ ID NO: 2234769 - RNA, 14 nt, Human
uauuaauuuguaag

SEQ ID NO: 2234770 - RNA, 15 nt, Human
aacgauaaaagacag

SEQ ID NO: 2234771 - RNA, 20 nt, Human
acaguuuucugagaaagacu

SEQ ID NO: 2234772 - RNA, 12 nt, Human
uuuuuuuuaaaa

SEQ ID NO: 2234773 - RNA, 15 nt, Human
cuaguaauuggaaag

SEQ ID NO: 2234774 - RNA, 20 nt, Human
ucaaauaugcaaagcacuga

SEQ ID NO: 2234775 - RNA, 20 nt, Human
aagggcuguuauaaucuuuc

SEQ ID NO: 2234776 - RNA, 18 nt, Human
agaauauuaaaaauuaau

SEQ ID NO: 2234777 - RNA, 22 nt, Human
ggacagcccuucuuuccacaga

SEQ ID NO: 2234778 - RNA, 17 nt, Human
agucucaggaaaucaaa

SEQ ID NO: 2234779 - RNA, 18 nt, Human
augcugguuuuucaguuu

SEQ ID NO: 2234780 - RNA, 19 nt, Human
uggugaacuugguuuuaau

SEQ ID NO: 2234781 - RNA, 15 nt, Human
cagccagcacagccu

SEQ ID NO: 2234782 - RNA, 18 nt, Human
ccagcacuaaagcagugg

SEQ ID NO: 2234783 - RNA, 19 nt, Human
gguuuaauaauuuuuaauu

SEQ ID NO: 2234784 - RNA, 15 nt, Human
uuagugaaauauuau

SEQ ID NO: 2234785 - RNA, 22 nt, Human
cuaagcuucacuguaaaauaau

SEQ ID NO: 2234786 - RNA, 12 nt, Human
uuuuauauuuga

SEQ ID NO: 2234787 - RNA, 19 nt, Human
uccagaaagugacaagcuc

SEQ ID NO: 2234788 - RNA, 18 nt, Human
cugccagccagcagccag

SEQ ID NO: 2234789 - RNA, 23 nt, Human
auuguuuuuccuuguauuuaaau

SEQ ID NO: 2234790 - RNA, 17 nt, Human
agggagagaagauagca

SEQ ID NO: 2234791 - RNA, 18 nt, Human
uaaaugugcuuuuaaaaa

SEQ ID NO: 2234792 - RNA, 21 nt, Human
cagucucaggaaaucaaauau

SEQ ID NO: 2234793 - RNA, 22 nt, Human
uaauaggcguaacuaauuuuaa

SEQ ID NO: 2234794 - RNA, 14 nt, Human
gaaaaaauaacaau

SEQ ID NO: 2234795 - RNA, 14 nt, Human
acacugaagaagca

SEQ ID NO: 2234796 - RNA, 21 nt, Human
ucacaugaacuuguaaaggaa

SEQ ID NO: 2234797 - RNA, 21 nt, Human
cuuguguuucuuuaguuuuug

SEQ ID NO: 2234798 - RNA, 15 nt, Human
uaaaagaugaaaaua

SEQ ID NO: 2234799 - RNA, 15 nt, Human
aaaaaagaaacauuu

SEQ ID NO: 2234800 - RNA, 12 nt, Human
agacagugaaag

SEQ ID NO: 2234801 - RNA, 13 nt, Human
aauugacuuauuu

SEQ ID NO: 2234802 - RNA, 14 nt, Human
cacuaaacaaagag

SEQ ID NO: 2234803 - RNA, 15 nt, Human
agaggggcagaacag

SEQ ID NO: 2234804 - RNA, 23 nt, Human
uacaaaugggaaacaaaaggaua

SEQ ID NO: 2234805 - RNA, 16 nt, Human
caauaacgauaaaaga

SEQ ID NO: 2234806 - RNA, 22 nt, Human
caagaugaugaugaucuuuaaa

SEQ ID NO: 2234807 - RNA, 22 nt, Human
aaccacagcaguugaaaagacu

SEQ ID NO: 2234808 - RNA, 20 nt, Human
uuuaaagcuuauuaaaacuc

SEQ ID NO: 2234809 - RNA, 23 nt, Human
cuucuaaguaaaaccacagcagu

SEQ ID NO: 2234810 - RNA, 16 nt, Human
aaaauaauccucaguu

SEQ ID NO: 2234811 - RNA, 16 nt, Human
ccuacaccccuccccu

SEQ ID NO: 2234812 - RNA, 17 nt, Human
augaucuuuaaaauaca

SEQ ID NO: 2234813 - RNA, 15 nt, Human
guagaaaagggaacu

SEQ ID NO: 2234814 - RNA, 12 nt, Human
cacacucaaauc

SEQ ID NO: 2234815 - RNA, 17 nt, Human
acuuccagauccuggaa

SEQ ID NO: 2234816 - RNA, 18 nt, Human
augucacuagggcaggga

SEQ ID NO: 2234817 - RNA, 12 nt, Human
acuccaaagaaa

SEQ ID NO: 2234818 - RNA, 21 nt, Human
aagcuagaaaugauccccagc

SEQ ID NO: 2234819 - RNA, 22 nt, Human
ugaagaaacauuuaucuuugua

SEQ ID NO: 2234820 - RNA, 19 nt, Human
auguuagcaaagaguuaau

SEQ ID NO: 2234821 - RNA, 14 nt, Human
aacauaaaauacaa

SEQ ID NO: 2234822 - RNA, 20 nt, Human
ugagaaagacuauucaaaca

SEQ ID NO: 2234823 - RNA, 23 nt, Human
gcagugaugucacuagggcaggg

SEQ ID NO: 2234824 - RNA, 18 nt, Human
gaugcaguucugaagaag

SEQ ID NO: 2234825 - RNA, 19 nt, Human
augaauuacauuuguauaa

SEQ ID NO: 2234826 - RNA, 23 nt, Human
agacuccaaagaaauguaaggga

SEQ ID NO: 2234827 - RNA, 15 nt, Human
agugacaagcucaca

SEQ ID NO: 2234828 - RNA, 13 nt, Human
uuagaauauuaaa

SEQ ID NO: 2234829 - RNA, 14 nt, Human
caguugaaaagacu

SEQ ID NO: 2234830 - RNA, 14 nt, Human
gaugaucuuuaaaa

SEQ ID NO: 2234831 - RNA, 20 nt, Human
aacuuccuuggacucauuuu

SEQ ID NO: 2234832 - RNA, 13 nt, Human
cagcucucagcca

SEQ ID NO: 2234833 - RNA, 17 nt, Human
gagcucgguggacccag

SEQ ID NO: 2234834 - RNA, 15 nt, Human
gggauuagggagaga

SEQ ID NO: 2234835 - RNA, 20 nt, Human
uauaaaagacugaccaauau

SEQ ID NO: 2234836 - RNA, 18 nt, Human
uacuuuauuuucuauaau

SEQ ID NO: 2234837 - RNA, 11 nt, Human
guauauucaaa

SEQ ID NO: 2234838 - RNA, 17 nt, Human
auguugacaugggacau

SEQ ID NO: 2234839 - RNA, 22 nt, Human
aucagcuugcccuguuaaaaga

SEQ ID NO: 2234840 - RNA, 15 nt, Human
ugcaucagcugcuga

SEQ ID NO: 2234841 - RNA, 12 nt, Human
auugauaauaaa

SEQ ID NO: 2234842 - RNA, 21 nt, Human
cauuucuugagguaaaagcau

SEQ ID NO: 2234843 - RNA, 19 nt, Human
auuucauaccuaucaucuu

SEQ ID NO: 2234844 - RNA, 12 nt, Human
uuacacauuuuu

SEQ ID NO: 2234845 - RNA, 13 nt, Human
gacucagggcccc

SEQ ID NO: 2234846 - RNA, 13 nt, Human
ucacguaaagcua

SEQ ID NO: 2234847 - RNA, 12 nt, Human
agcucucagcca

SEQ ID NO: 2234848 - RNA, 21 nt, Human
ucagcuugcccuguuaaaaga

SEQ ID NO: 2234849 - RNA, 19 nt, Human
auacuauggaauuucuccc

SEQ ID NO: 2234850 - RNA, 23 nt, Human
uagauguauagguugaugguggu

SEQ ID NO: 2234851 - RNA, 13 nt, Human
uuuagugaaauau

SEQ ID NO: 2234852 - RNA, 12 nt, Human
aucaucuuaagu

SEQ ID NO: 2234853 - RNA, 16 nt, Human
ccaacacgagcaggcu

SEQ ID NO: 2234854 - RNA, 19 nt, Human
uuuccugaaaacccuugcc

SEQ ID NO: 2234855 - RNA, 21 nt, Human
uuuauauaagcuuguauuccu

SEQ ID NO: 2234856 - RNA, 16 nt, Human
uaaaggaauuuaaaaa

SEQ ID NO: 2234857 - RNA, 12 nt, Human
cagggcauggcu

SEQ ID NO: 2234858 - RNA, 19 nt, Human
uaucacuugucaauaaaau

SEQ ID NO: 2234859 - RNA, 16 nt, Human
accucugccucagaaa

SEQ ID NO: 2234860 - RNA, 13 nt, Human
auaacgauaaaag

SEQ ID NO: 2234861 - RNA, 23 nt, Human
ucuccauguacuggcaagaccug

SEQ ID NO: 2234862 - RNA, 21 nt, Human
aaaauacauacuauagauucu

SEQ ID NO: 2234863 - RNA, 23 nt, Human
gaaaaucuuauaauuuaaaauau

SEQ ID NO: 2234864 - RNA, 15 nt, Human
caaauccaaugaaau

SEQ ID NO: 2234865 - RNA, 22 nt, Human
aauacugauguuccuagugaaa

SEQ ID NO: 2234866 - RNA, 18 nt, Human
uuuuaaaaaagaaacauu

SEQ ID NO: 2234867 - RNA, 21 nt, Human
ccaaauauaaauaaaaauaau

SEQ ID NO: 2234868 - RNA, 15 nt, Human
uucuuugagugucuu

SEQ ID NO: 2234869 - RNA, 20 nt, Human
ugcccgucuucagccuagcc

SEQ ID NO: 2234870 - RNA, 13 nt, Human
cgaggcaggguca

SEQ ID NO: 2234871 - RNA, 23 nt, Human
ugcauagguuuaauaauuuuuaa

SEQ ID NO: 2234872 - RNA, 15 nt, Human
agccuuccccuugcc

SEQ ID NO: 2234873 - RNA, 15 nt, Human
aaaauacaauguuau

SEQ ID NO: 2234874 - RNA, 13 nt, Human
gcuuagaccucag

SEQ ID NO: 2234875 - RNA, 20 nt, Human
auuauuguguguuauuuaaa

SEQ ID NO: 2234876 - RNA, 22 nt, Human
ucaggaguggguugauuucagc

SEQ ID NO: 2234877 - RNA, 19 nt, Human
cuagaauacuaauaaaaua

SEQ ID NO: 2234878 - RNA, 12 nt, Human
caggacagcccu

SEQ ID NO: 2234879 - RNA, 18 nt, Human
uggcauauugauaauaaa

SEQ ID NO: 2234880 - RNA, 23 nt, Human
uagauaggucagugcaaauacuc

SEQ ID NO: 2234881 - RNA, 14 nt, Human
cuauagauucuuua

SEQ ID NO: 2234882 - RNA, 12 nt, Human
cuuuuaaaaaaa

SEQ ID NO: 2234883 - RNA, 13 nt, Human
ccagcuguuuaug

SEQ ID NO: 2234884 - RNA, 12 nt, Human
acauaagcuaga

SEQ ID NO: 2234885 - RNA, 14 nt, Human
cuaaacauaugaau

SEQ ID NO: 2234886 - RNA, 14 nt, Human
guaacuaauuuuaa

SEQ ID NO: 2234887 - RNA, 22 nt, Human
uuccuuggacucauuuuaaaaa

SEQ ID NO: 2234888 - RNA, 22 nt, Human
ucccuacaccccuccccugccc

SEQ ID NO: 2234889 - RNA, 20 nt, Human
auauugauaauaaaauucau

SEQ ID NO: 2234890 - RNA, 13 nt, Human
uucuauaauuuaa

SEQ ID NO: 2234891 - RNA, 14 nt, Human
cuuaauuaaaagaa

SEQ ID NO: 2234892 - RNA, 16 nt, Human
cugagcauuuaauaug

SEQ ID NO: 2234893 - RNA, 21 nt, Human
gccgcuccugucugccagcca

SEQ ID NO: 2234894 - RNA, 23 nt, Human
cuucagccuagccgaccucagcc

SEQ ID NO: 2234895 - RNA, 20 nt, Human
uuaauugacuuauuuauaua

SEQ ID NO: 2234896 - RNA, 15 nt, Human
aagcacuaaacaaag

SEQ ID NO: 2234897 - RNA, 22 nt, Human
aauuuuuucucuaggaaauauu

SEQ ID NO: 2234898 - RNA, 16 nt, Human
auccaaugaaaugagu

SEQ ID NO: 2234899 - RNA, 22 nt, Human
aggaaaucaaauaugcaaagca

SEQ ID NO: 2234900 - RNA, 13 nt, Human
aaauaaaaauaau

SEQ ID NO: 2234901 - RNA, 20 nt, Human
agauucauuuuucuuucuga

SEQ ID NO: 2234902 - RNA, 21 nt, Human
uauuauuuuauagcuacuaau

SEQ ID NO: 2234903 - RNA, 13 nt, Human
uaacgauaaaaga

SEQ ID NO: 2234904 - RNA, 21 nt, Human
caaacagucucaggaaaucaa

SEQ ID NO: 2234905 - RNA, 17 nt, Human
uuaaagcuuauuaaaac

SEQ ID NO: 2234906 - RNA, 18 nt, Human
agugucuuaauuaaaaga

SEQ ID NO: 2234907 - RNA, 18 nt, Human
cagugaaagaaaauaaca

SEQ ID NO: 2234908 - RNA, 13 nt, Human
aaaaaaaaauacu

SEQ ID NO: 2234909 - RNA, 18 nt, Human
agccuggugggccuccuc

SEQ ID NO: 2234910 - RNA, 18 nt, Human
cuucacuguaaaauaaua

SEQ ID NO: 2234911 - RNA, 15 nt, Human
acuuuauaaaggauu

SEQ ID NO: 2234912 - RNA, 18 nt, Human
ugagaaagacuauucaaa

SEQ ID NO: 2234913 - RNA, 21 nt, Human
gaaucacucauuuauuuccau

SEQ ID NO: 2234914 - RNA, 12 nt, Human
gacgagaaaaca

SEQ ID NO: 2234915 - RNA, 23 nt, Human
ugucccuacaccccuccccugcc

SEQ ID NO: 2234916 - RNA, 15 nt, Human
uuuagugaaauauua

SEQ ID NO: 2234917 - RNA, 15 nt, Human
aagacuauucaaaca

SEQ ID NO: 2234918 - RNA, 21 nt, Human
uuuuauggcacuaguauuucu

SEQ ID NO: 2234919 - RNA, 17 nt, Human
gauugucugaaauuuuc

SEQ ID NO: 2234920 - RNA, 14 nt, Human
uccagauccuggaa

SEQ ID NO: 2234921 - RNA, 14 nt, Human
cccuugcccagggc

SEQ ID NO: 2234922 - RNA, 15 nt, Human
acauuuaucuuugua

SEQ ID NO: 2234923 - RNA, 18 nt, Human
ucaaggguacacugccuu

SEQ ID NO: 2234924 - RNA, 14 nt, Human
ucauccucaggccu

SEQ ID NO: 2234925 - RNA, 12 nt, Human
agaaaacaauaa

SEQ ID NO: 2234926 - RNA, 20 nt, Human
uaaaacaagcacuaaacaaa

SEQ ID NO: 2234927 - RNA, 14 nt, Human
caugaacuuguaaa

SEQ ID NO: 2234928 - RNA, 20 nt, Human
uguuaaaagaugaaaauauu

SEQ ID NO: 2234929 - RNA, 22 nt, Human
ugaagcaaaauuuuuucucuag

SEQ ID NO: 2234930 - RNA, 13 nt, Human
uuauguuuaauuc

SEQ ID NO: 2234931 - RNA, 19 nt, Human
ugcacugucaagaugauga

SEQ ID NO: 2234932 - RNA, 16 nt, Human
ugcuguauuuuaaaag

SEQ ID NO: 2234933 - RNA, 21 nt, Human
auaauuuuuauauuugaaaua

SEQ ID NO: 2234934 - RNA, 20 nt, Human
auuacuguaagaaaauauca

SEQ ID NO: 2234935 - RNA, 12 nt, Human
uuaauuaaaaga

SEQ ID NO: 2234936 - RNA, 21 nt, Human
uuucauuaucucaaaacugca

SEQ ID NO: 2234937 - RNA, 22 nt, Human
ccauuucuugagguaaaagcau

SEQ ID NO: 2234938 - RNA, 21 nt, Human
agacauguggugggacaggga

SEQ ID NO: 2234939 - RNA, 11 nt, Human
gcucucagcca

SEQ ID NO: 2234940 - RNA, 23 nt, Human
gaaugagagacacacugaagaag

SEQ ID NO: 2234941 - RNA, 17 nt, Human
aaauaccaugccauuua

SEQ ID NO: 2234942 - RNA, 14 nt, Human
uuucuuuaguuuuu

SEQ ID NO: 2234943 - RNA, 17 nt, Human
aaucuuucacaggggac

SEQ ID NO: 2234944 - RNA, 19 nt, Human
uaauaaaugugccuucauu

SEQ ID NO: 2234945 - RNA, 19 nt, Human
ucaauucuugccaaauaua

SEQ ID NO: 2234946 - RNA, 17 nt, Human
gaaucauaugggauacu

SEQ ID NO: 2234947 - RNA, 14 nt, Human
uaaaaaaaaauacu

SEQ ID NO: 2234948 - RNA, 14 nt, Human
acgagaaaacaaua

SEQ ID NO: 2234949 - RNA, 16 nt, Human
gcucgguggacccagg

SEQ ID NO: 2234950 - RNA, 22 nt, Human
agaaagugacaagcucacagac

SEQ ID NO: 2234951 - RNA, 19 nt, Human
gucuuucacauuuaaauaa

SEQ ID NO: 2234952 - RNA, 16 nt, Human
acaaauccaaugaaau

SEQ ID NO: 2234953 - RNA, 14 nt, Human
uauaauuuaaauau

SEQ ID NO: 2234954 - RNA, 14 nt, Human
uaaauaaaaauaau

SEQ ID NO: 2234955 - RNA, 16 nt, Human
agcucaggcacacuuc

SEQ ID NO: 2234956 - RNA, 18 nt, Human
gaugucacuagggcaggg

SEQ ID NO: 2234957 - RNA, 17 nt, Human
aaaugugcuuuuaaaaa

SEQ ID NO: 2234958 - RNA, 15 nt, Human
auuauuaccuuacag

SEQ ID NO: 2234959 - RNA, 16 nt, Human
uuaauaauuuuuaauu

SEQ ID NO: 2234960 - RNA, 14 nt, Human
auauuuauuuuaau

SEQ ID NO: 2234961 - RNA, 16 nt, Human
ucaaacugaagccaga

SEQ ID NO: 2234962 - RNA, 13 nt, Human
uuuuauacgauaa

SEQ ID NO: 2234963 - RNA, 21 nt, Human
aaugugcuuuuaaaaaaaaau

SEQ ID NO: 2234964 - RNA, 21 nt, Human
gauaaagcacuguuuggauau

SEQ ID NO: 2234965 - RNA, 18 nt, Human
acguaaagcuagaaauga

SEQ ID NO: 2234966 - RNA, 15 nt, Human
aaaauaacaaugaaa

SEQ ID NO: 2234967 - RNA, 22 nt, Human
aaguuacacauuuuucagauau

SEQ ID NO: 2234968 - RNA, 18 nt, Human
auggcuugaguuuaaauu

SEQ ID NO: 2234969 - RNA, 18 nt, Human
auaaaguguuugaaagcu

SEQ ID NO: 2234970 - RNA, 23 nt, Human
uguaaaugugcuuuuaaaaaaaa

SEQ ID NO: 2234971 - RNA, 12 nt, Human
cagugaaagaaa

SEQ ID NO: 2234972 - RNA, 23 nt, Human
auguuaaaacugggacaggggag

SEQ ID NO: 2234973 - RNA, 19 nt, Human
guuuuauuguuuaaaauca

SEQ ID NO: 2234974 - RNA, 16 nt, Human
aggcuacugucagcuc

SEQ ID NO: 2234975 - RNA, 17 nt, Human
cuucacuguaaaauaau

SEQ ID NO: 2234976 - RNA, 21 nt, Human
caagggugaugggaaagcauu

SEQ ID NO: 2234977 - RNA, 14 nt, Human
agugguauagaaau

SEQ ID NO: 2234978 - RNA, 18 nt, Human
gaauaauccuaaacauau

SEQ ID NO: 2234979 - RNA, 19 nt, Human
aaacaaaaggauaaugaau

SEQ ID NO: 2234980 - RNA, 22 nt, Human
cuuguaaaggaauuuaaaaauc

SEQ ID NO: 2234981 - RNA, 18 nt, Human
aauuaaaagaauauuuua

SEQ ID NO: 2234982 - RNA, 17 nt, Human
uauauuguagauaauac

SEQ ID NO: 2234983 - RNA, 13 nt, Human
auuggacaguaaa

SEQ ID NO: 2234984 - RNA, 20 nt, Human
uaaaauucauuccauuugcu

SEQ ID NO: 2234985 - RNA, 13 nt, Human
cuaauuuuuauua

SEQ ID NO: 2234986 - RNA, 18 nt, Human
cuggaaacuucagcgguu

SEQ ID NO: 2234987 - RNA, 19 nt, Human
cuuaauuaaaagaauauuu

SEQ ID NO: 2234988 - RNA, 19 nt, Human
gagccaaggguucagagac

SEQ ID NO: 2234989 - RNA, 16 nt, Human
uuuucucuaggaaaua

SEQ ID NO: 2234990 - RNA, 21 nt, Human
gcauauugauaauaaaauuca

SEQ ID NO: 2234991 - RNA, 17 nt, Human
uucauaccuaucaucuu

SEQ ID NO: 2234992 - RNA, 22 nt, Human
auaacaaugcuguauuuuaaaa

SEQ ID NO: 2234993 - RNA, 19 nt, Human
agggaaacugccagcaacg

SEQ ID NO: 2234994 - RNA, 17 nt, Human
gucaaagcugaaaugga

SEQ ID NO: 2234995 - RNA, 13 nt, Human
uuuugaaucauca

SEQ ID NO: 2234996 - RNA, 16 nt, Human
acaugaacuuguaaag

SEQ ID NO: 2234997 - RNA, 14 nt, Human
uuagaccucagccu

SEQ ID NO: 2234998 - RNA, 15 nt, Human
gacagggacccacuu

SEQ ID NO: 2234999 - RNA, 15 nt, Human
ggauggcaagaugug

SEQ ID NO: 2235000 - RNA, 19 nt, Human
auucccagccagcacagcc

SEQ ID NO: 2235001 - RNA, 18 nt, Human
ccuuagcuuagaccucag

SEQ ID NO: 2235002 - RNA, 11 nt, Human
auaauuuaaau

SEQ ID NO: 2235003 - RNA, 22 nt, Human
accauuucuugagguaaaagca

SEQ ID NO: 2235004 - RNA, 15 nt, Human
uacuaauaaaauaca

SEQ ID NO: 2235005 - RNA, 15 nt, Human
auuucauuucuuuga

SEQ ID NO: 2235006 - RNA, 16 nt, Human
guuucuuuaguuuuug

SEQ ID NO: 2235007 - RNA, 17 nt, Human
uucuuauuucauuucuu

SEQ ID NO: 2235008 - RNA, 19 nt, Human
cauuuaaagcuuauuaaaa

SEQ ID NO: 2235009 - RNA, 17 nt, Human
accaugccauuuaaagc

SEQ ID NO: 2235010 - RNA, 12 nt, Human
caauacauuauu

SEQ ID NO: 2235011 - RNA, 18 nt, Human
auuuuaacucuauaaugu

SEQ ID NO: 2235012 - RNA, 18 nt, Human
aagaccucauuuugaagg

SEQ ID NO: 2235013 - RNA, 17 nt, Human
uuuucauuaucucaaaa

SEQ ID NO: 2235014 - RNA, 16 nt, Human
uggugggacagggacc

SEQ ID NO: 2235015 - RNA, 14 nt, Human
uaaaggaauuuaaa

SEQ ID NO: 2235016 - RNA, 22 nt, Human
uauuccuuuuucucuccucucc

SEQ ID NO: 2235017 - RNA, 17 nt, Human
ucccagucauuuaauaa

SEQ ID NO: 2235018 - RNA, 20 nt, Human
agcuacuaauuuuaaaaugu

SEQ ID NO: 2235019 - RNA, 13 nt, Human
aggcuagauguau

SEQ ID NO: 2235020 - RNA, 21 nt, Human
auuccuuuuucucuccucucc

SEQ ID NO: 2235021 - RNA, 20 nt, Human
aguuuuuuuuuaaaaaagaa

SEQ ID NO: 2235022 - RNA, 21 nt, Human
ugcaucaauuuuucuuauuuc

SEQ ID NO: 2235023 - RNA, 17 nt, Human
uacaaaugcauuucuaa

SEQ ID NO: 2235024 - RNA, 21 nt, Human
ugaaguuuaauugacuuauuu

SEQ ID NO: 2235025 - RNA, 18 nt, Human
acuauugaaguugcagau

SEQ ID NO: 2235026 - RNA, 16 nt, Human
ucacuagggcagggac

SEQ ID NO: 2235027 - RNA, 15 nt, Human
uauuuauuuuaauaa

SEQ ID NO: 2235028 - RNA, 13 nt, Human
cugaggcagacag

SEQ ID NO: 2235029 - RNA, 23 nt, Human
gauauuaaccaggggccaugaau

SEQ ID NO: 2235030 - RNA, 16 nt, Human
caaauaugcaaagcac

SEQ ID NO: 2235031 - RNA, 16 nt, Human
uugucugaaauuuucu

SEQ ID NO: 2235032 - RNA, 18 nt, Human
acugccuucucaacucca

SEQ ID NO: 2235033 - RNA, 16 nt, Human
uuuuagugaaauauua

SEQ ID NO: 2235034 - RNA, 15 nt, Human
augauaacuggaaac

SEQ ID NO: 2235035 - RNA, 15 nt, Human
gugaacuugguuuua

SEQ ID NO: 2235036 - RNA, 17 nt, Human
agcuucacuguaaaaua

SEQ ID NO: 2235037 - RNA, 22 nt, Human
aaagacuccaaagaaauguaag

SEQ ID NO: 2235038 - RNA, 18 nt, Human
agcugcugaaacaacaaa

SEQ ID NO: 2235039 - RNA, 16 nt, Human
gacagcagcucaggca

SEQ ID NO: 2235040 - RNA, 22 nt, Human
caugaguaacugauuuguaaca

SEQ ID NO: 2235041 - RNA, 15 nt, Human
cucguggaacaguua

SEQ ID NO: 2235042 - RNA, 20 nt, Human
auuuugugauugauuauaug

SEQ ID NO: 2235043 - RNA, 16 nt, Human
gaggcagacagcagcu

SEQ ID NO: 2235044 - RNA, 16 nt, Human
acuaaagcaguggaca

SEQ ID NO: 2235045 - RNA, 21 nt, Human
cucauuuuuguuuucauuauc

SEQ ID NO: 2235046 - RNA, 14 nt, Human
cuuuuuuuuaaguu

SEQ ID NO: 2235047 - RNA, 18 nt, Human
cauuauuggacuuccauu

SEQ ID NO: 2235048 - RNA, 16 nt, Human
ggguccuggggccucg

SEQ ID NO: 2235049 - RNA, 17 nt, Human
auaauuuaaauauaugc

SEQ ID NO: 2235050 - RNA, 18 nt, Human
cuucucacauuuauauuu

SEQ ID NO: 2235051 - RNA, 16 nt, Human
ugguauagaaaugcug

SEQ ID NO: 2235052 - RNA, 18 nt, Human
uauuguguguuauuuaaa

SEQ ID NO: 2235053 - RNA, 19 nt, Human
cuguucacagccagacugg

SEQ ID NO: 2235054 - RNA, 20 nt, Human
cuaaaugucaaucagccuag

SEQ ID NO: 2235055 - RNA, 19 nt, Human
accacagcaguugaaaaga

SEQ ID NO: 2235056 - RNA, 15 nt, Human
uauuuccauauuaaa

SEQ ID NO: 2235057 - RNA, 18 nt, Human
uuuaugcauagauaaucu

SEQ ID NO: 2235058 - RNA, 15 nt, Human
uccuugcaucaauuu

SEQ ID NO: 2235059 - RNA, 22 nt, Human
guacacugccuucucaacucca

SEQ ID NO: 2235060 - RNA, 11 nt, Human
ucauuuuaaaa

SEQ ID NO: 2235061 - RNA, 22 nt, Human
ugguuguauuauuuuuuaaaaa

SEQ ID NO: 2235062 - RNA, 16 nt, Human
uuuauauuugaaauau

SEQ ID NO: 2235063 - RNA, 15 nt, Human
gcuguauuuuaaaag

SEQ ID NO: 2235064 - RNA, 18 nt, Human
ucuuguauuaaguuguua

SEQ ID NO: 2235065 - RNA, 14 nt, Human
uguuucauauugau

SEQ ID NO: 2235066 - RNA, 18 nt, Human
uucccguggaacguuuuu

SEQ ID NO: 2235067 - RNA, 18 nt, Human
uuuguacguucuucuauu

SEQ ID NO: 2235068 - RNA, 14 nt, Human
auucaaaaauuaua

SEQ ID NO: 2235069 - RNA, 17 nt, Human
uuuaaagcuuauuaaaa

SEQ ID NO: 2235070 - RNA, 20 nt, Human
augucccuacaccccucccc

SEQ ID NO: 2235071 - RNA, 14 nt, Human
aacugaggcagaca

SEQ ID NO: 2235072 - RNA, 21 nt, Human
ucuuaggguuaugauuaagua

SEQ ID NO: 2235073 - RNA, 13 nt, Human
cauacuauggaau

SEQ ID NO: 2235074 - RNA, 21 nt, Human
uuucucuggauuugcaacccc

SEQ ID NO: 2235075 - RNA, 21 nt, Human
auguagcaaauuccaauacau

SEQ ID NO: 2235076 - RNA, 15 nt, Human
uuuaugguuguauua

SEQ ID NO: 2235077 - RNA, 19 nt, Human
aaauuuucuagaauacuaa

SEQ ID NO: 2235078 - RNA, 16 nt, Human
aguacuguguacagaa

SEQ ID NO: 2235079 - RNA, 21 nt, Human
ugaaacgaggauugggaaaaa

SEQ ID NO: 2235080 - RNA, 21 nt, Human
auucccguggaacguuuuucc

SEQ ID NO: 2235081 - RNA, 12 nt, Human
ucuuaagaagac

SEQ ID NO: 2235082 - RNA, 19 nt, Human
cucacauuuauauuuuugu

SEQ ID NO: 2235083 - RNA, 15 nt, Human
aggaaaucaaauaug

SEQ ID NO: 2235084 - RNA, 18 nt, Human
gccuuccccuugcccagg

SEQ ID NO: 2235085 - RNA, 15 nt, Human
cuacaaaaacacagc

SEQ ID NO: 2235086 - RNA, 17 nt, Human
cgaaagcaucauuauuu

SEQ ID NO: 2235087 - RNA, 13 nt, Human
aagaaacauuuau

SEQ ID NO: 2235088 - RNA, 17 nt, Human
acacuaagagagaauga

SEQ ID NO: 2235089 - RNA, 17 nt, Human
cuuagaccucagccugu

SEQ ID NO: 2235090 - RNA, 20 nt, Human
uguaaaggaauuuaaaaauc

SEQ ID NO: 2235091 - RNA, 18 nt, Human
acauuugcucauggaauu

SEQ ID NO: 2235092 - RNA, 18 nt, Human
uaaugaauacuuuauaaa

SEQ ID NO: 2235093 - RNA, 15 nt, Human
agggcucacagaauu

SEQ ID NO: 2235094 - RNA, 16 nt, Human
ugcuaagucuuauaua

SEQ ID NO: 2235095 - RNA, 21 nt, Human
uaaaaaauggaacauaaaaua

SEQ ID NO: 2235096 - RNA, 18 nt, Human
uucccauucuacauacua

SEQ ID NO: 2235097 - RNA, 21 nt, Human
auguuauguauuauuauuccc

SEQ ID NO: 2235098 - RNA, 23 nt, Human
ggaugguucccuugaugaagaag

SEQ ID NO: 2235099 - RNA, 21 nt, Human
acucaaaucaagaaacuuaag

SEQ ID NO: 2235100 - RNA, 14 nt, Human
ggcaauagucaaau

SEQ ID NO: 2235101 - RNA, 21 nt, Human
agccuagccgaccucagccuu

SEQ ID NO: 2235102 - RNA, 21 nt, Human
gucagcuccccucggagaaga

SEQ ID NO: 2235103 - RNA, 18 nt, Human
acaaaugcauuucuaaag

SEQ ID NO: 2235104 - RNA, 17 nt, Human
gcagggcauggcuggga

SEQ ID NO: 2235105 - RNA, 15 nt, Human
ccucauccgaggcag

SEQ ID NO: 2235106 - RNA, 13 nt, Human
uaaacauguuuau

SEQ ID NO: 2235107 - RNA, 20 nt, Human
ccucagccugugcugcccgu

SEQ ID NO: 2235108 - RNA, 23 nt, Human
guaauuccguagguuauuuucag

SEQ ID NO: 2235109 - RNA, 16 nt, Human
agugaaggauuuaugu

SEQ ID NO: 2235110 - RNA, 19 nt, Human
cauggaauuggagcucgug

SEQ ID NO: 2235111 - RNA, 23 nt, Human
uaagggaaacugccagcaacgca

SEQ ID NO: 2235112 - RNA, 19 nt, Human
agucauuuaauaaaugugc

SEQ ID NO: 2235113 - RNA, 17 nt, Human
aaguaaaaccacagcag

SEQ ID NO: 2235114 - RNA, 15 nt, Human
cuguaaaauaauaac

SEQ ID NO: 2235115 - RNA, 21 nt, Human
cggagccucauccgaggcagg

SEQ ID NO: 2235116 - RNA, 17 nt, Human
aagacaaggaaaaaaua

SEQ ID NO: 2235117 - RNA, 21 nt, Human
acuuauuuauauaaauuuuuu

SEQ ID NO: 2235118 - RNA, 20 nt, Human
aaagacagugaaagaaaaua

SEQ ID NO: 2235119 - RNA, 14 nt, Human
acacucaaaucaag

SEQ ID NO: 2235120 - RNA, 20 nt, Human
gggagagaagauagcagggc

SEQ ID NO: 2235121 - RNA, 22 nt, Human
uuuccaagcaaguauuagaaua

SEQ ID NO: 2235122 - RNA, 18 nt, Human
uuacuguaagaaaauauc

SEQ ID NO: 2235123 - RNA, 15 nt, Human
guuuuucuuuucauu

SEQ ID NO: 2235124 - RNA, 15 nt, Human
ggugccccccuugcc

SEQ ID NO: 2235125 - RNA, 17 nt, Human
gauaaaagacagugaaa

SEQ ID NO: 2235126 - RNA, 20 nt, Human
gucaagaugaugaugaucuu

SEQ ID NO: 2235127 - RNA, 17 nt, Human
ggagcucguggaacagu

SEQ ID NO: 2235128 - RNA, 18 nt, Human
ucauuuaauaaaugugcc

SEQ ID NO: 2235129 - RNA, 12 nt, Human
acuaauaaaaua

SEQ ID NO: 2235130 - RNA, 21 nt, Human
uugagugucuuaauuaaaaga

SEQ ID NO: 2235131 - RNA, 22 nt, Human
agcuugcccuguuaaaagauga

SEQ ID NO: 2235132 - RNA, 14 nt, Human
uacuaauuuuaaaa

SEQ ID NO: 2235133 - RNA, 19 nt, Human
auuuucaguuauuauauuu

SEQ ID NO: 2235134 - RNA, 20 nt, Human
gacauuugcucauggaauug

SEQ ID NO: 2235135 - RNA, 20 nt, Human
aauucuugccaaauauaaau

SEQ ID NO: 2235136 - RNA, 15 nt, Human
uuuaauaauuuuuaa

SEQ ID NO: 2235137 - RNA, 20 nt, Human
uaugaaaaggcuaagcuuca

SEQ ID NO: 2235138 - RNA, 14 nt, Human
caaagaaauguaag

SEQ ID NO: 2235139 - RNA, 16 nt, Human
aaaauaacaauaaaag

SEQ ID NO: 2235140 - RNA, 22 nt, Human
agcagcauaaauguugacaugg

SEQ ID NO: 2235141 - RNA, 19 nt, Human
agcuacuaauuuuaaaaug

SEQ ID NO: 2235142 - RNA, 16 nt, Human
aaaaauuccaagugau

SEQ ID NO: 2235143 - RNA, 16 nt, Human
acaaggaugaauuaag

SEQ ID NO: 2235144 - RNA, 17 nt, Human
ucauacuucuuaggguu

SEQ ID NO: 2235145 - RNA, 21 nt, Human
uuauguuuaauucugaaagca

SEQ ID NO: 2235146 - RNA, 15 nt, Human
auuauucccauucua

SEQ ID NO: 2235147 - RNA, 14 nt, Human
aauauuauguuaaa

SEQ ID NO: 2235148 - RNA, 15 nt, Human
aaucucaauauuuca

SEQ ID NO: 2235149 - RNA, 13 nt, Human
aauuuuuauauuu

SEQ ID NO: 2235150 - RNA, 17 nt, Human
uaacgauaaaagacagu

SEQ ID NO: 2235151 - RNA, 19 nt, Human
cucugccucagaaaacaag

SEQ ID NO: 2235152 - RNA, 20 nt, Human
uaauaaguugcauagguuua

SEQ ID NO: 2235153 - RNA, 23 nt, Human
uguucuuaagacgugauuuugcu

SEQ ID NO: 2235154 - RNA, 17 nt, Human
aaauaacaauaaaagac

SEQ ID NO: 2235155 - RNA, 18 nt, Human
uuuugugaagcaaaauuu

SEQ ID NO: 2235156 - RNA, 22 nt, Human
gauaauaaaauucauuccauuu

SEQ ID NO: 2235157 - RNA, 10 nt, Human
aaaagaugaa

SEQ ID NO: 2235158 - RNA, 22 nt, Human
aauaugccccauucaacaucua

SEQ ID NO: 2235159 - RNA, 22 nt, Human
gcacagccucuuagaugcaguu

SEQ ID NO: 2235160 - RNA, 15 nt, Human
uccagauccuggaaa

SEQ ID NO: 2235161 - RNA, 19 nt, Human
cauuuauuuccauauuaaa

SEQ ID NO: 2235162 - RNA, 18 nt, Human
cgaccucagccuuccccu

SEQ ID NO: 2235163 - RNA, 14 nt, Human
aguuuuuuuuuaaa

SEQ ID NO: 2235164 - RNA, 19 nt, Human
auaaaagacagugaaagaa

SEQ ID NO: 2235165 - RNA, 20 nt, Human
cugauauuggacaguaaaau

SEQ ID NO: 2235166 - RNA, 11 nt, Human
uuaauuaaaag

SEQ ID NO: 2235167 - RNA, 15 nt, Human
aagcauaccaacacg

SEQ ID NO: 2235168 - RNA, 20 nt, Human
aucagcuugcccuguuaaaa

SEQ ID NO: 2235169 - RNA, 20 nt, Human
uaaaagacaaggaaaaaaua

SEQ ID NO: 2235170 - RNA, 17 nt, Human
ugcacuaaucaauacuu

SEQ ID NO: 2235171 - RNA, 15 nt, Human
ggccguuuugugaag

SEQ ID NO: 2235172 - RNA, 11 nt, Human
gggggagggga

SEQ ID NO: 2235173 - RNA, 19 nt, Human
gacagucaccucauggaau

SEQ ID NO: 2235174 - RNA, 15 nt, Human
ggccucggagccuca

SEQ ID NO: 2235175 - RNA, 22 nt, Human
uuaccucugccucagaaaacaa

SEQ ID NO: 2235176 - RNA, 21 nt, Human
uguaaaugugcuuuuaaaaaa

SEQ ID NO: 2235177 - RNA, 14 nt, Human
cagauccuggaaau

SEQ ID NO: 2235178 - RNA, 18 nt, Human
ucugcuaccucacugggg

SEQ ID NO: 2235179 - RNA, 14 nt, Human
uuucauuucuuuga

SEQ ID NO: 2235180 - RNA, 19 nt, Human
caugaguaacugauuugua

SEQ ID NO: 2235181 - RNA, 23 nt, Human
auuuucuagaauacuaauaaaau

SEQ ID NO: 2235182 - RNA, 16 nt, Human
ugaugaucuuuaaaau

SEQ ID NO: 2235183 - RNA, 13 nt, Human
uuguuuuuccuug

SEQ ID NO: 2235184 - RNA, 20 nt, Human
agaagaacugaaaucauacu

SEQ ID NO: 2235185 - RNA, 20 nt, Human
aagaugguaccaccagucug

SEQ ID NO: 2235186 - RNA, 16 nt, Human
acauuugcucauggaa

SEQ ID NO: 2235187 - RNA, 16 nt, Human
uccuguaauggaagca

SEQ ID NO: 2235188 - RNA, 15 nt, Human
uacuaauuuuaaaau

SEQ ID NO: 2235189 - RNA, 17 nt, Human
uuauuacuguaagaaaa

SEQ ID NO: 2235190 - RNA, 13 nt, Human
acacucaaaucaa

SEQ ID NO: 2235191 - RNA, 19 nt, Human
ugggcagugaugucacuag

SEQ ID NO: 2235192 - RNA, 18 nt, Human
auuuuuagugaaauauua

SEQ ID NO: 2235193 - RNA, 22 nt, Human
cacuuccaagagccuuuuuuug

SEQ ID NO: 2235194 - RNA, 18 nt, Human
aaaguaacccuacaaaac

SEQ ID NO: 2235195 - RNA, 21 nt, Human
gaaaaguauguuagugcaaau

SEQ ID NO: 2235196 - RNA, 17 nt, Human
caacugaggcagacagc

SEQ ID NO: 2235197 - RNA, 18 nt, Human
cucaaaucaagaaacuua

SEQ ID NO: 2235198 - RNA, 15 nt, Human
aucuuauaauuuaaa

SEQ ID NO: 2235199 - RNA, 13 nt, Human
acauaaaauacaa

SEQ ID NO: 2235200 - RNA, 14 nt, Human
ccucagccuucccc

SEQ ID NO: 2235201 - RNA, 18 nt, Human
acaaaaggauaaugaaua

SEQ ID NO: 2235202 - RNA, 17 nt, Human
ucccuacaccccucccc

SEQ ID NO: 2235203 - RNA, 18 nt, Human
aaauaacgauaaaagaca

SEQ ID NO: 2235204 - RNA, 22 nt, Human
cuaucuaauuuuuauuaauuug

SEQ ID NO: 2235205 - RNA, 16 nt, Human
ugacaagcucacagac

SEQ ID NO: 2235206 - RNA, 19 nt, Human
aauuuuuauauuugaaaua

SEQ ID NO: 2235207 - RNA, 21 nt, Human
ccccuugcccagggcucagcc

SEQ ID NO: 2235208 - RNA, 23 nt, Human
cuuuuuuuuauacgauaaauaac

SEQ ID NO: 2235209 - RNA, 18 nt, Human
uuuauggcacuaguauuu

SEQ ID NO: 2235210 - RNA, 13 nt, Human
gccagcucucagc

SEQ ID NO: 2235211 - RNA, 15 nt, Human
uuaauucugaaagca

SEQ ID NO: 2235212 - RNA, 15 nt, Human
aaucauuucugcauc

SEQ ID NO: 2235213 - RNA, 19 nt, Human
auuaaaacucauuuuuguu

SEQ ID NO: 2235214 - RNA, 23 nt, Human
uuauagcuacuaauuuuaaaaug

SEQ ID NO: 2235215 - RNA, 19 nt, Human
augaguaacugauuuguaa

SEQ ID NO: 2235216 - RNA, 15 nt, Human
acugaagaagcacca

SEQ ID NO: 2235217 - RNA, 16 nt, Human
acaugaaguccaagca

SEQ ID NO: 2235218 - RNA, 15 nt, Human
gucuuaauuaaaaga

SEQ ID NO: 2235219 - RNA, 13 nt, Human
cacaacuauauug

SEQ ID NO: 2235220 - RNA, 15 nt, Human
auaauccuaaacaua

SEQ ID NO: 2235221 - RNA, 14 nt, Human
auuuauuuuaauaa

SEQ ID NO: 2235222 - RNA, 22 nt, Human
cuaaguaaaaccacagcaguug

SEQ ID NO: 2235223 - RNA, 21 nt, Human
uguauaaaauaauuuuuauau

SEQ ID NO: 2235224 - RNA, 17 nt, Human
aagcacugacuucuaag

SEQ ID NO: 2235225 - RNA, 17 nt, Human
aaauccuacuuucauaa

SEQ ID NO: 2235226 - RNA, 14 nt, Human
gccuuccccuugcc

SEQ ID NO: 2235227 - RNA, 15 nt, Human
gucccuacaccccuc

SEQ ID NO: 2235228 - RNA, 16 nt, Human
acauuuauauuuuugu

SEQ ID NO: 2235229 - RNA, 18 nt, Human
agagaaugagagacacac

SEQ ID NO: 2235230 - RNA, 21 nt, Human
ucaagucuuucacauuuaaau

SEQ ID NO: 2235231 - RNA, 21 nt, Human
aauuagaugacugaauuucua

SEQ ID NO: 2235232 - RNA, 18 nt, Human
ugaacuugguuuuaauua

SEQ ID NO: 2235233 - RNA, 16 nt, Human
aaaguguuugaaagcu

SEQ ID NO: 2235234 - RNA, 15 nt, Human
agaauaccacaggaa

SEQ ID NO: 2235235 - RNA, 13 nt, Human
ugcauuucuaaag

SEQ ID NO: 2235236 - RNA, 17 nt, Human
aggguguguaaguagau

SEQ ID NO: 2235237 - RNA, 22 nt, Human
uuuucauuaucucaaaacugca

SEQ ID NO: 2235238 - RNA, 16 nt, Human
aaaagcaucacaugaa

SEQ ID NO: 2235239 - RNA, 15 nt, Human
cacugucaagaugau

SEQ ID NO: 2235240 - RNA, 22 nt, Human
acuuaagguuaccuuuguuccc

SEQ ID NO: 2235241 - RNA, 12 nt, Human
aauuuaaauaua

SEQ ID NO: 2235242 - RNA, 15 nt, Human
auuuuugucuugugu

SEQ ID NO: 2235243 - RNA, 22 nt, Human
gcaacugaggcagacagcagcu

SEQ ID NO: 2235244 - RNA, 18 nt, Human
aacaaugcuguauuuuaa

SEQ ID NO: 2235245 - RNA, 13 nt, Human
ccagcucucagcc

SEQ ID NO: 2235246 - RNA, 22 nt, Human
gcuaaaacaagcacuaaacaaa

SEQ ID NO: 2235247 - RNA, 11 nt, Human
auuuuugaagc

SEQ ID NO: 2235248 - RNA, 15 nt, Human
uucacauuuaaauaa

SEQ ID NO: 2235249 - RNA, 19 nt, Human
ccuuggacucauuuuaaaa

SEQ ID NO: 2235250 - RNA, 17 nt, Human
augggaaagcauuguaa

SEQ ID NO: 2235251 - RNA, 17 nt, Human
agucauuuaauaaaugu

SEQ ID NO: 2235252 - RNA, 16 nt, Human
guuacacauuuuucag

SEQ ID NO: 2235253 - RNA, 21 nt, Human
cuaccaaaaaucucaauauuu

SEQ ID NO: 2235254 - RNA, 21 nt, Human
augcuacaggauuugaaauug

SEQ ID NO: 2235255 - RNA, 14 nt, Human
uuauuauauuuaca

SEQ ID NO: 2235256 - RNA, 14 nt, Human
uuaugauuaaguaa

SEQ ID NO: 2235257 - RNA, 14 nt, Human
guuguucucuucuu

SEQ ID NO: 2235258 - RNA, 19 nt, Human
uguuuucauuaucucaaaa

SEQ ID NO: 2235259 - RNA, 13 nt, Human
agcuagaaaugau

SEQ ID NO: 2235260 - RNA, 23 nt, Human
ucuuagaugcaguucugaagaag

SEQ ID NO: 2235261 - RNA, 23 nt, Human
acuuccuuggacucauuuuaaaa

SEQ ID NO: 2235262 - RNA, 16 nt, Human
gcuucacuguaaaaua

SEQ ID NO: 2235263 - RNA, 13 nt, Human
ugguauagaaaug

SEQ ID NO: 2235264 - RNA, 21 nt, Human
caaagugguauagaaaugcug

SEQ ID NO: 2235265 - RNA, 18 nt, Human
aggaaaaaauaacaauga

SEQ ID NO: 2235266 - RNA, 16 nt, Human
agaagauagcagggca

SEQ ID NO: 2235267 - RNA, 18 nt, Human
cugagggcauagaaguaa

SEQ ID NO: 2235268 - RNA, 12 nt, Human
ccuugccagaca

SEQ ID NO: 2235269 - RNA, 22 nt, Human
gaugcaguucugaagaagaugg

SEQ ID NO: 2235270 - RNA, 16 nt, Human
aaaaauuaauucuuua

SEQ ID NO: 2235271 - RNA, 16 nt, Human
gaggcuuugcauagau

SEQ ID NO: 2235272 - RNA, 18 nt, Human
ucucuaggaaauauuuau

SEQ ID NO: 2235273 - RNA, 19 nt, Human
cuuccagauccuggaaauc

SEQ ID NO: 2235274 - RNA, 15 nt, Human
cuuuucccaacucca

SEQ ID NO: 2235275 - RNA, 15 nt, Human
gaaauguaagggaaa

SEQ ID NO: 2235276 - RNA, 18 nt, Human
acagcagcucaggcacac

SEQ ID NO: 2235277 - RNA, 16 nt, Human
cuagggcagggacagg

SEQ ID NO: 2235278 - RNA, 12 nt, Human
uauuauuuuuua

SEQ ID NO: 2235279 - RNA, 21 nt, Human
auuuacaaaugggaaacaaaa

SEQ ID NO: 2235280 - RNA, 23 nt, Human
auauaacaaugcuguauuuuaaa

SEQ ID NO: 2235281 - RNA, 16 nt, Human
augugaacacaucagc

SEQ ID NO: 2235282 - RNA, 23 nt, Human
uuuccaucaaggguacacugccu

SEQ ID NO: 2235283 - RNA, 18 nt, Human
gcacuaaagcaguggaca

SEQ ID NO: 2235284 - RNA, 22 nt, Human
cgaggcagggucaggagagggg

SEQ ID NO: 2235285 - RNA, 17 nt, Human
uugaaggaguccuugca

SEQ ID NO: 2235286 - RNA, 12 nt, Human
auauaaauaaaa

SEQ ID NO: 2235287 - RNA, 22 nt, Human
aaauguugacaugggacauuug

SEQ ID NO: 2235288 - RNA, 13 nt, Human
uuauauaaauuuu

SEQ ID NO: 2235289 - RNA, 14 nt, Human
ugcuguauuuuaaa

SEQ ID NO: 2235290 - RNA, 23 nt, Human
augucaauucuugccaaauauaa

SEQ ID NO: 2235291 - RNA, 20 nt, Human
caagccuccuuuuaaaguaa

SEQ ID NO: 2235292 - RNA, 20 nt, Human
uagaugcaguucugaagaag

SEQ ID NO: 2235293 - RNA, 18 nt, Human
guuaguauuguccagguc

SEQ ID NO: 2235294 - RNA, 21 nt, Human
gcuccugucugccagccagca

SEQ ID NO: 2235295 - RNA, 18 nt, Human
uuuaaaauacacacucaa

SEQ ID NO: 2235296 - RNA, 15 nt, Human
aguucugaagaagau

SEQ ID NO: 2235297 - RNA, 14 nt, Human
aaauggagaaagga

SEQ ID NO: 2235298 - RNA, 13 nt, Human
aauguaagggaaa

SEQ ID NO: 2235299 - RNA, 13 nt, Human
uaugaaauauuau

SEQ ID NO: 2235300 - RNA, 16 nt, Human
acuaaacaaagaguga

SEQ ID NO: 2235301 - RNA, 12 nt, Human
uaagaagacugc

SEQ ID NO: 2235302 - RNA, 17 nt, Human
ugaaggauuuauguuua

SEQ ID NO: 2235303 - RNA, 23 nt, Human
agaaaagggaacugaacauucca

SEQ ID NO: 2235304 - RNA, 18 nt, Human
cugagaugugaacacauc

SEQ ID NO: 2235305 - RNA, 15 nt, Human
aaauauaaauaaaaa

SEQ ID NO: 2235306 - RNA, 20 nt, Human
uauuuauuacuguaagaaaa

SEQ ID NO: 2235307 - RNA, 15 nt, Human
augugcuuuuaaaaa

SEQ ID NO: 2235308 - RNA, 14 nt, Human
agucugacuguuuc

SEQ ID NO: 2235309 - RNA, 20 nt, Human
gucagcuccccucggagaag

SEQ ID NO: 2235310 - RNA, 13 nt, Human
ugaucuuuaaaau

SEQ ID NO: 2235311 - RNA, 21 nt, Human
aagcaccuuuagaauauuaaa

SEQ ID NO: 2235312 - RNA, 17 nt, Human
auuuucuauaauuuaaa

SEQ ID NO: 2235313 - RNA, 22 nt, Human
aaccuacacgagauacagaauu

SEQ ID NO: 2235314 - RNA, 15 nt, Human
gaccucagccuuccc

SEQ ID NO: 2235315 - RNA, 14 nt, Human
uacacauuuuucag

SEQ ID NO: 2235316 - RNA, 20 nt, Human
uuaaaagaauauuuuaacuu

SEQ ID NO: 2235317 - RNA, 19 nt, Human
gucaaucagccuaguugau

SEQ ID NO: 2235318 - RNA, 12 nt, Human
aguguuugaaag

SEQ ID NO: 2235319 - RNA, 23 nt, Human
aagacgugauuuugcuguagaag

SEQ ID NO: 2235320 - RNA, 16 nt, Human
cauauugauaauaaaa

SEQ ID NO: 2235321 - RNA, 14 nt, Human
uaacuaauuuuaac

SEQ ID NO: 2235322 - RNA, 18 nt, Human
auuugcugauugucugaa

SEQ ID NO: 2235323 - RNA, 15 nt, Human
ccuagagcacacugu

SEQ ID NO: 2235324 - RNA, 15 nt, Human
ucacaaacucaucca

SEQ ID NO: 2235325 - RNA, 16 nt, Human
gaauacuaauaaaaua

SEQ ID NO: 2235326 - RNA, 17 nt, Human
aaauauaaauaaaaaua

SEQ ID NO: 2235327 - RNA, 14 nt, Human
augcacuaaucaau

SEQ ID NO: 2235328 - RNA, 13 nt, Human
cauuuguauaaaa

SEQ ID NO: 2235329 - RNA, 16 nt, Human
cauagaaguaaaaaca

SEQ ID NO: 2235330 - RNA, 11 nt, Human
uuauauuuauu

SEQ ID NO: 2235331 - RNA, 11 nt, Human
ugcuguagaag

SEQ ID NO: 2235332 - RNA, 21 nt, Human
uaguauuucuaugaaauauua

SEQ ID NO: 2235333 - RNA, 17 nt, Human
cgaccucagccuucccc

SEQ ID NO: 2235334 - RNA, 22 nt, Human
aaucacaaacucauccauuaau

SEQ ID NO: 2235335 - RNA, 21 nt, Human
ugaaagaggcagcuugaaacu

SEQ ID NO: 2235336 - RNA, 22 nt, Human
ggcuaagcuucacuguaaaaua

SEQ ID NO: 2235337 - RNA, 23 nt, Human
ucuaccaaaaaucucaauauuuc

SEQ ID NO: 2235338 - RNA, 16 nt, Human
guucucuucuuuaaag

SEQ ID NO: 2235339 - RNA, 14 nt, Human
cccuacaccccucc

SEQ ID NO: 2235340 - RNA, 19 nt, Human
auuaaguuuuuuuuuaaaa

SEQ ID NO: 2235341 - RNA, 18 nt, Human
gaaacaaaaggauaauga

SEQ ID NO: 2235342 - RNA, 12 nt, Human
cagauuuuccug

SEQ ID NO: 2235343 - RNA, 21 nt, Human
aaaauuuuuucucuaggaaau

SEQ ID NO: 2235344 - RNA, 17 nt, Human
agaaagacuauucaaac

SEQ ID NO: 2235345 - RNA, 14 nt, Human
agauauaaaagacu

SEQ ID NO: 2235346 - RNA, 20 nt, Human
ggaaaucaaauaugcaaagc

SEQ ID NO: 2235347 - RNA, 17 nt, Human
auuauuuuuuaaaaaaa

SEQ ID NO: 2235348 - RNA, 21 nt, Human
cagugaugucacuagggcagg

SEQ ID NO: 2235349 - RNA, 21 nt, Human
uuauccggucggguuuuauug

SEQ ID NO: 2235350 - RNA, 18 nt, Human
ugaaaagacuccaaagaa

SEQ ID NO: 2235351 - RNA, 20 nt, Human
gaaacauuugguaaggggaa

SEQ ID NO: 2235352 - RNA, 13 nt, Human
ugacccccauccc

SEQ ID NO: 2235353 - RNA, 19 nt, Human
ucaguuauuauauuuacaa

SEQ ID NO: 2235354 - RNA, 18 nt, Human
uugcauagauucccugag

SEQ ID NO: 2235355 - RNA, 14 nt, Human
caaacucauccauu

SEQ ID NO: 2235356 - RNA, 16 nt, Human
aggcuuugcauagauu

SEQ ID NO: 2235357 - RNA, 18 nt, Human
aaaccacagcaguugaaa

SEQ ID NO: 2235358 - RNA, 21 nt, Human
agcuguucacagccagacugg

SEQ ID NO: 2235359 - RNA, 15 nt, Human
aaagaauauuuuaac

SEQ ID NO: 2235360 - RNA, 18 nt, Human
gccuccucuguccagggc

SEQ ID NO: 2235361 - RNA, 17 nt, Human
agcaguugaaaagacuc

SEQ ID NO: 2235362 - RNA, 15 nt, Human
caagcucacagaccu

SEQ ID NO: 2235363 - RNA, 16 nt, Human
auauugauaauaaaau

SEQ ID NO: 2235364 - RNA, 15 nt, Human
ucacaggacagcccu

SEQ ID NO: 2235365 - RNA, 21 nt, Human
aggguuaugauuaaguaauga

SEQ ID NO: 2235366 - RNA, 23 nt, Human
ggucggguuuuauuguuuaaaau

SEQ ID NO: 2235367 - RNA, 17 nt, Human
agacagugaaagaaaau

SEQ ID NO: 2235368 - RNA, 18 nt, Human
guauuauuuuuuaaaaaa

SEQ ID NO: 2235369 - RNA, 20 nt, Human
acagcaagggugaugggaaa

SEQ ID NO: 2235370 - RNA, 14 nt, Human
auuuauuauugugu

SEQ ID NO: 2235371 - RNA, 21 nt, Human
uauagaaaugcugguuuuuca

SEQ ID NO: 2235372 - RNA, 21 nt, Human
uuuguauaaaauaauuuuuau

SEQ ID NO: 2235373 - RNA, 15 nt, Human
uucacuguaaaauaa

SEQ ID NO: 2235374 - RNA, 17 nt, Human
cuggagggaagccuugg

SEQ ID NO: 2235375 - RNA, 14 nt, Human
cuaaagcaguggac

SEQ ID NO: 2235376 - RNA, 20 nt, Human
agcaagggugaugggaaagc

SEQ ID NO: 2235377 - RNA, 19 nt, Human
aaaaucuuauaauuuaaaa

SEQ ID NO: 2235378 - RNA, 13 nt, Human
uacuuuauuuucu

SEQ ID NO: 2235379 - RNA, 20 nt, Human
ucacaugaacuuguaaagga

SEQ ID NO: 2235380 - RNA, 14 nt, Human
uaaaaccacagcag

SEQ ID NO: 2235381 - RNA, 13 nt, Human
cugccuucucaac

SEQ ID NO: 2235382 - RNA, 16 nt, Human
uucuauaauuuaaaua

SEQ ID NO: 2235383 - RNA, 19 nt, Human
aaguugcauagguuuaaua

SEQ ID NO: 2235384 - RNA, 17 nt, Human
gcuugcccuguuaaaag

SEQ ID NO: 2235385 - RNA, 20 nt, Human
ugguuguauuauuuuuuaaa

SEQ ID NO: 2235386 - RNA, 23 nt, Human
cuccauucccguggaacguuuuu

SEQ ID NO: 2235387 - RNA, 17 nt, Human
cugccucagaaaacaag

SEQ ID NO: 2235388 - RNA, 22 nt, Human
gaaaaucuuauaauuuaaaaua

SEQ ID NO: 2235389 - RNA, 15 nt, Human
cauuguaaaugugcu

SEQ ID NO: 2235390 - RNA, 20 nt, Human
uuacaaauccaaugaaauga

SEQ ID NO: 2235391 - RNA, 23 nt, Human
aacagucucaggaaaucaaauau

SEQ ID NO: 2235392 - RNA, 15 nt, Human
guaaggggaauugag

SEQ ID NO: 2235393 - RNA, 15 nt, Human
gccagcucucagcca

SEQ ID NO: 2235394 - RNA, 19 nt, Human
cuugcccagggcucagccu

SEQ ID NO: 2235395 - RNA, 19 nt, Human
uuaaaagaugaaaauauuu

SEQ ID NO: 2235396 - RNA, 14 nt, Human
aaauacauacuaua

SEQ ID NO: 2235397 - RNA, 15 nt, Human
ucauaauaaguugca

SEQ ID NO: 2235398 - RNA, 22 nt, Human
cagggcauggcugggaacccaa

SEQ ID NO: 2235399 - RNA, 17 nt, Human
aaauaacgauaaaagac

SEQ ID NO: 2235400 - RNA, 18 nt, Human
aaguugauaugccuuuuc

SEQ ID NO: 2235401 - RNA, 18 nt, Human
cagccucuuagaugcagu

SEQ ID NO: 2235402 - RNA, 13 nt, Human
cacuguaaaauaa

SEQ ID NO: 2235403 - RNA, 16 nt, Human
ugucuuguguuucuuu

SEQ ID NO: 2235404 - RNA, 13 nt, Human
gcugguuuuucag

SEQ ID NO: 2235405 - RNA, 22 nt, Human
ucuagcaugucgucaaagcuga

SEQ ID NO: 2235406 - RNA, 22 nt, Human
cauaaauguugacaugggacau

SEQ ID NO: 2235407 - RNA, 15 nt, Human
aauaaguacugugua

SEQ ID NO: 2235408 - RNA, 18 nt, Human
auuuguauaaaauaauuu

SEQ ID NO: 2235409 - RNA, 13 nt, Human
uagauucuuuauu

SEQ ID NO: 2235410 - RNA, 14 nt, Human
gcucaggcacacuu

SEQ ID NO: 2235411 - RNA, 15 nt, Human
aguaagcaccuuuag

SEQ ID NO: 2235412 - RNA, 20 nt, Human
acuagaguuuagcuggaaaa

SEQ ID NO: 2235413 - RNA, 19 nt, Human
uggaacaguuaccucugcc

SEQ ID NO: 2235414 - RNA, 23 nt, Human
uuugaacaacucgaaucacucau

SEQ ID NO: 2235415 - RNA, 19 nt, Human
ucccuacaccccuccccug

SEQ ID NO: 2235416 - RNA, 22 nt, Human
auauuuacaaaugggaaacaaa

SEQ ID NO: 2235417 - RNA, 15 nt, Human
auauaaauaaaaaua

SEQ ID NO: 2235418 - RNA, 23 nt, Human
caauaacgauaaaagacagugaa

SEQ ID NO: 2235419 - RNA, 16 nt, Human
aaauauuauguuaaaa

SEQ ID NO: 2235420 - RNA, 23 nt, Human
cauuuuaaaaaauggaacauaaa

SEQ ID NO: 2235421 - RNA, 19 nt, Human
gacucagggccccagcacu

SEQ ID NO: 2235422 - RNA, 20 nt, Human
agaugcaguucugaagaaga

SEQ ID NO: 2235423 - RNA, 23 nt, Human
caccucauggaauuggagcucgu

SEQ ID NO: 2235424 - RNA, 14 nt, Human
uaaaagacaaggaa

SEQ ID NO: 2235425 - RNA, 24 nt, Human
cauucuggaauaauccuaaacaua

SEQ ID NO: 2235426 - RNA, 19 nt, Human
aaucacucauuuauuucca

SEQ ID NO: 2235427 - RNA, 14 nt, Human
cucauuuuaaaaaa

SEQ ID NO: 2235428 - RNA, 13 nt, Human
cauuuaucuuugu

SEQ ID NO: 2235429 - RNA, 10 nt, Human
acaagagacu

SEQ ID NO: 2235430 - RNA, 19 nt, Human
acugaggcagacagcagcu

SEQ ID NO: 2235431 - RNA, 17 nt, Human
caaauauaaauaaaaau

SEQ ID NO: 2235432 - RNA, 19 nt, Human
uaaaaucauuucugcauca

SEQ ID NO: 2235433 - RNA, 19 nt, Human
caauucuugccaaauauaa

SEQ ID NO: 2235434 - RNA, 12 nt, Human
gcugaugcaguu

SEQ ID NO: 2235435 - RNA, 14 nt, Human
agacucagggcccc

SEQ ID NO: 2235436 - RNA, 12 nt, Human
acugaaaucaua

SEQ ID NO: 2235437 - RNA, 19 nt, Human
agaguuuagcuggaaaagu

SEQ ID NO: 2235438 - RNA, 22 nt, Human
aaacucauuuuuguuuucauua

SEQ ID NO: 2235439 - RNA, 13 nt, Human
acaauaaaagaca

SEQ ID NO: 2235440 - RNA, 12 nt, Human
uagaauacuaau

SEQ ID NO: 2235441 - RNA, 21 nt, Human
uuauagcuacuaauuuuaaaa

SEQ ID NO: 2235442 - RNA, 22 nt, Human
uggacgagaaaacaauaacgau

SEQ ID NO: 2235443 - RNA, 15 nt, Human
aauaacgauaaaaga

SEQ ID NO: 2235444 - RNA, 19 nt, Human
acucaaaucaagaaacuua

SEQ ID NO: 2235445 - RNA, 14 nt, Human
uaauaaaauucauu

SEQ ID NO: 2235446 - RNA, 19 nt, Human
acuucagcgguuuauauaa

SEQ ID NO: 2235447 - RNA, 11 nt, Human
aucaauuuuuc

SEQ ID NO: 2235448 - RNA, 19 nt, Human
auuauuuuuuaaaaaaauu

SEQ ID NO: 2235449 - RNA, 16 nt, Human
auuugaugcuacagga

SEQ ID NO: 2235450 - RNA, 18 nt, Human
guuucaaacauauauaac

SEQ ID NO: 2235451 - RNA, 14 nt, Human
uugaaauuguauua

SEQ ID NO: 2235452 - RNA, 23 nt, Human
cacuuggagccaaggguucagag

SEQ ID NO: 2235453 - RNA, 22 nt, Human
uggauuugcaaccccaucaucc

SEQ ID NO: 2235454 - RNA, 20 nt, Human
ucaagucuuucacauuuaaa

SEQ ID NO: 2235455 - RNA, 13 nt, Human
ucuuauaauuuaa

SEQ ID NO: 2235456 - RNA, 14 nt, Human
gcagcucaggcaca

SEQ ID NO: 2235457 - RNA, 21 nt, Human
cauuguaaaugugcuuuuaaa

SEQ ID NO: 2235458 - RNA, 16 nt, Human
uucuaaguaaaaccac

SEQ ID NO: 2235459 - RNA, 15 nt, Human
ccagagcguguagug

SEQ ID NO: 2235460 - RNA, 20 nt, Human
uaacgauaaaagacagugaa

SEQ ID NO: 2235461 - RNA, 20 nt, Human
agcucgguggacccagggau

SEQ ID NO: 2235462 - RNA, 12 nt, Human
agaaacauuuau

SEQ ID NO: 2235463 - RNA, 16 nt, Human
ugaauuaguuuuauau

SEQ ID NO: 2235464 - RNA, 13 nt, Human
ucacuguaaaaua

SEQ ID NO: 2235465 - RNA, 15 nt, Human
uaaagcuagaaauga

SEQ ID NO: 2235466 - RNA, 12 nt, Human
auuaaaaucaca

SEQ ID NO: 2235467 - RNA, 18 nt, Human
uuaucucaaaacugcacu

SEQ ID NO: 2235468 - RNA, 20 nt, Human
uaugcuucuguuuuauaauu

SEQ ID NO: 2235469 - RNA, 20 nt, Human
ucgugguaggacuguagaaa

SEQ ID NO: 2235470 - RNA, 20 nt, Human
guauuauuuuuuaaaaaaau

SEQ ID NO: 2235471 - RNA, 13 nt, Human
ugaaaaucuuaua

SEQ ID NO: 2235472 - RNA, 19 nt, Human
uauauuuuugugauuuugu

SEQ ID NO: 2235473 - RNA, 18 nt, Human
uaaguuuuuuuuuaaaaa

SEQ ID NO: 2235474 - RNA, 14 nt, Human
aacugcacugucaa

SEQ ID NO: 2235475 - RNA, 18 nt, Human
uauuuucuauaauuuaaa

SEQ ID NO: 2235476 - RNA, 21 nt, Human
aauuuuuauauuugaaauauu

SEQ ID NO: 2235477 - RNA, 22 nt, Human
uuuuauagcuacuaauuuuaaa

SEQ ID NO: 2235478 - RNA, 15 nt, Human
aaagcauuguaaaug

SEQ ID NO: 2235479 - RNA, 16 nt, Human
aggaccugacuauuga

SEQ ID NO: 2235480 - RNA, 14 nt, Human
agaauucauucacu

SEQ ID NO: 2235481 - RNA, 14 nt, Human
uggcuugaguuuaa

SEQ ID NO: 2235482 - RNA, 22 nt, Human
guuuucauuaucucaaaacugc

SEQ ID NO: 2235483 - RNA, 14 nt, Human
aguugaaaagacuc

SEQ ID NO: 2235484 - RNA, 18 nt, Human
uguaaaggaauuuaaaaa

SEQ ID NO: 2235485 - RNA, 16 nt, Human
aagacuauucaaacag

SEQ ID NO: 2235486 - RNA, 14 nt, Human
uuuugcuguagaag

SEQ ID NO: 2235487 - RNA, 17 nt, Human
auuuuaauaauguuuca

SEQ ID NO: 2235488 - RNA, 17 nt, Human
caccccuccccugcccu

SEQ ID NO: 2235489 - RNA, 18 nt, Human
agacauguggugggacag

SEQ ID NO: 2235490 - RNA, 20 nt, Human
aacaaugcuguauuuuaaaa

SEQ ID NO: 2235491 - RNA, 16 nt, Human
ucuuauaauuuaaaau

SEQ ID NO: 2235492 - RNA, 18 nt, Human
ucagccuuccccuugccc

SEQ ID NO: 2235493 - RNA, 17 nt, Human
ugaacuugguuuuaauu

SEQ ID NO: 2235494 - RNA, 22 nt, Human
uguuaaaagaugaaaauauuug

SEQ ID NO: 2235495 - RNA, 23 nt, Human
ugucaauucuugccaaauauaaa

SEQ ID NO: 2235496 - RNA, 18 nt, Human
uuaauaaaaguacauguu

SEQ ID NO: 2235497 - RNA, 21 nt, Human
aagcacugacuucuaaguaaa

SEQ ID NO: 2235498 - RNA, 19 nt, Human
auuggagcucgugggacag

SEQ ID NO: 2235499 - RNA, 22 nt, Human
auacaauguuauguauuauuau

SEQ ID NO: 2235500 - RNA, 17 nt, Human
ugguucccuugaugaag

SEQ ID NO: 2235501 - RNA, 16 nt, Human
cagccagcucucagcc

SEQ ID NO: 2235502 - RNA, 16 nt, Human
uuaaauuguaauaggc

SEQ ID NO: 2235503 - RNA, 23 nt, Human
uuuaaaugaguguguuugucacc

SEQ ID NO: 2235504 - RNA, 14 nt, Human
aagcaucacaugaa

SEQ ID NO: 2235505 - RNA, 23 nt, Human
uuuauaugcuucuguuuuauaau

SEQ ID NO: 2235506 - RNA, 12 nt, Human
uauaauuuaaaa

SEQ ID NO: 2235507 - RNA, 13 nt, Human
ucaagaaacuuaa

SEQ ID NO: 2235508 - RNA, 16 nt, Human
ugugcuuucuaucuaa

SEQ ID NO: 2235509 - RNA, 18 nt, Human
uaauuuuaacucuauaau

SEQ ID NO: 2235510 - RNA, 16 nt, Human
ucauuuuaaaaaaugg

SEQ ID NO: 2235511 - RNA, 17 nt, Human
aaaugcugguuuuucag

SEQ ID NO: 2235512 - RNA, 16 nt, Human
uaaaagacaaggaaaa

SEQ ID NO: 2235513 - RNA, 19 nt, Human
uguaaaagacuuuuuuuua

SEQ ID NO: 2235514 - RNA, 20 nt, Human
cagccuggugggccuccucu

SEQ ID NO: 2235515 - RNA, 12 nt, Human
cgaccucagccu

SEQ ID NO: 2235516 - RNA, 21 nt, Human
gccaaauauaaauaaaaauaa

SEQ ID NO: 2235517 - RNA, 11 nt, Human
ucggagaagag

SEQ ID NO: 2235518 - RNA, 20 nt, Human
aaguuguuaauaaaaguaca

SEQ ID NO: 2235519 - RNA, 22 nt, Human
auauauaacaaugcuguauuuu

SEQ ID NO: 2235520 - RNA, 18 nt, Human
uguauuauuuuuuaaaaa

SEQ ID NO: 2235521 - RNA, 18 nt, Human
uuuauguuuaauucugaa

SEQ ID NO: 2235522 - RNA, 12 nt, Human
cccuccccugcc

SEQ ID NO: 2235523 - RNA, 18 nt, Human
agcagcucaggcacacuu

SEQ ID NO: 2235524 - RNA, 15 nt, Human
uucugucuucacaac

SEQ ID NO: 2235525 - RNA, 21 nt, Human
aaaucaaauaugcaaagcacu

SEQ ID NO: 2235526 - RNA, 19 nt, Human
cucccagucauuuaauaaa

SEQ ID NO: 2235527 - RNA, 13 nt, Human
auugucuagugaa

SEQ ID NO: 2235528 - RNA, 13 nt, Human
acucauuuuuguu

SEQ ID NO: 2235529 - RNA, 16 nt, Human
uuauaauuuaaaauau

SEQ ID NO: 2235530 - RNA, 18 nt, Human
ucugccagccagcagcca

SEQ ID NO: 2235531 - RNA, 14 nt, Human
gauaauaaaauuca

SEQ ID NO: 2235532 - RNA, 20 nt, Human
aagcuucacuguaaaauaau

SEQ ID NO: 2235533 - RNA, 14 nt, Human
uugggaaaaaguaa

SEQ ID NO: 2235534 - RNA, 14 nt, Human
uuuuaaaaaaugga

SEQ ID NO: 2235535 - RNA, 16 nt, Human
agcauuguaaaugugc

SEQ ID NO: 2235536 - RNA, 13 nt, Human
ugaaauuguauua

SEQ ID NO: 2235537 - RNA, 20 nt, Human
gcugaaacaacaaauaggaa

SEQ ID NO: 2235538 - RNA, 13 nt, Human
ugauuauauguca

SEQ ID NO: 2235539 - RNA, 13 nt, Human
ucauuuuaaaaaa

SEQ ID NO: 2235540 - RNA, 17 nt, Human
gacugguucaaauguug

SEQ ID NO: 2235541 - RNA, 14 nt, Human
cuuauuuauuauug

SEQ ID NO: 2235542 - RNA, 14 nt, Human
uguguuauuuaaau

SEQ ID NO: 2235543 - RNA, 19 nt, Human
acaacucgaaucacucauu

SEQ ID NO: 2235544 - RNA, 20 nt, Human
aaauaauuuuuauauuugaa

SEQ ID NO: 2235545 - RNA, 13 nt, Human
uaagcuagaaaaa

SEQ ID NO: 2235546 - RNA, 16 nt, Human
uucaguuauuauauuu

SEQ ID NO: 2235547 - RNA, 17 nt, Human
ugaaauauuauuuuaua

SEQ ID NO: 2235548 - RNA, 16 nt, Human
gacauuugcucaugga

SEQ ID NO: 2235549 - RNA, 11 nt, Human
cagauauaaaa

SEQ ID NO: 2235550 - RNA, 23 nt, Human
guacuguguacagaauucugcua

SEQ ID NO: 2235551 - RNA, 14 nt, Human
acugagaugugaac

SEQ ID NO: 2235552 - RNA, 18 nt, Human
gcuacaaaaacacagcaa

SEQ ID NO: 2235553 - RNA, 21 nt, Human
acaguuaccucugccucagaa

SEQ ID NO: 2235554 - RNA, 18 nt, Human
uugcccagggcucagccu

SEQ ID NO: 2235555 - RNA, 17 nt, Human
caagccuccuuuuaaag

SEQ ID NO: 2235556 - RNA, 12 nt, Human
uuagggagagaa

SEQ ID NO: 2235557 - RNA, 22 nt, Human
uaucaaacugaagccagaaaua

SEQ ID NO: 2235558 - RNA, 12 nt, Human
aaaaaaaaauac

SEQ ID NO: 2235559 - RNA, 22 nt, Human
gaguccuugcaucaauuuuucu

SEQ ID NO: 2235560 - RNA, 13 nt, Human
cugggggagggga

SEQ ID NO: 2235561 - RNA, 16 nt, Human
gccaugugcuaguaau

SEQ ID NO: 2235562 - RNA, 17 nt, Human
aacauaagcuagaaaaa

SEQ ID NO: 2235563 - RNA, 13 nt, Human
uuuucuuuucauu

SEQ ID NO: 2235564 - RNA, 21 nt, Human
aaaauaccaugccauuuaaag

SEQ ID NO: 2235565 - RNA, 20 nt, Human
uuccuuagcuuagaccucag

SEQ ID NO: 2235566 - RNA, 18 nt, Human
gaaaauaacgauaaaaga

SEQ ID NO: 2235567 - RNA, 21 nt, Human
cagacauguggugggacaggg

SEQ ID NO: 2235568 - RNA, 20 nt, Human
aagucuuucacauuuaaaua

SEQ ID NO: 2235569 - RNA, 15 nt, Human
cagggccccagcacu

SEQ ID NO: 2235570 - RNA, 15 nt, Human
gcuuauuaaaacuca

SEQ ID NO: 2235571 - RNA, 18 nt, Human
ccuguggccaaguucuua

SEQ ID NO: 2235572 - RNA, 17 nt, Human
cccccuugccagacaug

SEQ ID NO: 2235573 - RNA, 14 nt, Human
uuuuaaaaaagaaa

SEQ ID NO: 2235574 - RNA, 17 nt, Human
aauaacaauaaaagaca

SEQ ID NO: 2235575 - RNA, 12 nt, Human
aacauaaaauac

SEQ ID NO: 2235576 - RNA, 23 nt, Human
ucuagcaugucgucaaagcugaa

SEQ ID NO: 2235577 - RNA, 15 nt, Human
gcugcccgucuucag

SEQ ID NO: 2235578 - RNA, 12 nt, Human
uauuuauauaaa

SEQ ID NO: 2235579 - RNA, 16 nt, Human
cugcccuagagcacac

SEQ ID NO: 2235580 - RNA, 18 nt, Human
gcuuucuaucuaauuuuu

SEQ ID NO: 2235581 - RNA, 16 nt, Human
ugaaauuguauuacaa

SEQ ID NO: 2235582 - RNA, 13 nt, Human
gaagaacugaaau

SEQ ID NO: 2235583 - RNA, 21 nt, Human
aaagaaaauaacgauaaaaga

SEQ ID NO: 2235584 - RNA, 22 nt, Human
cuguucacagccagacuggcac

SEQ ID NO: 2235585 - RNA, 18 nt, Human
gacauuugcucauggaau

SEQ ID NO: 2235586 - RNA, 16 nt, Human
uggacucauuuuaaaa

SEQ ID NO: 2235587 - RNA, 14 nt, Human
caccccuccccugc

SEQ ID NO: 2235588 - RNA, 23 nt, Human
aaauacugauguuccuagugaaa

SEQ ID NO: 2235589 - RNA, 21 nt, Human
uuacauuuguauaaaauaauu

SEQ ID NO: 2235590 - RNA, 17 nt, Human
cuccucuguccagggcc

SEQ ID NO: 2235591 - RNA, 16 nt, Human
ugaaacugagauguga

SEQ ID NO: 2235592 - RNA, 12 nt, Human
aaaacacagcaa

SEQ ID NO: 2235593 - RNA, 16 nt, Human
augcugguuuuucagu

SEQ ID NO: 2235594 - RNA, 17 nt, Human
acaaaugcauuucuaaa

SEQ ID NO: 2235595 - RNA, 18 nt, Human
caugaauuaguuuuauau

SEQ ID NO: 2235596 - RNA, 22 nt, Human
cuuguauuaaguuguuaauaaa

SEQ ID NO: 2235597 - RNA, 12 nt, Human
ugagagacacac

SEQ ID NO: 2235598 - RNA, 21 nt, Human
caaggaaaaaauaacaaugaa

SEQ ID NO: 2235599 - RNA, 14 nt, Human
gucuuaauuaaaag

SEQ ID NO: 2235600 - RNA, 14 nt, Human
auuauuugcagaga

SEQ ID NO: 2235601 - RNA, 20 nt, Human
cacuguggguagacacacau

SEQ ID NO: 2235602 - RNA, 15 nt, Human
aaauauuuauuuuaa

SEQ ID NO: 2235603 - RNA, 22 nt, Human
cugggacaggggagaaccuagg

SEQ ID NO: 2235604 - RNA, 18 nt, Human
caaggguucagagacuca

SEQ ID NO: 2235605 - RNA, 14 nt, Human
uauaaauaaaaaua

SEQ ID NO: 2235606 - RNA, 19 nt, Human
cacuguagcauuacagugg

SEQ ID NO: 2235607 - RNA, 22 nt, Human
cuuugagugucuuaauuaaaag

SEQ ID NO: 2235608 - RNA, 21 nt, Human
cacaugaacuuguaaaggaau

SEQ ID NO: 2235609 - RNA, 20 nt, Human
aucaauuuuucuuauuucau

SEQ ID NO: 2235610 - RNA, 17 nt, Human
gugcuacaaaaacacag

SEQ ID NO: 2235611 - RNA, 21 nt, Human
aaaaauggaacauaaaauaca

SEQ ID NO: 2235612 - RNA, 11 nt, Human
aauuuaaauau

SEQ ID NO: 2235613 - RNA, 19 nt, Human
gcacuaguauuucuaugaa

SEQ ID NO: 2235614 - RNA, 22 nt, Human
auuacuguaagaaaauaucacu

SEQ ID NO: 2235615 - RNA, 21 nt, Human
ucaagacaaaugacccccauc

SEQ ID NO: 2235616 - RNA, 19 nt, Human
gacucauuuuaaaaaaugg

SEQ ID NO: 2235617 - RNA, 12 nt, Human
acacugaagaag

SEQ ID NO: 2235618 - RNA, 13 nt, Human
aagagcuguucac

SEQ ID NO: 2235619 - RNA, 23 nt, Human
uuuuauagcuacuaauuuuaaaa

SEQ ID NO: 2235620 - RNA, 16 nt, Human
gcuugcccuguuaaaa

SEQ ID NO: 2235621 - RNA, 20 nt, Human
gcacaguuuucugagaaaga

SEQ ID NO: 2235622 - RNA, 12 nt, Human
gggaggggacau

SEQ ID NO: 2235623 - RNA, 15 nt, Human
agugguauagaaaug

SEQ ID NO: 2235624 - RNA, 21 nt, Human
gggaagacuguggcugcuagc

SEQ ID NO: 2235625 - RNA, 19 nt, Human
uauuuuaauaauguuucaa

SEQ ID NO: 2235626 - RNA, 23 nt, Human
uagacacacaugaaguccaagca

SEQ ID NO: 2235627 - RNA, 19 nt, Human
cccugguaauaaguacugu

SEQ ID NO: 2235628 - RNA, 16 nt, Human
caacacgagcaggcua

SEQ ID NO: 2235629 - RNA, 13 nt, Human
ccuccucugucca

SEQ ID NO: 2235630 - RNA, 18 nt, Human
agaaaugcugguuuuuca

SEQ ID NO: 2235631 - RNA, 21 nt, Human
ugaaauggacuuuuguacaua

SEQ ID NO: 2235632 - RNA, 12 nt, Human
aagcauuguaaa

SEQ ID NO: 2235633 - RNA, 19 nt, Human
ugcuacaaaaacacagcaa

SEQ ID NO: 2235634 - RNA, 17 nt, Human
uaaaugugcuuuuaaaa

SEQ ID NO: 2235635 - RNA, 20 nt, Human
uuuaaauaaaguguuugaaa

SEQ ID NO: 2235636 - RNA, 14 nt, Human
uuauuguuuaaaau

SEQ ID NO: 2235637 - RNA, 13 nt, Human
auaaauaaaaaua

SEQ ID NO: 2235638 - RNA, 14 nt, Human
agggaaacugccag

SEQ ID NO: 2235639 - RNA, 15 nt, Human
uaacaauaaaagaca

SEQ ID NO: 2235640 - RNA, 15 nt, Human
agaaauaaaguuggu

SEQ ID NO: 2235641 - RNA, 23 nt, Human
cauuguaaaugugcuuuuaaaaa

SEQ ID NO: 2235642 - RNA, 23 nt, Human
ggaacaguuaccucugccucaga

SEQ ID NO: 2235643 - RNA, 19 nt, Human
agggucaggagaggggcag

SEQ ID NO: 2235644 - RNA, 14 nt, Human
ugcuucuguuuuau

SEQ ID NO: 2235645 - RNA, 19 nt, Human
ugaaaagacuccaaagaaa

SEQ ID NO: 2235646 - RNA, 19 nt, Human
uucccaaauuucauaccua

SEQ ID NO: 2235647 - RNA, 17 nt, Human
ccuguguuacugauuug

SEQ ID NO: 2235648 - RNA, 18 nt, Human
auguaaaagacuuuuuuu

SEQ ID NO: 2235649 - RNA, 22 nt, Human
agaagcaccaaucaugaauuag

SEQ ID NO: 2235650 - RNA, 21 nt, Human
aggcaacugaggcagacagca

SEQ ID NO: 2235651 - RNA, 15 nt, Human
gccucuuagaugcag

SEQ ID NO: 2235652 - RNA, 19 nt, Human
cacugacuucuaaguaaaa

SEQ ID NO: 2235653 - RNA, 15 nt, Human
aaaaauaacaaugaa

SEQ ID NO: 2235654 - RNA, 16 nt, Human
aaaugugcuuuuaaaa

SEQ ID NO: 2235655 - RNA, 21 nt, Human
agaagagcuguucacagccag

SEQ ID NO: 2235656 - RNA, 16 nt, Human
auccccagcuguuuau

SEQ ID NO: 2235657 - RNA, 19 nt, Human
aacauaagcuagaaaaauu

SEQ ID NO: 2235658 - RNA, 12 nt, Human
guuaauaaaagu

SEQ ID NO: 2235659 - RNA, 21 nt, Human
aaucaauacuuugaacacaaa

SEQ ID NO: 2235660 - RNA, 20 nt, Human
aagcaucauuauuugcagag

SEQ ID NO: 2235661 - RNA, 18 nt, Human
aucacaaaaguauauuca

SEQ ID NO: 2235662 - RNA, 18 nt, Human
agagcuguucacagccag

SEQ ID NO: 2235663 - RNA, 15 nt, Human
uaaagcuuauuaaaa

SEQ ID NO: 2235664 - RNA, 19 nt, Human
gaaucacucauuuauuucc

SEQ ID NO: 2235665 - RNA, 17 nt, Human
auguagcaaauuccaau

SEQ ID NO: 2235666 - RNA, 20 nt, Human
augcuucuguuuuauaauuu

SEQ ID NO: 2235667 - RNA, 17 nt, Human
agugucuuaauuaaaag

SEQ ID NO: 2235668 - RNA, 16 nt, Human
auauuguacaguuuuu

SEQ ID NO: 2235669 - RNA, 20 nt, Human
aauuuugugaagcaaaauuu

SEQ ID NO: 2235670 - RNA, 12 nt, Human
uauuucauuucu

SEQ ID NO: 2235671 - RNA, 12 nt, Human
caccccuccccu

SEQ ID NO: 2235672 - RNA, 22 nt, Human
cagcaagggugaugggaaagca

SEQ ID NO: 2235673 - RNA, 23 nt, Human
ggaugaauuaaguuuuuuuuuaa

SEQ ID NO: 2235674 - RNA, 19 nt, Human
agacuccaaagaaauguaa

SEQ ID NO: 2235675 - RNA, 16 nt, Human
uaaauaaaaauaaucc

SEQ ID NO: 2235676 - RNA, 16 nt, Human
auggaggcuuugcaua

SEQ ID NO: 2235677 - RNA, 15 nt, Human
auacacacucaaauc

SEQ ID NO: 2235678 - RNA, 16 nt, Human
aacauuuaucuuugua

SEQ ID NO: 2235679 - RNA, 18 nt, Human
uuugugaagaaacauuua

SEQ ID NO: 2235680 - RNA, 17 nt, Human
uuucacauuuaaauaaa

SEQ ID NO: 2235681 - RNA, 19 nt, Human
uacuucuuaggguuaugau

SEQ ID NO: 2235682 - RNA, 17 nt, Human
gacgagaaaacaauaac

SEQ ID NO: 2235683 - RNA, 19 nt, Human
cacagcaagggugauggga

SEQ ID NO: 2235684 - RNA, 17 nt, Human
guuuaauucugaaagca

SEQ ID NO: 2235685 - RNA, 20 nt, Human
ugcuuguuggauuuuugucu

SEQ ID NO: 2235686 - RNA, 17 nt, Human
gacuuauuuauauaaau

SEQ ID NO: 2235687 - RNA, 19 nt, Human
agacagugaaagaaaauaa

SEQ ID NO: 2235688 - RNA, 20 nt, Human
uuguaaaugugcuuuuaaaa

SEQ ID NO: 2235689 - RNA, 18 nt, Human
uguuucuuuaguuuuugu

SEQ ID NO: 2235690 - RNA, 19 nt, Human
uguuggacgagaaaacaau

SEQ ID NO: 2235691 - RNA, 17 nt, Human
ugaucuuuaaaauacac

SEQ ID NO: 2235692 - RNA, 21 nt, Human
ggccccagcacuaaagcagug

SEQ ID NO: 2235693 - RNA, 16 nt, Human
agguacuucaaauccu

SEQ ID NO: 2235694 - RNA, 17 nt, Human
gccaaggguucagagac

SEQ ID NO: 2235695 - RNA, 14 nt, Human
aaaagacagugaaa

SEQ ID NO: 2235696 - RNA, 18 nt, Human
aaauggagaaaggacccu

SEQ ID NO: 2235697 - RNA, 17 nt, Human
cuaucucauuuccaagc

SEQ ID NO: 2235698 - RNA, 18 nt, Human
aaucaaauaugcaaagca

SEQ ID NO: 2235699 - RNA, 15 nt, Human
agacuggaaggacca

SEQ ID NO: 2235700 - RNA, 23 nt, Human
uccagguagaggguguguaagua

SEQ ID NO: 2235701 - RNA, 19 nt, Human
cucauggaauuggagcucg

SEQ ID NO: 2235702 - RNA, 20 nt, Human
accuacacgagauacagaau

SEQ ID NO: 2235703 - RNA, 14 nt, Human
auuguccaggucua

SEQ ID NO: 2235704 - RNA, 13 nt, Human
uacuaauaaaaua

SEQ ID NO: 2235705 - RNA, 18 nt, Human
cuaucuaauuuuuauuaa

SEQ ID NO: 2235706 - RNA, 22 nt, Human
cuuguuggauuuuugucuugug

SEQ ID NO: 2235707 - RNA, 12 nt, Human
auauuuugaaca

SEQ ID NO: 2235708 - RNA, 15 nt, Human
ccccuccccugcccu

SEQ ID NO: 2235709 - RNA, 14 nt, Human
uuuuaaguuacaca

SEQ ID NO: 2235710 - RNA, 19 nt, Human
auuguguguuauuuaaaug

SEQ ID NO: 2235711 - RNA, 14 nt, Human
ccaaauauaaauaa

SEQ ID NO: 2235712 - RNA, 22 nt, Human
cucauuuauuuccauauuaaaa

SEQ ID NO: 2235713 - RNA, 16 nt, Human
uuucacauuuaaauaa

SEQ ID NO: 2235714 - RNA, 14 nt, Human
agggccccagcacu

SEQ ID NO: 2235715 - RNA, 14 nt, Human
agcucguggaacag

SEQ ID NO: 2235716 - RNA, 23 nt, Human
uaaaagacagugaaagaaaauaa

SEQ ID NO: 2235717 - RNA, 17 nt, Human
ucuauaauuuaaauaua

SEQ ID NO: 2235718 - RNA, 16 nt, Human
cagccuggugggccuc

SEQ ID NO: 2235719 - RNA, 19 nt, Human
ugaaauggacuuuuguaca

SEQ ID NO: 2235720 - RNA, 23 nt, Human
aguaauuuauuguuuuuccuugu

SEQ ID NO: 2235721 - RNA, 19 nt, Human
cuuucuaucuaauuuuuau

SEQ ID NO: 2235722 - RNA, 23 nt, Human
auuauauggcuugaguuuaaauu

SEQ ID NO: 2235723 - RNA, 15 nt, Human
gggacagggacccac

SEQ ID NO: 2235724 - RNA, 18 nt, Human
aguuacacauuuuucaga

SEQ ID NO: 2235725 - RNA, 17 nt, Human
gacuuccauuuggaauc

SEQ ID NO: 2235726 - RNA, 16 nt, Human
aguguacagucuugua

SEQ ID NO: 2235727 - RNA, 17 nt, Human
ugaaaaucuuauaauuu

SEQ ID NO: 2235728 - RNA, 14 nt, Human
aggcgggaaggagg

SEQ ID NO: 2235729 - RNA, 13 nt, Human
agcuuauuaaaac

SEQ ID NO: 2235730 - RNA, 14 nt, Human
aagagugaaggauu

SEQ ID NO: 2235731 - RNA, 14 nt, Human
ugcugguuuuucag

SEQ ID NO: 2235732 - RNA, 18 nt, Human
cuauaggugcuacaaaaa

SEQ ID NO: 2235733 - RNA, 16 nt, Human
gucacuagggcaggga

SEQ ID NO: 2235734 - RNA, 17 nt, Human
gauuuuaaucuuuuucu

SEQ ID NO: 2235735 - RNA, 16 nt, Human
uaaaauccauacauuu

SEQ ID NO: 2235736 - RNA, 17 nt, Human
aacaguuaccucugccu

SEQ ID NO: 2235737 - RNA, 12 nt, Human
aaaauaacaaua

SEQ ID NO: 2235738 - RNA, 13 nt, Human
uagaccucagccu

SEQ ID NO: 2235739 - RNA, 13 nt, Human
guacagucuugua

SEQ ID NO: 2235740 - RNA, 13 nt, Human
auagaaggguacc

SEQ ID NO: 2235741 - RNA, 17 nt, Human
uuuuuaauuauauggcu

SEQ ID NO: 2235742 - RNA, 13 nt, Human
aagaugugggcag

SEQ ID NO: 2235743 - RNA, 20 nt, Human
uuucauuaucucaaaacugc

SEQ ID NO: 2235744 - RNA, 21 nt, Human
ugggccuccucuguccagggc

SEQ ID NO: 2235745 - RNA, 17 nt, Human
gaucuuuaaaauacaca

SEQ ID NO: 2235746 - RNA, 15 nt, Human
gacucauuuuaaaaa

SEQ ID NO: 2235747 - RNA, 22 nt, Human
auuguuuuuccuuguauuuaaa

SEQ ID NO: 2235748 - RNA, 14 nt, Human
augauguuuagaaa

SEQ ID NO: 2235749 - RNA, 16 nt, Human
aucaauacuuugaaca

SEQ ID NO: 2235750 - RNA, 20 nt, Human
uauauucaaaaauuauauuu

SEQ ID NO: 2235751 - RNA, 20 nt, Human
uggagaaaggacccucaaga

SEQ ID NO: 2235752 - RNA, 13 nt, Human
agaaguaaaaaca

SEQ ID NO: 2235753 - RNA, 18 nt, Human
auuuggccguuuugugaa

SEQ ID NO: 2235754 - RNA, 16 nt, Human
auccugucccuccucc

SEQ ID NO: 2235755 - RNA, 15 nt, Human
auaaauaaaaauaau

SEQ ID NO: 2235756 - RNA, 23 nt, Human
ugaauuacauuuguauaaaauaa

SEQ ID NO: 2235757 - RNA, 14 nt, Human
gcccagggcucagc

SEQ ID NO: 2235758 - RNA, 17 nt, Human
uuauaaucuuucacagg

SEQ ID NO: 2235759 - RNA, 15 nt, Human
gaaaacaaggaugaa

SEQ ID NO: 2235760 - RNA, 14 nt, Human
gaaacaacaaauag

SEQ ID NO: 2235761 - RNA, 14 nt, Human
caguucugaagaag

SEQ ID NO: 2235762 - RNA, 22 nt, Human
uggaaaguuuaugguuguauua

SEQ ID NO: 2235763 - RNA, 18 nt, Human
gacuucuaaguaaaacca

SEQ ID NO: 2235764 - RNA, 15 nt, Human
ugaaauuguauuaca

SEQ ID NO: 2235765 - RNA, 17 nt, Human
acugacuucuaaguaaa

SEQ ID NO: 2235766 - RNA, 18 nt, Human
gaaaauaacaauaaaaga

SEQ ID NO: 2235767 - RNA, 13 nt, Human
ccucauggaauug

SEQ ID NO: 2235768 - RNA, 12 nt, Human
guauauucaaaa

SEQ ID NO: 2235769 - RNA, 20 nt, Human
caagagccuuuuuuugaaaa

SEQ ID NO: 2235770 - RNA, 20 nt, Human
aaagacaaggaaaaaauaac

SEQ ID NO: 2235771 - RNA, 23 nt, Human
acugauuuggccguuuugugaag

SEQ ID NO: 2235772 - RNA, 16 nt, Human
gcagggcauggcuggg

SEQ ID NO: 2235773 - RNA, 17 nt, Human
aaucuuauaauuuaaaa

SEQ ID NO: 2235774 - RNA, 15 nt, Human
auagaaguaaaaaca

SEQ ID NO: 2235775 - RNA, 20 nt, Human
auaauccuaaacauaugaau

SEQ ID NO: 2235776 - RNA, 22 nt, Human
ggacaguaaaauccacagacca

SEQ ID NO: 2235777 - RNA, 14 nt, Human
ccaaugaaaugagu

SEQ ID NO: 2235778 - RNA, 21 nt, Human
uuaauugacuuauuuauauaa

SEQ ID NO: 2235779 - RNA, 17 nt, Human
uggaacauaaaauacaa

SEQ ID NO: 2235780 - RNA, 18 nt, Human
gaagcaccaaucaugaau

SEQ ID NO: 2235781 - RNA, 14 nt, Human
acuggaaggaccau

SEQ ID NO: 2235782 - RNA, 13 nt, Human
uuaaaaucauuuc

SEQ ID NO: 2235783 - RNA, 13 nt, Human
aacacaacuauau

SEQ ID NO: 2235784 - RNA, 21 nt, Human
agggugauauuaaccaggggc

SEQ ID NO: 2235785 - RNA, 17 nt, Human
guuucuuuaguuuuugu

SEQ ID NO: 2235786 - RNA, 20 nt, Human
ugcuacaaaaacacagcaag

SEQ ID NO: 2235787 - RNA, 19 nt, Human
cuuagcuuagaccucagcc

SEQ ID NO: 2235788 - RNA, 19 nt, Human
cacaguuuucugagaaaga

SEQ ID NO: 2235789 - RNA, 17 nt, Human
acaagagacuggaagga

SEQ ID NO: 2235790 - RNA, 17 nt, Human
caucagcugcugaaaca

SEQ ID NO: 2235791 - RNA, 19 nt, Human
caaagaaauguaagggaaa

SEQ ID NO: 2235792 - RNA, 22 nt, Human
uauuucuaugaaauauuauguu

SEQ ID NO: 2235793 - RNA, 19 nt, Human
agagggauuagggagagaa

SEQ ID NO: 2235794 - RNA, 14 nt, Human
acagucuuguauua

SEQ ID NO: 2235795 - RNA, 17 nt, Human
cucagccuuccccuugc

SEQ ID NO: 2235796 - RNA, 17 nt, Human
auaaguacaugauaagc

SEQ ID NO: 2235797 - RNA, 15 nt, Human
uguuauguauuauua

SEQ ID NO: 2235798 - RNA, 21 nt, Human
auuauauuuauuacuguaaga

SEQ ID NO: 2235799 - RNA, 13 nt, Human
gaaccuaggguga

SEQ ID NO: 2235800 - RNA, 19 nt, Human
agaauacuaauaaaauaca

SEQ ID NO: 2235801 - RNA, 18 nt, Human
uggaacauaaaauacaau

SEQ ID NO: 2235802 - RNA, 17 nt, Human
aguguacagucuuguau

SEQ ID NO: 2235803 - RNA, 23 nt, Human
uuuguauaaaauaauuuuuauau

SEQ ID NO: 2235804 - RNA, 19 nt, Human
agaaagacuauucaaacag

SEQ ID NO: 2235805 - RNA, 16 nt, Human
agugaaagaaaauaac

SEQ ID NO: 2235806 - RNA, 18 nt, Human
uaaaauccauacauuugu

SEQ ID NO: 2235807 - RNA, 20 nt, Human
ucaauaaaauccauacauuu

SEQ ID NO: 2235808 - RNA, 16 nt, Human
aaaauuauauuuugaa

SEQ ID NO: 2235809 - RNA, 13 nt, Human
uugauaauaaaau

SEQ ID NO: 2235810 - RNA, 19 nt, Human
ucuagaauacuaauaaaau

SEQ ID NO: 2235811 - RNA, 22 nt, Human
aaacaaggaugaauuaaguuuu

SEQ ID NO: 2235812 - RNA, 17 nt, Human
ucuuucacauuuaaaua

SEQ ID NO: 2235813 - RNA, 17 nt, Human
gucugccagccagcagc

SEQ ID NO: 2235814 - RNA, 19 nt, Human
aauacacacucaaaucaag

SEQ ID NO: 2235815 - RNA, 13 nt, Human
uuucuaucuaauu

SEQ ID NO: 2235816 - RNA, 20 nt, Human
gaacacugggggaggggaca

SEQ ID NO: 2235817 - RNA, 15 nt, Human
cuugcccagggcuca

SEQ ID NO: 2235818 - RNA, 15 nt, Human
aaagacuccaaagaa

SEQ ID NO: 2235819 - RNA, 15 nt, Human
uaugcaaagcacuga

SEQ ID NO: 2235820 - RNA, 17 nt, Human
gaccugacuauugaagu

SEQ ID NO: 2235821 - RNA, 20 nt, Human
aacaagccuccuuuuaaagu

SEQ ID NO: 2235822 - RNA, 19 nt, Human
aaacaauaacgauaaaaga

SEQ ID NO: 2235823 - RNA, 19 nt, Human
ugcuuuuaaaaaaaaauac

SEQ ID NO: 2235824 - RNA, 20 nt, Human
ucuggauuugcaaccccauc

SEQ ID NO: 2235825 - RNA, 21 nt, Human
uuuagaauauuaaaaauuaau

SEQ ID NO: 2235826 - RNA, 18 nt, Human
agcaaaauuuuuucucua

SEQ ID NO: 2235827 - RNA, 21 nt, Human
acagugaaagaaaauaacaau

SEQ ID NO: 2235828 - RNA, 23 nt, Human
aggaugguucccuugaugaagaa

SEQ ID NO: 2235829 - RNA, 21 nt, Human
aauucauucacucaacaaaca

SEQ ID NO: 2235830 - RNA, 22 nt, Human
uaaaauaauuuuuauauuugaa

SEQ ID NO: 2235831 - RNA, 21 nt, Human
cagggccccagcacuaaagca

SEQ ID NO: 2235832 - RNA, 14 nt, Human
auccuugaagauuu

SEQ ID NO: 2235833 - RNA, 14 nt, Human
aggugcuacaaaaa

SEQ ID NO: 2235834 - RNA, 14 nt, Human
ucuauaauuuaaau

SEQ ID NO: 2235835 - RNA, 16 nt, Human
aaauuagaugacugaa

SEQ ID NO: 2235836 - RNA, 19 nt, Human
gcucauggaauuggagcuc

SEQ ID NO: 2235837 - RNA, 14 nt, Human
gauaaaagacagug

SEQ ID NO: 2235838 - RNA, 15 nt, Human
agagacucagggccc

SEQ ID NO: 2235839 - RNA, 15 nt, Human
cugacucuuaagaag

SEQ ID NO: 2235840 - RNA, 22 nt, Human
cccaugauguuuagaaacacaa

SEQ ID NO: 2235841 - RNA, 19 nt, Human
auuuucuauaauuuaaaua

SEQ ID NO: 2235842 - RNA, 20 nt, Human
ggcucagccuggugggccuc

SEQ ID NO: 2235843 - RNA, 22 nt, Human
ugggcacuguggguagacacac

SEQ ID NO: 2235844 - RNA, 14 nt, Human
ccauuuaaagcuua

SEQ ID NO: 2235845 - RNA, 14 nt, Human
ugaugaucuuuaaa

SEQ ID NO: 2235846 - RNA, 14 nt, Human
aacgauaaaagaca

SEQ ID NO: 2235847 - RNA, 16 nt, Human
aucaaacugaagccag

SEQ ID NO: 2235848 - RNA, 14 nt, Human
agaaaauaacaaua

SEQ ID NO: 2235849 - RNA, 14 nt, Human
cauagaaguaaaaa

SEQ ID NO: 2235850 - RNA, 22 nt, Human
aaaucaggguuaguauugucca

SEQ ID NO: 2235851 - RNA, 17 nt, Human
ccaaguucuuaguugcu

SEQ ID NO: 2235852 - RNA, 22 nt, Human
cacuaguauuucuaugaaauau

SEQ ID NO: 2235853 - RNA, 17 nt, Human
acugaacauuccagagc

SEQ ID NO: 2235854 - RNA, 23 nt, Human
cugaaaucauacuucuuaggguu

SEQ ID NO: 2235855 - RNA, 19 nt, Human
agccuagccgaccucagcc

SEQ ID NO: 2235856 - RNA, 21 nt, Human
ccucuguccagggcccugagc

SEQ ID NO: 2235857 - RNA, 16 nt, Human
uucucuaggaaauauu

SEQ ID NO: 2235858 - RNA, 19 nt, Human
aagagcuguucacagccag

SEQ ID NO: 2235859 - RNA, 17 nt, Human
agacuccaaagaaaugu

SEQ ID NO: 2235860 - RNA, 12 nt, Human
auaacuggaaac

SEQ ID NO: 2235861 - RNA, 18 nt, Human
aaauaacuuuuuuuuaag

SEQ ID NO: 2235862 - RNA, 14 nt, Human
uuggggaagacugu

SEQ ID NO: 2235863 - RNA, 19 nt, Human
ggaaaaaauaacaaugaaa

SEQ ID NO: 2235864 - RNA, 16 nt, Human
gaaaugcugguuuuuc

SEQ ID NO: 2235865 - RNA, 22 nt, Human
auuuuaaaaaauggaacauaaa

SEQ ID NO: 2235866 - RNA, 22 nt, Human
uagauaaagcacuguuuggaua

SEQ ID NO: 2235867 - RNA, 15 nt, Human
auuugguaaggggaa

SEQ ID NO: 2235868 - RNA, 21 nt, Human
gacauguggugggacagggac

SEQ ID NO: 2235869 - RNA, 18 nt, Human
uacauuuguauaaaauaa

SEQ ID NO: 2235870 - RNA, 14 nt, Human
agcuuagaccucag

SEQ ID NO: 2235871 - RNA, 14 nt, Human
guccuggggccucg

SEQ ID NO: 2235872 - RNA, 18 nt, Human
gaaagaggcagcuugaaa

SEQ ID NO: 2235873 - RNA, 13 nt, Human
uuuaaaaauccua

SEQ ID NO: 2235874 - RNA, 14 nt, Human
aacuuacuuagugu

SEQ ID NO: 2235875 - RNA, 16 nt, Human
augaauacuuuauaaa

SEQ ID NO: 2235876 - RNA, 15 nt, Human
ccccugcccuagagc

SEQ ID NO: 2235877 - RNA, 16 nt, Human
uagcaaagaguuaaua

SEQ ID NO: 2235878 - RNA, 14 nt, Human
guccaagcauacca

SEQ ID NO: 2235879 - RNA, 24 nt, Human
gaaauguaagggaaacugccagca

SEQ ID NO: 2235880 - RNA, 20 nt, Human
acccacuucacacacaggca

SEQ ID NO: 2235881 - RNA, 19 nt, Human
cuuaagacgugauuuugcu

SEQ ID NO: 2235882 - RNA, 17 nt, Human
agcacuguuuggauaug

SEQ ID NO: 2235883 - RNA, 15 nt, Human
ugugaaguuuaauug

SEQ ID NO: 2235884 - RNA, 14 nt, Human
caucaauuuuucuu

SEQ ID NO: 2235885 - RNA, 22 nt, Human
ccacagcuguaugauucccagc

SEQ ID NO: 2235886 - RNA, 22 nt, Human
uguucugauauuggacaguaaa

SEQ ID NO: 2235887 - RNA, 22 nt, Human
acucauuuuuguuuucauuauc

SEQ ID NO: 2235888 - RNA, 14 nt, Human
uuaaaagaugaaaa

SEQ ID NO: 2235889 - RNA, 19 nt, Human
ucccguggaacguuuuucc

SEQ ID NO: 2235890 - RNA, 18 nt, Human
auauuguacaguuuuuau

SEQ ID NO: 2235891 - RNA, 17 nt, Human
caggcaacugaggcaga

SEQ ID NO: 2235892 - RNA, 18 nt, Human
acagcaguugaaaagacu

SEQ ID NO: 2235893 - RNA, 12 nt, Human
uacuaauaaaau

SEQ ID NO: 2235894 - RNA, 23 nt, Human
uguagaaaagggaacugaacauu

SEQ ID NO: 2235895 - RNA, 20 nt, Human
gaguaagcaccuuuagaaua

SEQ ID NO: 2235896 - RNA, 18 nt, Human
aaauauaaauaaaaauaa

SEQ ID NO: 2235897 - RNA, 18 nt, Human
cagccuagccgaccucag

SEQ ID NO: 2235898 - RNA, 13 nt, Human
cuaugaaauauua

SEQ ID NO: 2235899 - RNA, 22 nt, Human
auucccugagcaggauuuuaau

SEQ ID NO: 2235900 - RNA, 13 nt, Human
uuccccuugccca

SEQ ID NO: 2235901 - RNA, 14 nt, Human
caggagaggggcag

SEQ ID NO: 2235902 - RNA, 20 nt, Human
aaucuuucacaggggacagg

SEQ ID NO: 2235903 - RNA, 17 nt, Human
uauuuuaacuuccuugg

SEQ ID NO: 2235904 - RNA, 15 nt, Human
uuagaauauuaaaaa

SEQ ID NO: 2235905 - RNA, 15 nt, Human
uggcacuuauaacca

SEQ ID NO: 2235906 - RNA, 21 nt, Human
gauagcagggcauggcuggga

SEQ ID NO: 2235907 - RNA, 19 nt, Human
ucuucuuggucuuauuuau

SEQ ID NO: 2235908 - RNA, 23 nt, Human
acaaaaguauauucaaaaauuau

SEQ ID NO: 2235909 - RNA, 16 nt, Human
uacauuuguauaaaau

SEQ ID NO: 2235910 - RNA, 20 nt, Human
agccuuuuuuugaaaaaaag

SEQ ID NO: 2235911 - RNA, 17 nt, Human
guuaaaagaugaaaaua

SEQ ID NO: 2235912 - RNA, 22 nt, Human
uuuaaguuacacauuuuucaga

SEQ ID NO: 2235913 - RNA, 16 nt, Human
ugcaaauugucacagg

SEQ ID NO: 2235914 - RNA, 21 nt, Human
cugugcugcccgucuucagcc

SEQ ID NO: 2235915 - RNA, 19 nt, Human
aaaauaacgauaaaagaca

SEQ ID NO: 2235916 - RNA, 22 nt, Human
aguauguuagugcaaauuguca

SEQ ID NO: 2235917 - RNA, 19 nt, Human
aguauuucuaugaaauauu

SEQ ID NO: 2235918 - RNA, 13 nt, Human
uaaaugagugugu

SEQ ID NO: 2235919 - RNA, 20 nt, Human
aaaauaccaugccauuuaaa

SEQ ID NO: 2235920 - RNA, 14 nt, Human
auuugaaauuguau

SEQ ID NO: 2235921 - RNA, 17 nt, Human
ccuggugggccuccucu

SEQ ID NO: 2235922 - RNA, 22 nt, Human
uggugggccuccucuguccagg

SEQ ID NO: 2235923 - RNA, 18 nt, Human
ggaggguuagggaggggu

SEQ ID NO: 2235924 - RNA, 12 nt, Human
cucauggaauug

SEQ ID NO: 2235925 - RNA, 14 nt, Human
auuucuaugaaaua

SEQ ID NO: 2235926 - RNA, 19 nt, Human
uauacugugugcuaaaaca

SEQ ID NO: 2235927 - RNA, 14 nt, Human
auauuugaaauauu

SEQ ID NO: 2235928 - RNA, 16 nt, Human
gucucaggaaaucaaa

SEQ ID NO: 2235929 - RNA, 19 nt, Human
aauacugauguuccuagug

SEQ ID NO: 2235930 - RNA, 14 nt, Human
gagacucagggccc

SEQ ID NO: 2235931 - RNA, 19 nt, Human
auuuugugaagcaaaauuu

SEQ ID NO: 2235932 - RNA, 23 nt, Human
uugugcuuucuaucuaauuuuua

SEQ ID NO: 2235933 - RNA, 12 nt, Human
agaaaaauuaga

SEQ ID NO: 2235934 - RNA, 13 nt, Human
uauaaccaaagcc

SEQ ID NO: 2235935 - RNA, 20 nt, Human
accugauuucugagcauuua

SEQ ID NO: 2235936 - RNA, 21 nt, Human
gacagugaaagaaaauaacaa

SEQ ID NO: 2235937 - RNA, 20 nt, Human
uguuggugaacuugguuuua

SEQ ID NO: 2235938 - RNA, 21 nt, Human
ucaaaauaccaugccauuuaa

SEQ ID NO: 2235939 - RNA, 13 nt, Human
aguuaccucugcc

SEQ ID NO: 2235940 - RNA, 21 nt, Human
aauuaaguuuuuuuuuaaaaa

SEQ ID NO: 2235941 - RNA, 14 nt, Human
ggacagggacccac

SEQ ID NO: 2235942 - RNA, 19 nt, Human
uuaaauggagaaaggaccc

SEQ ID NO: 2235943 - RNA, 19 nt, Human
agugucuuaauuaaaagaa

SEQ ID NO: 2235944 - RNA, 21 nt, Human
gauaaaagacagugaaagaaa

SEQ ID NO: 2235945 - RNA, 13 nt, Human
caacaucuaguga

SEQ ID NO: 2235946 - RNA, 17 nt, Human
uguacagucuuguauua

SEQ ID NO: 2235947 - RNA, 15 nt, Human
cagugaaagaaaaua

SEQ ID NO: 2235948 - RNA, 13 nt, Human
agccuuccccuug

SEQ ID NO: 2235949 - RNA, 23 nt, Human
uguagguagaucuggucuuuaga

SEQ ID NO: 2235950 - RNA, 14 nt, Human
uaugaauuacauuu

SEQ ID NO: 2235951 - RNA, 19 nt, Human
uuguuuucauuaucucaaa

SEQ ID NO: 2235952 - RNA, 20 nt, Human
gaccucagccugugcugccc

SEQ ID NO: 2235953 - RNA, 21 nt, Human
caagacugcacaucaaaauau

SEQ ID NO: 2235954 - RNA, 18 nt, Human
cuuucacauuuaaauaaa

SEQ ID NO: 2235955 - RNA, 17 nt, Human
agacacacugaagaagc

SEQ ID NO: 2235956 - RNA, 23 nt, Human
uaauuuguaguguuggagaagaa

SEQ ID NO: 2235957 - RNA, 21 nt, Human
gaaaaaaagcuuuuuuugaau

SEQ ID NO: 2235958 - RNA, 19 nt, Human
cacaggaaccacaagacug

SEQ ID NO: 2235959 - RNA, 22 nt, Human
cagccgcuccugucugccagcc

SEQ ID NO: 2235960 - RNA, 17 nt, Human
uaaaauucauuccauuu

SEQ ID NO: 2235961 - RNA, 18 nt, Human
gaacacugggggagggga

SEQ ID NO: 2235962 - RNA, 17 nt, Human
ucuuauaauuuaaaaua

SEQ ID NO: 2235963 - RNA, 13 nt, Human
cuuuaguuuuugu

SEQ ID NO: 2235964 - RNA, 15 nt, Human
agaagauagcagggc

SEQ ID NO: 2235965 - RNA, 14 nt, Human
uguauuauuauucc

SEQ ID NO: 2235966 - RNA, 16 nt, Human
gaaaaaauaacaauga

SEQ ID NO: 2235967 - RNA, 18 nt, Human
uggagccaaggguucaga

SEQ ID NO: 2235968 - RNA, 20 nt, Human
aacugccagcaacgcaggcc

SEQ ID NO: 2235969 - RNA, 16 nt, Human
aauauuaaaaauuaau

SEQ ID NO: 2235970 - RNA, 22 nt, Human
gcuccccucggagaagagcugu

SEQ ID NO: 2235971 - RNA, 16 nt, Human
aauauaaauaaaaaua

SEQ ID NO: 2235972 - RNA, 19 nt, Human
acagucucaggaaaucaaa

SEQ ID NO: 2235973 - RNA, 15 nt, Human
acagcaguugaaaag

SEQ ID NO: 2235974 - RNA, 21 nt, Human
aauaauguuucaaacauauau

SEQ ID NO: 2235975 - RNA, 14 nt, Human
aggcagcuugaaac

SEQ ID NO: 2235976 - RNA, 20 nt, Human
acuuuauuuucuauaauuua

SEQ ID NO: 2235977 - RNA, 22 nt, Human
ugaaacugagaugugaacacau

SEQ ID NO: 2235978 - RNA, 18 nt, Human
aaagaauauuuuaacuuc

SEQ ID NO: 2235979 - RNA, 21 nt, Human
aagucuuucacauuuaaauaa

SEQ ID NO: 2235980 - RNA, 22 nt, Human
gcaucagcugcugaaacaacaa

SEQ ID NO: 2235981 - RNA, 21 nt, Human
ucagauauaaaagacugacca

SEQ ID NO: 2235982 - RNA, 19 nt, Human
ugaaauuguauuacaaauc

SEQ ID NO: 2235983 - RNA, 21 nt, Human
aaagcugaaauggacuuuugu

SEQ ID NO: 2235984 - RNA, 19 nt, Human
aaucacaaacucauccauu

SEQ ID NO: 2235985 - RNA, 17 nt, Human
gacagucaccucaugga

SEQ ID NO: 2235986 - RNA, 23 nt, Human
auuucugagcauuuaauauggau

SEQ ID NO: 2235987 - RNA, 14 nt, Human
ucuaggaaauauuu

SEQ ID NO: 2235988 - RNA, 19 nt, Human
aaauggaacauaaaauaca

SEQ ID NO: 2235989 - RNA, 23 nt, Human
gucuucagccuagccgaccucag

SEQ ID NO: 2235990 - RNA, 18 nt, Human
auuguguguuauuuaaau

SEQ ID NO: 2235991 - RNA, 22 nt, Human
gcacaguuuucugagaaagacu

SEQ ID NO: 2235992 - RNA, 22 nt, Human
cuucuaaguaaaaccacagcag

SEQ ID NO: 2235993 - RNA, 22 nt, Human
gaaaacaauaacgauaaaagac

SEQ ID NO: 2235994 - RNA, 17 nt, Human
aguugauaaguacauga

SEQ ID NO: 2235995 - RNA, 15 nt, Human
auuuuaaaagaauga

SEQ ID NO: 2235996 - RNA, 15 nt, Human
uccuuguauuuaaau

SEQ ID NO: 2235997 - RNA, 18 nt, Human
cuccauuuuuagugaaau

SEQ ID NO: 2235998 - RNA, 17 nt, Human
ccuagccgaccucagcc

SEQ ID NO: 2235999 - RNA, 21 nt, Human
cugauauuggacaguaaaauc

SEQ ID NO: 2236000 - RNA, 23 nt, Human
aucacaaacucauccauuaaugu

SEQ ID NO: 2236001 - RNA, 20 nt, Human
cgaccucagccuuccccuug

SEQ ID NO: 2236002 - RNA, 16 nt, Human
cuucacuguaaaauaa

SEQ ID NO: 2236003 - RNA, 15 nt, Human
ccagauccuggaaau

SEQ ID NO: 2236004 - RNA, 13 nt, Human
aaaguguuugaaa

SEQ ID NO: 2236005 - RNA, 16 nt, Human
uugcccuguuaaaaga

SEQ ID NO: 2236006 - RNA, 17 nt, Human
aauaaaguguuugaaag

SEQ ID NO: 2236007 - RNA, 20 nt, Human
aaaaucuuauaauuuaaaau

SEQ ID NO: 2236008 - RNA, 19 nt, Human
ccuguggccaaguucuuag

SEQ ID NO: 2236009 - RNA, 17 nt, Human
uugugaagcaaaauuuu

SEQ ID NO: 2236010 - RNA, 23 nt, Human
augaauuaaguuuuuuuuuaaaa

SEQ ID NO: 2236011 - RNA, 22 nt, Human
agacauguggugggacagggac

SEQ ID NO: 2236012 - RNA, 17 nt, Human
caauaacgauaaaagac

SEQ ID NO: 2236013 - RNA, 15 nt, Human
uguauuuuaaaagaa

SEQ ID NO: 2236014 - RNA, 22 nt, Human
guauuaaguuguuaauaaaagu

SEQ ID NO: 2236015 - RNA, 11 nt, Human
auaauaaaauu

SEQ ID NO: 2236016 - RNA, 16 nt, Human
cauuuguauaaaauaa

SEQ ID NO: 2236017 - RNA, 16 nt, Human
agaauauuaaaaauua

SEQ ID NO: 2236018 - RNA, 14 nt, Human
aauauaaauaaaaa

SEQ ID NO: 2236019 - RNA, 15 nt, Human
aauauaaauaaaaau

SEQ ID NO: 2236020 - RNA, 15 nt, Human
uauaaauaaaaauaa

SEQ ID NO: 2236021 - RNA, 17 nt, Human
cuaagcuucacuguaaa

SEQ ID NO: 2236022 - RNA, 22 nt, Human
gcaggauuuuaaucuuuuucua

SEQ ID NO: 2236023 - RNA, 17 nt, Human
agaugugaacacaucag

SEQ ID NO: 2236024 - RNA, 14 nt, Human
aaaccacagcaguu

SEQ ID NO: 2236025 - RNA, 22 nt, Human
uaaaacaagcacuaaacaaaga

SEQ ID NO: 2236026 - RNA, 16 nt, Human
agcucgguggacccag

SEQ ID NO: 2236027 - RNA, 19 nt, Human
uauuuauauaaauuuuuuu

SEQ ID NO: 2236028 - RNA, 13 nt, Human
uuguauuuaaaua

SEQ ID NO: 2236029 - RNA, 14 nt, Human
aauacuaauaaaau

SEQ ID NO: 2236030 - RNA, 15 nt, Human
aauaaaauacauacu

SEQ ID NO: 2236031 - RNA, 14 nt, Human
uuaugcauagauaa

SEQ ID NO: 2236032 - RNA, 22 nt, Human
gauggcaagaugugggcaguga

SEQ ID NO: 2236033 - RNA, 16 nt, Human
uauuuuugugauuuug

SEQ ID NO: 2236034 - RNA, 15 nt, Human
acgagauacagaauu

SEQ ID NO: 2236035 - RNA, 16 nt, Human
cuuguuggauuuuugu

SEQ ID NO: 2236036 - RNA, 14 nt, Human
auaaaauaauuuuu

SEQ ID NO: 2236037 - RNA, 16 nt, Human
gaugugggcagugaug

SEQ ID NO: 2236038 - RNA, 15 nt, Human
ucaguuuuugugaaa

SEQ ID NO: 2236039 - RNA, 18 nt, Human
uuauuacuguaagaaaau

SEQ ID NO: 2236040 - RNA, 22 nt, Human
aagcccaaagugguauagaaau

SEQ ID NO: 2236041 - RNA, 11 nt, Human
acugaggcaga

SEQ ID NO: 2236042 - RNA, 23 nt, Human
agggaaacugccagcaacgcagg

SEQ ID NO: 2236043 - RNA, 17 nt, Human
aagacagugaaagaaaa

SEQ ID NO: 2236044 - RNA, 21 nt, Human
ccuguggccaaguucuuaguu

SEQ ID NO: 2236045 - RNA, 14 nt, Human
ggcugcuagcacuu

SEQ ID NO: 2236046 - RNA, 16 nt, Human
gaaagacuauucaaac

SEQ ID NO: 2236047 - RNA, 18 nt, Human
guuuaugguuguauuauu

SEQ ID NO: 2236048 - RNA, 17 nt, Human
gaagcaccaaucaugaa

SEQ ID NO: 2236049 - RNA, 21 nt, Human
ucauucacucaacaaacauaa

SEQ ID NO: 2236050 - RNA, 18 nt, Human
cuuuccacagaagcucca

SEQ ID NO: 2236051 - RNA, 13 nt, Human
cacacugaagaag

SEQ ID NO: 2236052 - RNA, 23 nt, Human
acauacuauggaauuucucccag

SEQ ID NO: 2236053 - RNA, 16 nt, Human
aguuacacauuuuuca

SEQ ID NO: 2236054 - RNA, 14 nt, Human
cucagggccccagc

SEQ ID NO: 2236055 - RNA, 15 nt, Human
agaggcagcuugaaa

SEQ ID NO: 2236056 - RNA, 22 nt, Human
aauuacauuuguauaaaauaau

SEQ ID NO: 2236057 - RNA, 15 nt, Human
cuuaauuaaaagaau

SEQ ID NO: 2236058 - RNA, 16 nt, Human
cagggcucacagaauu

SEQ ID NO: 2236059 - RNA, 17 nt, Human
aaagaaacauuugguaa

SEQ ID NO: 2236060 - RNA, 14 nt, Human
gaaaacaauaacga

SEQ ID NO: 2236061 - RNA, 16 nt, Human
uucccaacuccagaaa

SEQ ID NO: 2236062 - RNA, 18 nt, Human
uaagcuucacuguaaaau

SEQ ID NO: 2236063 - RNA, 18 nt, Human
acaagccuccuuuuaaag

SEQ ID NO: 2236064 - RNA, 13 nt, Human
ucuguccagggcc

SEQ ID NO: 2236065 - RNA, 22 nt, Human
agucuuucacauuuaaauaaag

SEQ ID NO: 2236066 - RNA, 14 nt, Human
gccagcucucagcc

SEQ ID NO: 2236067 - RNA, 19 nt, Human
cacaaacucauccauuaau

SEQ ID NO: 2236068 - RNA, 14 nt, Human
auuuaucuuuguac

SEQ ID NO: 2236069 - RNA, 13 nt, Human
ugcuguagaagau

SEQ ID NO: 2236070 - RNA, 13 nt, Human
augacccccaucc

SEQ ID NO: 2236071 - RNA, 19 nt, Human
cuagaguuuagcuggaaaa

SEQ ID NO: 2236072 - RNA, 13 nt, Human
ucucaaaacugca

SEQ ID NO: 2236073 - RNA, 21 nt, Human
guauacugugugcuaaaacaa

SEQ ID NO: 2236074 - RNA, 15 nt, Human
aaugauuaugaauua

SEQ ID NO: 2236075 - RNA, 13 nt, Human
uauuaaaacucau

SEQ ID NO: 2236076 - RNA, 16 nt, Human
ugcauagguuuaauaa

SEQ ID NO: 2236077 - RNA, 14 nt, Human
agcuagaaaaauua

SEQ ID NO: 2236078 - RNA, 15 nt, Human
ccuugccaugugcua

SEQ ID NO: 2236079 - RNA, 15 nt, Human
auggagaaaggaccc

SEQ ID NO: 2236080 - RNA, 22 nt, Human
aagaugaugaugaucuuuaaaa

SEQ ID NO: 2236081 - RNA, 21 nt, Human
agccuuccccuugcccagggc

SEQ ID NO: 2236082 - RNA, 22 nt, Human
caauaaaagacaaggaaaaaau

SEQ ID NO: 2236083 - RNA, 19 nt, Human
uuauccugucccuccucca

SEQ ID NO: 2236084 - RNA, 14 nt, Human
augcugguuuuuca

SEQ ID NO: 2236085 - RNA, 13 nt, Human
aucucaauauuuc

SEQ ID NO: 2236086 - RNA, 19 nt, Human
caaaaguauauucaaaaau

SEQ ID NO: 2236087 - RNA, 23 nt, Human
uucccguggaacguuuuuccugu

SEQ ID NO: 2236088 - RNA, 16 nt, Human
uaacaauaaaagacaa

SEQ ID NO: 2236089 - RNA, 22 nt, Human
uagacacacaugaaguccaagc

SEQ ID NO: 2236090 - RNA, 20 nt, Human
ccgaccucagccuuccccuu

SEQ ID NO: 2236091 - RNA, 15 nt, Human
uacaaaugcauuucu

SEQ ID NO: 2236092 - RNA, 20 nt, Human
gauuuuugucuuguguuucu

SEQ ID NO: 2236093 - RNA, 18 nt, Human
aaaaauggaacauaaaau

SEQ ID NO: 2236094 - RNA, 15 nt, Human
auaaaguguuugaaa

SEQ ID NO: 2236095 - RNA, 19 nt, Human
aauauuauguuaaaacugg

SEQ ID NO: 2236096 - RNA, 17 nt, Human
ucagccuuccccuugcc

SEQ ID NO: 2236097 - RNA, 15 nt, Human
ugacuuauuuauaua

SEQ ID NO: 2236098 - RNA, 20 nt, Human
uacaucccuuaccugggaaa

SEQ ID NO: 2236099 - RNA, 23 nt, Human
uuguaacaagccuccuuuuaaag

SEQ ID NO: 2236100 - RNA, 15 nt, Human
ugcuguauuuuaaaa

SEQ ID NO: 2236101 - RNA, 16 nt, Human
auuuuucagauauaaa

SEQ ID NO: 2236102 - RNA, 14 nt, Human
aucacucauuuauu

SEQ ID NO: 2236103 - RNA, 23 nt, Human
ccucuguccagggcccugagcuc

SEQ ID NO: 2236104 - RNA, 13 nt, Human
aacucuauaaugu

SEQ ID NO: 2236105 - RNA, 13 nt, Human
caguuauuauauu

SEQ ID NO: 2236106 - RNA, 19 nt, Human
gcuuguauuccuuuuucuc

SEQ ID NO: 2236107 - RNA, 18 nt, Human
acuccaaagaaauguaag

SEQ ID NO: 2236108 - RNA, 20 nt, Human
gaaaagacuccaaagaaaug

SEQ ID NO: 2236109 - RNA, 17 nt, Human
cgauaaaagacagugaa

SEQ ID NO: 2236110 - RNA, 17 nt, Human
cagugaaagaaaauaac

SEQ ID NO: 2236111 - RNA, 13 nt, Human
acuuuuuuuuaag

SEQ ID NO: 2236112 - RNA, 23 nt, Human
ucaaacagucucaggaaaucaaa

SEQ ID NO: 2236113 - RNA, 19 nt, Human
auagugaggagcuuugaaa

SEQ ID NO: 2236114 - RNA, 12 nt, Human
cugcacugucaa

SEQ ID NO: 2236115 - RNA, 20 nt, Human
agcuuauuaaaacucauuuu

SEQ ID NO: 2236116 - RNA, 15 nt, Human
ccuccucuguccagg

SEQ ID NO: 2236117 - RNA, 15 nt, Human
aaaagaauauuuuaa

SEQ ID NO: 2236118 - RNA, 17 nt, Human
gaugaugaucuuuaaaa

SEQ ID NO: 2236119 - RNA, 15 nt, Human
auaauuuugugaagc

SEQ ID NO: 2236120 - RNA, 18 nt, Human
cuacauacuauggaauuu

SEQ ID NO: 2236121 - RNA, 16 nt, Human
uagcuacuaauuuuaa

SEQ ID NO: 2236122 - RNA, 15 nt, Human
agaaaacaauaacga

SEQ ID NO: 2236123 - RNA, 23 nt, Human
gcagcucaggcacacuucuucuu

SEQ ID NO: 2236124 - RNA, 17 nt, Human
cucguggaacaguuacc

SEQ ID NO: 2236125 - RNA, 15 nt, Human
gaggggacauugaac

SEQ ID NO: 2236126 - RNA, 15 nt, Human
cucauuuuaaaaaau

SEQ ID NO: 2236127 - RNA, 13 nt, Human
ucuuuaaaauaca

SEQ ID NO: 2236128 - RNA, 21 nt, Human
gcacuguggguagacacacau

SEQ ID NO: 2236129 - RNA, 12 nt, Human
aaagaauauuuu

SEQ ID NO: 2236130 - RNA, 13 nt, Human
uacacauuuuuca

SEQ ID NO: 2236131 - RNA, 21 nt, Human
gaaaacaauaacgauaaaaga

SEQ ID NO: 2236132 - RNA, 19 nt, Human
auuuuucagauauaaaaga

SEQ ID NO: 2236133 - RNA, 20 nt, Human
ugggaacccaaguccaagca

SEQ ID NO: 2236134 - RNA, 20 nt, Human
auaaauggcuuccuggcaau

SEQ ID NO: 2236135 - RNA, 18 nt, Human
uucucuaggaaauauuua

SEQ ID NO: 2236136 - RNA, 13 nt, Human
cacucaaaucaag

SEQ ID NO: 2236137 - RNA, 12 nt, Human
guagacacacau

SEQ ID NO: 2236138 - RNA, 16 nt, Human
gagcucgugggacagu

SEQ ID NO: 2236139 - RNA, 22 nt, Human
gaugcaguuguugcccacagcu

SEQ ID NO: 2236140 - RNA, 16 nt, Human
ucuuaauuaaaagaau

SEQ ID NO: 2236141 - RNA, 19 nt, Human
uaaaaauuaauucuuuauc

SEQ ID NO: 2236142 - RNA, 18 nt, Human
aaaaucuuauaauuuaaa

SEQ ID NO: 2236143 - RNA, 13 nt, Human
aaaaauccuacuu

SEQ ID NO: 2236144 - RNA, 16 nt, Human
ccuuuagaauauuaaa

SEQ ID NO: 2236145 - RNA, 17 nt, Human
agggauggcaagaugug

SEQ ID NO: 2236146 - RNA, 22 nt, Human
agaauuuuaugcggcauuuucu

SEQ ID NO: 2236147 - RNA, 15 nt, Human
cuacaccccuccccu

SEQ ID NO: 2236148 - RNA, 14 nt, Human
auuuucuauaauuu

SEQ ID NO: 2236149 - RNA, 14 nt, Human
gugagcuacaaaug

SEQ ID NO: 2236150 - RNA, 19 nt, Human
uaaaugugcuuuuaaaaaa

SEQ ID NO: 2236151 - RNA, 15 nt, Human
gcacagccucuuaga

SEQ ID NO: 2236152 - RNA, 22 nt, Human
acaagcaggcucaacauaacau

SEQ ID NO: 2236153 - RNA, 13 nt, Human
gaaguugcagauu

SEQ ID NO: 2236154 - RNA, 23 nt, Human
augugcuuuuaaaaaaaaauacu

SEQ ID NO: 2236155 - RNA, 18 nt, Human
caguguacagucuuguau

SEQ ID NO: 2236156 - RNA, 23 nt, Human
caugccauuuaaagcuuauuaaa

SEQ ID NO: 2236157 - RNA, 16 nt, Human
aaagcaguggacacca

SEQ ID NO: 2236158 - RNA, 14 nt, Human
aauauuauuuuaua

SEQ ID NO: 2236159 - RNA, 19 nt, Human
uagugagcagucaggaaag

SEQ ID NO: 2236160 - RNA, 14 nt, Human
uucuggaauaaucc

SEQ ID NO: 2236161 - RNA, 19 nt, Human
aagcauuccaacuaucuca

SEQ ID NO: 2236162 - RNA, 18 nt, Human
auagucaaauugugugaa

SEQ ID NO: 2236163 - RNA, 23 nt, Human
auggcuauaggugcuacaaaaac

SEQ ID NO: 2236164 - RNA, 17 nt, Human
gaagaccucauuuugaa

SEQ ID NO: 2236165 - RNA, 19 nt, Human
uuugccaaguucuccacua

SEQ ID NO: 2236166 - RNA, 22 nt, Human
caagcacuaaacaaagagugaa

SEQ ID NO: 2236167 - RNA, 14 nt, Human
auugauaauaaaau

SEQ ID NO: 2236168 - RNA, 15 nt, Human
aaaucacaaacucau

SEQ ID NO: 2236169 - RNA, 19 nt, Human
cuugaaacugagaugugaa

SEQ ID NO: 2236170 - RNA, 21 nt, Human
auaugcucuaaacauguuuau

SEQ ID NO: 2236171 - RNA, 15 nt, Human
aagccagauuuuccu

SEQ ID NO: 2236172 - RNA, 20 nt, Human
ccuuagcuuagaccucagcc

SEQ ID NO: 2236173 - RNA, 17 nt, Human
cagcaguugaaaagacu

SEQ ID NO: 2236174 - RNA, 13 nt, Human
uauuucauuucuu

SEQ ID NO: 2236175 - RNA, 14 nt, Human
agagcaguagcagc

SEQ ID NO: 2236176 - RNA, 22 nt, Human
uuguuaauaaaaguacauguua

SEQ ID NO: 2236177 - RNA, 14 nt, Human
cucuucuuuaaagg

SEQ ID NO: 2236178 - RNA, 18 nt, Human
ccaaagugguauagaaau

SEQ ID NO: 2236179 - RNA, 13 nt, Human
uaaucuuuuucua

SEQ ID NO: 2236180 - RNA, 20 nt, Human
aagcauaccaacacgagcag

SEQ ID NO: 2236181 - RNA, 20 nt, Human
uggcauauugauaauaaaau

SEQ ID NO: 2236182 - RNA, 18 nt, Human
uguaagggaaacugccag

SEQ ID NO: 2236183 - RNA, 12 nt, Human
auuccuuagcuu

SEQ ID NO: 2236184 - RNA, 16 nt, Human
gucuuaauuaaaagaa

SEQ ID NO: 2236185 - RNA, 16 nt, Human
auuuuuagugaaauau

SEQ ID NO: 2236186 - RNA, 21 nt, Human
gccuuuucccaacuccagaaa

SEQ ID NO: 2236187 - RNA, 20 nt, Human
gaaaucaaauaugcaaagca

SEQ ID NO: 2236188 - RNA, 12 nt, Human
acaucagcuugc

SEQ ID NO: 2236189 - RNA, 12 nt, Human
cagccagcagcc

SEQ ID NO: 2236190 - RNA, 13 nt, Human
uuauuaauuugua

SEQ ID NO: 2236191 - RNA, 15 nt, Human
cugucugccagccag

SEQ ID NO: 2236192 - RNA, 17 nt, Human
caaauaugcaaagcacu

SEQ ID NO: 2236193 - RNA, 20 nt, Human
auaacaaugcuguauuuuaa

SEQ ID NO: 2236194 - RNA, 18 nt, Human
uuccuuggacucauuuua

SEQ ID NO: 2236195 - RNA, 15 nt, Human
augaauuaaguuuuu

SEQ ID NO: 2236196 - RNA, 20 nt, Human
ugcaaagcacugacuucuaa

SEQ ID NO: 2236197 - RNA, 16 nt, Human
gccccccuugccagac

SEQ ID NO: 2236198 - RNA, 20 nt, Human
gaaacgaggauugggaaaaa

SEQ ID NO: 2236199 - RNA, 18 nt, Human
auguuaaaacugggacag

SEQ ID NO: 2236200 - RNA, 17 nt, Human
agucuuguauuaaguug

SEQ ID NO: 2236201 - RNA, 21 nt, Human
aauuucucccagucauuuaau

SEQ ID NO: 2236202 - RNA, 15 nt, Human
ugcuucuguuuuaua

SEQ ID NO: 2236203 - RNA, 18 nt, Human
gacagcagcucaggcaca

SEQ ID NO: 2236204 - RNA, 20 nt, Human
uaaaagacagugaaagaaaa

SEQ ID NO: 2236205 - RNA, 17 nt, Human
uuuuuguuucauauuga

SEQ ID NO: 2236206 - RNA, 15 nt, Human
aagaaaauaacaaua

SEQ ID NO: 2236207 - RNA, 16 nt, Human
cugcucucaguucacu

SEQ ID NO: 2236208 - RNA, 22 nt, Human
uuucugagaaagacuauucaaa

SEQ ID NO: 2236209 - RNA, 19 nt, Human
cagccuggugggccuccuc

SEQ ID NO: 2236210 - RNA, 20 nt, Human
aaaacaagcacuaaacaaag

SEQ ID NO: 2236211 - RNA, 20 nt, Human
ugacuuauuuauauaaauuu

SEQ ID NO: 2236212 - RNA, 18 nt, Human
gucugccagccagcagcc

SEQ ID NO: 2236213 - RNA, 13 nt, Human
cuucucaacucca

SEQ ID NO: 2236214 - RNA, 20 nt, Human
cagcuugcccuguuaaaaga

SEQ ID NO: 2236215 - RNA, 16 nt, Human
cagggucaggagaggg

SEQ ID NO: 2236216 - RNA, 16 nt, Human
caccccuccccugccc

SEQ ID NO: 2236217 - RNA, 21 nt, Human
agcccuucuuuccacagaagc

SEQ ID NO: 2236218 - RNA, 16 nt, Human
uacacacucaaaucaa

SEQ ID NO: 2236219 - RNA, 11 nt, Human
gagguaaaagc

SEQ ID NO: 2236220 - RNA, 18 nt, Human
agcaagggugaugggaaa

SEQ ID NO: 2236221 - RNA, 19 nt, Human
aagucuuucacauuuaaau

SEQ ID NO: 2236222 - RNA, 15 nt, Human
aauacuuuauaaagg

SEQ ID NO: 2236223 - RNA, 19 nt, Human
cuuuuaaaaaaaaauacug

SEQ ID NO: 2236224 - RNA, 18 nt, Human
cuugcccuguuaaaagau

SEQ ID NO: 2236225 - RNA, 13 nt, Human
cuuuaaaauacac

SEQ ID NO: 2236226 - RNA, 20 nt, Human
caagcauaccaacacgagca

SEQ ID NO: 2236227 - RNA, 19 nt, Human
aaagaaauguaagggaaac

SEQ ID NO: 2236228 - RNA, 14 nt, Human
agacuccaaagaaa

SEQ ID NO: 2236229 - RNA, 22 nt, Human
guuuucaggaguggguugauuu

SEQ ID NO: 2236230 - RNA, 15 nt, Human
uggacgagaaaacaa

SEQ ID NO: 2236231 - RNA, 15 nt, Human
aaucacucauuuauu

SEQ ID NO: 2236232 - RNA, 20 nt, Human
gaauucauucacucaacaaa

SEQ ID NO: 2236233 - RNA, 21 nt, Human
uauacugugugcuaaaacaag

SEQ ID NO: 2236234 - RNA, 23 nt, Human
auuuuauagcuacuaauuuuaaa

SEQ ID NO: 2236235 - RNA, 23 nt, Human
uucagccuagccgaccucagccu

SEQ ID NO: 2236236 - RNA, 20 nt, Human
aacugcacugucaagaugau

SEQ ID NO: 2236237 - RNA, 21 nt, Human
caggaaaucaaauaugcaaag

SEQ ID NO: 2236238 - RNA, 18 nt, Human
ucuaugaaauauuauguu

SEQ ID NO: 2236239 - RNA, 23 nt, Human
ugaaaugaguuuuucuuuucauu

SEQ ID NO: 2236240 - RNA, 23 nt, Human
agaguuuagcuggaaaaguaugu

SEQ ID NO: 2236241 - RNA, 17 nt, Human
ucugucuucacaacaga

SEQ ID NO: 2236242 - RNA, 21 nt, Human
uagaaaagggaacugaacauu

SEQ ID NO: 2236243 - RNA, 12 nt, Human
auuuuaaaagaa

SEQ ID NO: 2236244 - RNA, 22 nt, Human
aggugcuacaaaaacacagcaa

SEQ ID NO: 2236245 - RNA, 22 nt, Human
ccucuguccagggcccugagcu

SEQ ID NO: 2236246 - RNA, 16 nt, Human
caaaaggauaaugaau

SEQ ID NO: 2236247 - RNA, 23 nt, Human
aauauuuauuuuaauaauguuuc

SEQ ID NO: 2236248 - RNA, 22 nt, Human
gauaaaagacagugaaagaaaa

SEQ ID NO: 2236249 - RNA, 22 nt, Human
aaauaacaaugaaaguugauaa

SEQ ID NO: 2236250 - RNA, 16 nt, Human
uucacauuuaaauaaa

SEQ ID NO: 2236251 - RNA, 18 nt, Human
aucuuauaauuuaaaaua

SEQ ID NO: 2236252 - RNA, 16 nt, Human
aguuuaauugacuuau

SEQ ID NO: 2236253 - RNA, 19 nt, Human
uguaguguuggagaagaac

SEQ ID NO: 2236254 - RNA, 16 nt, Human
uguaucacaaaucuua

SEQ ID NO: 2236255 - RNA, 19 nt, Human
agugaggagcuuugaaacg

SEQ ID NO: 2236256 - RNA, 16 nt, Human
uauuaaguuguuaaua

SEQ ID NO: 2236257 - RNA, 18 nt, Human
auuaucucaaaacugcac

SEQ ID NO: 2236258 - RNA, 13 nt, Human
ugccccccuugcc

SEQ ID NO: 2236259 - RNA, 13 nt, Human
aacaagccuccuu

SEQ ID NO: 2236260 - RNA, 18 nt, Human
aaaucuuauaauuuaaaa

SEQ ID NO: 2236261 - RNA, 14 nt, Human
uugccaugugcuag

SEQ ID NO: 2236262 - RNA, 23 nt, Human
agccuuccccuugcccagggcuc

SEQ ID NO: 2236263 - RNA, 14 nt, Human
ugugaaaagcucca

SEQ ID NO: 2236264 - RNA, 22 nt, Human
gaggcagacagcagcucaggca

SEQ ID NO: 2236265 - RNA, 14 nt, Human
aauuguauuacaaa

SEQ ID NO: 2236266 - RNA, 12 nt, Human
ccccuccccugc

SEQ ID NO: 2236267 - RNA, 20 nt, Human
gaauuauccggucggguuuu

SEQ ID NO: 2236268 - RNA, 20 nt, Human
uaaaaguacauguuaaacuu

SEQ ID NO: 2236269 - RNA, 19 nt, Human
ucagccuagccgaccucag

SEQ ID NO: 2236270 - RNA, 17 nt, Human
aguauuucuaugaaaua

SEQ ID NO: 2236271 - RNA, 15 nt, Human
uagaauauuaaaaau

SEQ ID NO: 2236272 - RNA, 15 nt, Human
uacaggauuugaaau

SEQ ID NO: 2236273 - RNA, 19 nt, Human
caggugccaguuauggcua

SEQ ID NO: 2236274 - RNA, 17 nt, Human
aaguauauucaaaaauu

SEQ ID NO: 2236275 - RNA, 15 nt, Human
agucaccucauggaa

SEQ ID NO: 2236276 - RNA, 19 nt, Human
gaaagaaaauaacaauaaa

SEQ ID NO: 2236277 - RNA, 22 nt, Human
agugaugucacuagggcaggga

SEQ ID NO: 2236278 - RNA, 20 nt, Human
uggaauaauccuaaacauau

SEQ ID NO: 2236279 - RNA, 11 nt, Human
cuguuuuauaa

SEQ ID NO: 2236280 - RNA, 20 nt, Human
gacuguggcugcuagcacuu

SEQ ID NO: 2236281 - RNA, 12 nt, Human
auacuaauaaaa

SEQ ID NO: 2236282 - RNA, 14 nt, Human
aaauuauauuuuga

SEQ ID NO: 2236283 - RNA, 21 nt, Human
ugugcugcccgucuucagccu

SEQ ID NO: 2236284 - RNA, 21 nt, Human
acagcccuucuuuccacagaa

SEQ ID NO: 2236285 - RNA, 14 nt, Human
acagaauuuuaugc

SEQ ID NO: 2236286 - RNA, 12 nt, Human
guuuugugaaga

SEQ ID NO: 2236287 - RNA, 23 nt, Human
gcccugagcucgguggacccagg

SEQ ID NO: 2236288 - RNA, 16 nt, Human
aauuuuuaauuauaug

SEQ ID NO: 2236289 - RNA, 11 nt, Human
auuuaaaaauc

SEQ ID NO: 2236290 - RNA, 13 nt, Human
cucagaaaacaag

SEQ ID NO: 2236291 - RNA, 18 nt, Human
aggguucagagacucagg

SEQ ID NO: 2236292 - RNA, 15 nt, Human
acacaucagcuugcc

SEQ ID NO: 2236293 - RNA, 20 nt, Human
uugaacaaguuguuucauug

SEQ ID NO: 2236294 - RNA, 20 nt, Human
agccuuggggcugaugcagu

SEQ ID NO: 2236295 - RNA, 22 nt, Human
ucaaacagucucaggaaaucaa

SEQ ID NO: 2236296 - RNA, 21 nt, Human
aaacagucucaggaaaucaaa

SEQ ID NO: 2236297 - RNA, 19 nt, Human
guaguccuguaauggaagc

SEQ ID NO: 2236298 - RNA, 15 nt, Human
cagucauuuaauaaa

SEQ ID NO: 2236299 - RNA, 16 nt, Human
uguaguccuguaaugg

SEQ ID NO: 2236300 - RNA, 23 nt, Human
aagcaccuuuagaauauuaaaaa

SEQ ID NO: 2236301 - RNA, 16 nt, Human
uacaaaugggaaacaa

SEQ ID NO: 2236302 - RNA, 16 nt, Human
aggguguguaaguaga

SEQ ID NO: 2236303 - RNA, 14 nt, Human
gaggcagggucagg

SEQ ID NO: 2236304 - RNA, 15 nt, Human
caccccuccccugcc

SEQ ID NO: 2236305 - RNA, 20 nt, Human
augucgucaaagcugaaaug

SEQ ID NO: 2236306 - RNA, 18 nt, Human
auuuauuacuguaagaaa

SEQ ID NO: 2236307 - RNA, 23 nt, Human
aauaauccucaguuuuugugaaa

SEQ ID NO: 2236308 - RNA, 16 nt, Human
agaaagacuauucaaa

SEQ ID NO: 2236309 - RNA, 15 nt, Human
ugggccuccucuguc

SEQ ID NO: 2236310 - RNA, 13 nt, Human
aaauccuugaaga

SEQ ID NO: 2236311 - RNA, 20 nt, Human
ucggguuuuauuguuuaaaa

SEQ ID NO: 2236312 - RNA, 13 nt, Human
ccauuuaaagcuu

SEQ ID NO: 2236313 - RNA, 18 nt, Human
gaagcaaaauuuuuucuc

SEQ ID NO: 2236314 - RNA, 16 nt, Human
cauuucuaaagccauu

SEQ ID NO: 2236315 - RNA, 17 nt, Human
agcuacuaauuuuaaaa

SEQ ID NO: 2236316 - RNA, 14 nt, Human
acauauauaacaau

SEQ ID NO: 2236317 - RNA, 15 nt, Human
ugugcuuuuaaaaaa

SEQ ID NO: 2236318 - RNA, 19 nt, Human
agucaaauugugugaaagg

SEQ ID NO: 2236319 - RNA, 20 nt, Human
aucauuucugcaucagcugc

SEQ ID NO: 2236320 - RNA, 22 nt, Human
uuuauagcuacuaauuuuaaaa

SEQ ID NO: 2236321 - RNA, 20 nt, Human
gaaaauaacaauaaaagaca

SEQ ID NO: 2236322 - RNA, 23 nt, Human
aacuuguaaaggaauuuaaaaau

SEQ ID NO: 2236323 - RNA, 14 nt, Human
ugcuaagucuuaua

SEQ ID NO: 2236324 - RNA, 17 nt, Human
cccuagagcacacugua

SEQ ID NO: 2236325 - RNA, 15 nt, Human
ugccagccagcagcc

SEQ ID NO: 2236326 - RNA, 15 nt, Human
ccuagccgaccucag

SEQ ID NO: 2236327 - RNA, 13 nt, Human
uagaauacuaaua

SEQ ID NO: 2236328 - RNA, 14 nt, Human
uagcagcagcaucu

SEQ ID NO: 2236329 - RNA, 13 nt, Human
ccugagcaggauu

SEQ ID NO: 2236330 - RNA, 16 nt, Human
aacagauuauuaccuu

SEQ ID NO: 2236331 - RNA, 18 nt, Human
auuauuuuuuaaaaaaau

SEQ ID NO: 2236332 - RNA, 16 nt, Human
ugucuuaauuaaaaga

SEQ ID NO: 2236333 - RNA, 17 nt, Human
aaagacaaggaaaaaau

SEQ ID NO: 2236334 - RNA, 16 nt, Human
caccaggagucccugg

SEQ ID NO: 2236335 - RNA, 19 nt, Human
uagaaaagggaacugaaca

SEQ ID NO: 2236336 - RNA, 12 nt, Human
uugcccagggcu

SEQ ID NO: 2236337 - RNA, 21 nt, Human
cgauaaauaacuuuuuuuuaa

SEQ ID NO: 2236338 - RNA, 22 nt, Human
aaagacagugaaagaaaauaac

SEQ ID NO: 2236339 - RNA, 17 nt, Human
guuuaauaauuuuuaau

SEQ ID NO: 2236340 - RNA, 19 nt, Human
auagauucccugagcagga

SEQ ID NO: 2236341 - RNA, 21 nt, Human
gcaaaauuuuuucucuaggaa

SEQ ID NO: 2236342 - RNA, 14 nt, Human
auuuaaauauaugc

SEQ ID NO: 2236343 - RNA, 16 nt, Human
aagcuucacuguaaaa

SEQ ID NO: 2236344 - RNA, 22 nt, Human
cucagccuggugggccuccucu

SEQ ID NO: 2236345 - RNA, 14 nt, Human
uacaccccuccccu

SEQ ID NO: 2236346 - RNA, 17 nt, Human
gaaaaauuagaugacug

SEQ ID NO: 2236347 - RNA, 20 nt, Human
uuccuguucuuaagacguga

SEQ ID NO: 2236348 - RNA, 12 nt, Human
gguuuauauaag

SEQ ID NO: 2236349 - RNA, 16 nt, Human
aauaaaguguuugaaa

SEQ ID NO: 2236350 - RNA, 19 nt, Human
uauaggugcuacaaaaaca

SEQ ID NO: 2236351 - RNA, 13 nt, Human
uggacuuccauuu

SEQ ID NO: 2236352 - RNA, 22 nt, Human
uguauacugugugcuaaaacaa

SEQ ID NO: 2236353 - RNA, 22 nt, Human
aauaauccuaaacauaugaauu

SEQ ID NO: 2236354 - RNA, 21 nt, Human
ugguaauaaguacuguguaca

SEQ ID NO: 2236355 - RNA, 20 nt, Human
uuugcaagccagauuuuccu

SEQ ID NO: 2236356 - RNA, 15 nt, Human
auuuuaacuuccuug

SEQ ID NO: 2236357 - RNA, 23 nt, Human
acuggacugguucaaauguuguu

SEQ ID NO: 2236358 - RNA, 22 nt, Human
cauuuaaagcuuauuaaaacuc

SEQ ID NO: 2236359 - RNA, 22 nt, Human
cauuuaaauaaaguguuugaaa

SEQ ID NO: 2236360 - RNA, 21 nt, Human
aaaagaauauuuuaacuuccu

SEQ ID NO: 2236361 - RNA, 15 nt, Human
gccccauucaacauc

SEQ ID NO: 2236362 - RNA, 22 nt, Human
gaaagcaucauuauuugcagag

SEQ ID NO: 2236363 - RNA, 21 nt, Human
cuucucacauuuauauuuuug

SEQ ID NO: 2236364 - RNA, 12 nt, Human
uccauauuaaaa

SEQ ID NO: 2236365 - RNA, 16 nt, Human
uuuuaaguuacacauu

SEQ ID NO: 2236366 - RNA, 21 nt, Human
cuuguuggacgagaaaacaau

SEQ ID NO: 2236367 - RNA, 19 nt, Human
caguggacaccaggagucc

SEQ ID NO: 2236368 - RNA, 23 nt, Human
cuaguaauuggaaaggcagcucu

SEQ ID NO: 2236369 - RNA, 15 nt, Human
uaacgauaaaagaca

SEQ ID NO: 2236370 - RNA, 16 nt, Human
ccauuuuuagugaaau

SEQ ID NO: 2236371 - RNA, 18 nt, Human
gauucauuuuucuuucug

SEQ ID NO: 2236372 - RNA, 14 nt, Human
acucauuuuaaaaa

SEQ ID NO: 2236373 - RNA, 18 nt, Human
uggacucauuuuaaaaaa

SEQ ID NO: 2236374 - RNA, 14 nt, Human
auuuguauaaaaua

SEQ ID NO: 2236375 - RNA, 15 nt, Human
ccuuccccuugccca

SEQ ID NO: 2236376 - RNA, 21 nt, Human
aagcuccauuuuuagugaaau

SEQ ID NO: 2236377 - RNA, 22 nt, Human
aagcacugacuucuaaguaaaa

SEQ ID NO: 2236378 - RNA, 17 nt, Human
gagggauuagggagaga

SEQ ID NO: 2236379 - RNA, 21 nt, Human
gacagucaccucauggaauug

SEQ ID NO: 2236380 - RNA, 17 nt, Human
uugaacaacucgaauca

SEQ ID NO: 2236381 - RNA, 19 nt, Human
agaaaauaacaauaaaaga

SEQ ID NO: 2236382 - RNA, 20 nt, Human
auucccagccagcacagccu

SEQ ID NO: 2236383 - RNA, 22 nt, Human
uucauucacucaacaaacauaa

SEQ ID NO: 2236384 - RNA, 22 nt, Human
aggcaacugaggcagacagcag

SEQ ID NO: 2236385 - RNA, 21 nt, Human
aacuuguaaaggaauuuaaaa

SEQ ID NO: 2236386 - RNA, 12 nt, Human
aaacacagcaag

SEQ ID NO: 2236387 - RNA, 13 nt, Human
gacaaggaaaaaa

SEQ ID NO: 2236388 - RNA, 18 nt, Human
acaaaugggaaacaaaag

SEQ ID NO: 2236389 - RNA, 14 nt, Human
agcaguggacacca

SEQ ID NO: 2236390 - RNA, 20 nt, Human
ugaaauuuucuagaauacua

SEQ ID NO: 2236391 - RNA, 17 nt, Human
auagauucccugagcag

SEQ ID NO: 2236392 - RNA, 17 nt, Human
aucaagaaacuuaaggu

SEQ ID NO: 2236393 - RNA, 20 nt, Human
gauaauaaaauucauuccau

SEQ ID NO: 2236394 - RNA, 16 nt, Human
auugucuagugaaacu

SEQ ID NO: 2236395 - RNA, 15 nt, Human
aaauaauuuuuauau

SEQ ID NO: 2236396 - RNA, 20 nt, Human
auuuucaguuauuauauuua

SEQ ID NO: 2236397 - RNA, 17 nt, Human
ugggaaagcauuguaaa

SEQ ID NO: 2236398 - RNA, 21 nt, Human
ucagccuggugggccuccucu

SEQ ID NO: 2236399 - RNA, 13 nt, Human
agaauucugcuac

SEQ ID NO: 2236400 - RNA, 18 nt, Human
acauuuauauuuuuguga

SEQ ID NO: 2236401 - RNA, 18 nt, Human
gagugucuuaauuaaaag

SEQ ID NO: 2236402 - RNA, 17 nt, Human
aauaacgauaaaagaca

SEQ ID NO: 2236403 - RNA, 17 nt, Human
ucuauaauguguucauu

SEQ ID NO: 2236404 - RNA, 13 nt, Human
aucacaaaucuua

SEQ ID NO: 2236405 - RNA, 21 nt, Human
uaauaaguacuguguacagaa

SEQ ID NO: 2236406 - RNA, 21 nt, Human
aggugcuacaaaaacacagca

SEQ ID NO: 2236407 - RNA, 21 nt, Human
cacuguagcauuacagugggu

SEQ ID NO: 2236408 - RNA, 14 nt, Human
auugucuagugaaa

SEQ ID NO: 2236409 - RNA, 18 nt, Human
aauaccaugccauuuaaa

SEQ ID NO: 2236410 - RNA, 18 nt, Human
acugacucuuaagaagac

SEQ ID NO: 2236411 - RNA, 18 nt, Human
cuauagauucuuuauuag

SEQ ID NO: 2236412 - RNA, 17 nt, Human
cugcugaaacaacaaau

SEQ ID NO: 2236413 - RNA, 13 nt, Human
auugauuauaugu

SEQ ID NO: 2236414 - RNA, 23 nt, Human
aaguuuaauugacuuauuuauau

SEQ ID NO: 2236415 - RNA, 19 nt, Human
guuguucucuucuuuaaag

SEQ ID NO: 2236416 - RNA, 17 nt, Human
acguaaagcuagaaaug

SEQ ID NO: 2236417 - RNA, 18 nt, Human
caagaugugggcagugau

SEQ ID NO: 2236418 - RNA, 15 nt, Human
acccacuucacacac

SEQ ID NO: 2236419 - RNA, 17 nt, Human
ugcacaucaaaauaugc

SEQ ID NO: 2236420 - RNA, 14 nt, Human
cuggaaaucagggu

SEQ ID NO: 2236421 - RNA, 14 nt, Human
uucuaugaaauauu

SEQ ID NO: 2236422 - RNA, 20 nt, Human
aaauccuugaagauuuacca

SEQ ID NO: 2236423 - RNA, 22 nt, Human
ugggugccccccuugccagaca

SEQ ID NO: 2236424 - RNA, 15 nt, Human
uauaauuuaaauaua

SEQ ID NO: 2236425 - RNA, 17 nt, Human
aacaaauaggaauuguu

SEQ ID NO: 2236426 - RNA, 20 nt, Human
ugaaaaucuuauaauuuaaa

SEQ ID NO: 2236427 - RNA, 19 nt, Human
acagucaccucauggaauu

SEQ ID NO: 2236428 - RNA, 22 nt, Human
uacacauuuuucagauauaaaa

SEQ ID NO: 2236429 - RNA, 15 nt, Human
gcaaccccaucaucc

SEQ ID NO: 2236430 - RNA, 18 nt, Human
uaaaagacagugaaagaa

SEQ ID NO: 2236431 - RNA, 16 nt, Human
uucagauauaaaagac

SEQ ID NO: 2236432 - RNA, 17 nt, Human
gaaugagagacacacug

SEQ ID NO: 2236433 - RNA, 22 nt, Human
aagagccuuuuuuugaaaaaaa

SEQ ID NO: 2236434 - RNA, 14 nt, Human
caaaugcauuucua

SEQ ID NO: 2236435 - RNA, 17 nt, Human
ccgucuucagccuagcc

SEQ ID NO: 2236436 - RNA, 17 nt, Human
uucugagcauuuaauau

SEQ ID NO: 2236437 - RNA, 18 nt, Human
cuuuucccaacuccagaa

SEQ ID NO: 2236438 - RNA, 19 nt, Human
aggugcuacaaaaacacag

SEQ ID NO: 2236439 - RNA, 16 nt, Human
aaaaguauauucaaaa

SEQ ID NO: 2236440 - RNA, 20 nt, Human
uaauugacuuauuuauauaa

SEQ ID NO: 2236441 - RNA, 21 nt, Human
ggcccugagcucgguggaccc

SEQ ID NO: 2236442 - RNA, 14 nt, Human
aaucucaauauuuc

SEQ ID NO: 2236443 - RNA, 20 nt, Human
uauacugugugcuaaaacaa

SEQ ID NO: 2236444 - RNA, 21 nt, Human
auucaaaaauuauauuuugaa

SEQ ID NO: 2236445 - RNA, 22 nt, Human
aguccuugcaucaauuuuucuu

SEQ ID NO: 2236446 - RNA, 19 nt, Human
uaaaaguacauguuaaacu

SEQ ID NO: 2236447 - RNA, 18 nt, Human
aaaagacaaggaaaaaau

SEQ ID NO: 2236448 - RNA, 23 nt, Human
gggaaacaaaaggauaaugaaua

SEQ ID NO: 2236449 - RNA, 20 nt, Human
uguaagaaaauaucacuugu

SEQ ID NO: 2236450 - RNA, 14 nt, Human
uucuagaauacuaa

SEQ ID NO: 2236451 - RNA, 12 nt, Human
aaaacucauuuu

SEQ ID NO: 2236452 - RNA, 22 nt, Human
aagcauaccaacacgagcaggc

SEQ ID NO: 2236453 - RNA, 12 nt, Human
uucucuaggaaa

SEQ ID NO: 2236454 - RNA, 17 nt, Human
ggaacccaaguccaagc

SEQ ID NO: 2236455 - RNA, 17 nt, Human
aggcagggucaggagag

SEQ ID NO: 2236456 - RNA, 20 nt, Human
ugauuucugagcauuuaaua

SEQ ID NO: 2236457 - RNA, 19 nt, Human
auugaggacacugauaugg

SEQ ID NO: 2236458 - RNA, 13 nt, Human
aagacagugaaag

SEQ ID NO: 2236459 - RNA, 23 nt, Human
ugaaaaucuuauaauuuaaaaua

SEQ ID NO: 2236460 - RNA, 16 nt, Human
ugcacaucaaaauaug

SEQ ID NO: 2236461 - RNA, 22 nt, Human
ccuugcccagggcucagccugg

SEQ ID NO: 2236462 - RNA, 20 nt, Human
gcaccuuuagaauauuaaaa

SEQ ID NO: 2236463 - RNA, 16 nt, Human
auuaaaagaauauuuu

SEQ ID NO: 2236464 - RNA, 19 nt, Human
acaauaacgauaaaagaca

SEQ ID NO: 2236465 - RNA, 18 nt, Human
aaagagugaaggauuuau

SEQ ID NO: 2236466 - RNA, 21 nt, Human
caacugaggcagacagcagcu

SEQ ID NO: 2236467 - RNA, 21 nt, Human
gacugguucaaauguuguucu

SEQ ID NO: 2236468 - RNA, 16 nt, Human
ucuaauuuuuauuaau

SEQ ID NO: 2236469 - RNA, 11 nt, Human
cauaugaaaag

SEQ ID NO: 2236470 - RNA, 21 nt, Human
auuuuuucucuaggaaauauu

SEQ ID NO: 2236471 - RNA, 17 nt, Human
uggacuuccauuuggaa

SEQ ID NO: 2236472 - RNA, 12 nt, Human
gaagaccucauu

SEQ ID NO: 2236473 - RNA, 21 nt, Human
aaaauaugccccauucaacau

SEQ ID NO: 2236474 - RNA, 19 nt, Human
aaguuguuucauugacuau

SEQ ID NO: 2236475 - RNA, 19 nt, Human
auagcuacuaauuuuaaaa

SEQ ID NO: 2236476 - RNA, 22 nt, Human
uuaacuugaaggaguccuugca

SEQ ID NO: 2236477 - RNA, 10 nt, Human
auguuuucag

SEQ ID NO: 2236478 - RNA, 15 nt, Human
acagugaaagaaaau

SEQ ID NO: 2236479 - RNA, 20 nt, Human
aggaguggguugauuucagc

SEQ ID NO: 2236480 - RNA, 23 nt, Human
acgaggauugggaaaaaguaauu

SEQ ID NO: 2236481 - RNA, 14 nt, Human
guuggauuuuuguc

SEQ ID NO: 2236482 - RNA, 18 nt, Human
acaugaacuuguaaagga

SEQ ID NO: 2236483 - RNA, 23 nt, Human
uggcuugaguuuaaauuguaaua

SEQ ID NO: 2236484 - RNA, 12 nt, Human
aacugagaugug

SEQ ID NO: 2236485 - RNA, 23 nt, Human
uguugcccacagcuguaugauuc

SEQ ID NO: 2236486 - RNA, 15 nt, Human
gagaccacaagcagg

SEQ ID NO: 2236487 - RNA, 18 nt, Human
uggagggaagccuugggg

SEQ ID NO: 2236488 - RNA, 15 nt, Human
uagggugauauuaac

SEQ ID NO: 2236489 - RNA, 21 nt, Human
aaacgaggauugggaaaaagu

SEQ ID NO: 2236490 - RNA, 23 nt, Human
cuuaagaagacugcauuauauuu

SEQ ID NO: 2236491 - RNA, 22 nt, Human
accaauauuguacaguuuuuau

SEQ ID NO: 2236492 - RNA, 23 nt, Human
agcaugucgucaaagcugaaaug

SEQ ID NO: 2236493 - RNA, 18 nt, Human
uguaaaugugcuuuuaaa

SEQ ID NO: 2236494 - RNA, 15 nt, Human
agcucaggcacacuu

SEQ ID NO: 2236495 - RNA, 13 nt, Human
gccagacaugugg

SEQ ID NO: 2236496 - RNA, 13 nt, Human
acagcccuucuuu

SEQ ID NO: 2236497 - RNA, 14 nt, Human
gaaugauuaugaau

SEQ ID NO: 2236498 - RNA, 20 nt, Human
cagccuagccgaccucagcc

SEQ ID NO: 2236499 - RNA, 16 nt, Human
auuugcaaccccauca

SEQ ID NO: 2236500 - RNA, 23 nt, Human
caugcugucuacacuaagagaga

SEQ ID NO: 2236501 - RNA, 13 nt, Human
aggaaaaaauaac

SEQ ID NO: 2236502 - RNA, 21 nt, Human
ugaugcuacaggauuugaaau

SEQ ID NO: 2236503 - RNA, 16 nt, Human
gaugaucuuuaaaaua

SEQ ID NO: 2236504 - RNA, 20 nt, Human
uggagccaaggguucagaga

SEQ ID NO: 2236505 - RNA, 15 nt, Human
auauugacuuuuuau

SEQ ID NO: 2236506 - RNA, 16 nt, Human
aaauaugcaaagcacu

SEQ ID NO: 2236507 - RNA, 21 nt, Human
ugaaauuuucuagaauacuaa

SEQ ID NO: 2236508 - RNA, 23 nt, Human
ucaagaugaugaugaucuuuaaa

SEQ ID NO: 2236509 - RNA, 23 nt, Human
uugucugaaauuuucuagaauac

SEQ ID NO: 2236510 - RNA, 13 nt, Human
acucauuuuaaaa

SEQ ID NO: 2236511 - RNA, 15 nt, Human
cuacuaauuuuaaaa

SEQ ID NO: 2236512 - RNA, 20 nt, Human
aauuaaguuuuuuuuuaaaa

SEQ ID NO: 2236513 - RNA, 13 nt, Human
uggcaagaugugg

SEQ ID NO: 2236514 - RNA, 19 nt, Human
aaauaugccccauucaaca

SEQ ID NO: 2236515 - RNA, 14 nt, Human
gagcaggcuacugu

SEQ ID NO: 2236516 - RNA, 13 nt, Human
cccugagcaggau

SEQ ID NO: 2236517 - RNA, 12 nt, Human
agaccucagccu

SEQ ID NO: 2236518 - RNA, 13 nt, Human
acuagggcaggga

SEQ ID NO: 2236519 - RNA, 14 nt, Human
aacugaagccagaa

SEQ ID NO: 2236520 - RNA, 14 nt, Human
guauuuuaaaagaa

SEQ ID NO: 2236521 - RNA, 22 nt, Human
uauuucagauaaucacaauaca

SEQ ID NO: 2236522 - RNA, 15 nt, Human
uuaauuuguaguguu

SEQ ID NO: 2236523 - RNA, 14 nt, Human
uucacauuuaaaua

SEQ ID NO: 2236524 - RNA, 20 nt, Human
accucauggaauuggagcuc

SEQ ID NO: 2236525 - RNA, 20 nt, Human
agcuuauugucuagugaaac

SEQ ID NO: 2236526 - RNA, 20 nt, Human
cuagagcacacuguagcauu

SEQ ID NO: 2236527 - RNA, 13 nt, Human
aggacuguagaaa

SEQ ID NO: 2236528 - RNA, 15 nt, Human
agacaaggaaaaaau

SEQ ID NO: 2236529 - RNA, 18 nt, Human
uauaacaaugcuguauuu

SEQ ID NO: 2236530 - RNA, 13 nt, Human
aagaaaauaacga

SEQ ID NO: 2236531 - RNA, 21 nt, Human
auuauauggcuugaguuuaaa

SEQ ID NO: 2236532 - RNA, 21 nt, Human
aaagaauauuuuaacuuccuu

SEQ ID NO: 2236533 - RNA, 14 nt, Human
uaauccuaaacaua

SEQ ID NO: 2236534 - RNA, 12 nt, Human
cuccauuuuuag

SEQ ID NO: 2236535 - RNA, 13 nt, Human
auuuuaaaagaau

SEQ ID NO: 2236536 - RNA, 21 nt, Human
uaaaagacagugaaagaaaau

SEQ ID NO: 2236537 - RNA, 20 nt, Human
acuucuuaggguuaugauua

SEQ ID NO: 2236538 - RNA, 13 nt, Human
aagcauuguaaau

SEQ ID NO: 2236539 - RNA, 19 nt, Human
agcagccagcucucagcca

SEQ ID NO: 2236540 - RNA, 18 nt, Human
uuuucucuccucucccca

SEQ ID NO: 2236541 - RNA, 17 nt, Human
uuccaagugauugaaac

SEQ ID NO: 2236542 - RNA, 16 nt, Human
augaucuuuaaaauac

SEQ ID NO: 2236543 - RNA, 19 nt, Human
cugagcaggauuuuaaucu

SEQ ID NO: 2236544 - RNA, 13 nt, Human
ccuccuuuuaaag

SEQ ID NO: 2236545 - RNA, 17 nt, Human
aaccuagggugauauua

SEQ ID NO: 2236546 - RNA, 14 nt, Human
auccaaugaaauga

SEQ ID NO: 2236547 - RNA, 18 nt, Human
acucuuaagaagacugca

SEQ ID NO: 2236548 - RNA, 21 nt, Human
cuaagcuucacuguaaaauaa

SEQ ID NO: 2236549 - RNA, 17 nt, Human
gcaaauugucacaggac

SEQ ID NO: 2236550 - RNA, 16 nt, Human
gacaagcucacagacc

SEQ ID NO: 2236551 - RNA, 15 nt, Human
gcaucaauuuuucuu

SEQ ID NO: 2236552 - RNA, 20 nt, Human
gacucauuuuaaaaaaugga

SEQ ID NO: 2236553 - RNA, 19 nt, Human
agugggugccccccuugcc

SEQ ID NO: 2236554 - RNA, 16 nt, Human
uuccauauuaaaauca

SEQ ID NO: 2236555 - RNA, 19 nt, Human
uguauuaaguuguuaauaa

SEQ ID NO: 2236556 - RNA, 13 nt, Human
uaacaauaaaaga

SEQ ID NO: 2236557 - RNA, 16 nt, Human
ccuguuaaaagaugaa

SEQ ID NO: 2236558 - RNA, 23 nt, Human
ccucagccuuccccuugcccagg

SEQ ID NO: 2236559 - RNA, 18 nt, Human
cuuggacucauuuuaaaa

SEQ ID NO: 2236560 - RNA, 24 nt, Human
gcuccugucugccagccagcagcc

SEQ ID NO: 2236561 - RNA, 13 nt, Human
ugauaauaaaauu

SEQ ID NO: 2236562 - RNA, 15 nt, Human
aaacauaugaauuau

SEQ ID NO: 2236563 - RNA, 20 nt, Human
acagcccuucuuuccacaga

SEQ ID NO: 2236564 - RNA, 21 nt, Human
aaauaauuuuuauauuugaaa

SEQ ID NO: 2236565 - RNA, 14 nt, Human
augaucuuuaaaau

SEQ ID NO: 2236566 - RNA, 12 nt, Human
gaauuggagcuc

SEQ ID NO: 2236567 - RNA, 24 nt, Human
cuugaacacugggggaggggacau

SEQ ID NO: 2236568 - RNA, 14 nt, Human
cagugaaagaaaau

SEQ ID NO: 2236569 - RNA, 18 nt, Human
auuuauuuccauauuaaa

SEQ ID NO: 2236570 - RNA, 19 nt, Human
aauuguuuuuauggaggcu

SEQ ID NO: 2236571 - RNA, 13 nt, Human
acaaggaaaaaau

SEQ ID NO: 2236572 - RNA, 21 nt, Human
auauaugcuaagucuuauaua

SEQ ID NO: 2236573 - RNA, 18 nt, Human
auuggggaagacuguggc

SEQ ID NO: 2236574 - RNA, 14 nt, Human
cauuaucucaaaac

SEQ ID NO: 2236575 - RNA, 13 nt, Human
agaauauuaaaaa

SEQ ID NO: 2236576 - RNA, 19 nt, Human
cauagauucccugagcagg

SEQ ID NO: 2236577 - RNA, 19 nt, Human
acuuccuuggacucauuuu

SEQ ID NO: 2236578 - RNA, 22 nt, Human
uuugaaacgaggauugggaaaa

SEQ ID NO: 2236579 - RNA, 17 nt, Human
ucugccagccagcagcc

SEQ ID NO: 2236580 - RNA, 17 nt, Human
uugccaaauauaaauaa

SEQ ID NO: 2236581 - RNA, 18 nt, Human
auacuaauaaaauacaua

SEQ ID NO: 2236582 - RNA, 13 nt, Human
aguguuugaaagc

SEQ ID NO: 2236583 - RNA, 23 nt, Human
gauagauaggucagugcaaauac

SEQ ID NO: 2236584 - RNA, 20 nt, Human
aauaauuuuuauauuugaaa

SEQ ID NO: 2236585 - RNA, 15 nt, Human
ggcaauagucaaauu

SEQ ID NO: 2236586 - RNA, 12 nt, Human
auuaauucuuua

SEQ ID NO: 2236587 - RNA, 23 nt, Human
caucagcuugcccuguuaaaaga

SEQ ID NO: 2236588 - RNA, 22 nt, Human
aagacuguggcugcuagcacuu

SEQ ID NO: 2236589 - RNA, 20 nt, Human
auuucauaccuaucaucuua

SEQ ID NO: 2236590 - RNA, 21 nt, Human
aaaauggaacauaaaauacaa

SEQ ID NO: 2236591 - RNA, 18 nt, Human
auagcuacuaauuuuaaa

SEQ ID NO: 2236592 - RNA, 13 nt, Human
aagacaaggaaaa

SEQ ID NO: 2236593 - RNA, 21 nt, Human
agcagcaucucugaacauuuc

SEQ ID NO: 2236594 - RNA, 13 nt, Human
aaauaugcaaagc

SEQ ID NO: 2236595 - RNA, 15 nt, Human
gccucggagccucau

SEQ ID NO: 2236596 - RNA, 19 nt, Human
uucagauauaaaagacuga

SEQ ID NO: 2236597 - RNA, 15 nt, Human
auauugauaauaaaa

SEQ ID NO: 2236598 - RNA, 16 nt, Human
gacucagggccccagc

SEQ ID NO: 2236599 - RNA, 22 nt, Human
uguugcccacagcuguaugauu

SEQ ID NO: 2236600 - RNA, 23 nt, Human
auuuuucuuauuucauuucuuug

SEQ ID NO: 2236601 - RNA, 13 nt, Human
aaaauaacgauaa

SEQ ID NO: 2236602 - RNA, 15 nt, Human
agaauauuaaaaauu

SEQ ID NO: 2236603 - RNA, 18 nt, Human
gccuagccgaccucagcc

SEQ ID NO: 2236604 - RNA, 17 nt, Human
aaaucacaaacucaucc

SEQ ID NO: 2236605 - RNA, 17 nt, Human
gccuccuuuuaaaguaa

SEQ ID NO: 2236606 - RNA, 18 nt, Human
aaaagacuccaaagaaau

SEQ ID NO: 2236607 - RNA, 14 nt, Human
cauccauuaaugua

SEQ ID NO: 2236608 - RNA, 17 nt, Human
ugaggcagacagcagcu

SEQ ID NO: 2236609 - RNA, 14 nt, Human
aaauauuauuuuau

SEQ ID NO: 2236610 - RNA, 17 nt, Human
uuuuaaaaaaaaauacu

SEQ ID NO: 2236611 - RNA, 16 nt, Human
accuuuagaauauuaa

SEQ ID NO: 2236612 - RNA, 17 nt, Human
uucacuguaaaauaaua

SEQ ID NO: 2236613 - RNA, 16 nt, Human
uuauuuccauauuaaa

SEQ ID NO: 2236614 - RNA, 22 nt, Human
guucuuaagacgugauuuugcu

SEQ ID NO: 2236615 - RNA, 16 nt, Human
gacaaggaaaaaauaa

SEQ ID NO: 2236616 - RNA, 20 nt, Human
uuauauuuauuacuguaaga

SEQ ID NO: 2236617 - RNA, 23 nt, Human
uuaaaaaugguuuaaauggucaa

SEQ ID NO: 2236618 - RNA, 23 nt, Human
ugagcccauggcacucuauguuc

SEQ ID NO: 2236619 - RNA, 14 nt, Human
ugagaugcuagaac

SEQ ID NO: 2236620 - RNA, 17 nt, Human
uggaauuggagcucgug

SEQ ID NO: 2236621 - RNA, 19 nt, Human
ugccugcaggcaugaguca

SEQ ID NO: 2236622 - RNA, 22 nt, Human
gcuaccuuuugcuguggcaaau

SEQ ID NO: 2236623 - RNA, 19 nt, Human
gccuucggccuccauccug

SEQ ID NO: 2236624 - RNA, 18 nt, Human
gcgcccacuagacccacu

SEQ ID NO: 2236625 - RNA, 12 nt, Human
gcgacagugaga

SEQ ID NO: 2236626 - RNA, 23 nt, Human
ucacauuuaaauaaaguguuuga

SEQ ID NO: 2236627 - RNA, 22 nt, Human
uaaaacaagcacuaaacaaaga

SEQ ID NO: 2236628 - RNA, 18 nt, Human
uaaaauaauaacugggaa

SEQ ID NO: 2236629 - RNA, 14 nt, Human
gcagcuuuccucaa

SEQ ID NO: 2236630 - RNA, 13 nt, Human
gagucaaugaacu

SEQ ID NO: 2236631 - RNA, 20 nt, Human
gagucagucugaugagaacu

SEQ ID NO: 2236632 - RNA, 14 nt, Human
gauucccagccagc

SEQ ID NO: 2236633 - RNA, 13 nt, Human
cuuccuggcaaua

SEQ ID NO: 2236634 - RNA, 18 nt, Human
cugcugagucccaggcug

SEQ ID NO: 2236635 - RNA, 13 nt, Human
cugcauacucauu

SEQ ID NO: 2236636 - RNA, 22 nt, Human
gaaauaagccagacaucaacag

SEQ ID NO: 2236637 - RNA, 22 nt, Human
gacagugaaagaaaauaacgau

SEQ ID NO: 2236638 - RNA, 13 nt, Human
gacauuugcucau

SEQ ID NO: 2236639 - RNA, 11 nt, Human
cuccagccuga

SEQ ID NO: 2236640 - RNA, 18 nt, Human
cucauccugcaggcagcu

SEQ ID NO: 2236641 - RNA, 21 nt, Human
cugagucccaggcugagccuc

SEQ ID NO: 2236642 - RNA, 15 nt, Human
cucugcauacucauu

SEQ ID NO: 2236643 - RNA, 16 nt, Human
cuacacuccagugaga

SEQ ID NO: 2236644 - RNA, 11 nt, Human
cgcucucuggc

SEQ ID NO: 2236645 - RNA, 15 nt, Human
uugagcucagcccug

SEQ ID NO: 2236646 - RNA, 19 nt, Human
uugccauaauuacuauguc

SEQ ID NO: 2236647 - RNA, 17 nt, Human
uuaccagggacugaggg

SEQ ID NO: 2236648 - RNA, 21 nt, Human
uucaugcugucuacacuaaga

SEQ ID NO: 2236649 - RNA, 17 nt, Human
uuccaccuacaugaggu

SEQ ID NO: 2236650 - RNA, 22 nt, Human
aacacaugauccugcaauucca

SEQ ID NO: 2236651 - RNA, 14 nt, Human
aaaaauaacaauga

SEQ ID NO: 2236652 - RNA, 22 nt, Human
aagcuccauuuuuagugaaaua

SEQ ID NO: 2236653 - RNA, 15 nt, Human
aaguccagccuggca

SEQ ID NO: 2236654 - RNA, 21 nt, Human
aaauauuuauuuuaauaaugu

SEQ ID NO: 2236655 - RNA, 22 nt, Human
aacuugguuuuaauuagugaac

SEQ ID NO: 2236656 - RNA, 18 nt, Human
aagaaugauuaugaauua

SEQ ID NO: 2236657 - RNA, 14 nt, Human
aagacagugaaaga

SEQ ID NO: 2236658 - RNA, 19 nt, Human
aacgauaaaagacagugaa

SEQ ID NO: 2236659 - RNA, 20 nt, Human
aacgauaaaagacagugaaa

SEQ ID NO: 2236660 - RNA, 17 nt, Human
ucccaggcugagccuca

SEQ ID NO: 2236661 - RNA, 17 nt, Human
ugaaguacucauacaug

SEQ ID NO: 2236662 - RNA, 15 nt, Human
uauccuucagccuga

SEQ ID NO: 2236663 - RNA, 14 nt, Human
uccaagugauugaa

SEQ ID NO: 2236664 - RNA, 14 nt, Human
guuugaaagcuuua

SEQ ID NO: 2236665 - RNA, 21 nt, Human
ggacgagaaaacaauaacgau

SEQ ID NO: 2236666 - RNA, 15 nt, Human
ggagaagaacugaaa

SEQ ID NO: 2236667 - RNA, 12 nt, Human
ggagcucgugga

SEQ ID NO: 2236668 - RNA, 12 nt, Human
ggagcucguggg

SEQ ID NO: 2236669 - RNA, 15 nt, Human
ggauggggcuguggg

SEQ ID NO: 2236670 - RNA, 23 nt, Human
cuaaacauaugaauuauguuugc

SEQ ID NO: 2236671 - RNA, 17 nt, Human
cugccuaagugcagccc

SEQ ID NO: 2236672 - RNA, 15 nt, Human
cuuccucugagccuu

SEQ ID NO: 2236673 - RNA, 20 nt, Human
cugugagaugcuagaacucc

SEQ ID NO: 2236674 - RNA, 16 nt, Human
ccagauccuggaaauc

SEQ ID NO: 2236675 - RNA, 23 nt, Human
ccauaugaaaaggcuaagcuuca

SEQ ID NO: 2236676 - RNA, 23 nt, Human
ccuuuuuuugaaaaaaagcuuuu

SEQ ID NO: 2236677 - RNA, 16 nt, Human
ccucuggcuccagcug

SEQ ID NO: 2236678 - RNA, 20 nt, Human
caacuccagaaagugacaag

SEQ ID NO: 2236679 - RNA, 19 nt, Human
auguuugcauguucacuuc

SEQ ID NO: 2236680 - RNA, 13 nt, Human
caaggaugaauua

SEQ ID NO: 2236681 - RNA, 13 nt, Human
caaucaugaauua

SEQ ID NO: 2236682 - RNA, 19 nt, Human
cagccucuuagaugcaguu

SEQ ID NO: 2236683 - RNA, 16 nt, Human
cauccuacaagacaca

SEQ ID NO: 2236684 - RNA, 13 nt, Human
cauccugcaggca

SEQ ID NO: 2236685 - RNA, 13 nt, Human
ccaagugauugaa

SEQ ID NO: 2236686 - RNA, 17 nt, Human
cauucuggaauaauccu

SEQ ID NO: 2236687 - RNA, 16 nt, Human
acagaaagcagaacag

SEQ ID NO: 2236688 - RNA, 16 nt, Human
acacagugaccauacu

SEQ ID NO: 2236689 - RNA, 16 nt, Human
aacgauaaaagacagu

SEQ ID NO: 2236690 - RNA, 13 nt, Human
aacaauaacgaua

SEQ ID NO: 2236691 - RNA, 19 nt, Human
aauuggagcucguggaaca

SEQ ID NO: 2236692 - RNA, 19 nt, Human
aauuggagcucgugggaca

SEQ ID NO: 2236693 - RNA, 22 nt, Human
aauuguauuuuaguaagagauu

SEQ ID NO: 2236694 - RNA, 12 nt, Human
aagcugaaaugg

SEQ ID NO: 2236695 - RNA, 19 nt, Human
acuuggucugugagaugcu

SEQ ID NO: 2236696 - RNA, 13 nt, Human
agaaacauuuggu

SEQ ID NO: 2236697 - RNA, 22 nt, Human
agcagcauaaauguugacaugg

SEQ ID NO: 2236698 - RNA, 14 nt, Human
ucuaaacauguuua

SEQ ID NO: 2236699 - RNA, 14 nt, Human
uuccucugagccuu

SEQ ID NO: 2236700 - RNA, 15 nt, Human
uugucuagugaaacu

SEQ ID NO: 2236701 - RNA, 20 nt, Human
uuggagaagaacugaaauca

SEQ ID NO: 2236702 - RNA, 12 nt, Human
uuucuaugaaau

SEQ ID NO: 2236703 - RNA, 19 nt, Human
guacuggcugauggaguaa

SEQ ID NO: 2236704 - RNA, 13 nt, Human
gcuuugaaacgag

SEQ ID NO: 2236705 - RNA, 21 nt, Human
gcuuacacccacaguggaaag

SEQ ID NO: 2236706 - RNA, 17 nt, Human
ccccugagcuugcagag

SEQ ID NO: 2236707 - RNA, 15 nt, Human
uccauguacuggcaa

SEQ ID NO: 2236708 - RNA, 11 nt, Human
guuaaaugauu

SEQ ID NO: 2236709 - RNA, 16 nt, Human
guuaccucugccucag

SEQ ID NO: 2236710 - RNA, 17 nt, Human
gugauuuugugauugau

SEQ ID NO: 2236711 - RNA, 17 nt, Human
guaaugauaacuggaaa

SEQ ID NO: 2236712 - RNA, 13 nt, Human
gguugcagugagc

SEQ ID NO: 2236713 - RNA, 17 nt, Human
gggauuguaaaauggug

SEQ ID NO: 2236714 - RNA, 14 nt, Human
gccuugggaccccu

SEQ ID NO: 2236715 - RNA, 20 nt, Human
ggcauuuaggccaugggaca

SEQ ID NO: 2236716 - RNA, 16 nt, Human
uacaaaaccacuggaa

SEQ ID NO: 2236717 - RNA, 21 nt, Human
ucucuggccuucggccuccau

SEQ ID NO: 2236718 - RNA, 14 nt, Human
ucucaguucacugu

SEQ ID NO: 2236719 - RNA, 16 nt, Human
cugccccccagcccuc

SEQ ID NO: 2236720 - RNA, 23 nt, Human
agccaaacauccuacaagacaca

SEQ ID NO: 2236721 - RNA, 13 nt, Human
agaguacuggcug

SEQ ID NO: 2236722 - RNA, 21 nt, Human
agagaaugagagacacacuga

SEQ ID NO: 2236723 - RNA, 22 nt, Human
cucccuuggggccuaugcagag

SEQ ID NO: 2236724 - RNA, 17 nt, Human
caggcuugccugcaggc

SEQ ID NO: 2236725 - RNA, 18 nt, Human
caggcuugccugcaggca

SEQ ID NO: 2236726 - RNA, 13 nt, Human
caaauugucacag

SEQ ID NO: 2236727 - RNA, 21 nt, Human
caaaauaugccccauucaaca

SEQ ID NO: 2236728 - RNA, 23 nt, Human
caaaaaucucaauauuucagaua

SEQ ID NO: 2236729 - RNA, 13 nt, Human
auucauucacuca

SEQ ID NO: 2236730 - RNA, 13 nt, Human
cacuagacccacu

SEQ ID NO: 2236731 - RNA, 11 nt, Human
cacacugaaga

SEQ ID NO: 2236732 - RNA, 17 nt, Human
caaggguucaccugggc

SEQ ID NO: 2236733 - RNA, 15 nt, Human
ccacuggaaaguuua

SEQ ID NO: 2236734 - RNA, 20 nt, Human
cccacaguggaaagacagcu

SEQ ID NO: 2236735 - RNA, 12 nt, Human
ccauccugaggc

SEQ ID NO: 2236736 - RNA, 17 nt, Human
cagugucaaugcagccc

SEQ ID NO: 2236737 - RNA, 18 nt, Human
cagcucuaaaugucaauc

SEQ ID NO: 2236738 - RNA, 21 nt, Human
cagcuucucauccugcaggca

SEQ ID NO: 2236739 - RNA, 14 nt, Human
cagcuguaugauuc

SEQ ID NO: 2236740 - RNA, 17 nt, Human
auaauuuaaaauaugcu

SEQ ID NO: 2236741 - RNA, 21 nt, Human
auaauuuuuaauuauauggcu

SEQ ID NO: 2236742 - RNA, 17 nt, Human
auauauaacaaugcugu

SEQ ID NO: 2236743 - RNA, 16 nt, Human
augaaugaauggcuaa

SEQ ID NO: 2236744 - RNA, 15 nt, Human
augcuagaacucccu

SEQ ID NO: 2236745 - RNA, 23 nt, Human
augaaaaggcuaagcuucacugu

SEQ ID NO: 2236746 - RNA, 12 nt, Human
auguguucauuc

SEQ ID NO: 2236747 - RNA, 11 nt, Human
auuauauguca

SEQ ID NO: 2236748 - RNA, 17 nt, Human
agccucuuagaugcagu

SEQ ID NO: 2236749 - RNA, 20 nt, Human
agccuuggggcugaugcagu

SEQ ID NO: 2236750 - RNA, 21 nt, Human
agccuuggggcugaugcaguu

SEQ ID NO: 2236751 - RNA, 17 nt, Human
uuucagauaaucacaau

SEQ ID NO: 2236752 - RNA, 20 nt, Human
uuucaaacauauauaacaau

SEQ ID NO: 2236753 - RNA, 17 nt, Human
aggguucaccugggcug

SEQ ID NO: 2236754 - RNA, 18 nt, Human
aggaaugaaguacucaua

SEQ ID NO: 2236755 - RNA, 15 nt, Human
aggaaggcuuacacc

SEQ ID NO: 2236756 - RNA, 17 nt, Human
aggauuaaugucaauuc

SEQ ID NO: 2236757 - RNA, 18 nt, Human
aggauuuauguuuaauuc

SEQ ID NO: 2236758 - RNA, 16 nt, Human
aggccaugggacaggg

SEQ ID NO: 2236759 - RNA, 19 nt, Human
agcugcucaauaaaguaca

SEQ ID NO: 2236760 - RNA, 12 nt, Human
aaagugacaagc

SEQ ID NO: 2236761 - RNA, 14 nt, Human
acaugauccugcaa

SEQ ID NO: 2236762 - RNA, 14 nt, Human
auaaaaauaauccu

SEQ ID NO: 2236763 - RNA, 18 nt, Human
auaauuuaaauauaugcu

SEQ ID NO: 2236764 - RNA, 17 nt, Human
auaauuuugugaagcaa

SEQ ID NO: 2236765 - RNA, 22 nt, Human
aggaugguucccuugaugaaga

SEQ ID NO: 2236766 - RNA, 19 nt, Human
aggcauccuuccucacacc

SEQ ID NO: 2236767 - RNA, 17 nt, Human
aggacacugauaugggu

SEQ ID NO: 2236768 - RNA, 19 nt, Human
agcuuuccucaaaacuuca

SEQ ID NO: 2236769 - RNA, 22 nt, Human
cacagcugcucaauaaaguaca

SEQ ID NO: 2236770 - RNA, 14 nt, Human
auuuugugauugau

SEQ ID NO: 2236771 - RNA, 23 nt, Human
aaucgcuaccuuuugcuguggca

SEQ ID NO: 2236772 - RNA, 16 nt, Human
aaacauguuuaucgua

SEQ ID NO: 2236773 - RNA, 16 nt, Human
aaagaaaauaacgaua

SEQ ID NO: 2236774 - RNA, 22 nt, Human
aaaaaguucugcagauaaacag

SEQ ID NO: 2236775 - RNA, 13 nt, Human
acaacuauauugu

SEQ ID NO: 2236776 - RNA, 13 nt, Human
acacacugaagaa

SEQ ID NO: 2236777 - RNA, 22 nt, Human
acaccaggcuugccugcaggca

SEQ ID NO: 2236778 - RNA, 15 nt, Human
agaaaauaacaauaa

SEQ ID NO: 2236779 - RNA, 19 nt, Human
agaaaaucaggcuggccaa

SEQ ID NO: 2236780 - RNA, 15 nt, Human
aauccaaugaaauga

SEQ ID NO: 2236781 - RNA, 23 nt, Human
aauauugcaaggcaaagacuauu

SEQ ID NO: 2236782 - RNA, 22 nt, Human
aauagucaaauugugugaaagg

SEQ ID NO: 2236783 - RNA, 17 nt, Human
gacaaggaaaaaauaac

SEQ ID NO: 2236784 - RNA, 13 nt, Human
aguguuugaaagc

SEQ ID NO: 2236785 - RNA, 15 nt, Human
acaagacccaaaagg

SEQ ID NO: 2236786 - RNA, 17 nt, Human
auuuucuauaauuuaaa

SEQ ID NO: 2236787 - RNA, 15 nt, Human
gucccaggcugagcc

SEQ ID NO: 2236788 - RNA, 13 nt, Human
ugaaaaucuuaua

SEQ ID NO: 2236789 - RNA, 19 nt, Human
auuguauuuuaguaagaga

SEQ ID NO: 2236790 - RNA, 12 nt, Human
uauuauuuuuua

SEQ ID NO: 2236791 - RNA, 16 nt, Human
aggguguguaaguaga

SEQ ID NO: 2236792 - RNA, 16 nt, Human
cacgggggccaaggau

SEQ ID NO: 2236793 - RNA, 19 nt, Human
aaugaaauggugaaaugca

SEQ ID NO: 2236794 - RNA, 13 nt, Human
auaacuggaaacu

SEQ ID NO: 2236795 - RNA, 17 nt, Human
aaccuagggugauauua

SEQ ID NO: 2236796 - RNA, 17 nt, Human
aaauaacaauaaaagac

SEQ ID NO: 2236797 - RNA, 13 nt, Human
agaaaugaaagca

SEQ ID NO: 2236798 - RNA, 16 nt, Human
uacaaaugggaaacaa

SEQ ID NO: 2236799 - RNA, 15 nt, Human
uaucaauuuaaaaaa

SEQ ID NO: 2236800 - RNA, 17 nt, Human
uacaaaugcauuucuaa

SEQ ID NO: 2236801 - RNA, 22 nt, Human
uuuaauaauguuucaaacauau

SEQ ID NO: 2236802 - RNA, 15 nt, Human
acucaccucccccau

SEQ ID NO: 2236803 - RNA, 22 nt, Human
gaauuucuucaacucccugccc

SEQ ID NO: 2236804 - RNA, 15 nt, Human
aguucugaagaagau

SEQ ID NO: 2236805 - RNA, 22 nt, Human
auuuucuucucacauuuauauu

SEQ ID NO: 2236806 - RNA, 22 nt, Human
uuugaaacgaggauugggaaaa

SEQ ID NO: 2236807 - RNA, 15 nt, Human
gacaguauggcagcu

SEQ ID NO: 2236808 - RNA, 15 nt, Human
uuaauucugaaagca

SEQ ID NO: 2236809 - RNA, 19 nt, Human
gugaacuugguuuuaauua

SEQ ID NO: 2236810 - RNA, 21 nt, Human
ugagcucagcccuggugggca

SEQ ID NO: 2236811 - RNA, 13 nt, Human
agacagcucugca

SEQ ID NO: 2236812 - RNA, 15 nt, Human
ucauaauaaguugca

SEQ ID NO: 2236813 - RNA, 14 nt, Human
ccugccccccagcc

SEQ ID NO: 2236814 - RNA, 17 nt, Human
uugccaaauauaaauaa

SEQ ID NO: 2236815 - RNA, 18 nt, Human
uuuguuaaaugauuucau

SEQ ID NO: 2236816 - RNA, 21 nt, Human
aaugugacuuaaugccacuaa

SEQ ID NO: 2236817 - RNA, 18 nt, Human
gagccucagucucccucc

SEQ ID NO: 2236818 - RNA, 14 nt, Human
ugcuguauuuuaaa

SEQ ID NO: 2236819 - RNA, 17 nt, Human
uucacuguaaaauaaua

SEQ ID NO: 2236820 - RNA, 21 nt, Human
auauaugcuaagucuuauaua

SEQ ID NO: 2236821 - RNA, 23 nt, Human
ucggccuccauccugaggcucca

SEQ ID NO: 2236822 - RNA, 23 nt, Human
cacagauuugagcucagcccugg

SEQ ID NO: 2236823 - RNA, 16 nt, Human
acaaggaugaauuaag

SEQ ID NO: 2236824 - RNA, 15 nt, Human
agucugaugagaacu

SEQ ID NO: 2236825 - RNA, 15 nt, Human
cccccagcccuccuu

SEQ ID NO: 2236826 - RNA, 15 nt, Human
cucguggaacaguua

SEQ ID NO: 2236827 - RNA, 16 nt, Human
uucuauaauuuaaaua

SEQ ID NO: 2236828 - RNA, 14 nt, Human
aaagaggaaugaag

SEQ ID NO: 2236829 - RNA, 13 nt, Human
aaauccuugaaga

SEQ ID NO: 2236830 - RNA, 17 nt, Human
uaaaagacaaggaaaaa

SEQ ID NO: 2236831 - RNA, 19 nt, Human
cucaccucccccaucucuu

SEQ ID NO: 2236832 - RNA, 22 nt, Human
aucaccaaggcugauuaaacca

SEQ ID NO: 2236833 - RNA, 16 nt, Human
ugaaguacucauacau

SEQ ID NO: 2236834 - RNA, 16 nt, Human
ugcacaucaaaauaug

SEQ ID NO: 2236835 - RNA, 11 nt, Human
gcaugguuuag

SEQ ID NO: 2236836 - RNA, 21 nt, Human
aauuuacagagacagaaagca

SEQ ID NO: 2236837 - RNA, 21 nt, Human
ugaacaaauuuacagagacag

SEQ ID NO: 2236838 - RNA, 15 nt, Human
caaggaaaaaauaac

SEQ ID NO: 2236839 - RNA, 14 nt, Human
cagugaaagaaaau

SEQ ID NO: 2236840 - RNA, 15 nt, Human
uccuacaagacacag

SEQ ID NO: 2236841 - RNA, 22 nt, Human
gagucccaggcugagccucagu

SEQ ID NO: 2236842 - RNA, 16 nt, Human
aaaagcaucacaugaa

SEQ ID NO: 2236843 - RNA, 19 nt, Human
augaaagcagggacuugaa

SEQ ID NO: 2236844 - RNA, 16 nt, Human
cuagaaccaccugccu

SEQ ID NO: 2236845 - RNA, 19 nt, Human
ccccugagcuugcagagau

SEQ ID NO: 2236846 - RNA, 12 nt, Human
gccccugagccc

SEQ ID NO: 2236847 - RNA, 15 nt, Human
uuuaugguuguauua

SEQ ID NO: 2236848 - RNA, 20 nt, Human
uuaacacaugauccugcaau

SEQ ID NO: 2236849 - RNA, 20 nt, Human
uaaaacaagcacuaaacaaa

SEQ ID NO: 2236850 - RNA, 15 nt, Human
auaauccuaaacaua

SEQ ID NO: 2236851 - RNA, 23 nt, Human
cccacuggacucaccucccccau

SEQ ID NO: 2236852 - RNA, 21 nt, Human
auuuacaaaugggaaacaaaa

SEQ ID NO: 2236853 - RNA, 17 nt, Human
gccuccuuuuaaaguaa

SEQ ID NO: 2236854 - RNA, 16 nt, Human
aaaaauuccaagugau

SEQ ID NO: 2236855 - RNA, 22 nt, Human
gaugcaguucugaagaagaugg

SEQ ID NO: 2236856 - RNA, 18 nt, Human
ugcauagguuuaauaauu

SEQ ID NO: 2236857 - RNA, 20 nt, Human
aauaauuuuuauauuugaaa

SEQ ID NO: 2236858 - RNA, 23 nt, Human
gauagauaggucagugcaaauac

SEQ ID NO: 2236859 - RNA, 22 nt, Human
ucuccagagggaauugcagagu

SEQ ID NO: 2236860 - RNA, 18 nt, Human
gaauaauccuaaacauau

SEQ ID NO: 2236861 - RNA, 21 nt, Human
gaagugaaaaucuacacucca

SEQ ID NO: 2236862 - RNA, 20 nt, Human
aaaaaccugagccccaaaag

SEQ ID NO: 2236863 - RNA, 15 nt, Human
acugaagaagcacca

SEQ ID NO: 2236864 - RNA, 14 nt, Human
cagugucaggagga

SEQ ID NO: 2236865 - RNA, 10 nt, Human
auguuuucag

SEQ ID NO: 2236866 - RNA, 11 nt, Human
auuuuugaagc

SEQ ID NO: 2236867 - RNA, 20 nt, Human
uccaagccucauguccacug

SEQ ID NO: 2236868 - RNA, 22 nt, Human
aggacaccauuuuggcaagcuc

SEQ ID NO: 2236869 - RNA, 13 nt, Human
gcuggagcucugc

SEQ ID NO: 2236870 - RNA, 12 nt, Human
gucccaggcuga

SEQ ID NO: 2236871 - RNA, 20 nt, Human
agcuuauugucuagugaaac

SEQ ID NO: 2236872 - RNA, 20 nt, Human
uggaauaauccuaaacauau

SEQ ID NO: 2236873 - RNA, 20 nt, Human
ccugccuaagugcagccccg

SEQ ID NO: 2236874 - RNA, 19 nt, Human
cuuccagauccuggaaauc

SEQ ID NO: 2236875 - RNA, 13 nt, Human
uacuuuauuuucu

SEQ ID NO: 2236876 - RNA, 23 nt, Human
uacaaaugggaaacaaaaggaua

SEQ ID NO: 2236877 - RNA, 20 nt, Human
uuguagguaauauugcaagg

SEQ ID NO: 2236878 - RNA, 18 nt, Human
uaaaagacaaggaaaaaa

SEQ ID NO: 2236879 - RNA, 21 nt, Human
aggguucaccugggcugaggc

SEQ ID NO: 2236880 - RNA, 16 nt, Human
cauagaaguaaaaaca

SEQ ID NO: 2236881 - RNA, 18 nt, Human
aacaaugcuguauuuuaa

SEQ ID NO: 2236882 - RNA, 13 nt, Human
aaaaauccuacuu

SEQ ID NO: 2236883 - RNA, 14 nt, Human
agucucccucccuu

SEQ ID NO: 2236884 - RNA, 16 nt, Human
aaaaugugauauguac

SEQ ID NO: 2236885 - RNA, 17 nt, Human
ugaaggauuuauguuua

SEQ ID NO: 2236886 - RNA, 14 nt, Human
gaaagcagaacagu

SEQ ID NO: 2236887 - RNA, 21 nt, Human
ugaugcuacaggauuugaaau

SEQ ID NO: 2236888 - RNA, 19 nt, Human
uggaaauguuuacagaucc

SEQ ID NO: 2236889 - RNA, 16 nt, Human
cugagccucagucucc

SEQ ID NO: 2236890 - RNA, 13 nt, Human
gauuguaaaaugg

SEQ ID NO: 2236891 - RNA, 12 nt, Human
auauaaauaaaa

SEQ ID NO: 2236892 - RNA, 21 nt, Human
ugaccauacuaauuauacccc

SEQ ID NO: 2236893 - RNA, 12 nt, Human
cuuccucacacc

SEQ ID NO: 2236894 - RNA, 18 nt, Human
gaaacaaaaggauaauga

SEQ ID NO: 2236895 - RNA, 17 nt, Human
aaucuuucacaggggac

SEQ ID NO: 2236896 - RNA, 18 nt, Human
ucucuaggaaauauuuau

SEQ ID NO: 2236897 - RNA, 19 nt, Human
gucaaucagccuaguugau

SEQ ID NO: 2236898 - RNA, 14 nt, Human
aauggcuaagcaaa

SEQ ID NO: 2236899 - RNA, 15 nt, Human
ugauuucauucaaua

SEQ ID NO: 2236900 - RNA, 21 nt, Human
uuuuauggcacuaguauuucu

SEQ ID NO: 2236901 - RNA, 20 nt, Human
cccugcacuccagccugagc

SEQ ID NO: 2236902 - RNA, 15 nt, Human
aaucucaauauuuca

SEQ ID NO: 2236903 - RNA, 16 nt, Human
aauugacccacaagaa

SEQ ID NO: 2236904 - RNA, 23 nt, Human
cuuaagaagacugcauuauauuu

SEQ ID NO: 2236905 - RNA, 21 nt, Human
augcuacaggauuugaaauug

SEQ ID NO: 2236906 - RNA, 15 nt, Human
cuacuaauuuuaaaa

SEQ ID NO: 2236907 - RNA, 21 nt, Human
aaauaauuuuuauauuugaaa

SEQ ID NO: 2236908 - RNA, 19 nt, Human
augaauuacauuuguauaa

SEQ ID NO: 2236909 - RNA, 19 nt, Human
uuuauaucaauuuaaaaaa

SEQ ID NO: 2236910 - RNA, 19 nt, Human
aaugaauggcuaagcaaaa

SEQ ID NO: 2236911 - RNA, 17 nt, Human
aggguguguaaguagau

SEQ ID NO: 2236912 - RNA, 19 nt, Human
aaauggugaaaugcagagu

SEQ ID NO: 2236913 - RNA, 12 nt, Human
acaagacacagu

SEQ ID NO: 2236914 - RNA, 23 nt, Human
gaaaaucuuauaauuuaaaauau

SEQ ID NO: 2236915 - RNA, 23 nt, Human
uuuccaucaaggguacacugccu

SEQ ID NO: 2236916 - RNA, 16 nt, Human
gaaggcuuacacccac

SEQ ID NO: 2236917 - RNA, 15 nt, Human
acaggguuuauguuu

SEQ ID NO: 2236918 - RNA, 16 nt, Human
caugggacagggagga

SEQ ID NO: 2236919 - RNA, 19 nt, Human
aauuuuuauauuugaaaua

SEQ ID NO: 2236920 - RNA, 14 nt, Human
ggccuucggccucc

SEQ ID NO: 2236921 - RNA, 17 nt, Human
aaauguucaucaaugaa

SEQ ID NO: 2236922 - RNA, 17 nt, Human
aagcuuuuuuugaauca

SEQ ID NO: 2236923 - RNA, 13 nt, Human
aggaaaaaauaac

SEQ ID NO: 2236924 - RNA, 22 nt, Human
ccgggagccugaucaccugccc

SEQ ID NO: 2236925 - RNA, 17 nt, Human
cccccugcaaagcccag

SEQ ID NO: 2236926 - RNA, 13 nt, Human
acuaauuuuaaaa

SEQ ID NO: 2236927 - RNA, 16 nt, Human
ccugagcgacagugag

SEQ ID NO: 2236928 - RNA, 14 nt, Human
aaauauuauuuuau

SEQ ID NO: 2236929 - RNA, 20 nt, Human
uagaugcaguucugaagaag

SEQ ID NO: 2236930 - RNA, 15 nt, Human
ugggacagggaggac

SEQ ID NO: 2236931 - RNA, 18 nt, Human
cucuauguucuaagaagu

SEQ ID NO: 2236932 - RNA, 13 nt, Human
gcuugccugcagg

SEQ ID NO: 2236933 - RNA, 14 nt, Human
aaucucaauauuuc

SEQ ID NO: 2236934 - RNA, 18 nt, Human
guuaguauuguccagguc

SEQ ID NO: 2236935 - RNA, 15 nt, Human
acaaggaaaaaauaa

SEQ ID NO: 2236936 - RNA, 14 nt, Human
agguugcagugagc

SEQ ID NO: 2236937 - RNA, 18 nt, Human
acagcuucucauccugca

SEQ ID NO: 2236938 - RNA, 21 nt, Human
aaaagguauuuuaaucaccaa

SEQ ID NO: 2236939 - RNA, 20 nt, Human
uaaaagacagugaaagaaaa

SEQ ID NO: 2236940 - RNA, 18 nt, Human
cagaguacuggcugaugg

SEQ ID NO: 2236941 - RNA, 12 nt, Human
gaagaccucauu

SEQ ID NO: 2236942 - RNA, 18 nt, Human
cccacuggacucaccucc

SEQ ID NO: 2236943 - RNA, 15 nt, Human
auggugaaaugcaga

SEQ ID NO: 2236944 - RNA, 22 nt, Human
ccccuuccuaauuccacagcug

SEQ ID NO: 2236945 - RNA, 22 nt, Human
uuugaugcuacaggauuugaaa

SEQ ID NO: 2236946 - RNA, 21 nt, Human
gccaaauauaaauaaaaauaa

SEQ ID NO: 2236947 - RNA, 15 nt, Human
uguuaaaugauuuca

SEQ ID NO: 2236948 - RNA, 12 nt, Human
agaaaacaauaa

SEQ ID NO: 2236949 - RNA, 16 nt, Human
ggaugccccguccccc

SEQ ID NO: 2236950 - RNA, 20 nt, Human
aacaaugcuguauuuuaaaa

SEQ ID NO: 2236951 - RNA, 15 nt, Human
auuauuuuuuaaaaa

SEQ ID NO: 2236952 - RNA, 16 nt, Human
ccucagucucccuccc

SEQ ID NO: 2236953 - RNA, 16 nt, Human
cugaucaccugcccug

SEQ ID NO: 2236954 - RNA, 13 nt, Human
ugaaauuguauua

SEQ ID NO: 2236955 - RNA, 15 nt, Human
aaauauaaauaaaaa

SEQ ID NO: 2236956 - RNA, 10 nt, Human
caacucccug

SEQ ID NO: 2236957 - RNA, 23 nt, Human
cucagucucccucccuuggggcc

SEQ ID NO: 2236958 - RNA, 19 nt, Human
ucaauucuugccaaauaua

SEQ ID NO: 2236959 - RNA, 21 nt, Human
acaugagguacugagagugaa

SEQ ID NO: 2236960 - RNA, 19 nt, Human
auuaaguuuuuuuuuaaaa

SEQ ID NO: 2236961 - RNA, 19 nt, Human
gagccucagucucccuccc

SEQ ID NO: 2236962 - RNA, 16 nt, Human
gccaugugcuaguaau

SEQ ID NO: 2236963 - RNA, 17 nt, Human
cugccucagaaaacaag

SEQ ID NO: 2236964 - RNA, 15 nt, Human
uggaguaaaucgcua

SEQ ID NO: 2236965 - RNA, 19 nt, Human
gcacuaguauuucuaugaa

SEQ ID NO: 2236966 - RNA, 21 nt, Human
ucaagucuuucacauuuaaau

SEQ ID NO: 2236967 - RNA, 14 nt, Human
uugggaaaaaguaa

SEQ ID NO: 2236968 - RNA, 14 nt, Human
cuuggucugugaga

SEQ ID NO: 2236969 - RNA, 14 nt, Human
uggcuugaguuuaa

SEQ ID NO: 2236970 - RNA, 18 nt, Human
uucucuaggaaauauuua

SEQ ID NO: 2236971 - RNA, 18 nt, Human
uuacaaaugggaaacaaa

SEQ ID NO: 2236972 - RNA, 22 nt, Human
aaauguugacaugggacauuug

SEQ ID NO: 2236973 - RNA, 16 nt, Human
ugagaugcuagaacuc

SEQ ID NO: 2236974 - RNA, 21 nt, Human
uaaaagacagugaaagaaaau

SEQ ID NO: 2236975 - RNA, 12 nt, Human
acacuuaaaaau

SEQ ID NO: 2236976 - RNA, 16 nt, Human
augcuguauuuuaaaa

SEQ ID NO: 2236977 - RNA, 15 nt, Human
ucuaugaaauauuau

SEQ ID NO: 2236978 - RNA, 22 nt, Human
ggacagcccuucuuuccacaga

SEQ ID NO: 2236979 - RNA, 17 nt, Human
cgauaaaagacagugaa

SEQ ID NO: 2236980 - RNA, 12 nt, Human
ccccuugccaua

SEQ ID NO: 2236981 - RNA, 15 nt, Human
ugcagauaaacagua

SEQ ID NO: 2236982 - RNA, 12 nt, Human
uaagaagacugc

SEQ ID NO: 2236983 - RNA, 19 nt, Human
agggaauugcagaguacug

SEQ ID NO: 2236984 - RNA, 12 nt, Human
caggacagcccu

SEQ ID NO: 2236985 - RNA, 16 nt, Human
uucacauuuaaauaaa

SEQ ID NO: 2236986 - RNA, 16 nt, Human
uauccuacuuccccuu

SEQ ID NO: 2236987 - RNA, 13 nt, Human
cuugccugcaggc

SEQ ID NO: 2236988 - RNA, 16 nt, Human
uggcaagcucuaucac

SEQ ID NO: 2236989 - RNA, 17 nt, Human
ugaucaccugcccugcu

SEQ ID NO: 2236990 - RNA, 16 nt, Human
ugagcucagcccuggu

SEQ ID NO: 2236991 - RNA, 17 nt, Human
auguugacaugggacau

SEQ ID NO: 2236992 - RNA, 19 nt, Human
uaucacuugucaauaaaau

SEQ ID NO: 2236993 - RNA, 23 nt, Human
ugagucagucugaugagaacucu

SEQ ID NO: 2236994 - RNA, 14 nt, Human
agucugacuguuuc

SEQ ID NO: 2236995 - RNA, 18 nt, Human
acugauggguuucuccag

SEQ ID NO: 2236996 - RNA, 14 nt, Human
uuauuauauuuaca

SEQ ID NO: 2236997 - RNA, 20 nt, Human
acaugagguacugagaguga

SEQ ID NO: 2236998 - RNA, 17 nt, Human
caaauccaaugaaauga

SEQ ID NO: 2236999 - RNA, 21 nt, Human
auuuuccugaaaacccuugcc

SEQ ID NO: 2237000 - RNA, 20 nt, Human
uauuuauuacuguaagaaaa

SEQ ID NO: 2237001 - RNA, 20 nt, Human
ugagcgcccacuagacccac

SEQ ID NO: 2237002 - RNA, 18 nt, Human
uuuuaaaaaagaaacauu

SEQ ID NO: 2237003 - RNA, 15 nt, Human
uaggaaauauuuauu

SEQ ID NO: 2237004 - RNA, 21 nt, Human
gaaaugaguuuuucuuuucau

SEQ ID NO: 2237005 - RNA, 15 nt, Human
aaaaaagaaacauuu

SEQ ID NO: 2237006 - RNA, 14 nt, Human
auauuuauuuuaau

SEQ ID NO: 2237007 - RNA, 16 nt, Human
ccuccuuuuaaaguaa

SEQ ID NO: 2237008 - RNA, 19 nt, Human
auuuacagagacagaaagc

SEQ ID NO: 2237009 - RNA, 13 nt, Human
aucaaugaaugaa

SEQ ID NO: 2237010 - RNA, 17 nt, Human
augcagagguccacaac

SEQ ID NO: 2237011 - RNA, 23 nt, Human
augucaauucuugccaaauauaa

SEQ ID NO: 2237012 - RNA, 23 nt, Human
uuuauaugcuucuguuuuauaau

SEQ ID NO: 2237013 - RNA, 20 nt, Human
ccagugagacagcucugcau

SEQ ID NO: 2237014 - RNA, 19 nt, Human
auauugcaaggcaaagacu

SEQ ID NO: 2237015 - RNA, 19 nt, Human
cagauccccaagccuggca

SEQ ID NO: 2237016 - RNA, 12 nt, Human
gauaaaagacag

SEQ ID NO: 2237017 - RNA, 15 nt, Human
uucacuguaaaauaa

SEQ ID NO: 2237018 - RNA, 14 nt, Human
cagagguugcagug

SEQ ID NO: 2237019 - RNA, 15 nt, Human
cucccugccccccag

SEQ ID NO: 2237020 - RNA, 19 nt, Human
uauauuuuugugauuuugu

SEQ ID NO: 2237021 - RNA, 11 nt, Human
ugcagugagcc

SEQ ID NO: 2237022 - RNA, 18 nt, Human
uaucaaaagaaagaaaau

SEQ ID NO: 2237023 - RNA, 19 nt, Human
agauuugagcucagcccug

SEQ ID NO: 2237024 - RNA, 23 nt, Human
uagauguauagguugaugguggu

SEQ ID NO: 2237025 - RNA, 22 nt, Human
accuaacgaaguauccuucagc

SEQ ID NO: 2237026 - RNA, 19 nt, Human
augcagagguccacaacac

SEQ ID NO: 2237027 - RNA, 19 nt, Human
uccagaaagugacaagcuc

SEQ ID NO: 2237028 - RNA, 17 nt, Human
uaugcuaagugaaauaa

SEQ ID NO: 2237029 - RNA, 14 nt, Human
aaagagaacuucca

SEQ ID NO: 2237030 - RNA, 19 nt, Human
aaaauaacaauaaaagaca

SEQ ID NO: 2237031 - RNA, 11 nt, Human
ucaccuccccc

SEQ ID NO: 2237032 - RNA, 17 nt, Human
uaucuuuuuuuuaauaa

SEQ ID NO: 2237033 - RNA, 23 nt, Human
aguaauuggaaaggcagcucuaa

SEQ ID NO: 2237034 - RNA, 14 nt, Human
gcaaagcccagcuu

SEQ ID NO: 2237035 - RNA, 12 nt, Human
agggauggggcu

SEQ ID NO: 2237036 - RNA, 19 nt, Human
ccccugcaaagcccagcuu

SEQ ID NO: 2237037 - RNA, 19 nt, Human
agaguuuagcuggaaaagu

SEQ ID NO: 2237038 - RNA, 18 nt, Human
acagagacagaaagcaga

SEQ ID NO: 2237039 - RNA, 18 nt, Human
aaaaucuuauaauuuaaa

SEQ ID NO: 2237040 - RNA, 15 nt, Human
ccccugagcuugcag

SEQ ID NO: 2237041 - RNA, 20 nt, Human
cuucaacucccugcccccca

SEQ ID NO: 2237042 - RNA, 20 nt, Human
gggaggcagagguugcagug

SEQ ID NO: 2237043 - RNA, 20 nt, Human
uacaucccuuaccugggaaa

SEQ ID NO: 2237044 - RNA, 23 nt, Human
ccccucuggcuccagcuggccgg

SEQ ID NO: 2237045 - RNA, 14 nt, Human
aaugauuaugaauu

SEQ ID NO: 2237046 - RNA, 13 nt, Human
ucuauaauuuaaa

SEQ ID NO: 2237047 - RNA, 12 nt, Human
cauagaaguaaa

SEQ ID NO: 2237048 - RNA, 14 nt, Human
agaaaugaaagcag

SEQ ID NO: 2237049 - RNA, 19 nt, Human
caauucuugccaaauauaa

SEQ ID NO: 2237050 - RNA, 15 nt, Human
aaggguacacugccu

SEQ ID NO: 2237051 - RNA, 14 nt, Human
agaauucauucacu

SEQ ID NO: 2237052 - RNA, 21 nt, Human
gcugagucccaggcugagccu

SEQ ID NO: 2237053 - RNA, 21 nt, Human
guccccuauccuacuuccccu

SEQ ID NO: 2237054 - RNA, 21 nt, Human
ugagccagugucaggaggaag

SEQ ID NO: 2237055 - RNA, 14 nt, Human
cucauccugcaggc

SEQ ID NO: 2237056 - RNA, 21 nt, Human
aggcagcuuuuucucucccac

SEQ ID NO: 2237057 - RNA, 23 nt, Human
caacggggugaaacccugucucu

SEQ ID NO: 2237058 - RNA, 14 nt, Human
ugcuggagcucugc

SEQ ID NO: 2237059 - RNA, 18 nt, Human
agugucaaugcagccccc

SEQ ID NO: 2237060 - RNA, 11 nt, Human
ucaccugcccu

SEQ ID NO: 2237061 - RNA, 23 nt, Human
caucaacagauaaauaguuuaug

SEQ ID NO: 2237062 - RNA, 17 nt, Human
gaacucugagcagugcu

SEQ ID NO: 2237063 - RNA, 17 nt, Human
agagacagaaagcagaa

SEQ ID NO: 2237064 - RNA, 18 nt, Human
uguauuauuuuuuaaaaa

SEQ ID NO: 2237065 - RNA, 13 nt, Human
auuuuaaaagaau

SEQ ID NO: 2237066 - RNA, 16 nt, Human
aagcauuuagauguau

SEQ ID NO: 2237067 - RNA, 13 nt, Human
aagaaaauaacga

SEQ ID NO: 2237068 - RNA, 19 nt, Human
gguuuaauaauuuuuaauu

SEQ ID NO: 2237069 - RNA, 18 nt, Human
ggaaagacagcuucucau

SEQ ID NO: 2237070 - RNA, 16 nt, Human
ugcaugguuuagaaag

SEQ ID NO: 2237071 - RNA, 19 nt, Human
auuguaguccuguaaugga

SEQ ID NO: 2237072 - RNA, 16 nt, Human
cacuaguauuucuaug

SEQ ID NO: 2237073 - RNA, 21 nt, Human
gaaagcagggacuugaaccca

SEQ ID NO: 2237074 - RNA, 21 nt, Human
cccccucuggcuccagcuggc

SEQ ID NO: 2237075 - RNA, 22 nt, Human
ccgggaggcagagguugcagug

SEQ ID NO: 2237076 - RNA, 14 nt, Human
cucaacaaacauaa

SEQ ID NO: 2237077 - RNA, 15 nt, Human
aaagaaagaaaauca

SEQ ID NO: 2237078 - RNA, 17 nt, Human
aauaugcucuaaacaug

SEQ ID NO: 2237079 - RNA, 16 nt, Human
auuugaugcuacagga

SEQ ID NO: 2237080 - RNA, 14 nt, Human
guaacuaauuuuaa

SEQ ID NO: 2237081 - RNA, 15 nt, Human
ugccugcaggcauga

SEQ ID NO: 2237082 - RNA, 18 nt, Human
cagccucuuagaugcagu

SEQ ID NO: 2237083 - RNA, 16 nt, Human
cuggccuucggccucc

SEQ ID NO: 2237084 - RNA, 19 nt, Human
uccauccugaggcuccacu

SEQ ID NO: 2237085 - RNA, 17 nt, Human
gccccccagcccuccuu

SEQ ID NO: 2237086 - RNA, 20 nt, Human
ccagcuggccgggagccuga

SEQ ID NO: 2237087 - RNA, 17 nt, Human
gaggcauccuuccucac

SEQ ID NO: 2237088 - RNA, 13 nt, Human
ccucuggcuccag

SEQ ID NO: 2237089 - RNA, 14 nt, Human
auuuucuauaauuu

SEQ ID NO: 2237090 - RNA, 16 nt, Human
ucaucaaugaaugaau

SEQ ID NO: 2237091 - RNA, 22 nt, Human
uucaauaucuuuuuuuuaauaa

SEQ ID NO: 2237092 - RNA, 18 nt, Human
ucugaugagaacucugag

SEQ ID NO: 2237093 - RNA, 17 nt, Human
ggaaauauuuauuuuaa

SEQ ID NO: 2237094 - RNA, 18 nt, Human
uaaguuuuuuuuuaaaaa

SEQ ID NO: 2237095 - RNA, 17 nt, Human
aaaaauccuacuuucau

SEQ ID NO: 2237096 - RNA, 19 nt, Human
uccccuauccuacuucccc

SEQ ID NO: 2237097 - RNA, 18 nt, Human
cagaaagcagaacaguga

SEQ ID NO: 2237098 - RNA, 23 nt, Human
augaauuaaguuuuuuuuuaaaa

SEQ ID NO: 2237099 - RNA, 20 nt, Human
aaugaauacuuuauaaagga

SEQ ID NO: 2237100 - RNA, 22 nt, Human
gauaaaagacagugaaagaaaa

SEQ ID NO: 2237101 - RNA, 19 nt, Human
cucuguucugcacacagca

SEQ ID NO: 2237102 - RNA, 14 nt, Human
uuaugauuaaguaa

SEQ ID NO: 2237103 - RNA, 18 nt, Human
agcaaaauuuuuucucua

SEQ ID NO: 2237104 - RNA, 12 nt, Human
uguuugaaagcu

SEQ ID NO: 2237105 - RNA, 16 nt, Human
gacaaggaaaaaauaa

SEQ ID NO: 2237106 - RNA, 23 nt, Human
agcucugcccauccugccccuga

SEQ ID NO: 2237107 - RNA, 14 nt, Human
cuggaaaucagggu

SEQ ID NO: 2237108 - RNA, 15 nt, Human
aauaacgauaaaaga

SEQ ID NO: 2237109 - RNA, 19 nt, Human
gcauccuuccucacaccag

SEQ ID NO: 2237110 - RNA, 15 nt, Human
gacagggaggacgcu

SEQ ID NO: 2237111 - RNA, 13 nt, Human
uuaugcuaaguga

SEQ ID NO: 2237112 - RNA, 16 nt, Human
auccaaugaaaugagu

SEQ ID NO: 2237113 - RNA, 20 nt, Human
aaacuuuaugcuaagugaaa

SEQ ID NO: 2237114 - RNA, 22 nt, Human
gucucuacuaaaaauacaaaaa

SEQ ID NO: 2237115 - RNA, 16 nt, Human
aaaauaacaauaaaag

SEQ ID NO: 2237116 - RNA, 17 nt, Human
acaaaugcauuucuaaa

SEQ ID NO: 2237117 - RNA, 23 nt, Human
aauaauccucaguuuuugugaaa

SEQ ID NO: 2237118 - RNA, 13 nt, Human
aaauaaaaauaau

SEQ ID NO: 2237119 - RNA, 19 nt, Human
aaacaauaacgauaaaaga

SEQ ID NO: 2237120 - RNA, 11 nt, Human
caauaaaagac

SEQ ID NO: 2237121 - RNA, 14 nt, Human
aauauuuauuuuaa

SEQ ID NO: 2237122 - RNA, 19 nt, Human
cagagaugaggccgccaug

SEQ ID NO: 2237123 - RNA, 21 nt, Human
aggacagcccuucuuuccaca

SEQ ID NO: 2237124 - RNA, 19 nt, Human
ucaguccaugaagauguag

SEQ ID NO: 2237125 - RNA, 13 nt, Human
uuaaaaaagaaac

SEQ ID NO: 2237126 - RNA, 16 nt, Human
auuuuuagugaaauau

SEQ ID NO: 2237127 - RNA, 23 nt, Human
cagagguugcagugagccgagau

SEQ ID NO: 2237128 - RNA, 15 nt, Human
gagaugcuagaacuc

SEQ ID NO: 2237129 - RNA, 11 nt, Human
gagguaaaagc

SEQ ID NO: 2237130 - RNA, 15 nt, Human
uacaggauuugaaau

SEQ ID NO: 2237131 - RNA, 13 nt, Human
aucaggcuggcca

SEQ ID NO: 2237132 - RNA, 14 nt, Human
gcugauuaaaccaa

SEQ ID NO: 2237133 - RNA, 20 nt, Human
augucgucaaagcugaaaug

SEQ ID NO: 2237134 - RNA, 23 nt, Human
auuucugagcauuuaauauggau

SEQ ID NO: 2237135 - RNA, 12 nt, Human
aaaauaacaaua

SEQ ID NO: 2237136 - RNA, 23 nt, Human
uccaacuaucucauuuccaagca

SEQ ID NO: 2237137 - RNA, 18 nt, Human
agguccacaacacacaga

SEQ ID NO: 2237138 - RNA, 13 nt, Human
auccugaggcucc

SEQ ID NO: 2237139 - RNA, 21 nt, Human
cagagguccacaacacacaga

SEQ ID NO: 2237140 - RNA, 20 nt, Human
acagcuucucauccugcagg

SEQ ID NO: 2237141 - RNA, 14 nt, Human
gagcucagcccugg

SEQ ID NO: 2237142 - RNA, 17 nt, Human
auuauuuuuuaaaaaaa

SEQ ID NO: 2237143 - RNA, 23 nt, Human
aaagcccagcuugaaaccuucac

SEQ ID NO: 2237144 - RNA, 15 nt, Human
gcccacuagacccac

SEQ ID NO: 2237145 - RNA, 22 nt, Human
gcuaaaacaagcacuaaacaaa

SEQ ID NO: 2237146 - RNA, 21 nt, Human
auuauauggcuugaguuuaaa

SEQ ID NO: 2237147 - RNA, 22 nt, Human
agugagcagucaggaaagagaa

SEQ ID NO: 2237148 - RNA, 22 nt, Human
caccucccccaucucuucuggg

SEQ ID NO: 2237149 - RNA, 16 nt, Human
gagaaacuggaacucu

SEQ ID NO: 2237150 - RNA, 17 nt, Human
uccugccccugagccca

SEQ ID NO: 2237151 - RNA, 17 nt, Human
gaagcaccaaucaugaa

SEQ ID NO: 2237152 - RNA, 22 nt, Human
uucauucacucaacaaacauaa

SEQ ID NO: 2237153 - RNA, 16 nt, Human
ccugagcuugcagaga

SEQ ID NO: 2237154 - RNA, 22 nt, Human
aggauggcuaguaucaaaagaa

SEQ ID NO: 2237155 - RNA, 19 nt, Human
cagcuacuugggaggcuga

SEQ ID NO: 2237156 - RNA, 15 nt, Human
gaaaugaaagcaggg

SEQ ID NO: 2237157 - RNA, 22 nt, Human
aauugacccacaagaaaugaaa

SEQ ID NO: 2237158 - RNA, 17 nt, Human
uguaaaggaauuuaaaa

SEQ ID NO: 2237159 - RNA, 14 nt, Human
cagucucccucccu

SEQ ID NO: 2237160 - RNA, 22 nt, Human
ugauaguuguaccgcaauguga

SEQ ID NO: 2237161 - RNA, 22 nt, Human
uauuccuuuuucucuccucucc

SEQ ID NO: 2237162 - RNA, 23 nt, Human
gaaugagagacacacugaagaag

SEQ ID NO: 2237163 - RNA, 18 nt, Human
uuuauguuuaauucugaa

SEQ ID NO: 2237164 - RNA, 20 nt, Human
caagccuccuuuuaaaguaa

SEQ ID NO: 2237165 - RNA, 14 nt, Human
ccugggcugaggca

SEQ ID NO: 2237166 - RNA, 16 nt, Human
aaaauccauacauuug

SEQ ID NO: 2237167 - RNA, 20 nt, Human
auaacaaugcuguauuuuaa

SEQ ID NO: 2237168 - RNA, 16 nt, Human
uucucuaggaaauauu

SEQ ID NO: 2237169 - RNA, 13 nt, Human
uacagagacagaa

SEQ ID NO: 2237170 - RNA, 20 nt, Human
gcuugcagagaugaggccgc

SEQ ID NO: 2237171 - RNA, 18 nt, Human
uauuuucaguuauuauau

SEQ ID NO: 2237172 - RNA, 18 nt, Human
cagggaggacgcucucug

SEQ ID NO: 2237173 - RNA, 16 nt, Human
uuaaauuguaauaggc

SEQ ID NO: 2237174 - RNA, 13 nt, Human
acggggugaaacc

SEQ ID NO: 2237175 - RNA, 22 nt, Human
agacccacuggacucaccuccc

SEQ ID NO: 2237176 - RNA, 22 nt, Human
acaugagguacugagagugaac

SEQ ID NO: 2237177 - RNA, 17 nt, Human
aguugauaaguacauga

SEQ ID NO: 2237178 - RNA, 21 nt, Human
aaacaauaacgauaaaagaca

SEQ ID NO: 2237179 - RNA, 20 nt, Human
uuuaaauaaaguguuugaaa

SEQ ID NO: 2237180 - RNA, 18 nt, Human
gacccacuggacucaccu

SEQ ID NO: 2237181 - RNA, 14 nt, Human
agacaucaacagau

SEQ ID NO: 2237182 - RNA, 20 nt, Human
cuggccuucggccuccaucc

SEQ ID NO: 2237183 - RNA, 16 nt, Human
aagaaaauaacaauaa

SEQ ID NO: 2237184 - RNA, 22 nt, Human
aguauguuagugcaaauuguca

SEQ ID NO: 2237185 - RNA, 23 nt, Human
aucucuucuggguuccuuccucu

SEQ ID NO: 2237186 - RNA, 22 nt, Human
accccugagcuugcagagauga

SEQ ID NO: 2237187 - RNA, 19 nt, Human
aaauaugccccauucaaca

SEQ ID NO: 2237188 - RNA, 14 nt, Human
augggccauaugaa

SEQ ID NO: 2237189 - RNA, 15 nt, Human
cauuccaagccucau

SEQ ID NO: 2237190 - RNA, 18 nt, Human
gccuuggggcugaugcag

SEQ ID NO: 2237191 - RNA, 18 nt, Human
agauccccaagccuggca

SEQ ID NO: 2237192 - RNA, 19 nt, Human
accauuuuggcaagcucua

SEQ ID NO: 2237193 - RNA, 15 nt, Human
aaauauuuauuuuaa

SEQ ID NO: 2237194 - RNA, 16 nt, Human
agguugcagugagccg

SEQ ID NO: 2237195 - RNA, 20 nt, Human
cacuagacccacuggacuca

SEQ ID NO: 2237196 - RNA, 20 nt, Human
caaauguucaucaaugaaug

SEQ ID NO: 2237197 - RNA, 18 nt, Human
auagcuacuaauuuuaaa

SEQ ID NO: 2237198 - RNA, 13 nt, Human
aacaauaaaagac

SEQ ID NO: 2237199 - RNA, 15 nt, Human
gcaacccaaauguuc

SEQ ID NO: 2237200 - RNA, 20 nt, Human
acuccagugagacagcucug

SEQ ID NO: 2237201 - RNA, 22 nt, Human
agaagcaccaaucaugaauuag

SEQ ID NO: 2237202 - RNA, 16 nt, Human
cuugccugcaggcaug

SEQ ID NO: 2237203 - RNA, 21 nt, Human
cuaccaaaaaucucaauauuu

SEQ ID NO: 2237204 - RNA, 11 nt, Human
auaauuuaaau

SEQ ID NO: 2237205 - RNA, 18 nt, Human
cugagucccaggcugagc

SEQ ID NO: 2237206 - RNA, 20 nt, Human
cccugccccccagcccuccu

SEQ ID NO: 2237207 - RNA, 18 nt, Human
acuuuaugcuaagugaaa

SEQ ID NO: 2237208 - RNA, 13 nt, Human
ccaaaagguauuu

SEQ ID NO: 2237209 - RNA, 23 nt, Human
ugaaaugaguuuuucuuuucauu

SEQ ID NO: 2237210 - RNA, 19 nt, Human
ucaguuauuauauuuacaa

SEQ ID NO: 2237211 - RNA, 15 nt, Human
guucugcagauaaac

SEQ ID NO: 2237212 - RNA, 20 nt, Human
caggcugagccucagucucc

SEQ ID NO: 2237213 - RNA, 16 nt, Human
aauuuuuaauuauaug

SEQ ID NO: 2237214 - RNA, 18 nt, Human
agagaaugagagacacac

SEQ ID NO: 2237215 - RNA, 23 nt, Human
gauauuaaccaggggccaugaau

SEQ ID NO: 2237216 - RNA, 16 nt, Human
aaaguguuugaaagcu

SEQ ID NO: 2237217 - RNA, 12 nt, Human
aagagcuuaaca

SEQ ID NO: 2237218 - RNA, 19 nt, Human
auccuacaagacacaguga

SEQ ID NO: 2237219 - RNA, 11 nt, Human
caacucccugc

SEQ ID NO: 2237220 - RNA, 14 nt, Human
uaaauaaaaauaau

SEQ ID NO: 2237221 - RNA, 21 nt, Human
cccuauccuacuuccccuucc

SEQ ID NO: 2237222 - RNA, 18 nt, Human
auccuucagccugaaaga

SEQ ID NO: 2237223 - RNA, 20 nt, Human
cuacuuccccuuccuaauuc

SEQ ID NO: 2237224 - RNA, 18 nt, Human
cugagggcauagaaguaa

SEQ ID NO: 2237225 - RNA, 16 nt, Human
cucauccugcaggcag

SEQ ID NO: 2237226 - RNA, 20 nt, Human
caaacauccuacaagacaca

SEQ ID NO: 2237227 - RNA, 18 nt, Human
uguacuuuauuuucuaua

SEQ ID NO: 2237228 - RNA, 17 nt, Human
cuccuuaucaaaggaca

SEQ ID NO: 2237229 - RNA, 17 nt, Human
aggcaugagucagucug

SEQ ID NO: 2237230 - RNA, 16 nt, Human
aucaauuuaaaaaaaa

SEQ ID NO: 2237231 - RNA, 19 nt, Human
gaaaauaacgauaaaagac

SEQ ID NO: 2237232 - RNA, 20 nt, Human
aggcugagaugggagaauca

SEQ ID NO: 2237233 - RNA, 22 nt, Human
caaggaugccccgucccccucu

SEQ ID NO: 2237234 - RNA, 14 nt, Human
acccaaaaggcaga

SEQ ID NO: 2237235 - RNA, 16 nt, Human
ucuugagguaaaagca

SEQ ID NO: 2237236 - RNA, 22 nt, Human
aaaaaaccugagccccaaaagg

SEQ ID NO: 2237237 - RNA, 19 nt, Human
aaaaucuuauaauuuaaaa

SEQ ID NO: 2237238 - RNA, 20 nt, Human
ugaggcuccacuuggucugu

SEQ ID NO: 2237239 - RNA, 18 nt, Human
gccuucggccuccauccu

SEQ ID NO: 2237240 - RNA, 15 nt, Human
cuguaaaauaauaac

SEQ ID NO: 2237241 - RNA, 19 nt, Human
auuucuucaacucccugcc

SEQ ID NO: 2237242 - RNA, 14 nt, Human
agaugcuagaacuc

SEQ ID NO: 2237243 - RNA, 14 nt, Human
ccaugggacaggga

SEQ ID NO: 2237244 - RNA, 15 nt, Human
agagacagaaagcag

SEQ ID NO: 2237245 - RNA, 20 nt, Human
aaggagccaaacauccuaca

SEQ ID NO: 2237246 - RNA, 21 nt, Human
gaaauguuuacagauccccaa

SEQ ID NO: 2237247 - RNA, 18 nt, Human
cccacuagacccacugga

SEQ ID NO: 2237248 - RNA, 21 nt, Human
ugcccauccugccccugagcc

SEQ ID NO: 2237249 - RNA, 18 nt, Human
gcccuggugggcagagag

SEQ ID NO: 2237250 - RNA, 21 nt, Human
uguauaaaauaauuuuuauau

SEQ ID NO: 2237251 - RNA, 17 nt, Human
uuccaagugauugaaac

SEQ ID NO: 2237252 - RNA, 22 nt, Human
aauaauccuaaacauaugaauu

SEQ ID NO: 2237253 - RNA, 21 nt, Human
auucagagcuuacuuaaaauu

SEQ ID NO: 2237254 - RNA, 15 nt, Human
auuucauucaauauc

SEQ ID NO: 2237255 - RNA, 13 nt, Human
acacuuaaaaaug

SEQ ID NO: 2237256 - RNA, 18 nt, Human
ugagcucagcccuggugg

SEQ ID NO: 2237257 - RNA, 22 nt, Human
acauccuacaagacacagugac

SEQ ID NO: 2237258 - RNA, 17 nt, Human
guauuauuuuuuaaaaa

SEQ ID NO: 2237259 - RNA, 17 nt, Human
uggugaaaugcagaguc

SEQ ID NO: 2237260 - RNA, 14 nt, Human
acgagaaaacaaua

SEQ ID NO: 2237261 - RNA, 15 nt, Human
uuuaauaauuuuuaa

SEQ ID NO: 2237262 - RNA, 23 nt, Human
gggaaacaaaaggauaaugaaua

SEQ ID NO: 2237263 - RNA, 20 nt, Human
aaauccuugaagauuuacca

SEQ ID NO: 2237264 - RNA, 22 nt, Human
aauaugccccauucaacaucua

SEQ ID NO: 2237265 - RNA, 18 nt, Human
acaaauccaaugaaauga

SEQ ID NO: 2237266 - RNA, 16 nt, Human
auaucaauuuaaaaaa

SEQ ID NO: 2237267 - RNA, 16 nt, Human
aaauauaaauaaaaau

SEQ ID NO: 2237268 - RNA, 17 nt, Human
ucgggauuaguacacac

SEQ ID NO: 2237269 - RNA, 15 nt, Human
auauugacuuuuuau

SEQ ID NO: 2237270 - RNA, 19 nt, Human
cuucuggguuccuuccucu

SEQ ID NO: 2237271 - RNA, 16 nt, Human
agugagacagcucugc

SEQ ID NO: 2237272 - RNA, 13 nt, Human
gaaccuaggguga

SEQ ID NO: 2237273 - RNA, 16 nt, Human
auacauguuacaacac

SEQ ID NO: 2237274 - RNA, 16 nt, Human
ucccugccccccagcc

SEQ ID NO: 2237275 - RNA, 12 nt, Human
gguauuuuaauc

SEQ ID NO: 2237276 - RNA, 17 nt, Human
gacagugaaagaaaaua

SEQ ID NO: 2237277 - RNA, 21 nt, Human
cacuugaacccgggaggcaga

SEQ ID NO: 2237278 - RNA, 21 nt, Human
aggcaugagucagucugauga

SEQ ID NO: 2237279 - RNA, 17 nt, Human
uccuacaagacacagug

SEQ ID NO: 2237280 - RNA, 14 nt, Human
uaacuaauuuuaac

SEQ ID NO: 2237281 - RNA, 18 nt, Human
aguucuccacuagcuaug

SEQ ID NO: 2237282 - RNA, 23 nt, Human
gggccuaugcagagguccacaac

SEQ ID NO: 2237283 - RNA, 18 nt, Human
cagcuuauugucuaguga

SEQ ID NO: 2237284 - RNA, 13 nt, Human
cacaacuauauug

SEQ ID NO: 2237285 - RNA, 22 nt, Human
ugagacucugucucaguccaug

SEQ ID NO: 2237286 - RNA, 19 nt, Human
uacaaaaaaaaaaaaaaau

SEQ ID NO: 2237287 - RNA, 23 nt, Human
uaacgauaaaagacagugaaaga

SEQ ID NO: 2237288 - RNA, 16 nt, Human
auuuguauaaaauaau

SEQ ID NO: 2237289 - RNA, 14 nt, Human
aagcaacccaaaug

SEQ ID NO: 2237290 - RNA, 14 nt, Human
uuuguauaaaauaa

SEQ ID NO: 2237291 - RNA, 18 nt, Human
acauguuacaacacggac

SEQ ID NO: 2237292 - RNA, 13 nt, Human
aacacaacuauau

SEQ ID NO: 2237293 - RNA, 16 nt, Human
agcuugaaaccuucac

SEQ ID NO: 2237294 - RNA, 14 nt, Human
uaugaauuacauuu

SEQ ID NO: 2237295 - RNA, 20 nt, Human
acggacgaaccuugaaaacu

SEQ ID NO: 2237296 - RNA, 23 nt, Human
gucucccucccuuggggccuaug

SEQ ID NO: 2237297 - RNA, 17 nt, Human
cagacaucaacagauaa

SEQ ID NO: 2237298 - RNA, 15 nt, Human
cuucaacucccugcc

SEQ ID NO: 2237299 - RNA, 16 nt, Human
auuccaccuacaugag

SEQ ID NO: 2237300 - RNA, 15 nt, Human
gugaacuugguuuua

SEQ ID NO: 2237301 - RNA, 21 nt, Human
aacuuguaaaggaauuuaaaa

SEQ ID NO: 2237302 - RNA, 23 nt, Human
auugcagaguacuggcugaugga

SEQ ID NO: 2237303 - RNA, 18 nt, Human
auuugcuggagcucugcc

SEQ ID NO: 2237304 - RNA, 14 nt, Human
uauguauauuuuau

SEQ ID NO: 2237305 - RNA, 22 nt, Human
cucugagccuugggaccccuga

SEQ ID NO: 2237306 - RNA, 16 nt, Human
aaauaguuuaugauuc

SEQ ID NO: 2237307 - RNA, 13 nt, Human
cacaccaggcuug

SEQ ID NO: 2237308 - RNA, 15 nt, Human
gccuugggaccccug

SEQ ID NO: 2237309 - RNA, 19 nt, Human
cuugccugcaggcaugagu

SEQ ID NO: 2237310 - RNA, 19 nt, Human
caucaaggguacacugccu

SEQ ID NO: 2237311 - RNA, 15 nt, Human
cgggagccugaucac

SEQ ID NO: 2237312 - RNA, 14 nt, Human
aauuguauuacaaa

SEQ ID NO: 2237313 - RNA, 15 nt, Human
gccccauucaacauc

SEQ ID NO: 2237314 - RNA, 22 nt, Human
cacagauuugagcucagcccug

SEQ ID NO: 2237315 - RNA, 20 nt, Human
cuugccauaauuacuauguc

SEQ ID NO: 2237316 - RNA, 23 nt, Human
aauauuuauuuuaauaauguuuc

SEQ ID NO: 2237317 - RNA, 16 nt, Human
uccugcaauuccacuu

SEQ ID NO: 2237318 - RNA, 15 nt, Human
ugccccgucccccuc

SEQ ID NO: 2237319 - RNA, 22 nt, Human
ggcagcuuuccucaaaacuuca

SEQ ID NO: 2237320 - RNA, 17 nt, Human
ugaaaaucuuauaauuu

SEQ ID NO: 2237321 - RNA, 19 nt, Human
cccacuggacucaccuccc

SEQ ID NO: 2237322 - RNA, 16 nt, Human
ccuccuuaucaaagga

SEQ ID NO: 2237323 - RNA, 18 nt, Human
ccuugggaccccugagcu

SEQ ID NO: 2237324 - RNA, 15 nt, Human
acgagauacagaauu

SEQ ID NO: 2237325 - RNA, 19 nt, Human
guacaagagcuuaacagug

SEQ ID NO: 2237326 - RNA, 22 nt, Human
caugaguaacugauuuguaaca

SEQ ID NO: 2237327 - RNA, 12 nt, Human
aaaagaaagaaa

SEQ ID NO: 2237328 - RNA, 17 nt, Human
uccagcuggccgggagc

SEQ ID NO: 2237329 - RNA, 20 nt, Human
ucauucacucaacaaacaua

SEQ ID NO: 2237330 - RNA, 20 nt, Human
guucugcagauaaacaguag

SEQ ID NO: 2237331 - RNA, 22 nt, Human
agcccuccuuaucaaaggacac

SEQ ID NO: 2237332 - RNA, 17 nt, Human
cuaucucauuuccaagc

SEQ ID NO: 2237333 - RNA, 19 nt, Human
agucaaugaacuuuccaca

SEQ ID NO: 2237334 - RNA, 14 nt, Human
uugugauugauuau

SEQ ID NO: 2237335 - RNA, 17 nt, Human
ucauacuucuuaggguu

SEQ ID NO: 2237336 - RNA, 12 nt, Human
aagaaaauaaca

SEQ ID NO: 2237337 - RNA, 14 nt, Human
cuggccgggagccu

SEQ ID NO: 2237338 - RNA, 19 nt, Human
gaggcagagguugcaguga

SEQ ID NO: 2237339 - RNA, 17 nt, Human
ucuauaauuuaaauaua

SEQ ID NO: 2237340 - RNA, 22 nt, Human
uguauacugugugcuaaaacaa

SEQ ID NO: 2237341 - RNA, 15 nt, Human
cagucucccucccuu

SEQ ID NO: 2237342 - RNA, 21 nt, Human
augucauuugcuggagcucug

SEQ ID NO: 2237343 - RNA, 19 nt, Human
aauguuuacagauccccaa

SEQ ID NO: 2237344 - RNA, 20 nt, Human
cugcacuccagccugagcga

SEQ ID NO: 2237345 - RNA, 15 nt, Human
ccaaggagccaaaca

SEQ ID NO: 2237346 - RNA, 23 nt, Human
caccaaggagccaaacauccuac

SEQ ID NO: 2237347 - RNA, 11 nt, Human
cuguuuuauaa

SEQ ID NO: 2237348 - RNA, 20 nt, Human
auuuugugauugauuauaug

SEQ ID NO: 2237349 - RNA, 21 nt, Human
uaguauuucuaugaaauauua

SEQ ID NO: 2237350 - RNA, 15 nt, Human
cuaagugcagccccg

SEQ ID NO: 2237351 - RNA, 15 nt, Human
uaacgauaaaagaca

SEQ ID NO: 2237352 - RNA, 18 nt, Human
cagucucccucccuuggg

SEQ ID NO: 2237353 - RNA, 14 nt, Human
auugucuagugaaa

SEQ ID NO: 2237354 - RNA, 14 nt, Human
agaguacuggcuga

SEQ ID NO: 2237355 - RNA, 21 nt, Human
uuuucaggcuagauguaugua

SEQ ID NO: 2237356 - RNA, 15 nt, Human
guuuuucuuuucauu

SEQ ID NO: 2237357 - RNA, 17 nt, Human
aauaacgauaaaagaca

SEQ ID NO: 2237358 - RNA, 14 nt, Human
ucuuuuuuuuaaua

SEQ ID NO: 2237359 - RNA, 15 nt, Human
accaaggcugauuaa

SEQ ID NO: 2237360 - RNA, 14 nt, Human
uaauccuaaacaua

SEQ ID NO: 2237361 - RNA, 18 nt, Human
auuuuaacucuauaaugu

SEQ ID NO: 2237362 - RNA, 14 nt, Human
caguucugaagaag

SEQ ID NO: 2237363 - RNA, 13 nt, Human
agcgacagugaga

SEQ ID NO: 2237364 - RNA, 16 nt, Human
uaaaauccauacauuu

SEQ ID NO: 2237365 - RNA, 16 nt, Human
ucuucaacucccugcc

SEQ ID NO: 2237366 - RNA, 13 nt, Human
ugaaagaaaauaa

SEQ ID NO: 2237367 - RNA, 14 nt, Human
ccuugaugaagaag

SEQ ID NO: 2237368 - RNA, 23 nt, Human
ggaugguucccuugaugaagaag

SEQ ID NO: 2237369 - RNA, 23 nt, Human
aguacucauacauguuacaacac

SEQ ID NO: 2237370 - RNA, 17 nt, Human
gaacuuuccacauucag

SEQ ID NO: 2237371 - RNA, 22 nt, Human
ugguuguauuauuuuuuaaaaa

SEQ ID NO: 2237372 - RNA, 13 nt, Human
acaagaaaugaaa

SEQ ID NO: 2237373 - RNA, 17 nt, Human
acucaccucccccaucu

SEQ ID NO: 2237374 - RNA, 21 nt, Human
aggguuaugauuaaguaauga

SEQ ID NO: 2237375 - RNA, 15 nt, Human
ccgucccccucuggc

SEQ ID NO: 2237376 - RNA, 18 nt, Human
caguuguugcccacagcu

SEQ ID NO: 2237377 - RNA, 20 nt, Human
accucugccucagaaaacaa

SEQ ID NO: 2237378 - RNA, 20 nt, Human
uaagugaaauaagccagaca

SEQ ID NO: 2237379 - RNA, 16 nt, Human
cauuucuaaagccauu

SEQ ID NO: 2237380 - RNA, 22 nt, Human
ggacaguaaaauccacagacca

SEQ ID NO: 2237381 - RNA, 18 nt, Human
cagagacagaaagcagaa

SEQ ID NO: 2237382 - RNA, 16 nt, Human
cuuuaugcuaagugaa

SEQ ID NO: 2237383 - RNA, 21 nt, Human
gacagcuucucauccugcagg

SEQ ID NO: 2237384 - RNA, 11 nt, Human
ggguuucucca

SEQ ID NO: 2237385 - RNA, 22 nt, Human
cucagcccuggugggcagagag

SEQ ID NO: 2237386 - RNA, 15 nt, Human
ggcaauagucaaauu

SEQ ID NO: 2237387 - RNA, 14 nt, Human
agcucuaucaccaa

SEQ ID NO: 2237388 - RNA, 16 nt, Human
cagauccccaagccug

SEQ ID NO: 2237389 - RNA, 17 nt, Human
ucuauaauguguucauu

SEQ ID NO: 2237390 - RNA, 21 nt, Human
augaauacuuuauaaaggauu

SEQ ID NO: 2237391 - RNA, 14 nt, Human
auuuaaauauaugc

SEQ ID NO: 2237392 - RNA, 13 nt, Human
aagacaaggaaaa

SEQ ID NO: 2237393 - RNA, 21 nt, Human
ucuuaggguuaugauuaagua

SEQ ID NO: 2237394 - RNA, 17 nt, Human
gcuucucauccugcagg

SEQ ID NO: 2237395 - RNA, 17 nt, Human
ccuacuuccccuuccua

SEQ ID NO: 2237396 - RNA, 12 nt, Human
gguuuauauaag

SEQ ID NO: 2237397 - RNA, 19 nt, Human
acaauaacgauaaaagaca

SEQ ID NO: 2237398 - RNA, 16 nt, Human
cuucggccuccauccu

SEQ ID NO: 2237399 - RNA, 19 nt, Human
aagcuuguauuccuuuuuc

SEQ ID NO: 2237400 - RNA, 17 nt, Human
augauuaaguaaugaua

SEQ ID NO: 2237401 - RNA, 22 nt, Human
cacuaguauuucuaugaaauau

SEQ ID NO: 2237402 - RNA, 15 nt, Human
uuacagagacagaaa

SEQ ID NO: 2237403 - RNA, 23 nt, Human
aacuuguaaaggaauuuaaaaau

SEQ ID NO: 2237404 - RNA, 15 nt, Human
gcuguauuuuaaaag

SEQ ID NO: 2237405 - RNA, 17 nt, Human
ccaaaagguauuuuaau

SEQ ID NO: 2237406 - RNA, 19 nt, Human
agcucugcccauccugccc

SEQ ID NO: 2237407 - RNA, 19 nt, Human
cccccucuggcuccagcug

SEQ ID NO: 2237408 - RNA, 20 nt, Human
uuugcaagccagauuuuccu

SEQ ID NO: 2237409 - RNA, 22 nt, Human
augguuguauuauuuuuuaaaa

SEQ ID NO: 2237410 - RNA, 13 nt, Human
ccucccccaucuc

SEQ ID NO: 2237411 - RNA, 14 nt, Human
agcucguggaacag

SEQ ID NO: 2237412 - RNA, 17 nt, Human
cugaucaccugcccugc

SEQ ID NO: 2237413 - RNA, 18 nt, Human
acaaaugcauuucuaaag

SEQ ID NO: 2237414 - RNA, 14 nt, Human
ggcuccagcuggcc

SEQ ID NO: 2237415 - RNA, 15 nt, Human
aaugauuaugaauua

SEQ ID NO: 2237416 - RNA, 17 nt, Human
gaaaaucaggcuggcca

SEQ ID NO: 2237417 - RNA, 14 nt, Human
uauuuauuuuaaua

SEQ ID NO: 2237418 - RNA, 14 nt, Human
aauauuauguuaaa

SEQ ID NO: 2237419 - RNA, 16 nt, Human
uauaugucacuuugcu

SEQ ID NO: 2237420 - RNA, 21 nt, Human
auccccaagccuggcaaggga

SEQ ID NO: 2237421 - RNA, 12 nt, Human
ucuuaagaagac

SEQ ID NO: 2237422 - RNA, 21 nt, Human
aaaugucuugcuugauuguau

SEQ ID NO: 2237423 - RNA, 22 nt, Human
gacucaccucccccaucucuuc

SEQ ID NO: 2237424 - RNA, 19 nt, Human
agucaaauugugugaaagg

SEQ ID NO: 2237425 - RNA, 20 nt, Human
cugauauuggacaguaaaau

SEQ ID NO: 2237426 - RNA, 20 nt, Human
gccgggcgugguggugagug

SEQ ID NO: 2237427 - RNA, 12 nt, Human
uugccugcaggc

SEQ ID NO: 2237428 - RNA, 22 nt, Human
aaacauguuuaucguauuugau

SEQ ID NO: 2237429 - RNA, 15 nt, Human
ccugcaaagcccagc

SEQ ID NO: 2237430 - RNA, 19 nt, Human
ggaauuucuucaacucccu

SEQ ID NO: 2237431 - RNA, 20 nt, Human
uguaaaggaauuuaaaaauc

SEQ ID NO: 2237432 - RNA, 17 nt, Human
acaaaugggaaacaaaa

SEQ ID NO: 2237433 - RNA, 16 nt, Human
cugcacuccagccuga

SEQ ID NO: 2237434 - RNA, 13 nt, Human
ucauccugcaggc

SEQ ID NO: 2237435 - RNA, 16 nt, Human
agagggaauugcagag

SEQ ID NO: 2237436 - RNA, 18 nt, Human
gaaaauaucacuugucaa

SEQ ID NO: 2237437 - RNA, 14 nt, Human
auuuguauaaaaua

SEQ ID NO: 2237438 - RNA, 15 nt, Human
aagccuggcaaggga

SEQ ID NO: 2237439 - RNA, 18 nt, Human
uauagcuacuaauuuuaa

SEQ ID NO: 2237440 - RNA, 14 nt, Human
gaaaacaauaacga

SEQ ID NO: 2237441 - RNA, 16 nt, Human
accaggcuugccugca

SEQ ID NO: 2237442 - RNA, 17 nt, Human
cacuagacaaguccagc

SEQ ID NO: 2237443 - RNA, 16 nt, Human
aagacugcacaucaaa

SEQ ID NO: 2237444 - RNA, 13 nt, Human
gagacagcucugc

SEQ ID NO: 2237445 - RNA, 18 nt, Human
uuuugugaagcaaaauuu

SEQ ID NO: 2237446 - RNA, 19 nt, Human
cuggacucaccucccccau

SEQ ID NO: 2237447 - RNA, 19 nt, Human
agacucgggauuaguacac

SEQ ID NO: 2237448 - RNA, 18 nt, Human
ccugccuaagugcagccc

SEQ ID NO: 2237449 - RNA, 15 nt, Human
uagauaggccauggg

SEQ ID NO: 2237450 - RNA, 21 nt, Human
caccagucugacuguuuccau

SEQ ID NO: 2237451 - RNA, 18 nt, Human
gaaaauaacaauaaaaga

SEQ ID NO: 2237452 - RNA, 16 nt, Human
cugagcauuuaauaug

SEQ ID NO: 2237453 - RNA, 16 nt, Human
ccucaaaacuucagac

SEQ ID NO: 2237454 - RNA, 19 nt, Human
auucccagccagcacagcc

SEQ ID NO: 2237455 - RNA, 14 nt, Human
acagaauuuuaugc

SEQ ID NO: 2237456 - RNA, 17 nt, Human
cccacuggacucaccuc

SEQ ID NO: 2237457 - RNA, 18 nt, Human
cccaggcugagccucagu

SEQ ID NO: 2237458 - RNA, 13 nt, Human
agagguccacaac

SEQ ID NO: 2237459 - RNA, 21 nt, Human
uccuacaagacacagugacca

SEQ ID NO: 2237460 - RNA, 18 nt, Human
cuccauuuuuagugaaau

SEQ ID NO: 2237461 - RNA, 22 nt, Human
uauuucuaugaaauauuauguu

SEQ ID NO: 2237462 - RNA, 15 nt, Human
aauugacccacaaga

SEQ ID NO: 2237463 - RNA, 21 nt, Human
cugauauuggacaguaaaauc

SEQ ID NO: 2237464 - RNA, 15 nt, Human
gauuccugagccagu

SEQ ID NO: 2237465 - RNA, 18 nt, Human
auccccaagccuggcaag

SEQ ID NO: 2237466 - RNA, 19 nt, Human
uaguuuaugauuccaccua

SEQ ID NO: 2237467 - RNA, 23 nt, Human
cucagcccuggugggcagagagg

SEQ ID NO: 2237468 - RNA, 18 nt, Human
ggaggacgcucucuggcc

SEQ ID NO: 2237469 - RNA, 18 nt, Human
gcuccauuuuuagugaaa

SEQ ID NO: 2237470 - RNA, 15 nt, Human
gccuaagugcagccc

SEQ ID NO: 2237471 - RNA, 23 nt, Human
gcuuuggucuaucuuugagcgcc

SEQ ID NO: 2237472 - RNA, 13 nt, Human
ccaaggaugcccc

SEQ ID NO: 2237473 - RNA, 22 nt, Human
uuuauagcuacuaauuuuaaaa

SEQ ID NO: 2237474 - RNA, 18 nt, Human
ugggcacaggguuuaugu

SEQ ID NO: 2237475 - RNA, 20 nt, Human
ucuucuggguuccuuccucu

SEQ ID NO: 2237476 - RNA, 20 nt, Human
gaaacauuugguaaggggaa

SEQ ID NO: 2237477 - RNA, 22 nt, Human
cucccacuagacaaguccagcc

SEQ ID NO: 2237478 - RNA, 15 nt, Human
acaaaugggaaacaa

SEQ ID NO: 2237479 - RNA, 14 nt, Human
cugucucaguccau

SEQ ID NO: 2237480 - RNA, 16 nt, Human
augaauacuuuauaaa

SEQ ID NO: 2237481 - RNA, 22 nt, Human
cugagcagugcuugaaugaagu

SEQ ID NO: 2237482 - RNA, 19 nt, Human
ccccucuggcuccagcugg

SEQ ID NO: 2237483 - RNA, 22 nt, Human
ccauacuaauuauacccccugc

SEQ ID NO: 2237484 - RNA, 13 nt, Human
agccucagucucc

SEQ ID NO: 2237485 - RNA, 17 nt, Human
auaucaauuuaaaaaaa

SEQ ID NO: 2237486 - RNA, 21 nt, Human
ccugaucaccugcccugcuga

SEQ ID NO: 2237487 - RNA, 13 nt, Human
ugggaggcugaga

SEQ ID NO: 2237488 - RNA, 23 nt, Human
uccaaacugacucuuaagaagac

SEQ ID NO: 2237489 - RNA, 20 nt, Human
ggagccugaucaccugcccu

SEQ ID NO: 2237490 - RNA, 12 nt, Human
ccuucagccuga

SEQ ID NO: 2237491 - RNA, 13 nt, Human
cacacugaagaag

SEQ ID NO: 2237492 - RNA, 16 nt, Human
cuccauccugaggcuc

SEQ ID NO: 2237493 - RNA, 18 nt, Human
acugccuucucaacucca

SEQ ID NO: 2237494 - RNA, 17 nt, Human
uccucugagccuuggga

SEQ ID NO: 2237495 - RNA, 17 nt, Human
ccuauccuacuuccccu

SEQ ID NO: 2237496 - RNA, 18 nt, Human
acaagccuccuuuuaaag

SEQ ID NO: 2237497 - RNA, 15 nt, Human
ccuugccaugugcua

SEQ ID NO: 2237498 - RNA, 19 nt, Human
guacugagagugaacaaau

SEQ ID NO: 2237499 - RNA, 15 nt, Human
uuuagugaaauauua

SEQ ID NO: 2237500 - RNA, 14 nt, Human
cacaacacacagau

SEQ ID NO: 2237501 - RNA, 16 nt, Human
uacauuuguauaaaau

SEQ ID NO: 2237502 - RNA, 15 nt, Human
gaaaacaaggaugaa

SEQ ID NO: 2237503 - RNA, 18 nt, Human
ccacauucagagcuuacu

SEQ ID NO: 2237504 - RNA, 18 nt, Human
uaauaauguuucaaacau

SEQ ID NO: 2237505 - RNA, 17 nt, Human
uaacugauuuguaacaa

SEQ ID NO: 2237506 - RNA, 17 nt, Human
cccacuagacccacugg

SEQ ID NO: 2237507 - RNA, 12 nt, Human
ucuacacuccag

SEQ ID NO: 2237508 - RNA, 14 nt, Human
auuuauguuuaauu

SEQ ID NO: 2237509 - RNA, 17 nt, Human
aacaguuaccucugccu

SEQ ID NO: 2237510 - RNA, 21 nt, Human
acagugaaagaaaauaacaau

SEQ ID NO: 2237511 - RNA, 23 nt, Human
ugucaauucuugccaaauauaaa

SEQ ID NO: 2237512 - RNA, 15 nt, Human
aaggaaaaaauaaca

SEQ ID NO: 2237513 - RNA, 21 nt, Human
aaagcugaaauggacuuuugu

SEQ ID NO: 2237514 - RNA, 18 nt, Human
ccuucggccuccauccug

SEQ ID NO: 2237515 - RNA, 20 nt, Human
aagacagugaaagaaaauaa

SEQ ID NO: 2237516 - RNA, 14 nt, Human
acuuggucugugag

SEQ ID NO: 2237517 - RNA, 19 nt, Human
ccauccugccccugagccc

SEQ ID NO: 2237518 - RNA, 15 nt, Human
uugacacuuaaaaau

SEQ ID NO: 2237519 - RNA, 14 nt, Human
cuggagcucugccc

SEQ ID NO: 2237520 - RNA, 23 nt, Human
acguaaucguguccccuauccua

SEQ ID NO: 2237521 - RNA, 15 nt, Human
cauccugcaggcagc

SEQ ID NO: 2237522 - RNA, 16 nt, Human
cuucacuguaaaauaa

SEQ ID NO: 2237523 - RNA, 16 nt, Human
caauaacgauaaaaga

SEQ ID NO: 2237524 - RNA, 21 nt, Human
aggcucuuuugggauuuuuga

SEQ ID NO: 2237525 - RNA, 15 nt, Human
auuugguaaggggaa

SEQ ID NO: 2237526 - RNA, 21 nt, Human
caagacugcacaucaaaauau

SEQ ID NO: 2237527 - RNA, 22 nt, Human
guguccccuauccuacuucccc

SEQ ID NO: 2237528 - RNA, 15 nt, Human
gcacagccucuuaga

SEQ ID NO: 2237529 - RNA, 12 nt, Human
caugggaaguga

SEQ ID NO: 2237530 - RNA, 22 nt, Human
caagcacuaaacaaagagugaa

SEQ ID NO: 2237531 - RNA, 19 nt, Human
uuggcaagcucuaucacca

SEQ ID NO: 2237532 - RNA, 18 nt, Human
uauuuucuauaauuuaaa

SEQ ID NO: 2237533 - RNA, 21 nt, Human
aagacucgggauuaguacaca

SEQ ID NO: 2237534 - RNA, 13 nt, Human
ucacuguaaaaua

SEQ ID NO: 2237535 - RNA, 15 nt, Human
cagaauucauucacu

SEQ ID NO: 2237536 - RNA, 18 nt, Human
gaugcaguucugaagaag

SEQ ID NO: 2237537 - RNA, 16 nt, Human
cauccuuccucacacc

SEQ ID NO: 2237538 - RNA, 19 nt, Human
cugagccucagucucccuc

SEQ ID NO: 2237539 - RNA, 17 nt, Human
caaauauaaauaaaaau

SEQ ID NO: 2237540 - RNA, 13 nt, Human
augauuccaccua

SEQ ID NO: 2237541 - RNA, 21 nt, Human
aguuguugcccacagcuguau

SEQ ID NO: 2237542 - RNA, 17 nt, Human
cuauccuacuuccccuu

SEQ ID NO: 2237543 - RNA, 16 nt, Human
cccccagcccuccuua

SEQ ID NO: 2237544 - RNA, 23 nt, Human
uuguaacaagccuccuuuuaaag

SEQ ID NO: 2237545 - RNA, 15 nt, Human
ugucaauaaaaucca

SEQ ID NO: 2237546 - RNA, 15 nt, Human
gcaagcucuaucacc

SEQ ID NO: 2237547 - RNA, 17 nt, Human
uccacaacacacagauu

SEQ ID NO: 2237548 - RNA, 18 nt, Human
cuuucacauuuaaauaaa

SEQ ID NO: 2237549 - RNA, 22 nt, Human
gaaaacaauaacgauaaaagac

SEQ ID NO: 2237550 - RNA, 17 nt, Human
ccacuggacucaccucc

SEQ ID NO: 2237551 - RNA, 17 nt, Human
ucuuucacauuuaaaua

SEQ ID NO: 2237552 - RNA, 16 nt, Human
cagcuuuuucucuccc

SEQ ID NO: 2237553 - RNA, 16 nt, Human
gccucagucucccucc

SEQ ID NO: 2237554 - RNA, 16 nt, Human
caugguuuagaaagcu

SEQ ID NO: 2237555 - RNA, 21 nt, Human
cgacagugagacucugucuca

SEQ ID NO: 2237556 - RNA, 13 nt, Human
aaacauccuacaa

SEQ ID NO: 2237557 - RNA, 18 nt, Human
aaauauuuauuuuaauaa

SEQ ID NO: 2237558 - RNA, 11 nt, Human
uucacagggga

SEQ ID NO: 2237559 - RNA, 16 nt, Human
cugagcgacagugaga

SEQ ID NO: 2237560 - RNA, 13 nt, Human
ccagcccuccuua

SEQ ID NO: 2237561 - RNA, 23 nt, Human
cccagcccuccuuaucaaaggac

SEQ ID NO: 2237562 - RNA, 20 nt, Human
aauuuugugaagcaaaauuu

SEQ ID NO: 2237563 - RNA, 16 nt, Human
aaagacaaggaaaaaa

SEQ ID NO: 2237564 - RNA, 12 nt, Human
uaauuccacagc

SEQ ID NO: 2237565 - RNA, 22 nt, Human
gaagugaaaaucuacacuccag

SEQ ID NO: 2237566 - RNA, 22 nt, Human
gcagagagguagggauggggcu

SEQ ID NO: 2237567 - RNA, 14 nt, Human
ugcuagaacucccu

SEQ ID NO: 2237568 - RNA, 17 nt, Human
agcucugcccauccugc

SEQ ID NO: 2237569 - RNA, 19 nt, Human
gugacuuaaugccacuaaa

SEQ ID NO: 2237570 - RNA, 13 nt, Human
acacacaugaagu

SEQ ID NO: 2237571 - RNA, 17 nt, Human
cauuuguauaaaauaau

SEQ ID NO: 2237572 - RNA, 13 nt, Human
ccugccccccagc

SEQ ID NO: 2237573 - RNA, 12 nt, Human
cucauggaauug

SEQ ID NO: 2237574 - RNA, 13 nt, Human
uuccucugagccu

SEQ ID NO: 2237575 - RNA, 20 nt, Human
ucaagucuuucacauuuaaa

SEQ ID NO: 2237576 - RNA, 15 nt, Human
auccugccccugagc

SEQ ID NO: 2237577 - RNA, 14 nt, Human
auuucuaugaaaua

SEQ ID NO: 2237578 - RNA, 19 nt, Human
aauauuauguuaaaacugg

SEQ ID NO: 2237579 - RNA, 18 nt, Human
caaggcuagaaccaccug

SEQ ID NO: 2237580 - RNA, 17 nt, Human
accugagccccaaaagg

SEQ ID NO: 2237581 - RNA, 16 nt, Human
guucugcacacagcac

SEQ ID NO: 2237582 - RNA, 16 nt, Human
aauuacauuuguauaa

SEQ ID NO: 2237583 - RNA, 18 nt, Human
aaaucuuauaauuuaaaa

SEQ ID NO: 2237584 - RNA, 13 nt, Human
acaauaaaagaca

SEQ ID NO: 2237585 - RNA, 19 nt, Human
uggaacaguuaccucugcc

SEQ ID NO: 2237586 - RNA, 12 nt, Human
aagaaaauaacg

SEQ ID NO: 2237587 - RNA, 15 nt, Human
cagugaaagaaaaua

SEQ ID NO: 2237588 - RNA, 19 nt, Human
cuuggggccuaugcagagg

SEQ ID NO: 2237589 - RNA, 12 nt, Human
cuacaagacaca

SEQ ID NO: 2237590 - RNA, 18 nt, Human
gagcgacagugagacucu

SEQ ID NO: 2237591 - RNA, 15 nt, Human
agugacaagcucaca

SEQ ID NO: 2237592 - RNA, 18 nt, Human
gaaauggugaaaugcaga

SEQ ID NO: 2237593 - RNA, 12 nt, Human
cagaacagugau

SEQ ID NO: 2237594 - RNA, 13 nt, Human
cacauuuaaauaa

SEQ ID NO: 2237595 - RNA, 22 nt, Human
cuuuccacagaagcuccaggua

SEQ ID NO: 2237596 - RNA, 23 nt, Human
cacuggacucaccucccccaucu

SEQ ID NO: 2237597 - RNA, 21 nt, Human
uccuucagccugaaagaggaa

SEQ ID NO: 2237598 - RNA, 14 nt, Human
acacugaagaagca

SEQ ID NO: 2237599 - RNA, 23 nt, Human
ugaauuauguuugcauguucacu

SEQ ID NO: 2237600 - RNA, 23 nt, Human
caccucauggaauuggagcucgu

SEQ ID NO: 2237601 - RNA, 19 nt, Human
auagugaggagcuuugaaa

SEQ ID NO: 2237602 - RNA, 13 nt, Human
gcagaacagugau

SEQ ID NO: 2237603 - RNA, 16 nt, Human
uaccuuuugcuguggc

SEQ ID NO: 2237604 - RNA, 22 nt, Human
ccaaacauccuacaagacacag

SEQ ID NO: 2237605 - RNA, 18 nt, Human
agcugcucaauaaaguac

SEQ ID NO: 2237606 - RNA, 13 nt, Human
ucuuauaauuuaa

SEQ ID NO: 2237607 - RNA, 16 nt, Human
uaaaagacaaggaaaa

SEQ ID NO: 2237608 - RNA, 17 nt, Human
aauaacaauaaaagaca

SEQ ID NO: 2237609 - RNA, 13 nt, Human
ucuacuaaaaaua

SEQ ID NO: 2237610 - RNA, 20 nt, Human
gaccauacuaauuauacccc

SEQ ID NO: 2237611 - RNA, 16 nt, Human
auuuuaauaauguuuc

SEQ ID NO: 2237612 - RNA, 14 nt, Human
uaaaggaauuuaaa

SEQ ID NO: 2237613 - RNA, 17 nt, Human
auuuuaauaauguuuca

SEQ ID NO: 2237614 - RNA, 19 nt, Human
ucugagcauuuaauaugga

SEQ ID NO: 2237615 - RNA, 17 nt, Human
agggcauagaaguaaaa

SEQ ID NO: 2237616 - RNA, 16 nt, Human
guuuuuuuuuaaaaaa

SEQ ID NO: 2237617 - RNA, 19 nt, Human
uaucucauuuccaagcaag

SEQ ID NO: 2237618 - RNA, 22 nt, Human
augcagagguccacaacacaca

SEQ ID NO: 2237619 - RNA, 18 nt, Human
ugccauaauuacuauguc

SEQ ID NO: 2237620 - RNA, 17 nt, Human
gccugagcgacagugag

SEQ ID NO: 2237621 - RNA, 19 nt, Human
uggugaacuugguuuuaau

SEQ ID NO: 2237622 - RNA, 20 nt, Human
caagcucuaucaccaaggag

SEQ ID NO: 2237623 - RNA, 15 nt, Human
aaaaaauaacaauga

SEQ ID NO: 2237624 - RNA, 16 nt, Human
ccuacaugagguacug

SEQ ID NO: 2237625 - RNA, 18 nt, Human
ccauccugccccugagcc

SEQ ID NO: 2237626 - RNA, 14 nt, Human
cuacaagacacagu

SEQ ID NO: 2237627 - RNA, 22 nt, Human
caagcucuaucaccaaggagcc

SEQ ID NO: 2237628 - RNA, 19 nt, Human
gagguacugagagugaaca

SEQ ID NO: 2237629 - RNA, 20 nt, Human
guauuauuuuuuaaaaaaau

SEQ ID NO: 2237630 - RNA, 19 nt, Human
auaaaagacaaggaaaaaa

SEQ ID NO: 2237631 - RNA, 15 nt, Human
cuucucuucacaguc

SEQ ID NO: 2237632 - RNA, 16 nt, Human
aaaauaauccucaguu

SEQ ID NO: 2237633 - RNA, 16 nt, Human
cuucaacucccugccc

SEQ ID NO: 2237634 - RNA, 17 nt, Human
gacucaccucccccauc

SEQ ID NO: 2237635 - RNA, 20 nt, Human
uuaaguuuuuuuuuaaaaaa

SEQ ID NO: 2237636 - RNA, 19 nt, Human
agaaaauaacgauaaaaga

SEQ ID NO: 2237637 - RNA, 21 nt, Human
cauuuucuucucacauuuaua

SEQ ID NO: 2237638 - RNA, 20 nt, Human
aaagagugaaggauuuaugu

SEQ ID NO: 2237639 - RNA, 18 nt, Human
uuauuacuguaagaaaau

SEQ ID NO: 2237640 - RNA, 17 nt, Human
caagccuccuuuuaaag

SEQ ID NO: 2237641 - RNA, 19 nt, Human
ucagugucaaugcagcccc

SEQ ID NO: 2237642 - RNA, 16 nt, Human
cccacuggacucaccu

SEQ ID NO: 2237643 - RNA, 20 nt, Human
ccaaauguucaucaaugaau

SEQ ID NO: 2237644 - RNA, 13 nt, Human
uuuaaaaaagaaa

SEQ ID NO: 2237645 - RNA, 17 nt, Human
cuacacuccagugagac

SEQ ID NO: 2237646 - RNA, 18 nt, Human
guaauauugcaaggcaaa

SEQ ID NO: 2237647 - RNA, 12 nt, Human
cuucaacucccu

SEQ ID NO: 2237648 - RNA, 22 nt, Human
cuuccuaauuccacagcugcuc

SEQ ID NO: 2237649 - RNA, 18 nt, Human
aaguugauaugccuuuuc

SEQ ID NO: 2237650 - RNA, 19 nt, Human
cagaaagcagaacagugau

SEQ ID NO: 2237651 - RNA, 18 nt, Human
aucuacacuccagugaga

SEQ ID NO: 2237652 - RNA, 15 nt, Human
gcagagguugcagug

SEQ ID NO: 2237653 - RNA, 21 nt, Human
auguuuaauucugaaagcaac

SEQ ID NO: 2237654 - RNA, 23 nt, Human
cuugauaaauggcuuccuggcaa

SEQ ID NO: 2237655 - RNA, 21 nt, Human
acgcucucuggccuucggccu

SEQ ID NO: 2237656 - RNA, 17 nt, Human
aaacauccuacaagaca

SEQ ID NO: 2237657 - RNA, 22 nt, Human
gaaaaucuuauaauuuaaaaua

SEQ ID NO: 2237658 - RNA, 20 nt, Human
aauuuuuucucuaggaaaua

SEQ ID NO: 2237659 - RNA, 18 nt, Human
aaaaguucugcagauaaa

SEQ ID NO: 2237660 - RNA, 20 nt, Human
aagggcuguuauaaucuuuc

SEQ ID NO: 2237661 - RNA, 17 nt, Human
cucuuuugggauuuuug

SEQ ID NO: 2237662 - RNA, 13 nt, Human
agacacagugacc

SEQ ID NO: 2237663 - RNA, 15 nt, Human
cuaguaauuggaaag

SEQ ID NO: 2237664 - RNA, 16 nt, Human
auccuacaagacacag

SEQ ID NO: 2237665 - RNA, 15 nt, Human
augaauuaaguuuuu

SEQ ID NO: 2237666 - RNA, 17 nt, Human
ccugagcuugcagagau

SEQ ID NO: 2237667 - RNA, 21 nt, Human
uuuguauaaaauaauuuuuau

SEQ ID NO: 2237668 - RNA, 17 nt, Human
ucucauccugcaggcag

SEQ ID NO: 2237669 - RNA, 20 nt, Human
augcaguuguugcccacagc

SEQ ID NO: 2237670 - RNA, 15 nt, Human
aaugaauggcuaagc

SEQ ID NO: 2237671 - RNA, 17 nt, Human
ccaaaaaucucaauauu

SEQ ID NO: 2237672 - RNA, 15 nt, Human
agccucagucucccu

SEQ ID NO: 2237673 - RNA, 20 nt, Human
caaauauaaauaaaaauaau

SEQ ID NO: 2237674 - RNA, 17 nt, Human
cagugcuugaaugaagu

SEQ ID NO: 2237675 - RNA, 22 nt, Human
aaacaaggaugaauuaaguuuu

SEQ ID NO: 2237676 - RNA, 20 nt, Human
agcccuggugggcagagagg

SEQ ID NO: 2237677 - RNA, 19 nt, Human
aaucuacacuccagugaga

SEQ ID NO: 2237678 - RNA, 13 nt, Human
ugagcgacaguga

SEQ ID NO: 2237679 - RNA, 18 nt, Human
acaaaugggaaacaaaag

SEQ ID NO: 2237680 - RNA, 15 nt, Human
ugagcucagcccugg

SEQ ID NO: 2237681 - RNA, 21 nt, Human
ugggaggcugagaugggagaa

SEQ ID NO: 2237682 - RNA, 23 nt, Human
aucaccaaggcugauuaaaccaa

SEQ ID NO: 2237683 - RNA, 16 nt, Human
ccaggcugagccucag

SEQ ID NO: 2237684 - RNA, 20 nt, Human
uaugcuucuguuuuauaauu

SEQ ID NO: 2237685 - RNA, 21 nt, Human
ugcaggcagcuuuuucucucc

SEQ ID NO: 2237686 - RNA, 13 nt, Human
uuuugcuguggca

SEQ ID NO: 2237687 - RNA, 21 nt, Human
uuauuuucuauaauuuaaaua

SEQ ID NO: 2237688 - RNA, 18 nt, Human
ccucuggcuccagcuggc

SEQ ID NO: 2237689 - RNA, 17 nt, Human
cuggagggaagccuugg

SEQ ID NO: 2237690 - RNA, 19 nt, Human
agugaggagcuuugaaacg

SEQ ID NO: 2237691 - RNA, 19 nt, Human
ugagucccaggcugagccu

SEQ ID NO: 2237692 - RNA, 16 nt, Human
acaugaacuuguaaag

SEQ ID NO: 2237693 - RNA, 14 nt, Human
ugagaugcuagaac

SEQ ID NO: 2237694 - RNA, 14 nt, Human
uaaaauccauacau

SEQ ID NO: 2237695 - RNA, 16 nt, Human
agggaggacgcucucu

SEQ ID NO: 2237696 - RNA, 20 nt, Human
uuaaugccacuaaauugaca

SEQ ID NO: 2237697 - RNA, 19 nt, Human
agcagcuuauucacaagac

SEQ ID NO: 2237698 - RNA, 17 nt, Human
ugaacuugguuuuaauu

SEQ ID NO: 2237699 - RNA, 18 nt, Human
uuuauggcacuaguauuu

SEQ ID NO: 2237700 - RNA, 19 nt, Human
acuaucucauuuccaagca

SEQ ID NO: 2237701 - RNA, 17 nt, Human
agaaucacuugaacccg

SEQ ID NO: 2237702 - RNA, 13 nt, Human
agcucugcccauc

SEQ ID NO: 2237703 - RNA, 19 nt, Human
agcuucucauccugcaggc

SEQ ID NO: 2237704 - RNA, 18 nt, Human
aagaccucauuuugaagg

SEQ ID NO: 2237705 - RNA, 23 nt, Human
aauauugcaaggcaaagacuauu

SEQ ID NO: 2237706 - RNA, 23 nt, Human
caaagcugaaauggacuuuugua

SEQ ID NO: 2237707 - RNA, 17 nt, Human
agucccaggcugagccu

SEQ ID NO: 2237708 - RNA, 20 nt, Human
gaaaauaacaauaaaagaca

SEQ ID NO: 2237709 - RNA, 12 nt, Human
uucagccugaaa

SEQ ID NO: 2237710 - RNA, 18 nt, Human
uaaauugacacuuaaaaa

SEQ ID NO: 2237711 - RNA, 15 nt, Human
cccugcaaagcccag

SEQ ID NO: 2237712 - RNA, 15 nt, Human
auauuuuuuguuaaa

SEQ ID NO: 2237713 - RNA, 16 nt, Human
ucuuauaauuuaaaau

SEQ ID NO: 2237714 - RNA, 15 nt, Human
cucccuuggggccua

SEQ ID NO: 2237715 - RNA, 14 nt, Human
uggacucaccuccc

SEQ ID NO: 2237716 - RNA, 17 nt, Human
gccuaagugcagccccg

SEQ ID NO: 2237717 - RNA, 17 nt, Human
acccacuggacucaccu

SEQ ID NO: 2237718 - RNA, 14 nt, Human
ucuaggaaauauuu

SEQ ID NO: 2237719 - RNA, 18 nt, Human
gaaaauaacgauaaaaga

SEQ ID NO: 2237720 - RNA, 13 nt, Human
aaaugaaagcagg

SEQ ID NO: 2237721 - RNA, 20 nt, Human
ugagagacacacugaagaag

SEQ ID NO: 2237722 - RNA, 11 nt, Human
aauuuaaauau

SEQ ID NO: 2237723 - RNA, 13 nt, Human
aauuuuuauauuu

SEQ ID NO: 2237724 - RNA, 22 nt, Human
cccccugcaaagcccagcuuga

SEQ ID NO: 2237725 - RNA, 15 nt, Human
caaauccaaugaaau

SEQ ID NO: 2237726 - RNA, 17 nt, Human
ugaaauggugaaaugca

SEQ ID NO: 2237727 - RNA, 17 nt, Human
agcuucacuguaaaaua

SEQ ID NO: 2237728 - RNA, 17 nt, Human
agacacacugaagaagc

SEQ ID NO: 2237729 - RNA, 23 nt, Human
uggaaauguuuacagauccccaa

SEQ ID NO: 2237730 - RNA, 20 nt, Human
agaggagaaacuggaacucu

SEQ ID NO: 2237731 - RNA, 15 nt, Human
ugcuucuguuuuaua

SEQ ID NO: 2237732 - RNA, 18 nt, Human
cuuuucccaacuccagaa

SEQ ID NO: 2237733 - RNA, 21 nt, Human
uauacugugugcuaaaacaag

SEQ ID NO: 2237734 - RNA, 20 nt, Human
cugagccucagucucccucc

SEQ ID NO: 2237735 - RNA, 17 nt, Human
uggcuaagcaaaaugug

SEQ ID NO: 2237736 - RNA, 22 nt, Human
cuccagagggaauugcagagua

SEQ ID NO: 2237737 - RNA, 13 nt, Human
gcucucuggccuu

SEQ ID NO: 2237738 - RNA, 20 nt, Human
aauuaaguuuuuuuuuaaaa

SEQ ID NO: 2237739 - RNA, 20 nt, Human
agccuuggggcugaugcagu

SEQ ID NO: 2237740 - RNA, 14 nt, Human
cucccuuggggccu

SEQ ID NO: 2237741 - RNA, 19 nt, Human
ccuccauccugaggcucca

SEQ ID NO: 2237742 - RNA, 12 nt, Human
aauaaaguacaa

SEQ ID NO: 2237743 - RNA, 16 nt, Human
caaaaggauaaugaau

SEQ ID NO: 2237744 - RNA, 14 nt, Human
ugguauguuuucag

SEQ ID NO: 2237745 - RNA, 19 nt, Human
gagggaauugcagaguacu

SEQ ID NO: 2237746 - RNA, 12 nt, Human
gacgagaaaaca

SEQ ID NO: 2237747 - RNA, 12 nt, Human
guagacacacau

SEQ ID NO: 2237748 - RNA, 14 nt, Human
gaaggcuuacaccc

SEQ ID NO: 2237749 - RNA, 17 nt, Human
gccaugggacagggagg

SEQ ID NO: 2237750 - RNA, 19 nt, Human
caugaguaacugauuugua

SEQ ID NO: 2237751 - RNA, 20 nt, Human
auacugugugcuaaaacaag

SEQ ID NO: 2237752 - RNA, 12 nt, Human
acacugaagaag

SEQ ID NO: 2237753 - RNA, 15 nt, Human
ucccccaucucuucu

SEQ ID NO: 2237754 - RNA, 16 nt, Human
ucaaaagaaagaaaau

SEQ ID NO: 2237755 - RNA, 13 nt, Human
guaacuaauuuua

SEQ ID NO: 2237756 - RNA, 11 nt, Human
augggacaggg

SEQ ID NO: 2237757 - RNA, 15 nt, Human
agaaaacaauaacga

SEQ ID NO: 2237758 - RNA, 17 nt, Human
gaagaccucauuuugaa

SEQ ID NO: 2237759 - RNA, 23 nt, Human
aaauuuacagagacagaaagcag

SEQ ID NO: 2237760 - RNA, 17 nt, Human
gacagucaccucaugga

SEQ ID NO: 2237761 - RNA, 21 nt, Human
caacacacagauuugagcuca

SEQ ID NO: 2237762 - RNA, 15 nt, Human
auuuuaaaagaauga

SEQ ID NO: 2237763 - RNA, 18 nt, Human
auuauuuuuuaaaaaaau

SEQ ID NO: 2237764 - RNA, 18 nt, Human
cagauuugagcucagccc

SEQ ID NO: 2237765 - RNA, 13 nt, Human
aaaguguuugaaa

SEQ ID NO: 2237766 - RNA, 13 nt, Human
cccaaaaggcaga

SEQ ID NO: 2237767 - RNA, 23 nt, Human
gaccccugagcuugcagagauga

SEQ ID NO: 2237768 - RNA, 16 nt, Human
aacuugguuuuaauua

SEQ ID NO: 2237769 - RNA, 15 nt, Human
aaauaauuuuuauau

SEQ ID NO: 2237770 - RNA, 14 nt, Human
uugcuggagcucug

SEQ ID NO: 2237771 - RNA, 22 nt, Human
uuuccaagcaaguauuagaaua

SEQ ID NO: 2237772 - RNA, 23 nt, Human
uugccugcaggcaugagucaguc

SEQ ID NO: 2237773 - RNA, 13 nt, Human
aagacagugaaag

SEQ ID NO: 2237774 - RNA, 13 nt, Human
cuuaucaaaggac

SEQ ID NO: 2237775 - RNA, 16 nt, Human
acuaguuucccuugca

SEQ ID NO: 2237776 - RNA, 12 nt, Human
aucguguccccu

SEQ ID NO: 2237777 - RNA, 12 nt, Human
ugagagacacac

SEQ ID NO: 2237778 - RNA, 21 nt, Human
gacagugaaagaaaauaacaa

SEQ ID NO: 2237779 - RNA, 15 nt, Human
agccugaaagaggaa

SEQ ID NO: 2237780 - RNA, 16 nt, Human
gcuugccugcaggcau

SEQ ID NO: 2237781 - RNA, 16 nt, Human
ugaaauuguauuacaa

SEQ ID NO: 2237782 - RNA, 13 nt, Human
acagcccuucuuu

SEQ ID NO: 2237783 - RNA, 21 nt, Human
gaaaaguauguuagugcaaau

SEQ ID NO: 2237784 - RNA, 18 nt, Human
aagucuuucacauuuaaa

SEQ ID NO: 2237785 - RNA, 14 nt, Human
ugcuucuguuuuau

SEQ ID NO: 2237786 - RNA, 12 nt, Human
aaaugaaagcag

SEQ ID NO: 2237787 - RNA, 22 nt, Human
agacucugucucaguccaugaa

SEQ ID NO: 2237788 - RNA, 20 nt, Human
acuuuauuuucuauaauuua

SEQ ID NO: 2237789 - RNA, 22 nt, Human
ccauuucuugagguaaaagcau

SEQ ID NO: 2237790 - RNA, 14 nt, Human
uauaaauaaaaaua

SEQ ID NO: 2237791 - RNA, 19 nt, Human
uguuggacgagaaaacaau

SEQ ID NO: 2237792 - RNA, 21 nt, Human
auggcagcuuuccucaaaacu

SEQ ID NO: 2237793 - RNA, 14 nt, Human
uuucuaugaaauau

SEQ ID NO: 2237794 - RNA, 17 nt, Human
aauaaaguguuugaaag

SEQ ID NO: 2237795 - RNA, 23 nt, Human
uggcuugaguuuaaauuguaaua

SEQ ID NO: 2237796 - RNA, 19 nt, Human
cucugccucagaaaacaag

SEQ ID NO: 2237797 - RNA, 22 nt, Human
aaagagugaaggauuuauguuu

SEQ ID NO: 2237798 - RNA, 15 nt, Human
cuuuucccaacucca

SEQ ID NO: 2237799 - RNA, 15 nt, Human
uauaauuuaaauaua

SEQ ID NO: 2237800 - RNA, 13 nt, Human
uuauucacaagac

SEQ ID NO: 2237801 - RNA, 19 nt, Human
aaaauaacgauaaaagaca

SEQ ID NO: 2237802 - RNA, 14 nt, Human
gucccaggcugagc

SEQ ID NO: 2237803 - RNA, 18 nt, Human
ugaacuugguuuuaauua

SEQ ID NO: 2237804 - RNA, 14 nt, Human
gaaugauuaugaau

SEQ ID NO: 2237805 - RNA, 14 nt, Human
auccaaugaaauga

SEQ ID NO: 2237806 - RNA, 14 nt, Human
auuguccaggucua

SEQ ID NO: 2237807 - RNA, 16 nt, Human
ugugagaugcuagaac

SEQ ID NO: 2237808 - RNA, 12 nt, Human
ucugcacacagc

SEQ ID NO: 2237809 - RNA, 16 nt, Human
ugcuguauuuuaaaag

SEQ ID NO: 2237810 - RNA, 16 nt, Human
agguacuucaaauccu

SEQ ID NO: 2237811 - RNA, 22 nt, Human
aacucccugccccccagcccuc

SEQ ID NO: 2237812 - RNA, 16 nt, Human
uuuucucuaggaaaua

SEQ ID NO: 2237813 - RNA, 15 nt, Human
ggccuucggccucca

SEQ ID NO: 2237814 - RNA, 16 nt, Human
ccugcaaagcccagcu

SEQ ID NO: 2237815 - RNA, 20 nt, Human
aauucuugccaaauauaaau

SEQ ID NO: 2237816 - RNA, 21 nt, Human
cacaugaacuuguaaaggaau

SEQ ID NO: 2237817 - RNA, 19 nt, Human
uuauggcacuaguauuucu

SEQ ID NO: 2237818 - RNA, 10 nt, Human
accugagccc

SEQ ID NO: 2237819 - RNA, 19 nt, Human
gcuuguauuccuuuuucuc

SEQ ID NO: 2237820 - RNA, 16 nt, Human
uguucuaagaagugaa

SEQ ID NO: 2237821 - RNA, 18 nt, Human
uacuuuauuuucuauaau

SEQ ID NO: 2237822 - RNA, 12 nt, Human
auuuuaaaagaa

SEQ ID NO: 2237823 - RNA, 15 nt, Human
cucaacaaacauaau

SEQ ID NO: 2237824 - RNA, 18 nt, Human
auguuaaaacugggacag

SEQ ID NO: 2237825 - RNA, 18 nt, Human
ccuuccuaauuccacagc

SEQ ID NO: 2237826 - RNA, 18 nt, Human
gccccgucccccucuggc

SEQ ID NO: 2237827 - RNA, 15 nt, Human
uccaagccucauguc

SEQ ID NO: 2237828 - RNA, 15 nt, Human
agaauaccacaggaa

SEQ ID NO: 2237829 - RNA, 20 nt, Human
ugccccccagcccuccuuau

SEQ ID NO: 2237830 - RNA, 22 nt, Human
uagacacacaugaaguccaagc

SEQ ID NO: 2237831 - RNA, 12 nt, Human
ucaccccuugcc

SEQ ID NO: 2237832 - RNA, 23 nt, Human
uauguuaaaacugggacagggga

SEQ ID NO: 2237833 - RNA, 18 nt, Human
cucauccugcaggcagcu

SEQ ID NO: 2237834 - RNA, 23 nt, Human
ggaggcagagguugcagugagcc

SEQ ID NO: 2237835 - RNA, 19 nt, Human
uuugccaaguucuccacua

SEQ ID NO: 2237836 - RNA, 12 nt, Human
aguguuugaaag

SEQ ID NO: 2237837 - RNA, 17 nt, Human
cugagaugggagaauca

SEQ ID NO: 2237838 - RNA, 16 nt, Human
ccacuuauaggaauug

SEQ ID NO: 2237839 - RNA, 14 nt, Human
gauuaguacacacu

SEQ ID NO: 2237840 - RNA, 15 nt, Human
acuuuauaaaggauu

SEQ ID NO: 2237841 - RNA, 14 nt, Human
aguuuuuuuuuaaa

SEQ ID NO: 2237842 - RNA, 15 nt, Human
cugcacuccagccug

SEQ ID NO: 2237843 - RNA, 20 nt, Human
auaagccagacaucaacaga

SEQ ID NO: 2237844 - RNA, 19 nt, Human
agaaaauaacaauaaaaga

SEQ ID NO: 2237845 - RNA, 15 nt, Human
ugguuuagaaagcuu

SEQ ID NO: 2237846 - RNA, 18 nt, Human
cagugaaagaaaauaaca

SEQ ID NO: 2237847 - RNA, 17 nt, Human
ccucagucucccucccu

SEQ ID NO: 2237848 - RNA, 17 nt, Human
uaacgauaaaagacagu

SEQ ID NO: 2237849 - RNA, 16 nt, Human
cacuggacucaccucc

SEQ ID NO: 2237850 - RNA, 15 nt, Human
cugcagauaaacagu

SEQ ID NO: 2237851 - RNA, 15 nt, Human
ucugcagauaaacag

SEQ ID NO: 2237852 - RNA, 17 nt, Human
aaucuuauaauuuaaaa

SEQ ID NO: 2237853 - RNA, 19 nt, Human
cccugcaaagcccagcuug

SEQ ID NO: 2237854 - RNA, 18 nt, Human
cagcugcucaauaaagua

SEQ ID NO: 2237855 - RNA, 22 nt, Human
aaugaaauggugaaaugcagag

SEQ ID NO: 2237856 - RNA, 16 nt, Human
auaacuggaaacuuca

SEQ ID NO: 2237857 - RNA, 21 nt, Human
uuauguuuaauucugaaagca

SEQ ID NO: 2237858 - RNA, 21 nt, Human
auuuguauaaaauaauuuuua

SEQ ID NO: 2237859 - RNA, 23 nt, Human
gaaaaaguucugcagauaaacag

SEQ ID NO: 2237860 - RNA, 15 nt, Human
agggcucacagaauu

SEQ ID NO: 2237861 - RNA, 13 nt, Human
uaaacauguuuau

SEQ ID NO: 2237862 - RNA, 13 nt, Human
agaaguaaaaaca

SEQ ID NO: 2237863 - RNA, 18 nt, Human
cuuugagcgcccacuaga

SEQ ID NO: 2237864 - RNA, 22 nt, Human
caaauuuacagagacagaaagc

SEQ ID NO: 2237865 - RNA, 20 nt, Human
uaauaaguugcauagguuua

SEQ ID NO: 2237866 - RNA, 22 nt, Human
cugcucaauaaaguacaagagc

SEQ ID NO: 2237867 - RNA, 20 nt, Human
ggccuaugcagagguccaca

SEQ ID NO: 2237868 - RNA, 14 nt, Human
aucaaaagaaagaa

SEQ ID NO: 2237869 - RNA, 16 nt, Human
aaugaaagcagggacu

SEQ ID NO: 2237870 - RNA, 17 nt, Human
gugccuguaaucacagc

SEQ ID NO: 2237871 - RNA, 21 nt, Human
ccaaggaugccccgucccccu

SEQ ID NO: 2237872 - RNA, 19 nt, Human
uggugagugccuguaauca

SEQ ID NO: 2237873 - RNA, 19 nt, Human
cuccagcuggccgggagcc

SEQ ID NO: 2237874 - RNA, 13 nt, Human
agcccagcuugaa

SEQ ID NO: 2237875 - RNA, 14 nt, Human
ggcaauagucaaau

SEQ ID NO: 2237876 - RNA, 16 nt, Human
cagggacuugaaccca

SEQ ID NO: 2237877 - RNA, 19 nt, Human
ggcaaggguucaccugggc

SEQ ID NO: 2237878 - RNA, 11 nt, Human
aauugcagagu

SEQ ID NO: 2237879 - RNA, 16 nt, Human
gaagauguagaggaga

SEQ ID NO: 2237880 - RNA, 22 nt, Human
cagcccuggugggcagagaggu

SEQ ID NO: 2237881 - RNA, 22 nt, Human
aauuuuuucucuaggaaauauu

SEQ ID NO: 2237882 - RNA, 23 nt, Human
ugaaaaucuuauaauuuaaaaua

SEQ ID NO: 2237883 - RNA, 20 nt, Human
uaaaagacaaggaaaaaaua

SEQ ID NO: 2237884 - RNA, 14 nt, Human
ugcuaagucuuaua

SEQ ID NO: 2237885 - RNA, 24 nt, Human
aaagacagcuucucauccugcagg

SEQ ID NO: 2237886 - RNA, 12 nt, Human
cacaacacacag

SEQ ID NO: 2237887 - RNA, 14 nt, Human
aacgauaaaagaca

SEQ ID NO: 2237888 - RNA, 22 nt, Human
caucucuucuggguuccuuccu

SEQ ID NO: 2237889 - RNA, 20 nt, Human
uaugaaaaggcuaagcuuca

SEQ ID NO: 2237890 - RNA, 21 nt, Human
ugaacugauggguuucuccag

SEQ ID NO: 2237891 - RNA, 23 nt, Human
acgaggauugggaaaaaguaauu

SEQ ID NO: 2237892 - RNA, 21 nt, Human
auucauagcagcuuauucaca

SEQ ID NO: 2237893 - RNA, 19 nt, Human
agagccuuuuuuugaaaaa

SEQ ID NO: 2237894 - RNA, 13 nt, Human
uaacaauaaaaga

SEQ ID NO: 2237895 - RNA, 14 nt, Human
gccucagucucccu

SEQ ID NO: 2237896 - RNA, 19 nt, Human
agacagugaaagaaaauaa

SEQ ID NO: 2237897 - RNA, 17 nt, Human
uucugagcauuuaauau

SEQ ID NO: 2237898 - RNA, 17 nt, Human
aaagacaaggaaaaaau

SEQ ID NO: 2237899 - RNA, 22 nt, Human
uuguaacaagccuccuuuuaaa

SEQ ID NO: 2237900 - RNA, 16 nt, Human
agugucaaugcagccc

SEQ ID NO: 2237901 - RNA, 16 nt, Human
agugaaagaaaauaac

SEQ ID NO: 2237902 - RNA, 19 nt, Human
auacuaauuauacccccug

SEQ ID NO: 2237903 - RNA, 22 nt, Human
uaaaacaagcacuaaacaaaga

SEQ ID NO: 2237904 - RNA, 17 nt, Human
uguucuaagaagugaaa

SEQ ID NO: 2237905 - RNA, 18 nt, Human
uaaaagacagugaaagaa

SEQ ID NO: 2237906 - RNA, 13 nt, Human
ccagcacagccuc

SEQ ID NO: 2237907 - RNA, 16 nt, Human
aagcuucacuguaaaa

SEQ ID NO: 2237908 - RNA, 16 nt, Human
uuucuauaauuuaaau

SEQ ID NO: 2237909 - RNA, 18 nt, Human
ccugcaaagcccagcuug

SEQ ID NO: 2237910 - RNA, 17 nt, Human
uaauuccacagcugcuc

SEQ ID NO: 2237911 - RNA, 19 nt, Human
ccccuauccuacuuccccu

SEQ ID NO: 2237912 - RNA, 23 nt, Human
auuauauggcuugaguuuaaauu

SEQ ID NO: 2237913 - RNA, 17 nt, Human
uucucuaggaaauauuu

SEQ ID NO: 2237914 - RNA, 14 nt, Human
ggaaguagaggagg

SEQ ID NO: 2237915 - RNA, 17 nt, Human
aguauuucuaugaaaua

SEQ ID NO: 2237916 - RNA, 15 nt, Human
aucuuauaauuuaaa

SEQ ID NO: 2237917 - RNA, 17 nt, Human
agaacucccuuucaaca

SEQ ID NO: 2237918 - RNA, 14 nt, Human
cgcuaccuuuugcu

SEQ ID NO: 2237919 - RNA, 18 nt, Human
gaagcaaaauuuuuucuc

SEQ ID NO: 2237920 - RNA, 19 nt, Human
gagccugaucaccugcccu

SEQ ID NO: 2237921 - RNA, 15 nt, Human
uacuaauuuuaaaau

SEQ ID NO: 2237922 - RNA, 22 nt, Human
aaacauccuacaagacacagug

SEQ ID NO: 2237923 - RNA, 21 nt, Human
aagcuccauuuuuagugaaau

SEQ ID NO: 2237924 - RNA, 18 nt, Human
uggucaauuuuguuaugu

SEQ ID NO: 2237925 - RNA, 11 nt, Human
aaccugagccc

SEQ ID NO: 2237926 - RNA, 20 nt, Human
acaguggaaagacagcuucu

SEQ ID NO: 2237927 - RNA, 22 nt, Human
cuccugccuaagugcagccccg

SEQ ID NO: 2237928 - RNA, 15 nt, Human
aucaauuuaaaaaaa

SEQ ID NO: 2237929 - RNA, 20 nt, Human
aaagacaaggaaaaaauaac

SEQ ID NO: 2237930 - RNA, 13 nt, Human
aacucccugcccc

SEQ ID NO: 2237931 - RNA, 18 nt, Human
auaauccuaaacauauga

SEQ ID NO: 2237932 - RNA, 19 nt, Human
auuuucuauaauuuaaaua

SEQ ID NO: 2237933 - RNA, 14 nt, Human
agagguccacaaca

SEQ ID NO: 2237934 - RNA, 20 nt, Human
caagagccuuuuuuugaaaa

SEQ ID NO: 2237935 - RNA, 18 nt, Human
aaagaaaaucaggcuggc

SEQ ID NO: 2237936 - RNA, 18 nt, Human
ccugaaagaggaaugaag

SEQ ID NO: 2237937 - RNA, 23 nt, Human
aggaugguucccuugaugaagaa

SEQ ID NO: 2237938 - RNA, 22 nt, Human
ugggcacuguggguagacacac

SEQ ID NO: 2237939 - RNA, 22 nt, Human
gagccucagucucccucccuug

SEQ ID NO: 2237940 - RNA, 18 nt, Human
acuggacucaccuccccc

SEQ ID NO: 2237941 - RNA, 13 nt, Human
ccucauggaauug

SEQ ID NO: 2237942 - RNA, 22 nt, Human
acagauuugagcucagcccugg

SEQ ID NO: 2237943 - RNA, 12 nt, Human
accccugagcuu

SEQ ID NO: 2237944 - RNA, 14 nt, Human
aaaagaaacauuug

SEQ ID NO: 2237945 - RNA, 14 nt, Human
acauauauaacaau

SEQ ID NO: 2237946 - RNA, 23 nt, Human
uuauagcuacuaauuuuaaaaug

SEQ ID NO: 2237947 - RNA, 12 nt, Human
auucugaaagca

SEQ ID NO: 2237948 - RNA, 23 nt, Human
acugucuuguuggacgagaaaac

SEQ ID NO: 2237949 - RNA, 14 nt, Human
ccaaauauaaauaa

SEQ ID NO: 2237950 - RNA, 22 nt, Human
cauuuaaauaaaguguuugaaa

SEQ ID NO: 2237951 - RNA, 22 nt, Human
gaauuaaguuuuuuuuuaaaaa

SEQ ID NO: 2237952 - RNA, 22 nt, Human
aggcuccacuuggucugugaga

SEQ ID NO: 2237953 - RNA, 19 nt, Human
cuggccuucggccuccauc

SEQ ID NO: 2237954 - RNA, 18 nt, Human
auuuuuagugaaauauua

SEQ ID NO: 2237955 - RNA, 22 nt, Human
acaccuuguacuuuauuuucua

SEQ ID NO: 2237956 - RNA, 19 nt, Human
cucacauuuauauuuuugu

SEQ ID NO: 2237957 - RNA, 24 nt, Human
uggccgggagccugaucaccugcc

SEQ ID NO: 2237958 - RNA, 13 nt, Human
ugccugcaggcau

SEQ ID NO: 2237959 - RNA, 15 nt, Human
gaccacugcagaaga

SEQ ID NO: 2237960 - RNA, 19 nt, Human
gacagucaccucauggaau

SEQ ID NO: 2237961 - RNA, 21 nt, Human
cuggccuucggccuccauccu

SEQ ID NO: 2237962 - RNA, 18 nt, Human
caagccucauguccacug

SEQ ID NO: 2237963 - RNA, 15 nt, Human
cuacaagacacagug

SEQ ID NO: 2237964 - RNA, 16 nt, Human
ccauuuuuagugaaau

SEQ ID NO: 2237965 - RNA, 22 nt, Human
gaaauaagccagacaucaacag

SEQ ID NO: 2237966 - RNA, 21 nt, Human
cuaaauugacacuuaaaaaug

SEQ ID NO: 2237967 - RNA, 12 nt, Human
aaggaugccccg

SEQ ID NO: 2237968 - RNA, 14 nt, Human
aagagugaaggauu

SEQ ID NO: 2237969 - RNA, 18 nt, Human
cugcucaauaaaguacaa

SEQ ID NO: 2237970 - RNA, 13 nt, Human
cuucucaacucca

SEQ ID NO: 2237971 - RNA, 16 nt, Human
aauaaaguguuugaaa

SEQ ID NO: 2237972 - RNA, 22 nt, Human
guacacugccuucucaacucca

SEQ ID NO: 2237973 - RNA, 15 nt, Human
auaucaauuuaaaaa

SEQ ID NO: 2237974 - RNA, 15 nt, Human
gccucagucucccuc

SEQ ID NO: 2237975 - RNA, 13 nt, Human
acuguaaaauaau

SEQ ID NO: 2237976 - RNA, 21 nt, Human
ugccuguaaucacagcuacuu

SEQ ID NO: 2237977 - RNA, 16 nt, Human
ggcagagagguaggga

SEQ ID NO: 2237978 - RNA, 18 nt, Human
gcacuccagccugagcga

SEQ ID NO: 2237979 - RNA, 20 nt, Human
aguuuuuuuuuaaaaaagaa

SEQ ID NO: 2237980 - RNA, 14 nt, Human
aaccugagccccaa

SEQ ID NO: 2237981 - RNA, 13 nt, Human
aucucaauauuuc

SEQ ID NO: 2237982 - RNA, 16 nt, Human
gcuucacuguaaaaua

SEQ ID NO: 2237983 - RNA, 12 nt, Human
cuggcuccagcu

SEQ ID NO: 2237984 - RNA, 13 nt, Human
caacucccugccc

SEQ ID NO: 2237985 - RNA, 14 nt, Human
uaaauaguuuauga

SEQ ID NO: 2237986 - RNA, 12 nt, Human
cuccauuuuuag

SEQ ID NO: 2237987 - RNA, 21 nt, Human
uauuauuuuauagcuacuaau

SEQ ID NO: 2237988 - RNA, 20 nt, Human
uuacaaauccaaugaaauga

SEQ ID NO: 2237989 - RNA, 17 nt, Human
aaauauaaauaaaaaua

SEQ ID NO: 2237990 - RNA, 22 nt, Human
uguugcccacagcuguaugauu

SEQ ID NO: 2237991 - RNA, 20 nt, Human
uaacaagccuccuuuuaaag

SEQ ID NO: 2237992 - RNA, 21 nt, Human
accaccugccuauauuuuuug

SEQ ID NO: 2237993 - RNA, 17 nt, Human
auaauuuaaauauaugc

SEQ ID NO: 2237994 - RNA, 17 nt, Human
uuacagagacagaaagc

SEQ ID NO: 2237995 - RNA, 18 nt, Human
ccacuuggucugugagau

SEQ ID NO: 2237996 - RNA, 17 nt, Human
ugcacaucaaaauaugc

SEQ ID NO: 2237997 - RNA, 12 nt, Human
uccugcaggcag

SEQ ID NO: 2237998 - RNA, 21 nt, Human
aaaauuuuuucucuaggaaau

SEQ ID NO: 2237999 - RNA, 16 nt, Human
gacaagcucacagacc

SEQ ID NO: 2238000 - RNA, 17 nt, Human
agacagugaaagaaaau

SEQ ID NO: 2238001 - RNA, 14 nt, Human
aagcaucacaugaa

SEQ ID NO: 2238002 - RNA, 15 nt, Human
ucuggcuccagcugg

SEQ ID NO: 2238003 - RNA, 12 nt, Human
aauuuaaauaua

SEQ ID NO: 2238004 - RNA, 13 nt, Human
auaacgauaaaag

SEQ ID NO: 2238005 - RNA, 14 nt, Human
guauuuuaaaagaa

SEQ ID NO: 2238006 - RNA, 11 nt, Human
accauuuuuac

SEQ ID NO: 2238007 - RNA, 16 nt, Human
uuuauauuugaaauau

SEQ ID NO: 2238008 - RNA, 16 nt, Human
agagguccacaacaca

SEQ ID NO: 2238009 - RNA, 13 nt, Human
ucuaagaagugaa

SEQ ID NO: 2238010 - RNA, 17 nt, Human
acaaguccagccuggca

SEQ ID NO: 2238011 - RNA, 22 nt, Human
agaaugagagacacacugaaga

SEQ ID NO: 2238012 - RNA, 22 nt, Human
aaagacagugaaagaaaauaac

SEQ ID NO: 2238013 - RNA, 16 nt, Human
ccccugcacuccagcc

SEQ ID NO: 2238014 - RNA, 20 nt, Human
ucacaugaacuuguaaagga

SEQ ID NO: 2238015 - RNA, 17 nt, Human
cucguggaacaguuacc

SEQ ID NO: 2238016 - RNA, 21 nt, Human
cucaaaacuucagacauagaa

SEQ ID NO: 2238017 - RNA, 21 nt, Human
gggagccugaucaccugcccu

SEQ ID NO: 2238018 - RNA, 18 nt, Human
ccaagccuggcaagggaa

SEQ ID NO: 2238019 - RNA, 14 nt, Human
ugcucauggaauug

SEQ ID NO: 2238020 - RNA, 20 nt, Human
auucccagccagcacagccu

SEQ ID NO: 2238021 - RNA, 18 nt, Human
auggcuugaguuuaaauu

SEQ ID NO: 2238022 - RNA, 11 nt, Human
uuauauuuauu

SEQ ID NO: 2238023 - RNA, 23 nt, Human
cuucaacucccugccccccagcc

SEQ ID NO: 2238024 - RNA, 16 nt, Human
uccuguaauggaagca

SEQ ID NO: 2238025 - RNA, 15 nt, Human
aagaagugaaaaucu

SEQ ID NO: 2238026 - RNA, 21 nt, Human
gacagucaccucauggaauug

SEQ ID NO: 2238027 - RNA, 15 nt, Human
agacaaggaaaaaau

SEQ ID NO: 2238028 - RNA, 22 nt, Human
cuggguuccuuccucugagccu

SEQ ID NO: 2238029 - RNA, 17 nt, Human
ucucuggccuucggccu

SEQ ID NO: 2238030 - RNA, 23 nt, Human
cucauguccacugguucuucuug

SEQ ID NO: 2238031 - RNA, 22 nt, Human
gugccucaccccuugccauaau

SEQ ID NO: 2238032 - RNA, 12 nt, Human
uuaauaaaccau

SEQ ID NO: 2238033 - RNA, 14 nt, Human
caaggaaaaaauaa

SEQ ID NO: 2238034 - RNA, 20 nt, Human
guccccuauccuacuucccc

SEQ ID NO: 2238035 - RNA, 15 nt, Human
ggacucaccuccccc

SEQ ID NO: 2238036 - RNA, 21 nt, Human
cuucucacauuuauauuuuug

SEQ ID NO: 2238037 - RNA, 20 nt, Human
aauaucuuuuuuuuaauaaa

SEQ ID NO: 2238038 - RNA, 21 nt, Human
aaugaauggcuaagcaaaaug

SEQ ID NO: 2238039 - RNA, 23 nt, Human
auguuaaaacugggacaggggag

SEQ ID NO: 2238040 - RNA, 18 nt, Human
uuuucucuccucucccca

SEQ ID NO: 2238041 - RNA, 21 nt, Human
gcccauccugccccugagccc

SEQ ID NO: 2238042 - RNA, 14 nt, Human
uugccaugugcuag

SEQ ID NO: 2238043 - RNA, 11 nt, Human
cauaugaaaag

SEQ ID NO: 2238044 - RNA, 16 nt, Human
agugaaggauuuaugu

SEQ ID NO: 2238045 - RNA, 17 nt, Human
uuauuacuguaagaaaa

SEQ ID NO: 2238046 - RNA, 18 nt, Human
ucuucuggguuccuuccu

SEQ ID NO: 2238047 - RNA, 20 nt, Human
acaagacccaaaaggcagaa

SEQ ID NO: 2238048 - RNA, 17 nt, Human
gcaagcucuaucaccaa

SEQ ID NO: 2238049 - RNA, 16 nt, Human
acaugaaguccaagca

SEQ ID NO: 2238050 - RNA, 15 nt, Human
acagugaaagaaaau

SEQ ID NO: 2238051 - RNA, 13 nt, Human
acaaggaaaaaau

SEQ ID NO: 2238052 - RNA, 15 nt, Human
uucacauuuaaauaa

SEQ ID NO: 2238053 - RNA, 17 nt, Human
aaagcagggacuugaac

SEQ ID NO: 2238054 - RNA, 20 nt, Human
acaagacacagugaccauac

SEQ ID NO: 2238055 - RNA, 18 nt, Human
caaggcugauuaaaccaa

SEQ ID NO: 2238056 - RNA, 21 nt, Human
cugcccugcugagucccaggc

SEQ ID NO: 2238057 - RNA, 15 nt, Human
aagccuccuuuuaaa

SEQ ID NO: 2238058 - RNA, 22 nt, Human
aaguuguagguaauauugcaag

SEQ ID NO: 2238059 - RNA, 13 nt, Human
ccugagcuugcag

SEQ ID NO: 2238060 - RNA, 23 nt, Human
agcaugucgucaaagcugaaaug

SEQ ID NO: 2238061 - RNA, 21 nt, Human
aauuuuuauauuugaaauauu

SEQ ID NO: 2238062 - RNA, 18 nt, Human
guauuauuuuuuaaaaaa

SEQ ID NO: 2238063 - RNA, 18 nt, Human
aggaaaaaauaacaauga

SEQ ID NO: 2238064 - RNA, 15 nt, Human
uugacccacaagaaa

SEQ ID NO: 2238065 - RNA, 15 nt, Human
cacuuggucugugag

SEQ ID NO: 2238066 - RNA, 16 nt, Human
acuaaacaaagaguga

SEQ ID NO: 2238067 - RNA, 22 nt, Human
gcuucucauccugcaggcagcu

SEQ ID NO: 2238068 - RNA, 16 nt, Human
uggucugugagaugcu

SEQ ID NO: 2238069 - RNA, 19 nt, Human
ugcacacagcacgggggcc

SEQ ID NO: 2238070 - RNA, 21 nt, Human
auguuuacagauccccaagcc

SEQ ID NO: 2238071 - RNA, 14 nt, Human
gugagcuacaaaug

SEQ ID NO: 2238072 - RNA, 13 nt, Human
ccuccuuuuaaag

SEQ ID NO: 2238073 - RNA, 16 nt, Human
ccacuuggucugugag

SEQ ID NO: 2238074 - RNA, 12 nt, Human
uauaauuuaaaa

SEQ ID NO: 2238075 - RNA, 20 nt, Human
ugagucccaggcugagccuc

SEQ ID NO: 2238076 - RNA, 15 nt, Human
aaacauaugaauuau

SEQ ID NO: 2238077 - RNA, 15 nt, Human
ucaaaggacaccauu

SEQ ID NO: 2238078 - RNA, 19 nt, Human
ccugccuaagugcagcccc

SEQ ID NO: 2238079 - RNA, 19 nt, Human
cccauggcacucuauguuc

SEQ ID NO: 2238080 - RNA, 14 nt, Human
aaaacuucagacau

SEQ ID NO: 2238081 - RNA, 15 nt, Human
gaagauguagaggag

SEQ ID NO: 2238082 - RNA, 23 nt, Human
caugcugucuacacuaagagaga

SEQ ID NO: 2238083 - RNA, 20 nt, Human
gacauuugcucauggaauug

SEQ ID NO: 2238084 - RNA, 15 nt, Human
aucaaaggacaccau

SEQ ID NO: 2238085 - RNA, 22 nt, Human
cugggacaggggagaaccuagg

SEQ ID NO: 2238086 - RNA, 21 nt, Human
ccauccugccccugagcccau

SEQ ID NO: 2238087 - RNA, 15 nt, Human
caggcagcuuuuucu

SEQ ID NO: 2238088 - RNA, 21 nt, Human
ccaaauauaaauaaaaauaau

SEQ ID NO: 2238089 - RNA, 12 nt, Human
cucccugccccc

SEQ ID NO: 2238090 - RNA, 17 nt, Human
caagacccaaaaggcag

SEQ ID NO: 2238091 - RNA, 19 nt, Human
aaagacagugaaagaaaau

SEQ ID NO: 2238092 - RNA, 22 nt, Human
gaugcaguuguugcccacagcu

SEQ ID NO: 2238093 - RNA, 23 nt, Human
ucuuagaugcaguucugaagaag

SEQ ID NO: 2238094 - RNA, 15 nt, Human
ucacaggacagcccu

SEQ ID NO: 2238095 - RNA, 13 nt, Human
aaaauaacgauaa

SEQ ID NO: 2238096 - RNA, 21 nt, Human
caagacccaaaaggcagaagc

SEQ ID NO: 2238097 - RNA, 21 nt, Human
auuuuuucucuaggaaauauu

SEQ ID NO: 2238098 - RNA, 17 nt, Human
cugagcgacagugagac

SEQ ID NO: 2238099 - RNA, 13 nt, Human
augaacuuuccac

SEQ ID NO: 2238100 - RNA, 23 nt, Human
uuuaguaagagauuccugagcca

SEQ ID NO: 2238101 - RNA, 20 nt, Human
uccagccugagcgacaguga

SEQ ID NO: 2238102 - RNA, 19 nt, Human
cgcccacuagacccacugg

SEQ ID NO: 2238103 - RNA, 21 nt, Human
cagagucaaugaacuuuccac

SEQ ID NO: 2238104 - RNA, 15 nt, Human
cucgugggacaguca

SEQ ID NO: 2238105 - RNA, 14 nt, Human
aaaauacaaaaaaa

SEQ ID NO: 2238106 - RNA, 14 nt, Human
cagauccuggaaau

SEQ ID NO: 2238107 - RNA, 16 nt, Human
gucuaucuuugagcgc

SEQ ID NO: 2238108 - RNA, 13 nt, Human
cccuccuuaucaa

SEQ ID NO: 2238109 - RNA, 14 nt, Human
aucaccaaggcuga

SEQ ID NO: 2238110 - RNA, 18 nt, Human
cacuccagugagacagcu

SEQ ID NO: 2238111 - RNA, 12 nt, Human
cagauuuuccug

SEQ ID NO: 2238112 - RNA, 13 nt, Human
ugcauuucuaaag

SEQ ID NO: 2238113 - RNA, 20 nt, Human
uuuaguaagagauuccugag

SEQ ID NO: 2238114 - RNA, 13 nt, Human
aacucuauaaugu

SEQ ID NO: 2238115 - RNA, 23 nt, Human
cuggccgggagccugaucaccug

SEQ ID NO: 2238116 - RNA, 15 nt, Human
uacaaaugcauuucu

SEQ ID NO: 2238117 - RNA, 14 nt, Human
uugaaauuguauua

SEQ ID NO: 2238118 - RNA, 17 nt, Human
ugguucccuugaugaag

SEQ ID NO: 2238119 - RNA, 17 nt, Human
agguccacaacacacag

SEQ ID NO: 2238120 - RNA, 18 nt, Human
aggaaggcuuacacccac

SEQ ID NO: 2238121 - RNA, 18 nt, Human
guuucaaacauauauaac

SEQ ID NO: 2238122 - RNA, 14 nt, Human
uaaaagacaaggaa

SEQ ID NO: 2238123 - RNA, 20 nt, Human
agagacacacugaagaagca

SEQ ID NO: 2238124 - RNA, 23 nt, Human
gaaaacaauaacgauaaaagaca

SEQ ID NO: 2238125 - RNA, 14 nt, Human
ugacacuuaaaaau

SEQ ID NO: 2238126 - RNA, 22 nt, Human
aucaucaagucuuucacauuua

SEQ ID NO: 2238127 - RNA, 18 nt, Human
aaauaacgauaaaagaca

SEQ ID NO: 2238128 - RNA, 17 nt, Human
uaauuuuuauauuugaa

SEQ ID NO: 2238129 - RNA, 15 nt, Human
gccucuuagaugcag

SEQ ID NO: 2238130 - RNA, 21 nt, Human
cgaaguauccuucagccugaa

SEQ ID NO: 2238131 - RNA, 22 nt, Human
auauuuacaaaugggaaacaaa

SEQ ID NO: 2238132 - RNA, 12 nt, Human
aauuuuaaaaug

SEQ ID NO: 2238133 - RNA, 18 nt, Human
acaaaaggauaaugaaua

SEQ ID NO: 2238134 - RNA, 14 nt, Human
cuaaacauaugaau

SEQ ID NO: 2238135 - RNA, 16 nt, Human
gacauuugcucaugga

SEQ ID NO: 2238136 - RNA, 20 nt, Human
ugguuguauuauuuuuuaaa

SEQ ID NO: 2238137 - RNA, 14 nt, Human
cguguccccuaucc

SEQ ID NO: 2238138 - RNA, 16 nt, Human
cucagcccuggugggc

SEQ ID NO: 2238139 - RNA, 18 nt, Human
gaccccugagcuugcaga

SEQ ID NO: 2238140 - RNA, 12 nt, Human
agacagugaaag

SEQ ID NO: 2238141 - RNA, 14 nt, Human
gagagugaacaaau

SEQ ID NO: 2238142 - RNA, 12 nt, Human
cagugaaagaaa

SEQ ID NO: 2238143 - RNA, 21 nt, Human
gaaaacaauaacgauaaaaga

SEQ ID NO: 2238144 - RNA, 18 nt, Human
auuuaggccaugggacag

SEQ ID NO: 2238145 - RNA, 14 nt, Human
guaacugauuugua

SEQ ID NO: 2238146 - RNA, 22 nt, Human
cugaggcuccacuuggucugug

SEQ ID NO: 2238147 - RNA, 21 nt, Human
ugcucaauaaaguacaagagc

SEQ ID NO: 2238148 - RNA, 19 nt, Human
gcacacagcacgggggcca

SEQ ID NO: 2238149 - RNA, 20 nt, Human
gcagagaugaggccgccaug

SEQ ID NO: 2238150 - RNA, 19 nt, Human
gguuccuuccucugagccu

SEQ ID NO: 2238151 - RNA, 14 nt, Human
uauaauuuaaauau

SEQ ID NO: 2238152 - RNA, 23 nt, Human
agacagcuucucauccugcaggc

SEQ ID NO: 2238153 - RNA, 16 nt, Human
cuagaacucccuuuca

SEQ ID NO: 2238154 - RNA, 17 nt, Human
acuugaacccauauuug

SEQ ID NO: 2238155 - RNA, 19 nt, Human
guuguauuauuuuuuaaaa

SEQ ID NO: 2238156 - RNA, 18 nt, Human
uuguaaaggaauuuaaaa

SEQ ID NO: 2238157 - RNA, 13 nt, Human
auuggacaguaaa

SEQ ID NO: 2238158 - RNA, 15 nt, Human
aacgauaaaagacag

SEQ ID NO: 2238159 - RNA, 21 nt, Human
cccacuggacucaccuccccc

SEQ ID NO: 2238160 - RNA, 16 nt, Human
uccucacaccaggcuu

SEQ ID NO: 2238161 - RNA, 14 nt, Human
auaaauaaaaauaa

SEQ ID NO: 2238162 - RNA, 14 nt, Human
aaauauaaauaaaa

SEQ ID NO: 2238163 - RNA, 14 nt, Human
uauuugaaauauug

SEQ ID NO: 2238164 - RNA, 13 nt, Human
uuuaaaaaaaaac

SEQ ID NO: 2238165 - RNA, 13 nt, Human
uggcuccagcugg

SEQ ID NO: 2238166 - RNA, 14 nt, Human
cacuaaacaaagag

SEQ ID NO: 2238167 - RNA, 11 nt, Human
auuuaaaaauc

SEQ ID NO: 2238168 - RNA, 15 nt, Human
accucccccaucucu

SEQ ID NO: 2238169 - RNA, 17 nt, Human
cguaaucguguccccua

SEQ ID NO: 2238170 - RNA, 18 nt, Human
ucuucaacucccugcccc

SEQ ID NO: 2238171 - RNA, 14 nt, Human
ccacuggacucacc

SEQ ID NO: 2238172 - RNA, 13 nt, Human
acaagagcuuaac

SEQ ID NO: 2238173 - RNA, 12 nt, Human
ggaggcugagau

SEQ ID NO: 2238174 - RNA, 13 nt, Human
cagucugaugaga

SEQ ID NO: 2238175 - RNA, 22 nt, Human
agacucgggauuaguacacacu

SEQ ID NO: 2238176 - RNA, 23 nt, Human
ucuagcaugucgucaaagcugaa

SEQ ID NO: 2238177 - RNA, 13 nt, Human
cacuguaaaauaa

SEQ ID NO: 2238178 - RNA, 15 nt, Human
cuaagcaaaauguga

SEQ ID NO: 2238179 - RNA, 17 nt, Human
auauuugaaauauugac

SEQ ID NO: 2238180 - RNA, 21 nt, Human
ccucccuuggggccuaugcag

SEQ ID NO: 2238181 - RNA, 14 nt, Human
caugagucagucug

SEQ ID NO: 2238182 - RNA, 15 nt, Human
ggcaagcucuaucac

SEQ ID NO: 2238183 - RNA, 17 nt, Human
acuuccagauccuggaa

SEQ ID NO: 2238184 - RNA, 14 nt, Human
ugagcucagcccug

SEQ ID NO: 2238185 - RNA, 20 nt, Human
auauuuuauaucaauuuaaa

SEQ ID NO: 2238186 - RNA, 12 nt, Human
caacccaaaugu

SEQ ID NO: 2238187 - RNA, 20 nt, Human
auuacauuuguauaaaauaa

SEQ ID NO: 2238188 - RNA, 18 nt, Human
uuuuauaucaauuuaaaa

SEQ ID NO: 2238189 - RNA, 12 nt, Human
aauaauuuuuaa

SEQ ID NO: 2238190 - RNA, 22 nt, Human
aaauaacaaugaaaguugauaa

SEQ ID NO: 2238191 - RNA, 21 nt, Human
auaguuguaccgcaaugugac

SEQ ID NO: 2238192 - RNA, 18 nt, Human
auuuguauaaaauaauuu

SEQ ID NO: 2238193 - RNA, 17 nt, Human
uaaaagacagugaaaga

SEQ ID NO: 2238194 - RNA, 21 nt, Human
ucacaugaacuuguaaaggaa

SEQ ID NO: 2238195 - RNA, 13 nt, Human
uucuauaauuuaa

SEQ ID NO: 2238196 - RNA, 22 nt, Human
caauaaaagacaaggaaaaaau

SEQ ID NO: 2238197 - RNA, 20 nt, Human
uuccacagaagcuccaggua

SEQ ID NO: 2238198 - RNA, 14 nt, Human
cuaagcauuccaac

SEQ ID NO: 2238199 - RNA, 18 nt, Human
uauaacaaugcuguauuu

SEQ ID NO: 2238200 - RNA, 22 nt, Human
caaaugggaaacaaaaggauaa

SEQ ID NO: 2238201 - RNA, 15 nt, Human
gccccugcacuccag

SEQ ID NO: 2238202 - RNA, 17 nt, Human
ugaaauaagccagacau

SEQ ID NO: 2238203 - RNA, 18 nt, Human
gccccugcacuccagccu

SEQ ID NO: 2238204 - RNA, 15 nt, Human
aagugaaaaucuaca

SEQ ID NO: 2238205 - RNA, 19 nt, Human
cagcuuuuucucucccacu

SEQ ID NO: 2238206 - RNA, 24 nt, Human
uaauuuaaaauaugcucuaaacau

SEQ ID NO: 2238207 - RNA, 15 nt, Human
ccacaggaaccacaa

SEQ ID NO: 2238208 - RNA, 23 nt, Human
uuagaugcaguucugaagaagau

SEQ ID NO: 2238209 - RNA, 20 nt, Human
uguaauaggcguaacuaauu

SEQ ID NO: 2238210 - RNA, 20 nt, Human
acuagaguuuagcuggaaaa

SEQ ID NO: 2238211 - RNA, 16 nt, Human
ucaguuuuugugaaaa

SEQ ID NO: 2238212 - RNA, 15 nt, Human
uuaauuuguaguguu

SEQ ID NO: 2238213 - RNA, 16 nt, Human
uauaucaauuuaaaaa

SEQ ID NO: 2238214 - RNA, 16 nt, Human
auccuugaagauuuac

SEQ ID NO: 2238215 - RNA, 14 nt, Human
cagauccccaagcc

SEQ ID NO: 2238216 - RNA, 23 nt, Human
gccccugcacuccagccugagcg

SEQ ID NO: 2238217 - RNA, 15 nt, Human
auauaaauaaaaaua

SEQ ID NO: 2238218 - RNA, 22 nt, Human
ucuagcaugucgucaaagcuga

SEQ ID NO: 2238219 - RNA, 17 nt, Human
auaaaguacaagagcuu

SEQ ID NO: 2238220 - RNA, 23 nt, Human
auuuuauagcuacuaauuuuaaa

SEQ ID NO: 2238221 - RNA, 17 nt, Human
ccacugcagaagacagu

SEQ ID NO: 2238222 - RNA, 13 nt, Human
cauuuguauaaaa

SEQ ID NO: 2238223 - RNA, 22 nt, Human
agcacagccucuuagaugcagu

SEQ ID NO: 2238224 - RNA, 14 nt, Human
aaaagaaagaaaau

SEQ ID NO: 2238225 - RNA, 15 nt, Human
cagccagcacagccu

SEQ ID NO: 2238226 - RNA, 18 nt, Human
uccuaauuccacagcugc

SEQ ID NO: 2238227 - RNA, 19 nt, Human
cucauggaauuggagcucg

SEQ ID NO: 2238228 - RNA, 12 nt, Human
cauuauauuuau

SEQ ID NO: 2238229 - RNA, 22 nt, Human
ggcuaagcuucacuguaaaaua

SEQ ID NO: 2238230 - RNA, 12 nt, Human
uuuuauauuuga

SEQ ID NO: 2238231 - RNA, 13 nt, Human
aucuacacuccag

SEQ ID NO: 2238232 - RNA, 16 nt, Human
ggcagcuuuuucucuc

SEQ ID NO: 2238233 - RNA, 19 nt, Human
cuaagcuucacuguaaaau

SEQ ID NO: 2238234 - RNA, 13 nt, Human
uuuucuuuucauu

SEQ ID NO: 2238235 - RNA, 15 nt, Human
cacaggacagcccuu

SEQ ID NO: 2238236 - RNA, 22 nt, Human
accauuucuugagguaaaagca

SEQ ID NO: 2238237 - RNA, 18 nt, Human
acucuuaagaagacugca

SEQ ID NO: 2238238 - RNA, 18 nt, Human
uuuuagugaaauauuauu

SEQ ID NO: 2238239 - RNA, 14 nt, Human
ugaucaccugcccu

SEQ ID NO: 2238240 - RNA, 22 nt, Human
auauaugcuaagucuuauauau

SEQ ID NO: 2238241 - RNA, 15 nt, Human
accugggcugaggca

SEQ ID NO: 2238242 - RNA, 19 nt, Human
acauuuguauaaaauaauu

SEQ ID NO: 2238243 - RNA, 13 nt, Human
cugccuucucaac

SEQ ID NO: 2238244 - RNA, 19 nt, Human
cagcuucucauccugcagg

SEQ ID NO: 2238245 - RNA, 12 nt, Human
gacagugaaaga

SEQ ID NO: 2238246 - RNA, 20 nt, Human
uugaacccgggaggcagagg

SEQ ID NO: 2238247 - RNA, 17 nt, Human
gcaaauugucacaggac

SEQ ID NO: 2238248 - RNA, 24 nt, Human
cauucuggaauaauccuaaacaua

SEQ ID NO: 2238249 - RNA, 12 nt, Human
cuaagaagugaa

SEQ ID NO: 2238250 - RNA, 19 nt, Human
uugugccccugcacuccag

SEQ ID NO: 2238251 - RNA, 20 nt, Human
cagccugagcgacagugaga

SEQ ID NO: 2238252 - RNA, 15 nt, Human
ugcuguauuuuaaaa

SEQ ID NO: 2238253 - RNA, 15 nt, Human
ugccccccagcccuc

SEQ ID NO: 2238254 - RNA, 17 nt, Human
cuggcaaggguucaccu

SEQ ID NO: 2238255 - RNA, 15 nt, Human
caggaaguagaggag

SEQ ID NO: 2238256 - RNA, 13 nt, Human
ggaaguagaggag

SEQ ID NO: 2238257 - RNA, 18 nt, Human
uggagggaagccuugggg

SEQ ID NO: 2238258 - RNA, 15 nt, Human
uaauauugcaaggca

SEQ ID NO: 2238259 - RNA, 17 nt, Human
ccaaggaugccccgucc

SEQ ID NO: 2238260 - RNA, 22 nt, Human
cuuguaaaggaauuuaaaaauc

SEQ ID NO: 2238261 - RNA, 19 nt, Human
uauauuuuuuguuaaauga

SEQ ID NO: 2238262 - RNA, 17 nt, Human
ucagacauagaauuaac

SEQ ID NO: 2238263 - RNA, 19 nt, Human
cuagaguuuagcuggaaaa

SEQ ID NO: 2238264 - RNA, 15 nt, Human
aaggaauuuaaaaau

SEQ ID NO: 2238265 - RNA, 20 nt, Human
accuacacgagauacagaau

SEQ ID NO: 2238266 - RNA, 16 nt, Human
uguaguccuguaaugg

SEQ ID NO: 2238267 - RNA, 19 nt, Human
agcuacuaauuuuaaaaug

SEQ ID NO: 2238268 - RNA, 16 nt, Human
ggccuccauccugagg

SEQ ID NO: 2238269 - RNA, 15 nt, Human
ccugccccccagccc

SEQ ID NO: 2238270 - RNA, 14 nt, Human
cucccucccuuggg

SEQ ID NO: 2238271 - RNA, 20 nt, Human
ugagagugaacaaauuuaca

SEQ ID NO: 2238272 - RNA, 21 nt, Human
ccuggugccucaccccuugcc

SEQ ID NO: 2238273 - RNA, 21 nt, Human
cuauguucuaagaagugaaaa

SEQ ID NO: 2238274 - RNA, 16 nt, Human
augcuaagugaaauaa

SEQ ID NO: 2238275 - RNA, 18 nt, Human
auagucaaauugugugaa

SEQ ID NO: 2238276 - RNA, 22 nt, Human
agaaagugacaagcucacagac

SEQ ID NO: 2238277 - RNA, 13 nt, Human
uaagugcagcccc

SEQ ID NO: 2238278 - RNA, 17 nt, Human
cugagcagugcuugaau

SEQ ID NO: 2238279 - RNA, 17 nt, Human
cuuccucugagccuugg

SEQ ID NO: 2238280 - RNA, 19 nt, Human
aaacaaaaggauaaugaau

SEQ ID NO: 2238281 - RNA, 20 nt, Human
cuaaaugucaaucagccuag

SEQ ID NO: 2238282 - RNA, 21 nt, Human
ugaaacgaggauugggaaaaa

SEQ ID NO: 2238283 - RNA, 16 nt, Human
acauuugcucauggaa

SEQ ID NO: 2238284 - RNA, 22 nt, Human
auuacuguaagaaaauaucacu

SEQ ID NO: 2238285 - RNA, 20 nt, Human
cagcuggccgggagccugau

SEQ ID NO: 2238286 - RNA, 13 nt, Human
uuuagugaaauau

SEQ ID NO: 2238287 - RNA, 20 nt, Human
aagucuuucacauuuaaaua

SEQ ID NO: 2238288 - RNA, 17 nt, Human
augccccgucccccucu

SEQ ID NO: 2238289 - RNA, 16 nt, Human
acugauggguuucucc

SEQ ID NO: 2238290 - RNA, 20 nt, Human
augguuuagaaagcuugccc

SEQ ID NO: 2238291 - RNA, 19 nt, Human
acuagacaaguccagccug

SEQ ID NO: 2238292 - RNA, 13 nt, Human
agagauuccugag

SEQ ID NO: 2238293 - RNA, 21 nt, Human
gccuuuucccaacuccagaaa

SEQ ID NO: 2238294 - RNA, 19 nt, Human
uauuuuaauaauguuucaa

SEQ ID NO: 2238295 - RNA, 22 nt, Human
gugugaccacugcagaagacag

SEQ ID NO: 2238296 - RNA, 21 nt, Human
auuccuuuuucucuccucucc

SEQ ID NO: 2238297 - RNA, 16 nt, Human
uggggauagugaggca

SEQ ID NO: 2238298 - RNA, 19 nt, Human
gccugaucaccugcccugc

SEQ ID NO: 2238299 - RNA, 12 nt, Human
gcucagcccugg

SEQ ID NO: 2238300 - RNA, 16 nt, Human
gacauagaauuaacac

SEQ ID NO: 2238301 - RNA, 13 nt, Human
cugcacuccagcc

SEQ ID NO: 2238302 - RNA, 16 nt, Human
cagcuuuccucaaaac

SEQ ID NO: 2238303 - RNA, 12 nt, Human
ucccccucuggc

SEQ ID NO: 2238304 - RNA, 20 nt, Human
auaaauggcuuccuggcaau

SEQ ID NO: 2238305 - RNA, 16 nt, Human
ugaaguccaagcauuu

SEQ ID NO: 2238306 - RNA, 14 nt, Human
cacaagaaaugaaa

SEQ ID NO: 2238307 - RNA, 17 nt, Human
uuuccacauucagagcu

SEQ ID NO: 2238308 - RNA, 20 nt, Human
agcuucacuguaaaauaaua

SEQ ID NO: 2238309 - RNA, 18 nt, Human
uaagcuucacuguaaaau

SEQ ID NO: 2238310 - RNA, 12 nt, Human
gcugaugcaguu

SEQ ID NO: 2238311 - RNA, 23 nt, Human
agaaugauuaugaauuacauuug

SEQ ID NO: 2238312 - RNA, 21 nt, Human
aaagaaaauaacgauaaaaga

SEQ ID NO: 2238313 - RNA, 15 nt, Human
acucaacaaacauaa

SEQ ID NO: 2238314 - RNA, 14 nt, Human
cuucucuucacagu

SEQ ID NO: 2238315 - RNA, 22 nt, Human
aucucuucuggguuccuuccuc

SEQ ID NO: 2238316 - RNA, 20 nt, Human
cuuauucacaagacccaaaa

SEQ ID NO: 2238317 - RNA, 21 nt, Human
gcccugcugagucccaggcug

SEQ ID NO: 2238318 - RNA, 19 nt, Human
uuccucccuucucuucaca

SEQ ID NO: 2238319 - RNA, 16 nt, Human
gccaaggaugccccgu

SEQ ID NO: 2238320 - RNA, 23 nt, Human
uccagguagaggguguguaagua

SEQ ID NO: 2238321 - RNA, 21 nt, Human
uccauccugaggcuccacuug

SEQ ID NO: 2238322 - RNA, 19 nt, Human
aaaagacagugaaagaaaa

SEQ ID NO: 2238323 - RNA, 17 nt, Human
aaauaacgauaaaagac

SEQ ID NO: 2238324 - RNA, 15 nt, Human
uaaaagacaaggaaa

SEQ ID NO: 2238325 - RNA, 13 nt, Human
uuuuaaaaaagaa

SEQ ID NO: 2238326 - RNA, 18 nt, Human
gaaaugaaagcagggacu

SEQ ID NO: 2238327 - RNA, 15 nt, Human
aagccagauuuuccu

SEQ ID NO: 2238328 - RNA, 21 nt, Human
auaugcucuaaacauguuuau

SEQ ID NO: 2238329 - RNA, 15 nt, Human
cuugaaaacuuuaug

SEQ ID NO: 2238330 - RNA, 19 nt, Human
ugaucaccugcccugcuga

SEQ ID NO: 2238331 - RNA, 13 nt, Human
uaugaaauauuau

SEQ ID NO: 2238332 - RNA, 20 nt, Human
agcuacuaauuuuaaaaugu

SEQ ID NO: 2238333 - RNA, 11 nt, Human
cgauaaaagac

SEQ ID NO: 2238334 - RNA, 15 nt, Human
ugaaacccugucucu

SEQ ID NO: 2238335 - RNA, 21 nt, Human
uuccuaauuccacagcugcuc

SEQ ID NO: 2238336 - RNA, 14 nt, Human
ugugaaaagcucca

SEQ ID NO: 2238337 - RNA, 20 nt, Human
aguuguuucuacuacaugga

SEQ ID NO: 2238338 - RNA, 14 nt, Human
ucagucucccuccc

SEQ ID NO: 2238339 - RNA, 22 nt, Human
uauuucagauaaucacaauaca

SEQ ID NO: 2238340 - RNA, 19 nt, Human
ucaccaaggcugauuaaac

SEQ ID NO: 2238341 - RNA, 23 nt, Human
agcccuccuuaucaaaggacacc

SEQ ID NO: 2238342 - RNA, 21 nt, Human
cuaagcuucacuguaaaauaa

SEQ ID NO: 2238343 - RNA, 14 nt, Human
cucagucucccucc

SEQ ID NO: 2238344 - RNA, 18 nt, Human
uaaugaauacuuuauaaa

SEQ ID NO: 2238345 - RNA, 14 nt, Human
ucuauaauuuaaau

SEQ ID NO: 2238346 - RNA, 19 nt, Human
acagucaccucauggaauu

SEQ ID NO: 2238347 - RNA, 18 nt, Human
auaaaguguuugaaagcu

SEQ ID NO: 2238348 - RNA, 14 nt, Human
ggacucaccucccc

SEQ ID NO: 2238349 - RNA, 12 nt, Human
aauacuuuauaa

SEQ ID NO: 2238350 - RNA, 22 nt, Human
cccuauccuacuuccccuuccu

SEQ ID NO: 2238351 - RNA, 13 nt, Human
cucaccuccccca

SEQ ID NO: 2238352 - RNA, 22 nt, Human
accaaucaugaauuaguuuuau

SEQ ID NO: 2238353 - RNA, 23 nt, Human
caauaacgauaaaagacagugaa

SEQ ID NO: 2238354 - RNA, 22 nt, Human
uggacgagaaaacaauaacgau

SEQ ID NO: 2238355 - RNA, 14 nt, Human
cucaccccuugcca

SEQ ID NO: 2238356 - RNA, 14 nt, Human
caaaugcauuucua

SEQ ID NO: 2238357 - RNA, 22 nt, Human
uuuuauagcuacuaauuuuaaa

SEQ ID NO: 2238358 - RNA, 23 nt, Human
auaauguguucauucuggaauaa

SEQ ID NO: 2238359 - RNA, 15 nt, Human
uagggugauauuaac

SEQ ID NO: 2238360 - RNA, 23 nt, Human
gcccuggugccucaccccuugcc

SEQ ID NO: 2238361 - RNA, 15 nt, Human
ucuuauaauuuaaaa

SEQ ID NO: 2238362 - RNA, 16 nt, Human
gccuaagugcagcccc

SEQ ID NO: 2238363 - RNA, 15 nt, Human
uuauagcuacuaauu

SEQ ID NO: 2238364 - RNA, 20 nt, Human
ccauacuaauuauacccccu

SEQ ID NO: 2238365 - RNA, 19 nt, Human
ggaaaaaauaacaaugaaa

SEQ ID NO: 2238366 - RNA, 16 nt, Human
uaaugaauacuuuaua

SEQ ID NO: 2238367 - RNA, 16 nt, Human
cuacacuccagugaga

SEQ ID NO: 2238368 - RNA, 22 nt, Human
aaaucaggguuaguauugucca

SEQ ID NO: 2238369 - RNA, 20 nt, Human
accucauggaauuggagcuc

SEQ ID NO: 2238370 - RNA, 16 nt, Human
aggcuugccugcaggc

SEQ ID NO: 2238371 - RNA, 18 nt, Human
caugaauuaguuuuauau

SEQ ID NO: 2238372 - RNA, 16 nt, Human
acauuuauauuuuugu

SEQ ID NO: 2238373 - RNA, 19 nt, Human
caacucccugccccccagc

SEQ ID NO: 2238374 - RNA, 15 nt, Human
cuggacucaccuccc

SEQ ID NO: 2238375 - RNA, 15 nt, Human
acucugagcagugcu

SEQ ID NO: 2238376 - RNA, 19 nt, Human
aauuuuguuauguauauuu

SEQ ID NO: 2238377 - RNA, 21 nt, Human
agcccuucuuuccacagaagc

SEQ ID NO: 2238378 - RNA, 21 nt, Human
aauuaaguuuuuuuuuaaaaa

SEQ ID NO: 2238379 - RNA, 20 nt, Human
gaaacgaggauugggaaaaa

SEQ ID NO: 2238380 - RNA, 22 nt, Human
ugaguuuuucuuuucauuuacc

SEQ ID NO: 2238381 - RNA, 21 nt, Human
aauucauucacucaacaaaca

SEQ ID NO: 2238382 - RNA, 23 nt, Human
uuuuauagcuacuaauuuuaaaa

SEQ ID NO: 2238383 - RNA, 20 nt, Human
aaagacagugaaagaaaaua

SEQ ID NO: 2238384 - RNA, 14 nt, Human
uuccugagccagug

SEQ ID NO: 2238385 - RNA, 23 nt, Human
auauaacaaugcuguauuuuaaa

SEQ ID NO: 2238386 - RNA, 20 nt, Human
aaggaugccccgucccccuc

SEQ ID NO: 2238387 - RNA, 19 nt, Human
aagcauuccaacuaucuca

SEQ ID NO: 2238388 - RNA, 22 nt, Human
uacaugagguacugagagugaa

SEQ ID NO: 2238389 - RNA, 15 nt, Human
uauuuauuuuaauaa

SEQ ID NO: 2238390 - RNA, 18 nt, Human
cuccagccugagcgacag

SEQ ID NO: 2238391 - RNA, 22 nt, Human
cuucagccugaaagaggaauga

SEQ ID NO: 2238392 - RNA, 21 nt, Human
cccccauuguggucacaggaa

SEQ ID NO: 2238393 - RNA, 17 nt, Human
uuucacauuuaaauaaa

SEQ ID NO: 2238394 - RNA, 18 nt, Human
gacauuugcucauggaau

SEQ ID NO: 2238395 - RNA, 16 nt, Human
uugccauaauuacuau

SEQ ID NO: 2238396 - RNA, 21 nt, Human
cucaguccaugaagauguaga

SEQ ID NO: 2238397 - RNA, 14 nt, Human
uccagauccuggaa

SEQ ID NO: 2238398 - RNA, 16 nt, Human
ccuaugcagaggucca

SEQ ID NO: 2238399 - RNA, 17 nt, Human
aaauccuacuuucauaa

SEQ ID NO: 2238400 - RNA, 14 nt, Human
ugagacucugucuc

SEQ ID NO: 2238401 - RNA, 22 nt, Human
auggaaauguuuacagaucccc

SEQ ID NO: 2238402 - RNA, 16 nt, Human
auuauacccccugcaa

SEQ ID NO: 2238403 - RNA, 21 nt, Human
ucuucaacucccugcccccca

SEQ ID NO: 2238404 - RNA, 22 nt, Human
uggguuccuuccucugagccuu

SEQ ID NO: 2238405 - RNA, 19 nt, Human
cauggaauuggagcucgug

SEQ ID NO: 2238406 - RNA, 14 nt, Human
ggccgggagccuga

SEQ ID NO: 2238407 - RNA, 22 nt, Human
cccagcccuccuuaucaaagga

SEQ ID NO: 2238408 - RNA, 18 nt, Human
acauuuauauuuuuguga

SEQ ID NO: 2238409 - RNA, 16 nt, Human
ugacacuuaaaaaugg

SEQ ID NO: 2238410 - RNA, 23 nt, Human
cauuguggucacaggaaguagag

SEQ ID NO: 2238411 - RNA, 17 nt, Human
aggccaugggacaggga

SEQ ID NO: 2238412 - RNA, 17 nt, Human
guguccccuauccuacu

SEQ ID NO: 2238413 - RNA, 13 nt, Human
gguccacaacaca

SEQ ID NO: 2238414 - RNA, 19 nt, Human
uccagccuggcaaggguuc

SEQ ID NO: 2238415 - RNA, 17 nt, Human
gaaugagagacacacug

SEQ ID NO: 2238416 - RNA, 20 nt, Human
ggguuccuuccucugagccu

SEQ ID NO: 2238417 - RNA, 23 nt, Human
ggucucagugucaaugcagcccc

SEQ ID NO: 2238418 - RNA, 18 nt, Human
cucuggccuucggccucc

SEQ ID NO: 2238419 - RNA, 23 nt, Human
uagacacacaugaaguccaagca

SEQ ID NO: 2238420 - RNA, 18 nt, Human
aaaagacaaggaaaaaau

SEQ ID NO: 2238421 - RNA, 12 nt, Human
aauugcagagua

SEQ ID NO: 2238422 - RNA, 14 nt, Human
gauaaaagacagug

SEQ ID NO: 2238423 - RNA, 22 nt, Human
cagaguacuggcugauggagua

SEQ ID NO: 2238424 - RNA, 18 nt, Human
uacauuuguauaaaauaa

SEQ ID NO: 2238425 - RNA, 20 nt, Human
ugauuucugagcauuuaaua

SEQ ID NO: 2238426 - RNA, 16 nt, Human
uuguaaaggaauuuaa

SEQ ID NO: 2238427 - RNA, 16 nt, Human
cugagcuugcagagau

SEQ ID NO: 2238428 - RNA, 22 nt, Human
ggcauuuaggccaugggacagg

SEQ ID NO: 2238429 - RNA, 15 nt, Human
gagauuccugagcca

SEQ ID NO: 2238430 - RNA, 20 nt, Human
gaauucauucacucaacaaa

SEQ ID NO: 2238431 - RNA, 14 nt, Human
augauguuuagaaa

SEQ ID NO: 2238432 - RNA, 17 nt, Human
ugaccacugcagaagac

SEQ ID NO: 2238433 - RNA, 18 nt, Human
acaugaacuuguaaagga

SEQ ID NO: 2238434 - RNA, 18 nt, Human
gagucccaggcugagccu

SEQ ID NO: 2238435 - RNA, 22 nt, Human
aaccuacacgagauacagaauu

SEQ ID NO: 2238436 - RNA, 23 nt, Human
ugauggguuucuccagagggaau

SEQ ID NO: 2238437 - RNA, 16 nt, Human
agccucagucucccuc

SEQ ID NO: 2238438 - RNA, 20 nt, Human
agccuuuuuuugaaaaaaag

SEQ ID NO: 2238439 - RNA, 19 nt, Human
ggagccugaucaccugccc

SEQ ID NO: 2238440 - RNA, 15 nt, Human
ccagcacagccucuu

SEQ ID NO: 2238441 - RNA, 20 nt, Human
agaagaacugaaaucauacu

SEQ ID NO: 2238442 - RNA, 19 nt, Human
aggucuaccaaaaaucuca

SEQ ID NO: 2238443 - RNA, 12 nt, Human
gaauuggagcuc

SEQ ID NO: 2238444 - RNA, 18 nt, Human
caugaagauguagaggag

SEQ ID NO: 2238445 - RNA, 16 nt, Human
cccuauccuacuuccc

SEQ ID NO: 2238446 - RNA, 14 nt, Human
auccuugaagauuu

SEQ ID NO: 2238447 - RNA, 20 nt, Human
auaauccuaaacauaugaau

SEQ ID NO: 2238448 - RNA, 18 nt, Human
acauuugcucauggaauu

SEQ ID NO: 2238449 - RNA, 21 nt, Human
aucuuuuuuuuaauaaaccau

SEQ ID NO: 2238450 - RNA, 18 nt, Human
auuuauuacuguaagaaa

SEQ ID NO: 2238451 - RNA, 20 nt, Human
uguaagaaaauaucacuugu

SEQ ID NO: 2238452 - RNA, 18 nt, Human
cccaagccuggcaaggga

SEQ ID NO: 2238453 - RNA, 21 nt, Human
auuuuaguaagagauuccuga

SEQ ID NO: 2238454 - RNA, 14 nt, Human
uucuaugaaauauu

SEQ ID NO: 2238455 - RNA, 12 nt, Human
cccccagcccuc

SEQ ID NO: 2238456 - RNA, 13 nt, Human
aggcuagauguau

SEQ ID NO: 2238457 - RNA, 14 nt, Human
ugaagauguagagg

SEQ ID NO: 2238458 - RNA, 23 nt, Human
ggcuaagcuucacuguaaaauaa

SEQ ID NO: 2238459 - RNA, 21 nt, Human
cuucuaaccugaacugauggg

SEQ ID NO: 2238460 - RNA, 19 nt, Human
guuauuauauuuacaaaug

SEQ ID NO: 2238461 - RNA, 16 nt, Human
ccugccccccagcccu

SEQ ID NO: 2238462 - RNA, 22 nt, Human
cuggcaaggguucaccugggcu

SEQ ID NO: 2238463 - RNA, 23 nt, Human
ggaacaguuaccucugccucaga

SEQ ID NO: 2238464 - RNA, 13 nt, Human
aggauuugaaauu

SEQ ID NO: 2238465 - RNA, 21 nt, Human
aaguuuaugguuguauuauuu

SEQ ID NO: 2238466 - RNA, 14 nt, Human
acauagugaggagc

SEQ ID NO: 2238467 - RNA, 24 nt, Human
ccccugagcuugcagagaugaggc

SEQ ID NO: 2238468 - RNA, 13 nt, Human
caacaucuaguga

SEQ ID NO: 2238469 - RNA, 20 nt, Human
ugagcagugcuugaaugaag

SEQ ID NO: 2238470 - RNA, 20 nt, Human
augcuucuguuuuauaauuu

SEQ ID NO: 2238471 - RNA, 14 nt, Human
cucccugcccccca

SEQ ID NO: 2238472 - RNA, 18 nt, Human
auuaaguuuuuuuuuaaa

SEQ ID NO: 2238473 - RNA, 16 nt, Human
aaauauuauguuaaaa

SEQ ID NO: 2238474 - RNA, 22 nt, Human
cccaugauguuuagaaacacaa

SEQ ID NO: 2238475 - RNA, 19 nt, Human
uucccuugaugaagaaguu

SEQ ID NO: 2238476 - RNA, 16 nt, Human
uucccaacuccagaaa

SEQ ID NO: 2238477 - RNA, 17 nt, Human
uuauaucaauuuaaaaa

SEQ ID NO: 2238478 - RNA, 15 nt, Human
uggacgagaaaacaa

SEQ ID NO: 2238479 - RNA, 15 nt, Human
aauacuuuauaaagg

SEQ ID NO: 2238480 - RNA, 16 nt, Human
gaaucacuugaacccg

SEQ ID NO: 2238481 - RNA, 21 nt, Human
gacagaaagcagaacagugau

SEQ ID NO: 2238482 - RNA, 18 nt, Human
gccugagcgacagugaga

SEQ ID NO: 2238483 - RNA, 20 nt, Human
ggccaugggacagggaggac

SEQ ID NO: 2238484 - RNA, 16 nt, Human
acagagacagaaagca

SEQ ID NO: 2238485 - RNA, 16 nt, Human
aggccaugggacaggg

SEQ ID NO: 2238486 - RNA, 17 nt, Human
agaaaugaaagcaggga

SEQ ID NO: 2238487 - RNA, 17 nt, Human
aaagaaacauuugguaa

SEQ ID NO: 2238488 - RNA, 17 nt, Human
auguuuacagaucccca

SEQ ID NO: 2238489 - RNA, 15 nt, Human
augggacagggagga

SEQ ID NO: 2238490 - RNA, 14 nt, Human
aagcucuaucacca

SEQ ID NO: 2238491 - RNA, 21 nt, Human
aauaauguuucaaacauauau

SEQ ID NO: 2238492 - RNA, 16 nt, Human
cagcuucucauccugc

SEQ ID NO: 2238493 - RNA, 19 nt, Human
guccaggucuaccaaaaau

SEQ ID NO: 2238494 - RNA, 16 nt, Human
cagucucccucccuug

SEQ ID NO: 2238495 - RNA, 20 nt, Human
aaaagacagugaaagaaaau

SEQ ID NO: 2238496 - RNA, 23 nt, Human
gaggcauuuaggccaugggacag

SEQ ID NO: 2238497 - RNA, 14 nt, Human
aauugcagaguacu

SEQ ID NO: 2238498 - RNA, 14 nt, Human
cucugccucagaaa

SEQ ID NO: 2238499 - RNA, 20 nt, Human
aaucuuucacaggggacagg

SEQ ID NO: 2238500 - RNA, 14 nt, Human
auaaaauaauuuuu

SEQ ID NO: 2238501 - RNA, 22 nt, Human
uugacccacaagaaaugaaagc

SEQ ID NO: 2238502 - RNA, 16 nt, Human
cauuuguauaaaauaa

SEQ ID NO: 2238503 - RNA, 16 nt, Human
ccccaucucuucuggg

SEQ ID NO: 2238504 - RNA, 15 nt, Human
uuagugaaauauuau

SEQ ID NO: 2238505 - RNA, 15 nt, Human
ccagauccuggaaau

SEQ ID NO: 2238506 - RNA, 20 nt, Human
cucuguucugcacacagcac

SEQ ID NO: 2238507 - RNA, 19 nt, Human
gccccccagcccuccuuau

SEQ ID NO: 2238508 - RNA, 17 nt, Human
caagaaaugaaagcagg

SEQ ID NO: 2238509 - RNA, 16 nt, Human
acauccuacaagacac

SEQ ID NO: 2238510 - RNA, 17 nt, Human
guugcugggggggauug

SEQ ID NO: 2238511 - RNA, 15 nt, Human
uccauccugaggcuc

SEQ ID NO: 2238512 - RNA, 12 nt, Human
acagagacagaa

SEQ ID NO: 2238513 - RNA, 17 nt, Human
cccaggcugagccucag

SEQ ID NO: 2238514 - RNA, 14 nt, Human
aauauaaauaaaaa

SEQ ID NO: 2238515 - RNA, 12 nt, Human
ccaggcugagcc

SEQ ID NO: 2238516 - RNA, 17 nt, Human
agaugggagaaucacuu

SEQ ID NO: 2238517 - RNA, 23 nt, Human
agcagugcuugaaugaaguugua

SEQ ID NO: 2238518 - RNA, 17 nt, Human
uuauauuugaaauauug

SEQ ID NO: 2238519 - RNA, 13 nt, Human
cgggaggcagagg

SEQ ID NO: 2238520 - RNA, 21 nt, Human
ugaaauggacuuuuguacaua

SEQ ID NO: 2238521 - RNA, 20 nt, Human
aacaagccuccuuuuaaagu

SEQ ID NO: 2238522 - RNA, 17 nt, Human
aucaaggguacacugcc

SEQ ID NO: 2238523 - RNA, 15 nt, Human
cugacucuuaagaag

SEQ ID NO: 2238524 - RNA, 15 nt, Human
ugcaauuccacuuau

SEQ ID NO: 2238525 - RNA, 18 nt, Human
auggugaaaugcagaguc

SEQ ID NO: 2238526 - RNA, 20 nt, Human
gcccauccugccccugagcc

SEQ ID NO: 2238527 - RNA, 20 nt, Human
gauugugccccugcacucca

SEQ ID NO: 2238528 - RNA, 20 nt, Human
aagcuucacuguaaaauaau

SEQ ID NO: 2238529 - RNA, 17 nt, Human
aggcuagaaccaccugc

SEQ ID NO: 2238530 - RNA, 16 nt, Human
uaucaaaagaaagaaa

SEQ ID NO: 2238531 - RNA, 19 nt, Human
gcucauggaauuggagcuc

SEQ ID NO: 2238532 - RNA, 23 nt, Human
aucacagcuacuugggaggcuga

SEQ ID NO: 2238533 - RNA, 21 nt, Human
uacaugagguacugagaguga

SEQ ID NO: 2238534 - RNA, 16 nt, Human
agaugcuagaacuccc

SEQ ID NO: 2238535 - RNA, 12 nt, Human
agugcagccccg

SEQ ID NO: 2238536 - RNA, 15 nt, Human
aaaaauaacaaugaa

SEQ ID NO: 2238537 - RNA, 22 nt, Human
ccacagcuguaugauucccagc

SEQ ID NO: 2238538 - RNA, 14 nt, Human
cugagucccaggcu

SEQ ID NO: 2238539 - RNA, 14 nt, Human
aaaggaauuuaaaa

SEQ ID NO: 2238540 - RNA, 18 nt, Human
agccugaucaccugcccu

SEQ ID NO: 2238541 - RNA, 15 nt, Human
guacuggcugaugga

SEQ ID NO: 2238542 - RNA, 20 nt, Human
gaacguaaucguguccccua

SEQ ID NO: 2238543 - RNA, 18 nt, Human
cauagguuuaauaauuuu

SEQ ID NO: 2238544 - RNA, 13 nt, Human
auccugcaggcag

SEQ ID NO: 2238545 - RNA, 23 nt, Human
acucuauguucuaagaagugaaa

SEQ ID NO: 2238546 - RNA, 11 nt, Human
acugggacagg

SEQ ID NO: 2238547 - RNA, 19 nt, Human
cuaguaucaaaagaaagaa

SEQ ID NO: 2238548 - RNA, 15 nt, Human
uucggccuccauccu

SEQ ID NO: 2238549 - RNA, 22 nt, Human
aauuguauuuuaguaagagauu

SEQ ID NO: 2238550 - RNA, 16 nt, Human
uguccccuauccuacu

SEQ ID NO: 2238551 - RNA, 16 nt, Human
caggaaguagaggagg

SEQ ID NO: 2238552 - RNA, 14 nt, Human
cugcaaagcccagc

SEQ ID NO: 2238553 - RNA, 20 nt, Human
gaaaauaacgauaaaagaca

SEQ ID NO: 2238554 - RNA, 17 nt, Human
agucugacuguuuccau

SEQ ID NO: 2238555 - RNA, 14 nt, Human
cuuucauaauaagu

SEQ ID NO: 2238556 - RNA, 19 nt, Human
gucaaauugugugaaaggu

SEQ ID NO: 2238557 - RNA, 17 nt, Human
aauucuugccaaauaua

SEQ ID NO: 2238558 - RNA, 14 nt, Human
cagucugaugagaa

SEQ ID NO: 2238559 - RNA, 15 nt, Human
acaucaacagauaaa

SEQ ID NO: 2238560 - RNA, 18 nt, Human
acagaaagcagaacagug

SEQ ID NO: 2238561 - RNA, 23 nt, Human
ucaauaucuuuuuuuuaauaaac

SEQ ID NO: 2238562 - RNA, 24 nt, Human
cauaugaaaaggcuaagcuucacu

SEQ ID NO: 2238563 - RNA, 20 nt, Human
ugauuauaugucacuuugcu

SEQ ID NO: 2238564 - RNA, 16 nt, Human
cugcucucaguucacu

SEQ ID NO: 2238565 - RNA, 19 nt, Human
ugagcgcccacuagaccca

SEQ ID NO: 2238566 - RNA, 22 nt, Human
aauuacauuuguauaaaauaau

SEQ ID NO: 2238567 - RNA, 19 nt, Human
ccaccugccuauauuuuuu

SEQ ID NO: 2238568 - RNA, 23 nt, Human
aggcaugagucagucugaugaga

SEQ ID NO: 2238569 - RNA, 20 nt, Human
aauaagccagacaucaacag

SEQ ID NO: 2238570 - RNA, 14 nt, Human
acuaauuuuaaaau

SEQ ID NO: 2238571 - RNA, 23 nt, Human
cuacacgagauacagaauuuuau

SEQ ID NO: 2238572 - RNA, 14 nt, Human
gagcccauggcacu

SEQ ID NO: 2238573 - RNA, 14 nt, Human
accacaagacugca

SEQ ID NO: 2238574 - RNA, 16 nt, Human
cagaagcaacccaaau

SEQ ID NO: 2238575 - RNA, 22 nt, Human
auaucuuuuuuuuaauaaacca

SEQ ID NO: 2238576 - RNA, 19 nt, Human
auguuuacagauccccaag

SEQ ID NO: 2238577 - RNA, 15 nt, Human
cuggguuccuuccuc

SEQ ID NO: 2238578 - RNA, 17 nt, Human
uccauccugaggcucca

SEQ ID NO: 2238579 - RNA, 13 nt, Human
aaaaaugguuuaa

SEQ ID NO: 2238580 - RNA, 18 nt, Human
uccagcuggccgggagcc

SEQ ID NO: 2238581 - RNA, 16 nt, Human
uauuuuugugauuuug

SEQ ID NO: 2238582 - RNA, 23 nt, Human
ggcaaagacuauucccuucuaac

SEQ ID NO: 2238583 - RNA, 20 nt, Human
ccuccugccuaagugcagcc

SEQ ID NO: 2238584 - RNA, 20 nt, Human
ccauuguggucacaggaagu

SEQ ID NO: 2238585 - RNA, 16 nt, Human
uaacaauaaaagacaa

SEQ ID NO: 2238586 - RNA, 19 nt, Human
cccugccccccagcccucc

SEQ ID NO: 2238587 - RNA, 20 nt, Human
guaucaaaagaaagaaaauc

SEQ ID NO: 2238588 - RNA, 15 nt, Human
gacucaccuccccca

SEQ ID NO: 2238589 - RNA, 14 nt, Human
ucaaugcagccccc

SEQ ID NO: 2238590 - RNA, 14 nt, Human
uaguaucaaaagaa

SEQ ID NO: 2238591 - RNA, 22 nt, Human
uacugagagugaacaaauuuac

SEQ ID NO: 2238592 - RNA, 16 nt, Human
cagggcucacagaauu

SEQ ID NO: 2238593 - RNA, 18 nt, Human
uguaaaggaauuuaaaaa

SEQ ID NO: 2238594 - RNA, 21 nt, Human
ugcagaguacuggcugaugga

SEQ ID NO: 2238595 - RNA, 13 nt, Human
caguuauuauauu

SEQ ID NO: 2238596 - RNA, 15 nt, Human
uguauuuuaaaagaa

SEQ ID NO: 2238597 - RNA, 16 nt, Human
ugcauagguuuaauaa

SEQ ID NO: 2238598 - RNA, 22 nt, Human
cagcacgggggccaaggaugcc

SEQ ID NO: 2238599 - RNA, 19 nt, Human
cacaggaaccacaagacug

SEQ ID NO: 2238600 - RNA, 19 nt, Human
uggcaagcucuaucaccaa

SEQ ID NO: 2238601 - RNA, 21 nt, Human
gaaaaaaagcuuuuuuugaau

SEQ ID NO: 2238602 - RNA, 23 nt, Human
auaucuuuuuuuuaauaaaccau

SEQ ID NO: 2238603 - RNA, 18 nt, Human
uaguaucaaaagaaagaa

SEQ ID NO: 2238604 - RNA, 22 nt, Human
uaaaauaauuuuuauauuugaa

SEQ ID NO: 2238605 - RNA, 19 nt, Human
aguauuucuaugaaauauu

SEQ ID NO: 2238606 - RNA, 20 nt, Human
cugcacacagcacgggggcc

SEQ ID NO: 2238607 - RNA, 22 nt, Human
agccaaacauccuacaagacac

SEQ ID NO: 2238608 - RNA, 16 nt, Human
ucugcagauaaacagu

SEQ ID NO: 2238609 - RNA, 22 nt, Human
uugaaaaucuuauaauuuaaaa

SEQ ID NO: 2238610 - RNA, 19 nt, Human
uauacugugugcuaaaaca

SEQ ID NO: 2238611 - RNA, 22 nt, Human
caucgcaauguaagacucggga

SEQ ID NO: 2238612 - RNA, 14 nt, Human
cauagaaguaaaaa

SEQ ID NO: 2238613 - RNA, 13 nt, Human
caccaaggagcca

SEQ ID NO: 2238614 - RNA, 18 nt, Human
accaccugccuauauuuu

SEQ ID NO: 2238615 - RNA, 14 nt, Human
uucagccugaaaga

SEQ ID NO: 2238616 - RNA, 14 nt, Human
auauuugaaauauu

SEQ ID NO: 2238617 - RNA, 22 nt, Human
ugaagcaaaauuuuuucucuag

SEQ ID NO: 2238618 - RNA, 13 nt, Human
aaaugggaaacaa

SEQ ID NO: 2238619 - RNA, 14 nt, Human
cugccccccagccc

SEQ ID NO: 2238620 - RNA, 22 nt, Human
aaugggcacaggguuuauguuu

SEQ ID NO: 2238621 - RNA, 20 nt, Human
uuucuucaacucccugcccc

SEQ ID NO: 2238622 - RNA, 15 nt, Human
aauauaaauaaaaau

SEQ ID NO: 2238623 - RNA, 15 nt, Human
uauaaauaaaaauaa

SEQ ID NO: 2238624 - RNA, 14 nt, Human
gagccagugucagg

SEQ ID NO: 2238625 - RNA, 17 nt, Human
caauaacgauaaaagac

SEQ ID NO: 2238626 - RNA, 22 nt, Human
ucaacuccaaacugacucuuaa

SEQ ID NO: 2238627 - RNA, 16 nt, Human
cuucuggguuccuucc

SEQ ID NO: 2238628 - RNA, 20 nt, Human
uguuggugaacuugguuuua

SEQ ID NO: 2238629 - RNA, 21 nt, Human
uuacauuuguauaaaauaauu

SEQ ID NO: 2238630 - RNA, 16 nt, Human
aacaauaaaagacaag

SEQ ID NO: 2238631 - RNA, 22 nt, Human
aagacccaaaaggcagaagcaa

SEQ ID NO: 2238632 - RNA, 14 nt, Human
ccccugagcuugca

SEQ ID NO: 2238633 - RNA, 21 nt, Human
caauuuuguuauguauauuuu

SEQ ID NO: 2238634 - RNA, 13 nt, Human
cuaugaaauauua

SEQ ID NO: 2238635 - RNA, 14 nt, Human
cccugccccccagc

SEQ ID NO: 2238636 - RNA, 17 nt, Human
gacgagaaaacaauaac

SEQ ID NO: 2238637 - RNA, 21 nt, Human
cuaccuuuugcuguggcaaau

SEQ ID NO: 2238638 - RNA, 18 nt, Human
uguggucacaggaaguag

SEQ ID NO: 2238639 - RNA, 17 nt, Human
caaacauauauaacaau

SEQ ID NO: 2238640 - RNA, 15 nt, Human
ucaguuuuugugaaa

SEQ ID NO: 2238641 - RNA, 16 nt, Human
guuccuuccucugagc

SEQ ID NO: 2238642 - RNA, 16 nt, Human
gaaaaaauaacaauga

SEQ ID NO: 2238643 - RNA, 22 nt, Human
cucuggccuucggccuccaucc

SEQ ID NO: 2238644 - RNA, 14 nt, Human
uaguuucccuugca

SEQ ID NO: 2238645 - RNA, 15 nt, Human
ucucauccugcaggc

SEQ ID NO: 2238646 - RNA, 13 nt, Human
ucucccucccuug

SEQ ID NO: 2238647 - RNA, 15 nt, Human
agcucuaucaccaag

SEQ ID NO: 2238648 - RNA, 10 nt, Human
ccugagcccc

SEQ ID NO: 2238649 - RNA, 18 nt, Human
gaugccccgucccccucu

SEQ ID NO: 2238650 - RNA, 13 nt, Human
auugucuagugaa

SEQ ID NO: 2238651 - RNA, 18 nt, Human
ccaaccuggaguugaaaa

SEQ ID NO: 2238652 - RNA, 19 nt, Human
cugccccccagcccuccuu

SEQ ID NO: 2238653 - RNA, 19 nt, Human
ugggacaggggagaaccua

SEQ ID NO: 2238654 - RNA, 19 nt, Human
acaaauuuacagagacaga

SEQ ID NO: 2238655 - RNA, 22 nt, Human
uguucugauauuggacaguaaa

SEQ ID NO: 2238656 - RNA, 15 nt, Human
agacagcucugcaua

SEQ ID NO: 2238657 - RNA, 12 nt, Human
auaacuggaaac

SEQ ID NO: 2238658 - RNA, 18 nt, Human
uaaaauccauacauuugu

SEQ ID NO: 2238659 - RNA, 19 nt, Human
cugcaaagcccagcuugaa

SEQ ID NO: 2238660 - RNA, 18 nt, Human
accaggcuugccugcagg

SEQ ID NO: 2238661 - RNA, 18 nt, Human
guuuaugguuguauuauu

SEQ ID NO: 2238662 - RNA, 16 nt, Human
aauauaaauaaaaaua

SEQ ID NO: 2238663 - RNA, 16 nt, Human
gagcucgugggacagu

SEQ ID NO: 2238664 - RNA, 18 nt, Human
cuuccucugagccuuggg

SEQ ID NO: 2238665 - RNA, 17 nt, Human
ucuuauaauuuaaaaua

SEQ ID NO: 2238666 - RNA, 18 nt, Human
cuggaaacuucagcgguu

SEQ ID NO: 2238667 - RNA, 18 nt, Human
cucccuuggggccuaugc

SEQ ID NO: 2238668 - RNA, 16 nt, Human
uagcuacuaauuuuaa

SEQ ID NO: 2238669 - RNA, 20 nt, Human
cucccugccccccagcccuc

SEQ ID NO: 2238670 - RNA, 15 nt, Human
ggcagcuuuuucucu

SEQ ID NO: 2238671 - RNA, 16 nt, Human
ccuggugggcagagag

SEQ ID NO: 2238672 - RNA, 23 nt, Human
cacaagaaaugaaagcagggacu

SEQ ID NO: 2238673 - RNA, 14 nt, Human
cuaagucuuauaua

SEQ ID NO: 2238674 - RNA, 18 nt, Human
aaauauaaauaaaaauaa

SEQ ID NO: 2238675 - RNA, 18 nt, Human
cccucuggcuccagcugg

SEQ ID NO: 2238676 - RNA, 17 nt, Human
ccugcaggcaugaguca

SEQ ID NO: 2238677 - RNA, 19 nt, Human
uagugagcagucaggaaag

SEQ ID NO: 2238678 - RNA, 23 nt, Human
cugaaaucauacuucuuaggguu

SEQ ID NO: 2238679 - RNA, 18 nt, Human
ugugaccacugcagaaga

SEQ ID NO: 2238680 - RNA, 22 nt, Human
cuccagccugagcgacagugag

SEQ ID NO: 2238681 - RNA, 19 nt, Human
augaaguacucauacaugu

SEQ ID NO: 2238682 - RNA, 22 nt, Human
auauauaacaaugcuguauuuu

SEQ ID NO: 2238683 - RNA, 23 nt, Human
ugcauagguuuaauaauuuuuaa

SEQ ID NO: 2238684 - RNA, 13 nt, Human
cccugcacuccag

SEQ ID NO: 2238685 - RNA, 23 nt, Human
cucuacuaaaaauacaaaaaaaa

SEQ ID NO: 2238686 - RNA, 16 nt, Human
ugacuuaaugccacua

SEQ ID NO: 2238687 - RNA, 11 nt, Human
caucuagugag

SEQ ID NO: 2238688 - RNA, 15 nt, Human
ugagcgcccacuaga

SEQ ID NO: 2238689 - RNA, 14 nt, Human
cgucccccucuggc

SEQ ID NO: 2238690 - RNA, 18 nt, Human
uuggggccuaugcagagg

SEQ ID NO: 2238691 - RNA, 17 nt, Human
ggccaugggacagggag

SEQ ID NO: 2238692 - RNA, 21 nt, Human
ccccugcaaagcccagcuuga

SEQ ID NO: 2238693 - RNA, 13 nt, Human
uuuaaaaauccua

SEQ ID NO: 2238694 - RNA, 13 nt, Human
uauuucuaugaaa

SEQ ID NO: 2238695 - RNA, 14 nt, Human
agauguagaggaga

SEQ ID NO: 2238696 - RNA, 21 nt, Human
uuauagcuacuaauuuuaaaa

SEQ ID NO: 2238697 - RNA, 20 nt, Human
agccuaguugaucagcuuau

SEQ ID NO: 2238698 - RNA, 23 nt, Human
uguagguagaucuggucuuuaga

SEQ ID NO: 2238699 - RNA, 19 nt, Human
ggacucaccucccccaucu

SEQ ID NO: 2238700 - RNA, 19 nt, Human
cagcacgggggccaaggau

SEQ ID NO: 2238701 - RNA, 19 nt, Human
gcuaccuuuugcuguggca

SEQ ID NO: 2238702 - RNA, 21 nt, Human
cuaguaucaaaagaaagaaaa

SEQ ID NO: 2238703 - RNA, 16 nt, Human
ugaauuaguuuuauau

SEQ ID NO: 2238704 - RNA, 17 nt, Human
ccugccccccagcccuc

SEQ ID NO: 2238705 - RNA, 16 nt, Human
uuuuagugaaauauua

SEQ ID NO: 2238706 - RNA, 15 nt, Human
caggaggaaggcuua

SEQ ID NO: 2238707 - RNA, 14 nt, Human
uuuuaaaaaagaaa

SEQ ID NO: 2238708 - RNA, 15 nt, Human
uaacaauaaaagaca

SEQ ID NO: 2238709 - RNA, 19 nt, Human
cucugcauacucauuagga

SEQ ID NO: 2238710 - RNA, 15 nt, Human
ucagucucccucccu

SEQ ID NO: 2238711 - RNA, 13 nt, Human
uguauauuuuaua

SEQ ID NO: 2238712 - RNA, 18 nt, Human
uucaauaucuuuuuuuua

SEQ ID NO: 2238713 - RNA, 15 nt, Human
gaaagaaaauaacga

SEQ ID NO: 2238714 - RNA, 15 nt, Human
auaauuuugugaagc

SEQ ID NO: 2238715 - RNA, 12 nt, Human
ggcugaugcagu

SEQ ID NO: 2238716 - RNA, 17 nt, Human
ugaaauauuauuuuaua

SEQ ID NO: 2238717 - RNA, 21 nt, Human
cuccagcuggccgggagccug

SEQ ID NO: 2238718 - RNA, 11 nt, Human
aauuccacagc

SEQ ID NO: 2238719 - RNA, 21 nt, Human
uuuauauaagcuuguauuccu

SEQ ID NO: 2238720 - RNA, 15 nt, Human
ccuggugggcagaga

SEQ ID NO: 2238721 - RNA, 14 nt, Human
accauuuuuacuug

SEQ ID NO: 2238722 - RNA, 17 nt, Human
ucauccugcaggcagcu

SEQ ID NO: 2238723 - RNA, 22 nt, Human
aauuuaaaaaaaaaccugagcc

SEQ ID NO: 2238724 - RNA, 13 nt, Human
augcuagaacucc

SEQ ID NO: 2238725 - RNA, 19 nt, Human
caaggaugccccguccccc

SEQ ID NO: 2238726 - RNA, 16 nt, Human
acaaauccaaugaaau

SEQ ID NO: 2238727 - RNA, 21 nt, Human
uagggugauauuaaccagggg

SEQ ID NO: 2238728 - RNA, 14 nt, Human
aaaagacagugaaa

SEQ ID NO: 2238729 - RNA, 22 nt, Human
caccagucugacuguuuccauc

SEQ ID NO: 2238730 - RNA, 16 nt, Human
accucugccucagaaa

SEQ ID NO: 2238731 - RNA, 23 nt, Human
ucuccauguacuggcaagaccug

SEQ ID NO: 2238732 - RNA, 14 nt, Human
ccagcuggccggga

SEQ ID NO: 2238733 - RNA, 14 nt, Human
uccacaacacacag

SEQ ID NO: 2238734 - RNA, 14 nt, Human
cuugagguaaaagc

SEQ ID NO: 2238735 - RNA, 23 nt, Human
aggcuuacacccacaguggaaag

SEQ ID NO: 2238736 - RNA, 18 nt, Human
aagggaauuucuucaacu

SEQ ID NO: 2238737 - RNA, 19 nt, Human
auuggagcucgugggacag

SEQ ID NO: 2238738 - RNA, 12 nt, Human
gaaaauaacaau

SEQ ID NO: 2238739 - RNA, 15 nt, Human
cuaucuuugagcgcc

SEQ ID NO: 2238740 - RNA, 13 nt, Human
uccuacuuccccu

SEQ ID NO: 2238741 - RNA, 21 nt, Human
cucuucuggguuccuuccucu

SEQ ID NO: 2238742 - RNA, 20 nt, Human
aaauaauuuuuauauuugaa

SEQ ID NO: 2238743 - RNA, 20 nt, Human
uauaugcuaagucuuauaua

SEQ ID NO: 2238744 - RNA, 22 nt, Human
agaauuuuaugcggcauuuucu

SEQ ID NO: 2238745 - RNA, 19 nt, Human
guaguccuguaauggaagc

SEQ ID NO: 2238746 - RNA, 16 nt, Human
caggcuugccugcagg

SEQ ID NO: 2238747 - RNA, 17 nt, Human
ccccaguuguuucuacu

SEQ ID NO: 2238748 - RNA, 21 nt, Human
cauuucuugagguaaaagcau

SEQ ID NO: 2238749 - RNA, 17 nt, Human
cagugaaagaaaauaac

SEQ ID NO: 2238750 - RNA, 17 nt, Human
aaaguacaagagcuuaa

SEQ ID NO: 2238751 - RNA, 14 nt, Human
acaaauccaaugaa

SEQ ID NO: 2238752 - RNA, 18 nt, Human
aucuuauaauuuaaaaua

SEQ ID NO: 2238753 - RNA, 15 nt, Human
aaaagacaaggaaaa

SEQ ID NO: 2238754 - RNA, 13 nt, Human
aaaauaacaauga

SEQ ID NO: 2238755 - RNA, 17 nt, Human
auggcuaguaucaaaag

SEQ ID NO: 2238756 - RNA, 19 nt, Human
cuuccuaauuccacagcug

SEQ ID NO: 2238757 - RNA, 21 nt, Human
gcacuguggguagacacacau

SEQ ID NO: 2238758 - RNA, 21 nt, Human
ccuuuuuuugaaaaaaagcuu

SEQ ID NO: 2238759 - RNA, 16 nt, Human
uaggauguugaaaaag

SEQ ID NO: 2238760 - RNA, 19 nt, Human
agccugaucaccugcccug

SEQ ID NO: 2238761 - RNA, 14 nt, Human
gcuggagcucugcc

SEQ ID NO: 2238762 - RNA, 19 nt, Human
agaugcuagaacucccuuu

SEQ ID NO: 2238763 - RNA, 18 nt, Human
uagugaaauauuauuuua

SEQ ID NO: 2238764 - RNA, 19 nt, Human
auuauuuuuuaaaaaaauu

SEQ ID NO: 2238765 - RNA, 21 nt, Human
gaacuuuccacauucagagcu

SEQ ID NO: 2238766 - RNA, 15 nt, Human
gauccugcaauucca

SEQ ID NO: 2238767 - RNA, 15 nt, Human
augguuguauuauuu

SEQ ID NO: 2238768 - RNA, 20 nt, Human
ucaggaggaaggcuuacacc

SEQ ID NO: 2238769 - RNA, 15 nt, Human
ccacaagaaaugaaa

SEQ ID NO: 2238770 - RNA, 21 nt, Human
accaaggagccaaacauccua

SEQ ID NO: 2238771 - RNA, 16 nt, Human
aaaugggaaacaaaag

SEQ ID NO: 2238772 - RNA, 18 nt, Human
auucuugccaaauauaaa

SEQ ID NO: 2238773 - RNA, 17 nt, Human
cuggacucaccuccccc

SEQ ID NO: 2238774 - RNA, 16 nt, Human
uaaauaaaaauaaucc

SEQ ID NO: 2238775 - RNA, 16 nt, Human
uuauaauuuaaaauau

SEQ ID NO: 2238776 - RNA, 21 nt, Human
ucauucacucaacaaacauaa

SEQ ID NO: 2238777 - RNA, 16 nt, Human
gcuuuuucucucccac

SEQ ID NO: 2238778 - RNA, 17 nt, Human
uuccaagccucaugucc

SEQ ID NO: 2238779 - RNA, 15 nt, Human
gcaggcaugagucag

SEQ ID NO: 2238780 - RNA, 14 nt, Human
cuccagugagacag

SEQ ID NO: 2238781 - RNA, 20 nt, Human
ccagcuugaaaccuucacuu

SEQ ID NO: 2238782 - RNA, 12 nt, Human
uuuuuuuuaaaa

SEQ ID NO: 2238783 - RNA, 13 nt, Human
ugaaaugcagagu

SEQ ID NO: 2238784 - RNA, 12 nt, Human
acucccugcccc

SEQ ID NO: 2238785 - RNA, 22 nt, Human
cuaagcuucacuguaaaauaau

SEQ ID NO: 2238786 - RNA, 12 nt, Human
acugaaaucaua

SEQ ID NO: 2238787 - RNA, 16 nt, Human
aaauauuuauuuuaau

SEQ ID NO: 2238788 - RNA, 22 nt, Human
ccucccuuggggccuaugcaga

SEQ ID NO: 2238789 - RNA, 13 nt, Human
aacaagccuccuu

SEQ ID NO: 2238790 - RNA, 19 nt, Human
acuucagcgguuuauauaa

SEQ ID NO: 2238791 - RNA, 14 nt, Human
cuguaaucacagcu

SEQ ID NO: 2238792 - RNA, 16 nt, Human
cuuauaauuuaaaaua

SEQ ID NO: 2238793 - RNA, 13 nt, Human
ccacaacacacag

SEQ ID NO: 2238794 - RNA, 13 nt, Human
uaauuuuuauauu

SEQ ID NO: 2238795 - RNA, 14 nt, Human
aagaagugaaaauc

SEQ ID NO: 2238796 - RNA, 15 nt, Human
ccucauguccacugg

SEQ ID NO: 2238797 - RNA, 18 nt, Human
ugaaaaaguucugcagau

SEQ ID NO: 2238798 - RNA, 14 nt, Human
agagacagaaagca

SEQ ID NO: 2238799 - RNA, 16 nt, Human
uaaaggaauuuaaaaa

SEQ ID NO: 2238800 - RNA, 18 nt, Human
aaggaugccccguccccc

SEQ ID NO: 2238801 - RNA, 16 nt, Human
caggcugagccucagu

SEQ ID NO: 2238802 - RNA, 16 nt, Human
ucaccugggcugaggc

SEQ ID NO: 2238803 - RNA, 14 nt, Human
cacuuauaggaauu

SEQ ID NO: 2238804 - RNA, 18 nt, Human
acugugugcuaaaacaag

SEQ ID NO: 2238805 - RNA, 20 nt, Human
agaugcaguucugaagaaga

SEQ ID NO: 2238806 - RNA, 15 nt, Human
uugcucauggaauug

SEQ ID NO: 2238807 - RNA, 13 nt, Human
cugagagugaaca

SEQ ID NO: 2238808 - RNA, 15 nt, Human
guaaggggaauugag

SEQ ID NO: 2238809 - RNA, 19 nt, Human
aaguugcauagguuuaaua

SEQ ID NO: 2238810 - RNA, 13 nt, Human
aagcauuccaacu

SEQ ID NO: 2238811 - RNA, 18 nt, Human
cauggaauuggagcucgu

SEQ ID NO: 2238812 - RNA, 20 nt, Human
uaacgauaaaagacagugaa

SEQ ID NO: 2238813 - RNA, 21 nt, Human
guauacugugugcuaaaacaa

SEQ ID NO: 2238814 - RNA, 15 nt, Human
uggacucaccucccc

SEQ ID NO: 2238815 - RNA, 14 nt, Human
agcaaguauuagaa

SEQ ID NO: 2238816 - RNA, 19 nt, Human
uguauacugugugcuaaaa

SEQ ID NO: 2238817 - RNA, 16 nt, Human
aaauaacaaugaaagu

SEQ ID NO: 2238818 - RNA, 22 nt, Human
gugaacaaauuuacagagacag

SEQ ID NO: 2238819 - RNA, 17 nt, Human
cucagucucccucccuu

SEQ ID NO: 2238820 - RNA, 22 nt, Human
caguauggcagcuuuccucaaa

SEQ ID NO: 2238821 - RNA, 13 nt, Human
auugcaaggcaaa

SEQ ID NO: 2238822 - RNA, 16 nt, Human
augccccgucccccuc

SEQ ID NO: 2238823 - RNA, 14 nt, Human
aauauuauuuuaua

SEQ ID NO: 2238824 - RNA, 19 nt, Human
auaauuuuuauauuugaaa

SEQ ID NO: 2238825 - RNA, 15 nt, Human
cugaaagaggaauga

SEQ ID NO: 2238826 - RNA, 22 nt, Human
cauaaauguugacaugggacau

SEQ ID NO: 2238827 - RNA, 20 nt, Human
augaaguuguagguaauauu

SEQ ID NO: 2238828 - RNA, 21 nt, Human
uauuacuguaagaaaauauca

SEQ ID NO: 2238829 - RNA, 18 nt, Human
uaauuuuaacucuauaau

SEQ ID NO: 2238830 - RNA, 21 nt, Human
acagugauuaccagggacuga

SEQ ID NO: 2238831 - RNA, 19 nt, Human
auuuugugaagcaaaauuu

SEQ ID NO: 2238832 - RNA, 17 nt, Human
caccucccccaucucuu

SEQ ID NO: 2238833 - RNA, 17 nt, Human
agugauuaccagggacu

SEQ ID NO: 2238834 - RNA, 19 nt, Human
acuggacucaccuccccca

SEQ ID NO: 2238835 - RNA, 22 nt, Human
auauaaauaaaaauaauccuca

SEQ ID NO: 2238836 - RNA, 19 nt, Human
ccgggcgugguggugagug

SEQ ID NO: 2238837 - RNA, 23 nt, Human
ggucuaucuuugagcgcccacua

SEQ ID NO: 2238838 - RNA, 21 nt, Human
uauaaaauaauuuuuauauuu

SEQ ID NO: 2238839 - RNA, 21 nt, Human
uguaaaauggugugaccacug

SEQ ID NO: 2238840 - RNA, 13 nt, Human
uaacgauaaaaga

SEQ ID NO: 2238841 - RNA, 21 nt, Human
caucuagcaugucgucaaagc

SEQ ID NO: 2238842 - RNA, 13 nt, Human
uuauguuuaauuc

SEQ ID NO: 2238843 - RNA, 20 nt, Human
accugauuucugagcauuua

SEQ ID NO: 2238844 - RNA, 21 nt, Human
aaaaaguucugcagauaaaca

SEQ ID NO: 2238845 - RNA, 20 nt, Human
uugauaaguacaugauaagc

SEQ ID NO: 2238846 - RNA, 13 nt, Human
uuaaauuguaaua

SEQ ID NO: 2238847 - RNA, 14 nt, Human
cagauuugagcuca

SEQ ID NO: 2238848 - RNA, 14 nt, Human
aauaguuuaugauu

SEQ ID NO: 2238849 - RNA, 19 nt, Human
ugaacaaauuuacagagac

SEQ ID NO: 2238850 - RNA, 18 nt, Human
acugacucuuaagaagac

SEQ ID NO: 2238851 - RNA, 17 nt, Human
cuuccuaauuccacagc

SEQ ID NO: 2238852 - RNA, 21 nt, Human
aaacgaggauugggaaaaagu

SEQ ID NO: 2238853 - RNA, 17 nt, Human
ccucuggcuccagcugg

SEQ ID NO: 2238854 - RNA, 17 nt, Human
cuaagcuucacuguaaa

SEQ ID NO: 2238855 - RNA, 15 nt, Human
cuuaagaagacugca

SEQ ID NO: 2238856 - RNA, 13 nt, Human
auaaauaaaaaua

SEQ ID NO: 2238857 - RNA, 11 nt, Human
ggucacaggaa

SEQ ID NO: 2238858 - RNA, 22 nt, Human
ugucucuacuaaaaauacaaaa

SEQ ID NO: 2238859 - RNA, 22 nt, Human
auaacaaugcuguauuuuaaaa

SEQ ID NO: 2238860 - RNA, 16 nt, Human
uucaguuauuauauuu

SEQ ID NO: 2238861 - RNA, 17 nt, Human
ucugugagaugcuagaa

SEQ ID NO: 2238862 - RNA, 19 nt, Human
gaaagaaaauaacaauaaa

SEQ ID NO: 2238863 - RNA, 21 nt, Human
ccucuguucugcacacagcac

SEQ ID NO: 2238864 - RNA, 22 nt, Human
gcuugcagagaugaggccgcca

SEQ ID NO: 2238865 - RNA, 20 nt, Human
acuucuuaggguuaugauua

SEQ ID NO: 2238866 - RNA, 14 nt, Human
gaaaaaauaacaau

SEQ ID NO: 2238867 - RNA, 15 nt, Human
agucaccucauggaa

SEQ ID NO: 2238868 - RNA, 23 nt, Human
ggaugaauuaaguuuuuuuuuaa

SEQ ID NO: 2238869 - RNA, 12 nt, Human
cuuccucugagc

SEQ ID NO: 2238870 - RNA, 23 nt, Human
ucuaccaaaaaucucaauauuuc

SEQ ID NO: 2238871 - RNA, 20 nt, Human
ucaauaaaauccauacauuu

SEQ ID NO: 2238872 - RNA, 17 nt, Human
ggagcucguggaacagu

SEQ ID NO: 2238873 - RNA, 21 nt, Human
auaauuuuuauauuugaaaua

SEQ ID NO: 2238874 - RNA, 21 nt, Human
gccugaucaccugcccugcug

SEQ ID NO: 2238875 - RNA, 14 nt, Human
acuggacucaccuc

SEQ ID NO: 2238876 - RNA, 17 nt, Human
agugagacagcucugca

SEQ ID NO: 2238877 - RNA, 15 nt, Human
ggccuccauccugag

SEQ ID NO: 2238878 - RNA, 19 nt, Human
acucugucucaguccauga

SEQ ID NO: 2238879 - RNA, 20 nt, Human
aaaaucuuauaauuuaaaau

SEQ ID NO: 2238880 - RNA, 18 nt, Human
aaaguaacccuacaaaac

SEQ ID NO: 2238881 - RNA, 19 nt, Human
ugaaauuguauuacaaauc

SEQ ID NO: 2238882 - RNA, 23 nt, Human
uagauaggucagugcaaauacuc

SEQ ID NO: 2238883 - RNA, 17 nt, Human
guuuaauucugaaagca

SEQ ID NO: 2238884 - RNA, 15 nt, Human
aaaauacaaaaaaaa

SEQ ID NO: 2238885 - RNA, 21 nt, Human
caaggaaaaaauaacaaugaa

SEQ ID NO: 2238886 - RNA, 18 nt, Human
agaagcaacccaaauguu

SEQ ID NO: 2238887 - RNA, 17 nt, Human
uuaaauggucaauuuug

SEQ ID NO: 2238888 - RNA, 18 nt, Human
agcuucucauccugcagg

SEQ ID NO: 2238889 - RNA, 15 nt, Human
acauccuacaagaca

SEQ ID NO: 2238890 - RNA, 14 nt, Human
ugagcuugcagaga

SEQ ID NO: 2238891 - RNA, 15 nt, Human
auuucuaugaaauau

SEQ ID NO: 2238892 - RNA, 12 nt, Human
cuugguuuuaau

SEQ ID NO: 2238893 - RNA, 16 nt, Human
aguaagagauuccuga

SEQ ID NO: 2238894 - RNA, 18 nt, Human
agcuuacuuaaaauugua

SEQ ID NO: 2238895 - RNA, 13 nt, Human
ugauuauauguca

SEQ ID NO: 2238896 - RNA, 13 nt, Human
gaagaacugaaau

SEQ ID NO: 2238897 - RNA, 13 nt, Human
cucagaaaacaag

SEQ ID NO: 2238898 - RNA, 15 nt, Human
gucaaugcagccccc

SEQ ID NO: 2238899 - RNA, 16 nt, Human
uuaauaauuuuuaauu

SEQ ID NO: 2238900 - RNA, 22 nt, Human
uaauaggcguaacuaauuuuaa

SEQ ID NO: 2238901 - RNA, 15 nt, Human
gccagugucaggagg

SEQ ID NO: 2238902 - RNA, 13 nt, Human
auuuuuuaaaaaa

SEQ ID NO: 2238903 - RNA, 18 nt, Human
uucugauauuggacagua

SEQ ID NO: 2238904 - RNA, 14 nt, Human
auuauuuuuuaaaa

SEQ ID NO: 2238905 - RNA, 14 nt, Human
uauaauuuaaaaua

SEQ ID NO: 2238906 - RNA, 16 nt, Human
ucucuaggaaauauuu

SEQ ID NO: 2238907 - RNA, 20 nt, Human
acagcccuucuuuccacaga

SEQ ID NO: 2238908 - RNA, 15 nt, Human
augauaacuggaaac

SEQ ID NO: 2238909 - RNA, 19 nt, Human
auagcuacuaauuuuaaaa

SEQ ID NO: 2238910 - RNA, 23 nt, Human
ccagagggaauugcagaguacug

SEQ ID NO: 2238911 - RNA, 20 nt, Human
gagccugaucaccugcccug

SEQ ID NO: 2238912 - RNA, 13 nt, Human
uuggacgagaaaa

SEQ ID NO: 2238913 - RNA, 12 nt, Human
aaugcagccccc

SEQ ID NO: 2238914 - RNA, 23 nt, Human
agccuugggaccccugagcuugc

SEQ ID NO: 2238915 - RNA, 23 nt, Human
uguugcccacagcuguaugauuc

SEQ ID NO: 2238916 - RNA, 18 nt, Human
ucaaggguacacugccuu

SEQ ID NO: 2238917 - RNA, 23 nt, Human
ucacaccaggcuugccugcaggc

SEQ ID NO: 2238918 - RNA, 23 nt, Human
ggccuccauccugaggcuccacu

SEQ ID NO: 2238919 - RNA, 19 nt, Human
uuuccugaaaacccuugcc

SEQ ID NO: 2238920 - RNA, 19 nt, Human
accccugagcuugcagaga

SEQ ID NO: 2238921 - RNA, 16 nt, Human
agaacucugagcagug

SEQ ID NO: 2238922 - RNA, 15 nt, Human
auaaaguguuugaaa

SEQ ID NO: 2238923 - RNA, 14 nt, Human
ucccuugaugaaga

SEQ ID NO: 2238924 - RNA, 16 nt, Human
ucuuggucucaguguc

SEQ ID NO: 2238925 - RNA, 21 nt, Human
gauaaaagacagugaaagaaa

SEQ ID NO: 2238926 - RNA, 14 nt, Human
cugaggcuccacuu

SEQ ID NO: 2238927 - RNA, 22 nt, Human
ucuacuaaaaauacaaaaaaaa

SEQ ID NO: 2238928 - RNA, 21 nt, Human
acaguuaccucugccucagaa

SEQ ID NO: 2238929 - RNA, 13 nt, Human
ccccagcccuccu

SEQ ID NO: 2238930 - RNA, 14 nt, Human
agaaaauaacaaua

SEQ ID NO: 2238931 - RNA, 23 nt, Human
uaauuuguaguguuggagaagaa

SEQ ID NO: 2238932 - RNA, 19 nt, Human
gucuuucacauuuaaauaa

SEQ ID NO: 2238933 - RNA, 20 nt, Human
cacuguggguagacacacau

SEQ ID NO: 2238934 - RNA, 20 nt, Human
uaggaauugacccacaagaa

SEQ ID NO: 2238935 - RNA, 22 nt, Human
agcuuguauuccuuuuucucuc

SEQ ID NO: 2238936 - RNA, 14 nt, Human
auuugaaauuguau

SEQ ID NO: 2238937 - RNA, 19 nt, Human
cggccuccauccugaggcu

SEQ ID NO: 2238938 - RNA, 15 nt, Human
cagugucaggaggaa

SEQ ID NO: 2238939 - RNA, 14 nt, Human
acccgggaggcaga

SEQ ID NO: 2238940 - RNA, 20 nt, Human
uauacugugugcuaaaacaa

SEQ ID NO: 2238941 - RNA, 23 nt, Human
ugcagagguccacaacacacaga

SEQ ID NO: 2238942 - RNA, 23 nt, Human
caucucuucuggguuccuuccuc

SEQ ID NO: 2238943 - RNA, 15 nt, Human
aaaauaacaaugaaa

SEQ ID NO: 2238944 - RNA, 17 nt, Human
uauauuguagauaauac

SEQ ID NO: 2238945 - RNA, 14 nt, Human
uugacccacaagaa

SEQ ID NO: 2238946 - RNA, 22 nt, Human
gaggggagcaugggaagugacg

SEQ ID NO: 2238947 - RNA, 18 nt, Human
cuucacuguaaaauaaua

SEQ ID NO: 2238948 - RNA, 17 nt, Human
uuuuuaauuauauggcu

SEQ ID NO: 2238949 - RNA, 16 nt, Human
ugcaaauugucacagg

SEQ ID NO: 2238950 - RNA, 14 nt, Human
ccuuaucaaaggac

SEQ ID NO: 2238951 - RNA, 16 nt, Human
cugauggguuucucca

SEQ ID NO: 2238952 - RNA, 20 nt, Human
auuacuguaagaaaauauca

SEQ ID NO: 2238953 - RNA, 21 nt, Human
aauaauccucaguuuuuguga

SEQ ID NO: 2238954 - RNA, 16 nt, Human
uauguucuaagaagug

SEQ ID NO: 2238955 - RNA, 20 nt, Human
aagaugguaccaccagucug

SEQ ID NO: 2238956 - RNA, 17 nt, Human
aagacagugaaagaaaa

SEQ ID NO: 2238957 - RNA, 12 nt, Human
acaugagguacu

SEQ ID NO: 2238958 - RNA, 13 nt, Human
ccaggcugagccu

SEQ ID NO: 2238959 - RNA, 23 nt, Human
cuagacccacuggacucaccucc

SEQ ID NO: 2238960 - RNA, 21 nt, Human
agucucccucccuuggggccu

SEQ ID NO: 2238961 - RNA, 18 nt, Human
cuucucacauuuauauuu

SEQ ID NO: 2238962 - RNA, 16 nt, Human
aucaaaagaaagaaaa

SEQ ID NO: 2238963 - RNA, 16 nt, Human
ccuaagugcagccccg

SEQ ID NO: 2238964 - RNA, 21 nt, Human
cugagccucagucucccuccc

SEQ ID NO: 2238965 - RNA, 15 nt, Human
auagaaguaaaaaca

SEQ ID NO: 2238966 - RNA, 15 nt, Human
aagaaaauaacaaua

SEQ ID NO: 2238967 - RNA, 18 nt, Human
aaagagugaaggauuuau

SEQ ID NO: 2238968 - RNA, 19 nt, Human
auugaggacacugauaugg

SEQ ID NO: 2238969 - RNA, 16 nt, Human
ugacaagcucacagac

SEQ ID NO: 2238970 - RNA, 21 nt, Human
aaaauaugccccauucaacau

SEQ ID NO: 2238971 - RNA, 14 nt, Human
uucuggaauaaucc

SEQ ID NO: 2238972 - RNA, 22 nt, Human
cugaggcauccuuccucacacc

SEQ ID NO: 2238973 - RNA, 16 nt, Human
ugccucaccccuugcc

SEQ ID NO: 2238974 - RNA, 13 nt, Human
ccaccugccuaua

SEQ ID NO: 2238975 - RNA, 17 nt, Human
acacuaagagagaauga

SEQ ID NO: 2238976 - RNA, 23 nt, Human
gggagccugaucaccugcccugc

SEQ ID NO: 2238977 - RNA, 22 nt, Human
gaacuuuccacauucagagcuu

SEQ ID NO: 2238978 - RNA, 20 nt, Human
ugaaaaucuuauaauuuaaa

SEQ ID NO: 2238979 - RNA, 11 nt, Human
gccaugggaca

SEQ ID NO: 2238980 - RNA, 16 nt, Human
gugagacagcucugca

SEQ ID NO: 2238981 - RNA, 15 nt, Human
cauguccacugguuc

SEQ ID NO: 2238982 - RNA, 18 nt, Human
cuuuccacagaagcucca

SEQ ID NO: 2238983 - RNA, 17 nt, Human
cuucacuguaaaauaau

SEQ ID NO: 2238984 - RNA, 17 nt, Human
cucgugggacagucacc

SEQ ID NO: 2238985 - RNA, 13 nt, Human
aguuaccucugcc

SEQ ID NO: 2238986 - RNA, 12 nt, Human
uucucuaggaaa

SEQ ID NO: 2238987 - RNA, 18 nt, Human
gcaaagcccagcuugaaa

SEQ ID NO: 2238988 - RNA, 22 nt, Human
ugaaaaaguucugcagauaaac

SEQ ID NO: 2238989 - RNA, 20 nt, Human
ucaaaacuucagacauagaa

SEQ ID NO: 2238990 - RNA, 17 nt, Human
agcuacuaauuuuaaaa

SEQ ID NO: 2238991 - RNA, 22 nt, Human
cacuuccaagagccuuuuuuug

SEQ ID NO: 2238992 - RNA, 23 nt, Human
uaggauggcuaguaucaaaagaa

SEQ ID NO: 2238993 - RNA, 15 nt, Human
aagcacuaaacaaag

SEQ ID NO: 2238994 - RNA, 19 nt, Human
auaaaagacagugaaagaa

SEQ ID NO: 2238995 - RNA, 22 nt, Human
ggguuccuuccucugagccuug

SEQ ID NO: 2238996 - RNA, 16 nt, Human
aaaagcuccauuuuua

SEQ ID NO: 2238997 - RNA, 17 nt, Human
agcgacagugagacucu

SEQ ID NO: 2238998 - RNA, 13 nt, Human
gacaaggaaaaaa

SEQ ID NO: 2238999 - RNA, 21 nt, Human
uaauaggcguaacuaauuuua

SEQ ID NO: 2239000 - RNA, 15 nt, Human
ugaaauuguauuaca

SEQ ID NO: 2239001 - RNA, 18 nt, Human
uuacuguaagaaaauauc

SEQ ID NO: 2239002 - RNA, 16 nt, Human
uugucaauaaaaucca

SEQ ID NO: 2239003 - RNA, 14 nt, Human
caaggcuagaacca

SEQ ID NO: 2239004 - RNA, 14 nt, Human
uccacuuggucugu

SEQ ID NO: 2239005 - RNA, 15 nt, Human
uccagauccuggaaa

SEQ ID NO: 2239006 - RNA, 22 nt, Human
aagagccuuuuuuugaaaaaaa

SEQ ID NO: 2239007 - RNA, 15 nt, Human
cccugccccccagcc

SEQ ID NO: 2239008 - RNA, 21 nt, Human
caaagcccagcuugaaaccuu

SEQ ID NO: 2239009 - RNA, 15 nt, Human
ucugucucaguccau

SEQ ID NO: 2239010 - RNA, 21 nt, Human
agggugauauuaaccaggggc

SEQ ID NO: 2239011 - RNA, 21 nt, Human
cuuguuggacgagaaaacaau

SEQ ID NO: 2239012 - RNA, 23 nt, Human
uuuguauaaaauaauuuuuauau

SEQ ID NO: 2239013 - RNA, 14 nt, Human
acaagagcuuaaca

SEQ ID NO: 2239014 - RNA, 17 nt, Human
acaagaaaugaaagcag

SEQ ID NO: 2239015 - RNA, 16 nt, Human
cugcugagucccaggc

SEQ ID NO: 2239016 - RNA, 22 nt, Human
ugaauggcuaagcaaaauguga

SEQ ID NO: 2239017 - RNA, 20 nt, Human
gagccucagucucccucccu

SEQ ID NO: 2239018 - RNA, 22 nt, Human
ugaccauacuaauuauaccccc

SEQ ID NO: 2239019 - RNA, 12 nt, Human
uaguacacacuu

SEQ ID NO: 2239020 - RNA, 14 nt, Human
ccaaugaaaugagu

SEQ ID NO: 2239021 - RNA, 20 nt, Human
accuuuugcuguggcaaaug

SEQ ID NO: 2239022 - RNA, 22 nt, Human
gaugguucccuugaugaagaag

SEQ ID NO: 2239023 - RNA, 20 nt, Human
auuuucaguuauuauauuua

SEQ ID NO: 2239024 - RNA, 21 nt, Human
aagucuuucacauuuaaauaa

SEQ ID NO: 2239025 - RNA, 22 nt, Human
ucuggguuccuuccucugagcc

SEQ ID NO: 2239026 - RNA, 23 nt, Human
aaguauccuucagccugaaagag

SEQ ID NO: 2239027 - RNA, 19 nt, Human
aagucuuucacauuuaaau

SEQ ID NO: 2239028 - RNA, 20 nt, Human
aaaacaagcacuaaacaaag

SEQ ID NO: 2239029 - RNA, 22 nt, Human
uuccccuuccuaauuccacagc

SEQ ID NO: 2239030 - RNA, 16 nt, Human
aauuccacagcugcuc

SEQ ID NO: 2239031 - RNA, 21 nt, Human
auuauauuuauuacuguaaga

SEQ ID NO: 2239032 - RNA, 20 nt, Human
guuccuuccucugagccuug

SEQ ID NO: 2239033 - RNA, 22 nt, Human
caaugcuguauuuuaaaagaau

SEQ ID NO: 2239034 - RNA, 12 nt, Human
uauucacaagac

SEQ ID NO: 2239035 - RNA, 18 nt, Human
agucagucugaugagaac

SEQ ID NO: 2239036 - RNA, 17 nt, Human
uuauaaucuuucacagg

SEQ ID NO: 2239037 - RNA, 23 nt, Human
caggcaugagucagucugaugag

SEQ ID NO: 2239038 - RNA, 22 nt, Human
uuuauggcacuaguauuucuau

SEQ ID NO: 2239039 - RNA, 16 nt, Human
aauuucuucaacuccc

SEQ ID NO: 2239040 - RNA, 14 nt, Human
caugaacuuguaaa

SEQ ID NO: 2239041 - RNA, 20 nt, Human
cccuuccuaauuccacagcu

SEQ ID NO: 2239042 - RNA, 23 nt, Human
guaauuccguagguuauuuucag

SEQ ID NO: 2239043 - RNA, 20 nt, Human
ccccuauccuacuuccccuu

SEQ ID NO: 2239044 - RNA, 14 nt, Human
uugccugcaggcau

SEQ ID NO: 2239045 - RNA, 17 nt, Human
cugcacuccagccugag

SEQ ID NO: 2239046 - RNA, 22 nt, Human
gucacaggaaguagaggaggcc

SEQ ID NO: 2239047 - RNA, 16 nt, Human
agugaaauauuauuuu

SEQ ID NO: 2239048 - RNA, 18 nt, Human
gaagcaccaaucaugaau

SEQ ID NO: 2239049 - RNA, 16 nt, Human
gaauggcuaagcaaaa

SEQ ID NO: 2239050 - RNA, 19 nt, Human
acagugauuaccagggacu

SEQ ID NO: 2239051 - RNA, 18 nt, Human
ucuaugaaauauuauguu

SEQ ID NO: 2239052 - RNA, 20 nt, Human
cacagcacgggggccaagga

SEQ ID NO: 2239053 - RNA, 21 nt, Human
gucucagugucaaugcagccc

SEQ ID NO: 2239054 - RNA, 18 nt, Human
gaacucugagcagugcuu

SEQ ID NO: 2239055 - RNA, 21 nt, Human
aaucaccaaggcugauuaaac

SEQ ID NO: 2239056 - RNA, 12 nt, Human
gcaaagcccagc

SEQ ID NO: 2239057 - RNA, 17 nt, Human
aaagcuccauuuuuagu

SEQ ID NO: 2239058 - RNA, 17 nt, Human
auaaguacaugauaagc

SEQ ID NO: 2239059 - RNA, 16 nt, Human
ccugaucaccugcccu

SEQ ID NO: 2239060 - RNA, 20 nt, Human
cagugaaagaaaauaacgau

SEQ ID NO: 2239061 - RNA, 21 nt, Human
cucagugucaaugcagccccc

SEQ ID NO: 2239062 - RNA, 19 nt, Human
augaguaacugauuuguaa

SEQ ID NO: 2239063 - RNA, 17 nt, Human
aauauugcaaggcaaag

SEQ ID NO: 2239064 - RNA, 23 nt, Human
uaaaagacagugaaagaaaauaa

SEQ ID NO: 2239065 - RNA, 13 nt, Human
auugauuauaugu

SEQ ID NO: 2239066 - RNA, 23 nt, Human
aaaauaucacuugucaauaaaau

SEQ ID NO: 2239067 - RNA, 21 nt, Human
acagcccuucuuuccacagaa

SEQ ID NO: 2239068 - RNA, 22 nt, Human
gcacagccucuuagaugcaguu

SEQ ID NO: 2239069 - RNA, 16 nt, Human
ucagucucccucccuu

SEQ ID NO: 2239070 - RNA, 15 nt, Human
gugaccacugcagaa

SEQ ID NO: 2239071 - RNA, 22 nt, Human
uggaaaguuuaugguuguauua

SEQ ID NO: 2239072 - RNA, 22 nt, Human
uauccuacuuccccuuccuaau

SEQ ID NO: 2239073 - RNA, 20 nt, Human
uuaaauggucaauuuuguua

SEQ ID NO: 2239074 - RNA, 11 nt, Human
ccugagcccca

SEQ ID NO: 2239075 - RNA, 16 nt, Human
cucaauaaaguacaag

SEQ ID NO: 2239076 - RNA, 18 nt, Human
cuccauccugaggcucca

SEQ ID NO: 2239077 - RNA, 16 nt, Human
uuucacauuuaaauaa

SEQ ID NO: 2239078 - RNA, 19 nt, Human
auuuucaguuauuauauuu

SEQ ID NO: 2239079 - RNA, 17 nt, Human
gucaaagcugaaaugga

SEQ ID NO: 2239080 - RNA, 15 nt, Human
aauucugaaagcaac

SEQ ID NO: 2239081 - RNA, 16 nt, Human
auaaugaauacuuuau

SEQ ID NO: 2239082 - RNA, 17 nt, Human
gauaaaagacagugaaa

SEQ ID NO: 2239083 - RNA, 17 nt, Human
uaucaauuuaaaaaaaa

SEQ ID NO: 2239084 - RNA, 18 nt, Human
auagaauuaacacaugau

SEQ ID NO: 2239085 - RNA, 13 nt, Human
cacaacacacaga

SEQ ID NO: 2239086 - RNA, 21 nt, Human
cagugagacagcucugcauac

SEQ ID NO: 2239087 - RNA, 22 nt, Human
aggaugccccgucccccucugg

SEQ ID NO: 2239088 - RNA, 16 nt, Human
ggcugagccucagucu

SEQ ID NO: 2239089 - RNA, 20 nt, Human
acuaaauugacacuuaaaaa

SEQ ID NO: 2239090 - RNA, 13 nt, Human
cucugagccuugg

SEQ ID NO: 2239091 - RNA, 23 nt, Human
aagagccuuuuuuugaaaaaaag

SEQ ID NO: 2239092 - RNA, 23 nt, Human
auucaauaucuuuuuuuuaauaa

SEQ ID NO: 2239093 - RNA, 23 nt, Human
uaaguuuuuuuuuaaaaaagaaa

SEQ ID NO: 2239094 - RNA, 19 nt, Human
ugaaauggacuuuuguaca

SEQ ID NO: 2239095 - RNA, 21 nt, Human
gcaaaauuuuuucucuaggaa

SEQ ID NO: 2239096 - RNA, 12 nt, Human
acaagaaaugaa

SEQ ID NO: 2239097 - RNA, 20 nt, Human
uccagagggaauugcagagu

SEQ ID NO: 2239098 - RNA, 14 nt, Human
cucuggcuccagcu

SEQ ID NO: 2239099 - RNA, 21 nt, Human
ucaccugggcugaggcauccu

SEQ ID NO: 2239100 - RNA, 16 nt, Human
cacuuaaaaaugguuu

SEQ ID NO: 2239101 - RNA, 16 nt, Human
ugcuaagucuuauaua

SEQ ID NO: 2239102 - RNA, 14 nt, Human
auacaaaaaaaaaa

SEQ ID NO: 2239103 - RNA, 13 nt, Human
uggacgagaaaac

SEQ ID NO: 2239104 - RNA, 22 nt, Human
agucuuucacauuuaaauaaag

SEQ ID NO: 2239105 - RNA, 14 nt, Human
uucacauuuaaaua

SEQ ID NO: 2239106 - RNA, 22 nt, Human
agcagcauaaauguugacaugg

SEQ ID NO: 2239107 - RNA, 15 nt, Human
caagcucacagaccu

SEQ ID NO: 2239108 - RNA, 14 nt, Human
ccugccccugagcc

SEQ ID NO: 2239109 - RNA, 17 nt, Human
uugugaagcaaaauuuu

SEQ ID NO: 2239110 - RNA, 17 nt, Human
aagacaaggaaaaaaua

SEQ ID NO: 2239111 - RNA, 15 nt, Human
auaaauaaaaauaau

SEQ ID NO: 2239112 - RNA, 21 nt, Human
agccucuuagaugcaguucug

SEQ ID NO: 2239113 - RNA, 15 nt, Human
uucugcacacagcac

SEQ ID NO: 2239114 - RNA, 19 nt, Human
uacuucuuaggguuaugau

SEQ ID NO: 2239115 - RNA, 23 nt, Human
cuaguaauuggaaaggcagcucu

SEQ ID NO: 2239116 - RNA, 13 nt, Human
uauuuauuuuaau

SEQ ID NO: 2239117 - RNA, 23 nt, Human
agaguuuagcuggaaaaguaugu

SEQ ID NO: 2239118 - RNA, 14 nt, Human
cugcugagucccag

SEQ ID NO: 2239119 - RNA, 22 nt, Human
agaaaacaauaacgauaaaaga

SEQ ID NO: 2239120 - RNA, 22 nt, Human
uuaccucugccucagaaaacaa

SEQ ID NO: 2239121 - RNA, 14 nt, Human
uacuaauuuuaaaa

SEQ ID NO: 2239122 - RNA, 23 nt, Human
ugaauuacauuuguauaaaauaa

SEQ ID NO: 2239123 - RNA, 17 nt, Human
guuuaauaauuuuuaau

SEQ ID NO: 2239124 - RNA, 22 nt, Human
cuucaacucccugccccccagc

SEQ ID NO: 2239125 - RNA, 15 nt, Human
ccucagucucccucc

SEQ ID NO: 2239126 - RNA, 13 nt, Human
aagugcagccccg

SEQ ID NO: 2239127 - RNA, 13 nt, Human
uuuugaaucauca

SEQ ID NO: 2239128 - RNA, 19 nt, Human
uguaguguuggagaagaac

SEQ ID NO: 2239129 - RNA, 17 nt, Human
gcaugguuuagaaagcu

SEQ ID NO: 2239130 - RNA, 14 nt, Human
auuuauuuuaauaa

SEQ ID NO: 2239131 - RNA, 14 nt, Human
ccucagucucccuc

SEQ ID NO: 2239132 - RNA, 17 nt, Human
cugauggguuucuccag

SEQ ID NO: 2239133 - RNA, 18 nt, Human
cugagccuugggaccccu

SEQ ID NO: 2239134 - RNA, 17 nt, Human
uuaauaauuuuuaauua

SEQ ID NO: 2239135 - RNA, 16 nt, Human
auugucuagugaaacu

SEQ ID NO: 2239136 - RNA, 18 nt, Human
gaggcuccacuuggucug

SEQ ID NO: 2239137 - RNA, 16 nt, Human
auaauccuaaacauau

SEQ ID NO: 2239138 - RNA, 13 nt, Yersinia pestis
uuuuuucugcaaa

SEQ ID NO: 2239139 - RNA, 19 nt, Yersinia pestis
uuuuugcauauaaaacacg

SEQ ID NO: 2239140 - RNA, 20 nt, Yersinia pestis
uuuuucgggccacuacggcg

SEQ ID NO: 2239141 - RNA, 16 nt, Yersinia pestis
uuugguagaacugcgg

SEQ ID NO: 2239142 - RNA, 19 nt, Yersinia pestis
uuugccguauucagcagug

SEQ ID NO: 2239143 - RNA, 13 nt, Yersinia pestis
uuucgucauuauu

SEQ ID NO: 2239144 - RNA, 22 nt, Yersinia pestis
uuuuacgccuauccucaugauu

SEQ ID NO: 2239145 - RNA, 18 nt, Yersinia pestis
uuuguagugaaugacagu

SEQ ID NO: 2239146 - RNA, 21 nt, Yersinia pestis
uuuccgucagcccaacgucau

SEQ ID NO: 2239147 - RNA, 23 nt, Yersinia pestis
uuucauucggcacagccagugcu

SEQ ID NO: 2239148 - RNA, 13 nt, Yersinia pestis
uuucauuacggcg

SEQ ID NO: 2239149 - RNA, 23 nt, Yersinia pestis
uuucaucccauaugcuauagcca

SEQ ID NO: 2239150 - RNA, 15 nt, Yersinia pestis
uuucaacauccaguu

SEQ ID NO: 2239151 - RNA, 14 nt, Yersinia pestis
uuuaagauccaguu

SEQ ID NO: 2239152 - RNA, 13 nt, Yersinia pestis
uuuagcgaugacc

SEQ ID NO: 2239153 - RNA, 23 nt, Yersinia pestis
uuuaaggaacggguaaucggugu

SEQ ID NO: 2239154 - RNA, 21 nt, Yersinia pestis
uuuaaauucaauccauugauc

SEQ ID NO: 2239155 - RNA, 21 nt, Yersinia pestis
uuuaaaggggggaaacgguuu

SEQ ID NO: 2239156 - RNA, 19 nt, Yersinia pestis
uuuauugagcgaugacaau

SEQ ID NO: 2239157 - RNA, 22 nt, Yersinia pestis
uuuagucuauggcgcuaaaggc

SEQ ID NO: 2239158 - RNA, 22 nt, Yersinia pestis
uuggguuugagcagugcgcggc

SEQ ID NO: 2239159 - RNA, 12 nt, Yersinia pestis
uuggccguugau

SEQ ID NO: 2239160 - RNA, 20 nt, Yersinia pestis
uuguauuaccgauaaaggcc

SEQ ID NO: 2239161 - RNA, 20 nt, Yersinia pestis
uugucagcagucugagggcc

SEQ ID NO: 2239162 - RNA, 20 nt, Yersinia pestis
uugucagcagucugaaaucu

SEQ ID NO: 2239163 - RNA, 19 nt, Yersinia pestis
uugagugccgugucuucca

SEQ ID NO: 2239164 - RNA, 22 nt, Yersinia pestis
uugaguagcaggccgacaauac

SEQ ID NO: 2239165 - RNA, 14 nt, Yersinia pestis
uugaugaaguuauu

SEQ ID NO: 2239166 - RNA, 18 nt, Yersinia pestis
uugauguagcagaucuau

SEQ ID NO: 2239167 - RNA, 15 nt, Yersinia pestis
uugauuaucaaguua

SEQ ID NO: 2239168 - RNA, 15 nt, Yersinia pestis
uugcccccaucacua

SEQ ID NO: 2239169 - RNA, 15 nt, Yersinia pestis
uugcauaucagcaau

SEQ ID NO: 2239170 - RNA, 17 nt, Yersinia pestis
uugcaguucaucaauaa

SEQ ID NO: 2239171 - RNA, 13 nt, Yersinia pestis
uugccaccagcgu

SEQ ID NO: 2239172 - RNA, 22 nt, Yersinia pestis
uugcacaaagcuuacuguucac

SEQ ID NO: 2239173 - RNA, 20 nt, Yersinia pestis
uugcacuuuuacugguucau

SEQ ID NO: 2239174 - RNA, 20 nt, Yersinia pestis
uugcagauaccacaucaaac

SEQ ID NO: 2239175 - RNA, 21 nt, Yersinia pestis
uugacaaaguaccuauggcga

SEQ ID NO: 2239176 - RNA, 15 nt, Yersinia pestis
uugacuggucacucg

SEQ ID NO: 2239177 - RNA, 14 nt, Yersinia pestis
uugagaguucacuu

SEQ ID NO: 2239178 - RNA, 20 nt, Yersinia pestis
uugagagaacguucaaccaa

SEQ ID NO: 2239179 - RNA, 15 nt, Yersinia pestis
uuggauuggucaggu

SEQ ID NO: 2239180 - RNA, 22 nt, Yersinia pestis
uugcugugcgauuucacggaua

SEQ ID NO: 2239181 - RNA, 14 nt, Yersinia pestis
uugcuggcuaucau

SEQ ID NO: 2239182 - RNA, 12 nt, Yersinia pestis
uugcugcaaccg

SEQ ID NO: 2239183 - RNA, 22 nt, Yersinia pestis
uugcugcaacgcagacaugauu

SEQ ID NO: 2239184 - RNA, 16 nt, Yersinia pestis
uugcucagcgcaucaa

SEQ ID NO: 2239185 - RNA, 18 nt, Yersinia pestis
uugcugaguggacgauaa

SEQ ID NO: 2239186 - RNA, 16 nt, Yersinia pestis
uugccugugcgcuggu

SEQ ID NO: 2239187 - RNA, 15 nt, Yersinia pestis
uugcgaccaauaccg

SEQ ID NO: 2239188 - RNA, 22 nt, Yersinia pestis
uugccgaucgaugggugaaagc

SEQ ID NO: 2239189 - RNA, 16 nt, Yersinia pestis
uugcccugcaauaccg

SEQ ID NO: 2239190 - RNA, 22 nt, Yersinia pestis
uuaccacgacgaucuuguucac

SEQ ID NO: 2239191 - RNA, 20 nt, Yersinia pestis
uuacugcuucuguggcggca

SEQ ID NO: 2239192 - RNA, 15 nt, Yersinia pestis
uuaggauuagccgcu

SEQ ID NO: 2239193 - RNA, 12 nt, Yersinia pestis
uuaguaaucaau

SEQ ID NO: 2239194 - RNA, 18 nt, Yersinia pestis
uuaguaacuguaaggcca

SEQ ID NO: 2239195 - RNA, 16 nt, Yersinia pestis
uuaucacgguugccgc

SEQ ID NO: 2239196 - RNA, 15 nt, Yersinia pestis
uuaucuugguuucac

SEQ ID NO: 2239197 - RNA, 16 nt, Yersinia pestis
uuaucuaucuguucac

SEQ ID NO: 2239198 - RNA, 22 nt, Yersinia pestis
uuaaggaaaaguagccaauaga

SEQ ID NO: 2239199 - RNA, 14 nt, Yersinia pestis
uuaacuuauugauu

SEQ ID NO: 2239200 - RNA, 12 nt, Yersinia pestis
uuaacuuuauca

SEQ ID NO: 2239201 - RNA, 21 nt, Yersinia pestis
uuaacacgaaaagcagcaguu

SEQ ID NO: 2239202 - RNA, 18 nt, Yersinia pestis
uuaaucaucgacuugaug

SEQ ID NO: 2239203 - RNA, 16 nt, Yersinia pestis
uuaaugaaauuaguua

SEQ ID NO: 2239204 - RNA, 21 nt, Yersinia pestis
uguuggaucucuccagccugc

SEQ ID NO: 2239205 - RNA, 15 nt, Yersinia pestis
uguuggcccaagaua

SEQ ID NO: 2239206 - RNA, 13 nt, Yersinia pestis
uuaugcgcugcug

SEQ ID NO: 2239207 - RNA, 15 nt, Yersinia pestis
uuaugccacaucagu

SEQ ID NO: 2239208 - RNA, 19 nt, Yersinia pestis
uuauguuuacugagcagca

SEQ ID NO: 2239209 - RNA, 19 nt, Yersinia pestis
uuauguaacaacugaacca

SEQ ID NO: 2239210 - RNA, 18 nt, Yersinia pestis
uucaacgccaauaccggu

SEQ ID NO: 2239211 - RNA, 20 nt, Yersinia pestis
uucaauuucgacaacgccaa

SEQ ID NO: 2239212 - RNA, 19 nt, Yersinia pestis
uucaacucuacauugacua

SEQ ID NO: 2239213 - RNA, 22 nt, Yersinia pestis
uucacuggccuauuaagauaau

SEQ ID NO: 2239214 - RNA, 18 nt, Yersinia pestis
uucacguucaucaauacc

SEQ ID NO: 2239215 - RNA, 18 nt, Yersinia pestis
uucaccaaaccaucagcg

SEQ ID NO: 2239216 - RNA, 14 nt, Yersinia pestis
uucaccaaccaauu

SEQ ID NO: 2239217 - RNA, 22 nt, Yersinia pestis
uucacuucuggggucaucaacg

SEQ ID NO: 2239218 - RNA, 23 nt, Yersinia pestis
uucacugugcuuuucuuaauacc

SEQ ID NO: 2239219 - RNA, 13 nt, Yersinia pestis
uucaggguacugu

SEQ ID NO: 2239220 - RNA, 15 nt, Yersinia pestis
uucaucauuauuaug

SEQ ID NO: 2239221 - RNA, 22 nt, Yersinia pestis
uucaucaauagguguugccggc

SEQ ID NO: 2239222 - RNA, 14 nt, Yersinia pestis
uucauaagccagug

SEQ ID NO: 2239223 - RNA, 16 nt, Yersinia pestis
ugugauuaagcguuaa

SEQ ID NO: 2239224 - RNA, 20 nt, Yersinia pestis
ugugauuuccaucuagcuca

SEQ ID NO: 2239225 - RNA, 18 nt, Yersinia pestis
ugugauaaccguucaaga

SEQ ID NO: 2239226 - RNA, 16 nt, Yersinia pestis
ugugugaauaucaggc

SEQ ID NO: 2239227 - RNA, 19 nt, Yersinia pestis
uguugaauaccaagccaaa

SEQ ID NO: 2239228 - RNA, 15 nt, Yersinia pestis
uguucggcaaugggu

SEQ ID NO: 2239229 - RNA, 17 nt, Yersinia pestis
uguugauacuccauuug

SEQ ID NO: 2239230 - RNA, 11 nt, Yersinia pestis
uguuagcggcu

SEQ ID NO: 2239231 - RNA, 20 nt, Yersinia pestis
uguuagggcgcggcugguaa

SEQ ID NO: 2239232 - RNA, 16 nt, Yersinia pestis
uguuaugguauucaga

SEQ ID NO: 2239233 - RNA, 19 nt, Yersinia pestis
uguucaucgcuuaacggcc

SEQ ID NO: 2239234 - RNA, 15 nt, Yersinia pestis
uggguuugagcagug

SEQ ID NO: 2239235 - RNA, 21 nt, Yersinia pestis
ugguaccccgugcuuugccuu

SEQ ID NO: 2239236 - RNA, 20 nt, Yersinia pestis
ugguggcgucaaagcggugg

SEQ ID NO: 2239237 - RNA, 12 nt, Yersinia pestis
ugguuucaaacu

SEQ ID NO: 2239238 - RNA, 15 nt, Yersinia pestis
ugguuuuaucaauag

SEQ ID NO: 2239239 - RNA, 14 nt, Yersinia pestis
ugguuggcuaucaa

SEQ ID NO: 2239240 - RNA, 21 nt, Yersinia pestis
uguaccgguucauuuagcagc

SEQ ID NO: 2239241 - RNA, 23 nt, Yersinia pestis
uguacggguaaaugauggcggcu

SEQ ID NO: 2239242 - RNA, 20 nt, Yersinia pestis
uguacuuaauacugaacaug

SEQ ID NO: 2239243 - RNA, 18 nt, Yersinia pestis
uguccggagagagacuuu

SEQ ID NO: 2239244 - RNA, 18 nt, Yersinia pestis
uguccacugaccagcggu

SEQ ID NO: 2239245 - RNA, 14 nt, Yersinia pestis
ugucaugaaaaucu

SEQ ID NO: 2239246 - RNA, 16 nt, Yersinia pestis
ugucaucccguaggcu

SEQ ID NO: 2239247 - RNA, 19 nt, Yersinia pestis
ugucagaucgcgaugcgcc

SEQ ID NO: 2239248 - RNA, 15 nt, Yersinia pestis
uggaccuccaucaac

SEQ ID NO: 2239249 - RNA, 12 nt, Yersinia pestis
uggcaaaggaua

SEQ ID NO: 2239250 - RNA, 13 nt, Yersinia pestis
uggcaaaggccag

SEQ ID NO: 2239251 - RNA, 18 nt, Yersinia pestis
uggcaaaaauaaucaacg

SEQ ID NO: 2239252 - RNA, 19 nt, Yersinia pestis
uggcaaccccugccaauau

SEQ ID NO: 2239253 - RNA, 18 nt, Yersinia pestis
uggauugugaacgguaug

SEQ ID NO: 2239254 - RNA, 19 nt, Yersinia pestis
uggauaacccccugacauu

SEQ ID NO: 2239255 - RNA, 22 nt, Yersinia pestis
uggaucaaguuagcaggcagca

SEQ ID NO: 2239256 - RNA, 23 nt, Yersinia pestis
uggagccagcgccgugccagaaa

SEQ ID NO: 2239257 - RNA, 14 nt, Yersinia pestis
uggccaacugcgcc

SEQ ID NO: 2239258 - RNA, 15 nt, Yersinia pestis
uggcaggucucgcaa

SEQ ID NO: 2239259 - RNA, 17 nt, Yersinia pestis
uggcagguaucaauaca

SEQ ID NO: 2239260 - RNA, 19 nt, Yersinia pestis
uggcaucaauauaacgccc

SEQ ID NO: 2239261 - RNA, 18 nt, Yersinia pestis
uggcauguucacaucggu

SEQ ID NO: 2239262 - RNA, 20 nt, Yersinia pestis
uggcaggccuuucggcaaau

SEQ ID NO: 2239263 - RNA, 23 nt, Yersinia pestis
uggcaggccccaucauaaaggcu

SEQ ID NO: 2239264 - RNA, 20 nt, Yersinia pestis
uggccagcgggaaucaaacu

SEQ ID NO: 2239265 - RNA, 19 nt, Yersinia pestis
ugggcagggcgcaauggcg

SEQ ID NO: 2239266 - RNA, 17 nt, Yersinia pestis
uggguuaccugccuuca

SEQ ID NO: 2239267 - RNA, 14 nt, Yersinia pestis
ugggggucagggcg

SEQ ID NO: 2239268 - RNA, 15 nt, Yersinia pestis
uggcuuucucccauu

SEQ ID NO: 2239269 - RNA, 18 nt, Yersinia pestis
uggcugaaucguacuucu

SEQ ID NO: 2239270 - RNA, 17 nt, Yersinia pestis
uggccgacauuauguuc

SEQ ID NO: 2239271 - RNA, 22 nt, Yersinia pestis
uggcggaauugguagacgcgcu

SEQ ID NO: 2239272 - RNA, 17 nt, Yersinia pestis
ucuaaccaggugcagau

SEQ ID NO: 2239273 - RNA, 16 nt, Yersinia pestis
ucucauccauguuaga

SEQ ID NO: 2239274 - RNA, 12 nt, Yersinia pestis
ucuccagccugc

SEQ ID NO: 2239275 - RNA, 14 nt, Yersinia pestis
ucgucuucagcuuc

SEQ ID NO: 2239276 - RNA, 19 nt, Yersinia pestis
ucgugaccccguggcggcg

SEQ ID NO: 2239277 - RNA, 20 nt, Yersinia pestis
ucguauguccucaccauuua

SEQ ID NO: 2239278 - RNA, 23 nt, Yersinia pestis
ucggugugacuuucaaucgcgau

SEQ ID NO: 2239279 - RNA, 13 nt, Yersinia pestis
ucgcgcuucaggu

SEQ ID NO: 2239280 - RNA, 18 nt, Yersinia pestis
ucgggauaucuucaauca

SEQ ID NO: 2239281 - RNA, 20 nt, Yersinia pestis
ucgauaaacaucaugacaaa

SEQ ID NO: 2239282 - RNA, 15 nt, Yersinia pestis
ucgauaguccuucgu

SEQ ID NO: 2239283 - RNA, 18 nt, Yersinia pestis
ucgcaaccgccaaccagc

SEQ ID NO: 2239284 - RNA, 20 nt, Yersinia pestis
ucgauugaccggucacacca

SEQ ID NO: 2239285 - RNA, 21 nt, Yersinia pestis
ucgcaaagcguuucgccaaau

SEQ ID NO: 2239286 - RNA, 21 nt, Yersinia pestis
ucgcacgggcuuuaaugagua

SEQ ID NO: 2239287 - RNA, 19 nt, Yersinia pestis
ucgagcgggcuucaccauc

SEQ ID NO: 2239288 - RNA, 17 nt, Yersinia pestis
ucgacgcgccauaagcc

SEQ ID NO: 2239289 - RNA, 16 nt, Yersinia pestis
ucgagaugcugacccu

SEQ ID NO: 2239290 - RNA, 17 nt, Yersinia pestis
ucgcaucaggucgucua

SEQ ID NO: 2239291 - RNA, 17 nt, Yersinia pestis
ucgcacuugaucagggg

SEQ ID NO: 2239292 - RNA, 17 nt, Yersinia pestis
ucgcagaacccagggcg

SEQ ID NO: 2239293 - RNA, 12 nt, Yersinia pestis
ucgcagcagaga

SEQ ID NO: 2239294 - RNA, 21 nt, Yersinia pestis
ucgccauagccgaucaccgca

SEQ ID NO: 2239295 - RNA, 14 nt, Yersinia pestis
ucgccuucuggcaa

SEQ ID NO: 2239296 - RNA, 16 nt, Yersinia pestis
ugagggugaugacaau

SEQ ID NO: 2239297 - RNA, 19 nt, Yersinia pestis
ugagggcgucucuacgacg

SEQ ID NO: 2239298 - RNA, 17 nt, Yersinia pestis
ugacuuaugacgcgcug

SEQ ID NO: 2239299 - RNA, 22 nt, Yersinia pestis
ugacuuaugacgcgcugcuuug

SEQ ID NO: 2239300 - RNA, 22 nt, Yersinia pestis
ugacugucugcggccuaccguu

SEQ ID NO: 2239301 - RNA, 16 nt, Yersinia pestis
ugacugcccgccugcu

SEQ ID NO: 2239302 - RNA, 22 nt, Yersinia pestis
ugacucucuuguucuaacgcuu

SEQ ID NO: 2239303 - RNA, 16 nt, Yersinia pestis
ugacguccccggucau

SEQ ID NO: 2239304 - RNA, 13 nt, Yersinia pestis
ugacucagcgaau

SEQ ID NO: 2239305 - RNA, 13 nt, Yersinia pestis
ugagcgagcggua

SEQ ID NO: 2239306 - RNA, 15 nt, Yersinia pestis
ugacggagcuaucac

SEQ ID NO: 2239307 - RNA, 15 nt, Yersinia pestis
ugacgcuuauccugc

SEQ ID NO: 2239308 - RNA, 19 nt, Yersinia pestis
ugacgguuucaacauccag

SEQ ID NO: 2239309 - RNA, 21 nt, Yersinia pestis
ugaugaaaccaaaaccuuuac

SEQ ID NO: 2239310 - RNA, 15 nt, Yersinia pestis
ugauaaaaucaccgc

SEQ ID NO: 2239311 - RNA, 14 nt, Yersinia pestis
ugauuacugucauu

SEQ ID NO: 2239312 - RNA, 12 nt, Yersinia pestis
ugauucgccauu

SEQ ID NO: 2239313 - RNA, 18 nt, Yersinia pestis
ugacacgggaucaacaug

SEQ ID NO: 2239314 - RNA, 14 nt, Yersinia pestis
ugacauacaguggc

SEQ ID NO: 2239315 - RNA, 17 nt, Yersinia pestis
ugacaucccgcaccaac

SEQ ID NO: 2239316 - RNA, 15 nt, Yersinia pestis
ugacauccgcuugca

SEQ ID NO: 2239317 - RNA, 23 nt, Yersinia pestis
ugacaucgcccgguaagcgguau

SEQ ID NO: 2239318 - RNA, 18 nt, Yersinia pestis
ugacaucggccugcgcug

SEQ ID NO: 2239319 - RNA, 15 nt, Yersinia pestis
ugaccuuaauaccgu

SEQ ID NO: 2239320 - RNA, 16 nt, Yersinia pestis
ugaccgguaauaucgg

SEQ ID NO: 2239321 - RNA, 22 nt, Yersinia pestis
ugaauaacagcuaaucauugca

SEQ ID NO: 2239322 - RNA, 21 nt, Yersinia pestis
ugaagagugaccaaagcagua

SEQ ID NO: 2239323 - RNA, 15 nt, Yersinia pestis
ugaagacacuuuggu

SEQ ID NO: 2239324 - RNA, 22 nt, Yersinia pestis
ugaagauacccuugagguuauu

SEQ ID NO: 2239325 - RNA, 22 nt, Yersinia pestis
ugaaugugaguguucauugaga

SEQ ID NO: 2239326 - RNA, 19 nt, Yersinia pestis
ugacaaaccccgaugacuc

SEQ ID NO: 2239327 - RNA, 22 nt, Yersinia pestis
ugacaaaccccgaugacucacu

SEQ ID NO: 2239328 - RNA, 20 nt, Yersinia pestis
ugacaaaaugcuaucggcgg

SEQ ID NO: 2239329 - RNA, 18 nt, Yersinia pestis
ugaauagguaaaacaucu

SEQ ID NO: 2239330 - RNA, 17 nt, Yersinia pestis
ugaauaguaacgcgcca

SEQ ID NO: 2239331 - RNA, 12 nt, Yersinia pestis
ugaauaccgcua

SEQ ID NO: 2239332 - RNA, 19 nt, Yersinia pestis
ugaauaugcuucaucacuu

SEQ ID NO: 2239333 - RNA, 15 nt, Yersinia pestis
ugaaucagccagaga

SEQ ID NO: 2239334 - RNA, 17 nt, Yersinia pestis
ugaaagcacgaucagcu

SEQ ID NO: 2239335 - RNA, 18 nt, Yersinia pestis
ugaaacuuuccugacccg

SEQ ID NO: 2239336 - RNA, 15 nt, Yersinia pestis
ugaaccgccauugca

SEQ ID NO: 2239337 - RNA, 13 nt, Yersinia pestis
ugaaccgcuaucu

SEQ ID NO: 2239338 - RNA, 14 nt, Yersinia pestis
ugaaccgccauugc

SEQ ID NO: 2239339 - RNA, 19 nt, Yersinia pestis
ugaaauaucacgacuuuaa

SEQ ID NO: 2239340 - RNA, 21 nt, Yersinia pestis
ugaacaaaccccacuaacgcu

SEQ ID NO: 2239341 - RNA, 23 nt, Yersinia pestis
ugccauuuauugcggcuuagcca

SEQ ID NO: 2239342 - RNA, 18 nt, Yersinia pestis
ugccauuuccaauaccaa

SEQ ID NO: 2239343 - RNA, 13 nt, Yersinia pestis
ugccagauaguca

SEQ ID NO: 2239344 - RNA, 20 nt, Yersinia pestis
ugcccacauaaagauagcca

SEQ ID NO: 2239345 - RNA, 17 nt, Yersinia pestis
ugcccaucagcaucaau

SEQ ID NO: 2239346 - RNA, 17 nt, Yersinia pestis
ugcccaucaugccagca

SEQ ID NO: 2239347 - RNA, 17 nt, Yersinia pestis
ugcccccuguaacgcua

SEQ ID NO: 2239348 - RNA, 13 nt, Yersinia pestis
ugcauacaaccgu

SEQ ID NO: 2239349 - RNA, 19 nt, Yersinia pestis
ugcaguuucuaccgcuuca

SEQ ID NO: 2239350 - RNA, 13 nt, Yersinia pestis
ugcagucgcuuca

SEQ ID NO: 2239351 - RNA, 15 nt, Yersinia pestis
ugccaccuuggcggc

SEQ ID NO: 2239352 - RNA, 21 nt, Yersinia pestis
ugcaucuauugugucaauacc

SEQ ID NO: 2239353 - RNA, 17 nt, Yersinia pestis
ugcaucggauugcaaca

SEQ ID NO: 2239354 - RNA, 12 nt, Yersinia pestis
ugcccggcugau

SEQ ID NO: 2239355 - RNA, 21 nt, Yersinia pestis
ugccgcccugcucaaucgaau

SEQ ID NO: 2239356 - RNA, 14 nt, Yersinia pestis
ugccgcuugcuuug

SEQ ID NO: 2239357 - RNA, 21 nt, Yersinia pestis
ugccgcugugauuaagcguua

SEQ ID NO: 2239358 - RNA, 16 nt, Yersinia pestis
ugccuauuucagggcg

SEQ ID NO: 2239359 - RNA, 19 nt, Yersinia pestis
ugccugauuuuuaucauca

SEQ ID NO: 2239360 - RNA, 16 nt, Yersinia pestis
ugcgacaauaacgccu

SEQ ID NO: 2239361 - RNA, 19 nt, Yersinia pestis
ugcgaccaaggcucuggca

SEQ ID NO: 2239362 - RNA, 18 nt, Yersinia pestis
ugccugugccauaucgcc

SEQ ID NO: 2239363 - RNA, 20 nt, Yersinia pestis
ugcggccacucgcaucgccu

SEQ ID NO: 2239364 - RNA, 22 nt, Yersinia pestis
ugcggccagccuugagccugca

SEQ ID NO: 2239365 - RNA, 22 nt, Yersinia pestis
ugcggcauaaauucuagcaaca

SEQ ID NO: 2239366 - RNA, 19 nt, Yersinia pestis
ucauaugcgguaaugacuu

SEQ ID NO: 2239367 - RNA, 23 nt, Yersinia pestis
ucaucgcaccauaaccaauccau

SEQ ID NO: 2239368 - RNA, 18 nt, Yersinia pestis
ucaugccggucugcuggc

SEQ ID NO: 2239369 - RNA, 23 nt, Yersinia pestis
ucauuacguaaucccagaaacgg

SEQ ID NO: 2239370 - RNA, 12 nt, Yersinia pestis
ucaguaacgccu

SEQ ID NO: 2239371 - RNA, 18 nt, Yersinia pestis
ucauacaucauuugagcu

SEQ ID NO: 2239372 - RNA, 17 nt, Yersinia pestis
ucauaucgaucaaccau

SEQ ID NO: 2239373 - RNA, 17 nt, Yersinia pestis
ucauaucgaugacagca

SEQ ID NO: 2239374 - RNA, 19 nt, Yersinia pestis
ucagggaugaagcucauua

SEQ ID NO: 2239375 - RNA, 17 nt, Yersinia pestis
uccacgccccaacggua

SEQ ID NO: 2239376 - RNA, 22 nt, Yersinia pestis
ucauuguagauggccaucucaa

SEQ ID NO: 2239377 - RNA, 20 nt, Yersinia pestis
uccaggcaagaaacuucauu

SEQ ID NO: 2239378 - RNA, 15 nt, Yersinia pestis
uccaggacauccagc

SEQ ID NO: 2239379 - RNA, 11 nt, Yersinia pestis
uccaucaauag

SEQ ID NO: 2239380 - RNA, 13 nt, Yersinia pestis
ucccaagccuaac

SEQ ID NO: 2239381 - RNA, 17 nt, Yersinia pestis
ucccagcagcaaacagu

SEQ ID NO: 2239382 - RNA, 17 nt, Yersinia pestis
ucccauagacggcgaac

SEQ ID NO: 2239383 - RNA, 17 nt, Yersinia pestis
ucccgaugauugcauca

SEQ ID NO: 2239384 - RNA, 21 nt, Yersinia pestis
ucaaaacgccagauaugauca

SEQ ID NO: 2239385 - RNA, 23 nt, Yersinia pestis
ucaaaaggauggcccaagccauc

SEQ ID NO: 2239386 - RNA, 20 nt, Yersinia pestis
ucaaaaaauaggcuaauuua

SEQ ID NO: 2239387 - RNA, 14 nt, Yersinia pestis
uauuuucuauacca

SEQ ID NO: 2239388 - RNA, 13 nt, Yersinia pestis
uauuucauuagau

SEQ ID NO: 2239389 - RNA, 16 nt, Yersinia pestis
uauuuccacgacauga

SEQ ID NO: 2239390 - RNA, 12 nt, Yersinia pestis
uaugcguugaga

SEQ ID NO: 2239391 - RNA, 17 nt, Yersinia pestis
uaugcguuuucaccgug

SEQ ID NO: 2239392 - RNA, 14 nt, Yersinia pestis
uauuacuaucgaaa

SEQ ID NO: 2239393 - RNA, 19 nt, Yersinia pestis
uauggaaguaauccagaug

SEQ ID NO: 2239394 - RNA, 15 nt, Yersinia pestis
uaugcuuucaucuua

SEQ ID NO: 2239395 - RNA, 20 nt, Yersinia pestis
uauuaucaucauuacacuga

SEQ ID NO: 2239396 - RNA, 13 nt, Yersinia pestis
uauuaucaauggc

SEQ ID NO: 2239397 - RNA, 15 nt, Yersinia pestis
uauuaguuucaaaua

SEQ ID NO: 2239398 - RNA, 22 nt, Yersinia pestis
uauuagaauguguaguugaagu

SEQ ID NO: 2239399 - RNA, 15 nt, Yersinia pestis
uauucuuguauccug

SEQ ID NO: 2239400 - RNA, 17 nt, Yersinia pestis
uauugauccaaauggcu

SEQ ID NO: 2239401 - RNA, 15 nt, Yersinia pestis
uaugcauuauugaug

SEQ ID NO: 2239402 - RNA, 18 nt, Yersinia pestis
uaucucucuaaucgcgca

SEQ ID NO: 2239403 - RNA, 20 nt, Yersinia pestis
uaucuuccacuugaucggcg

SEQ ID NO: 2239404 - RNA, 20 nt, Yersinia pestis
uaucugcugcgguauuaccc

SEQ ID NO: 2239405 - RNA, 15 nt, Yersinia pestis
uaucuguuucaaaua

SEQ ID NO: 2239406 - RNA, 16 nt, Yersinia pestis
uaucgaucaaaccaga

SEQ ID NO: 2239407 - RNA, 23 nt, Yersinia pestis
ucaauccgggcaaacgccagugc

SEQ ID NO: 2239408 - RNA, 14 nt, Yersinia pestis
ucaauaucaccagu

SEQ ID NO: 2239409 - RNA, 15 nt, Yersinia pestis
ucaauaagcuggcag

SEQ ID NO: 2239410 - RNA, 20 nt, Yersinia pestis
ucaagagcgauaaccgcacu

SEQ ID NO: 2239411 - RNA, 16 nt, Yersinia pestis
ucaagccuaaucggua

SEQ ID NO: 2239412 - RNA, 15 nt, Yersinia pestis
ucaagccgcuuaucu

SEQ ID NO: 2239413 - RNA, 13 nt, Yersinia pestis
ucaacucagggcu

SEQ ID NO: 2239414 - RNA, 12 nt, Yersinia pestis
ucaacucauuua

SEQ ID NO: 2239415 - RNA, 22 nt, Yersinia pestis
ucaacuucacccuuggcuacca

SEQ ID NO: 2239416 - RNA, 16 nt, Yersinia pestis
ucaaaagggaucacca

SEQ ID NO: 2239417 - RNA, 16 nt, Yersinia pestis
ucaaacucagcgaaua

SEQ ID NO: 2239418 - RNA, 15 nt, Yersinia pestis
ucaaauaacggaauu

SEQ ID NO: 2239419 - RNA, 20 nt, Yersinia pestis
ucaaaucaguuccugauucg

SEQ ID NO: 2239420 - RNA, 15 nt, Yersinia pestis
ucaacauuccauacc

SEQ ID NO: 2239421 - RNA, 22 nt, Yersinia pestis
ucaacauugcucggcugacgau

SEQ ID NO: 2239422 - RNA, 22 nt, Yersinia pestis
ucaaccugccagccugaucguu

SEQ ID NO: 2239423 - RNA, 11 nt, Yersinia pestis
ucaacgauaua

SEQ ID NO: 2239424 - RNA, 19 nt, Yersinia pestis
ucagccuauccucaccguu

SEQ ID NO: 2239425 - RNA, 21 nt, Yersinia pestis
ucagccaaagcauucgcgguu

SEQ ID NO: 2239426 - RNA, 19 nt, Yersinia pestis
ucagcccccucaauaccgg

SEQ ID NO: 2239427 - RNA, 16 nt, Yersinia pestis
ucagcauucucacuua

SEQ ID NO: 2239428 - RNA, 17 nt, Yersinia pestis
ucagacugcugacaaac

SEQ ID NO: 2239429 - RNA, 16 nt, Yersinia pestis
ucacguuuaccggcaa

SEQ ID NO: 2239430 - RNA, 15 nt, Yersinia pestis
ucaccuagauaauca

SEQ ID NO: 2239431 - RNA, 16 nt, Yersinia pestis
ucaauucucccauuua

SEQ ID NO: 2239432 - RNA, 20 nt, Yersinia pestis
ucaauguauugcuccagagg

SEQ ID NO: 2239433 - RNA, 23 nt, Yersinia pestis
ucaaugcuggcaguggcggcaaa

SEQ ID NO: 2239434 - RNA, 21 nt, Yersinia pestis
ucaaugggauccgcgauaacg

SEQ ID NO: 2239435 - RNA, 20 nt, Yersinia pestis
ucacacgcccaggccauagc

SEQ ID NO: 2239436 - RNA, 16 nt, Yersinia pestis
ucacaaucucuggcaa

SEQ ID NO: 2239437 - RNA, 22 nt, Yersinia pestis
ucacaaucgcauugacgauauc

SEQ ID NO: 2239438 - RNA, 13 nt, Yersinia pestis
ucacacagccagc

SEQ ID NO: 2239439 - RNA, 18 nt, Yersinia pestis
ucacauccgaucagccag

SEQ ID NO: 2239440 - RNA, 20 nt, Yersinia pestis
ucacccucugcagcuugcaa

SEQ ID NO: 2239441 - RNA, 20 nt, Yersinia pestis
ucaccaugauuucgacauca

SEQ ID NO: 2239442 - RNA, 19 nt, Yersinia pestis
ucacccauacgaucagcaa

SEQ ID NO: 2239443 - RNA, 20 nt, Yersinia pestis
ucacccagcaaaauagcaca

SEQ ID NO: 2239444 - RNA, 20 nt, Yersinia pestis
ucaccccgcguugucagcca

SEQ ID NO: 2239445 - RNA, 15 nt, Yersinia pestis
ucaccagauggcgau

SEQ ID NO: 2239446 - RNA, 15 nt, Yersinia pestis
uaaaaucuaucgaua

SEQ ID NO: 2239447 - RNA, 14 nt, Yersinia pestis
uaaacccggcauca

SEQ ID NO: 2239448 - RNA, 14 nt, Yersinia pestis
uaaacguucugcca

SEQ ID NO: 2239449 - RNA, 18 nt, Yersinia pestis
uaaacuugauucaccaga

SEQ ID NO: 2239450 - RNA, 17 nt, Yersinia pestis
uaaagaaugcaaccagu

SEQ ID NO: 2239451 - RNA, 17 nt, Yersinia pestis
guuucaauaaaucccgc

SEQ ID NO: 2239452 - RNA, 21 nt, Yersinia pestis
uaaaaaucagagauaacggcg

SEQ ID NO: 2239453 - RNA, 16 nt, Yersinia pestis
uaaccaugaugacaau

SEQ ID NO: 2239454 - RNA, 17 nt, Yersinia pestis
uaaccagaccgauagcc

SEQ ID NO: 2239455 - RNA, 20 nt, Yersinia pestis
uaaccaggugcagauaaacu

SEQ ID NO: 2239456 - RNA, 16 nt, Yersinia pestis
uaaccaguuaucgaua

SEQ ID NO: 2239457 - RNA, 17 nt, Yersinia pestis
uaacgacgcauuaaucc

SEQ ID NO: 2239458 - RNA, 15 nt, Yersinia pestis
uaacgaggcauaauc

SEQ ID NO: 2239459 - RNA, 22 nt, Yersinia pestis
uaacgccaccaaugcauccaag

SEQ ID NO: 2239460 - RNA, 20 nt, Yersinia pestis
uaacgccgcuaaaucaucaa

SEQ ID NO: 2239461 - RNA, 15 nt, Yersinia pestis
uaacgccgcugaccu

SEQ ID NO: 2239462 - RNA, 11 nt, Yersinia pestis
uaaaucggcgg

SEQ ID NO: 2239463 - RNA, 18 nt, Yersinia pestis
uaaauaccaauuucauac

SEQ ID NO: 2239464 - RNA, 23 nt, Yersinia pestis
uaaauacagcaccauucaaugua

SEQ ID NO: 2239465 - RNA, 20 nt, Yersinia pestis
uaaagugcuucucugccgcu

SEQ ID NO: 2239466 - RNA, 13 nt, Yersinia pestis
uaacaacaauuua

SEQ ID NO: 2239467 - RNA, 13 nt, Yersinia pestis
uaauuucuugaug

SEQ ID NO: 2239468 - RNA, 16 nt, Yersinia pestis
uaauugaagauuuaaa

SEQ ID NO: 2239469 - RNA, 15 nt, Yersinia pestis
uaauuaccacgacga

SEQ ID NO: 2239470 - RNA, 18 nt, Yersinia pestis
uaaugccacgucaucgaa

SEQ ID NO: 2239471 - RNA, 19 nt, Yersinia pestis
uaaugcaccaaucaacaua

SEQ ID NO: 2239472 - RNA, 17 nt, Yersinia pestis
uaauuaauucaaucggc

SEQ ID NO: 2239473 - RNA, 18 nt, Yersinia pestis
uacacaggcguaauaugu

SEQ ID NO: 2239474 - RNA, 15 nt, Yersinia pestis
uacaccaacgcaaug

SEQ ID NO: 2239475 - RNA, 16 nt, Yersinia pestis
uacaccaauaaucggg

SEQ ID NO: 2239476 - RNA, 19 nt, Yersinia pestis
uacacccgaaggccauugc

SEQ ID NO: 2239477 - RNA, 19 nt, Yersinia pestis
uacagcagcaguauuagcg

SEQ ID NO: 2239478 - RNA, 16 nt, Yersinia pestis
uaagugaauaacgcug

SEQ ID NO: 2239479 - RNA, 15 nt, Yersinia pestis
uaaguugaugcagua

SEQ ID NO: 2239480 - RNA, 16 nt, Yersinia pestis
uaacugcauagcuaac

SEQ ID NO: 2239481 - RNA, 17 nt, Yersinia pestis
uaacugcacaauuuggu

SEQ ID NO: 2239482 - RNA, 16 nt, Yersinia pestis
uaacuggucuagcgca

SEQ ID NO: 2239483 - RNA, 21 nt, Yersinia pestis
uaagccgcagaugccagacuu

SEQ ID NO: 2239484 - RNA, 17 nt, Yersinia pestis
uaauagcgaaagccaaa

SEQ ID NO: 2239485 - RNA, 18 nt, Yersinia pestis
uaauaguuaaucgcagca

SEQ ID NO: 2239486 - RNA, 13 nt, Yersinia pestis
uaauauaauacuu

SEQ ID NO: 2239487 - RNA, 20 nt, Yersinia pestis
uaauagauaguacguagcga

SEQ ID NO: 2239488 - RNA, 17 nt, Yersinia pestis
uaauagguuggcauuag

SEQ ID NO: 2239489 - RNA, 13 nt, Yersinia pestis
uaauacugacauu

SEQ ID NO: 2239490 - RNA, 15 nt, Yersinia pestis
uaauacugauagcgg

SEQ ID NO: 2239491 - RNA, 13 nt, Yersinia pestis
uaaugauggcgau

SEQ ID NO: 2239492 - RNA, 13 nt, Yersinia pestis
uaaugacgcuaug

SEQ ID NO: 2239493 - RNA, 18 nt, Yersinia pestis
uaaugagccgcauugauc

SEQ ID NO: 2239494 - RNA, 15 nt, Yersinia pestis
uaaucggauggucau

SEQ ID NO: 2239495 - RNA, 13 nt, Yersinia pestis
uacugcauuucaa

SEQ ID NO: 2239496 - RNA, 18 nt, Yersinia pestis
uacucauauuguccaaag

SEQ ID NO: 2239497 - RNA, 16 nt, Yersinia pestis
uacucagggaugcgcc

SEQ ID NO: 2239498 - RNA, 14 nt, Yersinia pestis
uagacgucagauua

SEQ ID NO: 2239499 - RNA, 13 nt, Yersinia pestis
uagccagcguggu

SEQ ID NO: 2239500 - RNA, 19 nt, Yersinia pestis
uagcacguuuuucagcuuc

SEQ ID NO: 2239501 - RNA, 20 nt, Yersinia pestis
uagauaccgcaaccauugcu

SEQ ID NO: 2239502 - RNA, 16 nt, Yersinia pestis
uagauagaaaucacug

SEQ ID NO: 2239503 - RNA, 14 nt, Yersinia pestis
uagcgauauaacuc

SEQ ID NO: 2239504 - RNA, 21 nt, Yersinia pestis
uagcgcaaagagaacgggcaa

SEQ ID NO: 2239505 - RNA, 23 nt, Yersinia pestis
uacccggccaaccguagugaguc

SEQ ID NO: 2239506 - RNA, 11 nt, Yersinia pestis
uacccgaauca

SEQ ID NO: 2239507 - RNA, 19 nt, Yersinia pestis
uacccgacaccggcugauu

SEQ ID NO: 2239508 - RNA, 18 nt, Yersinia pestis
uacccuaauucagauguu

SEQ ID NO: 2239509 - RNA, 20 nt, Yersinia pestis
uacccuaucgucacagcaau

SEQ ID NO: 2239510 - RNA, 20 nt, Yersinia pestis
uacccguaauauuucaagcu

SEQ ID NO: 2239511 - RNA, 18 nt, Yersinia pestis
uaccaauuucauacaggc

SEQ ID NO: 2239512 - RNA, 15 nt, Yersinia pestis
uacagguguaccgcu

SEQ ID NO: 2239513 - RNA, 21 nt, Yersinia pestis
uacagguguugaguaacgcca

SEQ ID NO: 2239514 - RNA, 18 nt, Yersinia pestis
uacaguagugaagauaau

SEQ ID NO: 2239515 - RNA, 19 nt, Yersinia pestis
uaccacuauccaacugggc

SEQ ID NO: 2239516 - RNA, 20 nt, Yersinia pestis
uaccacgucuaauugcugcc

SEQ ID NO: 2239517 - RNA, 13 nt, Yersinia pestis
uaccgccaagcgc

SEQ ID NO: 2239518 - RNA, 14 nt, Yersinia pestis
uaccgcgaucaaca

SEQ ID NO: 2239519 - RNA, 19 nt, Yersinia pestis
uacgauguaaucugaauag

SEQ ID NO: 2239520 - RNA, 13 nt, Yersinia pestis
uaccgucauccag

SEQ ID NO: 2239521 - RNA, 22 nt, Yersinia pestis
uacgccaccuucuuauuuauca

SEQ ID NO: 2239522 - RNA, 11 nt, Yersinia pestis
uacgccagcag

SEQ ID NO: 2239523 - RNA, 12 nt, Yersinia pestis
uacgcagguuau

SEQ ID NO: 2239524 - RNA, 17 nt, Yersinia pestis
uacgcaacguaauaucu

SEQ ID NO: 2239525 - RNA, 19 nt, Yersinia pestis
uacgcagcuuguugauauc

SEQ ID NO: 2239526 - RNA, 18 nt, Yersinia pestis
guuaagccgugcggcacu

SEQ ID NO: 2239527 - RNA, 16 nt, Yersinia pestis
guuaaguuucaucauu

SEQ ID NO: 2239528 - RNA, 23 nt, Yersinia pestis
guuaagauuacguagacauaaau

SEQ ID NO: 2239529 - RNA, 21 nt, Yersinia pestis
guguaggcaccaccaugauga

SEQ ID NO: 2239530 - RNA, 15 nt, Yersinia pestis
guguaaaaccuucgc

SEQ ID NO: 2239531 - RNA, 16 nt, Yersinia pestis
gugguucuauauagac

SEQ ID NO: 2239532 - RNA, 14 nt, Yersinia pestis
gugguuaacagcgu

SEQ ID NO: 2239533 - RNA, 19 nt, Yersinia pestis
gugucaauguagacuuggc

SEQ ID NO: 2239534 - RNA, 20 nt, Yersinia pestis
guucaaccuuuuccgccaug

SEQ ID NO: 2239535 - RNA, 13 nt, Yersinia pestis
guucaagaaccga

SEQ ID NO: 2239536 - RNA, 21 nt, Yersinia pestis
guuauugcugcacaaguuggu

SEQ ID NO: 2239537 - RNA, 14 nt, Yersinia pestis
guuaucacaucauc

SEQ ID NO: 2239538 - RNA, 14 nt, Yersinia pestis
guuaucaucaccac

SEQ ID NO: 2239539 - RNA, 20 nt, Yersinia pestis
guuauaaccaugaugacaau

SEQ ID NO: 2239540 - RNA, 19 nt, Yersinia pestis
guuagggcgcggcugguaa

SEQ ID NO: 2239541 - RNA, 23 nt, Yersinia pestis
guuagcgauuucuaguggcaacg

SEQ ID NO: 2239542 - RNA, 17 nt, Yersinia pestis
guuaccuugugucacca

SEQ ID NO: 2239543 - RNA, 22 nt, Yersinia pestis
guuacgauacguugcaggucaa

SEQ ID NO: 2239544 - RNA, 24 nt, Yersinia pestis
guuaccuauaaacuugauucacca

SEQ ID NO: 2239545 - RNA, 14 nt, Yersinia pestis
guuaaugcggaucg

SEQ ID NO: 2239546 - RNA, 13 nt, Yersinia pestis
guucagcaccagu

SEQ ID NO: 2239547 - RNA, 16 nt, Yersinia pestis
guucagaucggcucca

SEQ ID NO: 2239548 - RNA, 22 nt, Yersinia pestis
guucagacguacauauaucacu

SEQ ID NO: 2239549 - RNA, 22 nt, Yersinia pestis
guucaccccagucacuuacuga

SEQ ID NO: 2239550 - RNA, 11 nt, Yersinia pestis
guucugcgccc

SEQ ID NO: 2239551 - RNA, 17 nt, Yersinia pestis
guugucuauguuugaug

SEQ ID NO: 2239552 - RNA, 16 nt, Yersinia pestis
guuggguaaaccaauc

SEQ ID NO: 2239553 - RNA, 12 nt, Yersinia pestis
guugacgccauu

SEQ ID NO: 2239554 - RNA, 14 nt, Yersinia pestis
guugcgccgcuuug

SEQ ID NO: 2239555 - RNA, 12 nt, Yersinia pestis
gcugacacgcca

SEQ ID NO: 2239556 - RNA, 15 nt, Yersinia pestis
gcugaucugccagua

SEQ ID NO: 2239557 - RNA, 14 nt, Yersinia pestis
gcugaucugccccu

SEQ ID NO: 2239558 - RNA, 23 nt, Yersinia pestis
gcugacgauaacuuuuggcagca

SEQ ID NO: 2239559 - RNA, 16 nt, Yersinia pestis
gcugacuuguggaaca

SEQ ID NO: 2239560 - RNA, 20 nt, Yersinia pestis
gcugagugaagacaucgcca

SEQ ID NO: 2239561 - RNA, 22 nt, Yersinia pestis
gcuaccaagacuucaugacuac

SEQ ID NO: 2239562 - RNA, 21 nt, Yersinia pestis
gcuccugagggugaugacaau

SEQ ID NO: 2239563 - RNA, 17 nt, Yersinia pestis
gcucgcuguggcuacca

SEQ ID NO: 2239564 - RNA, 20 nt, Yersinia pestis
gcucgaucagcgucagcaga

SEQ ID NO: 2239565 - RNA, 12 nt, Yersinia pestis
gcuuuaaugagu

SEQ ID NO: 2239566 - RNA, 13 nt, Yersinia pestis
ggaaaguagccau

SEQ ID NO: 2239567 - RNA, 14 nt, Yersinia pestis
ggaagaaucaccga

SEQ ID NO: 2239568 - RNA, 14 nt, Yersinia pestis
ggacugccgcgcca

SEQ ID NO: 2239569 - RNA, 21 nt, Yersinia pestis
gcuucaguaaagcgcaggaaa

SEQ ID NO: 2239570 - RNA, 23 nt, Yersinia pestis
gcuuccagcucugggaucgauug

SEQ ID NO: 2239571 - RNA, 20 nt, Yersinia pestis
gcuuaacugugcagcccauu

SEQ ID NO: 2239572 - RNA, 19 nt, Yersinia pestis
gcuuaaauaaaacacccuu

SEQ ID NO: 2239573 - RNA, 23 nt, Yersinia pestis
gcuuacuuacccgaaucacuuac

SEQ ID NO: 2239574 - RNA, 21 nt, Yersinia pestis
gcuuauccgcuuuggucaaca

SEQ ID NO: 2239575 - RNA, 15 nt, Yersinia pestis
gcuuauuaauuaaug

SEQ ID NO: 2239576 - RNA, 15 nt, Yersinia pestis
gcuuauccgggugau

SEQ ID NO: 2239577 - RNA, 13 nt, Yersinia pestis
gcuuccugcgcca

SEQ ID NO: 2239578 - RNA, 13 nt, Yersinia pestis
gcuguuauuacug

SEQ ID NO: 2239579 - RNA, 21 nt, Yersinia pestis
gcuguuaagcauugaguacgc

SEQ ID NO: 2239580 - RNA, 21 nt, Yersinia pestis
gcuggucagcggagcagauca

SEQ ID NO: 2239581 - RNA, 17 nt, Yersinia pestis
gcuguacugcugcaacu

SEQ ID NO: 2239582 - RNA, 19 nt, Yersinia pestis
gcuguccaguugcuggaac

SEQ ID NO: 2239583 - RNA, 16 nt, Yersinia pestis
gcuggcuaucaucccu

SEQ ID NO: 2239584 - RNA, 17 nt, Yersinia pestis
gcuaaggugugauugaa

SEQ ID NO: 2239585 - RNA, 16 nt, Yersinia pestis
gcuaacgucgcuguua

SEQ ID NO: 2239586 - RNA, 22 nt, Yersinia pestis
gcuaacaccuuuaccuuuacgg

SEQ ID NO: 2239587 - RNA, 16 nt, Yersinia pestis
gcuaaccccugcaucu

SEQ ID NO: 2239588 - RNA, 16 nt, Yersinia pestis
gcuaaagucacacugu

SEQ ID NO: 2239589 - RNA, 22 nt, Yersinia pestis
gcuaaauacugcuggaacguug

SEQ ID NO: 2239590 - RNA, 23 nt, Yersinia pestis
gcuaaacccaaccccaucagcau

SEQ ID NO: 2239591 - RNA, 17 nt, Yersinia pestis
gcuaaacauccguucaa

SEQ ID NO: 2239592 - RNA, 17 nt, Yersinia pestis
gcguuuucugcauaagc

SEQ ID NO: 2239593 - RNA, 20 nt, Yersinia pestis
gcguuaucggcgcaggcaga

SEQ ID NO: 2239594 - RNA, 18 nt, Yersinia pestis
gcgucgccguaaauugcu

SEQ ID NO: 2239595 - RNA, 13 nt, Yersinia pestis
gcggucacgcuga

SEQ ID NO: 2239596 - RNA, 14 nt, Yersinia pestis
gcgggcuggccaca

SEQ ID NO: 2239597 - RNA, 16 nt, Yersinia pestis
gcgggcaucagcccau

SEQ ID NO: 2239598 - RNA, 16 nt, Yersinia pestis
gcgaaaauccuucauu

SEQ ID NO: 2239599 - RNA, 19 nt, Yersinia pestis
gcgaaaaauuucacuggca

SEQ ID NO: 2239600 - RNA, 13 nt, Yersinia pestis
gccuuucccugaa

SEQ ID NO: 2239601 - RNA, 23 nt, Yersinia pestis
gcgaagaacaacgggccguuuac

SEQ ID NO: 2239602 - RNA, 17 nt, Yersinia pestis
gccuucauguugcaaca

SEQ ID NO: 2239603 - RNA, 23 nt, Yersinia pestis
gcgaggagguaugacgagcggua

SEQ ID NO: 2239604 - RNA, 21 nt, Yersinia pestis
gcgacaccaagaggcugcgug

SEQ ID NO: 2239605 - RNA, 22 nt, Yersinia pestis
gccuauuaagauaauuauccau

SEQ ID NO: 2239606 - RNA, 15 nt, Yersinia pestis
gccuauccucaugau

SEQ ID NO: 2239607 - RNA, 18 nt, Yersinia pestis
gccguuuacucgcaauac

SEQ ID NO: 2239608 - RNA, 20 nt, Yersinia pestis
gccguuggcuaaauaaccag

SEQ ID NO: 2239609 - RNA, 17 nt, Yersinia pestis
gccgugccugcuggcaa

SEQ ID NO: 2239610 - RNA, 18 nt, Yersinia pestis
gccgugccugcuggcaaa

SEQ ID NO: 2239611 - RNA, 17 nt, Yersinia pestis
gccucgaccuuaaccgc

SEQ ID NO: 2239612 - RNA, 21 nt, Yersinia pestis
gccgucuggcuaauacugcca

SEQ ID NO: 2239613 - RNA, 13 nt, Yersinia pestis
gccgggcagcaag

SEQ ID NO: 2239614 - RNA, 23 nt, Yersinia pestis
gcgccgcuucggucucuggaugc

SEQ ID NO: 2239615 - RNA, 17 nt, Yersinia pestis
gcgcauccccaucgcca

SEQ ID NO: 2239616 - RNA, 20 nt, Yersinia pestis
gcgcaucgacuugcucuuga

SEQ ID NO: 2239617 - RNA, 14 nt, Yersinia pestis
gcgcaucgccaucc

SEQ ID NO: 2239618 - RNA, 16 nt, Yersinia pestis
gcgcagguuaugcagc

SEQ ID NO: 2239619 - RNA, 15 nt, Yersinia pestis
gcgcagugcucgggu

SEQ ID NO: 2239620 - RNA, 19 nt, Yersinia pestis
gcgcaggcagauugagugc

SEQ ID NO: 2239621 - RNA, 18 nt, Yersinia pestis
gcgcagagaucgauagca

SEQ ID NO: 2239622 - RNA, 10 nt, Yersinia pestis
gcgcagcaaa

SEQ ID NO: 2239623 - RNA, 17 nt, Yersinia pestis
gcgaucaauacaccaga

SEQ ID NO: 2239624 - RNA, 23 nt, Yersinia pestis
gcgaucaccaguacgccgacaau

SEQ ID NO: 2239625 - RNA, 22 nt, Yersinia pestis
gcgcaccgaaauagucgcgcug

SEQ ID NO: 2239626 - RNA, 17 nt, Yersinia pestis
ggauugccaaaugcaaa

SEQ ID NO: 2239627 - RNA, 18 nt, Yersinia pestis
ggcaacgacagcaacaac

SEQ ID NO: 2239628 - RNA, 13 nt, Yersinia pestis
ggcaaccgaguaa

SEQ ID NO: 2239629 - RNA, 21 nt, Yersinia pestis
ggcaauaauucagaugagaau

SEQ ID NO: 2239630 - RNA, 13 nt, Yersinia pestis
ggcaaucuccagu

SEQ ID NO: 2239631 - RNA, 20 nt, Yersinia pestis
ggcaaucucuccccaagcgg

SEQ ID NO: 2239632 - RNA, 15 nt, Yersinia pestis
ggcaaguucagcauc

SEQ ID NO: 2239633 - RNA, 15 nt, Yersinia pestis
ggcaauauaggcguc

SEQ ID NO: 2239634 - RNA, 21 nt, Yersinia pestis
ggcacgugcagguuugccaau

SEQ ID NO: 2239635 - RNA, 20 nt, Yersinia pestis
ggcacuccgguggcuuacgc

SEQ ID NO: 2239636 - RNA, 18 nt, Yersinia pestis
ggcacgcuuucugcaaua

SEQ ID NO: 2239637 - RNA, 17 nt, Yersinia pestis
ggcaugauagcgcgaga

SEQ ID NO: 2239638 - RNA, 17 nt, Yersinia pestis
ggcaugaaguuuaacca

SEQ ID NO: 2239639 - RNA, 22 nt, Yersinia pestis
ggcauggaacgggaacagcgcc

SEQ ID NO: 2239640 - RNA, 20 nt, Yersinia pestis
ggcgaaagcauggcagguau

SEQ ID NO: 2239641 - RNA, 14 nt, Yersinia pestis
ggccgcuugccaau

SEQ ID NO: 2239642 - RNA, 12 nt, Yersinia pestis
ggccgccaaaua

SEQ ID NO: 2239643 - RNA, 15 nt, Yersinia pestis
ggccgacaauaccgc

SEQ ID NO: 2239644 - RNA, 18 nt, Yersinia pestis
ggcuaucggguaacggcu

SEQ ID NO: 2239645 - RNA, 18 nt, Yersinia pestis
ggcuauuacugucaaugc

SEQ ID NO: 2239646 - RNA, 14 nt, Yersinia pestis
ggcuaucuuaugac

SEQ ID NO: 2239647 - RNA, 21 nt, Yersinia pestis
ggcuaaaggugauaucaauac

SEQ ID NO: 2239648 - RNA, 22 nt, Yersinia pestis
ggcggucugagucagucagggu

SEQ ID NO: 2239649 - RNA, 20 nt, Yersinia pestis
ggcuggaaaggaauaucugu

SEQ ID NO: 2239650 - RNA, 22 nt, Yersinia pestis
ggcugcgcaccacugucagggc

SEQ ID NO: 2239651 - RNA, 18 nt, Yersinia pestis
ggcugauucacuggcaaa

SEQ ID NO: 2239652 - RNA, 15 nt, Yersinia pestis
ggcucccccuugauu

SEQ ID NO: 2239653 - RNA, 22 nt, Yersinia pestis
gggaauuaagaagccucaugaa

SEQ ID NO: 2239654 - RNA, 18 nt, Yersinia pestis
gggaauucaccggcaauc

SEQ ID NO: 2239655 - RNA, 23 nt, Yersinia pestis
ggcuuuuuuaauaaaaaacugac

SEQ ID NO: 2239656 - RNA, 14 nt, Yersinia pestis
gggcggcaaugacu

SEQ ID NO: 2239657 - RNA, 14 nt, Yersinia pestis
gggcggcggcuacg

SEQ ID NO: 2239658 - RNA, 20 nt, Yersinia pestis
ggcgcuuaauucuggccgau

SEQ ID NO: 2239659 - RNA, 20 nt, Yersinia pestis
ggcgcacgaauaucuagcaa

SEQ ID NO: 2239660 - RNA, 19 nt, Yersinia pestis
ggcgcagagaucgauagca

SEQ ID NO: 2239661 - RNA, 15 nt, Yersinia pestis
ggcgacaaucaaugg

SEQ ID NO: 2239662 - RNA, 16 nt, Yersinia pestis
guaacuguaaggccaa

SEQ ID NO: 2239663 - RNA, 15 nt, Yersinia pestis
guaagauuucaagca

SEQ ID NO: 2239664 - RNA, 13 nt, Yersinia pestis
guaauucagauaa

SEQ ID NO: 2239665 - RNA, 22 nt, Yersinia pestis
guaacgacgaaauagcgccugc

SEQ ID NO: 2239666 - RNA, 18 nt, Yersinia pestis
guaacggaauucagaacg

SEQ ID NO: 2239667 - RNA, 16 nt, Yersinia pestis
guaacggaauucagaa

SEQ ID NO: 2239668 - RNA, 12 nt, Yersinia pestis
guaaauacaugg

SEQ ID NO: 2239669 - RNA, 17 nt, Yersinia pestis
gguuguccuucaauggc

SEQ ID NO: 2239670 - RNA, 13 nt, Yersinia pestis
gguuggcuagccu

SEQ ID NO: 2239671 - RNA, 14 nt, Yersinia pestis
gguuaaauacagca

SEQ ID NO: 2239672 - RNA, 16 nt, Yersinia pestis
gguguuuuguaaaugc

SEQ ID NO: 2239673 - RNA, 14 nt, Yersinia pestis
gguggauuaccggc

SEQ ID NO: 2239674 - RNA, 14 nt, Yersinia pestis
guauccaucugaug

SEQ ID NO: 2239675 - RNA, 23 nt, Yersinia pestis
guauauugcucuggauucggcuu

SEQ ID NO: 2239676 - RNA, 16 nt, Yersinia pestis
guauaacucaucagua

SEQ ID NO: 2239677 - RNA, 23 nt, Yersinia pestis
gucacaccagacagaauauccag

SEQ ID NO: 2239678 - RNA, 17 nt, Yersinia pestis
guauguuccugaauggc

SEQ ID NO: 2239679 - RNA, 22 nt, Yersinia pestis
gucaaauucccccaaaaccucu

SEQ ID NO: 2239680 - RNA, 19 nt, Yersinia pestis
gucacccgcacguagcaca

SEQ ID NO: 2239681 - RNA, 22 nt, Yersinia pestis
guaccggcgguuaucacaucau

SEQ ID NO: 2239682 - RNA, 22 nt, Yersinia pestis
guacgugacggcagcgagcacu

SEQ ID NO: 2239683 - RNA, 17 nt, Yersinia pestis
guacuccucgccgguaa

SEQ ID NO: 2239684 - RNA, 12 nt, Yersinia pestis
guaccugcauca

SEQ ID NO: 2239685 - RNA, 21 nt, Yersinia pestis
guacgacgccagauagcauca

SEQ ID NO: 2239686 - RNA, 14 nt, Yersinia pestis
guagcccacugaca

SEQ ID NO: 2239687 - RNA, 17 nt, Yersinia pestis
guacuuugcgaaagacg

SEQ ID NO: 2239688 - RNA, 17 nt, Yersinia pestis
gguaaagcccauagcca

SEQ ID NO: 2239689 - RNA, 14 nt, Yersinia pestis
ggguuccaacugau

SEQ ID NO: 2239690 - RNA, 23 nt, Yersinia pestis
gguaaugcgcaccagcucaauac

SEQ ID NO: 2239691 - RNA, 17 nt, Yersinia pestis
gguaaccagcaucagua

SEQ ID NO: 2239692 - RNA, 22 nt, Yersinia pestis
gguaacuuacaggcugccugcc

SEQ ID NO: 2239693 - RNA, 13 nt, Yersinia pestis
gguaucggugaug

SEQ ID NO: 2239694 - RNA, 15 nt, Yersinia pestis
gguauucaucagcaa

SEQ ID NO: 2239695 - RNA, 19 nt, Yersinia pestis
ggucaauaaacgccgauca

SEQ ID NO: 2239696 - RNA, 18 nt, Yersinia pestis
ggucacuaaaacugaagc

SEQ ID NO: 2239697 - RNA, 23 nt, Yersinia pestis
gguagccugcacggcucaggugc

SEQ ID NO: 2239698 - RNA, 13 nt, Yersinia pestis
gguacuuaacugg

SEQ ID NO: 2239699 - RNA, 17 nt, Yersinia pestis
gugaauaacgcuggaua

SEQ ID NO: 2239700 - RNA, 16 nt, Yersinia pestis
gugaauucacucagau

SEQ ID NO: 2239701 - RNA, 13 nt, Yersinia pestis
gugacaaacgcuu

SEQ ID NO: 2239702 - RNA, 14 nt, Yersinia pestis
gugaaucagccaga

SEQ ID NO: 2239703 - RNA, 20 nt, Yersinia pestis
gugacauccgcuugcagcaa

SEQ ID NO: 2239704 - RNA, 20 nt, Yersinia pestis
gucugcuguugccacagacg

SEQ ID NO: 2239705 - RNA, 18 nt, Yersinia pestis
gucugcgucauaccauuc

SEQ ID NO: 2239706 - RNA, 15 nt, Yersinia pestis
gucgucuucagcuuc

SEQ ID NO: 2239707 - RNA, 13 nt, Yersinia pestis
gugaggaucaccg

SEQ ID NO: 2239708 - RNA, 14 nt, Yersinia pestis
gugacuaacacggu

SEQ ID NO: 2239709 - RNA, 18 nt, Yersinia pestis
gugauggcugucugauga

SEQ ID NO: 2239710 - RNA, 17 nt, Yersinia pestis
gugaucucguugcccug

SEQ ID NO: 2239711 - RNA, 16 nt, Yersinia pestis
gugaucgcugccaccg

SEQ ID NO: 2239712 - RNA, 15 nt, Yersinia pestis
gugaucgcugccgca

SEQ ID NO: 2239713 - RNA, 22 nt, Yersinia pestis
gugaucgcucaggcggucaccg

SEQ ID NO: 2239714 - RNA, 18 nt, Yersinia pestis
gugcaaucaagggcgaua

SEQ ID NO: 2239715 - RNA, 20 nt, Yersinia pestis
gugcagaacaaaagugaaac

SEQ ID NO: 2239716 - RNA, 16 nt, Yersinia pestis
gugccaacccuugaua

SEQ ID NO: 2239717 - RNA, 14 nt, Yersinia pestis
guccguguuggcaa

SEQ ID NO: 2239718 - RNA, 19 nt, Yersinia pestis
guccucugauuguaacaau

SEQ ID NO: 2239719 - RNA, 15 nt, Yersinia pestis
guccauaaucuggaa

SEQ ID NO: 2239720 - RNA, 13 nt, Yersinia pestis
gucagaucgcgau

SEQ ID NO: 2239721 - RNA, 20 nt, Yersinia pestis
gucagauuaguuuuagacgu

SEQ ID NO: 2239722 - RNA, 12 nt, Yersinia pestis
gucacggaaagc

SEQ ID NO: 2239723 - RNA, 23 nt, Yersinia pestis
gucccuacgguaccgcaggucag

SEQ ID NO: 2239724 - RNA, 20 nt, Yersinia pestis
gucgcauaagacaacgccgc

SEQ ID NO: 2239725 - RNA, 19 nt, Yersinia pestis
uuagaugauugaaaaucag

SEQ ID NO: 2239726 - RNA, 16 nt, Yersinia pestis
uuagauuacagccuaa

SEQ ID NO: 2239727 - RNA, 18 nt, Yersinia pestis
uuagcaccggauggucac

SEQ ID NO: 2239728 - RNA, 18 nt, Yersinia pestis
uuagcacguuuuucagcu

SEQ ID NO: 2239729 - RNA, 23 nt, Yersinia pestis
uuacggccgcuaguuugacgcug

SEQ ID NO: 2239730 - RNA, 23 nt, Yersinia pestis
uuacguaauaucagcaaaguacc

SEQ ID NO: 2239731 - RNA, 15 nt, Yersinia pestis
uuaguuuuagacguc

SEQ ID NO: 2239732 - RNA, 13 nt, Yersinia pestis
uuaguuucuacgg

SEQ ID NO: 2239733 - RNA, 13 nt, Yersinia pestis
uuaucaacgaaga

SEQ ID NO: 2239734 - RNA, 23 nt, Yersinia pestis
uuaucaaucagacggaauaccac

SEQ ID NO: 2239735 - RNA, 18 nt, Yersinia pestis
uuaucacaucauccacua

SEQ ID NO: 2239736 - RNA, 16 nt, Yersinia pestis
uuauccaacuggcgca

SEQ ID NO: 2239737 - RNA, 18 nt, Yersinia pestis
uuaucagggccuacguuc

SEQ ID NO: 2239738 - RNA, 14 nt, Yersinia pestis
uuaucacgucgcca

SEQ ID NO: 2239739 - RNA, 18 nt, Yersinia pestis
uuaggauacguucgccgu

SEQ ID NO: 2239740 - RNA, 14 nt, Yersinia pestis
uuaguaaucaauaa

SEQ ID NO: 2239741 - RNA, 15 nt, Yersinia pestis
uuagucuuagacguc

SEQ ID NO: 2239742 - RNA, 18 nt, Yersinia pestis
uuagugcugccagacaau

SEQ ID NO: 2239743 - RNA, 21 nt, Yersinia pestis
uuaaccgcuuggggucgcgca

SEQ ID NO: 2239744 - RNA, 23 nt, Yersinia pestis
uuaaauuauugaguaacauuaau

SEQ ID NO: 2239745 - RNA, 14 nt, Yersinia pestis
uuaacaauuuauca

SEQ ID NO: 2239746 - RNA, 21 nt, Yersinia pestis
uuaauccacuuuucagauagc

SEQ ID NO: 2239747 - RNA, 17 nt, Yersinia pestis
uuaaucaucgacuugau

SEQ ID NO: 2239748 - RNA, 15 nt, Yersinia pestis
uuaaucaagauauua

SEQ ID NO: 2239749 - RNA, 18 nt, Yersinia pestis
uuaauacugaacauggau

SEQ ID NO: 2239750 - RNA, 16 nt, Yersinia pestis
uuacagacgaucggca

SEQ ID NO: 2239751 - RNA, 18 nt, Yersinia pestis
uuaaucgcagcagagaau

SEQ ID NO: 2239752 - RNA, 16 nt, Yersinia pestis
uguugacucaccggcu

SEQ ID NO: 2239753 - RNA, 22 nt, Yersinia pestis
ugucaauaaaaugggccugagu

SEQ ID NO: 2239754 - RNA, 15 nt, Yersinia pestis
ugucaauaaccucag

SEQ ID NO: 2239755 - RNA, 22 nt, Yersinia pestis
ugucgggugguugucuauguuu

SEQ ID NO: 2239756 - RNA, 19 nt, Yersinia pestis
ugucuuucauucggcacag

SEQ ID NO: 2239757 - RNA, 18 nt, Yersinia pestis
ugucugaggcguggcaca

SEQ ID NO: 2239758 - RNA, 16 nt, Yersinia pestis
uguuagcccaaggcga

SEQ ID NO: 2239759 - RNA, 19 nt, Yersinia pestis
uguucggggguugucagca

SEQ ID NO: 2239760 - RNA, 18 nt, Yersinia pestis
uguuauccagcgucaccg

SEQ ID NO: 2239761 - RNA, 21 nt, Yersinia pestis
uguuauccagcgucaccgaua

SEQ ID NO: 2239762 - RNA, 19 nt, Yersinia pestis
uguuauugaccaccuuauu

SEQ ID NO: 2239763 - RNA, 18 nt, Yersinia pestis
uguggaucagaccuuuac

SEQ ID NO: 2239764 - RNA, 16 nt, Yersinia pestis
uucagcucccgccgca

SEQ ID NO: 2239765 - RNA, 21 nt, Yersinia pestis
uucaggacugucuucaacuuu

SEQ ID NO: 2239766 - RNA, 14 nt, Yersinia pestis
uucagcuugcaaca

SEQ ID NO: 2239767 - RNA, 12 nt, Yersinia pestis
uucagcaccaua

SEQ ID NO: 2239768 - RNA, 23 nt, Yersinia pestis
uucaucucaauaacuauuuuuga

SEQ ID NO: 2239769 - RNA, 20 nt, Yersinia pestis
uucaucugaccaaacauugu

SEQ ID NO: 2239770 - RNA, 19 nt, Yersinia pestis
uucaucggauugaacguca

SEQ ID NO: 2239771 - RNA, 13 nt, Yersinia pestis
uucaucgcuuaac

SEQ ID NO: 2239772 - RNA, 15 nt, Yersinia pestis
uucaucauucaauac

SEQ ID NO: 2239773 - RNA, 17 nt, Yersinia pestis
uucaucgcauaggccaa

SEQ ID NO: 2239774 - RNA, 23 nt, Yersinia pestis
uucaucccuuuagcgucuaacag

SEQ ID NO: 2239775 - RNA, 14 nt, Yersinia pestis
uucauaugacaaau

SEQ ID NO: 2239776 - RNA, 13 nt, Yersinia pestis
uucauccaacuua

SEQ ID NO: 2239777 - RNA, 14 nt, Yersinia pestis
uucaucauucaaua

SEQ ID NO: 2239778 - RNA, 13 nt, Yersinia pestis
uucauaugacaaa

SEQ ID NO: 2239779 - RNA, 19 nt, Yersinia pestis
uuccauaugaacaucaaac

SEQ ID NO: 2239780 - RNA, 18 nt, Yersinia pestis
uucccuuguuugcgccgu

SEQ ID NO: 2239781 - RNA, 20 nt, Yersinia pestis
uucccguuagguucaauucc

SEQ ID NO: 2239782 - RNA, 21 nt, Yersinia pestis
uuccagacaaagugagggaua

SEQ ID NO: 2239783 - RNA, 13 nt, Yersinia pestis
uuccaauauugag

SEQ ID NO: 2239784 - RNA, 18 nt, Yersinia pestis
uuccacaacagauggcga

SEQ ID NO: 2239785 - RNA, 14 nt, Yersinia pestis
uucauguugcaaca

SEQ ID NO: 2239786 - RNA, 12 nt, Yersinia pestis
uucugcgggagu

SEQ ID NO: 2239787 - RNA, 15 nt, Yersinia pestis
uucuacaauggccuu

SEQ ID NO: 2239788 - RNA, 17 nt, Yersinia pestis
aaucacuucugcugcca

SEQ ID NO: 2239789 - RNA, 23 nt, Yersinia pestis
uucguuugggcuaagacuauuaa

SEQ ID NO: 2239790 - RNA, 22 nt, Yersinia pestis
uucggcgucccgaauaucgaaa

SEQ ID NO: 2239791 - RNA, 15 nt, Yersinia pestis
uucggcgucgccacc

SEQ ID NO: 2239792 - RNA, 18 nt, Yersinia pestis
uucgcuguaggauuucau

SEQ ID NO: 2239793 - RNA, 14 nt, Yersinia pestis
uucuucgaucaacg

SEQ ID NO: 2239794 - RNA, 15 nt, Yersinia pestis
uugauuaaaucagac

SEQ ID NO: 2239795 - RNA, 12 nt, Yersinia pestis
uugaugguucag

SEQ ID NO: 2239796 - RNA, 14 nt, Yersinia pestis
uugcauaucagcaa

SEQ ID NO: 2239797 - RNA, 18 nt, Yersinia pestis
uugcaucaccaucauuac

SEQ ID NO: 2239798 - RNA, 17 nt, Yersinia pestis
uugcagaucggcauuau

SEQ ID NO: 2239799 - RNA, 21 nt, Yersinia pestis
uugcaaacaucacaucggcga

SEQ ID NO: 2239800 - RNA, 10 nt, Yersinia pestis
aaucaucauc

SEQ ID NO: 2239801 - RNA, 21 nt, Yersinia pestis
aaucaugggccaauccaauag

SEQ ID NO: 2239802 - RNA, 10 nt, Yersinia pestis
aaucaugggg

SEQ ID NO: 2239803 - RNA, 18 nt, Yersinia pestis
aaucaugggguuuauugg

SEQ ID NO: 2239804 - RNA, 20 nt, Yersinia pestis
uugccacgccaguaaacagc

SEQ ID NO: 2239805 - RNA, 20 nt, Yersinia pestis
uugccagugaaucagccaga

SEQ ID NO: 2239806 - RNA, 18 nt, Yersinia pestis
uugucagguuaauaccug

SEQ ID NO: 2239807 - RNA, 19 nt, Yersinia pestis
uugucagcagucugaagcc

SEQ ID NO: 2239808 - RNA, 19 nt, Yersinia pestis
uugucagcagucugaggcc

SEQ ID NO: 2239809 - RNA, 16 nt, Yersinia pestis
uuguuuuacggcagua

SEQ ID NO: 2239810 - RNA, 19 nt, Yersinia pestis
uugugggucgccuugccgc

SEQ ID NO: 2239811 - RNA, 16 nt, Yersinia pestis
uugugucaauaccuua

SEQ ID NO: 2239812 - RNA, 15 nt, Yersinia pestis
uuguaacucaaugcc

SEQ ID NO: 2239813 - RNA, 12 nt, Yersinia pestis
uuguaugacaag

SEQ ID NO: 2239814 - RNA, 18 nt, Yersinia pestis
aaucgauacgcauugagg

SEQ ID NO: 2239815 - RNA, 12 nt, Yersinia pestis
uugucagcaguc

SEQ ID NO: 2239816 - RNA, 20 nt, Yersinia pestis
uugucagcagucugaaacgc

SEQ ID NO: 2239817 - RNA, 18 nt, Yersinia pestis
uuggucuuaucagcggua

SEQ ID NO: 2239818 - RNA, 17 nt, Yersinia pestis
uugggguauaacgauca

SEQ ID NO: 2239819 - RNA, 21 nt, Yersinia pestis
uuuggccaccgcgucgccgcu

SEQ ID NO: 2239820 - RNA, 18 nt, Yersinia pestis
uuuggcccccuagcgcaa

SEQ ID NO: 2239821 - RNA, 13 nt, Yersinia pestis
uuugcugcacugc

SEQ ID NO: 2239822 - RNA, 14 nt, Yersinia pestis
uuuuacgaucaacc

SEQ ID NO: 2239823 - RNA, 23 nt, Yersinia pestis
uuuuaauaaaaaacugacucacg

SEQ ID NO: 2239824 - RNA, 14 nt, Yersinia pestis
uuugugcaggagua

SEQ ID NO: 2239825 - RNA, 23 nt, Yersinia pestis
uuugaacgacaugugaguggugu

SEQ ID NO: 2239826 - RNA, 13 nt, Yersinia pestis
uuugaccagggcu

SEQ ID NO: 2239827 - RNA, 13 nt, Yersinia pestis
uuugauacuguuc

SEQ ID NO: 2239828 - RNA, 15 nt, Yersinia pestis
uuugagcucaccguu

SEQ ID NO: 2239829 - RNA, 19 nt, Yersinia pestis
uuuaaauaugaucuugaua

SEQ ID NO: 2239830 - RNA, 21 nt, Yersinia pestis
uuuacauaauaaccauuuaua

SEQ ID NO: 2239831 - RNA, 18 nt, Yersinia pestis
uuuaccaaaagcauccaa

SEQ ID NO: 2239832 - RNA, 14 nt, Yersinia pestis
uuuaccauccagug

SEQ ID NO: 2239833 - RNA, 18 nt, Yersinia pestis
uuuaccuccauauagccc

SEQ ID NO: 2239834 - RNA, 15 nt, Yersinia pestis
uuucccgugcacugc

SEQ ID NO: 2239835 - RNA, 23 nt, Yersinia pestis
uuucugaagggcaaauugccgcu

SEQ ID NO: 2239836 - RNA, 15 nt, Yersinia pestis
uuucucuuugcgcug

SEQ ID NO: 2239837 - RNA, 21 nt, Yersinia pestis
uuucuucaauaauguggcaug

SEQ ID NO: 2239838 - RNA, 20 nt, Yersinia pestis
aaugacuaauugugcagcau

SEQ ID NO: 2239839 - RNA, 19 nt, Yersinia pestis
aaugagagcgaauggcaau

SEQ ID NO: 2239840 - RNA, 16 nt, Yersinia pestis
aaugaugguaacgcgc

SEQ ID NO: 2239841 - RNA, 17 nt, Yersinia pestis
aaugauuaacggauacc

SEQ ID NO: 2239842 - RNA, 14 nt, Yersinia pestis
aauggcaacgcgca

SEQ ID NO: 2239843 - RNA, 20 nt, Yersinia pestis
aaugcggugguuaacagcgu

SEQ ID NO: 2239844 - RNA, 13 nt, Yersinia pestis
aauggucaggaac

SEQ ID NO: 2239845 - RNA, 21 nt, Yersinia pestis
aaugugacucagcgaauagua

SEQ ID NO: 2239846 - RNA, 20 nt, Yersinia pestis
uuuuuacagcaaacgucccg

SEQ ID NO: 2239847 - RNA, 19 nt, Yersinia pestis
uuuuucuuucaccaguggu

SEQ ID NO: 2239848 - RNA, 23 nt, Yersinia pestis
aaugaagguacgcaccauugagc

SEQ ID NO: 2239849 - RNA, 23 nt, Yersinia pestis
aaugacaguauuuguaguggaug

SEQ ID NO: 2239850 - RNA, 22 nt, Yersinia pestis
aaucuacugugggacugaucaa

SEQ ID NO: 2239851 - RNA, 23 nt, Yersinia pestis
aaucgucccacaugaacucaacu

SEQ ID NO: 2239852 - RNA, 13 nt, Yersinia pestis
aaucgguuucagc

SEQ ID NO: 2239853 - RNA, 22 nt, Yersinia pestis
aaucgguugccgccuuccugcu

SEQ ID NO: 2239854 - RNA, 14 nt, Yersinia pestis
ugcuuuuugcuuuu

SEQ ID NO: 2239855 - RNA, 20 nt, Yersinia pestis
ugcuucuacccuggcggcaa

SEQ ID NO: 2239856 - RNA, 16 nt, Yersinia pestis
ugcuuuaucguagcca

SEQ ID NO: 2239857 - RNA, 23 nt, Yersinia pestis
ugcuguuaguaacuguaaggcca

SEQ ID NO: 2239858 - RNA, 22 nt, Yersinia pestis
ugcuggaacguugcacccugcu

SEQ ID NO: 2239859 - RNA, 20 nt, Yersinia pestis
ugcugugguugauccgaguu

SEQ ID NO: 2239860 - RNA, 16 nt, Yersinia pestis
ugcucaucaaccucag

SEQ ID NO: 2239861 - RNA, 22 nt, Yersinia pestis
ugcuccagaggguaugacauuc

SEQ ID NO: 2239862 - RNA, 16 nt, Yersinia pestis
ugcugaucgagcauca

SEQ ID NO: 2239863 - RNA, 16 nt, Yersinia pestis
ugcugcaaggcauuaa

SEQ ID NO: 2239864 - RNA, 21 nt, Yersinia pestis
ugcggauuuacucgccuuuca

SEQ ID NO: 2239865 - RNA, 15 nt, Yersinia pestis
ugcggguuagcggca

SEQ ID NO: 2239866 - RNA, 15 nt, Yersinia pestis
ugcgguggccagagc

SEQ ID NO: 2239867 - RNA, 16 nt, Yersinia pestis
ugcgguggccgccuua

SEQ ID NO: 2239868 - RNA, 16 nt, Yersinia pestis
aauagcguuaacgaua

SEQ ID NO: 2239869 - RNA, 13 nt, Yersinia pestis
aauaggccagcaa

SEQ ID NO: 2239870 - RNA, 16 nt, Yersinia pestis
aauagcugcuucugaa

SEQ ID NO: 2239871 - RNA, 13 nt, Yersinia pestis
ugccuuaucaauc

SEQ ID NO: 2239872 - RNA, 20 nt, Yersinia pestis
ugccuugcugcaacgccaau

SEQ ID NO: 2239873 - RNA, 18 nt, Yersinia pestis
ugcgagcaaggcauccac

SEQ ID NO: 2239874 - RNA, 16 nt, Yersinia pestis
aauagcgaucagcaac

SEQ ID NO: 2239875 - RNA, 11 nt, Yersinia pestis
aauagccugua

SEQ ID NO: 2239876 - RNA, 23 nt, Yersinia pestis
aauagcaccauuaggcuuaggca

SEQ ID NO: 2239877 - RNA, 19 nt, Yersinia pestis
aauagcaaacccaccugaa

SEQ ID NO: 2239878 - RNA, 15 nt, Yersinia pestis
aauauugucacugca

SEQ ID NO: 2239879 - RNA, 23 nt, Yersinia pestis
aauauucgcauucgugccauaaa

SEQ ID NO: 2239880 - RNA, 23 nt, Yersinia pestis
aauauggguauugagcgcgguaa

SEQ ID NO: 2239881 - RNA, 21 nt, Yersinia pestis
uggcuaauaaugcaccaauca

SEQ ID NO: 2239882 - RNA, 24 nt, Yersinia pestis
aauaucguguuggaguaucagaaa

SEQ ID NO: 2239883 - RNA, 15 nt, Yersinia pestis
aauaugauuaaucau

SEQ ID NO: 2239884 - RNA, 13 nt, Yersinia pestis
ugggcgauagucg

SEQ ID NO: 2239885 - RNA, 16 nt, Yersinia pestis
uggguuauuaacuuca

SEQ ID NO: 2239886 - RNA, 21 nt, Yersinia pestis
ugggugucaggaagcaagaaa

SEQ ID NO: 2239887 - RNA, 14 nt, Yersinia pestis
ugguaucggugagu

SEQ ID NO: 2239888 - RNA, 21 nt, Yersinia pestis
ugggcuaaccagugucuggca

SEQ ID NO: 2239889 - RNA, 15 nt, Yersinia pestis
ugggcuugagcagug

SEQ ID NO: 2239890 - RNA, 14 nt, Yersinia pestis
uguacauccaacuu

SEQ ID NO: 2239891 - RNA, 21 nt, Yersinia pestis
uguaauaagcuacgccaugca

SEQ ID NO: 2239892 - RNA, 21 nt, Yersinia pestis
uguaagccagauugugcggcu

SEQ ID NO: 2239893 - RNA, 22 nt, Yersinia pestis
ugguugcccggcaaacuuaauu

SEQ ID NO: 2239894 - RNA, 22 nt, Yersinia pestis
ugguugcacgugaggauucaag

SEQ ID NO: 2239895 - RNA, 20 nt, Yersinia pestis
ugguuucacccgcuaccggu

SEQ ID NO: 2239896 - RNA, 13 nt, Yersinia pestis
ugguuuggccauu

SEQ ID NO: 2239897 - RNA, 17 nt, Yersinia pestis
ugguuugaauucaagaa

SEQ ID NO: 2239898 - RNA, 20 nt, Yersinia pestis
ugguggauaaaaaacgggcu

SEQ ID NO: 2239899 - RNA, 13 nt, Yersinia pestis
ugguggcugagac

SEQ ID NO: 2239900 - RNA, 20 nt, Yersinia pestis
ugguggcggucaacccggcu

SEQ ID NO: 2239901 - RNA, 15 nt, Yersinia pestis
ugguauggcgauaug

SEQ ID NO: 2239902 - RNA, 23 nt, Yersinia pestis
uggccacccaacgcaauugcacc

SEQ ID NO: 2239903 - RNA, 15 nt, Yersinia pestis
uggccacucaccuca

SEQ ID NO: 2239904 - RNA, 12 nt, Yersinia pestis
uggcccgcaucu

SEQ ID NO: 2239905 - RNA, 20 nt, Yersinia pestis
uggcgauuuugcggcugagu

SEQ ID NO: 2239906 - RNA, 21 nt, Yersinia pestis
uggcggcuugccugacagccu

SEQ ID NO: 2239907 - RNA, 15 nt, Yersinia pestis
acaguuguuucaaua

SEQ ID NO: 2239908 - RNA, 21 nt, Yersinia pestis
acaguucauaucgauaccgau

SEQ ID NO: 2239909 - RNA, 18 nt, Yersinia pestis
acauagcuauuggcugau

SEQ ID NO: 2239910 - RNA, 14 nt, Yersinia pestis
accaaaugcucagc

SEQ ID NO: 2239911 - RNA, 17 nt, Yersinia pestis
accaaccgguugacguu

SEQ ID NO: 2239912 - RNA, 19 nt, Yersinia pestis
accaagcccaguaaagcaa

SEQ ID NO: 2239913 - RNA, 13 nt, Yersinia pestis
accaagcuuuuau

SEQ ID NO: 2239914 - RNA, 22 nt, Yersinia pestis
accaauaccauuuucagacuga

SEQ ID NO: 2239915 - RNA, 17 nt, Yersinia pestis
acaucuggcuggcauau

SEQ ID NO: 2239916 - RNA, 12 nt, Yersinia pestis
accaccaaugcg

SEQ ID NO: 2239917 - RNA, 17 nt, Yersinia pestis
accaccaauuucaucgc

SEQ ID NO: 2239918 - RNA, 17 nt, Yersinia pestis
accacccgacaucaaga

SEQ ID NO: 2239919 - RNA, 21 nt, Yersinia pestis
accacugcuucugucaguguu

SEQ ID NO: 2239920 - RNA, 16 nt, Yersinia pestis
accagaaaguuguuca

SEQ ID NO: 2239921 - RNA, 18 nt, Yersinia pestis
accagcguggcauugagg

SEQ ID NO: 2239922 - RNA, 17 nt, Yersinia pestis
acacaagcgaaucuggc

SEQ ID NO: 2239923 - RNA, 17 nt, Yersinia pestis
acaauagucucuugggc

SEQ ID NO: 2239924 - RNA, 15 nt, Yersinia pestis
acaauaacgccguua

SEQ ID NO: 2239925 - RNA, 15 nt, Yersinia pestis
acaauacagcaaaua

SEQ ID NO: 2239926 - RNA, 15 nt, Yersinia pestis
acaauaaaucgccac

SEQ ID NO: 2239927 - RNA, 19 nt, Yersinia pestis
acaaucucuggcaacggca

SEQ ID NO: 2239928 - RNA, 18 nt, Yersinia pestis
acaaucagcccgauggca

SEQ ID NO: 2239929 - RNA, 11 nt, Yersinia pestis
acaauccggug

SEQ ID NO: 2239930 - RNA, 20 nt, Yersinia pestis
acaagggguuucagacuccu

SEQ ID NO: 2239931 - RNA, 15 nt, Yersinia pestis
acaagagcaauggcg

SEQ ID NO: 2239932 - RNA, 22 nt, Yersinia pestis
acaagaaggucuugauggcuau

SEQ ID NO: 2239933 - RNA, 14 nt, Yersinia pestis
acaagcgaccauca

SEQ ID NO: 2239934 - RNA, 16 nt, Yersinia pestis
acaacgucauuuguga

SEQ ID NO: 2239935 - RNA, 19 nt, Yersinia pestis
acaacuggguggccaguaa

SEQ ID NO: 2239936 - RNA, 14 nt, Yersinia pestis
acaacugaaugucu

SEQ ID NO: 2239937 - RNA, 13 nt, Yersinia pestis
acaacgcaucagu

SEQ ID NO: 2239938 - RNA, 15 nt, Yersinia pestis
acaacgcucuaacgu

SEQ ID NO: 2239939 - RNA, 18 nt, Yersinia pestis
acaaauguuuaauggcau

SEQ ID NO: 2239940 - RNA, 15 nt, Yersinia pestis
acaacagauggcgau

SEQ ID NO: 2239941 - RNA, 17 nt, Yersinia pestis
acaaauaugaagaugcu

SEQ ID NO: 2239942 - RNA, 13 nt, Yersinia pestis
acaaauauuggcc

SEQ ID NO: 2239943 - RNA, 16 nt, Yersinia pestis
acaaccccaugaccgc

SEQ ID NO: 2239944 - RNA, 15 nt, Yersinia pestis
acaacaucaauggca

SEQ ID NO: 2239945 - RNA, 16 nt, Yersinia pestis
aauguucggucauaau

SEQ ID NO: 2239946 - RNA, 23 nt, Yersinia pestis
acaaaauaauaauucugcuauua

SEQ ID NO: 2239947 - RNA, 16 nt, Yersinia pestis
acaaacagggcagcca

SEQ ID NO: 2239948 - RNA, 21 nt, Yersinia pestis
acaaaauggaauaagccauua

SEQ ID NO: 2239949 - RNA, 14 nt, Yersinia pestis
acacgcccaggcca

SEQ ID NO: 2239950 - RNA, 19 nt, Yersinia pestis
acacgaugccaguagccgu

SEQ ID NO: 2239951 - RNA, 21 nt, Yersinia pestis
acacgaugccaguagccguua

SEQ ID NO: 2239952 - RNA, 15 nt, Yersinia pestis
acacacucaggcgau

SEQ ID NO: 2239953 - RNA, 19 nt, Yersinia pestis
acacccgaaggccauugcc

SEQ ID NO: 2239954 - RNA, 18 nt, Yersinia pestis
acacccguuccuucagcc

SEQ ID NO: 2239955 - RNA, 18 nt, Yersinia pestis
acagcacgguaaacgcau

SEQ ID NO: 2239956 - RNA, 16 nt, Yersinia pestis
acagccaccagccaac

SEQ ID NO: 2239957 - RNA, 16 nt, Yersinia pestis
acagcccaagagaaau

SEQ ID NO: 2239958 - RNA, 14 nt, Yersinia pestis
acacuuagccagca

SEQ ID NO: 2239959 - RNA, 17 nt, Yersinia pestis
acacugauugaaguccu

SEQ ID NO: 2239960 - RNA, 21 nt, Yersinia pestis
acacugcacuuuaaucgccag

SEQ ID NO: 2239961 - RNA, 22 nt, Yersinia pestis
accgcacugagggugauaucgu

SEQ ID NO: 2239962 - RNA, 11 nt, Yersinia pestis
accgcauaaga

SEQ ID NO: 2239963 - RNA, 13 nt, Yersinia pestis
accggaacagcag

SEQ ID NO: 2239964 - RNA, 18 nt, Yersinia pestis
accggauuguucagcaac

SEQ ID NO: 2239965 - RNA, 17 nt, Yersinia pestis
accgcugcagggccuuu

SEQ ID NO: 2239966 - RNA, 23 nt, Yersinia pestis
accagcuugggugaagacacuuu

SEQ ID NO: 2239967 - RNA, 15 nt, Yersinia pestis
accccagcaaagcca

SEQ ID NO: 2239968 - RNA, 16 nt, Yersinia pestis
acccccagugcugccg

SEQ ID NO: 2239969 - RNA, 18 nt, Yersinia pestis
accccguggcaggccuuu

SEQ ID NO: 2239970 - RNA, 22 nt, Yersinia pestis
acccgcuugucuugaaaguguc

SEQ ID NO: 2239971 - RNA, 19 nt, Yersinia pestis
acccgcgggagucagucgc

SEQ ID NO: 2239972 - RNA, 17 nt, Yersinia pestis
acccgccccccaucaac

SEQ ID NO: 2239973 - RNA, 22 nt, Yersinia pestis
acccuuucucgcguuugaucaa

SEQ ID NO: 2239974 - RNA, 20 nt, Yersinia pestis
acccuuuagaggcugauaac

SEQ ID NO: 2239975 - RNA, 21 nt, Yersinia pestis
acccucugcguacaacacauc

SEQ ID NO: 2239976 - RNA, 18 nt, Yersinia pestis
acguucgacgauauugau

SEQ ID NO: 2239977 - RNA, 19 nt, Yersinia pestis
acguuuuaaugccaauuga

SEQ ID NO: 2239978 - RNA, 15 nt, Yersinia pestis
acguuuaucgcuacc

SEQ ID NO: 2239979 - RNA, 21 nt, Yersinia pestis
acguuggcggcuccaggcauu

SEQ ID NO: 2239980 - RNA, 20 nt, Yersinia pestis
acgguaucuaggugcaguaa

SEQ ID NO: 2239981 - RNA, 18 nt, Yersinia pestis
acgguauuugaacuucaa

SEQ ID NO: 2239982 - RNA, 17 nt, Yersinia pestis
acugccccgaagcucaa

SEQ ID NO: 2239983 - RNA, 14 nt, Yersinia pestis
acugccugaugcua

SEQ ID NO: 2239984 - RNA, 18 nt, Yersinia pestis
acugaaucacuggugagu

SEQ ID NO: 2239985 - RNA, 21 nt, Yersinia pestis
acugaaucccagaaccucaac

SEQ ID NO: 2239986 - RNA, 13 nt, Yersinia pestis
acugaucaucaac

SEQ ID NO: 2239987 - RNA, 20 nt, Yersinia pestis
acucuuugaguagcaggccg

SEQ ID NO: 2239988 - RNA, 22 nt, Yersinia pestis
acucgcgauaacgguaucaguc

SEQ ID NO: 2239989 - RNA, 14 nt, Yersinia pestis
acucccauucgcgc

SEQ ID NO: 2239990 - RNA, 22 nt, Yersinia pestis
acuauaggcuauuuuacuugcc

SEQ ID NO: 2239991 - RNA, 19 nt, Yersinia pestis
acucgaucaccacgucacc

SEQ ID NO: 2239992 - RNA, 15 nt, Yersinia pestis
acggaugaucggcau

SEQ ID NO: 2239993 - RNA, 20 nt, Yersinia pestis
acggaugaaaagugauccac

SEQ ID NO: 2239994 - RNA, 14 nt, Yersinia pestis
acggauaucaacau

SEQ ID NO: 2239995 - RNA, 14 nt, Yersinia pestis
acggccagaaucaa

SEQ ID NO: 2239996 - RNA, 22 nt, Yersinia pestis
acggcagugaucgcacuucaac

SEQ ID NO: 2239997 - RNA, 16 nt, Yersinia pestis
acggccagcaaugugu

SEQ ID NO: 2239998 - RNA, 17 nt, Yersinia pestis
acgggcgcaauggaaga

SEQ ID NO: 2239999 - RNA, 19 nt, Yersinia pestis
acggcuuuucgcucagacu

SEQ ID NO: 2240000 - RNA, 12 nt, Yersinia pestis
accuuaucacuc

SEQ ID NO: 2240001 - RNA, 17 nt, Yersinia pestis
accuucaaacgggugau

SEQ ID NO: 2240002 - RNA, 21 nt, Yersinia pestis
accuucacgcaucacaucuug

SEQ ID NO: 2240003 - RNA, 15 nt, Yersinia pestis
accuuccauauugau

SEQ ID NO: 2240004 - RNA, 22 nt, Yersinia pestis
accuugcuccgcaauuugccca

SEQ ID NO: 2240005 - RNA, 16 nt, Yersinia pestis
accugcuggcgcaacu

SEQ ID NO: 2240006 - RNA, 12 nt, Yersinia pestis
accugcucaacu

SEQ ID NO: 2240007 - RNA, 18 nt, Yersinia pestis
accugcucaacugcucaa

SEQ ID NO: 2240008 - RNA, 14 nt, Yersinia pestis
accuuuauguaaca

SEQ ID NO: 2240009 - RNA, 15 nt, Yersinia pestis
accuuguuuguuacu

SEQ ID NO: 2240010 - RNA, 18 nt, Yersinia pestis
acgacaacaucaauggca

SEQ ID NO: 2240011 - RNA, 14 nt, Yersinia pestis
acgaccuugccaag

SEQ ID NO: 2240012 - RNA, 23 nt, Yersinia pestis
acgacuagccuaacuggcgguua

SEQ ID NO: 2240013 - RNA, 16 nt, Yersinia pestis
accuaccgcaccaaug

SEQ ID NO: 2240014 - RNA, 19 nt, Yersinia pestis
accuaccgcaccaaugccg

SEQ ID NO: 2240015 - RNA, 17 nt, Yersinia pestis
accggucauacauuggc

SEQ ID NO: 2240016 - RNA, 17 nt, Yersinia pestis
accucauuggcgguuau

SEQ ID NO: 2240017 - RNA, 16 nt, Yersinia pestis
accucgaaaucauccg

SEQ ID NO: 2240018 - RNA, 22 nt, Yersinia pestis
accucucaguugauggcuuuau

SEQ ID NO: 2240019 - RNA, 16 nt, Yersinia pestis
accucguaguaaugac

SEQ ID NO: 2240020 - RNA, 17 nt, Yersinia pestis
accugaaugccauucaa

SEQ ID NO: 2240021 - RNA, 15 nt, Yersinia pestis
accugccugcugcug

SEQ ID NO: 2240022 - RNA, 14 nt, Yersinia pestis
accugcaucaucac

SEQ ID NO: 2240023 - RNA, 17 nt, Yersinia pestis
accugcaucaucacauu

SEQ ID NO: 2240024 - RNA, 19 nt, Yersinia pestis
acgcaauucgcauaucaac

SEQ ID NO: 2240025 - RNA, 18 nt, Yersinia pestis
acgcaauacgguaggcau

SEQ ID NO: 2240026 - RNA, 17 nt, Yersinia pestis
acgcaaggucgcaacca

SEQ ID NO: 2240027 - RNA, 20 nt, Yersinia pestis
acgcagacaugauuaaauca

SEQ ID NO: 2240028 - RNA, 16 nt, Yersinia pestis
acgcaucaugguccag

SEQ ID NO: 2240029 - RNA, 15 nt, Yersinia pestis
acgcaucgaccaccc

SEQ ID NO: 2240030 - RNA, 14 nt, Yersinia pestis
acgccaauucacgc

SEQ ID NO: 2240031 - RNA, 14 nt, Yersinia pestis
acgccaccaaugca

SEQ ID NO: 2240032 - RNA, 22 nt, Yersinia pestis
acgcgaucuugaacggugagga

SEQ ID NO: 2240033 - RNA, 14 nt, Yersinia pestis
acgccugggaucca

SEQ ID NO: 2240034 - RNA, 17 nt, Yersinia pestis
acgcgcgguucacuggu

SEQ ID NO: 2240035 - RNA, 20 nt, Yersinia pestis
ucuucaauuuccaucugcaa

SEQ ID NO: 2240036 - RNA, 14 nt, Yersinia pestis
ucugcuuuacugcu

SEQ ID NO: 2240037 - RNA, 23 nt, Yersinia pestis
ucuuggauaacagauuugguauu

SEQ ID NO: 2240038 - RNA, 20 nt, Yersinia pestis
ugaacgaggacuuccugccc

SEQ ID NO: 2240039 - RNA, 13 nt, Yersinia pestis
ugaacaucuggcg

SEQ ID NO: 2240040 - RNA, 20 nt, Yersinia pestis
ugaaccaaugaaucgggcgu

SEQ ID NO: 2240041 - RNA, 18 nt, Yersinia pestis
ugaaccaguugaucgucc

SEQ ID NO: 2240042 - RNA, 15 nt, Yersinia pestis
ugaaaucagaucaac

SEQ ID NO: 2240043 - RNA, 12 nt, Yersinia pestis
ucugcauugauu

SEQ ID NO: 2240044 - RNA, 19 nt, Yersinia pestis
ucugcaauacugggcuuau

SEQ ID NO: 2240045 - RNA, 18 nt, Yersinia pestis
ucugagucagucagggug

SEQ ID NO: 2240046 - RNA, 16 nt, Yersinia pestis
ucugagcgagcgguaa

SEQ ID NO: 2240047 - RNA, 18 nt, Yersinia pestis
ucucuauagagugcaauu

SEQ ID NO: 2240048 - RNA, 23 nt, Yersinia pestis
ucucuauucugcuuuuugcuuuu

SEQ ID NO: 2240049 - RNA, 13 nt, Yersinia pestis
ucucugucuucca

SEQ ID NO: 2240050 - RNA, 22 nt, Yersinia pestis
ucucugccgcugaauugauuua

SEQ ID NO: 2240051 - RNA, 20 nt, Yersinia pestis
ucucguggggucauaccggc

SEQ ID NO: 2240052 - RNA, 14 nt, Yersinia pestis
ucucguucuuaacc

SEQ ID NO: 2240053 - RNA, 22 nt, Yersinia pestis
ucucaauacgcugucugaauag

SEQ ID NO: 2240054 - RNA, 15 nt, Yersinia pestis
ucguauuaucaauag

SEQ ID NO: 2240055 - RNA, 15 nt, Yersinia pestis
ucgguuaaagacaua

SEQ ID NO: 2240056 - RNA, 15 nt, Yersinia pestis
ucgggugagugagcg

SEQ ID NO: 2240057 - RNA, 19 nt, Yersinia pestis
ugaugguucagccaccauu

SEQ ID NO: 2240058 - RNA, 13 nt, Yersinia pestis
ugcacgguauagc

SEQ ID NO: 2240059 - RNA, 21 nt, Yersinia pestis
ugcacgggaaaugagcgccaa

SEQ ID NO: 2240060 - RNA, 20 nt, Yersinia pestis
ugcacgacaacaaagccgcu

SEQ ID NO: 2240061 - RNA, 11 nt, Yersinia pestis
ugcacgauacc

SEQ ID NO: 2240062 - RNA, 16 nt, Yersinia pestis
ugcagccgggaugauc

SEQ ID NO: 2240063 - RNA, 14 nt, Yersinia pestis
ugccacgccaguaa

SEQ ID NO: 2240064 - RNA, 17 nt, Yersinia pestis
ugcauacagaucgagca

SEQ ID NO: 2240065 - RNA, 22 nt, Yersinia pestis
ugccagacacaagauaaauacc

SEQ ID NO: 2240066 - RNA, 17 nt, Yersinia pestis
ugccagauaauguucgu

SEQ ID NO: 2240067 - RNA, 20 nt, Yersinia pestis
ugccagaaucgccugcacac

SEQ ID NO: 2240068 - RNA, 19 nt, Yersinia pestis
ugccacggauauccaacgg

SEQ ID NO: 2240069 - RNA, 12 nt, Yersinia pestis
ugcccaucaacc

SEQ ID NO: 2240070 - RNA, 21 nt, Yersinia pestis
ugcccagucacuaccgcucag

SEQ ID NO: 2240071 - RNA, 18 nt, Yersinia pestis
ugaucguuuuauggcgau

SEQ ID NO: 2240072 - RNA, 15 nt, Yersinia pestis
ugaucgcucaggcgg

SEQ ID NO: 2240073 - RNA, 19 nt, Yersinia pestis
ugaucgcggcaaucaccgg

SEQ ID NO: 2240074 - RNA, 16 nt, Yersinia pestis
ugauaccacaauccgg

SEQ ID NO: 2240075 - RNA, 18 nt, Yersinia pestis
ugauacaacaacggguca

SEQ ID NO: 2240076 - RNA, 23 nt, Yersinia pestis
ugaggccaacacucaugacaaaa

SEQ ID NO: 2240077 - RNA, 14 nt, Yersinia pestis
ugauaaaaccgcuu

SEQ ID NO: 2240078 - RNA, 16 nt, Yersinia pestis
ugaggagccauugauu

SEQ ID NO: 2240079 - RNA, 15 nt, Yersinia pestis
ugagcgcagacguug

SEQ ID NO: 2240080 - RNA, 17 nt, Yersinia pestis
ugacguucaguaguggc

SEQ ID NO: 2240081 - RNA, 18 nt, Yersinia pestis
ugacucgauaacccaaag

SEQ ID NO: 2240082 - RNA, 21 nt, Yersinia pestis
ugacgauaguauaaauaccug

SEQ ID NO: 2240083 - RNA, 21 nt, Yersinia pestis
ugacgauaucaauaaagaacg

SEQ ID NO: 2240084 - RNA, 19 nt, Yersinia pestis
ugacgccaccauuccgcca

SEQ ID NO: 2240085 - RNA, 16 nt, Yersinia pestis
ugacgauggucgucgu

SEQ ID NO: 2240086 - RNA, 14 nt, Yersinia pestis
ugacgcgaucgucg

SEQ ID NO: 2240087 - RNA, 19 nt, Yersinia pestis
ucggcaauaauaucuggcg

SEQ ID NO: 2240088 - RNA, 17 nt, Yersinia pestis
ucggccuguucucgccg

SEQ ID NO: 2240089 - RNA, 21 nt, Yersinia pestis
aauaccuaaaauuaucgcaau

SEQ ID NO: 2240090 - RNA, 14 nt, Yersinia pestis
aauaccgcuaacgu

SEQ ID NO: 2240091 - RNA, 14 nt, Yersinia pestis
aauaccaaugcugu

SEQ ID NO: 2240092 - RNA, 20 nt, Yersinia pestis
ucgccuguaaaucuuguuua

SEQ ID NO: 2240093 - RNA, 22 nt, Yersinia pestis
ucgcgaugcgccuguuagggcg

SEQ ID NO: 2240094 - RNA, 14 nt, Yersinia pestis
ucgcagcuuccagc

SEQ ID NO: 2240095 - RNA, 16 nt, Yersinia pestis
ucgcauaggccaauag

SEQ ID NO: 2240096 - RNA, 17 nt, Yersinia pestis
uccccccuucaucgaca

SEQ ID NO: 2240097 - RNA, 18 nt, Yersinia pestis
ucccaggcguucuguagc

SEQ ID NO: 2240098 - RNA, 18 nt, Yersinia pestis
ucccucaauagcuaauaa

SEQ ID NO: 2240099 - RNA, 13 nt, Yersinia pestis
ucccucggcuuau

SEQ ID NO: 2240100 - RNA, 16 nt, Yersinia pestis
ucccgcguuaccguaa

SEQ ID NO: 2240101 - RNA, 14 nt, Yersinia pestis
ucccuuuuccauca

SEQ ID NO: 2240102 - RNA, 18 nt, Yersinia pestis
ucccuucggcaugcaacu

SEQ ID NO: 2240103 - RNA, 14 nt, Yersinia pestis
ucccugcgccagca

SEQ ID NO: 2240104 - RNA, 14 nt, Yersinia pestis
ucccugguuugcca

SEQ ID NO: 2240105 - RNA, 19 nt, Yersinia pestis
uccgcgaauuccaaccaga

SEQ ID NO: 2240106 - RNA, 22 nt, Yersinia pestis
uccggcaaccaguuauagcggu

SEQ ID NO: 2240107 - RNA, 19 nt, Yersinia pestis
uccugcaaauuaaccugcu

SEQ ID NO: 2240108 - RNA, 24 nt, Yersinia pestis
uccugauucgcgaccagcagaagu

SEQ ID NO: 2240109 - RNA, 18 nt, Yersinia pestis
ucgauaaaaggcuauuua

SEQ ID NO: 2240110 - RNA, 15 nt, Yersinia pestis
ucgagugugaugaug

SEQ ID NO: 2240111 - RNA, 15 nt, Yersinia pestis
ucgagcuaccggcau

SEQ ID NO: 2240112 - RNA, 19 nt, Yersinia pestis
ucagggcgucucuacgacg

SEQ ID NO: 2240113 - RNA, 16 nt, Yersinia pestis
ucagggagucagggag

SEQ ID NO: 2240114 - RNA, 14 nt, Yersinia pestis
ucagggaucaccuc

SEQ ID NO: 2240115 - RNA, 15 nt, Yersinia pestis
ucagguuguuccgcu

SEQ ID NO: 2240116 - RNA, 19 nt, Yersinia pestis
ucaucgggguuugucagca

SEQ ID NO: 2240117 - RNA, 14 nt, Yersinia pestis
ucaugaauaggaua

SEQ ID NO: 2240118 - RNA, 11 nt, Yersinia pestis
ucaucgccgca

SEQ ID NO: 2240119 - RNA, 17 nt, Yersinia pestis
ucaucaccauucaagau

SEQ ID NO: 2240120 - RNA, 21 nt, Yersinia pestis
ucaucccagucgucuucagcu

SEQ ID NO: 2240121 - RNA, 13 nt, Yersinia pestis
ucaucccuuuagc

SEQ ID NO: 2240122 - RNA, 23 nt, Yersinia pestis
ucaguacagcgcaucggaucaau

SEQ ID NO: 2240123 - RNA, 17 nt, Yersinia pestis
ucaguaagauacuugcg

SEQ ID NO: 2240124 - RNA, 22 nt, Yersinia pestis
ucagugcacggcagugaucaau

SEQ ID NO: 2240125 - RNA, 11 nt, Yersinia pestis
ucaucaauacc

SEQ ID NO: 2240126 - RNA, 17 nt, Yersinia pestis
uccaaaugcccauuagu

SEQ ID NO: 2240127 - RNA, 20 nt, Yersinia pestis
ucaugcucugcuaauacgcu

SEQ ID NO: 2240128 - RNA, 19 nt, Yersinia pestis
uccaccacugauaggucau

SEQ ID NO: 2240129 - RNA, 12 nt, Yersinia pestis
uccaggcauuaa

SEQ ID NO: 2240130 - RNA, 19 nt, Yersinia pestis
ucacuguggcggccagugc

SEQ ID NO: 2240131 - RNA, 22 nt, Yersinia pestis
ucagcaaaucuugugaugcaua

SEQ ID NO: 2240132 - RNA, 16 nt, Yersinia pestis
ucagacugcugacaac

SEQ ID NO: 2240133 - RNA, 16 nt, Yersinia pestis
ucagcaaaaauaacgu

SEQ ID NO: 2240134 - RNA, 15 nt, Yersinia pestis
ucagcgcccuugcca

SEQ ID NO: 2240135 - RNA, 18 nt, Yersinia pestis
aauacaggugucaucaag

SEQ ID NO: 2240136 - RNA, 19 nt, Yersinia pestis
ucagcagucugagccucau

SEQ ID NO: 2240137 - RNA, 15 nt, Yersinia pestis
ucagccgauguuuga

SEQ ID NO: 2240138 - RNA, 23 nt, Yersinia pestis
ucacaugcggauugaacugcgcu

SEQ ID NO: 2240139 - RNA, 19 nt, Yersinia pestis
ucaccaaaggaagccgagc

SEQ ID NO: 2240140 - RNA, 20 nt, Yersinia pestis
ucacagccacguaauaccac

SEQ ID NO: 2240141 - RNA, 20 nt, Yersinia pestis
ucaaccacgguuuaaucaau

SEQ ID NO: 2240142 - RNA, 14 nt, Yersinia pestis
ucaccaaucggauc

SEQ ID NO: 2240143 - RNA, 22 nt, Yersinia pestis
ucaccacaaaggucagcauggu

SEQ ID NO: 2240144 - RNA, 15 nt, Yersinia pestis
ucaccagaugccgca

SEQ ID NO: 2240145 - RNA, 18 nt, Yersinia pestis
ucaccacgcacgauauuc

SEQ ID NO: 2240146 - RNA, 20 nt, Yersinia pestis
ucacccacacgacaugugua

SEQ ID NO: 2240147 - RNA, 21 nt, Yersinia pestis
ucacccaauaagauaaacagc

SEQ ID NO: 2240148 - RNA, 16 nt, Yersinia pestis
ucaccuaaaucauaca

SEQ ID NO: 2240149 - RNA, 24 nt, Yersinia pestis
ucaccuuugaucauggcuugugca

SEQ ID NO: 2240150 - RNA, 15 nt, Yersinia pestis
ucacgaauagcggua

SEQ ID NO: 2240151 - RNA, 18 nt, Yersinia pestis
ucacccgcacguagcaca

SEQ ID NO: 2240152 - RNA, 21 nt, Yersinia pestis
ucaccgccggauuucaauccg

SEQ ID NO: 2240153 - RNA, 17 nt, Yersinia pestis
uagcuggcugaacgcuc

SEQ ID NO: 2240154 - RNA, 22 nt, Yersinia pestis
uagcuuauccccugagaaacau

SEQ ID NO: 2240155 - RNA, 18 nt, Yersinia pestis
uaguaacaaaaugcggug

SEQ ID NO: 2240156 - RNA, 18 nt, Yersinia pestis
uagucaauguucucuggg

SEQ ID NO: 2240157 - RNA, 13 nt, Yersinia pestis
uagugcacagaua

SEQ ID NO: 2240158 - RNA, 16 nt, Yersinia pestis
uagugaguuauucgcc

SEQ ID NO: 2240159 - RNA, 12 nt, Yersinia pestis
uauccaauaccg

SEQ ID NO: 2240160 - RNA, 21 nt, Yersinia pestis
uauccagcgucaccgauacuu

SEQ ID NO: 2240161 - RNA, 23 nt, Yersinia pestis
uaucaaacagcacaucgccauua

SEQ ID NO: 2240162 - RNA, 17 nt, Yersinia pestis
uaucaauggggaucugc

SEQ ID NO: 2240163 - RNA, 15 nt, Yersinia pestis
uaucaucccuuaacc

SEQ ID NO: 2240164 - RNA, 13 nt, Yersinia pestis
uaucacaucgccc

SEQ ID NO: 2240165 - RNA, 21 nt, Yersinia pestis
uauaacaauguuuauccgcua

SEQ ID NO: 2240166 - RNA, 21 nt, Yersinia pestis
uauaagcagcaccaauaucaa

SEQ ID NO: 2240167 - RNA, 17 nt, Yersinia pestis
uauagcaaucauuuaua

SEQ ID NO: 2240168 - RNA, 21 nt, Yersinia pestis
uauauacccagcaucauaaga

SEQ ID NO: 2240169 - RNA, 12 nt, Yersinia pestis
uauggaccucac

SEQ ID NO: 2240170 - RNA, 20 nt, Yersinia pestis
uauggauaaauccugaacau

SEQ ID NO: 2240171 - RNA, 18 nt, Yersinia pestis
uauucuguuguaaccagu

SEQ ID NO: 2240172 - RNA, 15 nt, Yersinia pestis
uauuuucuaaccagg

SEQ ID NO: 2240173 - RNA, 18 nt, Yersinia pestis
uauuguuuuuacgugaua

SEQ ID NO: 2240174 - RNA, 13 nt, Yersinia pestis
uauuguuaucaaa

SEQ ID NO: 2240175 - RNA, 21 nt, Yersinia pestis
uauugaccaccuuauuggccc

SEQ ID NO: 2240176 - RNA, 18 nt, Yersinia pestis
uauugaagacaaugccga

SEQ ID NO: 2240177 - RNA, 13 nt, Yersinia pestis
uauuucaauggga

SEQ ID NO: 2240178 - RNA, 21 nt, Yersinia pestis
ucaaauuuuugaucggcgaca

SEQ ID NO: 2240179 - RNA, 21 nt, Yersinia pestis
ucaaauucagguugaucagua

SEQ ID NO: 2240180 - RNA, 23 nt, Yersinia pestis
ucaacagauaugcauuauugaug

SEQ ID NO: 2240181 - RNA, 17 nt, Yersinia pestis
ucaacauuuaagugcua

SEQ ID NO: 2240182 - RNA, 14 nt, Yersinia pestis
uacccacggguuaa

SEQ ID NO: 2240183 - RNA, 15 nt, Yersinia pestis
uaccauaacaauggc

SEQ ID NO: 2240184 - RNA, 17 nt, Yersinia pestis
uaccaguaacugaucaa

SEQ ID NO: 2240185 - RNA, 20 nt, Yersinia pestis
uaccgauaaaaguacaacua

SEQ ID NO: 2240186 - RNA, 22 nt, Yersinia pestis
uacccguaggcccacaaucaag

SEQ ID NO: 2240187 - RNA, 20 nt, Yersinia pestis
uacccguuauauuucaagcu

SEQ ID NO: 2240188 - RNA, 14 nt, Yersinia pestis
uaccugcuaaccga

SEQ ID NO: 2240189 - RNA, 17 nt, Yersinia pestis
uaccgguauccauccca

SEQ ID NO: 2240190 - RNA, 12 nt, Yersinia pestis
uacucucgcccu

SEQ ID NO: 2240191 - RNA, 22 nt, Yersinia pestis
uacugggcuuauuaauuaauga

SEQ ID NO: 2240192 - RNA, 14 nt, Yersinia pestis
uacugguagcagcc

SEQ ID NO: 2240193 - RNA, 15 nt, Yersinia pestis
uacuucaggccaaua

SEQ ID NO: 2240194 - RNA, 14 nt, Yersinia pestis
uagaaccggcugac

SEQ ID NO: 2240195 - RNA, 22 nt, Yersinia pestis
uagagucacagaggaaucaaag

SEQ ID NO: 2240196 - RNA, 17 nt, Yersinia pestis
uagauaguacguagcga

SEQ ID NO: 2240197 - RNA, 17 nt, Yersinia pestis
uagauaguacuuagcaa

SEQ ID NO: 2240198 - RNA, 19 nt, Yersinia pestis
uagcauaaguaucagcggc

SEQ ID NO: 2240199 - RNA, 17 nt, Yersinia pestis
uagauuuauucaacauu

SEQ ID NO: 2240200 - RNA, 14 nt, Yersinia pestis
uagccaaauagcgg

SEQ ID NO: 2240201 - RNA, 23 nt, Yersinia pestis
uagccaaaucuggauaaugucgu

SEQ ID NO: 2240202 - RNA, 14 nt, Yersinia pestis
uagccgcgccaucc

SEQ ID NO: 2240203 - RNA, 17 nt, Yersinia pestis
uagcggguaauaccggg

SEQ ID NO: 2240204 - RNA, 12 nt, Yersinia pestis
uagcgccagcaa

SEQ ID NO: 2240205 - RNA, 17 nt, Yersinia pestis
uagccgcuuucaucgau

SEQ ID NO: 2240206 - RNA, 18 nt, Yersinia pestis
uaagcaggaagauaucgc

SEQ ID NO: 2240207 - RNA, 16 nt, Yersinia pestis
uaagcauaaccgguac

SEQ ID NO: 2240208 - RNA, 18 nt, Yersinia pestis
uaagcaauaccgacauca

SEQ ID NO: 2240209 - RNA, 13 nt, Yersinia pestis
uaagcaauaccga

SEQ ID NO: 2240210 - RNA, 13 nt, Yersinia pestis
uaacgaacgcucu

SEQ ID NO: 2240211 - RNA, 13 nt, Yersinia pestis
uaauaauaucaaa

SEQ ID NO: 2240212 - RNA, 15 nt, Yersinia pestis
uaauacgaucagcgu

SEQ ID NO: 2240213 - RNA, 23 nt, Yersinia pestis
uaauacacccgaaggccauugcc

SEQ ID NO: 2240214 - RNA, 13 nt, Yersinia pestis
uaagcucaucuaa

SEQ ID NO: 2240215 - RNA, 20 nt, Yersinia pestis
uaagcuagagccgcgcuaua

SEQ ID NO: 2240216 - RNA, 16 nt, Yersinia pestis
uaaugaauuauuagau

SEQ ID NO: 2240217 - RNA, 16 nt, Yersinia pestis
uaauacguuggcggcu

SEQ ID NO: 2240218 - RNA, 18 nt, Yersinia pestis
uaauccagaagcugagcc

SEQ ID NO: 2240219 - RNA, 20 nt, Yersinia pestis
uaauccaacgggcaauacgu

SEQ ID NO: 2240220 - RNA, 17 nt, Yersinia pestis
uaaucccgaaucaagcu

SEQ ID NO: 2240221 - RNA, 14 nt, Yersinia pestis
uaauucagauguua

SEQ ID NO: 2240222 - RNA, 16 nt, Yersinia pestis
uaaugcuaaugccacu

SEQ ID NO: 2240223 - RNA, 17 nt, Yersinia pestis
uaaugcuguuguagcgc

SEQ ID NO: 2240224 - RNA, 20 nt, Yersinia pestis
uaaugauagcgagggccuuu

SEQ ID NO: 2240225 - RNA, 20 nt, Yersinia pestis
uaaugauugccguagcguca

SEQ ID NO: 2240226 - RNA, 15 nt, Yersinia pestis
uaaauucuagcaaca

SEQ ID NO: 2240227 - RNA, 22 nt, Yersinia pestis
uaaauuauugaguaacauuaau

SEQ ID NO: 2240228 - RNA, 22 nt, Yersinia pestis
uaacagauuugguauuacgcuc

SEQ ID NO: 2240229 - RNA, 20 nt, Yersinia pestis
uaacagaagaguacgaacag

SEQ ID NO: 2240230 - RNA, 18 nt, Yersinia pestis
uaaaugcuuuuugcgcug

SEQ ID NO: 2240231 - RNA, 23 nt, Yersinia pestis
uaaauggcgugcacugacccauu

SEQ ID NO: 2240232 - RNA, 12 nt, Yersinia pestis
uaaauaagaagu

SEQ ID NO: 2240233 - RNA, 15 nt, Yersinia pestis
uaaauacauggcgau

SEQ ID NO: 2240234 - RNA, 14 nt, Yersinia pestis
uaaauagcggccau

SEQ ID NO: 2240235 - RNA, 18 nt, Yersinia pestis
uaaagcacccacaccgca

SEQ ID NO: 2240236 - RNA, 16 nt, Yersinia pestis
uaaagcaaacgccgcu

SEQ ID NO: 2240237 - RNA, 17 nt, Yersinia pestis
uaaagcagcaucuggcg

SEQ ID NO: 2240238 - RNA, 23 nt, Yersinia pestis
uaaagguguaguggaagugaucc

SEQ ID NO: 2240239 - RNA, 17 nt, Yersinia pestis
uaaacaaggcagaagua

SEQ ID NO: 2240240 - RNA, 15 nt, Yersinia pestis
uaaaacucaaauaga

SEQ ID NO: 2240241 - RNA, 14 nt, Yersinia pestis
uaaaauuaucgcaa

SEQ ID NO: 2240242 - RNA, 20 nt, Yersinia pestis
uaaacaacgcugaaaaaucu

SEQ ID NO: 2240243 - RNA, 17 nt, Yersinia pestis
guucgcguggcagauug

SEQ ID NO: 2240244 - RNA, 16 nt, Yersinia pestis
guuuaucaaacagcac

SEQ ID NO: 2240245 - RNA, 11 nt, Yersinia pestis
guuuaccggca

SEQ ID NO: 2240246 - RNA, 14 nt, Yersinia pestis
guugccgcuucaua

SEQ ID NO: 2240247 - RNA, 17 nt, Yersinia pestis
guuauuacuaaugagau

SEQ ID NO: 2240248 - RNA, 18 nt, Yersinia pestis
guuauggcuuuacggcuc

SEQ ID NO: 2240249 - RNA, 16 nt, Yersinia pestis
guuaccagaaaaccuu

SEQ ID NO: 2240250 - RNA, 15 nt, Yersinia pestis
guguugacgccauuc

SEQ ID NO: 2240251 - RNA, 17 nt, Yersinia pestis
guuaauuuucaccguau

SEQ ID NO: 2240252 - RNA, 16 nt, Yersinia pestis
guuaacuuauagcuca

SEQ ID NO: 2240253 - RNA, 13 nt, Yersinia pestis
gugugauuuccau

SEQ ID NO: 2240254 - RNA, 14 nt, Yersinia pestis
guguauaucacuau

SEQ ID NO: 2240255 - RNA, 23 nt, Yersinia pestis
guguaagaacuggcuggaucagc

SEQ ID NO: 2240256 - RNA, 15 nt, Yersinia pestis
guguaacugccaccg

SEQ ID NO: 2240257 - RNA, 14 nt, Yersinia pestis
guggcuaccaauua

SEQ ID NO: 2240258 - RNA, 14 nt, Yersinia pestis
guggccugugauga

SEQ ID NO: 2240259 - RNA, 16 nt, Yersinia pestis
aagugaauaccgcuaa

SEQ ID NO: 2240260 - RNA, 17 nt, Yersinia pestis
aaguggcauaaccaauc

SEQ ID NO: 2240261 - RNA, 17 nt, Yersinia pestis
aagugcugcaaggcauu

SEQ ID NO: 2240262 - RNA, 16 nt, Yersinia pestis
gugauuauagcggcaa

SEQ ID NO: 2240263 - RNA, 16 nt, Yersinia pestis
gugauggcggcuggaa

SEQ ID NO: 2240264 - RNA, 22 nt, Yersinia pestis
gugaugaaauccagaucagcgc

SEQ ID NO: 2240265 - RNA, 17 nt, Yersinia pestis
gugaugacaaugcguua

SEQ ID NO: 2240266 - RNA, 15 nt, Yersinia pestis
gugaucgccgcuaau

SEQ ID NO: 2240267 - RNA, 14 nt, Yersinia pestis
gugcagcaucaccc

SEQ ID NO: 2240268 - RNA, 22 nt, Yersinia pestis
gugccagcaaagacaauaacgg

SEQ ID NO: 2240269 - RNA, 18 nt, Yersinia pestis
agaagcauauggauguga

SEQ ID NO: 2240270 - RNA, 15 nt, Yersinia pestis
acugcugcaacucau

SEQ ID NO: 2240271 - RNA, 18 nt, Yersinia pestis
agaaaguuguucaacgcc

SEQ ID NO: 2240272 - RNA, 21 nt, Yersinia pestis
agaacauuuccacaaucagcc

SEQ ID NO: 2240273 - RNA, 13 nt, Yersinia pestis
agaacagcgaauc

SEQ ID NO: 2240274 - RNA, 12 nt, Yersinia pestis
agacaaugccga

SEQ ID NO: 2240275 - RNA, 20 nt, Yersinia pestis
agaauguuauugcuccgaca

SEQ ID NO: 2240276 - RNA, 14 nt, Yersinia pestis
agaauugcagauac

SEQ ID NO: 2240277 - RNA, 21 nt, Yersinia pestis
agacauaaugccggcggccca

SEQ ID NO: 2240278 - RNA, 16 nt, Yersinia pestis
agaauagugauauccc

SEQ ID NO: 2240279 - RNA, 18 nt, Yersinia pestis
agaaugcagauaucagcc

SEQ ID NO: 2240280 - RNA, 17 nt, Yersinia pestis
agaagucggcuuugacu

SEQ ID NO: 2240281 - RNA, 20 nt, Yersinia pestis
agaaggguauugaagauacc

SEQ ID NO: 2240282 - RNA, 15 nt, Yersinia pestis
agaccguaucacccg

SEQ ID NO: 2240283 - RNA, 21 nt, Yersinia pestis
agaccagauaaucgccaauaa

SEQ ID NO: 2240284 - RNA, 20 nt, Yersinia pestis
agagaauuauuucucguggc

SEQ ID NO: 2240285 - RNA, 23 nt, Yersinia pestis
agauacaaggucacgaccaagac

SEQ ID NO: 2240286 - RNA, 13 nt, Yersinia pestis
agauaaucgccaa

SEQ ID NO: 2240287 - RNA, 22 nt, Yersinia pestis
agauaguacguagcgauaacag

SEQ ID NO: 2240288 - RNA, 21 nt, Yersinia pestis
agcaauaaggugccacacaga

SEQ ID NO: 2240289 - RNA, 22 nt, Yersinia pestis
agcacaagcgccugcgacagca

SEQ ID NO: 2240290 - RNA, 13 nt, Yersinia pestis
agcacacugguug

SEQ ID NO: 2240291 - RNA, 19 nt, Yersinia pestis
agcaagugaauaacgcugg

SEQ ID NO: 2240292 - RNA, 14 nt, Yersinia pestis
agcaauaaacucau

SEQ ID NO: 2240293 - RNA, 15 nt, Yersinia pestis
agcaaacccaccuga

SEQ ID NO: 2240294 - RNA, 19 nt, Yersinia pestis
agauuucaucauucaauac

SEQ ID NO: 2240295 - RNA, 23 nt, Yersinia pestis
agaucauuuuuuuccacccgcug

SEQ ID NO: 2240296 - RNA, 22 nt, Yersinia pestis
agauugagugcggacagcgcgc

SEQ ID NO: 2240297 - RNA, 22 nt, Yersinia pestis
agcacuuccaacuuuucauugg

SEQ ID NO: 2240298 - RNA, 16 nt, Yersinia pestis
agcacugguagcauca

SEQ ID NO: 2240299 - RNA, 12 nt, Yersinia pestis
agcaucggcauu

SEQ ID NO: 2240300 - RNA, 15 nt, Yersinia pestis
agcauugagcgccac

SEQ ID NO: 2240301 - RNA, 15 nt, Yersinia pestis
agccacacauucagu

SEQ ID NO: 2240302 - RNA, 20 nt, Yersinia pestis
agccaccaccacggccagaa

SEQ ID NO: 2240303 - RNA, 17 nt, Yersinia pestis
agcauccugaacuuccu

SEQ ID NO: 2240304 - RNA, 18 nt, Yersinia pestis
agcauacguugccagcca

SEQ ID NO: 2240305 - RNA, 14 nt, Yersinia pestis
agcaggauugcgcc

SEQ ID NO: 2240306 - RNA, 17 nt, Yersinia pestis
agccugagcaauauguu

SEQ ID NO: 2240307 - RNA, 16 nt, Yersinia pestis
agccucuguagccgca

SEQ ID NO: 2240308 - RNA, 17 nt, Yersinia pestis
agccgguuaggccaguu

SEQ ID NO: 2240309 - RNA, 23 nt, Yersinia pestis
agccgagcaagugaauaacgcug

SEQ ID NO: 2240310 - RNA, 21 nt, Yersinia pestis
agccacgaaucgggauuggcc

SEQ ID NO: 2240311 - RNA, 16 nt, Yersinia pestis
agccaccgcacacuga

SEQ ID NO: 2240312 - RNA, 13 nt, Yersinia pestis
agcgggcggcaau

SEQ ID NO: 2240313 - RNA, 19 nt, Yersinia pestis
agcgauugacugaauguga

SEQ ID NO: 2240314 - RNA, 18 nt, Yersinia pestis
agcgccgcaucaaagcgc

SEQ ID NO: 2240315 - RNA, 15 nt, Yersinia pestis
agcgcuuccacugcg

SEQ ID NO: 2240316 - RNA, 18 nt, Yersinia pestis
agggccgcuagugaguga

SEQ ID NO: 2240317 - RNA, 22 nt, Yersinia pestis
agggcgaugcaguuuauccaag

SEQ ID NO: 2240318 - RNA, 18 nt, Yersinia pestis
agggcgauagacuuucac

SEQ ID NO: 2240319 - RNA, 18 nt, Yersinia pestis
agggcggcgcaagcgaua

SEQ ID NO: 2240320 - RNA, 19 nt, Yersinia pestis
aggcuggcugugugaguaa

SEQ ID NO: 2240321 - RNA, 21 nt, Yersinia pestis
aggcuuauuaugacaacugaa

SEQ ID NO: 2240322 - RNA, 14 nt, Yersinia pestis
aggcgacgcaguaa

SEQ ID NO: 2240323 - RNA, 22 nt, Yersinia pestis
agcuguuguuguugauuacggg

SEQ ID NO: 2240324 - RNA, 17 nt, Yersinia pestis
agcuuccaacugauaaa

SEQ ID NO: 2240325 - RNA, 14 nt, Yersinia pestis
agcuuacuguucac

SEQ ID NO: 2240326 - RNA, 17 nt, Yersinia pestis
agcguccauguaucccg

SEQ ID NO: 2240327 - RNA, 17 nt, Yersinia pestis
agcuucuggcugauugc

SEQ ID NO: 2240328 - RNA, 16 nt, Yersinia pestis
aggauaaagcugaaua

SEQ ID NO: 2240329 - RNA, 18 nt, Yersinia pestis
aggagguaugacgagcgg

SEQ ID NO: 2240330 - RNA, 16 nt, Yersinia pestis
aggauauuuauuugau

SEQ ID NO: 2240331 - RNA, 20 nt, Yersinia pestis
aggagauagccucaccgcca

SEQ ID NO: 2240332 - RNA, 15 nt, Yersinia pestis
aggagauagcgugua

SEQ ID NO: 2240333 - RNA, 23 nt, Yersinia pestis
aggcagauugagugcggacagcg

SEQ ID NO: 2240334 - RNA, 16 nt, Yersinia pestis
aggcauccgccagcca

SEQ ID NO: 2240335 - RNA, 17 nt, Yersinia pestis
agugcaaucacggcagg

SEQ ID NO: 2240336 - RNA, 18 nt, Yersinia pestis
agugauucgggugaguga

SEQ ID NO: 2240337 - RNA, 16 nt, Yersinia pestis
agugaugagaaugccu

SEQ ID NO: 2240338 - RNA, 16 nt, Yersinia pestis
agugaucgcacuucaa

SEQ ID NO: 2240339 - RNA, 17 nt, Yersinia pestis
agugauccacauuaccg

SEQ ID NO: 2240340 - RNA, 17 nt, Yersinia pestis
agugaauuauuucagua

SEQ ID NO: 2240341 - RNA, 20 nt, Yersinia pestis
agugacgcagugacgcagug

SEQ ID NO: 2240342 - RNA, 21 nt, Yersinia pestis
agugcugccgcaacggcaccu

SEQ ID NO: 2240343 - RNA, 16 nt, Yersinia pestis
aguuaggguucaguaa

SEQ ID NO: 2240344 - RNA, 19 nt, Yersinia pestis
aguuaucuguuucaaauaa

SEQ ID NO: 2240345 - RNA, 15 nt, Yersinia pestis
aguuauucgccccuu

SEQ ID NO: 2240346 - RNA, 20 nt, Yersinia pestis
aguuaacgaguguacagcgu

SEQ ID NO: 2240347 - RNA, 14 nt, Yersinia pestis
aguuaaaaccagua

SEQ ID NO: 2240348 - RNA, 14 nt, Yersinia pestis
aguuaaucgcagca

SEQ ID NO: 2240349 - RNA, 20 nt, Yersinia pestis
aguuaagacaauuauagcca

SEQ ID NO: 2240350 - RNA, 18 nt, Yersinia pestis
aguguuucucagcgugaa

SEQ ID NO: 2240351 - RNA, 14 nt, Yersinia pestis
aguggcuaucugaa

SEQ ID NO: 2240352 - RNA, 22 nt, Yersinia pestis
aguggcuucucuuccuguucau

SEQ ID NO: 2240353 - RNA, 21 nt, Yersinia pestis
agucaaugagccugcggcacg

SEQ ID NO: 2240354 - RNA, 15 nt, Yersinia pestis
agucaccgcuguaaa

SEQ ID NO: 2240355 - RNA, 17 nt, Yersinia pestis
agucagcacaucgggau

SEQ ID NO: 2240356 - RNA, 24 nt, Yersinia pestis
aguagauaaucaugcucugcuaau

SEQ ID NO: 2240357 - RNA, 16 nt, Yersinia pestis
agucugaaaugaucac

SEQ ID NO: 2240358 - RNA, 21 nt, Yersinia pestis
agucucuguggauugccaaau

SEQ ID NO: 2240359 - RNA, 18 nt, Yersinia pestis
agugaaaagguuaacugc

SEQ ID NO: 2240360 - RNA, 12 nt, Yersinia pestis
agugaagacauc

SEQ ID NO: 2240361 - RNA, 17 nt, Yersinia pestis
agugaagacaucgccag

SEQ ID NO: 2240362 - RNA, 12 nt, Yersinia pestis
aguccggccauu

SEQ ID NO: 2240363 - RNA, 16 nt, Yersinia pestis
auagggacugccagau

SEQ ID NO: 2240364 - RNA, 17 nt, Yersinia pestis
auaggcgaaaggcgcaa

SEQ ID NO: 2240365 - RNA, 17 nt, Yersinia pestis
auaggggaaauagcuuc

SEQ ID NO: 2240366 - RNA, 22 nt, Yersinia pestis
auagucacgucuucaccaauga

SEQ ID NO: 2240367 - RNA, 17 nt, Yersinia pestis
auaguucccccagcguu

SEQ ID NO: 2240368 - RNA, 17 nt, Yersinia pestis
auagugaaggccgucgu

SEQ ID NO: 2240369 - RNA, 20 nt, Yersinia pestis
auagcuaaccuuaacugcau

SEQ ID NO: 2240370 - RNA, 14 nt, Yersinia pestis
auagcgcugcauca

SEQ ID NO: 2240371 - RNA, 18 nt, Yersinia pestis
auagcggcguucagcaau

SEQ ID NO: 2240372 - RNA, 19 nt, Yersinia pestis
auacuuucccauagcuggc

SEQ ID NO: 2240373 - RNA, 15 nt, Yersinia pestis
auaucaaaacuccau

SEQ ID NO: 2240374 - RNA, 15 nt, Yersinia pestis
auaucgaugacagca

SEQ ID NO: 2240375 - RNA, 21 nt, Yersinia pestis
auauuauuuacaaaccacauu

SEQ ID NO: 2240376 - RNA, 20 nt, Yersinia pestis
auauucacguuuuuccauuc

SEQ ID NO: 2240377 - RNA, 23 nt, Yersinia pestis
auauugacacgaaucccuaacga

SEQ ID NO: 2240378 - RNA, 12 nt, Yersinia pestis
auauuccuaauu

SEQ ID NO: 2240379 - RNA, 13 nt, Yersinia pestis
auaucugccaccg

SEQ ID NO: 2240380 - RNA, 21 nt, Yersinia pestis
auaucugccgcucgcgaggug

SEQ ID NO: 2240381 - RNA, 20 nt, Yersinia pestis
auaucgguacgcugauagcc

SEQ ID NO: 2240382 - RNA, 18 nt, Yersinia pestis
auaaccaucaaacauaga

SEQ ID NO: 2240383 - RNA, 20 nt, Yersinia pestis
auaacauuuuuucuuuuagc

SEQ ID NO: 2240384 - RNA, 12 nt, Yersinia pestis
auaacagcuaaa

SEQ ID NO: 2240385 - RNA, 18 nt, Yersinia pestis
auaacccgccuagcauca

SEQ ID NO: 2240386 - RNA, 21 nt, Yersinia pestis
auaaccucauuggcgguuauu

SEQ ID NO: 2240387 - RNA, 13 nt, Yersinia pestis
auaacgauaacuc

SEQ ID NO: 2240388 - RNA, 18 nt, Yersinia pestis
auaacggaaaaucaucgc

SEQ ID NO: 2240389 - RNA, 15 nt, Yersinia pestis
auaacgcggccagaa

SEQ ID NO: 2240390 - RNA, 16 nt, Yersinia pestis
auaacgcggccagaaa

SEQ ID NO: 2240391 - RNA, 14 nt, Yersinia pestis
auaacggcggcaau

SEQ ID NO: 2240392 - RNA, 20 nt, Yersinia pestis
auaacuugagcacauagcau

SEQ ID NO: 2240393 - RNA, 20 nt, Yersinia pestis
auaacuuuggguauaugacu

SEQ ID NO: 2240394 - RNA, 15 nt, Yersinia pestis
auaacguuauaacuc

SEQ ID NO: 2240395 - RNA, 22 nt, Yersinia pestis
auaacgugaugguaucaaucgc

SEQ ID NO: 2240396 - RNA, 13 nt, Yersinia pestis
auaagaagacuuc

SEQ ID NO: 2240397 - RNA, 15 nt, Yersinia pestis
auaagauucagcugc

SEQ ID NO: 2240398 - RNA, 17 nt, Yersinia pestis
auaagugaucagcuaac

SEQ ID NO: 2240399 - RNA, 13 nt, Yersinia pestis
auaauaaugcgau

SEQ ID NO: 2240400 - RNA, 13 nt, Yersinia pestis
auaauaauccaua

SEQ ID NO: 2240401 - RNA, 13 nt, Yersinia pestis
auacaccaucgcg

SEQ ID NO: 2240402 - RNA, 17 nt, Yersinia pestis
auacacaagucauugga

SEQ ID NO: 2240403 - RNA, 13 nt, Yersinia pestis
auacaaccguuac

SEQ ID NO: 2240404 - RNA, 15 nt, Yersinia pestis
auaauaucuggcguu

SEQ ID NO: 2240405 - RNA, 17 nt, Yersinia pestis
auaauauuaaagccauu

SEQ ID NO: 2240406 - RNA, 17 nt, Yersinia pestis
auaauuugucaguaaug

SEQ ID NO: 2240407 - RNA, 16 nt, Yersinia pestis
auaauauuggccgcca

SEQ ID NO: 2240408 - RNA, 17 nt, Yersinia pestis
auacacuaagugcauca

SEQ ID NO: 2240409 - RNA, 17 nt, Yersinia pestis
auaccuaaaauuaucgc

SEQ ID NO: 2240410 - RNA, 15 nt, Yersinia pestis
auaccggcuucacgg

SEQ ID NO: 2240411 - RNA, 14 nt, Yersinia pestis
auaccuuacugcau

SEQ ID NO: 2240412 - RNA, 17 nt, Yersinia pestis
auaccuuacugcaucaa

SEQ ID NO: 2240413 - RNA, 15 nt, Yersinia pestis
auacggucaaaagcu

SEQ ID NO: 2240414 - RNA, 18 nt, Yersinia pestis
auacgcgcaccggcuaac

SEQ ID NO: 2240415 - RNA, 18 nt, Yersinia pestis
cacaugccgucaccucau

SEQ ID NO: 2240416 - RNA, 22 nt, Yersinia pestis
cacauuacaagugccaaaugga

SEQ ID NO: 2240417 - RNA, 16 nt, Yersinia pestis
caccaaagcaaugaau

SEQ ID NO: 2240418 - RNA, 15 nt, Yersinia pestis
caccaaaaugacaau

SEQ ID NO: 2240419 - RNA, 23 nt, Yersinia pestis
cacaucaaaaccggaagccaccu

SEQ ID NO: 2240420 - RNA, 20 nt, Yersinia pestis
cacauagcauggucaucgcu

SEQ ID NO: 2240421 - RNA, 11 nt, Yersinia pestis
cacauaucucc

SEQ ID NO: 2240422 - RNA, 23 nt, Yersinia pestis
cacagagcgggaacgccaaguau

SEQ ID NO: 2240423 - RNA, 16 nt, Yersinia pestis
cacagcacucauaaug

SEQ ID NO: 2240424 - RNA, 19 nt, Yersinia pestis
cacagcacggcaacaggcu

SEQ ID NO: 2240425 - RNA, 17 nt, Yersinia pestis
cacaccgugcacccggc

SEQ ID NO: 2240426 - RNA, 20 nt, Yersinia pestis
cacacgacagcgcggcuaaa

SEQ ID NO: 2240427 - RNA, 20 nt, Yersinia pestis
caaggggcgagccacgauca

SEQ ID NO: 2240428 - RNA, 13 nt, Yersinia pestis
caaugaaugccgg

SEQ ID NO: 2240429 - RNA, 15 nt, Yersinia pestis
caaugauaaaauccu

SEQ ID NO: 2240430 - RNA, 19 nt, Yersinia pestis
caauuaugacguucaguag

SEQ ID NO: 2240431 - RNA, 17 nt, Yersinia pestis
caauucacgcaaggcca

SEQ ID NO: 2240432 - RNA, 16 nt, Yersinia pestis
caauucaucacguuua

SEQ ID NO: 2240433 - RNA, 22 nt, Yersinia pestis
caauucaaggccagcacguuuu

SEQ ID NO: 2240434 - RNA, 15 nt, Yersinia pestis
caauuaaaaacgcgc

SEQ ID NO: 2240435 - RNA, 17 nt, Yersinia pestis
caccauuuggacugaau

SEQ ID NO: 2240436 - RNA, 23 nt, Yersinia pestis
caccccagucacuuacugaucaa

SEQ ID NO: 2240437 - RNA, 16 nt, Yersinia pestis
cacccgcuuucagaca

SEQ ID NO: 2240438 - RNA, 21 nt, Yersinia pestis
caccauccggguuuaucccau

SEQ ID NO: 2240439 - RNA, 18 nt, Yersinia pestis
caccauccagcaaaucau

SEQ ID NO: 2240440 - RNA, 16 nt, Yersinia pestis
caccaguaaacgccaa

SEQ ID NO: 2240441 - RNA, 17 nt, Yersinia pestis
cacccucaagagcgaua

SEQ ID NO: 2240442 - RNA, 22 nt, Yersinia pestis
cacccucaagagcgauaaccgc

SEQ ID NO: 2240443 - RNA, 14 nt, Yersinia pestis
cacccugacgaaau

SEQ ID NO: 2240444 - RNA, 15 nt, Yersinia pestis
caaaagcccaucgcc

SEQ ID NO: 2240445 - RNA, 13 nt, Yersinia pestis
caaaagauaaucu

SEQ ID NO: 2240446 - RNA, 20 nt, Yersinia pestis
caaaauaacugggauauucu

SEQ ID NO: 2240447 - RNA, 17 nt, Yersinia pestis
caaacaccgcacguuua

SEQ ID NO: 2240448 - RNA, 19 nt, Yersinia pestis
caaacaccgcacguuuaaa

SEQ ID NO: 2240449 - RNA, 16 nt, Yersinia pestis
caaaaucaccuggcca

SEQ ID NO: 2240450 - RNA, 20 nt, Yersinia pestis
caaaaucaaauacugugcca

SEQ ID NO: 2240451 - RNA, 13 nt, Yersinia pestis
caaacgcugcaca

SEQ ID NO: 2240452 - RNA, 23 nt, Yersinia pestis
caaacggcgcgucgccauaacca

SEQ ID NO: 2240453 - RNA, 14 nt, Yersinia pestis
auuuuuuaccauua

SEQ ID NO: 2240454 - RNA, 24 nt, Yersinia pestis
caaaaaauuaaugagucucacaaa

SEQ ID NO: 2240455 - RNA, 15 nt, Yersinia pestis
auuuugcggcugagu

SEQ ID NO: 2240456 - RNA, 23 nt, Yersinia pestis
auuugagaccgcacgaguugccg

SEQ ID NO: 2240457 - RNA, 18 nt, Yersinia pestis
auuugacgcuguauaccc

SEQ ID NO: 2240458 - RNA, 21 nt, Yersinia pestis
auuugggucgguaaccugaaa

SEQ ID NO: 2240459 - RNA, 20 nt, Yersinia pestis
auuugcggcaugauagacgc

SEQ ID NO: 2240460 - RNA, 15 nt, Yersinia pestis
auuucgaaaacucaa

SEQ ID NO: 2240461 - RNA, 16 nt, Yersinia pestis
auuugaacuucaaauc

SEQ ID NO: 2240462 - RNA, 13 nt, Yersinia pestis
auuuagccgguaa

SEQ ID NO: 2240463 - RNA, 17 nt, Yersinia pestis
auuuaucaaucagcuga

SEQ ID NO: 2240464 - RNA, 15 nt, Yersinia pestis
auuuaccgacagcau

SEQ ID NO: 2240465 - RNA, 20 nt, Yersinia pestis
auucccaccacuugcuacca

SEQ ID NO: 2240466 - RNA, 21 nt, Yersinia pestis
auucccccgguuaaugccagc

SEQ ID NO: 2240467 - RNA, 13 nt, Yersinia pestis
auuuaugcaccaa

SEQ ID NO: 2240468 - RNA, 22 nt, Yersinia pestis
auuucaaugggaugcccacacu

SEQ ID NO: 2240469 - RNA, 18 nt, Yersinia pestis
auuucaaggcuaaccggg

SEQ ID NO: 2240470 - RNA, 14 nt, Yersinia pestis
caagagcaauggcg

SEQ ID NO: 2240471 - RNA, 17 nt, Yersinia pestis
caagaccuugguaucug

SEQ ID NO: 2240472 - RNA, 17 nt, Yersinia pestis
caacugagcuaacgacc

SEQ ID NO: 2240473 - RNA, 20 nt, Yersinia pestis
caagaguuucauuugcugug

SEQ ID NO: 2240474 - RNA, 19 nt, Yersinia pestis
caagcaaccgcaaugccgc

SEQ ID NO: 2240475 - RNA, 12 nt, Yersinia pestis
caagcaauggca

SEQ ID NO: 2240476 - RNA, 23 nt, Yersinia pestis
caagcauugagcgccacaucggc

SEQ ID NO: 2240477 - RNA, 23 nt, Yersinia pestis
caagccaaauuaaguaagccgca

SEQ ID NO: 2240478 - RNA, 18 nt, Yersinia pestis
caaggagaucgcucucac

SEQ ID NO: 2240479 - RNA, 19 nt, Yersinia pestis
caagcguacaucaggguga

SEQ ID NO: 2240480 - RNA, 17 nt, Yersinia pestis
caagcccuuuggcaauc

SEQ ID NO: 2240481 - RNA, 18 nt, Yersinia pestis
caacccuaacaccgagua

SEQ ID NO: 2240482 - RNA, 15 nt, Yersinia pestis
caacgccaauaccgg

SEQ ID NO: 2240483 - RNA, 22 nt, Yersinia pestis
caacgcccgcggccaauagcaa

SEQ ID NO: 2240484 - RNA, 19 nt, Yersinia pestis
caacgccggaucaucaacc

SEQ ID NO: 2240485 - RNA, 18 nt, Yersinia pestis
caacggacacauaagugu

SEQ ID NO: 2240486 - RNA, 13 nt, Yersinia pestis
caacagucaauau

SEQ ID NO: 2240487 - RNA, 20 nt, Yersinia pestis
caacauaaauaggccgccaa

SEQ ID NO: 2240488 - RNA, 18 nt, Yersinia pestis
caacauaaguaauaagua

SEQ ID NO: 2240489 - RNA, 20 nt, Yersinia pestis
caaccacgucuacgcucucc

SEQ ID NO: 2240490 - RNA, 16 nt, Yersinia pestis
caacagacucacucuc

SEQ ID NO: 2240491 - RNA, 11 nt, Yersinia pestis
caacagcaaaa

SEQ ID NO: 2240492 - RNA, 15 nt, Yersinia pestis
caacagcauuaccaa

SEQ ID NO: 2240493 - RNA, 16 nt, Yersinia pestis
caaaguagaacuggcc

SEQ ID NO: 2240494 - RNA, 14 nt, Yersinia pestis
caaauaaauauccu

SEQ ID NO: 2240495 - RNA, 21 nt, Yersinia pestis
caaauaacccgccuagcauca

SEQ ID NO: 2240496 - RNA, 19 nt, Yersinia pestis
caacacuggggcgcagaga

SEQ ID NO: 2240497 - RNA, 14 nt, Yersinia pestis
caacacuucuggcc

SEQ ID NO: 2240498 - RNA, 20 nt, Yersinia pestis
auuagagguuguugacaaag

SEQ ID NO: 2240499 - RNA, 12 nt, Yersinia pestis
auuagccauaag

SEQ ID NO: 2240500 - RNA, 20 nt, Yersinia pestis
auuacuucuuuuuaacgacg

SEQ ID NO: 2240501 - RNA, 14 nt, Yersinia pestis
auuagaaaacaagu

SEQ ID NO: 2240502 - RNA, 19 nt, Yersinia pestis
auuaucaucauuacacuga

SEQ ID NO: 2240503 - RNA, 17 nt, Yersinia pestis
auuagcgaaauaucagg

SEQ ID NO: 2240504 - RNA, 16 nt, Yersinia pestis
auuagggcugacagag

SEQ ID NO: 2240505 - RNA, 20 nt, Yersinia pestis
auuagugagcgguugaaaag

SEQ ID NO: 2240506 - RNA, 21 nt, Yersinia pestis
auucauuagccagccaauggc

SEQ ID NO: 2240507 - RNA, 17 nt, Yersinia pestis
auuauuuauuuacagcc

SEQ ID NO: 2240508 - RNA, 22 nt, Yersinia pestis
auucaaacggucuguuaauccu

SEQ ID NO: 2240509 - RNA, 16 nt, Yersinia pestis
auuacaagugccaaau

SEQ ID NO: 2240510 - RNA, 14 nt, Yersinia pestis
auuacacgguggcc

SEQ ID NO: 2240511 - RNA, 15 nt, Yersinia pestis
auuaccucacguuuu

SEQ ID NO: 2240512 - RNA, 15 nt, Yersinia pestis
auuacccauaacuug

SEQ ID NO: 2240513 - RNA, 20 nt, Yersinia pestis
auuacaucccgccauggcau

SEQ ID NO: 2240514 - RNA, 15 nt, Yersinia pestis
auuaccgagcgucaa

SEQ ID NO: 2240515 - RNA, 20 nt, Yersinia pestis
auuaauacacgcuuccagua

SEQ ID NO: 2240516 - RNA, 23 nt, Yersinia pestis
auuaaucuuguaaagacgcuaau

SEQ ID NO: 2240517 - RNA, 20 nt, Yersinia pestis
auuaaugucgccauaacgca

SEQ ID NO: 2240518 - RNA, 24 nt, Yersinia pestis
auuaacgcacaugccgucaccuca

SEQ ID NO: 2240519 - RNA, 22 nt, Yersinia pestis
auuaaccaagcucgccaucgca

SEQ ID NO: 2240520 - RNA, 16 nt, Yersinia pestis
auuaaggaaacucaug

SEQ ID NO: 2240521 - RNA, 15 nt, Yersinia pestis
auguacuacuucaua

SEQ ID NO: 2240522 - RNA, 20 nt, Yersinia pestis
auguagcacacuaccgucuu

SEQ ID NO: 2240523 - RNA, 21 nt, Yersinia pestis
auggucacccuuuugaauuca

SEQ ID NO: 2240524 - RNA, 17 nt, Yersinia pestis
auggcugccaucaggau

SEQ ID NO: 2240525 - RNA, 17 nt, Yersinia pestis
auggcugaaauaacuua

SEQ ID NO: 2240526 - RNA, 17 nt, Yersinia pestis
auggugccgucaacagg

SEQ ID NO: 2240527 - RNA, 22 nt, Yersinia pestis
auggcuaaacucuggcacuggc

SEQ ID NO: 2240528 - RNA, 13 nt, Yersinia pestis
auggcggucgcac

SEQ ID NO: 2240529 - RNA, 21 nt, Yersinia pestis
augccuggugcaaccgcugaa

SEQ ID NO: 2240530 - RNA, 22 nt, Yersinia pestis
augcgacaccugcuaucaugau

SEQ ID NO: 2240531 - RNA, 16 nt, Yersinia pestis
augcggauaucuugau

SEQ ID NO: 2240532 - RNA, 17 nt, Yersinia pestis
augcuaaaaaacagccu

SEQ ID NO: 2240533 - RNA, 17 nt, Yersinia pestis
augcgcucgcuugcugc

SEQ ID NO: 2240534 - RNA, 21 nt, Yersinia pestis
augcaaaugucagaucgcgau

SEQ ID NO: 2240535 - RNA, 20 nt, Yersinia pestis
augcaauuacugcauugcgu

SEQ ID NO: 2240536 - RNA, 17 nt, Yersinia pestis
augccaagucuuauugc

SEQ ID NO: 2240537 - RNA, 19 nt, Yersinia pestis
augccacuucgcuacgccg

SEQ ID NO: 2240538 - RNA, 14 nt, Yersinia pestis
augccagcccauca

SEQ ID NO: 2240539 - RNA, 14 nt, Yersinia pestis
augccauucaagcc

SEQ ID NO: 2240540 - RNA, 19 nt, Yersinia pestis
augauuguuuuauggcgau

SEQ ID NO: 2240541 - RNA, 14 nt, Yersinia pestis
augaugacggugau

SEQ ID NO: 2240542 - RNA, 12 nt, Yersinia pestis
augacugaacau

SEQ ID NO: 2240543 - RNA, 23 nt, Yersinia pestis
augagcgcauugcacagguccau

SEQ ID NO: 2240544 - RNA, 21 nt, Yersinia pestis
augaggcuaccugcaccaauc

SEQ ID NO: 2240545 - RNA, 21 nt, Yersinia pestis
aucugccaguaaacggcgguu

SEQ ID NO: 2240546 - RNA, 18 nt, Yersinia pestis
aucugauacugaacgcaa

SEQ ID NO: 2240547 - RNA, 20 nt, Yersinia pestis
aucugaucaaucucaucaau

SEQ ID NO: 2240548 - RNA, 21 nt, Yersinia pestis
aucgguggugaccugccaauu

SEQ ID NO: 2240549 - RNA, 17 nt, Yersinia pestis
aucgguaucaucgagau

SEQ ID NO: 2240550 - RNA, 13 nt, Yersinia pestis
aucgguaucgaua

SEQ ID NO: 2240551 - RNA, 13 nt, Yersinia pestis
aucgguaucggcc

SEQ ID NO: 2240552 - RNA, 18 nt, Yersinia pestis
aucggccaauucagcaac

SEQ ID NO: 2240553 - RNA, 13 nt, Yersinia pestis
aucucuccagccu

SEQ ID NO: 2240554 - RNA, 20 nt, Yersinia pestis
aucucuucggcccagauauc

SEQ ID NO: 2240555 - RNA, 16 nt, Yersinia pestis
aucucaucggcauacu

SEQ ID NO: 2240556 - RNA, 18 nt, Yersinia pestis
aucguauucucaauggcu

SEQ ID NO: 2240557 - RNA, 17 nt, Yersinia pestis
aucguuacggcugcgcg

SEQ ID NO: 2240558 - RNA, 15 nt, Yersinia pestis
aucgcuugccacuuu

SEQ ID NO: 2240559 - RNA, 17 nt, Yersinia pestis
aucgccuucaucgcgau

SEQ ID NO: 2240560 - RNA, 14 nt, Yersinia pestis
aucgcgaccaauuc

SEQ ID NO: 2240561 - RNA, 19 nt, Yersinia pestis
aucgauggauguuccuggc

SEQ ID NO: 2240562 - RNA, 14 nt, Yersinia pestis
aucgccaaacugcu

SEQ ID NO: 2240563 - RNA, 18 nt, Yersinia pestis
aucgcaguuaaagacaug

SEQ ID NO: 2240564 - RNA, 16 nt, Yersinia pestis
aucgccaguguugcca

SEQ ID NO: 2240565 - RNA, 17 nt, Yersinia pestis
aucauaaugguaccggc

SEQ ID NO: 2240566 - RNA, 21 nt, Yersinia pestis
aucauauuaacauaucaauaa

SEQ ID NO: 2240567 - RNA, 19 nt, Yersinia pestis
aucauauuaggcaggugaa

SEQ ID NO: 2240568 - RNA, 14 nt, Yersinia pestis
aucaucaauacccu

SEQ ID NO: 2240569 - RNA, 23 nt, Yersinia pestis
aucauaacuaagagucacagcau

SEQ ID NO: 2240570 - RNA, 19 nt, Yersinia pestis
aucaguuccugauucgguu

SEQ ID NO: 2240571 - RNA, 16 nt, Yersinia pestis
aucaguagucaauaca

SEQ ID NO: 2240572 - RNA, 20 nt, Yersinia pestis
aucagguuguauuuugcagg

SEQ ID NO: 2240573 - RNA, 14 nt, Yersinia pestis
aucaguaacgccgu

SEQ ID NO: 2240574 - RNA, 18 nt, Yersinia pestis
aucaggcgcacgaauauc

SEQ ID NO: 2240575 - RNA, 16 nt, Yersinia pestis
aucagcuuaaucgcau

SEQ ID NO: 2240576 - RNA, 21 nt, Yersinia pestis
aucauggaagaccagauaauc

SEQ ID NO: 2240577 - RNA, 15 nt, Yersinia pestis
aucaucauaaauggu

SEQ ID NO: 2240578 - RNA, 18 nt, Yersinia pestis
aucaucgcaccauaacca

SEQ ID NO: 2240579 - RNA, 12 nt, Yersinia pestis
auccaauaccga

SEQ ID NO: 2240580 - RNA, 22 nt, Yersinia pestis
auccaaucauucugucaucaag

SEQ ID NO: 2240581 - RNA, 13 nt, Yersinia pestis
auccaagccauca

SEQ ID NO: 2240582 - RNA, 15 nt, Yersinia pestis
aucauguaaggcaau

SEQ ID NO: 2240583 - RNA, 13 nt, Yersinia pestis
aucauucaauugu

SEQ ID NO: 2240584 - RNA, 13 nt, Yersinia pestis
ccauuuccuuaua

SEQ ID NO: 2240585 - RNA, 15 nt, Yersinia pestis
ccauuuccaauacca

SEQ ID NO: 2240586 - RNA, 19 nt, Yersinia pestis
ccauuucucugaugguauc

SEQ ID NO: 2240587 - RNA, 14 nt, Yersinia pestis
cccaaaauuugcuu

SEQ ID NO: 2240588 - RNA, 22 nt, Yersinia pestis
ccauugcgguuacguucaccua

SEQ ID NO: 2240589 - RNA, 14 nt, Yersinia pestis
cccaaauacuguug

SEQ ID NO: 2240590 - RNA, 19 nt, Yersinia pestis
cccaaccccaucagcauau

SEQ ID NO: 2240591 - RNA, 12 nt, Yersinia pestis
cccacaaccagg

SEQ ID NO: 2240592 - RNA, 17 nt, Yersinia pestis
cccaauguauauguugg

SEQ ID NO: 2240593 - RNA, 13 nt, Yersinia pestis
cccaaucaucauc

SEQ ID NO: 2240594 - RNA, 14 nt, Yersinia pestis
ccauggcguaaccg

SEQ ID NO: 2240595 - RNA, 19 nt, Yersinia pestis
cccacuggccccgaucauc

SEQ ID NO: 2240596 - RNA, 22 nt, Yersinia pestis
cccacuucguagggcacuuuca

SEQ ID NO: 2240597 - RNA, 13 nt, Yersinia pestis
cccagccagaaug

SEQ ID NO: 2240598 - RNA, 12 nt, Yersinia pestis
ccagguuacugc

SEQ ID NO: 2240599 - RNA, 14 nt, Yersinia pestis
ccaguacugaccac

SEQ ID NO: 2240600 - RNA, 19 nt, Yersinia pestis
ccaguagcacaaugccuaa

SEQ ID NO: 2240601 - RNA, 21 nt, Yersinia pestis
ccaggcugugguggcggucaa

SEQ ID NO: 2240602 - RNA, 13 nt, Yersinia pestis
ccauaaaucccga

SEQ ID NO: 2240603 - RNA, 20 nt, Yersinia pestis
ccauaagcgacgacauuaau

SEQ ID NO: 2240604 - RNA, 16 nt, Yersinia pestis
ccauauacgcauaaug

SEQ ID NO: 2240605 - RNA, 17 nt, Yersinia pestis
ccauauccaaagauauc

SEQ ID NO: 2240606 - RNA, 12 nt, Yersinia pestis
ccauaucaaccg

SEQ ID NO: 2240607 - RNA, 19 nt, Yersinia pestis
ccaucaaggacuucaucac

SEQ ID NO: 2240608 - RNA, 14 nt, Yersinia pestis
ccaucaaccaccgc

SEQ ID NO: 2240609 - RNA, 19 nt, Yersinia pestis
ccagugcuuuauccaaugg

SEQ ID NO: 2240610 - RNA, 21 nt, Yersinia pestis
ccgaauaaaaccuugcgccaa

SEQ ID NO: 2240611 - RNA, 21 nt, Yersinia pestis
ccgaaagccaagcaagcggca

SEQ ID NO: 2240612 - RNA, 21 nt, Yersinia pestis
cccguuacacaaucaguaaau

SEQ ID NO: 2240613 - RNA, 17 nt, Yersinia pestis
cccguucaacaguauca

SEQ ID NO: 2240614 - RNA, 18 nt, Yersinia pestis
cccgguugauaucggcaa

SEQ ID NO: 2240615 - RNA, 16 nt, Yersinia pestis
cccgcagggguauccg

SEQ ID NO: 2240616 - RNA, 13 nt, Yersinia pestis
cccgaguuaaacu

SEQ ID NO: 2240617 - RNA, 12 nt, Yersinia pestis
cccauucaucaa

SEQ ID NO: 2240618 - RNA, 19 nt, Yersinia pestis
ccccgguuuuuacuguucu

SEQ ID NO: 2240619 - RNA, 14 nt, Yersinia pestis
ccccuuuagugcgg

SEQ ID NO: 2240620 - RNA, 17 nt, Yersinia pestis
ccccucgaaaauaacca

SEQ ID NO: 2240621 - RNA, 17 nt, Yersinia pestis
cccgaagcucaagcugg

SEQ ID NO: 2240622 - RNA, 17 nt, Yersinia pestis
ccaauaaaaugcaccgc

SEQ ID NO: 2240623 - RNA, 15 nt, Yersinia pestis
ccaaguucaacuuca

SEQ ID NO: 2240624 - RNA, 23 nt, Yersinia pestis
ccaacucaccuaaaucauacagg

SEQ ID NO: 2240625 - RNA, 19 nt, Yersinia pestis
ccaacgagaaaggaaugcc

SEQ ID NO: 2240626 - RNA, 12 nt, Yersinia pestis
ccacaucaaccu

SEQ ID NO: 2240627 - RNA, 22 nt, Yersinia pestis
ccacauagcugcgauaauccgc

SEQ ID NO: 2240628 - RNA, 16 nt, Yersinia pestis
ccaccaguaaacgcca

SEQ ID NO: 2240629 - RNA, 16 nt, Yersinia pestis
ccaccagacugacaac

SEQ ID NO: 2240630 - RNA, 14 nt, Yersinia pestis
ccaccaagggucau

SEQ ID NO: 2240631 - RNA, 15 nt, Yersinia pestis
cauuggcaaaggcca

SEQ ID NO: 2240632 - RNA, 17 nt, Yersinia pestis
cauugcgcuaacagcgu

SEQ ID NO: 2240633 - RNA, 14 nt, Yersinia pestis
cauucuaucauccu

SEQ ID NO: 2240634 - RNA, 23 nt, Yersinia pestis
cauucuaguuugugcugcuaaua

SEQ ID NO: 2240635 - RNA, 15 nt, Yersinia pestis
cauucguucguuauu

SEQ ID NO: 2240636 - RNA, 16 nt, Yersinia pestis
cauucaggccgaguaa

SEQ ID NO: 2240637 - RNA, 16 nt, Yersinia pestis
cauucaugaggcuucu

SEQ ID NO: 2240638 - RNA, 15 nt, Yersinia pestis
cauucaugaggcuca

SEQ ID NO: 2240639 - RNA, 20 nt, Yersinia pestis
cauugucagguuaauaccug

SEQ ID NO: 2240640 - RNA, 23 nt, Yersinia pestis
cauuuuaaucucuccaugauaua

SEQ ID NO: 2240641 - RNA, 21 nt, Yersinia pestis
cauuuucgaacuuaacuacug

SEQ ID NO: 2240642 - RNA, 17 nt, Yersinia pestis
cauuuuggccgcuuugg

SEQ ID NO: 2240643 - RNA, 14 nt, Yersinia pestis
cauuuugaccagca

SEQ ID NO: 2240644 - RNA, 24 nt, Yersinia pestis
cauuuugaccagcauacgugccaa

SEQ ID NO: 2240645 - RNA, 17 nt, Yersinia pestis
ccaaacugcucauaaag

SEQ ID NO: 2240646 - RNA, 22 nt, Yersinia pestis
ccaaagcccuuauccguuaacc

SEQ ID NO: 2240647 - RNA, 18 nt, Yersinia pestis
ccaaacauugucaccuga

SEQ ID NO: 2240648 - RNA, 20 nt, Yersinia pestis
ccaaaugcccauuaguaaug

SEQ ID NO: 2240649 - RNA, 14 nt, Yersinia pestis
ccaaauucagaaug

SEQ ID NO: 2240650 - RNA, 18 nt, Yersinia pestis
ccaaagccgucaguuccu

SEQ ID NO: 2240651 - RNA, 15 nt, Yersinia pestis
ccaaagcugcgccaa

SEQ ID NO: 2240652 - RNA, 11 nt, Yersinia pestis
ccaaccuauau

SEQ ID NO: 2240653 - RNA, 21 nt, Yersinia pestis
caugcagcauuucaggaucga

SEQ ID NO: 2240654 - RNA, 12 nt, Yersinia pestis
caugcuguucac

SEQ ID NO: 2240655 - RNA, 16 nt, Yersinia pestis
cauggcguaaccgccg

SEQ ID NO: 2240656 - RNA, 20 nt, Yersinia pestis
caucuuuuuuuuuauuauca

SEQ ID NO: 2240657 - RNA, 21 nt, Yersinia pestis
caucuaccuguguugcgccau

SEQ ID NO: 2240658 - RNA, 16 nt, Yersinia pestis
cauccgguacgcauca

SEQ ID NO: 2240659 - RNA, 15 nt, Yersinia pestis
cauccguccaaugaa

SEQ ID NO: 2240660 - RNA, 14 nt, Yersinia pestis
ccacuacggcgacu

SEQ ID NO: 2240661 - RNA, 14 nt, Yersinia pestis
ccaccauuggcgau

SEQ ID NO: 2240662 - RNA, 17 nt, Yersinia pestis
ccacgaggguucagggc

SEQ ID NO: 2240663 - RNA, 14 nt, Yersinia pestis
cauauggaugaugc

SEQ ID NO: 2240664 - RNA, 18 nt, Yersinia pestis
cauauggaugaugcacag

SEQ ID NO: 2240665 - RNA, 22 nt, Yersinia pestis
cauauuguccaacaucuccgcc

SEQ ID NO: 2240666 - RNA, 22 nt, Yersinia pestis
cauauagcggcguucagcaaua

SEQ ID NO: 2240667 - RNA, 13 nt, Yersinia pestis
cauauaucacuau

SEQ ID NO: 2240668 - RNA, 22 nt, Yersinia pestis
cauauccaaagauaucuuugag

SEQ ID NO: 2240669 - RNA, 18 nt, Yersinia pestis
cauaucuccguugaaacc

SEQ ID NO: 2240670 - RNA, 14 nt, Yersinia pestis
caucaaauacacga

SEQ ID NO: 2240671 - RNA, 14 nt, Yersinia pestis
caucacagugccaa

SEQ ID NO: 2240672 - RNA, 16 nt, Yersinia pestis
caucacaucggcgacu

SEQ ID NO: 2240673 - RNA, 21 nt, Yersinia pestis
caucacccguuuucccaguaa

SEQ ID NO: 2240674 - RNA, 16 nt, Yersinia pestis
caucauauucagccga

SEQ ID NO: 2240675 - RNA, 11 nt, Yersinia pestis
caucagugacu

SEQ ID NO: 2240676 - RNA, 20 nt, Yersinia pestis
caucacuggcgggccguuua

SEQ ID NO: 2240677 - RNA, 20 nt, Yersinia pestis
cauccccugccguuggcaua

SEQ ID NO: 2240678 - RNA, 21 nt, Yersinia pestis
caucccuucgcaaaaugccaa

SEQ ID NO: 2240679 - RNA, 19 nt, Yersinia pestis
cauccgcaaaauggguaua

SEQ ID NO: 2240680 - RNA, 22 nt, Yersinia pestis
cauacuguugugggaucuuggc

SEQ ID NO: 2240681 - RNA, 20 nt, Yersinia pestis
cauacgucuccauuucaacg

SEQ ID NO: 2240682 - RNA, 22 nt, Yersinia pestis
cauaccgaauaauaaauauccu

SEQ ID NO: 2240683 - RNA, 16 nt, Yersinia pestis
cauaagacaacgccgc

SEQ ID NO: 2240684 - RNA, 21 nt, Yersinia pestis
cauaaaucccgagacacucau

SEQ ID NO: 2240685 - RNA, 19 nt, Yersinia pestis
caguuugcgaccaauaccg

SEQ ID NO: 2240686 - RNA, 17 nt, Yersinia pestis
caguuucuaccgcuuca

SEQ ID NO: 2240687 - RNA, 22 nt, Yersinia pestis
caguuuauuuucccuuucucag

SEQ ID NO: 2240688 - RNA, 12 nt, Yersinia pestis
caguucaacagu

SEQ ID NO: 2240689 - RNA, 23 nt, Yersinia pestis
caguucagcccccucaauaccgg

SEQ ID NO: 2240690 - RNA, 19 nt, Yersinia pestis
caguucauuccccaucgcc

SEQ ID NO: 2240691 - RNA, 20 nt, Yersinia pestis
caguacuauucacgagcuaa

SEQ ID NO: 2240692 - RNA, 21 nt, Yersinia pestis
caguaccgacaccaauaccga

SEQ ID NO: 2240693 - RNA, 17 nt, Yersinia pestis
caguaaugcccauugcg

SEQ ID NO: 2240694 - RNA, 13 nt, Yersinia pestis
cagguuggcggca

SEQ ID NO: 2240695 - RNA, 18 nt, Yersinia pestis
cagguaucucacucaggc

SEQ ID NO: 2240696 - RNA, 13 nt, Yersinia pestis
cagguaaauccuu

SEQ ID NO: 2240697 - RNA, 19 nt, Yersinia pestis
cagguaccccauaaauccc

SEQ ID NO: 2240698 - RNA, 12 nt, Yersinia pestis
cagggcuguuau

SEQ ID NO: 2240699 - RNA, 12 nt, Yersinia pestis
cagggccacuuc

SEQ ID NO: 2240700 - RNA, 20 nt, Yersinia pestis
cagggcgauagcccuacugg

SEQ ID NO: 2240701 - RNA, 22 nt, Yersinia pestis
cagcuugguaaugcgcaccagc

SEQ ID NO: 2240702 - RNA, 22 nt, Yersinia pestis
caggcagaucguaaagacgccg

SEQ ID NO: 2240703 - RNA, 18 nt, Yersinia pestis
caggcccugguugcagca

SEQ ID NO: 2240704 - RNA, 18 nt, Yersinia pestis
caggccagcgacauggcg

SEQ ID NO: 2240705 - RNA, 16 nt, Yersinia pestis
caggcaggagcacaau

SEQ ID NO: 2240706 - RNA, 16 nt, Yersinia pestis
caggccuagcccagua

SEQ ID NO: 2240707 - RNA, 23 nt, Yersinia pestis
caggccuaucucgcgucgcguac

SEQ ID NO: 2240708 - RNA, 13 nt, Yersinia pestis
cagcggcggccau

SEQ ID NO: 2240709 - RNA, 12 nt, Yersinia pestis
cagcucaccguc

SEQ ID NO: 2240710 - RNA, 23 nt, Yersinia pestis
cagcguccauaaacccggugacc

SEQ ID NO: 2240711 - RNA, 17 nt, Yersinia pestis
cagcgucucguguaaca

SEQ ID NO: 2240712 - RNA, 16 nt, Yersinia pestis
cagcagaaccauggca

SEQ ID NO: 2240713 - RNA, 14 nt, Yersinia pestis
cagcagcacguuca

SEQ ID NO: 2240714 - RNA, 17 nt, Yersinia pestis
cagcacgccaguguuca

SEQ ID NO: 2240715 - RNA, 22 nt, Yersinia pestis
cagauggccagauucaccagua

SEQ ID NO: 2240716 - RNA, 19 nt, Yersinia pestis
cagauauuacgcagccaua

SEQ ID NO: 2240717 - RNA, 19 nt, Yersinia pestis
cagauauuuucggguaucu

SEQ ID NO: 2240718 - RNA, 14 nt, Yersinia pestis
cagauaaugccuaa

SEQ ID NO: 2240719 - RNA, 21 nt, Yersinia pestis
cagaauacguagcccuuugcu

SEQ ID NO: 2240720 - RNA, 15 nt, Yersinia pestis
cagcacauccaugcc

SEQ ID NO: 2240721 - RNA, 17 nt, Yersinia pestis
cagauucuagcaucgcc

SEQ ID NO: 2240722 - RNA, 19 nt, Yersinia pestis
cagccacuuguagguuaaa

SEQ ID NO: 2240723 - RNA, 17 nt, Yersinia pestis
cagccaaccaucaucaa

SEQ ID NO: 2240724 - RNA, 23 nt, Yersinia pestis
cagcagcuuuugugcaggaguaa

SEQ ID NO: 2240725 - RNA, 19 nt, Yersinia pestis
cagccccaaacacuuagca

SEQ ID NO: 2240726 - RNA, 13 nt, Yersinia pestis
cagccagcgucau

SEQ ID NO: 2240727 - RNA, 14 nt, Yersinia pestis
cagcccagauggca

SEQ ID NO: 2240728 - RNA, 17 nt, Yersinia pestis
cagcccagauggcaauc

SEQ ID NO: 2240729 - RNA, 23 nt, Yersinia pestis
cagccggauaggcuuaauaugcc

SEQ ID NO: 2240730 - RNA, 19 nt, Yersinia pestis
cacggauauccaacgguag

SEQ ID NO: 2240731 - RNA, 21 nt, Yersinia pestis
cacuuuuauauccgccauccu

SEQ ID NO: 2240732 - RNA, 23 nt, Yersinia pestis
cacuuugucaauaaccucagccu

SEQ ID NO: 2240733 - RNA, 21 nt, Yersinia pestis
cacuuugucaauaaccucaaa

SEQ ID NO: 2240734 - RNA, 14 nt, Yersinia pestis
cagaagguaagcca

SEQ ID NO: 2240735 - RNA, 18 nt, Yersinia pestis
cagaagggcggccagcaa

SEQ ID NO: 2240736 - RNA, 19 nt, Yersinia pestis
cacugugcuuuucuuaaua

SEQ ID NO: 2240737 - RNA, 16 nt, Yersinia pestis
cacugacugagugcca

SEQ ID NO: 2240738 - RNA, 20 nt, Yersinia pestis
cacugaaaguguauuucuca

SEQ ID NO: 2240739 - RNA, 17 nt, Yersinia pestis
cacucuugaacggugag

SEQ ID NO: 2240740 - RNA, 23 nt, Yersinia pestis
caccuugauuaauaacaguaaua

SEQ ID NO: 2240741 - RNA, 22 nt, Yersinia pestis
cacgaaccugagcgaucaauac

SEQ ID NO: 2240742 - RNA, 22 nt, Yersinia pestis
cacgacaugagcaugccugagc

SEQ ID NO: 2240743 - RNA, 20 nt, Yersinia pestis
caccugaucgugccauuaca

SEQ ID NO: 2240744 - RNA, 16 nt, Yersinia pestis
caccucuugcauacuc

SEQ ID NO: 2240745 - RNA, 20 nt, Yersinia pestis
caccugcuaucaugauaaau

SEQ ID NO: 2240746 - RNA, 21 nt, Yersinia pestis
cacgcccggcuaaacgcucaa

SEQ ID NO: 2240747 - RNA, 17 nt, Yersinia pestis
cacgcaaucagaugguc

SEQ ID NO: 2240748 - RNA, 20 nt, Yersinia pestis
cacgaugccaguagccguua

SEQ ID NO: 2240749 - RNA, 23 nt, Yersinia pestis
gcaauauuggcgcacaacugcga

SEQ ID NO: 2240750 - RNA, 14 nt, Yersinia pestis
gcaauaccagccga

SEQ ID NO: 2240751 - RNA, 21 nt, Yersinia pestis
gcaaugcuuauuucacacugu

SEQ ID NO: 2240752 - RNA, 16 nt, Yersinia pestis
gcaauuugaucaccaa

SEQ ID NO: 2240753 - RNA, 12 nt, Yersinia pestis
gcaauuugccgc

SEQ ID NO: 2240754 - RNA, 15 nt, Yersinia pestis
gcacacugacagcaa

SEQ ID NO: 2240755 - RNA, 15 nt, Yersinia pestis
gcacauagggcucgg

SEQ ID NO: 2240756 - RNA, 15 nt, Yersinia pestis
gcacagguccaucag

SEQ ID NO: 2240757 - RNA, 21 nt, Yersinia pestis
gcacauuacaagugccaaaug

SEQ ID NO: 2240758 - RNA, 15 nt, Yersinia pestis
gcaccaccgacacca

SEQ ID NO: 2240759 - RNA, 16 nt, Yersinia pestis
gcaccauccagcaaau

SEQ ID NO: 2240760 - RNA, 17 nt, Yersinia pestis
gcaccauaaccaaucca

SEQ ID NO: 2240761 - RNA, 11 nt, Yersinia pestis
gcaccagcgca

SEQ ID NO: 2240762 - RNA, 19 nt, Yersinia pestis
gcaccucggggcacuucgg

SEQ ID NO: 2240763 - RNA, 14 nt, Yersinia pestis
gcaccgccgccaua

SEQ ID NO: 2240764 - RNA, 14 nt, Yersinia pestis
gcaccgcugauaac

SEQ ID NO: 2240765 - RNA, 15 nt, Yersinia pestis
gcauauguagccaga

SEQ ID NO: 2240766 - RNA, 20 nt, Yersinia pestis
gcaucaaacggcaacuucua

SEQ ID NO: 2240767 - RNA, 12 nt, Yersinia pestis
gcaucagccagc

SEQ ID NO: 2240768 - RNA, 13 nt, Yersinia pestis
gcaucauccucau

SEQ ID NO: 2240769 - RNA, 13 nt, Yersinia pestis
gcaucauccagcu

SEQ ID NO: 2240770 - RNA, 17 nt, Yersinia pestis
gcaucauuaagaugcau

SEQ ID NO: 2240771 - RNA, 16 nt, Yersinia pestis
gcauccacugcggcca

SEQ ID NO: 2240772 - RNA, 21 nt, Yersinia pestis
gcagcuuuugugcaggaguaa

SEQ ID NO: 2240773 - RNA, 18 nt, Yersinia pestis
gcaggaagauaucgcuac

SEQ ID NO: 2240774 - RNA, 21 nt, Yersinia pestis
gcagaucguaaagacgccgua

SEQ ID NO: 2240775 - RNA, 17 nt, Yersinia pestis
gcagaggaguaaagcgu

SEQ ID NO: 2240776 - RNA, 24 nt, Yersinia pestis
gcagcagugcgguucaagccgaua

SEQ ID NO: 2240777 - RNA, 17 nt, Yersinia pestis
gauaaucacguucaacu

SEQ ID NO: 2240778 - RNA, 15 nt, Yersinia pestis
gauaaugccgcccau

SEQ ID NO: 2240779 - RNA, 23 nt, Yersinia pestis
gauaagaaucuugggaucagcca

SEQ ID NO: 2240780 - RNA, 23 nt, Yersinia pestis
gauaagcauaaccgguaccggcu

SEQ ID NO: 2240781 - RNA, 16 nt, Yersinia pestis
gauaaggcaaggccgu

SEQ ID NO: 2240782 - RNA, 17 nt, Yersinia pestis
gauaaccagcaguugcu

SEQ ID NO: 2240783 - RNA, 16 nt, Yersinia pestis
gauaacccuaucguca

SEQ ID NO: 2240784 - RNA, 15 nt, Yersinia pestis
gauaacccccugaca

SEQ ID NO: 2240785 - RNA, 18 nt, Yersinia pestis
gauaacuccaggguaaua

SEQ ID NO: 2240786 - RNA, 20 nt, Yersinia pestis
gauaacuuccuuugcccuua

SEQ ID NO: 2240787 - RNA, 17 nt, Yersinia pestis
gauaacgguaucaguca

SEQ ID NO: 2240788 - RNA, 19 nt, Yersinia pestis
gauaaccucucgccgguua

SEQ ID NO: 2240789 - RNA, 19 nt, Yersinia pestis
gauaaccguuuuuucaacu

SEQ ID NO: 2240790 - RNA, 13 nt, Yersinia pestis
gauaguacguagc

SEQ ID NO: 2240791 - RNA, 17 nt, Yersinia pestis
gauacuacaaucaucgg

SEQ ID NO: 2240792 - RNA, 13 nt, Yersinia pestis
gauacgcgcaccg

SEQ ID NO: 2240793 - RNA, 17 nt, Yersinia pestis
gaggcugagguugauga

SEQ ID NO: 2240794 - RNA, 22 nt, Yersinia pestis
gaguagagcuuccagugcauua

SEQ ID NO: 2240795 - RNA, 21 nt, Yersinia pestis
gagucaggaaacuggccaacu

SEQ ID NO: 2240796 - RNA, 20 nt, Yersinia pestis
gaguagcaggccgacaauac

SEQ ID NO: 2240797 - RNA, 18 nt, Yersinia pestis
gaggguuagcgaugacug

SEQ ID NO: 2240798 - RNA, 23 nt, Yersinia pestis
gagcgccccgccuaucaggcaca

SEQ ID NO: 2240799 - RNA, 12 nt, Yersinia pestis
gagccagcacac

SEQ ID NO: 2240800 - RNA, 18 nt, Yersinia pestis
gauuuuggugcuggccug

SEQ ID NO: 2240801 - RNA, 14 nt, Yersinia pestis
gauguuuaaauugc

SEQ ID NO: 2240802 - RNA, 23 nt, Yersinia pestis
gauuaaggagcccucugucauua

SEQ ID NO: 2240803 - RNA, 13 nt, Yersinia pestis
gaugcguguaaug

SEQ ID NO: 2240804 - RNA, 12 nt, Yersinia pestis
gaucguugcagg

SEQ ID NO: 2240805 - RNA, 20 nt, Yersinia pestis
gauccugcaauaacaccagc

SEQ ID NO: 2240806 - RNA, 18 nt, Yersinia pestis
gauccaguuucaguggcu

SEQ ID NO: 2240807 - RNA, 17 nt, Yersinia pestis
gaucccagaauggcaaa

SEQ ID NO: 2240808 - RNA, 21 nt, Yersinia pestis
gccgaacucgucauucaccac

SEQ ID NO: 2240809 - RNA, 15 nt, Yersinia pestis
gccgaaagccaagca

SEQ ID NO: 2240810 - RNA, 15 nt, Yersinia pestis
gcccuucagcaaaug

SEQ ID NO: 2240811 - RNA, 13 nt, Yersinia pestis
gcccugcucuucu

SEQ ID NO: 2240812 - RNA, 16 nt, Yersinia pestis
gcccugaauuucaaua

SEQ ID NO: 2240813 - RNA, 13 nt, Yersinia pestis
gcccucuugaacg

SEQ ID NO: 2240814 - RNA, 12 nt, Yersinia pestis
gcccugaagcaa

SEQ ID NO: 2240815 - RNA, 22 nt, Yersinia pestis
gcccucguuguuguaugacaag

SEQ ID NO: 2240816 - RNA, 16 nt, Yersinia pestis
gccgagguuauagcag

SEQ ID NO: 2240817 - RNA, 17 nt, Yersinia pestis
gccgaggugaagacacc

SEQ ID NO: 2240818 - RNA, 19 nt, Yersinia pestis
gccgaugaagguaaugcga

SEQ ID NO: 2240819 - RNA, 21 nt, Yersinia pestis
gccgccagccuugugcuucau

SEQ ID NO: 2240820 - RNA, 12 nt, Yersinia pestis
gccgcgccaucc

SEQ ID NO: 2240821 - RNA, 17 nt, Yersinia pestis
gccgcgcccccagccau

SEQ ID NO: 2240822 - RNA, 20 nt, Yersinia pestis
gccaauggccacugcgggca

SEQ ID NO: 2240823 - RNA, 16 nt, Yersinia pestis
gcauccccaucgccaa

SEQ ID NO: 2240824 - RNA, 21 nt, Yersinia pestis
gcauccugcaaauuuauccaa

SEQ ID NO: 2240825 - RNA, 21 nt, Yersinia pestis
gccaauauguuagcagcacaa

SEQ ID NO: 2240826 - RNA, 15 nt, Yersinia pestis
gccaauauugaccaa

SEQ ID NO: 2240827 - RNA, 18 nt, Yersinia pestis
gccaauaaccgcagcagg

SEQ ID NO: 2240828 - RNA, 22 nt, Yersinia pestis
gccaauaaccgcagcaggcaga

SEQ ID NO: 2240829 - RNA, 13 nt, Yersinia pestis
gccaagccaguaa

SEQ ID NO: 2240830 - RNA, 21 nt, Yersinia pestis
gccaaggcaaggauggcgcgg

SEQ ID NO: 2240831 - RNA, 15 nt, Yersinia pestis
gccacccgcuuucag

SEQ ID NO: 2240832 - RNA, 15 nt, Yersinia pestis
gccagcgccccauca

SEQ ID NO: 2240833 - RNA, 13 nt, Yersinia pestis
gccagcugcaauu

SEQ ID NO: 2240834 - RNA, 16 nt, Yersinia pestis
gccagauugccaauca

SEQ ID NO: 2240835 - RNA, 19 nt, Yersinia pestis
gccagcagcaaguuagcga

SEQ ID NO: 2240836 - RNA, 23 nt, Yersinia pestis
gccagcagcauaauacgaucagc

SEQ ID NO: 2240837 - RNA, 22 nt, Yersinia pestis
gccacggaaacguucaggcuuu

SEQ ID NO: 2240838 - RNA, 22 nt, Yersinia pestis
gccacgaauggcgacuaauggc

SEQ ID NO: 2240839 - RNA, 19 nt, Yersinia pestis
gccacuguucagaagcuga

SEQ ID NO: 2240840 - RNA, 14 nt, Yersinia pestis
gcccagauauccau

SEQ ID NO: 2240841 - RNA, 18 nt, Yersinia pestis
gccauggccgccagcacg

SEQ ID NO: 2240842 - RNA, 22 nt, Yersinia pestis
gccaguggcaucaauauaacgc

SEQ ID NO: 2240843 - RNA, 14 nt, Yersinia pestis
gccagugaaucagc

SEQ ID NO: 2240844 - RNA, 21 nt, Yersinia pestis
gccagugcaaaaugcucuuca

SEQ ID NO: 2240845 - RNA, 22 nt, Yersinia pestis
gccaguaaacugcgcuuccagc

SEQ ID NO: 2240846 - RNA, 22 nt, Yersinia pestis
gccauacccaaaccaacaauau

SEQ ID NO: 2240847 - RNA, 14 nt, Yersinia pestis
gccauaccaggcca

SEQ ID NO: 2240848 - RNA, 17 nt, Yersinia pestis
gccauaaguaaagcgau

SEQ ID NO: 2240849 - RNA, 14 nt, Yersinia pestis
gccauaacaucguu

SEQ ID NO: 2240850 - RNA, 15 nt, Yersinia pestis
gccauccugccaacg

SEQ ID NO: 2240851 - RNA, 21 nt, Yersinia pestis
gcccgcaauuuuaaaggcaac

SEQ ID NO: 2240852 - RNA, 18 nt, Yersinia pestis
gcccaucaaccaccgcca

SEQ ID NO: 2240853 - RNA, 21 nt, Yersinia pestis
gcccauauccuuaacagcacg

SEQ ID NO: 2240854 - RNA, 14 nt, Yersinia pestis
gcccaucaugccag

SEQ ID NO: 2240855 - RNA, 18 nt, Yersinia pestis
gcccauaaauuuaucgau

SEQ ID NO: 2240856 - RNA, 14 nt, Yersinia pestis
gcccaguuuaccau

SEQ ID NO: 2240857 - RNA, 21 nt, Yersinia pestis
gcccaucuaugggcuucgcca

SEQ ID NO: 2240858 - RNA, 23 nt, Yersinia pestis
gcccaugaccacuugguuggcac

SEQ ID NO: 2240859 - RNA, 14 nt, Yersinia pestis
cuaagauucaaaca

SEQ ID NO: 2240860 - RNA, 17 nt, Yersinia pestis
cuaagauucaaacagua

SEQ ID NO: 2240861 - RNA, 16 nt, Yersinia pestis
cuaaccuuaacugcau

SEQ ID NO: 2240862 - RNA, 23 nt, Yersinia pestis
cuaacgaaucccacacucuggca

SEQ ID NO: 2240863 - RNA, 18 nt, Yersinia pestis
cuaauacggguuucugcu

SEQ ID NO: 2240864 - RNA, 15 nt, Yersinia pestis
cuaauaccaauacca

SEQ ID NO: 2240865 - RNA, 16 nt, Yersinia pestis
cuaauaauaaucuuaa

SEQ ID NO: 2240866 - RNA, 18 nt, Yersinia pestis
cuaauaauuguucauaaa

SEQ ID NO: 2240867 - RNA, 14 nt, Yersinia pestis
cuaagugccaguua

SEQ ID NO: 2240868 - RNA, 13 nt, Yersinia pestis
cuaauugcugccc

SEQ ID NO: 2240869 - RNA, 14 nt, Yersinia pestis
cuacaaucaucggc

SEQ ID NO: 2240870 - RNA, 19 nt, Yersinia pestis
cuacccgacaccggcugau

SEQ ID NO: 2240871 - RNA, 16 nt, Yersinia pestis
cuaucggguaacggcu

SEQ ID NO: 2240872 - RNA, 17 nt, Yersinia pestis
cuaccugucaacgacgg

SEQ ID NO: 2240873 - RNA, 20 nt, Yersinia pestis
cucacccaauaagauaaaca

SEQ ID NO: 2240874 - RNA, 21 nt, Yersinia pestis
cuauugcccaucaugccagca

SEQ ID NO: 2240875 - RNA, 14 nt, Yersinia pestis
cuauuuccgaaagc

SEQ ID NO: 2240876 - RNA, 22 nt, Yersinia pestis
cucaccccacuuuccacguuug

SEQ ID NO: 2240877 - RNA, 18 nt, Yersinia pestis
cucagcuugguaaugcgc

SEQ ID NO: 2240878 - RNA, 17 nt, Yersinia pestis
cucagcacaaacauggc

SEQ ID NO: 2240879 - RNA, 15 nt, Yersinia pestis
cucauacucagucau

SEQ ID NO: 2240880 - RNA, 21 nt, Yersinia pestis
cuaaacccaaccccaucagca

SEQ ID NO: 2240881 - RNA, 15 nt, Yersinia pestis
cuaaaaaugauuuca

SEQ ID NO: 2240882 - RNA, 20 nt, Yersinia pestis
cuaaaaucauugacguuaca

SEQ ID NO: 2240883 - RNA, 17 nt, Yersinia pestis
cuaacauugagcggcga

SEQ ID NO: 2240884 - RNA, 18 nt, Yersinia pestis
cuaaccagugucuggcaa

SEQ ID NO: 2240885 - RNA, 18 nt, Yersinia pestis
cuaacaacugccgccaug

SEQ ID NO: 2240886 - RNA, 23 nt, Yersinia pestis
cuaaaguguacuguuaacucaug

SEQ ID NO: 2240887 - RNA, 23 nt, Yersinia pestis
cguuuuuacaguggcuaagccgc

SEQ ID NO: 2240888 - RNA, 15 nt, Yersinia pestis
cguuuuguugaacag

SEQ ID NO: 2240889 - RNA, 19 nt, Yersinia pestis
cguuuugcagaucaaucgc

SEQ ID NO: 2240890 - RNA, 21 nt, Yersinia pestis
cguuuccgguaaugucacguu

SEQ ID NO: 2240891 - RNA, 15 nt, Yersinia pestis
cguuuccagcggcgu

SEQ ID NO: 2240892 - RNA, 22 nt, Yersinia pestis
cguuucccgauggaacaggauu

SEQ ID NO: 2240893 - RNA, 22 nt, Yersinia pestis
cguuuaaauaagcuaucauuaa

SEQ ID NO: 2240894 - RNA, 20 nt, Yersinia pestis
cguuuaccuauugcgacggu

SEQ ID NO: 2240895 - RNA, 20 nt, Yersinia pestis
cguuggcuucuuccacuggu

SEQ ID NO: 2240896 - RNA, 18 nt, Yersinia pestis
cguucuaguuuggugauc

SEQ ID NO: 2240897 - RNA, 15 nt, Yersinia pestis
cguuccucuugagcg

SEQ ID NO: 2240898 - RNA, 20 nt, Yersinia pestis
cucgacauccaauucaguac

SEQ ID NO: 2240899 - RNA, 21 nt, Yersinia pestis
cucgaauaaacggauuugucu

SEQ ID NO: 2240900 - RNA, 17 nt, Yersinia pestis
cuccguugcaggcacuu

SEQ ID NO: 2240901 - RNA, 22 nt, Yersinia pestis
cuccgucgcgggcacuuuguca

SEQ ID NO: 2240902 - RNA, 15 nt, Yersinia pestis
cucccgcuaacgcac

SEQ ID NO: 2240903 - RNA, 17 nt, Yersinia pestis
cucgacuuuauucaaac

SEQ ID NO: 2240904 - RNA, 15 nt, Yersinia pestis
cugagauuauuggcg

SEQ ID NO: 2240905 - RNA, 22 nt, Yersinia pestis
cugacuuguggaacaacaggcg

SEQ ID NO: 2240906 - RNA, 15 nt, Yersinia pestis
cugauaaccagccaa

SEQ ID NO: 2240907 - RNA, 14 nt, Yersinia pestis
cugaguaugagcgc

SEQ ID NO: 2240908 - RNA, 20 nt, Yersinia pestis
cugagguuauugacaaagug

SEQ ID NO: 2240909 - RNA, 17 nt, Yersinia pestis
cugauagcaaucccaaa

SEQ ID NO: 2240910 - RNA, 20 nt, Yersinia pestis
cugauuucaggaauggugua

SEQ ID NO: 2240911 - RNA, 23 nt, Yersinia pestis
cugauuuuuucgaguaguuuggc

SEQ ID NO: 2240912 - RNA, 19 nt, Yersinia pestis
cugauucgcgaccagcaga

SEQ ID NO: 2240913 - RNA, 14 nt, Yersinia pestis
cugauuguaacaau

SEQ ID NO: 2240914 - RNA, 23 nt, Yersinia pestis
cugauguauucccucaauagcua

SEQ ID NO: 2240915 - RNA, 20 nt, Yersinia pestis
cugcaaugcccagagcgcgg

SEQ ID NO: 2240916 - RNA, 20 nt, Yersinia pestis
cugcaccuaacaaacguuca

SEQ ID NO: 2240917 - RNA, 22 nt, Yersinia pestis
cugcaccuaacaaacguucauu

SEQ ID NO: 2240918 - RNA, 15 nt, Yersinia pestis
cucucugcugcgaau

SEQ ID NO: 2240919 - RNA, 19 nt, Yersinia pestis
cucuggcgcggacguuuua

SEQ ID NO: 2240920 - RNA, 17 nt, Yersinia pestis
cucucgaaaauguguga

SEQ ID NO: 2240921 - RNA, 13 nt, Yersinia pestis
cugaaacuuuuca

SEQ ID NO: 2240922 - RNA, 15 nt, Yersinia pestis
cugaacaaugccaua

SEQ ID NO: 2240923 - RNA, 22 nt, Yersinia pestis
cucuucuuuacugcccucgcaa

SEQ ID NO: 2240924 - RNA, 20 nt, Yersinia pestis
cucuucaauaccaacgguag

SEQ ID NO: 2240925 - RNA, 15 nt, Yersinia pestis
cucuuaguuucuacg

SEQ ID NO: 2240926 - RNA, 16 nt, Yersinia pestis
cucuguggauugccaa

SEQ ID NO: 2240927 - RNA, 17 nt, Yersinia pestis
cucggucugauuggcac

SEQ ID NO: 2240928 - RNA, 15 nt, Yersinia pestis
cgguuuuaucaauag

SEQ ID NO: 2240929 - RNA, 19 nt, Yersinia pestis
cguaaugacugucugcggc

SEQ ID NO: 2240930 - RNA, 17 nt, Yersinia pestis
cguaauuauuguucaaa

SEQ ID NO: 2240931 - RNA, 18 nt, Yersinia pestis
cguaauucguagcuaucu

SEQ ID NO: 2240932 - RNA, 15 nt, Yersinia pestis
cguaauuuacuggua

SEQ ID NO: 2240933 - RNA, 19 nt, Yersinia pestis
cgguuugagcuugcugcug

SEQ ID NO: 2240934 - RNA, 24 nt, Yersinia pestis
cgguucuguaucauauguucgauc

SEQ ID NO: 2240935 - RNA, 13 nt, Yersinia pestis
cgguuaucacauc

SEQ ID NO: 2240936 - RNA, 20 nt, Yersinia pestis
cgguucccacggauuaacuu

SEQ ID NO: 2240937 - RNA, 18 nt, Yersinia pestis
cgucaagacaacaaacag

SEQ ID NO: 2240938 - RNA, 14 nt, Yersinia pestis
cgucacuaaaucca

SEQ ID NO: 2240939 - RNA, 16 nt, Yersinia pestis
cgucacuuugacguua

SEQ ID NO: 2240940 - RNA, 19 nt, Yersinia pestis
cgucacggcgcuccaucag

SEQ ID NO: 2240941 - RNA, 13 nt, Yersinia pestis
cgucacgauagca

SEQ ID NO: 2240942 - RNA, 22 nt, Yersinia pestis
cguagcccuuugcuuucaggau

SEQ ID NO: 2240943 - RNA, 15 nt, Yersinia pestis
cguagauuuucucag

SEQ ID NO: 2240944 - RNA, 19 nt, Yersinia pestis
cggugacucgggucaguga

SEQ ID NO: 2240945 - RNA, 18 nt, Yersinia pestis
cgucaucaggauaccuga

SEQ ID NO: 2240946 - RNA, 12 nt, Yersinia pestis
cgucaguugccc

SEQ ID NO: 2240947 - RNA, 18 nt, Yersinia pestis
cguccgcuuagcaggccc

SEQ ID NO: 2240948 - RNA, 13 nt, Yersinia pestis
cgucgcuguuacu

SEQ ID NO: 2240949 - RNA, 15 nt, Yersinia pestis
cgucuuuacgaucug

SEQ ID NO: 2240950 - RNA, 17 nt, Yersinia pestis
cgugaacaucuggcgau

SEQ ID NO: 2240951 - RNA, 20 nt, Yersinia pestis
cgugaacauugcaguauuuu

SEQ ID NO: 2240952 - RNA, 13 nt, Yersinia pestis
cgugaucgccgua

SEQ ID NO: 2240953 - RNA, 14 nt, Yersinia pestis
cgucugccauugcu

SEQ ID NO: 2240954 - RNA, 13 nt, Yersinia pestis
cgucugauaaccg

SEQ ID NO: 2240955 - RNA, 17 nt, Yersinia pestis
cuuauccguuaacccaa

SEQ ID NO: 2240956 - RNA, 22 nt, Yersinia pestis
cuuauuacucauuauggauaau

SEQ ID NO: 2240957 - RNA, 17 nt, Yersinia pestis
cuuaucuuccagauagc

SEQ ID NO: 2240958 - RNA, 21 nt, Yersinia pestis
cuuaucuuccagauagcgaau

SEQ ID NO: 2240959 - RNA, 17 nt, Yersinia pestis
cuguuguugugacaggc

SEQ ID NO: 2240960 - RNA, 20 nt, Yersinia pestis
cuguuggcuauuacugucaa

SEQ ID NO: 2240961 - RNA, 13 nt, Yersinia pestis
cuuaacugaaagc

SEQ ID NO: 2240962 - RNA, 16 nt, Yersinia pestis
cugugaaauaccgauu

SEQ ID NO: 2240963 - RNA, 20 nt, Yersinia pestis
cugucuccuaucugagguua

SEQ ID NO: 2240964 - RNA, 21 nt, Yersinia pestis
cuguguaacugccaccguauu

SEQ ID NO: 2240965 - RNA, 20 nt, Yersinia pestis
cuguguuuugagcaucacuu

SEQ ID NO: 2240966 - RNA, 21 nt, Yersinia pestis
cuucucgaugccuucuuucaa

SEQ ID NO: 2240967 - RNA, 15 nt, Yersinia pestis
cuucauuuucaucac

SEQ ID NO: 2240968 - RNA, 19 nt, Yersinia pestis
cuucauguuuaucaaacag

SEQ ID NO: 2240969 - RNA, 20 nt, Yersinia pestis
cuuccccuuuagugcgguua

SEQ ID NO: 2240970 - RNA, 17 nt, Yersinia pestis
cuuuggcaaagucauca

SEQ ID NO: 2240971 - RNA, 16 nt, Yersinia pestis
cuuucuuaauaauauc

SEQ ID NO: 2240972 - RNA, 21 nt, Yersinia pestis
cuuucuggcgagucaucaggc

SEQ ID NO: 2240973 - RNA, 21 nt, Yersinia pestis
cuuucgcgaauagagacggaa

SEQ ID NO: 2240974 - RNA, 23 nt, Yersinia pestis
cuuucauaucaaaaggauaaccu

SEQ ID NO: 2240975 - RNA, 20 nt, Yersinia pestis
cuuuccacgcccaacucuuu

SEQ ID NO: 2240976 - RNA, 14 nt, Yersinia pestis
gaaaagcgccauca

SEQ ID NO: 2240977 - RNA, 22 nt, Yersinia pestis
gaaaaaccuccggcuaugccgg

SEQ ID NO: 2240978 - RNA, 21 nt, Yersinia pestis
cuugauuuuagccucuguagc

SEQ ID NO: 2240979 - RNA, 20 nt, Yersinia pestis
cuugcaacagcgcucauagc

SEQ ID NO: 2240980 - RNA, 17 nt, Yersinia pestis
cugcuuaaaccauacuc

SEQ ID NO: 2240981 - RNA, 17 nt, Yersinia pestis
cugcugggcgauccaaa

SEQ ID NO: 2240982 - RNA, 19 nt, Yersinia pestis
cugcuugcgcgccuguuua

SEQ ID NO: 2240983 - RNA, 22 nt, Yersinia pestis
cuggaagccgacgaucuugccc

SEQ ID NO: 2240984 - RNA, 21 nt, Yersinia pestis
cuggcgcugaucaucaucaau

SEQ ID NO: 2240985 - RNA, 18 nt, Yersinia pestis
cuggcugauucacuggca

SEQ ID NO: 2240986 - RNA, 15 nt, Yersinia pestis
cugguccagaucggc

SEQ ID NO: 2240987 - RNA, 21 nt, Yersinia pestis
cugggggcuagccgcgccauc

SEQ ID NO: 2240988 - RNA, 17 nt, Yersinia pestis
cugcuaguauuaucgcu

SEQ ID NO: 2240989 - RNA, 15 nt, Yersinia pestis
cugcugaucgccaau

SEQ ID NO: 2240990 - RNA, 12 nt, Yersinia pestis
cugcgauaaucu

SEQ ID NO: 2240991 - RNA, 20 nt, Yersinia pestis
gacaaaccccgaugacgcga

SEQ ID NO: 2240992 - RNA, 18 nt, Yersinia pestis
gacaaccacccgacauca

SEQ ID NO: 2240993 - RNA, 15 nt, Yersinia pestis
gacagaauauccagc

SEQ ID NO: 2240994 - RNA, 14 nt, Yersinia pestis
gacauacuuugccu

SEQ ID NO: 2240995 - RNA, 18 nt, Yersinia pestis
gacaggcaauuauccauc

SEQ ID NO: 2240996 - RNA, 22 nt, Yersinia pestis
gacauucucuacucgcucacca

SEQ ID NO: 2240997 - RNA, 17 nt, Yersinia pestis
gacaugagacagcgcgg

SEQ ID NO: 2240998 - RNA, 17 nt, Yersinia pestis
gaccaaauagcaagcca

SEQ ID NO: 2240999 - RNA, 21 nt, Yersinia pestis
gaauugccccccaauauugga

SEQ ID NO: 2241000 - RNA, 16 nt, Yersinia pestis
gaauagcgcugcauca

SEQ ID NO: 2241001 - RNA, 19 nt, Yersinia pestis
gaauagcgcugcaucagca

SEQ ID NO: 2241002 - RNA, 15 nt, Yersinia pestis
gaauaugcuucauca

SEQ ID NO: 2241003 - RNA, 16 nt, Yersinia pestis
gaagucauugggguaa

SEQ ID NO: 2241004 - RNA, 18 nt, Yersinia pestis
gaaguacaguaccugcua

SEQ ID NO: 2241005 - RNA, 13 nt, Yersinia pestis
gaaacgcaauuuu

SEQ ID NO: 2241006 - RNA, 22 nt, Yersinia pestis
gaacgaggcccgauaaacugac

SEQ ID NO: 2241007 - RNA, 16 nt, Yersinia pestis
gaagaccagauaaucg

SEQ ID NO: 2241008 - RNA, 17 nt, Yersinia pestis
gaagacagauccugccg

SEQ ID NO: 2241009 - RNA, 13 nt, Yersinia pestis
gaagagcgccuca

SEQ ID NO: 2241010 - RNA, 21 nt, Yersinia pestis
gaacuuuaacuuccaauuucu

SEQ ID NO: 2241011 - RNA, 18 nt, Yersinia pestis
gaagcacguaaaucgguu

SEQ ID NO: 2241012 - RNA, 21 nt, Yersinia pestis
gaccugcaacucuugcgcgaa

SEQ ID NO: 2241013 - RNA, 14 nt, Yersinia pestis
gacccaauugcagg

SEQ ID NO: 2241014 - RNA, 18 nt, Yersinia pestis
gacgaucuuucucaacgg

SEQ ID NO: 2241015 - RNA, 12 nt, Yersinia pestis
gacgauaaucag

SEQ ID NO: 2241016 - RNA, 13 nt, Yersinia pestis
gacgauaacgcgg

SEQ ID NO: 2241017 - RNA, 23 nt, Yersinia pestis
ccucuucuucuugguguugcagu

SEQ ID NO: 2241018 - RNA, 14 nt, Yersinia pestis
ccucuuucuuaaua

SEQ ID NO: 2241019 - RNA, 17 nt, Yersinia pestis
ccugauaucaaccuggc

SEQ ID NO: 2241020 - RNA, 15 nt, Yersinia pestis
ccugauacaccauuu

SEQ ID NO: 2241021 - RNA, 13 nt, Yersinia pestis
ccugccaaaaaau

SEQ ID NO: 2241022 - RNA, 12 nt, Yersinia pestis
ccuagauaccgc

SEQ ID NO: 2241023 - RNA, 14 nt, Yersinia pestis
ccucagugcgguua

SEQ ID NO: 2241024 - RNA, 13 nt, Yersinia pestis
ccucaguuaucag

SEQ ID NO: 2241025 - RNA, 13 nt, Yersinia pestis
ccucauucaugag

SEQ ID NO: 2241026 - RNA, 23 nt, Yersinia pestis
ccucaugaaugaggcugagguua

SEQ ID NO: 2241027 - RNA, 18 nt, Yersinia pestis
ccucaugauuuguugaug

SEQ ID NO: 2241028 - RNA, 22 nt, Yersinia pestis
ccucauucgggcauuccgguuc

SEQ ID NO: 2241029 - RNA, 19 nt, Yersinia pestis
ccucgcaauggugauaaac

SEQ ID NO: 2241030 - RNA, 20 nt, Yersinia pestis
ccguaauauuucaagcugua

SEQ ID NO: 2241031 - RNA, 20 nt, Yersinia pestis
ccguaaacugccguaaacaa

SEQ ID NO: 2241032 - RNA, 16 nt, Yersinia pestis
ccguaaauacauccau

SEQ ID NO: 2241033 - RNA, 15 nt, Yersinia pestis
ccgguuguucaaucg

SEQ ID NO: 2241034 - RNA, 13 nt, Yersinia pestis
ccguaugcgcaua

SEQ ID NO: 2241035 - RNA, 12 nt, Yersinia pestis
ccguacauuaaa

SEQ ID NO: 2241036 - RNA, 17 nt, Yersinia pestis
ccgguugauaucggcaa

SEQ ID NO: 2241037 - RNA, 14 nt, Yersinia pestis
ccgguguaccgacc

SEQ ID NO: 2241038 - RNA, 19 nt, Yersinia pestis
ccguuacggcggccaucau

SEQ ID NO: 2241039 - RNA, 21 nt, Yersinia pestis
ccguuacaagacaagcccgau

SEQ ID NO: 2241040 - RNA, 23 nt, Yersinia pestis
ccggcuaggcucagcauggaaga

SEQ ID NO: 2241041 - RNA, 21 nt, Yersinia pestis
ccgggggcguauuaucggauc

SEQ ID NO: 2241042 - RNA, 13 nt, Yersinia pestis
ccgccucaaugca

SEQ ID NO: 2241043 - RNA, 19 nt, Yersinia pestis
ccgcgaauaacagacguua

SEQ ID NO: 2241044 - RNA, 15 nt, Yersinia pestis
ccgcuagugagugaa

SEQ ID NO: 2241045 - RNA, 23 nt, Yersinia pestis
ccgcuggcgcgcauaguauccau

SEQ ID NO: 2241046 - RNA, 13 nt, Yersinia pestis
ccgagaagcuuca

SEQ ID NO: 2241047 - RNA, 11 nt, Yersinia pestis
ccgagaucacc

SEQ ID NO: 2241048 - RNA, 23 nt, Yersinia pestis
ccgauucagcucugccagcguca

SEQ ID NO: 2241049 - RNA, 23 nt, Yersinia pestis
ccgcaaccuguuguggaauuacc

SEQ ID NO: 2241050 - RNA, 16 nt, Yersinia pestis
ccgauucggauaaccg

SEQ ID NO: 2241051 - RNA, 18 nt, Yersinia pestis
cgacucaauaauauggga

SEQ ID NO: 2241052 - RNA, 11 nt, Yersinia pestis
cgacucaauug

SEQ ID NO: 2241053 - RNA, 21 nt, Yersinia pestis
cgacuuguucacggcuuugcu

SEQ ID NO: 2241054 - RNA, 15 nt, Yersinia pestis
cgacgggaacgacgu

SEQ ID NO: 2241055 - RNA, 15 nt, Yersinia pestis
cgacgugccaacugg

SEQ ID NO: 2241056 - RNA, 16 nt, Yersinia pestis
cgagauagucagcgac

SEQ ID NO: 2241057 - RNA, 15 nt, Yersinia pestis
cgagccgcgguuaag

SEQ ID NO: 2241058 - RNA, 17 nt, Yersinia pestis
cgaaaucacccggccau

SEQ ID NO: 2241059 - RNA, 14 nt, Yersinia pestis
cgaaauagcgccug

SEQ ID NO: 2241060 - RNA, 22 nt, Yersinia pestis
cgaaaaauuucacuggcaccgc

SEQ ID NO: 2241061 - RNA, 15 nt, Yersinia pestis
ccuguauuuccugua

SEQ ID NO: 2241062 - RNA, 18 nt, Yersinia pestis
ccuucagaugaauccagc

SEQ ID NO: 2241063 - RNA, 21 nt, Yersinia pestis
ccuucgcaccacaaugauuuc

SEQ ID NO: 2241064 - RNA, 20 nt, Yersinia pestis
ccuugagguuauugacaaag

SEQ ID NO: 2241065 - RNA, 13 nt, Yersinia pestis
ccuugaauagcca

SEQ ID NO: 2241066 - RNA, 22 nt, Yersinia pestis
ccuugaauagccagaagccagg

SEQ ID NO: 2241067 - RNA, 16 nt, Yersinia pestis
ccuguaccgccuguuc

SEQ ID NO: 2241068 - RNA, 15 nt, Yersinia pestis
ccuguacuggcucuc

SEQ ID NO: 2241069 - RNA, 17 nt, Yersinia pestis
cgaaucaagcuacgcaa

SEQ ID NO: 2241070 - RNA, 21 nt, Yersinia pestis
cgaaugugcaguaaccaguua

SEQ ID NO: 2241071 - RNA, 22 nt, Yersinia pestis
cgaauguuauggguaccguuua

SEQ ID NO: 2241072 - RNA, 17 nt, Yersinia pestis
cgacaccacgaucaggu

SEQ ID NO: 2241073 - RNA, 15 nt, Yersinia pestis
cgagugccaacucag

SEQ ID NO: 2241074 - RNA, 22 nt, Yersinia pestis
cgagugaacguagccucaauuu

SEQ ID NO: 2241075 - RNA, 16 nt, Yersinia pestis
cgaguaggucucgccg

SEQ ID NO: 2241076 - RNA, 19 nt, Yersinia pestis
cgaguaacuccaucaggcu

SEQ ID NO: 2241077 - RNA, 16 nt, Yersinia pestis
cgauauuuaucagccg

SEQ ID NO: 2241078 - RNA, 14 nt, Yersinia pestis
cgauacugccauca

SEQ ID NO: 2241079 - RNA, 12 nt, Yersinia pestis
cgauaccaauaa

SEQ ID NO: 2241080 - RNA, 14 nt, Yersinia pestis
cgauacaggcucug

SEQ ID NO: 2241081 - RNA, 21 nt, Yersinia pestis
cgaucauucuagccuugagcg

SEQ ID NO: 2241082 - RNA, 21 nt, Yersinia pestis
cgauuagccauaagauaacgg

SEQ ID NO: 2241083 - RNA, 16 nt, Yersinia pestis
cgauguuuacggcauu

SEQ ID NO: 2241084 - RNA, 19 nt, Yersinia pestis
cgauugaaucaaggcuuua

SEQ ID NO: 2241085 - RNA, 18 nt, Yersinia pestis
cgauguguuucgacgguu

SEQ ID NO: 2241086 - RNA, 15 nt, Yersinia pestis
cgaucuguugauaaa

SEQ ID NO: 2241087 - RNA, 17 nt, Yersinia pestis
cgaucugaaacggugag

SEQ ID NO: 2241088 - RNA, 20 nt, Yersinia pestis
cgaucugccuuaucuaaccg

SEQ ID NO: 2241089 - RNA, 21 nt, Yersinia pestis
cgaugcaaggaaguccaguaa

SEQ ID NO: 2241090 - RNA, 21 nt, Yersinia pestis
cgcagguaucucacucaggcg

SEQ ID NO: 2241091 - RNA, 18 nt, Yersinia pestis
cgcaggccaugucgauca

SEQ ID NO: 2241092 - RNA, 23 nt, Yersinia pestis
cgcacggccgggugcagcgccac

SEQ ID NO: 2241093 - RNA, 14 nt, Yersinia pestis
cgcacuacccgaau

SEQ ID NO: 2241094 - RNA, 20 nt, Yersinia pestis
cgcacugguugcuucaucaa

SEQ ID NO: 2241095 - RNA, 15 nt, Yersinia pestis
cgcacuuacccgaau

SEQ ID NO: 2241096 - RNA, 18 nt, Yersinia pestis
cgcacugggaucugauca

SEQ ID NO: 2241097 - RNA, 18 nt, Yersinia pestis
cgcaccggcuaaccacag

SEQ ID NO: 2241098 - RNA, 17 nt, Yersinia pestis
cgcauguaaauuaauac

SEQ ID NO: 2241099 - RNA, 14 nt, Yersinia pestis
cgcauugauaaucu

SEQ ID NO: 2241100 - RNA, 16 nt, Yersinia pestis
cgccaauucaugcauc

SEQ ID NO: 2241101 - RNA, 18 nt, Yersinia pestis
cgccgcugaccuugcugg

SEQ ID NO: 2241102 - RNA, 16 nt, Yersinia pestis
cgccuccgauucauag

SEQ ID NO: 2241103 - RNA, 20 nt, Yersinia pestis
cgccuguauuuuaaugccga

SEQ ID NO: 2241104 - RNA, 14 nt, Yersinia pestis
cgccuuaaaugcgu

SEQ ID NO: 2241105 - RNA, 19 nt, Yersinia pestis
cgcucauaccaugccauca

SEQ ID NO: 2241106 - RNA, 16 nt, Yersinia pestis
cgcuccaucagguuua

SEQ ID NO: 2241107 - RNA, 11 nt, Yersinia pestis
cgcugagguuc

SEQ ID NO: 2241108 - RNA, 12 nt, Yersinia pestis
cgcucuggguua

SEQ ID NO: 2241109 - RNA, 16 nt, Yersinia pestis
cgcugaucaucaucaa

SEQ ID NO: 2241110 - RNA, 23 nt, Yersinia pestis
cgcguuauugcgacauaaagcaa

SEQ ID NO: 2241111 - RNA, 11 nt, Yersinia pestis
cgcguucacuu

SEQ ID NO: 2241112 - RNA, 17 nt, Yersinia pestis
cgcguugauccauccau

SEQ ID NO: 2241113 - RNA, 21 nt, Yersinia pestis
cgcgguuggcccuuuucaaac

SEQ ID NO: 2241114 - RNA, 21 nt, Yersinia pestis
cgcguaauaaacacuuggcau

SEQ ID NO: 2241115 - RNA, 13 nt, Yersinia pestis
cgcgcccugcgca

SEQ ID NO: 2241116 - RNA, 16 nt, Yersinia pestis
cgcgccauucgcauaa

SEQ ID NO: 2241117 - RNA, 18 nt, Yersinia pestis
cgggugaaaccacugcgg

SEQ ID NO: 2241118 - RNA, 20 nt, Yersinia pestis
cgguauugcucucgauuucu

SEQ ID NO: 2241119 - RNA, 15 nt, Yersinia pestis
cgguaucaaucagcg

SEQ ID NO: 2241120 - RNA, 13 nt, Yersinia pestis
cgguaucaaucag

SEQ ID NO: 2241121 - RNA, 23 nt, Yersinia pestis
cgguauguguguacuuaucgauu

SEQ ID NO: 2241122 - RNA, 18 nt, Yersinia pestis
cgguaucggccaauucag

SEQ ID NO: 2241123 - RNA, 20 nt, Yersinia pestis
cggguaacugugcaggaaau

SEQ ID NO: 2241124 - RNA, 21 nt, Yersinia pestis
cggguaaugcuguuguagcgc

SEQ ID NO: 2241125 - RNA, 15 nt, Yersinia pestis
cgggcucaugcagca

SEQ ID NO: 2241126 - RNA, 22 nt, Yersinia pestis
cgggcagacguuggccuuucac

SEQ ID NO: 2241127 - RNA, 15 nt, Yersinia pestis
cggcgcugauaguua

SEQ ID NO: 2241128 - RNA, 14 nt, Yersinia pestis
cggcggcggaucaa

SEQ ID NO: 2241129 - RNA, 22 nt, Yersinia pestis
cggcguuaauauaacaauguuu

SEQ ID NO: 2241130 - RNA, 16 nt, Yersinia pestis
cggcuaugccggagga

SEQ ID NO: 2241131 - RNA, 16 nt, Yersinia pestis
cggcuaaccacagcaa

SEQ ID NO: 2241132 - RNA, 14 nt, Yersinia pestis
cggcaucagcaaag

SEQ ID NO: 2241133 - RNA, 14 nt, Yersinia pestis
cggcauagcaaaau

SEQ ID NO: 2241134 - RNA, 13 nt, Yersinia pestis
cggcaaugaccau

SEQ ID NO: 2241135 - RNA, 19 nt, Yersinia pestis
cgcuguaaucuuggcacuc

SEQ ID NO: 2241136 - RNA, 22 nt, Yersinia pestis
cggaucacuggcuagauagcca

SEQ ID NO: 2241137 - RNA, 16 nt, Yersinia pestis
cggagaauguuaaacc

SEQ ID NO: 2241138 - RNA, 20 nt, Yersinia pestis
cggccauuuuuuaccauuac

SEQ ID NO: 2241139 - RNA, 20 nt, Yersinia pestis
cggcccuuggcuuugcgcaa

SEQ ID NO: 2241140 - RNA, 15 nt, Yersinia pestis
cggcgacuuacgucg

SEQ ID NO: 2241141 - RNA, 19 nt, Yersinia pestis
cucaucgggauuaaugagc

SEQ ID NO: 2241142 - RNA, 20 nt, Yersinia pestis
cucauccguuuuaacgcugc

SEQ ID NO: 2241143 - RNA, 12 nt, Yersinia pestis
cucaugacaaaa

SEQ ID NO: 2241144 - RNA, 18 nt, Yersinia pestis
cuagucuguuaugcccaa

SEQ ID NO: 2241145 - RNA, 18 nt, Yersinia pestis
cucaguucgguugccaaa

SEQ ID NO: 2241146 - RNA, 17 nt, Yersinia pestis
cucagucaucgcuaacc

SEQ ID NO: 2241147 - RNA, 13 nt, Yersinia pestis
cucauaauuuuga

SEQ ID NO: 2241148 - RNA, 18 nt, Yersinia pestis
cucgaacgcuuguggaaa

SEQ ID NO: 2241149 - RNA, 15 nt, Yersinia pestis
cucugagccauccag

SEQ ID NO: 2241150 - RNA, 13 nt, Yersinia pestis
cucuuccuguuca

SEQ ID NO: 2241151 - RNA, 15 nt, Yersinia pestis
cucguuaucagccac

SEQ ID NO: 2241152 - RNA, 22 nt, Yersinia pestis
cuaaucgguaugaccagugaau

SEQ ID NO: 2241153 - RNA, 15 nt, Yersinia pestis
cuaauacggcuugca

SEQ ID NO: 2241154 - RNA, 16 nt, Yersinia pestis
cuaauuccucaucgaa

SEQ ID NO: 2241155 - RNA, 23 nt, Yersinia pestis
cuaaugccgcgcccccagccauu

SEQ ID NO: 2241156 - RNA, 18 nt, Yersinia pestis
cuaaugcgcucuguauug

SEQ ID NO: 2241157 - RNA, 21 nt, Yersinia pestis
cuaaguuaacaccaucaacau

SEQ ID NO: 2241158 - RNA, 13 nt, Yersinia pestis
cuaccaggaagcg

SEQ ID NO: 2241159 - RNA, 13 nt, Yersinia pestis
cuacaauaucuuc

SEQ ID NO: 2241160 - RNA, 13 nt, Yersinia pestis
cuaauuucucccg

SEQ ID NO: 2241161 - RNA, 15 nt, Yersinia pestis
cuacugcaucagcga

SEQ ID NO: 2241162 - RNA, 13 nt, Yersinia pestis
cuacggauugcaa

SEQ ID NO: 2241163 - RNA, 13 nt, Yersinia pestis
cuaaaaugacgau

SEQ ID NO: 2241164 - RNA, 23 nt, Yersinia pestis
cuaaaauaucaaauuugcaguau

SEQ ID NO: 2241165 - RNA, 20 nt, Yersinia pestis
cuaaauaauaucugucugac

SEQ ID NO: 2241166 - RNA, 19 nt, Yersinia pestis
cuaacgguggcauugacca

SEQ ID NO: 2241167 - RNA, 20 nt, Yersinia pestis
cuaacgucccauuccguuua

SEQ ID NO: 2241168 - RNA, 22 nt, Yersinia pestis
cuaaccgaagauaaccggcugg

SEQ ID NO: 2241169 - RNA, 20 nt, Yersinia pestis
cuaaauuaaaugcagcggcc

SEQ ID NO: 2241170 - RNA, 12 nt, Yersinia pestis
cuaaaacuggca

SEQ ID NO: 2241171 - RNA, 18 nt, Yersinia pestis
cguuuuuuuuaucagccc

SEQ ID NO: 2241172 - RNA, 15 nt, Yersinia pestis
cguuuuucagcuucu

SEQ ID NO: 2241173 - RNA, 18 nt, Yersinia pestis
cguuuuaucgcauuacuc

SEQ ID NO: 2241174 - RNA, 21 nt, Yersinia pestis
cguuuucggugcauguaacug

SEQ ID NO: 2241175 - RNA, 12 nt, Yersinia pestis
cguuugaucaaa

SEQ ID NO: 2241176 - RNA, 14 nt, Yersinia pestis
cguuuaaugccccu

SEQ ID NO: 2241177 - RNA, 17 nt, Yersinia pestis
cguuuacgauaagccgc

SEQ ID NO: 2241178 - RNA, 16 nt, Yersinia pestis
cguuuccagaaucaau

SEQ ID NO: 2241179 - RNA, 17 nt, Yersinia pestis
cguuguucacccacuug

SEQ ID NO: 2241180 - RNA, 15 nt, Yersinia pestis
cguugggguggcaga

SEQ ID NO: 2241181 - RNA, 19 nt, Yersinia pestis
cguuggucagcaaaucuug

SEQ ID NO: 2241182 - RNA, 23 nt, Yersinia pestis
cguuguauuuuccugaucaacug

SEQ ID NO: 2241183 - RNA, 14 nt, Yersinia pestis
cguugucagccaug

SEQ ID NO: 2241184 - RNA, 23 nt, Yersinia pestis
cguucuccgucgucacuuugacg

SEQ ID NO: 2241185 - RNA, 23 nt, Yersinia pestis
cguucguuuacugccuuguugcc

SEQ ID NO: 2241186 - RNA, 18 nt, Yersinia pestis
cguugccccaucagcacu

SEQ ID NO: 2241187 - RNA, 14 nt, Yersinia pestis
cguucaucaauacc

SEQ ID NO: 2241188 - RNA, 13 nt, Yersinia pestis
cguuacugcaucu

SEQ ID NO: 2241189 - RNA, 21 nt, Yersinia pestis
cguuaccugcaauaauguuga

SEQ ID NO: 2241190 - RNA, 21 nt, Yersinia pestis
cgugucagacugcugacaaac

SEQ ID NO: 2241191 - RNA, 16 nt, Yersinia pestis
cguggcauugagguuu

SEQ ID NO: 2241192 - RNA, 21 nt, Yersinia pestis
cguggaguagagcuuccagug

SEQ ID NO: 2241193 - RNA, 19 nt, Yersinia pestis
cguauguccucaccauuua

SEQ ID NO: 2241194 - RNA, 19 nt, Yersinia pestis
cgucauaccauucucuguc

SEQ ID NO: 2241195 - RNA, 16 nt, Yersinia pestis
cgucuaauugcugccc

SEQ ID NO: 2241196 - RNA, 16 nt, Yersinia pestis
cgguucccaugacgau

SEQ ID NO: 2241197 - RNA, 18 nt, Yersinia pestis
cgguguuuuuuuguuacu

SEQ ID NO: 2241198 - RNA, 19 nt, Yersinia pestis
cguaaauaaaagcgccggu

SEQ ID NO: 2241199 - RNA, 13 nt, Yersinia pestis
cguaaacauuggc

SEQ ID NO: 2241200 - RNA, 19 nt, Yersinia pestis
cgguugucggcauaacagg

SEQ ID NO: 2241201 - RNA, 18 nt, Yersinia pestis
cgguuguccuucaauggc

SEQ ID NO: 2241202 - RNA, 16 nt, Yersinia pestis
cgguuguauacaauug

SEQ ID NO: 2241203 - RNA, 20 nt, Yersinia pestis
cgguuggccguuaugccaac

SEQ ID NO: 2241204 - RNA, 19 nt, Yersinia pestis
cggugugacuuucaaucgc

SEQ ID NO: 2241205 - RNA, 21 nt, Yersinia pestis
cgguguuccacaauguugaua

SEQ ID NO: 2241206 - RNA, 23 nt, Yersinia pestis
cgguggauuacauaacaccaauu

SEQ ID NO: 2241207 - RNA, 16 nt, Yersinia pestis
cggugauuaucggugg

SEQ ID NO: 2241208 - RNA, 17 nt, Yersinia pestis
cggugacgcgaucgucg

SEQ ID NO: 2241209 - RNA, 17 nt, Yersinia pestis
cugcuaacaacagucaa

SEQ ID NO: 2241210 - RNA, 16 nt, Yersinia pestis
cugcgucuuuaucgcc

SEQ ID NO: 2241211 - RNA, 11 nt, Yersinia pestis
cugcugacaac

SEQ ID NO: 2241212 - RNA, 14 nt, Yersinia pestis
cugcugcaacucau

SEQ ID NO: 2241213 - RNA, 19 nt, Yersinia pestis
cugcugauguuucuuugcg

SEQ ID NO: 2241214 - RNA, 21 nt, Yersinia pestis
cugcuuacucuuccaacucau

SEQ ID NO: 2241215 - RNA, 11 nt, Yersinia pestis
cugcuuaaucc

SEQ ID NO: 2241216 - RNA, 15 nt, Yersinia pestis
cugcuggcaggguau

SEQ ID NO: 2241217 - RNA, 18 nt, Yersinia pestis
cugcuucuacccuggcgg

SEQ ID NO: 2241218 - RNA, 15 nt, Yersinia pestis
cugcuugauuugcug

SEQ ID NO: 2241219 - RNA, 12 nt, Yersinia pestis
cugcuuuaucgu

SEQ ID NO: 2241220 - RNA, 20 nt, Yersinia pestis
cugcuuuaaaggcuucgcug

SEQ ID NO: 2241221 - RNA, 13 nt, Yersinia pestis
cuggacgcaucag

SEQ ID NO: 2241222 - RNA, 17 nt, Yersinia pestis
cuggacgcaucagaucg

SEQ ID NO: 2241223 - RNA, 15 nt, Yersinia pestis
cuggcacuggcaaua

SEQ ID NO: 2241224 - RNA, 14 nt, Yersinia pestis
cugaaaugacauug

SEQ ID NO: 2241225 - RNA, 12 nt, Yersinia pestis
cugaaauccaaa

SEQ ID NO: 2241226 - RNA, 19 nt, Yersinia pestis
cugaaauaaacaagccauu

SEQ ID NO: 2241227 - RNA, 17 nt, Yersinia pestis
cugccgcaaacgcucag

SEQ ID NO: 2241228 - RNA, 14 nt, Yersinia pestis
cugccuauccucac

SEQ ID NO: 2241229 - RNA, 15 nt, Yersinia pestis
cugccugcaccagug

SEQ ID NO: 2241230 - RNA, 19 nt, Yersinia pestis
cugccugcaccagugccaa

SEQ ID NO: 2241231 - RNA, 17 nt, Yersinia pestis
cugcgccacgcuuuagc

SEQ ID NO: 2241232 - RNA, 20 nt, Yersinia pestis
cuugcacuuuuacugguuca

SEQ ID NO: 2241233 - RNA, 17 nt, Yersinia pestis
cuugagcuagauggaaa

SEQ ID NO: 2241234 - RNA, 16 nt, Yersinia pestis
cuugccugacagccug

SEQ ID NO: 2241235 - RNA, 20 nt, Yersinia pestis
cuucugcaaaaucguuaccg

SEQ ID NO: 2241236 - RNA, 11 nt, Yersinia pestis
cuucucaauuu

SEQ ID NO: 2241237 - RNA, 18 nt, Yersinia pestis
cuucuccuuucuguucca

SEQ ID NO: 2241238 - RNA, 20 nt, Yersinia pestis
cuucuucauuuucaucacug

SEQ ID NO: 2241239 - RNA, 15 nt, Yersinia pestis
cuucagacugaaagu

SEQ ID NO: 2241240 - RNA, 20 nt, Yersinia pestis
cuucccauagacggcgaacu

SEQ ID NO: 2241241 - RNA, 14 nt, Yersinia pestis
cuuccaugacacau

SEQ ID NO: 2241242 - RNA, 14 nt, Yersinia pestis
cuuccaucaggaag

SEQ ID NO: 2241243 - RNA, 13 nt, Yersinia pestis
cuucgcgaucaug

SEQ ID NO: 2241244 - RNA, 13 nt, Yersinia pestis
cuuaucagcgaaa

SEQ ID NO: 2241245 - RNA, 22 nt, Yersinia pestis
cuuauccccugagaaacauccu

SEQ ID NO: 2241246 - RNA, 17 nt, Yersinia pestis
cuuaucacucgggauau

SEQ ID NO: 2241247 - RNA, 17 nt, Yersinia pestis
cuuaauuuuaucacuua

SEQ ID NO: 2241248 - RNA, 14 nt, Yersinia pestis
cuuaccccuuucaa

SEQ ID NO: 2241249 - RNA, 16 nt, Yersinia pestis
cuuacgcgaugccaac

SEQ ID NO: 2241250 - RNA, 12 nt, Yersinia pestis
cuuacgagcuaa

SEQ ID NO: 2241251 - RNA, 23 nt, Yersinia pestis
cuguaagguugaccugcagcggu

SEQ ID NO: 2241252 - RNA, 14 nt, Yersinia pestis
cuguccaguugcug

SEQ ID NO: 2241253 - RNA, 13 nt, Yersinia pestis
cuguucaucaggc

SEQ ID NO: 2241254 - RNA, 22 nt, Yersinia pestis
cuguucaucaauagguguugcc

SEQ ID NO: 2241255 - RNA, 21 nt, Yersinia pestis
cugguacggcgcaucgccauc

SEQ ID NO: 2241256 - RNA, 16 nt, Yersinia pestis
cugguaacagagccuu

SEQ ID NO: 2241257 - RNA, 17 nt, Yersinia pestis
cugguaacagagccuua

SEQ ID NO: 2241258 - RNA, 21 nt, Yersinia pestis
cuggguuuuauugcaacuggg

SEQ ID NO: 2241259 - RNA, 14 nt, Yersinia pestis
cugggguaucgauu

SEQ ID NO: 2241260 - RNA, 18 nt, Yersinia pestis
cugguuaucacagcaaau

SEQ ID NO: 2241261 - RNA, 18 nt, Yersinia pestis
cuggucgauaagcacucc

SEQ ID NO: 2241262 - RNA, 13 nt, Yersinia pestis
aacgguaucaguc

SEQ ID NO: 2241263 - RNA, 18 nt, Yersinia pestis
aacggugaggauaggcug

SEQ ID NO: 2241264 - RNA, 16 nt, Yersinia pestis
aacggguaacgaacgc

SEQ ID NO: 2241265 - RNA, 19 nt, Yersinia pestis
gacgaaauagcgccugccc

SEQ ID NO: 2241266 - RNA, 15 nt, Yersinia pestis
aacggcggcaauacc

SEQ ID NO: 2241267 - RNA, 22 nt, Yersinia pestis
gacauuauuggcguaacugcug

SEQ ID NO: 2241268 - RNA, 23 nt, Yersinia pestis
gaccaaucaauacacuggcagug

SEQ ID NO: 2241269 - RNA, 20 nt, Yersinia pestis
gaccacaucaaccugaucau

SEQ ID NO: 2241270 - RNA, 17 nt, Yersinia pestis
gaccaacuggcaaucau

SEQ ID NO: 2241271 - RNA, 20 nt, Yersinia pestis
gaccaaaagccaccgcauca

SEQ ID NO: 2241272 - RNA, 15 nt, Yersinia pestis
gaaugguguaaaugc

SEQ ID NO: 2241273 - RNA, 18 nt, Yersinia pestis
gaaugguacuugacgcug

SEQ ID NO: 2241274 - RNA, 19 nt, Yersinia pestis
aacgaacgcucuuuaacaa

SEQ ID NO: 2241275 - RNA, 13 nt, Yersinia pestis
gaccagauagcug

SEQ ID NO: 2241276 - RNA, 14 nt, Yersinia pestis
gaccagauaaucgc

SEQ ID NO: 2241277 - RNA, 22 nt, Yersinia pestis
aacgcauucauaucguccaaag

SEQ ID NO: 2241278 - RNA, 13 nt, Yersinia pestis
aacgcacgacugc

SEQ ID NO: 2241279 - RNA, 16 nt, Yersinia pestis
aacgcaacgcacgauc

SEQ ID NO: 2241280 - RNA, 13 nt, Yersinia pestis
gaagacaaugccg

SEQ ID NO: 2241281 - RNA, 13 nt, Yersinia pestis
gaacauugcagua

SEQ ID NO: 2241282 - RNA, 20 nt, Yersinia pestis
gaaccaaaauucacaacuug

SEQ ID NO: 2241283 - RNA, 13 nt, Yersinia pestis
gaaagcuucaacu

SEQ ID NO: 2241284 - RNA, 14 nt, Yersinia pestis
cuuguggugaugaa

SEQ ID NO: 2241285 - RNA, 20 nt, Yersinia pestis
cuuguuuaucggucacuuua

SEQ ID NO: 2241286 - RNA, 16 nt, Yersinia pestis
gaaacucccuucaauc

SEQ ID NO: 2241287 - RNA, 21 nt, Yersinia pestis
gaaaucgauggauguuccugg

SEQ ID NO: 2241288 - RNA, 22 nt, Yersinia pestis
gaacaccagagaugauagcaau

SEQ ID NO: 2241289 - RNA, 16 nt, Yersinia pestis
gaauaccaccccuucg

SEQ ID NO: 2241290 - RNA, 17 nt, Yersinia pestis
gaaucaccuuucuccau

SEQ ID NO: 2241291 - RNA, 14 nt, Yersinia pestis
gaauccaacccgua

SEQ ID NO: 2241292 - RNA, 18 nt, Yersinia pestis
gaagggcaaauugccgcu

SEQ ID NO: 2241293 - RNA, 13 nt, Yersinia pestis
gaagggucccgcu

SEQ ID NO: 2241294 - RNA, 19 nt, Yersinia pestis
gaaggccugcugugucgcu

SEQ ID NO: 2241295 - RNA, 17 nt, Yersinia pestis
gaagccucaugaaugag

SEQ ID NO: 2241296 - RNA, 21 nt, Yersinia pestis
gaagauuuaaauaacagcuaa

SEQ ID NO: 2241297 - RNA, 16 nt, Yersinia pestis
gaagaucgcuucacgg

SEQ ID NO: 2241298 - RNA, 13 nt, Yersinia pestis
gccauaaugccgu

SEQ ID NO: 2241299 - RNA, 18 nt, Yersinia pestis
gccauagccgaucaccgc

SEQ ID NO: 2241300 - RNA, 17 nt, Yersinia pestis
gccauagcccaugauug

SEQ ID NO: 2241301 - RNA, 17 nt, Yersinia pestis
gccauacaucgcuggac

SEQ ID NO: 2241302 - RNA, 16 nt, Yersinia pestis
gccaucauauuagcaa

SEQ ID NO: 2241303 - RNA, 23 nt, Yersinia pestis
gccaucaucuucaaccuggaacc

SEQ ID NO: 2241304 - RNA, 16 nt, Yersinia pestis
aagaauggcgcgacca

SEQ ID NO: 2241305 - RNA, 20 nt, Yersinia pestis
aagaauggucgaucagcgua

SEQ ID NO: 2241306 - RNA, 17 nt, Yersinia pestis
gccaucuugucgucacc

SEQ ID NO: 2241307 - RNA, 13 nt, Yersinia pestis
gccauccuuggcg

SEQ ID NO: 2241308 - RNA, 13 nt, Yersinia pestis
gccaucgccaucg

SEQ ID NO: 2241309 - RNA, 18 nt, Yersinia pestis
gccagugaugcugcacau

SEQ ID NO: 2241310 - RNA, 23 nt, Yersinia pestis
gccagugggcagggcgcaauggc

SEQ ID NO: 2241311 - RNA, 16 nt, Yersinia pestis
gccacucgcaucgccu

SEQ ID NO: 2241312 - RNA, 23 nt, Yersinia pestis
gccagagaauuauuucucguggc

SEQ ID NO: 2241313 - RNA, 19 nt, Yersinia pestis
gccagacacugacaucauc

SEQ ID NO: 2241314 - RNA, 19 nt, Yersinia pestis
gccagaagaaaaucacuuc

SEQ ID NO: 2241315 - RNA, 17 nt, Yersinia pestis
gccacgaugugaagcaa

SEQ ID NO: 2241316 - RNA, 13 nt, Yersinia pestis
gccacgccaguaa

SEQ ID NO: 2241317 - RNA, 21 nt, Yersinia pestis
gccacgccaguaaacagccag

SEQ ID NO: 2241318 - RNA, 16 nt, Yersinia pestis
gccagauagucaucuu

SEQ ID NO: 2241319 - RNA, 20 nt, Yersinia pestis
gccagauagcaucauccagc

SEQ ID NO: 2241320 - RNA, 18 nt, Yersinia pestis
gccagcaauuggccuucc

SEQ ID NO: 2241321 - RNA, 19 nt, Yersinia pestis
gccagcggcaccgccguca

SEQ ID NO: 2241322 - RNA, 15 nt, Yersinia pestis
gcauuagugaaucau

SEQ ID NO: 2241323 - RNA, 13 nt, Yersinia pestis
gcaugaccaagca

SEQ ID NO: 2241324 - RNA, 16 nt, Yersinia pestis
gcaugaauauucacca

SEQ ID NO: 2241325 - RNA, 21 nt, Yersinia pestis
gcaugauagacgcaucgacca

SEQ ID NO: 2241326 - RNA, 23 nt, Yersinia pestis
gcaucuuuaccccauugcaccaa

SEQ ID NO: 2241327 - RNA, 22 nt, Yersinia pestis
gcaucuucaaucaacugaacca

SEQ ID NO: 2241328 - RNA, 23 nt, Yersinia pestis
gcauuggccgacugauuaaccaa

SEQ ID NO: 2241329 - RNA, 22 nt, Yersinia pestis
gccaaauaucuuucagcaccau

SEQ ID NO: 2241330 - RNA, 16 nt, Yersinia pestis
gccaaccagcucaccg

SEQ ID NO: 2241331 - RNA, 19 nt, Yersinia pestis
gccaaaacagccuaaggcc

SEQ ID NO: 2241332 - RNA, 21 nt, Yersinia pestis
gccacacaaaucgucgucagc

SEQ ID NO: 2241333 - RNA, 20 nt, Yersinia pestis
gccaacgggguauuuaaccc

SEQ ID NO: 2241334 - RNA, 14 nt, Yersinia pestis
gcauaccuggauca

SEQ ID NO: 2241335 - RNA, 15 nt, Yersinia pestis
gcauacuguuggcaa

SEQ ID NO: 2241336 - RNA, 13 nt, Yersinia pestis
gcauaguauccau

SEQ ID NO: 2241337 - RNA, 20 nt, Yersinia pestis
gcauauacguuaguuauccu

SEQ ID NO: 2241338 - RNA, 14 nt, Yersinia pestis
gcaucaccaaagau

SEQ ID NO: 2241339 - RNA, 13 nt, Yersinia pestis
gcaucagcccauu

SEQ ID NO: 2241340 - RNA, 18 nt, Yersinia pestis
gcaucacugacugagugc

SEQ ID NO: 2241341 - RNA, 19 nt, Yersinia pestis
gcauaaagcuauucaucug

SEQ ID NO: 2241342 - RNA, 15 nt, Yersinia pestis
gcauaagacaacgcc

SEQ ID NO: 2241343 - RNA, 17 nt, Yersinia pestis
gcauaagcgguuucaug

SEQ ID NO: 2241344 - RNA, 20 nt, Yersinia pestis
gcaguugccaaacaaacgcu

SEQ ID NO: 2241345 - RNA, 15 nt, Yersinia pestis
gcagugcgggcaaca

SEQ ID NO: 2241346 - RNA, 16 nt, Yersinia pestis
gcaucauaaauaccgc

SEQ ID NO: 2241347 - RNA, 19 nt, Yersinia pestis
gcauccucagggcgaugca

SEQ ID NO: 2241348 - RNA, 16 nt, Yersinia pestis
gcaucugaaagcuuca

SEQ ID NO: 2241349 - RNA, 19 nt, Yersinia pestis
gcaucuauugugucaauac

SEQ ID NO: 2241350 - RNA, 21 nt, Yersinia pestis
gcaucgcgaucugacauuugc

SEQ ID NO: 2241351 - RNA, 21 nt, Yersinia pestis
aagagaaaguugauccugggu

SEQ ID NO: 2241352 - RNA, 22 nt, Yersinia pestis
aagagagaauccauuuaaucgc

SEQ ID NO: 2241353 - RNA, 14 nt, Yersinia pestis
gccauggucaguuu

SEQ ID NO: 2241354 - RNA, 21 nt, Yersinia pestis
gcccuaacaggcgcaucgcga

SEQ ID NO: 2241355 - RNA, 20 nt, Yersinia pestis
gccgaaagccaagcaagcgg

SEQ ID NO: 2241356 - RNA, 18 nt, Yersinia pestis
gccgaaccuuuugccagu

SEQ ID NO: 2241357 - RNA, 23 nt, Yersinia pestis
gccgaguugacuuuuuuuaacca

SEQ ID NO: 2241358 - RNA, 23 nt, Yersinia pestis
gccgaucauaaaucacaauuuca

SEQ ID NO: 2241359 - RNA, 18 nt, Yersinia pestis
gccgcaguuaccggucau

SEQ ID NO: 2241360 - RNA, 12 nt, Yersinia pestis
gccgcauacaua

SEQ ID NO: 2241361 - RNA, 16 nt, Yersinia pestis
gccgcacacaucuguc

SEQ ID NO: 2241362 - RNA, 18 nt, Yersinia pestis
gacuucaucacccaacgu

SEQ ID NO: 2241363 - RNA, 19 nt, Yersinia pestis
gagaacagcgaaucaagcu

SEQ ID NO: 2241364 - RNA, 20 nt, Yersinia pestis
aacuauauucucauugcccc

SEQ ID NO: 2241365 - RNA, 19 nt, Yersinia pestis
aacuagcgccgcaucaaag

SEQ ID NO: 2241366 - RNA, 16 nt, Yersinia pestis
aacucaaacugauaaa

SEQ ID NO: 2241367 - RNA, 14 nt, Yersinia pestis
aacuauuagcgcuu

SEQ ID NO: 2241368 - RNA, 17 nt, Yersinia pestis
gacuuaaaucuuacugg

SEQ ID NO: 2241369 - RNA, 19 nt, Yersinia pestis
aacguuuaucgcuaccgcg

SEQ ID NO: 2241370 - RNA, 21 nt, Yersinia pestis
gacuaauauuucaggcuguga

SEQ ID NO: 2241371 - RNA, 22 nt, Yersinia pestis
gacuacgguguuuggugaagaa

SEQ ID NO: 2241372 - RNA, 16 nt, Yersinia pestis
gacucaauaaauccau

SEQ ID NO: 2241373 - RNA, 21 nt, Yersinia pestis
gacguugcucccaucccucac

SEQ ID NO: 2241374 - RNA, 13 nt, Yersinia pestis
gacgacagauuau

SEQ ID NO: 2241375 - RNA, 19 nt, Yersinia pestis
gagauuucagacugcugac

SEQ ID NO: 2241376 - RNA, 14 nt, Yersinia pestis
gagcaaacgccuga

SEQ ID NO: 2241377 - RNA, 13 nt, Yersinia pestis
gagcaaaucgaua

SEQ ID NO: 2241378 - RNA, 23 nt, Yersinia pestis
gagccacuuuaauauuucaaaug

SEQ ID NO: 2241379 - RNA, 21 nt, Yersinia pestis
gagcagugcgcggcgccguca

SEQ ID NO: 2241380 - RNA, 22 nt, Yersinia pestis
gagcauacuguuggcaauuuca

SEQ ID NO: 2241381 - RNA, 14 nt, Yersinia pestis
gaguucugcugcca

SEQ ID NO: 2241382 - RNA, 13 nt, Yersinia pestis
gauaacugccaua

SEQ ID NO: 2241383 - RNA, 17 nt, Yersinia pestis
gauaaagugaccgguaa

SEQ ID NO: 2241384 - RNA, 12 nt, Yersinia pestis
gauaaaaacauu

SEQ ID NO: 2241385 - RNA, 15 nt, Yersinia pestis
gauaaaaagaauaag

SEQ ID NO: 2241386 - RNA, 14 nt, Yersinia pestis
gauaaacuuaucgg

SEQ ID NO: 2241387 - RNA, 19 nt, Yersinia pestis
gauacgcauugaggucagc

SEQ ID NO: 2241388 - RNA, 19 nt, Yersinia pestis
gauaauuucagcagcacgu

SEQ ID NO: 2241389 - RNA, 20 nt, Yersinia pestis
gauacaauucacccauacca

SEQ ID NO: 2241390 - RNA, 20 nt, Yersinia pestis
gauaauagagaauagauagc

SEQ ID NO: 2241391 - RNA, 20 nt, Yersinia pestis
gauaauagcuaaacauccgu

SEQ ID NO: 2241392 - RNA, 22 nt, Yersinia pestis
gaucaccgaugauaagugaaua

SEQ ID NO: 2241393 - RNA, 14 nt, Yersinia pestis
gaucaacagugagg

SEQ ID NO: 2241394 - RNA, 12 nt, Yersinia pestis
gauaucugcuca

SEQ ID NO: 2241395 - RNA, 15 nt, Yersinia pestis
gaucaaaggcgacca

SEQ ID NO: 2241396 - RNA, 18 nt, Yersinia pestis
gauagcuguuagccagau

SEQ ID NO: 2241397 - RNA, 19 nt, Yersinia pestis
gauagacaguaacuaaagc

SEQ ID NO: 2241398 - RNA, 19 nt, Yersinia pestis
gauagagacuucgcgauca

SEQ ID NO: 2241399 - RNA, 22 nt, Yersinia pestis
gauagugauuuuuuucacccau

SEQ ID NO: 2241400 - RNA, 13 nt, Yersinia pestis
gauaguacuuagc

SEQ ID NO: 2241401 - RNA, 16 nt, Yersinia pestis
gauaucgauggcaacc

SEQ ID NO: 2241402 - RNA, 21 nt, Yersinia pestis
gagguggccgagaggcugaag

SEQ ID NO: 2241403 - RNA, 16 nt, Yersinia pestis
gaguaggaaauacagg

SEQ ID NO: 2241404 - RNA, 17 nt, Yersinia pestis
gagugguuuaaggcaac

SEQ ID NO: 2241405 - RNA, 20 nt, Yersinia pestis
gaggaauaugcccuuuuagc

SEQ ID NO: 2241406 - RNA, 14 nt, Yersinia pestis
gaucggguugauga

SEQ ID NO: 2241407 - RNA, 17 nt, Yersinia pestis
gaucgcugugguuauca

SEQ ID NO: 2241408 - RNA, 14 nt, Yersinia pestis
gaucgcugccaccg

SEQ ID NO: 2241409 - RNA, 20 nt, Yersinia pestis
gauccaaaacaucggccagc

SEQ ID NO: 2241410 - RNA, 15 nt, Yersinia pestis
gauccaguuucagug

SEQ ID NO: 2241411 - RNA, 12 nt, Yersinia pestis
gaucauucuagc

SEQ ID NO: 2241412 - RNA, 16 nt, Yersinia pestis
gaucacuggcauugca

SEQ ID NO: 2241413 - RNA, 15 nt, Yersinia pestis
gaucacgcaaugcca

SEQ ID NO: 2241414 - RNA, 14 nt, Yersinia pestis
gaucagcaagauug

SEQ ID NO: 2241415 - RNA, 20 nt, Yersinia pestis
gaucagacggcccacgauua

SEQ ID NO: 2241416 - RNA, 16 nt, Yersinia pestis
gaucaguaaacgguug

SEQ ID NO: 2241417 - RNA, 13 nt, Yersinia pestis
gauuauuggcaug

SEQ ID NO: 2241418 - RNA, 16 nt, Yersinia pestis
gauuauuguuauccac

SEQ ID NO: 2241419 - RNA, 17 nt, Yersinia pestis
gauucgggugagugagc

SEQ ID NO: 2241420 - RNA, 19 nt, Yersinia pestis
gauugguuuauccccuucg

SEQ ID NO: 2241421 - RNA, 18 nt, Yersinia pestis
gauugaaucaaggcuuua

SEQ ID NO: 2241422 - RNA, 21 nt, Yersinia pestis
gcaaccaaucguugcugguua

SEQ ID NO: 2241423 - RNA, 18 nt, Yersinia pestis
gcaaagcgggccagcaac

SEQ ID NO: 2241424 - RNA, 14 nt, Yersinia pestis
gcaaauugcuggcg

SEQ ID NO: 2241425 - RNA, 24 nt, Yersinia pestis
gcaacacagucgcacugauagcaa

SEQ ID NO: 2241426 - RNA, 18 nt, Yersinia pestis
gcaaaagaacgugcugcg

SEQ ID NO: 2241427 - RNA, 13 nt, Yersinia pestis
gcaaaaaaacuga

SEQ ID NO: 2241428 - RNA, 14 nt, Yersinia pestis
gaugcuucagccac

SEQ ID NO: 2241429 - RNA, 21 nt, Yersinia pestis
gauggcgauagauuggcauca

SEQ ID NO: 2241430 - RNA, 23 nt, Yersinia pestis
gcacacuuuucacuccggcauca

SEQ ID NO: 2241431 - RNA, 21 nt, Yersinia pestis
gcacaacgcucuaacgucaga

SEQ ID NO: 2241432 - RNA, 14 nt, Yersinia pestis
gcacaacggaaggc

SEQ ID NO: 2241433 - RNA, 17 nt, Yersinia pestis
gcaauggcuaauuagau

SEQ ID NO: 2241434 - RNA, 20 nt, Yersinia pestis
gcaauagcgaucacggguuu

SEQ ID NO: 2241435 - RNA, 18 nt, Yersinia pestis
gcaacggaagucaaucgg

SEQ ID NO: 2241436 - RNA, 21 nt, Yersinia pestis
gcaacgcaggcacugcagaaa

SEQ ID NO: 2241437 - RNA, 20 nt, Yersinia pestis
gcaaggauaccaaucccuac

SEQ ID NO: 2241438 - RNA, 13 nt, Yersinia pestis
gcacguuuaaaca

SEQ ID NO: 2241439 - RNA, 17 nt, Yersinia pestis
gcagaagaguaaagcgu

SEQ ID NO: 2241440 - RNA, 20 nt, Yersinia pestis
gcagaaguugaauuugacgu

SEQ ID NO: 2241441 - RNA, 17 nt, Yersinia pestis
gcagccaauuacgcugc

SEQ ID NO: 2241442 - RNA, 21 nt, Yersinia pestis
gcacagagcgggaacgccaag

SEQ ID NO: 2241443 - RNA, 19 nt, Yersinia pestis
gcaccauccagcaaaucau

SEQ ID NO: 2241444 - RNA, 18 nt, Yersinia pestis
gcacgauuugaucacgca

SEQ ID NO: 2241445 - RNA, 19 nt, Yersinia pestis
gcaccuuugucauugagga

SEQ ID NO: 2241446 - RNA, 13 nt, Yersinia pestis
gccugcggccauc

SEQ ID NO: 2241447 - RNA, 17 nt, Yersinia pestis
gccugcugagccaaaua

SEQ ID NO: 2241448 - RNA, 15 nt, Yersinia pestis
aagccauuagcguug

SEQ ID NO: 2241449 - RNA, 20 nt, Yersinia pestis
aagccagauugugcggcugg

SEQ ID NO: 2241450 - RNA, 11 nt, Yersinia pestis
gccguuggcaa

SEQ ID NO: 2241451 - RNA, 22 nt, Yersinia pestis
gccucgacuuuauucaaaccgc

SEQ ID NO: 2241452 - RNA, 17 nt, Yersinia pestis
gccucgcuuacugguac

SEQ ID NO: 2241453 - RNA, 19 nt, Yersinia pestis
gccucgcggaaaucagcuu

SEQ ID NO: 2241454 - RNA, 16 nt, Yersinia pestis
gccugcgacagcacgu

SEQ ID NO: 2241455 - RNA, 16 nt, Yersinia pestis
gccugccauacccgcu

SEQ ID NO: 2241456 - RNA, 15 nt, Yersinia pestis
gccugagaacccaug

SEQ ID NO: 2241457 - RNA, 16 nt, Yersinia pestis
gccgguauucagccaa

SEQ ID NO: 2241458 - RNA, 19 nt, Yersinia pestis
gccggcguuaaugccaccc

SEQ ID NO: 2241459 - RNA, 13 nt, Yersinia pestis
gccgcuuuagcga

SEQ ID NO: 2241460 - RNA, 19 nt, Yersinia pestis
gccgcuuuagcgaugacca

SEQ ID NO: 2241461 - RNA, 22 nt, Yersinia pestis
gccgcuucgcugacauuuucua

SEQ ID NO: 2241462 - RNA, 19 nt, Yersinia pestis
gcgaucccagaauggcaaa

SEQ ID NO: 2241463 - RNA, 21 nt, Yersinia pestis
gcgaucacaauacagcaaaua

SEQ ID NO: 2241464 - RNA, 22 nt, Yersinia pestis
gcgcacguucccaggccaaggu

SEQ ID NO: 2241465 - RNA, 19 nt, Yersinia pestis
gcgauacggucaucgccgc

SEQ ID NO: 2241466 - RNA, 12 nt, Yersinia pestis
gcgccugcgcua

SEQ ID NO: 2241467 - RNA, 17 nt, Yersinia pestis
gcgccggaauaaagcuc

SEQ ID NO: 2241468 - RNA, 22 nt, Yersinia pestis
gcgccguuggcuaaauaaccag

SEQ ID NO: 2241469 - RNA, 18 nt, Yersinia pestis
gcgcaguacucaccgccg

SEQ ID NO: 2241470 - RNA, 13 nt, Yersinia pestis
gcuauugaugucu

SEQ ID NO: 2241471 - RNA, 13 nt, Yersinia pestis
gcuauugacaaag

SEQ ID NO: 2241472 - RNA, 22 nt, Yersinia pestis
gcuaucuuaugacgcugcaccg

SEQ ID NO: 2241473 - RNA, 18 nt, Yersinia pestis
gcuaucaccggaugaaac

SEQ ID NO: 2241474 - RNA, 15 nt, Yersinia pestis
gcucaagcuggucgc

SEQ ID NO: 2241475 - RNA, 18 nt, Yersinia pestis
gcucaacugcucaacugc

SEQ ID NO: 2241476 - RNA, 20 nt, Yersinia pestis
gcucaacugcucaacugcuc

SEQ ID NO: 2241477 - RNA, 15 nt, Yersinia pestis
gcuaguuugacgcug

SEQ ID NO: 2241478 - RNA, 21 nt, Yersinia pestis
gcuacggauugcaaauccguc

SEQ ID NO: 2241479 - RNA, 13 nt, Yersinia pestis
gcuaauucaccaa

SEQ ID NO: 2241480 - RNA, 20 nt, Yersinia pestis
gcuaaucguggugaagaaua

SEQ ID NO: 2241481 - RNA, 15 nt, Yersinia pestis
gcuaccagcagugca

SEQ ID NO: 2241482 - RNA, 14 nt, Yersinia pestis
gcuaauacggcuug

SEQ ID NO: 2241483 - RNA, 23 nt, Yersinia pestis
gcuaaccagugucuggcaaucca

SEQ ID NO: 2241484 - RNA, 14 nt, Yersinia pestis
gcuaacgaagguaa

SEQ ID NO: 2241485 - RNA, 20 nt, Yersinia pestis
gcuaacgaggcauaaucagc

SEQ ID NO: 2241486 - RNA, 17 nt, Yersinia pestis
gcuaaccuuaacugcau

SEQ ID NO: 2241487 - RNA, 21 nt, Yersinia pestis
gcuaaagcguaagugcaauua

SEQ ID NO: 2241488 - RNA, 16 nt, Yersinia pestis
gcuaaacguaaugcga

SEQ ID NO: 2241489 - RNA, 16 nt, Yersinia pestis
gcuaaaucaucaaauu

SEQ ID NO: 2241490 - RNA, 18 nt, Yersinia pestis
gcuaacaacuaacgauug

SEQ ID NO: 2241491 - RNA, 16 nt, Yersinia pestis
gcguugauccauccau

SEQ ID NO: 2241492 - RNA, 15 nt, Yersinia pestis
gcguugcgcugacca

SEQ ID NO: 2241493 - RNA, 16 nt, Yersinia pestis
aagcuuaguauccgcg

SEQ ID NO: 2241494 - RNA, 14 nt, Yersinia pestis
gcgucaaauuagca

SEQ ID NO: 2241495 - RNA, 19 nt, Yersinia pestis
gcgucacuaaauccaaaug

SEQ ID NO: 2241496 - RNA, 20 nt, Yersinia pestis
gcgucaucagcauccgccaa

SEQ ID NO: 2241497 - RNA, 13 nt, Yersinia pestis
gcguccgcgccaa

SEQ ID NO: 2241498 - RNA, 16 nt, Yersinia pestis
gcugacuggcaggaaa

SEQ ID NO: 2241499 - RNA, 16 nt, Yersinia pestis
gcugacgucagaucgc

SEQ ID NO: 2241500 - RNA, 22 nt, Yersinia pestis
gcugacgguuauugugcugccg

SEQ ID NO: 2241501 - RNA, 17 nt, Yersinia pestis
gcugauucacuggcaaa

SEQ ID NO: 2241502 - RNA, 17 nt, Yersinia pestis
gcuggcaguucggcuuu

SEQ ID NO: 2241503 - RNA, 14 nt, Yersinia pestis
gcuggcaaggcacg

SEQ ID NO: 2241504 - RNA, 19 nt, Yersinia pestis
gcuggcagcgcuugcaaca

SEQ ID NO: 2241505 - RNA, 18 nt, Yersinia pestis
gcucacucgguaaugagc

SEQ ID NO: 2241506 - RNA, 17 nt, Yersinia pestis
gcuccugacgggucagc

SEQ ID NO: 2241507 - RNA, 18 nt, Yersinia pestis
gcucgcucaacaugccag

SEQ ID NO: 2241508 - RNA, 12 nt, Yersinia pestis
gcugaagccagc

SEQ ID NO: 2241509 - RNA, 13 nt, Yersinia pestis
gcugaagccagca

SEQ ID NO: 2241510 - RNA, 14 nt, Yersinia pestis
gcucuucaauuucc

SEQ ID NO: 2241511 - RNA, 15 nt, Yersinia pestis
gcucuguugacucgc

SEQ ID NO: 2241512 - RNA, 17 nt, Yersinia pestis
gcucuuacucauucgaa

SEQ ID NO: 2241513 - RNA, 16 nt, Yersinia pestis
aagcugcucaaugcgu

SEQ ID NO: 2241514 - RNA, 17 nt, Yersinia pestis
aagcucaucuaacucau

SEQ ID NO: 2241515 - RNA, 15 nt, Yersinia pestis
gcggcuacucgcucg

SEQ ID NO: 2241516 - RNA, 19 nt, Yersinia pestis
gcgggcaguaacgccauaa

SEQ ID NO: 2241517 - RNA, 18 nt, Yersinia pestis
gcgggguauuuuacugau

SEQ ID NO: 2241518 - RNA, 15 nt, Yersinia pestis
gcgcuucgcacuuca

SEQ ID NO: 2241519 - RNA, 14 nt, Yersinia pestis
gcggaauggcaacg

SEQ ID NO: 2241520 - RNA, 19 nt, Yersinia pestis
gcgcugcgucuuuaucgcc

SEQ ID NO: 2241521 - RNA, 17 nt, Yersinia pestis
gcgcgcauaguauccau

SEQ ID NO: 2241522 - RNA, 18 nt, Yersinia pestis
gcgcugagcgggcggcaa

SEQ ID NO: 2241523 - RNA, 15 nt, Yersinia pestis
aagccucaugaauga

SEQ ID NO: 2241524 - RNA, 15 nt, Yersinia pestis
aagccgucagcuuac

SEQ ID NO: 2241525 - RNA, 15 nt, Yersinia pestis
gcggacauggcaaca

SEQ ID NO: 2241526 - RNA, 15 nt, Yersinia pestis
aaggucuuucgccca

SEQ ID NO: 2241527 - RNA, 17 nt, Yersinia pestis
aagguaaaaggcccgcu

SEQ ID NO: 2241528 - RNA, 20 nt, Yersinia pestis
aagggcgcauccccaucgcc

SEQ ID NO: 2241529 - RNA, 13 nt, Yersinia pestis
ggccccuaaugcg

SEQ ID NO: 2241530 - RNA, 14 nt, Yersinia pestis
aaggcucuguuacc

SEQ ID NO: 2241531 - RNA, 21 nt, Yersinia pestis
aaggcucuguuaccagccgcg

SEQ ID NO: 2241532 - RNA, 16 nt, Yersinia pestis
ggcgacccagcgccau

SEQ ID NO: 2241533 - RNA, 18 nt, Yersinia pestis
aaggccagaguuaugggc

SEQ ID NO: 2241534 - RNA, 14 nt, Yersinia pestis
ggauaucucaccgc

SEQ ID NO: 2241535 - RNA, 15 nt, Yersinia pestis
ggaucacaaugcaaa

SEQ ID NO: 2241536 - RNA, 12 nt, Yersinia pestis
ggaucacgcugu

SEQ ID NO: 2241537 - RNA, 18 nt, Yersinia pestis
ggaucacgcuguucaccg

SEQ ID NO: 2241538 - RNA, 18 nt, Yersinia pestis
ggauccgguugccagcca

SEQ ID NO: 2241539 - RNA, 13 nt, Yersinia pestis
ggauaaauggcaa

SEQ ID NO: 2241540 - RNA, 18 nt, Yersinia pestis
ggaguaauuaauaaucga

SEQ ID NO: 2241541 - RNA, 20 nt, Yersinia pestis
ggaauuugccucugcuagca

SEQ ID NO: 2241542 - RNA, 14 nt, Yersinia pestis
ggacgcaucagauc

SEQ ID NO: 2241543 - RNA, 16 nt, Yersinia pestis
ggaaccuccaaaugaa

SEQ ID NO: 2241544 - RNA, 13 nt, Yersinia pestis
ggaaucagccaga

SEQ ID NO: 2241545 - RNA, 23 nt, Yersinia pestis
ggaaugcuauauuuggcuuucag

SEQ ID NO: 2241546 - RNA, 14 nt, Yersinia pestis
ggaagguauccaau

SEQ ID NO: 2241547 - RNA, 19 nt, Yersinia pestis
ggcaauauuggcgcacaac

SEQ ID NO: 2241548 - RNA, 17 nt, Yersinia pestis
ggcaauacguguagcca

SEQ ID NO: 2241549 - RNA, 17 nt, Yersinia pestis
ggcaacgcgcagugccg

SEQ ID NO: 2241550 - RNA, 16 nt, Yersinia pestis
ggcacuuugucaauaa

SEQ ID NO: 2241551 - RNA, 19 nt, Yersinia pestis
ggcaucaccgcuaucacug

SEQ ID NO: 2241552 - RNA, 19 nt, Yersinia pestis
ggccaguuuuagucucgca

SEQ ID NO: 2241553 - RNA, 21 nt, Yersinia pestis
ggccauauacgcauaaugcgc

SEQ ID NO: 2241554 - RNA, 16 nt, Yersinia pestis
ggccaugucgaucaug

SEQ ID NO: 2241555 - RNA, 20 nt, Yersinia pestis
ggccauguacuuaauacuga

SEQ ID NO: 2241556 - RNA, 20 nt, Yersinia pestis
gggcuuguugauaugagcga

SEQ ID NO: 2241557 - RNA, 20 nt, Yersinia pestis
gggcugcacuuuuacgggcc

SEQ ID NO: 2241558 - RNA, 16 nt, Yersinia pestis
gggcgcuuacaugaug

SEQ ID NO: 2241559 - RNA, 18 nt, Yersinia pestis
gggcaacgguaaaagguu

SEQ ID NO: 2241560 - RNA, 19 nt, Yersinia pestis
gggauaugacuaaacugau

SEQ ID NO: 2241561 - RNA, 16 nt, Yersinia pestis
gggcagcgacaaccug

SEQ ID NO: 2241562 - RNA, 18 nt, Yersinia pestis
ggugacauguuccagugc

SEQ ID NO: 2241563 - RNA, 19 nt, Yersinia pestis
ggugagacagugagguuau

SEQ ID NO: 2241564 - RNA, 21 nt, Yersinia pestis
ggugagaaacgugaauugcua

SEQ ID NO: 2241565 - RNA, 17 nt, Yersinia pestis
ggucugcuggcggaaca

SEQ ID NO: 2241566 - RNA, 21 nt, Yersinia pestis
ggugcgggcaucgacggguaa

SEQ ID NO: 2241567 - RNA, 20 nt, Yersinia pestis
gguggcagauagccaguggg

SEQ ID NO: 2241568 - RNA, 17 nt, Yersinia pestis
gguauuggcuaacuggc

SEQ ID NO: 2241569 - RNA, 13 nt, Yersinia pestis
gguauucaggaug

SEQ ID NO: 2241570 - RNA, 21 nt, Yersinia pestis
gguauuaccaaucagcgcgaa

SEQ ID NO: 2241571 - RNA, 18 nt, Yersinia pestis
gguagcagccacaugguu

SEQ ID NO: 2241572 - RNA, 21 nt, Yersinia pestis
gguagcaaaauuagcauuacc

SEQ ID NO: 2241573 - RNA, 22 nt, Yersinia pestis
gguaucaaucagcggagcugac

SEQ ID NO: 2241574 - RNA, 17 nt, Yersinia pestis
gguagcuccgcagcuaa

SEQ ID NO: 2241575 - RNA, 19 nt, Yersinia pestis
gguaaugguaaaaaauggc

SEQ ID NO: 2241576 - RNA, 21 nt, Yersinia pestis
gguaauaccggggagcggaua

SEQ ID NO: 2241577 - RNA, 20 nt, Yersinia pestis
gguaaacgcaucccaggcau

SEQ ID NO: 2241578 - RNA, 15 nt, Yersinia pestis
ggucauauacaccgc

SEQ ID NO: 2241579 - RNA, 15 nt, Yersinia pestis
aagucaugauguuga

SEQ ID NO: 2241580 - RNA, 21 nt, Yersinia pestis
aagucaaucggaacucagacu

SEQ ID NO: 2241581 - RNA, 18 nt, Yersinia pestis
guaguaagcaugccaucc

SEQ ID NO: 2241582 - RNA, 17 nt, Yersinia pestis
guauaugccuauagccg

SEQ ID NO: 2241583 - RNA, 18 nt, Yersinia pestis
guauaucacuucugcugu

SEQ ID NO: 2241584 - RNA, 23 nt, Yersinia pestis
guacuuccaauaagugauucgag

SEQ ID NO: 2241585 - RNA, 13 nt, Yersinia pestis
guacuguugaugc

SEQ ID NO: 2241586 - RNA, 11 nt, Yersinia pestis
guacuuaacgu

SEQ ID NO: 2241587 - RNA, 15 nt, Yersinia pestis
guaaaaagcagcaaa

SEQ ID NO: 2241588 - RNA, 18 nt, Yersinia pestis
gguuuucugaauaccaua

SEQ ID NO: 2241589 - RNA, 18 nt, Yersinia pestis
guaaagguuucugccuua

SEQ ID NO: 2241590 - RNA, 14 nt, Yersinia pestis
gguuuuaucaauag

SEQ ID NO: 2241591 - RNA, 22 nt, Yersinia pestis
guaagcacgcuugauggccaca

SEQ ID NO: 2241592 - RNA, 13 nt, Yersinia pestis
guaacugaucaau

SEQ ID NO: 2241593 - RNA, 19 nt, Yersinia pestis
guaaauuagccacugguug

SEQ ID NO: 2241594 - RNA, 23 nt, Yersinia pestis
guaauaauaauucauaugacaaa

SEQ ID NO: 2241595 - RNA, 20 nt, Yersinia pestis
guaagcggguuagcgccgcu

SEQ ID NO: 2241596 - RNA, 18 nt, Yersinia pestis
guaccugauguaacucag

SEQ ID NO: 2241597 - RNA, 19 nt, Yersinia pestis
guaauaucugccaccgcac

SEQ ID NO: 2241598 - RNA, 13 nt, Yersinia pestis
guauuuacggcgu

SEQ ID NO: 2241599 - RNA, 15 nt, Yersinia pestis
guauuugggccaccg

SEQ ID NO: 2241600 - RNA, 19 nt, Yersinia pestis
guauugaccagauaggcuu

SEQ ID NO: 2241601 - RNA, 19 nt, Yersinia pestis
guauuguauacaugccucu

SEQ ID NO: 2241602 - RNA, 19 nt, Yersinia pestis
guaucuguuuuugccaccu

SEQ ID NO: 2241603 - RNA, 22 nt, Yersinia pestis
guaucagaaauacgcuuuccaa

SEQ ID NO: 2241604 - RNA, 13 nt, Yersinia pestis
guaucagcggcgu

SEQ ID NO: 2241605 - RNA, 16 nt, Yersinia pestis
guaucgcuaucaccgg

SEQ ID NO: 2241606 - RNA, 22 nt, Yersinia pestis
guaucucacucaggcgugucau

SEQ ID NO: 2241607 - RNA, 23 nt, Yersinia pestis
guaucuacccacuccccgucagc

SEQ ID NO: 2241608 - RNA, 22 nt, Yersinia pestis
gucaaccguuguguaucagcaa

SEQ ID NO: 2241609 - RNA, 23 nt, Yersinia pestis
gucaauaaccucacgggcuucca

SEQ ID NO: 2241610 - RNA, 10 nt, Yersinia pestis
gucagcccaa

SEQ ID NO: 2241611 - RNA, 20 nt, Yersinia pestis
gucagauuagucuuagacgu

SEQ ID NO: 2241612 - RNA, 21 nt, Yersinia pestis
gucaucagcgccuuugccccg

SEQ ID NO: 2241613 - RNA, 15 nt, Yersinia pestis
gucgaccgcucuuca

SEQ ID NO: 2241614 - RNA, 22 nt, Yersinia pestis
gucgauaaacaucaugacaaaa

SEQ ID NO: 2241615 - RNA, 14 nt, Yersinia pestis
gucgaucauggcaa

SEQ ID NO: 2241616 - RNA, 22 nt, Yersinia pestis
gucgcugaaaugcuauggguaa

SEQ ID NO: 2241617 - RNA, 20 nt, Yersinia pestis
ccuuucgaguuuauauugcc

SEQ ID NO: 2241618 - RNA, 18 nt, Yersinia pestis
ccuuucaauacggcuuca

SEQ ID NO: 2241619 - RNA, 23 nt, Yersinia pestis
ccuuucuggugguaccugcauca

SEQ ID NO: 2241620 - RNA, 19 nt, Yersinia pestis
ccuuugacagcaucugcaa

SEQ ID NO: 2241621 - RNA, 15 nt, Yersinia pestis
ccuuuuuucugcaaa

SEQ ID NO: 2241622 - RNA, 17 nt, Yersinia pestis
ccuuuugaauucaccaa

SEQ ID NO: 2241623 - RNA, 22 nt, Yersinia pestis
cgaaagacggccaacugcuggc

SEQ ID NO: 2241624 - RNA, 19 nt, Yersinia pestis
cgaaacaccuagccguuua

SEQ ID NO: 2241625 - RNA, 17 nt, Yersinia pestis
ccuugcugaucgagcau

SEQ ID NO: 2241626 - RNA, 22 nt, Yersinia pestis
ccuucugaaaccccaaagcgca

SEQ ID NO: 2241627 - RNA, 14 nt, Yersinia pestis
ccuucauuucagga

SEQ ID NO: 2241628 - RNA, 20 nt, Yersinia pestis
ccuucagacugcugacaaac

SEQ ID NO: 2241629 - RNA, 19 nt, Yersinia pestis
ccuucagacugcugacaaa

SEQ ID NO: 2241630 - RNA, 17 nt, Yersinia pestis
ccuuaucuaucucaggc

SEQ ID NO: 2241631 - RNA, 14 nt, Yersinia pestis
ccuucaccaauaca

SEQ ID NO: 2241632 - RNA, 17 nt, Yersinia pestis
ccuucaccaauacaaac

SEQ ID NO: 2241633 - RNA, 13 nt, Yersinia pestis
ccuucacgcucuu

SEQ ID NO: 2241634 - RNA, 19 nt, Yersinia pestis
ccuuaacggucagauccac

SEQ ID NO: 2241635 - RNA, 12 nt, Yersinia pestis
ccuuaauaccgu

SEQ ID NO: 2241636 - RNA, 13 nt, Yersinia pestis
ccuuacugcauca

SEQ ID NO: 2241637 - RNA, 18 nt, Yersinia pestis
ccuuacuguaucaauacc

SEQ ID NO: 2241638 - RNA, 15 nt, Yersinia pestis
ccuguuucgauccag

SEQ ID NO: 2241639 - RNA, 19 nt, Yersinia pestis
cgaaauauucgucucauca

SEQ ID NO: 2241640 - RNA, 14 nt, Yersinia pestis
cgaacccuucagca

SEQ ID NO: 2241641 - RNA, 22 nt, Yersinia pestis
cgaacgaacacaguccuguuua

SEQ ID NO: 2241642 - RNA, 19 nt, Yersinia pestis
cgaaugacucgaugacagg

SEQ ID NO: 2241643 - RNA, 17 nt, Yersinia pestis
cgaauauugcguuaccu

SEQ ID NO: 2241644 - RNA, 18 nt, Yersinia pestis
cgaauagaaccggcugac

SEQ ID NO: 2241645 - RNA, 15 nt, Yersinia pestis
cgaagcccuguuuca

SEQ ID NO: 2241646 - RNA, 22 nt, Yersinia pestis
cgaacucgauaauaaaacggcu

SEQ ID NO: 2241647 - RNA, 19 nt, Yersinia pestis
aacaaucgauuccuguuga

SEQ ID NO: 2241648 - RNA, 21 nt, Yersinia pestis
aacacacuucgccaggucagg

SEQ ID NO: 2241649 - RNA, 23 nt, Yersinia pestis
aacacagagguagacguaucaug

SEQ ID NO: 2241650 - RNA, 14 nt, Yersinia pestis
cgacuaaauccuug

SEQ ID NO: 2241651 - RNA, 14 nt, Yersinia pestis
cgacgauugcacug

SEQ ID NO: 2241652 - RNA, 22 nt, Yersinia pestis
cgaccaacuggcaaucaugggc

SEQ ID NO: 2241653 - RNA, 21 nt, Yersinia pestis
cgaaugcgacaccugcuauca

SEQ ID NO: 2241654 - RNA, 18 nt, Yersinia pestis
cgacauccaauucaguac

SEQ ID NO: 2241655 - RNA, 22 nt, Yersinia pestis
cgacgauggaguggucaugcuc

SEQ ID NO: 2241656 - RNA, 14 nt, Yersinia pestis
cgaugcggauaucu

SEQ ID NO: 2241657 - RNA, 23 nt, Yersinia pestis
cgagcuucaccuuuguguugaac

SEQ ID NO: 2241658 - RNA, 18 nt, Yersinia pestis
cgagggcucaaucucugc

SEQ ID NO: 2241659 - RNA, 19 nt, Yersinia pestis
cgaguaucgugaccaauaa

SEQ ID NO: 2241660 - RNA, 17 nt, Yersinia pestis
cgauaagcgggguuaau

SEQ ID NO: 2241661 - RNA, 18 nt, Yersinia pestis
cgauacggucaucgccgc

SEQ ID NO: 2241662 - RNA, 15 nt, Yersinia pestis
cgauacucauugcac

SEQ ID NO: 2241663 - RNA, 22 nt, Yersinia pestis
cgauacucauugcaccucauug

SEQ ID NO: 2241664 - RNA, 17 nt, Yersinia pestis
cgauaaccaaaucaccu

SEQ ID NO: 2241665 - RNA, 17 nt, Yersinia pestis
cgaucaccacgucaccu

SEQ ID NO: 2241666 - RNA, 21 nt, Yersinia pestis
cgauauaaauaaaauagcgua

SEQ ID NO: 2241667 - RNA, 16 nt, Yersinia pestis
cgaucaacccccugug

SEQ ID NO: 2241668 - RNA, 21 nt, Yersinia pestis
cgaucagugaagagauaaccg

SEQ ID NO: 2241669 - RNA, 18 nt, Yersinia pestis
cgcaccacugucagggcu

SEQ ID NO: 2241670 - RNA, 18 nt, Yersinia pestis
cgcacaguuuucuuaaaa

SEQ ID NO: 2241671 - RNA, 21 nt, Yersinia pestis
cgcaaucagccgcaucacuga

SEQ ID NO: 2241672 - RNA, 17 nt, Yersinia pestis
cgauuguuacgccuuca

SEQ ID NO: 2241673 - RNA, 17 nt, Yersinia pestis
cgauuuuagcuuugacc

SEQ ID NO: 2241674 - RNA, 18 nt, Yersinia pestis
cgcaaagcguuucgccaa

SEQ ID NO: 2241675 - RNA, 18 nt, Yersinia pestis
cgcaaauaggggcaccgu

SEQ ID NO: 2241676 - RNA, 17 nt, Yersinia pestis
cgcacgggcuuuaauga

SEQ ID NO: 2241677 - RNA, 17 nt, Yersinia pestis
cgcagauccagaauuuc

SEQ ID NO: 2241678 - RNA, 18 nt, Yersinia pestis
cgcagaguccucucacca

SEQ ID NO: 2241679 - RNA, 14 nt, Yersinia pestis
cgcaucagccagcc

SEQ ID NO: 2241680 - RNA, 23 nt, Yersinia pestis
cgcaucaaacggcaacuucuaca

SEQ ID NO: 2241681 - RNA, 14 nt, Yersinia pestis
cgcauuacccgaau

SEQ ID NO: 2241682 - RNA, 15 nt, Yersinia pestis
cgcauguucagccgc

SEQ ID NO: 2241683 - RNA, 13 nt, Yersinia pestis
cgccaccaaugca

SEQ ID NO: 2241684 - RNA, 18 nt, Yersinia pestis
cgcaugcaacagauaauu

SEQ ID NO: 2241685 - RNA, 17 nt, Yersinia pestis
cgcauccccaucgccaa

SEQ ID NO: 2241686 - RNA, 18 nt, Yersinia pestis
aaauuggcuucacccugg

SEQ ID NO: 2241687 - RNA, 23 nt, Yersinia pestis
aaauuggcuucacccuggcucug

SEQ ID NO: 2241688 - RNA, 18 nt, Yersinia pestis
ccggcuaaccacagcaau

SEQ ID NO: 2241689 - RNA, 15 nt, Yersinia pestis
ccgcuuugcguaaua

SEQ ID NO: 2241690 - RNA, 18 nt, Yersinia pestis
ccgcuuuagcgaugacca

SEQ ID NO: 2241691 - RNA, 22 nt, Yersinia pestis
ccuauaauuaacagcaucacug

SEQ ID NO: 2241692 - RNA, 21 nt, Yersinia pestis
ccuauaaacuugauucaccag

SEQ ID NO: 2241693 - RNA, 18 nt, Yersinia pestis
ccuaggcuauugacaaag

SEQ ID NO: 2241694 - RNA, 18 nt, Yersinia pestis
ccucaguaccugaagcua

SEQ ID NO: 2241695 - RNA, 23 nt, Yersinia pestis
ccucaugaaugaggcugagguug

SEQ ID NO: 2241696 - RNA, 12 nt, Yersinia pestis
ccuacugcauca

SEQ ID NO: 2241697 - RNA, 18 nt, Yersinia pestis
ccuaaaaacgucacuucg

SEQ ID NO: 2241698 - RNA, 16 nt, Yersinia pestis
ccguuuacucgcaaua

SEQ ID NO: 2241699 - RNA, 17 nt, Yersinia pestis
ccguuguguaucagcaa

SEQ ID NO: 2241700 - RNA, 21 nt, Yersinia pestis
ccguguuuuucccuaccguau

SEQ ID NO: 2241701 - RNA, 18 nt, Yersinia pestis
ccguuaugccaaccggau

SEQ ID NO: 2241702 - RNA, 20 nt, Yersinia pestis
ccguuauaccucaagcugca

SEQ ID NO: 2241703 - RNA, 14 nt, Yersinia pestis
ccguguacccguuc

SEQ ID NO: 2241704 - RNA, 17 nt, Yersinia pestis
ccgugguuauugcgcca

SEQ ID NO: 2241705 - RNA, 14 nt, Yersinia pestis
ccguucuuauugaa

SEQ ID NO: 2241706 - RNA, 19 nt, Yersinia pestis
ccggucugaauaccgcugg

SEQ ID NO: 2241707 - RNA, 13 nt, Yersinia pestis
ccggguaacgcca

SEQ ID NO: 2241708 - RNA, 22 nt, Yersinia pestis
ccguaacgguuacugcgcaaau

SEQ ID NO: 2241709 - RNA, 20 nt, Yersinia pestis
ccgucguacuuuaagcugca

SEQ ID NO: 2241710 - RNA, 21 nt, Yersinia pestis
ccgucgcgggcacuuugucaa

SEQ ID NO: 2241711 - RNA, 15 nt, Yersinia pestis
aaauucauuaucagg

SEQ ID NO: 2241712 - RNA, 13 nt, Yersinia pestis
aaauucaaauauc

SEQ ID NO: 2241713 - RNA, 22 nt, Yersinia pestis
aaauuauucaucguaucgugca

SEQ ID NO: 2241714 - RNA, 19 nt, Yersinia pestis
ccgcugugauuaagcguua

SEQ ID NO: 2241715 - RNA, 17 nt, Yersinia pestis
ccgcuggucgauaagca

SEQ ID NO: 2241716 - RNA, 15 nt, Yersinia pestis
aaauggcuaaacucu

SEQ ID NO: 2241717 - RNA, 20 nt, Yersinia pestis
aaaugucagaucgcgaugcg

SEQ ID NO: 2241718 - RNA, 14 nt, Yersinia pestis
ccgcgagcaauacc

SEQ ID NO: 2241719 - RNA, 13 nt, Yersinia pestis
ccgccauugccag

SEQ ID NO: 2241720 - RNA, 14 nt, Yersinia pestis
ccgcccaauacggc

SEQ ID NO: 2241721 - RNA, 19 nt, Yersinia pestis
ccgcaaucucuugacgccg

SEQ ID NO: 2241722 - RNA, 15 nt, Yersinia pestis
ccgcacacugacagc

SEQ ID NO: 2241723 - RNA, 19 nt, Yersinia pestis
ccgcagcagacaacugaca

SEQ ID NO: 2241724 - RNA, 18 nt, Yersinia pestis
ccgauggugccgucaaca

SEQ ID NO: 2241725 - RNA, 21 nt, Yersinia pestis
ccgaugguggcagccugcggc

SEQ ID NO: 2241726 - RNA, 13 nt, Yersinia pestis
ccgaucaccgcaa

SEQ ID NO: 2241727 - RNA, 20 nt, Yersinia pestis
aacagcgaaucaagcuacgc

SEQ ID NO: 2241728 - RNA, 12 nt, Yersinia pestis
cgcggguauccu

SEQ ID NO: 2241729 - RNA, 24 nt, Yersinia pestis
cgcgguuugguacaugcuguucac

SEQ ID NO: 2241730 - RNA, 18 nt, Yersinia pestis
cgcgguuggguucaauuc

SEQ ID NO: 2241731 - RNA, 13 nt, Yersinia pestis
cgcucaucgccaa

SEQ ID NO: 2241732 - RNA, 17 nt, Yersinia pestis
cgcuccacacccgccaa

SEQ ID NO: 2241733 - RNA, 13 nt, Yersinia pestis
cgcuaugcagccc

SEQ ID NO: 2241734 - RNA, 21 nt, Yersinia pestis
cgcuauccccacggcgacguu

SEQ ID NO: 2241735 - RNA, 15 nt, Yersinia pestis
cgcuacugagauaau

SEQ ID NO: 2241736 - RNA, 12 nt, Yersinia pestis
cgcgucaaucgg

SEQ ID NO: 2241737 - RNA, 21 nt, Yersinia pestis
cgcgcccauccgcaggaagca

SEQ ID NO: 2241738 - RNA, 18 nt, Yersinia pestis
aacagauauuacgcagcc

SEQ ID NO: 2241739 - RNA, 19 nt, Yersinia pestis
aacagagccuuauaggcgc

SEQ ID NO: 2241740 - RNA, 19 nt, Yersinia pestis
aacacguggguauccagug

SEQ ID NO: 2241741 - RNA, 23 nt, Yersinia pestis
aacacucuacuuucuacuccauu

SEQ ID NO: 2241742 - RNA, 14 nt, Yersinia pestis
aacacuggcagcca

SEQ ID NO: 2241743 - RNA, 19 nt, Yersinia pestis
aacacgggcaugaacgugu

SEQ ID NO: 2241744 - RNA, 17 nt, Yersinia pestis
cgccgugagcaaucugg

SEQ ID NO: 2241745 - RNA, 18 nt, Yersinia pestis
cgccgauggugugcagca

SEQ ID NO: 2241746 - RNA, 18 nt, Yersinia pestis
cgccccaacgguaacccg

SEQ ID NO: 2241747 - RNA, 22 nt, Yersinia pestis
cgcccggagcguacacgcaaua

SEQ ID NO: 2241748 - RNA, 18 nt, Yersinia pestis
cgccgacaauacugccaa

SEQ ID NO: 2241749 - RNA, 15 nt, Yersinia pestis
cgcccuccugcggcg

SEQ ID NO: 2241750 - RNA, 22 nt, Yersinia pestis
cggauaggcuuaauaugccaaa

SEQ ID NO: 2241751 - RNA, 19 nt, Yersinia pestis
cggauagccaaugcgcaaa

SEQ ID NO: 2241752 - RNA, 17 nt, Yersinia pestis
cggauaucgggcggaua

SEQ ID NO: 2241753 - RNA, 14 nt, Yersinia pestis
cggaucaucaacca

SEQ ID NO: 2241754 - RNA, 16 nt, Yersinia pestis
cggaggcgauuaaacg

SEQ ID NO: 2241755 - RNA, 20 nt, Yersinia pestis
cggagcugacgucagaucgc

SEQ ID NO: 2241756 - RNA, 17 nt, Yersinia pestis
cggacgccccaccgaua

SEQ ID NO: 2241757 - RNA, 18 nt, Yersinia pestis
cggaugguauucgauaug

SEQ ID NO: 2241758 - RNA, 16 nt, Yersinia pestis
cggauuugucugccgc

SEQ ID NO: 2241759 - RNA, 23 nt, Yersinia pestis
cggauuguucagcaaccgcauca

SEQ ID NO: 2241760 - RNA, 15 nt, Yersinia pestis
cggaugaucagccga

SEQ ID NO: 2241761 - RNA, 14 nt, Yersinia pestis
cggaugccagcuua

SEQ ID NO: 2241762 - RNA, 22 nt, Yersinia pestis
cggcaaugggucauugcgugca

SEQ ID NO: 2241763 - RNA, 13 nt, Yersinia pestis
aacaguaucaaua

SEQ ID NO: 2241764 - RNA, 16 nt, Yersinia pestis
cggcauccucagggcg

SEQ ID NO: 2241765 - RNA, 12 nt, Yersinia pestis
cggcaucagcaa

SEQ ID NO: 2241766 - RNA, 17 nt, Yersinia pestis
cggcaugguguagcuga

SEQ ID NO: 2241767 - RNA, 14 nt, Yersinia pestis
aacauuaacucauu

SEQ ID NO: 2241768 - RNA, 17 nt, Yersinia pestis
cgggaugcgcucgcuug

SEQ ID NO: 2241769 - RNA, 22 nt, Yersinia pestis
aacaugguuaagagaucccgug

SEQ ID NO: 2241770 - RNA, 14 nt, Yersinia pestis
cgggauaucgaugg

SEQ ID NO: 2241771 - RNA, 15 nt, Yersinia pestis
cgggacgcguuugcu

SEQ ID NO: 2241772 - RNA, 22 nt, Yersinia pestis
cggggaagagauaaaucggcgg

SEQ ID NO: 2241773 - RNA, 13 nt, Yersinia pestis
cggcgccgucacg

SEQ ID NO: 2241774 - RNA, 19 nt, Yersinia pestis
cggcgccgucacguacugg

SEQ ID NO: 2241775 - RNA, 14 nt, Yersinia pestis
ccauaaugccguua

SEQ ID NO: 2241776 - RNA, 19 nt, Yersinia pestis
ccauauacccaaagccagu

SEQ ID NO: 2241777 - RNA, 21 nt, Yersinia pestis
ccauagguacggguauagcgg

SEQ ID NO: 2241778 - RNA, 21 nt, Yersinia pestis
ccauaaugagugacaacauug

SEQ ID NO: 2241779 - RNA, 15 nt, Yersinia pestis
ccauaauaaugcgau

SEQ ID NO: 2241780 - RNA, 21 nt, Yersinia pestis
ccaguuugcgaccaauaccga

SEQ ID NO: 2241781 - RNA, 18 nt, Yersinia pestis
ccaucacggucaugcggc

SEQ ID NO: 2241782 - RNA, 22 nt, Yersinia pestis
ccaucaccccaacgcuggcugg

SEQ ID NO: 2241783 - RNA, 16 nt, Yersinia pestis
ccaucaggauuugcug

SEQ ID NO: 2241784 - RNA, 15 nt, Yersinia pestis
ccaucagcgauagcu

SEQ ID NO: 2241785 - RNA, 14 nt, Yersinia pestis
ccaucaagccaccg

SEQ ID NO: 2241786 - RNA, 13 nt, Yersinia pestis
ccaucaaccaccg

SEQ ID NO: 2241787 - RNA, 14 nt, Yersinia pestis
ccaucaacaugggc

SEQ ID NO: 2241788 - RNA, 23 nt, Yersinia pestis
ccaucaacucagggcuggcaccg

SEQ ID NO: 2241789 - RNA, 19 nt, Yersinia pestis
ccauauugauauagcggua

SEQ ID NO: 2241790 - RNA, 23 nt, Yersinia pestis
ccauauauucuguuguaaccagu

SEQ ID NO: 2241791 - RNA, 20 nt, Yersinia pestis
ccagugguuucccuucgcgc

SEQ ID NO: 2241792 - RNA, 20 nt, Yersinia pestis
ccagugcuuuauccaauggc

SEQ ID NO: 2241793 - RNA, 13 nt, Yersinia pestis
ccaguuauagcgg

SEQ ID NO: 2241794 - RNA, 21 nt, Yersinia pestis
ccagugcgcgauaaacgguag

SEQ ID NO: 2241795 - RNA, 12 nt, Yersinia pestis
ccagucagggcg

SEQ ID NO: 2241796 - RNA, 14 nt, Yersinia pestis
ccagucuaaacgcc

SEQ ID NO: 2241797 - RNA, 14 nt, Yersinia pestis
ccaguaacugauca

SEQ ID NO: 2241798 - RNA, 23 nt, Yersinia pestis
ccaugcuugucguauuuccagua

SEQ ID NO: 2241799 - RNA, 14 nt, Yersinia pestis
ccaucgaucugggc

SEQ ID NO: 2241800 - RNA, 16 nt, Yersinia pestis
ccauccccuguugauc

SEQ ID NO: 2241801 - RNA, 16 nt, Yersinia pestis
cccaaugucaggaaau

SEQ ID NO: 2241802 - RNA, 14 nt, Yersinia pestis
cccuuaucuacugg

SEQ ID NO: 2241803 - RNA, 22 nt, Yersinia pestis
cccugcuccaaagcuuccaaua

SEQ ID NO: 2241804 - RNA, 17 nt, Yersinia pestis
cccguaacuuaucgaca

SEQ ID NO: 2241805 - RNA, 20 nt, Yersinia pestis
cccguaauauuucaagcugu

SEQ ID NO: 2241806 - RNA, 23 nt, Yersinia pestis
cccguacaaaaauaaacgggcuu

SEQ ID NO: 2241807 - RNA, 16 nt, Yersinia pestis
cccucacgacgcgcuu

SEQ ID NO: 2241808 - RNA, 19 nt, Yersinia pestis
cccucucuuuccagcaaaa

SEQ ID NO: 2241809 - RNA, 19 nt, Yersinia pestis
ccccaguagcacaaugccu

SEQ ID NO: 2241810 - RNA, 11 nt, Yersinia pestis
cccgcgccgac

SEQ ID NO: 2241811 - RNA, 17 nt, Yersinia pestis
cccgcuaacaugccaca

SEQ ID NO: 2241812 - RNA, 12 nt, Yersinia pestis
ccaaaaccggca

SEQ ID NO: 2241813 - RNA, 18 nt, Yersinia pestis
ccaaacauuuucaucuga

SEQ ID NO: 2241814 - RNA, 18 nt, Yersinia pestis
ccaaaucucaucggcaua

SEQ ID NO: 2241815 - RNA, 22 nt, Yersinia pestis
ccaacaccacacugagcaccgc

SEQ ID NO: 2241816 - RNA, 24 nt, Yersinia pestis
ccaacucuuucaacuuccgcguua

SEQ ID NO: 2241817 - RNA, 15 nt, Yersinia pestis
ccaagcccaguaaag

SEQ ID NO: 2241818 - RNA, 18 nt, Yersinia pestis
cauuuuauugccagaggg

SEQ ID NO: 2241819 - RNA, 22 nt, Yersinia pestis
cauuugaguaaacauccggcug

SEQ ID NO: 2241820 - RNA, 23 nt, Yersinia pestis
cauuucugguugugcuucagaca

SEQ ID NO: 2241821 - RNA, 17 nt, Yersinia pestis
cauuuauauaacagcca

SEQ ID NO: 2241822 - RNA, 21 nt, Yersinia pestis
cauuuaucaagccaaugaauc

SEQ ID NO: 2241823 - RNA, 17 nt, Yersinia pestis
cauuuccguuaacccaa

SEQ ID NO: 2241824 - RNA, 19 nt, Yersinia pestis
cauuggugucccaaacucu

SEQ ID NO: 2241825 - RNA, 17 nt, Yersinia pestis
cauuguuggcggugaca

SEQ ID NO: 2241826 - RNA, 20 nt, Yersinia pestis
ccaauguuuaauuuccggua

SEQ ID NO: 2241827 - RNA, 12 nt, Yersinia pestis
ccaauucaguac

SEQ ID NO: 2241828 - RNA, 17 nt, Yersinia pestis
ccaauggcucaccuuuc

SEQ ID NO: 2241829 - RNA, 14 nt, Yersinia pestis
ccaauggcucaccu

SEQ ID NO: 2241830 - RNA, 18 nt, Yersinia pestis
ccaauuugggcauuaagu

SEQ ID NO: 2241831 - RNA, 15 nt, Yersinia pestis
ccaauuggcuuaacu

SEQ ID NO: 2241832 - RNA, 19 nt, Yersinia pestis
ccaauugaguaacugauua

SEQ ID NO: 2241833 - RNA, 16 nt, Yersinia pestis
ccacacauucagucac

SEQ ID NO: 2241834 - RNA, 14 nt, Yersinia pestis
ccacagugagaaac

SEQ ID NO: 2241835 - RNA, 23 nt, Yersinia pestis
ccacauagcugcgauaauccgcc

SEQ ID NO: 2241836 - RNA, 17 nt, Yersinia pestis
ccacaugagauucagga

SEQ ID NO: 2241837 - RNA, 16 nt, Yersinia pestis
ccaccaccacaccggc

SEQ ID NO: 2241838 - RNA, 16 nt, Yersinia pestis
cauuacugcggaucaa

SEQ ID NO: 2241839 - RNA, 12 nt, Yersinia pestis
cauuaaaggccg

SEQ ID NO: 2241840 - RNA, 22 nt, Yersinia pestis
cauuaaagauuucaucauucaa

SEQ ID NO: 2241841 - RNA, 19 nt, Yersinia pestis
cauugcagaaagcugaacu

SEQ ID NO: 2241842 - RNA, 18 nt, Yersinia pestis
cauucugcagauguauua

SEQ ID NO: 2241843 - RNA, 16 nt, Yersinia pestis
cauuccccaucgccaa

SEQ ID NO: 2241844 - RNA, 20 nt, Yersinia pestis
cauuauuauaggcguugaug

SEQ ID NO: 2241845 - RNA, 23 nt, Yersinia pestis
cauucaucccgguugcgauacag

SEQ ID NO: 2241846 - RNA, 14 nt, Yersinia pestis
cauucagaugcuga

SEQ ID NO: 2241847 - RNA, 20 nt, Yersinia pestis
caugcgaugcgagcaaggca

SEQ ID NO: 2241848 - RNA, 20 nt, Yersinia pestis
cauggaugguauuugacaug

SEQ ID NO: 2241849 - RNA, 19 nt, Yersinia pestis
cauggcgaucaccaguacg

SEQ ID NO: 2241850 - RNA, 22 nt, Yersinia pestis
aaauauccuccgacauagccgg

SEQ ID NO: 2241851 - RNA, 14 nt, Yersinia pestis
aaaucaagggcgau

SEQ ID NO: 2241852 - RNA, 13 nt, Yersinia pestis
ccagcccuacugg

SEQ ID NO: 2241853 - RNA, 23 nt, Yersinia pestis
aaauaguuagugaguuauucgcc

SEQ ID NO: 2241854 - RNA, 22 nt, Yersinia pestis
ccacgaguuuucccugcgccag

SEQ ID NO: 2241855 - RNA, 21 nt, Yersinia pestis
aaaguuuuuccucaaacguga

SEQ ID NO: 2241856 - RNA, 13 nt, Yersinia pestis
aaauaaauacucu

SEQ ID NO: 2241857 - RNA, 19 nt, Yersinia pestis
aaauaaagggccugcaaac

SEQ ID NO: 2241858 - RNA, 21 nt, Yersinia pestis
ccacuucgcggggcguauuau

SEQ ID NO: 2241859 - RNA, 17 nt, Yersinia pestis
ccacuagguccauaaug

SEQ ID NO: 2241860 - RNA, 21 nt, Yersinia pestis
ccagauaaucgccaauaaccg

SEQ ID NO: 2241861 - RNA, 18 nt, Yersinia pestis
ccagcaauaaaccacugg

SEQ ID NO: 2241862 - RNA, 18 nt, Yersinia pestis
ccagacccugcaccacgc

SEQ ID NO: 2241863 - RNA, 22 nt, Yersinia pestis
ccagagcgcggcuucagcaccu

SEQ ID NO: 2241864 - RNA, 19 nt, Yersinia pestis
ccagagcguuucaguauug

SEQ ID NO: 2241865 - RNA, 12 nt, Yersinia pestis
cagacugcugac

SEQ ID NO: 2241866 - RNA, 15 nt, Yersinia pestis
cagacugcugacaaa

SEQ ID NO: 2241867 - RNA, 17 nt, Yersinia pestis
cagacgaaccgcuuuga

SEQ ID NO: 2241868 - RNA, 16 nt, Yersinia pestis
cagacgaaagauaauu

SEQ ID NO: 2241869 - RNA, 17 nt, Yersinia pestis
cacuuuuauccagccau

SEQ ID NO: 2241870 - RNA, 15 nt, Yersinia pestis
cacuuacugaucaau

SEQ ID NO: 2241871 - RNA, 13 nt, Yersinia pestis
cagaaaauaccgc

SEQ ID NO: 2241872 - RNA, 17 nt, Yersinia pestis
cagaaacggcaucugcc

SEQ ID NO: 2241873 - RNA, 18 nt, Yersinia pestis
cacguuaaauuucuucaa

SEQ ID NO: 2241874 - RNA, 16 nt, Yersinia pestis
cacguggguauccagu

SEQ ID NO: 2241875 - RNA, 19 nt, Yersinia pestis
cacgcuauccgcgccgagc

SEQ ID NO: 2241876 - RNA, 13 nt, Yersinia pestis
caccuaucgccgc

SEQ ID NO: 2241877 - RNA, 17 nt, Yersinia pestis
caccuaacuuccuaaca

SEQ ID NO: 2241878 - RNA, 20 nt, Yersinia pestis
caccuaccgguguugagguc

SEQ ID NO: 2241879 - RNA, 19 nt, Yersinia pestis
caccuaccaccuacaaccu

SEQ ID NO: 2241880 - RNA, 16 nt, Yersinia pestis
caccguugauugauaa

SEQ ID NO: 2241881 - RNA, 14 nt, Yersinia pestis
aaacuuguaucaaa

SEQ ID NO: 2241882 - RNA, 14 nt, Yersinia pestis
cacggcggccguca

SEQ ID NO: 2241883 - RNA, 14 nt, Yersinia pestis
cagcauauugagca

SEQ ID NO: 2241884 - RNA, 22 nt, Yersinia pestis
cagcauacgugccaaaaugccu

SEQ ID NO: 2241885 - RNA, 17 nt, Yersinia pestis
cagcagucugaaacgcc

SEQ ID NO: 2241886 - RNA, 16 nt, Yersinia pestis
cagcagucugacaccg

SEQ ID NO: 2241887 - RNA, 16 nt, Yersinia pestis
cagcagucugagccuc

SEQ ID NO: 2241888 - RNA, 17 nt, Yersinia pestis
cagcaggcguagcgugu

SEQ ID NO: 2241889 - RNA, 19 nt, Yersinia pestis
cagauacuuucggguaucu

SEQ ID NO: 2241890 - RNA, 15 nt, Yersinia pestis
cagcaaccgcaucau

SEQ ID NO: 2241891 - RNA, 16 nt, Yersinia pestis
cagcacagagcacaac

SEQ ID NO: 2241892 - RNA, 21 nt, Yersinia pestis
cagcacagagcacaacggaag

SEQ ID NO: 2241893 - RNA, 13 nt, Yersinia pestis
cagcaccauacag

SEQ ID NO: 2241894 - RNA, 17 nt, Yersinia pestis
cagccucuaacauacuc

SEQ ID NO: 2241895 - RNA, 15 nt, Yersinia pestis
cagccugguugguaa

SEQ ID NO: 2241896 - RNA, 17 nt, Yersinia pestis
cagccguuucuuucaau

SEQ ID NO: 2241897 - RNA, 14 nt, Yersinia pestis
cagccuauccucac

SEQ ID NO: 2241898 - RNA, 21 nt, Yersinia pestis
cagcgaaaaauuucacuggca

SEQ ID NO: 2241899 - RNA, 23 nt, Yersinia pestis
cagccaucaguucacugaauccc

SEQ ID NO: 2241900 - RNA, 11 nt, Yersinia pestis
cagccauuacc

SEQ ID NO: 2241901 - RNA, 12 nt, Yersinia pestis
cagcucaauacg

SEQ ID NO: 2241902 - RNA, 20 nt, Yersinia pestis
cagcgucagcagauugauaa

SEQ ID NO: 2241903 - RNA, 17 nt, Yersinia pestis
cagcugggauaugccgu

SEQ ID NO: 2241904 - RNA, 21 nt, Yersinia pestis
cagcuuauaggucauugguua

SEQ ID NO: 2241905 - RNA, 17 nt, Yersinia pestis
aaagcauggcagguauc

SEQ ID NO: 2241906 - RNA, 12 nt, Yersinia pestis
aaagccaucgcc

SEQ ID NO: 2241907 - RNA, 13 nt, Yersinia pestis
aaagcccaucgcc

SEQ ID NO: 2241908 - RNA, 13 nt, Yersinia pestis
cagcuuguugaua

SEQ ID NO: 2241909 - RNA, 13 nt, Yersinia pestis
caggaaacuggcc

SEQ ID NO: 2241910 - RNA, 13 nt, Yersinia pestis
caggaagcggcca

SEQ ID NO: 2241911 - RNA, 14 nt, Yersinia pestis
cauaauaaugcgau

SEQ ID NO: 2241912 - RNA, 21 nt, Yersinia pestis
cauaacaauuaauuggcucau

SEQ ID NO: 2241913 - RNA, 18 nt, Yersinia pestis
cauaaauuaaaacugaaa

SEQ ID NO: 2241914 - RNA, 21 nt, Yersinia pestis
cauaagcggacauggcaacag

SEQ ID NO: 2241915 - RNA, 22 nt, Yersinia pestis
cauaaaucccgagacacucauc

SEQ ID NO: 2241916 - RNA, 16 nt, Yersinia pestis
cauaauccagaagcca

SEQ ID NO: 2241917 - RNA, 19 nt, Yersinia pestis
caguuugaucgcuaaucgc

SEQ ID NO: 2241918 - RNA, 23 nt, Yersinia pestis
cauaaaaauacauaucaacacug

SEQ ID NO: 2241919 - RNA, 14 nt, Yersinia pestis
cauaaaacgauuuu

SEQ ID NO: 2241920 - RNA, 16 nt, Yersinia pestis
cauauaagcaauaccg

SEQ ID NO: 2241921 - RNA, 17 nt, Yersinia pestis
cauauaagcaauaccga

SEQ ID NO: 2241922 - RNA, 19 nt, Yersinia pestis
cauauaaaccagccaguga

SEQ ID NO: 2241923 - RNA, 17 nt, Yersinia pestis
cauaggucuuuacgcag

SEQ ID NO: 2241924 - RNA, 18 nt, Yersinia pestis
cauaugaaaaaccuccgg

SEQ ID NO: 2241925 - RNA, 21 nt, Yersinia pestis
cauaugaaaaaccuccggcua

SEQ ID NO: 2241926 - RNA, 13 nt, Yersinia pestis
cauaucggccaag

SEQ ID NO: 2241927 - RNA, 15 nt, Yersinia pestis
cauaucgaucaacca

SEQ ID NO: 2241928 - RNA, 12 nt, Yersinia pestis
cauauauugauc

SEQ ID NO: 2241929 - RNA, 20 nt, Yersinia pestis
cauauauuuuucuuucucga

SEQ ID NO: 2241930 - RNA, 21 nt, Yersinia pestis
cauauauugauccaaauggcu

SEQ ID NO: 2241931 - RNA, 19 nt, Yersinia pestis
cauaucaaaaggauaaccu

SEQ ID NO: 2241932 - RNA, 17 nt, Yersinia pestis
caucaaaggcaauaccg

SEQ ID NO: 2241933 - RNA, 18 nt, Yersinia pestis
caucaaaggcaauaccgg

SEQ ID NO: 2241934 - RNA, 22 nt, Yersinia pestis
caucaauaaaauuacccagcau

SEQ ID NO: 2241935 - RNA, 13 nt, Yersinia pestis
caucaaguauuuu

SEQ ID NO: 2241936 - RNA, 21 nt, Yersinia pestis
cauccacauauauagagaaau

SEQ ID NO: 2241937 - RNA, 15 nt, Yersinia pestis
cauccacugcggcca

SEQ ID NO: 2241938 - RNA, 17 nt, Yersinia pestis
caucacccaacguggcu

SEQ ID NO: 2241939 - RNA, 15 nt, Yersinia pestis
caucacccagcaaaa

SEQ ID NO: 2241940 - RNA, 14 nt, Yersinia pestis
caucauaacgaaug

SEQ ID NO: 2241941 - RNA, 20 nt, Yersinia pestis
caucauaagacuaacagaau

SEQ ID NO: 2241942 - RNA, 13 nt, Yersinia pestis
caucauaucgaug

SEQ ID NO: 2241943 - RNA, 20 nt, Yersinia pestis
caucaucaaaugaauaaccu

SEQ ID NO: 2241944 - RNA, 19 nt, Yersinia pestis
caucaucaauuaauacccu

SEQ ID NO: 2241945 - RNA, 20 nt, Yersinia pestis
caucaucacaaauaacccgc

SEQ ID NO: 2241946 - RNA, 16 nt, Yersinia pestis
caucaugaucugauac

SEQ ID NO: 2241947 - RNA, 20 nt, Yersinia pestis
caucgccaauacaaucguca

SEQ ID NO: 2241948 - RNA, 20 nt, Yersinia pestis
caucgaggaauagccagcgu

SEQ ID NO: 2241949 - RNA, 22 nt, Yersinia pestis
cagugggcagggcgcaauggcg

SEQ ID NO: 2241950 - RNA, 17 nt, Yersinia pestis
caguggucaucaccguu

SEQ ID NO: 2241951 - RNA, 21 nt, Yersinia pestis
caguucauuccccaucgccaa

SEQ ID NO: 2241952 - RNA, 19 nt, Yersinia pestis
caguucauaucgauaccga

SEQ ID NO: 2241953 - RNA, 21 nt, Yersinia pestis
caguucagcccccucaauacc

SEQ ID NO: 2241954 - RNA, 17 nt, Yersinia pestis
caguaauucacugcuua

SEQ ID NO: 2241955 - RNA, 21 nt, Yersinia pestis
caguaagguauugauacagua

SEQ ID NO: 2241956 - RNA, 15 nt, Yersinia pestis
caguaacugaucaau

SEQ ID NO: 2241957 - RNA, 22 nt, Yersinia pestis
caguaaccccuucgagcaccgc

SEQ ID NO: 2241958 - RNA, 20 nt, Yersinia pestis
caggugaacguuggcuucac

SEQ ID NO: 2241959 - RNA, 19 nt, Yersinia pestis
cagguauuucuccauugcg

SEQ ID NO: 2241960 - RNA, 14 nt, Yersinia pestis
cagguaaauagcca

SEQ ID NO: 2241961 - RNA, 21 nt, Yersinia pestis
cagguaacgccgcuguagcgc

SEQ ID NO: 2241962 - RNA, 14 nt, Yersinia pestis
caauuacugcauug

SEQ ID NO: 2241963 - RNA, 17 nt, Yersinia pestis
caauuacuuuggcauuu

SEQ ID NO: 2241964 - RNA, 15 nt, Yersinia pestis
caauuuucccucugc

SEQ ID NO: 2241965 - RNA, 14 nt, Yersinia pestis
caauuuuauggaua

SEQ ID NO: 2241966 - RNA, 15 nt, Yersinia pestis
caauucucccauuua

SEQ ID NO: 2241967 - RNA, 13 nt, Yersinia pestis
caauugaucaggg

SEQ ID NO: 2241968 - RNA, 15 nt, Yersinia pestis
caauucaugcaucuc

SEQ ID NO: 2241969 - RNA, 19 nt, Yersinia pestis
caaguaaaagucagcaaau

SEQ ID NO: 2241970 - RNA, 22 nt, Yersinia pestis
caauauauacccguaauauuuc

SEQ ID NO: 2241971 - RNA, 15 nt, Yersinia pestis
caauauucgcagcca

SEQ ID NO: 2241972 - RNA, 16 nt, Yersinia pestis
caauauggguauugag

SEQ ID NO: 2241973 - RNA, 18 nt, Yersinia pestis
caaucacuucugcugcca

SEQ ID NO: 2241974 - RNA, 20 nt, Yersinia pestis
caauccgaccacugacaaaa

SEQ ID NO: 2241975 - RNA, 17 nt, Yersinia pestis
caagacgauaucgacgc

SEQ ID NO: 2241976 - RNA, 19 nt, Yersinia pestis
caacugcucaacugcucaa

SEQ ID NO: 2241977 - RNA, 12 nt, Yersinia pestis
caaggcuaaccg

SEQ ID NO: 2241978 - RNA, 14 nt, Yersinia pestis
caaggccuuguggc

SEQ ID NO: 2241979 - RNA, 15 nt, Yersinia pestis
caacguuuuaccugc

SEQ ID NO: 2241980 - RNA, 22 nt, Yersinia pestis
caacuaauucuuaggauaacca

SEQ ID NO: 2241981 - RNA, 22 nt, Yersinia pestis
caacugauuuuuauggcagaaa

SEQ ID NO: 2241982 - RNA, 19 nt, Yersinia pestis
caacugaaaccgaucacua

SEQ ID NO: 2241983 - RNA, 14 nt, Yersinia pestis
caacggugaacaga

SEQ ID NO: 2241984 - RNA, 17 nt, Yersinia pestis
caacccgauccagaaua

SEQ ID NO: 2241985 - RNA, 21 nt, Yersinia pestis
caacgcuuacguuuugagguu

SEQ ID NO: 2241986 - RNA, 13 nt, Yersinia pestis
caacgcuuaucaa

SEQ ID NO: 2241987 - RNA, 20 nt, Yersinia pestis
caacgcagacaugauuaaau

SEQ ID NO: 2241988 - RNA, 23 nt, Yersinia pestis
caacgcacgauccgcccauugcg

SEQ ID NO: 2241989 - RNA, 14 nt, Yersinia pestis
caacgaaacacacu

SEQ ID NO: 2241990 - RNA, 21 nt, Yersinia pestis
caaaugaccguacaucuggcc

SEQ ID NO: 2241991 - RNA, 16 nt, Yersinia pestis
caaaucuggauaaugu

SEQ ID NO: 2241992 - RNA, 17 nt, Yersinia pestis
caaauagaucggguaaa

SEQ ID NO: 2241993 - RNA, 21 nt, Yersinia pestis
caaaugcugacugaacgccuc

SEQ ID NO: 2241994 - RNA, 20 nt, Yersinia pestis
caacaaauucaccagcaaua

SEQ ID NO: 2241995 - RNA, 19 nt, Yersinia pestis
caaagcauucgcgguuaca

SEQ ID NO: 2241996 - RNA, 18 nt, Yersinia pestis
auuuacguuuuuugcggu

SEQ ID NO: 2241997 - RNA, 23 nt, Yersinia pestis
caaauaaguguuucaaauaagua

SEQ ID NO: 2241998 - RNA, 18 nt, Yersinia pestis
caacauaaauaggccgcc

SEQ ID NO: 2241999 - RNA, 13 nt, Yersinia pestis
caacaucacaucc

SEQ ID NO: 2242000 - RNA, 20 nt, Yersinia pestis
caacauccaguucgaccaau

SEQ ID NO: 2242001 - RNA, 18 nt, Yersinia pestis
caacaguaaaccggcuaa

SEQ ID NO: 2242002 - RNA, 20 nt, Yersinia pestis
caccaaagcaaugaauaccc

SEQ ID NO: 2242003 - RNA, 15 nt, Yersinia pestis
caccaacagcauuac

SEQ ID NO: 2242004 - RNA, 14 nt, Yersinia pestis
caccaaccaaccau

SEQ ID NO: 2242005 - RNA, 23 nt, Yersinia pestis
cacauuucaaauuaucgaucaca

SEQ ID NO: 2242006 - RNA, 17 nt, Yersinia pestis
cacaucacagugccaaa

SEQ ID NO: 2242007 - RNA, 15 nt, Yersinia pestis
cacauauuucauuag

SEQ ID NO: 2242008 - RNA, 20 nt, Yersinia pestis
cacagccugccgggaugacu

SEQ ID NO: 2242009 - RNA, 21 nt, Yersinia pestis
caccauuggcgaucgcgccaa

SEQ ID NO: 2242010 - RNA, 20 nt, Yersinia pestis
caccaugccuucugaaaccc

SEQ ID NO: 2242011 - RNA, 15 nt, Yersinia pestis
caccccuauuaggga

SEQ ID NO: 2242012 - RNA, 12 nt, Yersinia pestis
caccgcauucca

SEQ ID NO: 2242013 - RNA, 21 nt, Yersinia pestis
cacccuuuacgcauugguaua

SEQ ID NO: 2242014 - RNA, 17 nt, Yersinia pestis
caccggcccaacuggcg

SEQ ID NO: 2242015 - RNA, 23 nt, Yersinia pestis
caccggcgagaaggauugaccaa

SEQ ID NO: 2242016 - RNA, 17 nt, Yersinia pestis
auguugcacugacggca

SEQ ID NO: 2242017 - RNA, 22 nt, Yersinia pestis
auguuuacggcauuagugaauc

SEQ ID NO: 2242018 - RNA, 14 nt, Yersinia pestis
auguuguucaaugc

SEQ ID NO: 2242019 - RNA, 18 nt, Yersinia pestis
auguuuuuccuucaguuc

SEQ ID NO: 2242020 - RNA, 12 nt, Yersinia pestis
auuaaaacugaa

SEQ ID NO: 2242021 - RNA, 11 nt, Yersinia pestis
auuaaacugaa

SEQ ID NO: 2242022 - RNA, 14 nt, Yersinia pestis
auguucagccgcuc

SEQ ID NO: 2242023 - RNA, 14 nt, Yersinia pestis
auguguugaauauc

SEQ ID NO: 2242024 - RNA, 18 nt, Yersinia pestis
auguguuuguaccgauuu

SEQ ID NO: 2242025 - RNA, 14 nt, Yersinia pestis
auguggauaauuuc

SEQ ID NO: 2242026 - RNA, 23 nt, Yersinia pestis
auuauuuagccugccaauaucca

SEQ ID NO: 2242027 - RNA, 16 nt, Yersinia pestis
auucaaacggugugca

SEQ ID NO: 2242028 - RNA, 19 nt, Yersinia pestis
auuauugacgguuacagcg

SEQ ID NO: 2242029 - RNA, 17 nt, Yersinia pestis
auuaucccguucaauaa

SEQ ID NO: 2242030 - RNA, 14 nt, Yersinia pestis
auuauccauccccg

SEQ ID NO: 2242031 - RNA, 15 nt, Yersinia pestis
auucaguaacaacau

SEQ ID NO: 2242032 - RNA, 14 nt, Yersinia pestis
auucaaaguugccg

SEQ ID NO: 2242033 - RNA, 16 nt, Yersinia pestis
auucaacgccaauacc

SEQ ID NO: 2242034 - RNA, 20 nt, Yersinia pestis
auucaacagccuuucccuga

SEQ ID NO: 2242035 - RNA, 20 nt, Yersinia pestis
auuaaccuaaaaacgucacu

SEQ ID NO: 2242036 - RNA, 12 nt, Yersinia pestis
auuaacaagcga

SEQ ID NO: 2242037 - RNA, 21 nt, Yersinia pestis
auuaagccgacucgaacuugu

SEQ ID NO: 2242038 - RNA, 23 nt, Yersinia pestis
auuaaguccaagaagauaacuuu

SEQ ID NO: 2242039 - RNA, 11 nt, Yersinia pestis
auuaacugcag

SEQ ID NO: 2242040 - RNA, 18 nt, Yersinia pestis
auuaguuuuagaugucag

SEQ ID NO: 2242041 - RNA, 22 nt, Yersinia pestis
auuagccugaccgguaauaucg

SEQ ID NO: 2242042 - RNA, 14 nt, Yersinia pestis
auuaauaacgccga

SEQ ID NO: 2242043 - RNA, 16 nt, Yersinia pestis
auuagccgaauauccc

SEQ ID NO: 2242044 - RNA, 21 nt, Yersinia pestis
auuaauaauaacgucgccagu

SEQ ID NO: 2242045 - RNA, 18 nt, Yersinia pestis
auuagccagccaauggcc

SEQ ID NO: 2242046 - RNA, 15 nt, Yersinia pestis
auugaagacaaugcc

SEQ ID NO: 2242047 - RNA, 16 nt, Yersinia pestis
auugagaaucacuacg

SEQ ID NO: 2242048 - RNA, 22 nt, Yersinia pestis
auugagaagaaaucauuuaggc

SEQ ID NO: 2242049 - RNA, 21 nt, Yersinia pestis
auugagcaggcucuucucuga

SEQ ID NO: 2242050 - RNA, 13 nt, Yersinia pestis
auugaggugguaa

SEQ ID NO: 2242051 - RNA, 13 nt, Yersinia pestis
auugagguugccg

SEQ ID NO: 2242052 - RNA, 23 nt, Yersinia pestis
auucuguuuccucuucaucuaca

SEQ ID NO: 2242053 - RNA, 13 nt, Yersinia pestis
auugaauaacuuc

SEQ ID NO: 2242054 - RNA, 14 nt, Yersinia pestis
auuccguggcuuag

SEQ ID NO: 2242055 - RNA, 13 nt, Yersinia pestis
auugcucaucaac

SEQ ID NO: 2242056 - RNA, 20 nt, Yersinia pestis
auugcacgguauagcuauca

SEQ ID NO: 2242057 - RNA, 17 nt, Yersinia pestis
auuuaccuccauauccu

SEQ ID NO: 2242058 - RNA, 21 nt, Yersinia pestis
auuguucaauaggccagcaau

SEQ ID NO: 2242059 - RNA, 22 nt, Yersinia pestis
auuguugaauaccaagccaaau

SEQ ID NO: 2242060 - RNA, 22 nt, Yersinia pestis
auugguuauccuauucagcagc

SEQ ID NO: 2242061 - RNA, 13 nt, Yersinia pestis
auuggagucauga

SEQ ID NO: 2242062 - RNA, 21 nt, Yersinia pestis
augaugaagcauuaaacagau

SEQ ID NO: 2242063 - RNA, 19 nt, Yersinia pestis
augauggcguuuucuucga

SEQ ID NO: 2242064 - RNA, 18 nt, Yersinia pestis
augcguaucauuauugau

SEQ ID NO: 2242065 - RNA, 13 nt, Yersinia pestis
auggccaccauua

SEQ ID NO: 2242066 - RNA, 15 nt, Yersinia pestis
auggccauuaccccg

SEQ ID NO: 2242067 - RNA, 21 nt, Yersinia pestis
auggcuugcucaauaccauug

SEQ ID NO: 2242068 - RNA, 14 nt, Yersinia pestis
auggcuuuacgcaa

SEQ ID NO: 2242069 - RNA, 15 nt, Yersinia pestis
auguagaaguugccg

SEQ ID NO: 2242070 - RNA, 21 nt, Yersinia pestis
auguacguucagguaucgcuu

SEQ ID NO: 2242071 - RNA, 13 nt, Yersinia pestis
augguggcagccu

SEQ ID NO: 2242072 - RNA, 14 nt, Yersinia pestis
aucgcucaucgcca

SEQ ID NO: 2242073 - RNA, 19 nt, Yersinia pestis
aucggaaccaccaagaacg

SEQ ID NO: 2242074 - RNA, 14 nt, Yersinia pestis
aucggaauccauua

SEQ ID NO: 2242075 - RNA, 21 nt, Yersinia pestis
aucgcgggcgcgcugcugcuc

SEQ ID NO: 2242076 - RNA, 19 nt, Yersinia pestis
aucgccugcugagccaaau

SEQ ID NO: 2242077 - RNA, 13 nt, Yersinia pestis
aucgccugcacac

SEQ ID NO: 2242078 - RNA, 15 nt, Yersinia pestis
aucgccgccgccagc

SEQ ID NO: 2242079 - RNA, 14 nt, Yersinia pestis
aucgauuucuacgg

SEQ ID NO: 2242080 - RNA, 12 nt, Yersinia pestis
aucgcaauuuca

SEQ ID NO: 2242081 - RNA, 16 nt, Yersinia pestis
aucgcacugaguucug

SEQ ID NO: 2242082 - RNA, 13 nt, Yersinia pestis
aucgccauagccg

SEQ ID NO: 2242083 - RNA, 23 nt, Yersinia pestis
aucaggccgguauucagccaaau

SEQ ID NO: 2242084 - RNA, 13 nt, Yersinia pestis
aucgaccaacugg

SEQ ID NO: 2242085 - RNA, 16 nt, Yersinia pestis
aucaggcgcacgaaua

SEQ ID NO: 2242086 - RNA, 20 nt, Yersinia pestis
aucgaguugaugcaauggca

SEQ ID NO: 2242087 - RNA, 16 nt, Yersinia pestis
aucguuuuauggcgau

SEQ ID NO: 2242088 - RNA, 20 nt, Yersinia pestis
aucguuggugcgacaaagau

SEQ ID NO: 2242089 - RNA, 17 nt, Yersinia pestis
aucuauaaacuucacga

SEQ ID NO: 2242090 - RNA, 22 nt, Yersinia pestis
aucuacauaaucuuuacugcau

SEQ ID NO: 2242091 - RNA, 14 nt, Yersinia pestis
aucggguagcaucc

SEQ ID NO: 2242092 - RNA, 14 nt, Yersinia pestis
aucgucacgaucaa

SEQ ID NO: 2242093 - RNA, 21 nt, Yersinia pestis
aucgucagccccugccagaau

SEQ ID NO: 2242094 - RNA, 18 nt, Yersinia pestis
augacuaucccuucaauc

SEQ ID NO: 2242095 - RNA, 17 nt, Yersinia pestis
augacuuagcacggcau

SEQ ID NO: 2242096 - RNA, 15 nt, Yersinia pestis
augagucagucuguu

SEQ ID NO: 2242097 - RNA, 12 nt, Yersinia pestis
augaucaacagu

SEQ ID NO: 2242098 - RNA, 17 nt, Yersinia pestis
augaucagccgauguuu

SEQ ID NO: 2242099 - RNA, 21 nt, Yersinia pestis
aucuuucaaguccugcuucaa

SEQ ID NO: 2242100 - RNA, 18 nt, Yersinia pestis
augaaugaggcugagguu

SEQ ID NO: 2242101 - RNA, 13 nt, Yersinia pestis
augacccaaugga

SEQ ID NO: 2242102 - RNA, 18 nt, Yersinia pestis
augaccaucuuccagcau

SEQ ID NO: 2242103 - RNA, 13 nt, Yersinia pestis
augaccgccagug

SEQ ID NO: 2242104 - RNA, 23 nt, Yersinia pestis
aucuuaugacgcugcaccgcuga

SEQ ID NO: 2242105 - RNA, 16 nt, Yersinia pestis
aucuguuuuugccacc

SEQ ID NO: 2242106 - RNA, 20 nt, Yersinia pestis
aucuuccgucaguugcccgu

SEQ ID NO: 2242107 - RNA, 17 nt, Yersinia pestis
aucuggucugccagaau

SEQ ID NO: 2242108 - RNA, 12 nt, Yersinia pestis
auaccuuacugc

SEQ ID NO: 2242109 - RNA, 12 nt, Yersinia pestis
auaccuuacugu

SEQ ID NO: 2242110 - RNA, 14 nt, Yersinia pestis
auacgaucagcaag

SEQ ID NO: 2242111 - RNA, 21 nt, Yersinia pestis
auacccguaauauuucaagcu

SEQ ID NO: 2242112 - RNA, 20 nt, Yersinia pestis
auacaucgcuggacgcauca

SEQ ID NO: 2242113 - RNA, 12 nt, Yersinia pestis
auacauggcgau

SEQ ID NO: 2242114 - RNA, 13 nt, Yersinia pestis
auaccaacagcag

SEQ ID NO: 2242115 - RNA, 20 nt, Yersinia pestis
auaauagaggguaaccgccg

SEQ ID NO: 2242116 - RNA, 20 nt, Yersinia pestis
auaauagauaacaaacuacu

SEQ ID NO: 2242117 - RNA, 14 nt, Yersinia pestis
auaauaaauauccu

SEQ ID NO: 2242118 - RNA, 18 nt, Yersinia pestis
auaauuucagcagcacgu

SEQ ID NO: 2242119 - RNA, 21 nt, Yersinia pestis
auaauuuagcaaagcgauauc

SEQ ID NO: 2242120 - RNA, 17 nt, Yersinia pestis
auaacguuucagggugg

SEQ ID NO: 2242121 - RNA, 14 nt, Yersinia pestis
auaagcaggaaugc

SEQ ID NO: 2242122 - RNA, 16 nt, Yersinia pestis
auaaccugauauuggg

SEQ ID NO: 2242123 - RNA, 18 nt, Yersinia pestis
auaaccaugaugacaaug

SEQ ID NO: 2242124 - RNA, 14 nt, Yersinia pestis
aguuugaucacagc

SEQ ID NO: 2242125 - RNA, 23 nt, Yersinia pestis
aguuuauuuuauuuaaucaucga

SEQ ID NO: 2242126 - RNA, 19 nt, Yersinia pestis
auaaccacaacgacagcca

SEQ ID NO: 2242127 - RNA, 12 nt, Yersinia pestis
auaacagauauu

SEQ ID NO: 2242128 - RNA, 21 nt, Yersinia pestis
auaacagauauuacgcagcca

SEQ ID NO: 2242129 - RNA, 12 nt, Yersinia pestis
auaacagcuaau

SEQ ID NO: 2242130 - RNA, 19 nt, Yersinia pestis
auaacagggaggccagcaa

SEQ ID NO: 2242131 - RNA, 13 nt, Yersinia pestis
agugugaugaugg

SEQ ID NO: 2242132 - RNA, 19 nt, Yersinia pestis
aguucauuuugaccagcau

SEQ ID NO: 2242133 - RNA, 14 nt, Yersinia pestis
aguugaaccaauga

SEQ ID NO: 2242134 - RNA, 17 nt, Yersinia pestis
aguugcaguucaucaau

SEQ ID NO: 2242135 - RNA, 15 nt, Yersinia pestis
aguugcagugggccu

SEQ ID NO: 2242136 - RNA, 23 nt, Yersinia pestis
aguugcagaagggcggccagcaa

SEQ ID NO: 2242137 - RNA, 17 nt, Yersinia pestis
agucugagccucaugaa

SEQ ID NO: 2242138 - RNA, 14 nt, Yersinia pestis
agugaacaugauga

SEQ ID NO: 2242139 - RNA, 18 nt, Yersinia pestis
agugaaaacguuaacugc

SEQ ID NO: 2242140 - RNA, 20 nt, Yersinia pestis
agugaaaacguuaacugcag

SEQ ID NO: 2242141 - RNA, 14 nt, Yersinia pestis
agugaaucgccguu

SEQ ID NO: 2242142 - RNA, 19 nt, Yersinia pestis
agucucgcagccgccagua

SEQ ID NO: 2242143 - RNA, 16 nt, Yersinia pestis
aguggacacgccguuu

SEQ ID NO: 2242144 - RNA, 16 nt, Yersinia pestis
agugcucccugaacgc

SEQ ID NO: 2242145 - RNA, 17 nt, Yersinia pestis
auagaugcaaaugucag

SEQ ID NO: 2242146 - RNA, 15 nt, Yersinia pestis
auagauuuucagcgc

SEQ ID NO: 2242147 - RNA, 23 nt, Yersinia pestis
auagccagaugucccagaaauau

SEQ ID NO: 2242148 - RNA, 21 nt, Yersinia pestis
auagccgaaccccuagccagc

SEQ ID NO: 2242149 - RNA, 19 nt, Yersinia pestis
auacuauuccgucgauauc

SEQ ID NO: 2242150 - RNA, 21 nt, Yersinia pestis
auacguucguagccacgaucg

SEQ ID NO: 2242151 - RNA, 19 nt, Yersinia pestis
auacuggcauacagcucau

SEQ ID NO: 2242152 - RNA, 15 nt, Yersinia pestis
auagcgaucagcaac

SEQ ID NO: 2242153 - RNA, 22 nt, Yersinia pestis
auagguauacaccucaacguga

SEQ ID NO: 2242154 - RNA, 16 nt, Yersinia pestis
auagggcugucagcca

SEQ ID NO: 2242155 - RNA, 19 nt, Yersinia pestis
auaggcguuaucggcgcag

SEQ ID NO: 2242156 - RNA, 22 nt, Yersinia pestis
auauaaauccagcccacuggcc

SEQ ID NO: 2242157 - RNA, 13 nt, Yersinia pestis
auauuaauccaua

SEQ ID NO: 2242158 - RNA, 18 nt, Yersinia pestis
aucaaaggcaauaccggu

SEQ ID NO: 2242159 - RNA, 16 nt, Yersinia pestis
aucaacguaauacccu

SEQ ID NO: 2242160 - RNA, 17 nt, Yersinia pestis
aucacaucggcgacuuu

SEQ ID NO: 2242161 - RNA, 18 nt, Yersinia pestis
aucacauccccugccguu

SEQ ID NO: 2242162 - RNA, 16 nt, Yersinia pestis
aucacacccagcgaac

SEQ ID NO: 2242163 - RNA, 12 nt, Yersinia pestis
aucacaauacag

SEQ ID NO: 2242164 - RNA, 12 nt, Yersinia pestis
aucaagccgcuu

SEQ ID NO: 2242165 - RNA, 18 nt, Yersinia pestis
aucaccuuggauggcgaa

SEQ ID NO: 2242166 - RNA, 15 nt, Yersinia pestis
aucaccaucggcaau

SEQ ID NO: 2242167 - RNA, 14 nt, Yersinia pestis
aucacuagcgggcc

SEQ ID NO: 2242168 - RNA, 17 nt, Yersinia pestis
aucagacugcugacaac

SEQ ID NO: 2242169 - RNA, 17 nt, Yersinia pestis
aucagcaagugauagau

SEQ ID NO: 2242170 - RNA, 15 nt, Yersinia pestis
aucagcgauagcugc

SEQ ID NO: 2242171 - RNA, 21 nt, Yersinia pestis
agguuucccguaccagugcca

SEQ ID NO: 2242172 - RNA, 20 nt, Yersinia pestis
aguaacaaaaugcgguggca

SEQ ID NO: 2242173 - RNA, 17 nt, Yersinia pestis
aguaaagcgaucgugag

SEQ ID NO: 2242174 - RNA, 16 nt, Yersinia pestis
agguuuaacaaugugg

SEQ ID NO: 2242175 - RNA, 14 nt, Yersinia pestis
aguaucuucauccg

SEQ ID NO: 2242176 - RNA, 17 nt, Yersinia pestis
aguaugagcgucaguag

SEQ ID NO: 2242177 - RNA, 14 nt, Yersinia pestis
aguacuucagguaa

SEQ ID NO: 2242178 - RNA, 20 nt, Yersinia pestis
aguacuggaucacaaugcaa

SEQ ID NO: 2242179 - RNA, 15 nt, Yersinia pestis
aguacggugccagca

SEQ ID NO: 2242180 - RNA, 18 nt, Yersinia pestis
agguauuacaggccccuu

SEQ ID NO: 2242181 - RNA, 14 nt, Yersinia pestis
aggucccuuugaca

SEQ ID NO: 2242182 - RNA, 20 nt, Yersinia pestis
agggcgcauccccaucgcca

SEQ ID NO: 2242183 - RNA, 20 nt, Yersinia pestis
aggcuauuuuacuugccauu

SEQ ID NO: 2242184 - RNA, 15 nt, Yersinia pestis
aggcucauuaauccc

SEQ ID NO: 2242185 - RNA, 22 nt, Yersinia pestis
agcuggagccauaaguaaagcg

SEQ ID NO: 2242186 - RNA, 20 nt, Yersinia pestis
aggcagaggaguaaagcguc

SEQ ID NO: 2242187 - RNA, 21 nt, Yersinia pestis
aggcagguggguacugauaaa

SEQ ID NO: 2242188 - RNA, 14 nt, Yersinia pestis
aggcgcaucgcgau

SEQ ID NO: 2242189 - RNA, 15 nt, Yersinia pestis
aggcgauuaaacguc

SEQ ID NO: 2242190 - RNA, 13 nt, Yersinia pestis
aggcgaccaaugg

SEQ ID NO: 2242191 - RNA, 12 nt, Yersinia pestis
agcuaugcaguu

SEQ ID NO: 2242192 - RNA, 20 nt, Yersinia pestis
agcguucgaggauaucacuc

SEQ ID NO: 2242193 - RNA, 19 nt, Yersinia pestis
agcggucgacaaaauguga

SEQ ID NO: 2242194 - RNA, 13 nt, Yersinia pestis
agcgugaaagcau

SEQ ID NO: 2242195 - RNA, 14 nt, Yersinia pestis
agcgugaaagcauc

SEQ ID NO: 2242196 - RNA, 18 nt, Yersinia pestis
agcugaacaaacuuaucc

SEQ ID NO: 2242197 - RNA, 13 nt, Yersinia pestis
agcugacgcagca

SEQ ID NO: 2242198 - RNA, 14 nt, Yersinia pestis
agcgcguugcgcug

SEQ ID NO: 2242199 - RNA, 16 nt, Yersinia pestis
agcgaauggcaauggc

SEQ ID NO: 2242200 - RNA, 17 nt, Yersinia pestis
agcgaauggcaauggcc

SEQ ID NO: 2242201 - RNA, 14 nt, Yersinia pestis
aaacgcugcacauc

SEQ ID NO: 2242202 - RNA, 13 nt, Yersinia pestis
agcgaaucacauc

SEQ ID NO: 2242203 - RNA, 22 nt, Yersinia pestis
agcgcaaugcuccagcaacuga

SEQ ID NO: 2242204 - RNA, 14 nt, Yersinia pestis
agccuuaacugcau

SEQ ID NO: 2242205 - RNA, 22 nt, Yersinia pestis
agccugcugcccuuugcuggca

SEQ ID NO: 2242206 - RNA, 19 nt, Yersinia pestis
agcgcgcuccagauuguca

SEQ ID NO: 2242207 - RNA, 20 nt, Yersinia pestis
agcgcagggucagaauacgu

SEQ ID NO: 2242208 - RNA, 13 nt, Yersinia pestis
agcgcccuacugc

SEQ ID NO: 2242209 - RNA, 15 nt, Yersinia pestis
agcaauacgccaguu

SEQ ID NO: 2242210 - RNA, 17 nt, Yersinia pestis
agcaauaugaauacgaa

SEQ ID NO: 2242211 - RNA, 23 nt, Yersinia pestis
agcaauggcgaugagaaugccga

SEQ ID NO: 2242212 - RNA, 13 nt, Yersinia pestis
agcacaacgcucu

SEQ ID NO: 2242213 - RNA, 16 nt, Yersinia pestis
agcaagggcagcuaac

SEQ ID NO: 2242214 - RNA, 18 nt, Yersinia pestis
agcaauaccagccgauaa

SEQ ID NO: 2242215 - RNA, 19 nt, Yersinia pestis
agcaauaaacucauaccga

SEQ ID NO: 2242216 - RNA, 22 nt, Yersinia pestis
agcaaauaacaugauguaacag

SEQ ID NO: 2242217 - RNA, 23 nt, Yersinia pestis
agauuuuugauaauuucaguuca

SEQ ID NO: 2242218 - RNA, 12 nt, Yersinia pestis
acuuuaucaguc

SEQ ID NO: 2242219 - RNA, 16 nt, Yersinia pestis
acuuucggguaucugu

SEQ ID NO: 2242220 - RNA, 13 nt, Yersinia pestis
agcaccagcacca

SEQ ID NO: 2242221 - RNA, 20 nt, Yersinia pestis
agcagacucaagcauuguca

SEQ ID NO: 2242222 - RNA, 13 nt, Yersinia pestis
agcacgaccuugc

SEQ ID NO: 2242223 - RNA, 18 nt, Yersinia pestis
agcacggacagcagcacg

SEQ ID NO: 2242224 - RNA, 14 nt, Yersinia pestis
agcacuucagcgua

SEQ ID NO: 2242225 - RNA, 17 nt, Yersinia pestis
agcacugccccgaagcu

SEQ ID NO: 2242226 - RNA, 22 nt, Yersinia pestis
agcaucaguaacuucucucccg

SEQ ID NO: 2242227 - RNA, 12 nt, Yersinia pestis
agcauucagaua

SEQ ID NO: 2242228 - RNA, 22 nt, Yersinia pestis
agcauuauauuauuuaucaauc

SEQ ID NO: 2242229 - RNA, 15 nt, Yersinia pestis
agccagccaauggcc

SEQ ID NO: 2242230 - RNA, 15 nt, Yersinia pestis
agccaccgcaucaau

SEQ ID NO: 2242231 - RNA, 16 nt, Yersinia pestis
agcagugcugaacgua

SEQ ID NO: 2242232 - RNA, 21 nt, Yersinia pestis
agcaguaugucgucgcaugac

SEQ ID NO: 2242233 - RNA, 18 nt, Yersinia pestis
agcagccucuaacauacu

SEQ ID NO: 2242234 - RNA, 16 nt, Yersinia pestis
aaaccugugugaccuc

SEQ ID NO: 2242235 - RNA, 19 nt, Yersinia pestis
aaacgaaacuaacgcguga

SEQ ID NO: 2242236 - RNA, 17 nt, Yersinia pestis
aaacgacacuaaccgua

SEQ ID NO: 2242237 - RNA, 19 nt, Yersinia pestis
agccgagaaauaguuacug

SEQ ID NO: 2242238 - RNA, 13 nt, Yersinia pestis
agcccaaggcgac

SEQ ID NO: 2242239 - RNA, 14 nt, Yersinia pestis
aaauagauaucgaa

SEQ ID NO: 2242240 - RNA, 13 nt, Yersinia pestis
aaauacugccaau

SEQ ID NO: 2242241 - RNA, 23 nt, Yersinia pestis
aaauacggucaacgauuguuacg

SEQ ID NO: 2242242 - RNA, 12 nt, Yersinia pestis
aaaguugcuguu

SEQ ID NO: 2242243 - RNA, 19 nt, Yersinia pestis
aaauauaccgccaagcgcc

SEQ ID NO: 2242244 - RNA, 20 nt, Yersinia pestis
aaauaggugcgccaguggca

SEQ ID NO: 2242245 - RNA, 22 nt, Yersinia pestis
aaauauccuccggcauagccgg

SEQ ID NO: 2242246 - RNA, 21 nt, Yersinia pestis
aaaaaugcacugaacaaugcc

SEQ ID NO: 2242247 - RNA, 22 nt, Yersinia pestis
aaaaaugccagccccaaucacc

SEQ ID NO: 2242248 - RNA, 23 nt, Yersinia pestis
aaaaauugacgaaaguuaaacaa

SEQ ID NO: 2242249 - RNA, 21 nt, Yersinia pestis
aaagucauugguguuacagca

SEQ ID NO: 2242250 - RNA, 22 nt, Yersinia pestis
aaaggcccgcuagugauagcgg

SEQ ID NO: 2242251 - RNA, 17 nt, Yersinia pestis
aaaaaggcagugacagu

SEQ ID NO: 2242252 - RNA, 19 nt, Yersinia pestis
aaagagugauuaccugaga

SEQ ID NO: 2242253 - RNA, 20 nt, Yersinia pestis
aaacucugcguagccauuaa

SEQ ID NO: 2242254 - RNA, 15 nt, Yersinia pestis
aaacguuacugcucg

SEQ ID NO: 2242255 - RNA, 15 nt, Yersinia pestis
aaacgugaaacgccu

SEQ ID NO: 2242256 - RNA, 19 nt, Yersinia pestis
aaacggugaggauaggcag

SEQ ID NO: 2242257 - RNA, 14 nt, Yersinia pestis
aaacgguugcugua

SEQ ID NO: 2242258 - RNA, 13 nt, Yersinia pestis
aaaugucagaucg

SEQ ID NO: 2242259 - RNA, 21 nt, Yersinia pestis
aaaugucagaucgcgaugcgc

SEQ ID NO: 2242260 - RNA, 19 nt, Yersinia pestis
aaaucuacaaagucugaua

SEQ ID NO: 2242261 - RNA, 16 nt, Yersinia pestis
aaaucuaaguucagcg

SEQ ID NO: 2242262 - RNA, 15 nt, Yersinia pestis
aaauucuaucugguu

SEQ ID NO: 2242263 - RNA, 19 nt, Yersinia pestis
aaauucucaaugauaaaau

SEQ ID NO: 2242264 - RNA, 18 nt, Yersinia pestis
aaaagauggcuacguagc

SEQ ID NO: 2242265 - RNA, 24 nt, Yersinia pestis
aaaagcaccgcagucgauaaacau

SEQ ID NO: 2242266 - RNA, 17 nt, Yersinia pestis
aaaagcccggucacuca

SEQ ID NO: 2242267 - RNA, 16 nt, Yersinia pestis
aacaaugaacuguguu

SEQ ID NO: 2242268 - RNA, 20 nt, Yersinia pestis
aacaaucuggcagccgguga

SEQ ID NO: 2242269 - RNA, 18 nt, Yersinia pestis
aacacuuaauugguuuau

SEQ ID NO: 2242270 - RNA, 20 nt, Yersinia pestis
aacacuuuaucgaccacuuu

SEQ ID NO: 2242271 - RNA, 21 nt, Yersinia pestis
aacagacuaaaaaccgccaca

SEQ ID NO: 2242272 - RNA, 17 nt, Yersinia pestis
aacaguaagcuuugugc

SEQ ID NO: 2242273 - RNA, 13 nt, Yersinia pestis
aacaggcagaucg

SEQ ID NO: 2242274 - RNA, 19 nt, Yersinia pestis
aaccaucgcucuccugccc

SEQ ID NO: 2242275 - RNA, 23 nt, Yersinia pestis
aacccaaagcccuuauccguuaa

SEQ ID NO: 2242276 - RNA, 21 nt, Yersinia pestis
aaccagugcgccguaaaucgu

SEQ ID NO: 2242277 - RNA, 15 nt, Yersinia pestis
aaccaggugcagaua

SEQ ID NO: 2242278 - RNA, 12 nt, Yersinia pestis
aacccggcgacg

SEQ ID NO: 2242279 - RNA, 23 nt, Yersinia pestis
aacccguucgcgguuuacggcaa

SEQ ID NO: 2242280 - RNA, 13 nt, Yersinia pestis
aaccgauaacgcc

SEQ ID NO: 2242281 - RNA, 19 nt, Yersinia pestis
aaccgacaucaaccguuaa

SEQ ID NO: 2242282 - RNA, 20 nt, Yersinia pestis
aacaucgacaccaagacuga

SEQ ID NO: 2242283 - RNA, 13 nt, Yersinia pestis
aacaucgcccuuu

SEQ ID NO: 2242284 - RNA, 14 nt, Yersinia pestis
aacaugccauugau

SEQ ID NO: 2242285 - RNA, 21 nt, Yersinia pestis
aacauaacuuugccagugacu

SEQ ID NO: 2242286 - RNA, 17 nt, Yersinia pestis
aacaguuaaacaacgcu

SEQ ID NO: 2242287 - RNA, 16 nt, Yersinia pestis
aacagugauucgcucg

SEQ ID NO: 2242288 - RNA, 20 nt, Yersinia pestis
aacauuuccacucuuugagu

SEQ ID NO: 2242289 - RNA, 13 nt, Yersinia pestis
aaccacgucuacg

SEQ ID NO: 2242290 - RNA, 19 nt, Yersinia pestis
aaccacgaagagcgccuca

SEQ ID NO: 2242291 - RNA, 19 nt, Yersinia pestis
aaccacuuauccagcucau

SEQ ID NO: 2242292 - RNA, 20 nt, Yersinia pestis
aacgggcuuccaucaggaag

SEQ ID NO: 2242293 - RNA, 18 nt, Yersinia pestis
aacggugaggauaggcag

SEQ ID NO: 2242294 - RNA, 15 nt, Yersinia pestis
aacgguuggucagca

SEQ ID NO: 2242295 - RNA, 11 nt, Yersinia pestis
aacgugacaua

SEQ ID NO: 2242296 - RNA, 21 nt, Yersinia pestis
aacgaucuggucugccagaau

SEQ ID NO: 2242297 - RNA, 19 nt, Yersinia pestis
aacgaucgcuuaacgaggc

SEQ ID NO: 2242298 - RNA, 23 nt, Yersinia pestis
aacgaaaugucgaaagauagcaa

SEQ ID NO: 2242299 - RNA, 13 nt, Yersinia pestis
aaccgcugauaac

SEQ ID NO: 2242300 - RNA, 13 nt, Yersinia pestis
aaccgccauugca

SEQ ID NO: 2242301 - RNA, 15 nt, Yersinia pestis
aacgcaauugcaccg

SEQ ID NO: 2242302 - RNA, 18 nt, Yersinia pestis
aaucaguaaauauggcgg

SEQ ID NO: 2242303 - RNA, 13 nt, Yersinia pestis
aauagcggccauu

SEQ ID NO: 2242304 - RNA, 14 nt, Yersinia pestis
aauagguguugccg

SEQ ID NO: 2242305 - RNA, 16 nt, Yersinia pestis
aauccacacgcgagca

SEQ ID NO: 2242306 - RNA, 13 nt, Yersinia pestis
aaucauaauggua

SEQ ID NO: 2242307 - RNA, 19 nt, Yersinia pestis
aaucauacgcagccugaau

SEQ ID NO: 2242308 - RNA, 15 nt, Yersinia pestis
aaucaucguggcuuu

SEQ ID NO: 2242309 - RNA, 21 nt, Yersinia pestis
aauccacugaaauaaacaagc

SEQ ID NO: 2242310 - RNA, 23 nt, Yersinia pestis
aauccccccuuuuucaaucacuu

SEQ ID NO: 2242311 - RNA, 20 nt, Yersinia pestis
aaucgucuuguuggucacca

SEQ ID NO: 2242312 - RNA, 18 nt, Yersinia pestis
aaucgugcacccccuucg

SEQ ID NO: 2242313 - RNA, 22 nt, Yersinia pestis
aaugagccgcauugauccucgu

SEQ ID NO: 2242314 - RNA, 19 nt, Yersinia pestis
aaugccgcugaucaggaag

SEQ ID NO: 2242315 - RNA, 14 nt, Yersinia pestis
aaugagcgccaaau

SEQ ID NO: 2242316 - RNA, 18 nt, Yersinia pestis
aaugcgaccggccgcuug

SEQ ID NO: 2242317 - RNA, 21 nt, Yersinia pestis
aaugcgaccggccgcuugcca

SEQ ID NO: 2242318 - RNA, 19 nt, Yersinia pestis
aauggccagcgggaaucaa

SEQ ID NO: 2242319 - RNA, 17 nt, Yersinia pestis
aaugguguaaaugcccg

SEQ ID NO: 2242320 - RNA, 15 nt, Yersinia pestis
aauggugucuuuacu

SEQ ID NO: 2242321 - RNA, 18 nt, Yersinia pestis
aauguucgcugacagagu

SEQ ID NO: 2242322 - RNA, 19 nt, Yersinia pestis
aauuacuuuaaagccaaau

SEQ ID NO: 2242323 - RNA, 15 nt, Yersinia pestis
aauuagauaugaucg

SEQ ID NO: 2242324 - RNA, 21 nt, Yersinia pestis
aauuauuuuggaguauacauu

SEQ ID NO: 2242325 - RNA, 16 nt, Yersinia pestis
aauucagccucauaca

SEQ ID NO: 2242326 - RNA, 20 nt, Yersinia pestis
aauucaccaauugcggucag

SEQ ID NO: 2242327 - RNA, 17 nt, Yersinia pestis
aauuucaauaacaccgu

SEQ ID NO: 2242328 - RNA, 22 nt, Yersinia pestis
aauuugauauuaauaucagcga

SEQ ID NO: 2242329 - RNA, 23 nt, Yersinia pestis
aagauaaacagcuuaucagcgua

SEQ ID NO: 2242330 - RNA, 14 nt, Yersinia pestis
aagagugaccaaag

SEQ ID NO: 2242331 - RNA, 18 nt, Yersinia pestis
aacuaccgaucaucaggc

SEQ ID NO: 2242332 - RNA, 16 nt, Yersinia pestis
aacguucugccaauuu

SEQ ID NO: 2242333 - RNA, 16 nt, Yersinia pestis
aacguguuuaucgauc

SEQ ID NO: 2242334 - RNA, 19 nt, Yersinia pestis
aagauaucgcuaccuccgg

SEQ ID NO: 2242335 - RNA, 15 nt, Yersinia pestis
aagauuggcagcgua

SEQ ID NO: 2242336 - RNA, 15 nt, Yersinia pestis
aagcaauaaacucau

SEQ ID NO: 2242337 - RNA, 22 nt, Yersinia pestis
aagauuuuguagcccacugaca

SEQ ID NO: 2242338 - RNA, 21 nt, Yersinia pestis
aagcacagacaaacaaccuaa

SEQ ID NO: 2242339 - RNA, 14 nt, Yersinia pestis
aagccuucauucaa

SEQ ID NO: 2242340 - RNA, 15 nt, Yersinia pestis
aagcaucgacgagcg

SEQ ID NO: 2242341 - RNA, 15 nt, Yersinia pestis
aagcucgccaucgca

SEQ ID NO: 2242342 - RNA, 18 nt, Yersinia pestis
aagcgucagaugcugacg

SEQ ID NO: 2242343 - RNA, 19 nt, Yersinia pestis
aagcgcugcuuuaaaggcu

SEQ ID NO: 2242344 - RNA, 17 nt, Yersinia pestis
aagcgcuguuaacgcuu

SEQ ID NO: 2242345 - RNA, 21 nt, Yersinia pestis
aagggcguuuugcguuaucuu

SEQ ID NO: 2242346 - RNA, 14 nt, Yersinia pestis
aaguagucagcaac

SEQ ID NO: 2242347 - RNA, 23 nt, Yersinia pestis
aaguaccgcuuugugaugcaccu

SEQ ID NO: 2242348 - RNA, 22 nt, Yersinia pestis
aagcuuauccauuacagcaccu

SEQ ID NO: 2242349 - RNA, 14 nt, Yersinia pestis
aagggccaugccug

SEQ ID NO: 2242350 - RNA, 14 nt, Yersinia pestis
aauaacgcggccag

SEQ ID NO: 2242351 - RNA, 15 nt, Yersinia pestis
aauaaacacuuggca

SEQ ID NO: 2242352 - RNA, 18 nt, Yersinia pestis
aauaaaccgaaaugaucu

SEQ ID NO: 2242353 - RNA, 22 nt, Yersinia pestis
aauaacugccaauauugaccaa

SEQ ID NO: 2242354 - RNA, 19 nt, Yersinia pestis
aaguuuucuggcaauuucu

SEQ ID NO: 2242355 - RNA, 16 nt, Yersinia pestis
aauaaaaaccgcagca

SEQ ID NO: 2242356 - RNA, 22 nt, Yersinia pestis
aauaccaaggagauagcgugua

SEQ ID NO: 2242357 - RNA, 21 nt, Yersinia pestis
aauaccauuuucagacugaaa

SEQ ID NO: 2242358 - RNA, 21 nt, Yersinia pestis
acaaacucugcguagccauua

SEQ ID NO: 2242359 - RNA, 17 nt, Yersinia pestis
acaaacgcuugagcuua

SEQ ID NO: 2242360 - RNA, 12 nt, Yersinia pestis
acagccaccagc

SEQ ID NO: 2242361 - RNA, 15 nt, Yersinia pestis
acagcccagauggca

SEQ ID NO: 2242362 - RNA, 15 nt, Yersinia pestis
acagcccccugccua

SEQ ID NO: 2242363 - RNA, 16 nt, Yersinia pestis
acaaacauggcggcag

SEQ ID NO: 2242364 - RNA, 18 nt, Yersinia pestis
acagcgugaagugaugac

SEQ ID NO: 2242365 - RNA, 13 nt, Yersinia pestis
acagccgagaaau

SEQ ID NO: 2242366 - RNA, 21 nt, Yersinia pestis
acauaucuccguugaaaccua

SEQ ID NO: 2242367 - RNA, 14 nt, Yersinia pestis
acauaucgagacua

SEQ ID NO: 2242368 - RNA, 20 nt, Yersinia pestis
acaucaaccccuuucuuaac

SEQ ID NO: 2242369 - RNA, 23 nt, Yersinia pestis
acaucaccuugcgcccuugugga

SEQ ID NO: 2242370 - RNA, 13 nt, Yersinia pestis
acaucauccaguu

SEQ ID NO: 2242371 - RNA, 17 nt, Yersinia pestis
acauagcacccaaugua

SEQ ID NO: 2242372 - RNA, 17 nt, Yersinia pestis
acaggccccaauccacc

SEQ ID NO: 2242373 - RNA, 14 nt, Yersinia pestis
acauuagccgguua

SEQ ID NO: 2242374 - RNA, 20 nt, Yersinia pestis
acauucgagcuaccggcauu

SEQ ID NO: 2242375 - RNA, 22 nt, Yersinia pestis
acauuaagcauauccaacgcuu

SEQ ID NO: 2242376 - RNA, 20 nt, Yersinia pestis
acauuuaucuaucuguucac

SEQ ID NO: 2242377 - RNA, 13 nt, Yersinia pestis
accaaaaaucuug

SEQ ID NO: 2242378 - RNA, 17 nt, Yersinia pestis
accaaaaaucuuguuaa

SEQ ID NO: 2242379 - RNA, 17 nt, Yersinia pestis
acauuuucuaucucauc

SEQ ID NO: 2242380 - RNA, 18 nt, Yersinia pestis
accaaguuugacuuauga

SEQ ID NO: 2242381 - RNA, 15 nt, Yersinia pestis
accaaucuccaauga

SEQ ID NO: 2242382 - RNA, 20 nt, Yersinia pestis
accaaucuccaaugaccccg

SEQ ID NO: 2242383 - RNA, 20 nt, Yersinia pestis
accaacaauauucgcagcca

SEQ ID NO: 2242384 - RNA, 17 nt, Yersinia pestis
accaacggcaaugacca

SEQ ID NO: 2242385 - RNA, 23 nt, Yersinia pestis
accaacgaaaucacccggccauc

SEQ ID NO: 2242386 - RNA, 15 nt, Yersinia pestis
acaucuggccaguaa

SEQ ID NO: 2242387 - RNA, 20 nt, Yersinia pestis
acaugauuaaaucaagcugc

SEQ ID NO: 2242388 - RNA, 17 nt, Yersinia pestis
acaugcaccguaacuuc

SEQ ID NO: 2242389 - RNA, 16 nt, Yersinia pestis
acaugagacagcgcgg

SEQ ID NO: 2242390 - RNA, 23 nt, Yersinia pestis
acauccgcuugcagcaacagggu

SEQ ID NO: 2242391 - RNA, 16 nt, Yersinia pestis
acaucccgccauggca

SEQ ID NO: 2242392 - RNA, 13 nt, Yersinia pestis
acaucgcaccgau

SEQ ID NO: 2242393 - RNA, 19 nt, Yersinia pestis
accagaaugguuuggccgu

SEQ ID NO: 2242394 - RNA, 21 nt, Yersinia pestis
accacguugaauauucaacgc

SEQ ID NO: 2242395 - RNA, 19 nt, Yersinia pestis
accacaaaggucagcaugg

SEQ ID NO: 2242396 - RNA, 10 nt, Yersinia pestis
accaaugguu

SEQ ID NO: 2242397 - RNA, 22 nt, Yersinia pestis
accacaugagauucaggagaua

SEQ ID NO: 2242398 - RNA, 13 nt, Yersinia pestis
accaccaccaggc

SEQ ID NO: 2242399 - RNA, 20 nt, Yersinia pestis
accaccauauugguuagcgc

SEQ ID NO: 2242400 - RNA, 20 nt, Yersinia pestis
accaccaucacuuccagcgc

SEQ ID NO: 2242401 - RNA, 20 nt, Yersinia pestis
accaccuaauacagcaccac

SEQ ID NO: 2242402 - RNA, 18 nt, Yersinia pestis
accacgguaucaaucagc

SEQ ID NO: 2242403 - RNA, 17 nt, Yersinia pestis
aaaaugccagccgguga

SEQ ID NO: 2242404 - RNA, 23 nt, Yersinia pestis
accgaaauauucgucucaucaau

SEQ ID NO: 2242405 - RNA, 21 nt, Yersinia pestis
acccuuaugccgugacugccg

SEQ ID NO: 2242406 - RNA, 14 nt, Yersinia pestis
accgaacacgaucc

SEQ ID NO: 2242407 - RNA, 14 nt, Yersinia pestis
accgacgcugaacu

SEQ ID NO: 2242408 - RNA, 21 nt, Yersinia pestis
acccucgacaccaaaacuccc

SEQ ID NO: 2242409 - RNA, 19 nt, Yersinia pestis
acccuaucgucacagcaau

SEQ ID NO: 2242410 - RNA, 17 nt, Yersinia pestis
acccguuagcaccggau

SEQ ID NO: 2242411 - RNA, 14 nt, Yersinia pestis
acccguuacugcau

SEQ ID NO: 2242412 - RNA, 14 nt, Yersinia pestis
acccaaauuacggc

SEQ ID NO: 2242413 - RNA, 23 nt, Yersinia pestis
acccaacaaugaacuguguuuau

SEQ ID NO: 2242414 - RNA, 15 nt, Yersinia pestis
acccaauauucgcca

SEQ ID NO: 2242415 - RNA, 14 nt, Yersinia pestis
acccaguugcgccg

SEQ ID NO: 2242416 - RNA, 13 nt, Yersinia pestis
acccaguaacuga

SEQ ID NO: 2242417 - RNA, 20 nt, Yersinia pestis
acccacgguaucugcuuuau

SEQ ID NO: 2242418 - RNA, 22 nt, Yersinia pestis
acccagcaacagguucgauacu

SEQ ID NO: 2242419 - RNA, 14 nt, Yersinia pestis
accccauugcacca

SEQ ID NO: 2242420 - RNA, 15 nt, Yersinia pestis
accccguuacggcug

SEQ ID NO: 2242421 - RNA, 22 nt, Yersinia pestis
accccuauuagggaacgccagc

SEQ ID NO: 2242422 - RNA, 18 nt, Yersinia pestis
accccguugcucuacaca

SEQ ID NO: 2242423 - RNA, 18 nt, Yersinia pestis
accgcuaaggccaaugga

SEQ ID NO: 2242424 - RNA, 14 nt, Yersinia pestis
accgccgcaggcca

SEQ ID NO: 2242425 - RNA, 19 nt, Yersinia pestis
accgccgcaggccauuacc

SEQ ID NO: 2242426 - RNA, 22 nt, Yersinia pestis
acucggccaaacaaaguuaugc

SEQ ID NO: 2242427 - RNA, 20 nt, Yersinia pestis
acucggccgcuaagucacgc

SEQ ID NO: 2242428 - RNA, 22 nt, Yersinia pestis
acucgccaacagagugaaucgc

SEQ ID NO: 2242429 - RNA, 15 nt, Yersinia pestis
acuccgguggcuuac

SEQ ID NO: 2242430 - RNA, 22 nt, Yersinia pestis
acucauaaucgcuuggucacug

SEQ ID NO: 2242431 - RNA, 13 nt, Yersinia pestis
acucauugcaccu

SEQ ID NO: 2242432 - RNA, 18 nt, Yersinia pestis
acucauugcgucagguaa

SEQ ID NO: 2242433 - RNA, 22 nt, Yersinia pestis
acucacguaccaaaucagcaag

SEQ ID NO: 2242434 - RNA, 17 nt, Yersinia pestis
acucacacagccagccu

SEQ ID NO: 2242435 - RNA, 16 nt, Yersinia pestis
acucuagcgccagcaa

SEQ ID NO: 2242436 - RNA, 16 nt, Yersinia pestis
acugccgucaaugccu

SEQ ID NO: 2242437 - RNA, 14 nt, Yersinia pestis
acuguaaaaucuuu

SEQ ID NO: 2242438 - RNA, 20 nt, Yersinia pestis
acuggcuagauagccauaau

SEQ ID NO: 2242439 - RNA, 17 nt, Yersinia pestis
acugggauauucuggac

SEQ ID NO: 2242440 - RNA, 14 nt, Yersinia pestis
acugcuugccaaau

SEQ ID NO: 2242441 - RNA, 23 nt, Yersinia pestis
acuggcaggaaaucuucauaaac

SEQ ID NO: 2242442 - RNA, 15 nt, Yersinia pestis
acuugcccaauggca

SEQ ID NO: 2242443 - RNA, 23 nt, Yersinia pestis
acuugccguuuugggcuugagca

SEQ ID NO: 2242444 - RNA, 14 nt, Yersinia pestis
acuugagucagcac

SEQ ID NO: 2242445 - RNA, 19 nt, Yersinia pestis
acuucuauuacccuaacag

SEQ ID NO: 2242446 - RNA, 13 nt, Yersinia pestis
acugucauugcug

SEQ ID NO: 2242447 - RNA, 15 nt, Yersinia pestis
acugucauugcuguu

SEQ ID NO: 2242448 - RNA, 16 nt, Yersinia pestis
acuguaguucaauggu

SEQ ID NO: 2242449 - RNA, 21 nt, Yersinia pestis
acuuaucgaccaacuggcaau

SEQ ID NO: 2242450 - RNA, 15 nt, Yersinia pestis
acuucaaacugcgug

SEQ ID NO: 2242451 - RNA, 20 nt, Yersinia pestis
acguaucuauaaacuucacg

SEQ ID NO: 2242452 - RNA, 18 nt, Yersinia pestis
acgucauaauugccaaac

SEQ ID NO: 2242453 - RNA, 20 nt, Yersinia pestis
acgucaguaaugaggguaag

SEQ ID NO: 2242454 - RNA, 13 nt, Yersinia pestis
acggugauguccg

SEQ ID NO: 2242455 - RNA, 18 nt, Yersinia pestis
acgggcuuccaucaggaa

SEQ ID NO: 2242456 - RNA, 12 nt, Yersinia pestis
aaaccacugacc

SEQ ID NO: 2242457 - RNA, 14 nt, Yersinia pestis
aaaccagccaguga

SEQ ID NO: 2242458 - RNA, 21 nt, Yersinia pestis
acggcgcagggcgauauccag

SEQ ID NO: 2242459 - RNA, 19 nt, Yersinia pestis
accugucaccuaccaccua

SEQ ID NO: 2242460 - RNA, 13 nt, Yersinia pestis
accugucaccugu

SEQ ID NO: 2242461 - RNA, 18 nt, Yersinia pestis
accugucaccugucaccu

SEQ ID NO: 2242462 - RNA, 16 nt, Yersinia pestis
accuggcucaaauuug

SEQ ID NO: 2242463 - RNA, 21 nt, Yersinia pestis
accuguuucaacaucgcaccg

SEQ ID NO: 2242464 - RNA, 23 nt, Yersinia pestis
acgaugcagcuuagaguaaguaa

SEQ ID NO: 2242465 - RNA, 13 nt, Yersinia pestis
acgccaauaccgg

SEQ ID NO: 2242466 - RNA, 15 nt, Yersinia pestis
acgcagcuuguugau

SEQ ID NO: 2242467 - RNA, 15 nt, Yersinia pestis
acgccaugccgguug

SEQ ID NO: 2242468 - RNA, 18 nt, Yersinia pestis
acgcuaaccaccgucacc

SEQ ID NO: 2242469 - RNA, 16 nt, Yersinia pestis
acgcuaccaugaguga

SEQ ID NO: 2242470 - RNA, 14 nt, Yersinia pestis
acgcguagagccuu

SEQ ID NO: 2242471 - RNA, 23 nt, Yersinia pestis
acgcguagagccuuuacgggcug

SEQ ID NO: 2242472 - RNA, 17 nt, Yersinia pestis
acgcguuagcgauuucu

SEQ ID NO: 2242473 - RNA, 15 nt, Yersinia pestis
acgcguugauccauc

SEQ ID NO: 2242474 - RNA, 13 nt, Yersinia pestis
acgccuucagcga

SEQ ID NO: 2242475 - RNA, 14 nt, Yersinia pestis
acgcgauuauuugc

SEQ ID NO: 2242476 - RNA, 13 nt, Yersinia pestis
acgccgccgcacc

SEQ ID NO: 2242477 - RNA, 20 nt, Yersinia pestis
acgccgcuacaagcauguga

SEQ ID NO: 2242478 - RNA, 20 nt, Yersinia pestis
acgccgcucaauuaaccuga

SEQ ID NO: 2242479 - RNA, 13 nt, Yersinia pestis
acgccuacggcuu

SEQ ID NO: 2242480 - RNA, 20 nt, Yersinia pestis
acgccugggauccauaggau

SEQ ID NO: 2242481 - RNA, 16 nt, Yersinia pestis
uuuuuaacgucagaua

SEQ ID NO: 2242482 - RNA, 19 nt, Yersinia pestis
uuuuucaucauauucagcc

SEQ ID NO: 2242483 - RNA, 20 nt, Yersinia pestis
uuuggcucgugaucagcaga

SEQ ID NO: 2242484 - RNA, 14 nt, Yersinia pestis
uuuugguggcugcu

SEQ ID NO: 2242485 - RNA, 21 nt, Yersinia pestis
uuucuauguagaaguugccgu

SEQ ID NO: 2242486 - RNA, 17 nt, Yersinia pestis
uuucuauuuucagcaua

SEQ ID NO: 2242487 - RNA, 15 nt, Yersinia pestis
uuucucaauacgcug

SEQ ID NO: 2242488 - RNA, 16 nt, Yersinia pestis
uuucuacugcaugauu

SEQ ID NO: 2242489 - RNA, 13 nt, Yersinia pestis
uuucuaccgcuuc

SEQ ID NO: 2242490 - RNA, 16 nt, Yersinia pestis
uuucaggcauaucacu

SEQ ID NO: 2242491 - RNA, 13 nt, Yersinia pestis
uuugaauccagug

SEQ ID NO: 2242492 - RNA, 17 nt, Yersinia pestis
uuugcuccuggcaugca

SEQ ID NO: 2242493 - RNA, 20 nt, Yersinia pestis
uuuggccaccgcgucgccgc

SEQ ID NO: 2242494 - RNA, 19 nt, Yersinia pestis
uuugcgcccgcgccagaug

SEQ ID NO: 2242495 - RNA, 16 nt, Yersinia pestis
uugaaaucagaucaac

SEQ ID NO: 2242496 - RNA, 14 nt, Yersinia pestis
uucuuuaugacaag

SEQ ID NO: 2242497 - RNA, 16 nt, Yersinia pestis
uuggcuaaauaaccag

SEQ ID NO: 2242498 - RNA, 17 nt, Yersinia pestis
uuggcuaaauaaccaga

SEQ ID NO: 2242499 - RNA, 20 nt, Yersinia pestis
uugaacaacgcuaugcagcc

SEQ ID NO: 2242500 - RNA, 18 nt, Yersinia pestis
uuggcucgugaucagcag

SEQ ID NO: 2242501 - RNA, 15 nt, Yersinia pestis
uugggaacuggcgau

SEQ ID NO: 2242502 - RNA, 12 nt, Yersinia pestis
uuguagcgccag

SEQ ID NO: 2242503 - RNA, 15 nt, Yersinia pestis
uuuacugcauugaga

SEQ ID NO: 2242504 - RNA, 17 nt, Yersinia pestis
uuuauauugauacggcu

SEQ ID NO: 2242505 - RNA, 12 nt, Yersinia pestis
uuuauauugaug

SEQ ID NO: 2242506 - RNA, 17 nt, Yersinia pestis
uuuauauugccaucuug

SEQ ID NO: 2242507 - RNA, 13 nt, Yersinia pestis
uuuaucgauaacc

SEQ ID NO: 2242508 - RNA, 14 nt, Yersinia pestis
uuuauccaaucuug

SEQ ID NO: 2242509 - RNA, 18 nt, Yersinia pestis
uuuaaucucuccaugaua

SEQ ID NO: 2242510 - RNA, 21 nt, Yersinia pestis
uuguucauccuguaccgcgcu

SEQ ID NO: 2242511 - RNA, 13 nt, Yersinia pestis
uugucgucaggcg

SEQ ID NO: 2242512 - RNA, 16 nt, Yersinia pestis
ugucaagagugcgagu

SEQ ID NO: 2242513 - RNA, 18 nt, Yersinia pestis
uguauucccucaauagcu

SEQ ID NO: 2242514 - RNA, 19 nt, Yersinia pestis
uguaugacuacccccgcau

SEQ ID NO: 2242515 - RNA, 16 nt, Yersinia pestis
uguauccaucugauga

SEQ ID NO: 2242516 - RNA, 23 nt, Yersinia pestis
uguaucgaugaucaaugugguua

SEQ ID NO: 2242517 - RNA, 17 nt, Yersinia pestis
uguaucauauguucgau

SEQ ID NO: 2242518 - RNA, 16 nt, Yersinia pestis
uguaaggcaauaccaa

SEQ ID NO: 2242519 - RNA, 16 nt, Yersinia pestis
ugucacaaucucuggc

SEQ ID NO: 2242520 - RNA, 13 nt, Yersinia pestis
ugucugauaaccu

SEQ ID NO: 2242521 - RNA, 18 nt, Yersinia pestis
ugucguuucugcuuaacu

SEQ ID NO: 2242522 - RNA, 13 nt, Yersinia pestis
ugugaaauaccga

SEQ ID NO: 2242523 - RNA, 22 nt, Yersinia pestis
ugucggcgaugaaaaacagaua

SEQ ID NO: 2242524 - RNA, 14 nt, Yersinia pestis
ugucgucacccauu

SEQ ID NO: 2242525 - RNA, 15 nt, Yersinia pestis
ugucggguaacggcu

SEQ ID NO: 2242526 - RNA, 14 nt, Yersinia pestis
ugucgggccaauaa

SEQ ID NO: 2242527 - RNA, 18 nt, Yersinia pestis
uggucagcacaaacagcu

SEQ ID NO: 2242528 - RNA, 20 nt, Yersinia pestis
uggucccuaacgcaauacgg

SEQ ID NO: 2242529 - RNA, 19 nt, Yersinia pestis
uggucaguauaaauugccc

SEQ ID NO: 2242530 - RNA, 17 nt, Yersinia pestis
uggucgcugggccuacu

SEQ ID NO: 2242531 - RNA, 20 nt, Yersinia pestis
ugguucacggaaaguagcca

SEQ ID NO: 2242532 - RNA, 22 nt, Yersinia pestis
ugguucacggaaaguagccauu

SEQ ID NO: 2242533 - RNA, 21 nt, Yersinia pestis
ugguuuuuuaaaaaagugcua

SEQ ID NO: 2242534 - RNA, 15 nt, Yersinia pestis
uggugauaccacccg

SEQ ID NO: 2242535 - RNA, 20 nt, Yersinia pestis
uggugaguaaaugccccauu

SEQ ID NO: 2242536 - RNA, 17 nt, Yersinia pestis
uggugacccgucagcgu

SEQ ID NO: 2242537 - RNA, 11 nt, Yersinia pestis
uggugcaaccg

SEQ ID NO: 2242538 - RNA, 15 nt, Yersinia pestis
uggggagaucagugc

SEQ ID NO: 2242539 - RNA, 15 nt, Yersinia pestis
ugguacuugacgcug

SEQ ID NO: 2242540 - RNA, 20 nt, Yersinia pestis
ugguaggugcucaucaggcg

SEQ ID NO: 2242541 - RNA, 21 nt, Yersinia pestis
ugggcuugagcagugcgcggc

SEQ ID NO: 2242542 - RNA, 12 nt, Yersinia pestis
ugggauaucugc

SEQ ID NO: 2242543 - RNA, 19 nt, Yersinia pestis
uggcgggcgcuucgucauu

SEQ ID NO: 2242544 - RNA, 23 nt, Yersinia pestis
uggcgauagauuggcaucagugg

SEQ ID NO: 2242545 - RNA, 15 nt, Yersinia pestis
uggcgccucucuggc

SEQ ID NO: 2242546 - RNA, 18 nt, Yersinia pestis
uuccugcacaucaaguac

SEQ ID NO: 2242547 - RNA, 19 nt, Yersinia pestis
uuccugaauggcaucaccg

SEQ ID NO: 2242548 - RNA, 16 nt, Yersinia pestis
uucccuaccguaucaa

SEQ ID NO: 2242549 - RNA, 19 nt, Yersinia pestis
uucgaaacugaucacuggc

SEQ ID NO: 2242550 - RNA, 18 nt, Yersinia pestis
uucgauuuuauauugaua

SEQ ID NO: 2242551 - RNA, 14 nt, Yersinia pestis
uucgcccacggaug

SEQ ID NO: 2242552 - RNA, 23 nt, Yersinia pestis
uucuauaaaacgcacacugcaga

SEQ ID NO: 2242553 - RNA, 14 nt, Yersinia pestis
uucgugcucaucaa

SEQ ID NO: 2242554 - RNA, 22 nt, Yersinia pestis
uucggcgacuuacgucgcuacg

SEQ ID NO: 2242555 - RNA, 23 nt, Yersinia pestis
uucuguagugccgccagugcuuc

SEQ ID NO: 2242556 - RNA, 13 nt, Yersinia pestis
uucugucaucaag

SEQ ID NO: 2242557 - RNA, 15 nt, Yersinia pestis
uucugcaauagccau

SEQ ID NO: 2242558 - RNA, 15 nt, Yersinia pestis
uuauucuaauugaua

SEQ ID NO: 2242559 - RNA, 13 nt, Yersinia pestis
uuaucgccagcug

SEQ ID NO: 2242560 - RNA, 21 nt, Yersinia pestis
uucaaauaaguguuucaaaua

SEQ ID NO: 2242561 - RNA, 21 nt, Yersinia pestis
uucaaaaucugauacugaacg

SEQ ID NO: 2242562 - RNA, 17 nt, Yersinia pestis
uuauuuucaaccaguua

SEQ ID NO: 2242563 - RNA, 20 nt, Yersinia pestis
uucaagagcgauagaucgau

SEQ ID NO: 2242564 - RNA, 12 nt, Yersinia pestis
uucaauaccaua

SEQ ID NO: 2242565 - RNA, 21 nt, Yersinia pestis
uucaauugcccccuagugaug

SEQ ID NO: 2242566 - RNA, 18 nt, Yersinia pestis
uucaaugagcauaccggu

SEQ ID NO: 2242567 - RNA, 23 nt, Yersinia pestis
uucacgauggaaaaaauacaggu

SEQ ID NO: 2242568 - RNA, 23 nt, Yersinia pestis
uucaccguguuucagcaucaacu

SEQ ID NO: 2242569 - RNA, 15 nt, Yersinia pestis
uucagcaacggaacg

SEQ ID NO: 2242570 - RNA, 14 nt, Yersinia pestis
uucagcacugcuuu

SEQ ID NO: 2242571 - RNA, 18 nt, Yersinia pestis
uucauuccccaucgccaa

SEQ ID NO: 2242572 - RNA, 13 nt, Yersinia pestis
uucauuagucaau

SEQ ID NO: 2242573 - RNA, 19 nt, Yersinia pestis
uucauuaaggagugccauc

SEQ ID NO: 2242574 - RNA, 20 nt, Yersinia pestis
uuccauaugaacaucaaacc

SEQ ID NO: 2242575 - RNA, 13 nt, Yersinia pestis
uucccagccacuc

SEQ ID NO: 2242576 - RNA, 15 nt, Yersinia pestis
uucaucuuucaagug

SEQ ID NO: 2242577 - RNA, 21 nt, Yersinia pestis
uucaugccuugaaacucaacg

SEQ ID NO: 2242578 - RNA, 16 nt, Yersinia pestis
uucaugcuaauaccac

SEQ ID NO: 2242579 - RNA, 14 nt, Yersinia pestis
uucaggccgauacg

SEQ ID NO: 2242580 - RNA, 17 nt, Yersinia pestis
uucauccuaaagauaau

SEQ ID NO: 2242581 - RNA, 17 nt, Yersinia pestis
uucagcgucacgauagc

SEQ ID NO: 2242582 - RNA, 21 nt, Yersinia pestis
uguggaacaacaggcgcuuca

SEQ ID NO: 2242583 - RNA, 16 nt, Yersinia pestis
uuaaagaaugcaacca

SEQ ID NO: 2242584 - RNA, 15 nt, Yersinia pestis
uuaaaguugauaaag

SEQ ID NO: 2242585 - RNA, 22 nt, Yersinia pestis
uuaaauaagaaguagaaugaga

SEQ ID NO: 2242586 - RNA, 15 nt, Yersinia pestis
uuaaauacagaucau

SEQ ID NO: 2242587 - RNA, 18 nt, Yersinia pestis
uuaaauauuaacauuaau

SEQ ID NO: 2242588 - RNA, 11 nt, Yersinia pestis
uuaaauaccag

SEQ ID NO: 2242589 - RNA, 22 nt, Yersinia pestis
uuaaacugaccgauaaacgcca

SEQ ID NO: 2242590 - RNA, 13 nt, Yersinia pestis
uuaaucaacagau

SEQ ID NO: 2242591 - RNA, 22 nt, Yersinia pestis
uuaauaucuuuaaauuauugag

SEQ ID NO: 2242592 - RNA, 12 nt, Yersinia pestis
uuacggauauga

SEQ ID NO: 2242593 - RNA, 13 nt, Yersinia pestis
uuacguaauucgu

SEQ ID NO: 2242594 - RNA, 22 nt, Yersinia pestis
uuacgaucgauaguaacaccag

SEQ ID NO: 2242595 - RNA, 19 nt, Yersinia pestis
uuaauuaguuuaucaguug

SEQ ID NO: 2242596 - RNA, 14 nt, Yersinia pestis
uuaauugcugaugu

SEQ ID NO: 2242597 - RNA, 21 nt, Yersinia pestis
uuaauucuggccgaugcgaca

SEQ ID NO: 2242598 - RNA, 17 nt, Yersinia pestis
uuaauuuggcuauugag

SEQ ID NO: 2242599 - RNA, 21 nt, Yersinia pestis
uuaccuauaaacuugauucac

SEQ ID NO: 2242600 - RNA, 16 nt, Yersinia pestis
uuauagaacggcagug

SEQ ID NO: 2242601 - RNA, 23 nt, Yersinia pestis
uuauacccguuauauuucaagcu

SEQ ID NO: 2242602 - RNA, 19 nt, Yersinia pestis
uuauccagcccuacuggcc

SEQ ID NO: 2242603 - RNA, 15 nt, Yersinia pestis
uuacugcaucaauaa

SEQ ID NO: 2242604 - RNA, 14 nt, Yersinia pestis
uuacugaucaauaa

SEQ ID NO: 2242605 - RNA, 17 nt, Yersinia pestis
uuacucugcggcaggcu

SEQ ID NO: 2242606 - RNA, 20 nt, Yersinia pestis
ucgcugguggcuugaugaua

SEQ ID NO: 2242607 - RNA, 15 nt, Yersinia pestis
ucgcuguagcgccag

SEQ ID NO: 2242608 - RNA, 19 nt, Yersinia pestis
ucgcuaacucaauaaauuc

SEQ ID NO: 2242609 - RNA, 21 nt, Yersinia pestis
ucgcguuugaucaaaucauac

SEQ ID NO: 2242610 - RNA, 21 nt, Yersinia pestis
ucgcuuucaucuucuucuuua

SEQ ID NO: 2242611 - RNA, 15 nt, Yersinia pestis
ucgcuucacggcacc

SEQ ID NO: 2242612 - RNA, 14 nt, Yersinia pestis
ucggauaaccgcau

SEQ ID NO: 2242613 - RNA, 13 nt, Yersinia pestis
ucggaucacgccc

SEQ ID NO: 2242614 - RNA, 19 nt, Yersinia pestis
ucgccgacaacuucaauac

SEQ ID NO: 2242615 - RNA, 15 nt, Yersinia pestis
ucgccauuuccauca

SEQ ID NO: 2242616 - RNA, 14 nt, Yersinia pestis
ucgccguauuugua

SEQ ID NO: 2242617 - RNA, 22 nt, Yersinia pestis
ucgcgaccaauucaucagcgcu

SEQ ID NO: 2242618 - RNA, 18 nt, Yersinia pestis
ucuggggguaacgccgcu

SEQ ID NO: 2242619 - RNA, 23 nt, Yersinia pestis
ucuuaaauugaagaguuugauca

SEQ ID NO: 2242620 - RNA, 22 nt, Yersinia pestis
ucuuaauucccagccacucaca

SEQ ID NO: 2242621 - RNA, 24 nt, Yersinia pestis
ucuuaccuucaguuuauuuaagcu

SEQ ID NO: 2242622 - RNA, 17 nt, Yersinia pestis
ucugucugcuguugcca

SEQ ID NO: 2242623 - RNA, 16 nt, Yersinia pestis
ucugcguuuuucccug

SEQ ID NO: 2242624 - RNA, 15 nt, Yersinia pestis
ucucuuuaucauuga

SEQ ID NO: 2242625 - RNA, 20 nt, Yersinia pestis
ucugauggucgucauguuua

SEQ ID NO: 2242626 - RNA, 19 nt, Yersinia pestis
ucugacuaacucuucuggc

SEQ ID NO: 2242627 - RNA, 22 nt, Yersinia pestis
ucugaggggcguuuaaugcccc

SEQ ID NO: 2242628 - RNA, 20 nt, Yersinia pestis
ucugagguggccauuacgcc

SEQ ID NO: 2242629 - RNA, 17 nt, Yersinia pestis
ucugcaaauuagcggau

SEQ ID NO: 2242630 - RNA, 13 nt, Yersinia pestis
ucugccaaccagg

SEQ ID NO: 2242631 - RNA, 22 nt, Yersinia pestis
ucugccugauaccauuggguca

SEQ ID NO: 2242632 - RNA, 14 nt, Yersinia pestis
ucuucuacuuacga

SEQ ID NO: 2242633 - RNA, 15 nt, Yersinia pestis
ugaacacagaaacga

SEQ ID NO: 2242634 - RNA, 18 nt, Yersinia pestis
ugaacaacgcuaugcagc

SEQ ID NO: 2242635 - RNA, 22 nt, Yersinia pestis
ucuuuuaguaacaaaaugcggu

SEQ ID NO: 2242636 - RNA, 21 nt, Yersinia pestis
ucuugguguugcagucuccau

SEQ ID NO: 2242637 - RNA, 14 nt, Yersinia pestis
ucucaaacucguuu

SEQ ID NO: 2242638 - RNA, 12 nt, Yersinia pestis
ucucacaacuuu

SEQ ID NO: 2242639 - RNA, 18 nt, Yersinia pestis
ucucggugugacuuucaa

SEQ ID NO: 2242640 - RNA, 22 nt, Yersinia pestis
ucuacucgcucaccacugaguu

SEQ ID NO: 2242641 - RNA, 24 nt, Yersinia pestis
ucguuagcauaaguaucagcggcg

SEQ ID NO: 2242642 - RNA, 14 nt, Yersinia pestis
ucguggugaugaug

SEQ ID NO: 2242643 - RNA, 21 nt, Yersinia pestis
ucgguauuaccaaucagcgcg

SEQ ID NO: 2242644 - RNA, 19 nt, Yersinia pestis
ucggugauauucgugauca

SEQ ID NO: 2242645 - RNA, 19 nt, Yersinia pestis
ugagaaucucuccagugca

SEQ ID NO: 2242646 - RNA, 16 nt, Yersinia pestis
ugacuuucaaucgcga

SEQ ID NO: 2242647 - RNA, 15 nt, Yersinia pestis
ugaacguuuaucgcu

SEQ ID NO: 2242648 - RNA, 22 nt, Yersinia pestis
ugaacguguuagguaauaccaa

SEQ ID NO: 2242649 - RNA, 14 nt, Yersinia pestis
ugacucacgucagu

SEQ ID NO: 2242650 - RNA, 18 nt, Yersinia pestis
ugacguuaucucaaccag

SEQ ID NO: 2242651 - RNA, 19 nt, Yersinia pestis
ugacguguuuaacgccgcu

SEQ ID NO: 2242652 - RNA, 19 nt, Yersinia pestis
ugauagcuugggcgauagu

SEQ ID NO: 2242653 - RNA, 22 nt, Yersinia pestis
ugauacaccgucucacccgcuu

SEQ ID NO: 2242654 - RNA, 22 nt, Yersinia pestis
ugaggcccgcuagugauagcgg

SEQ ID NO: 2242655 - RNA, 15 nt, Yersinia pestis
ugaguaagcucaucg

SEQ ID NO: 2242656 - RNA, 17 nt, Yersinia pestis
ugaguaaaagauucaua

SEQ ID NO: 2242657 - RNA, 17 nt, Yersinia pestis
ugagguuauugacaaag

SEQ ID NO: 2242658 - RNA, 15 nt, Yersinia pestis
ugagucagucagggu

SEQ ID NO: 2242659 - RNA, 22 nt, Yersinia pestis
ugauaaccacaacgacagccaa

SEQ ID NO: 2242660 - RNA, 23 nt, Yersinia pestis
ugauaaccguuuuuucaacuggc

SEQ ID NO: 2242661 - RNA, 13 nt, Yersinia pestis
ugcagaccaauca

SEQ ID NO: 2242662 - RNA, 15 nt, Yersinia pestis
ugcacggcagugauc

SEQ ID NO: 2242663 - RNA, 18 nt, Yersinia pestis
ugauuguuuuauggcgau

SEQ ID NO: 2242664 - RNA, 14 nt, Yersinia pestis
ugcaacucauuaac

SEQ ID NO: 2242665 - RNA, 13 nt, Yersinia pestis
ugcaacgccuuca

SEQ ID NO: 2242666 - RNA, 13 nt, Yersinia pestis
ugaugaaauccag

SEQ ID NO: 2242667 - RNA, 20 nt, Yersinia pestis
ugaucagcuaacaaaaccgg

SEQ ID NO: 2242668 - RNA, 18 nt, Yersinia pestis
ugaucaggggacaaccag

SEQ ID NO: 2242669 - RNA, 19 nt, Yersinia pestis
ugaucagcaguggcuuggc

SEQ ID NO: 2242670 - RNA, 23 nt, Yersinia pestis
ugaugucagccguuuacgauaag

SEQ ID NO: 2242671 - RNA, 17 nt, Yersinia pestis
ugauugaaaaucaguuu

SEQ ID NO: 2242672 - RNA, 16 nt, Yersinia pestis
ugauggggcaaucaag

SEQ ID NO: 2242673 - RNA, 16 nt, Yersinia pestis
ugccaucaaucaguac

SEQ ID NO: 2242674 - RNA, 22 nt, Yersinia pestis
ugccauggaauuuaugcaccaa

SEQ ID NO: 2242675 - RNA, 16 nt, Yersinia pestis
ugccgaugucaauaaa

SEQ ID NO: 2242676 - RNA, 21 nt, Yersinia pestis
ugccaagguucgaaaaaacau

SEQ ID NO: 2242677 - RNA, 17 nt, Yersinia pestis
ugccacggauauccaac

SEQ ID NO: 2242678 - RNA, 21 nt, Yersinia pestis
ugccacggauauccaacggua

SEQ ID NO: 2242679 - RNA, 20 nt, Yersinia pestis
ugccaaaaugccuaccguua

SEQ ID NO: 2242680 - RNA, 19 nt, Yersinia pestis
ugccaaauauagcauguac

SEQ ID NO: 2242681 - RNA, 14 nt, Yersinia pestis
ugccaacaacuggg

SEQ ID NO: 2242682 - RNA, 21 nt, Yersinia pestis
ugcauugcagaaagcugaacu

SEQ ID NO: 2242683 - RNA, 20 nt, Yersinia pestis
ugccauaagugaacaugaug

SEQ ID NO: 2242684 - RNA, 22 nt, Yersinia pestis
ugccauaggggggaaagcaaua

SEQ ID NO: 2242685 - RNA, 19 nt, Yersinia pestis
ugcaggcccugguugcagc

SEQ ID NO: 2242686 - RNA, 15 nt, Yersinia pestis
ugcagggccuuuagc

SEQ ID NO: 2242687 - RNA, 21 nt, Yersinia pestis
ugcagauuaguugaccuuggu

SEQ ID NO: 2242688 - RNA, 21 nt, Yersinia pestis
ugcagcaagccgauaaucaau

SEQ ID NO: 2242689 - RNA, 22 nt, Yersinia pestis
ugccguuugaugcgcugagcaa

SEQ ID NO: 2242690 - RNA, 16 nt, Yersinia pestis
ugccuacgcuggcgca

SEQ ID NO: 2242691 - RNA, 18 nt, Yersinia pestis
ugcgaaagacggccaacu

SEQ ID NO: 2242692 - RNA, 22 nt, Yersinia pestis
ugccguagguaauuaaacgcuc

SEQ ID NO: 2242693 - RNA, 16 nt, Yersinia pestis
ugcgcuucgcacuuca

SEQ ID NO: 2242694 - RNA, 22 nt, Yersinia pestis
ugcgcucuugcaugugaucacg

SEQ ID NO: 2242695 - RNA, 18 nt, Yersinia pestis
ugcucaaacucagcauca

SEQ ID NO: 2242696 - RNA, 16 nt, Yersinia pestis
ugcuauuuuauaucga

SEQ ID NO: 2242697 - RNA, 20 nt, Yersinia pestis
ugcguguucuucucaccccg

SEQ ID NO: 2242698 - RNA, 15 nt, Yersinia pestis
ugcuugauggcauca

SEQ ID NO: 2242699 - RNA, 20 nt, Yersinia pestis
ugcuguuuaccuaucucagu

SEQ ID NO: 2242700 - RNA, 23 nt, Yersinia pestis
ugcuucauggcuaaauccacacg

SEQ ID NO: 2242701 - RNA, 16 nt, Yersinia pestis
ugcuuccaggauauuc

SEQ ID NO: 2242702 - RNA, 21 nt, Yersinia pestis
ugcugucgagcaaaucgauac

SEQ ID NO: 2242703 - RNA, 23 nt, Yersinia pestis
ugcuguauuuuucgcaguaacgg

SEQ ID NO: 2242704 - RNA, 18 nt, Yersinia pestis
ugcugguaaaaacaccau

SEQ ID NO: 2242705 - RNA, 15 nt, Yersinia pestis
ugcuggaggcuggca

SEQ ID NO: 2242706 - RNA, 16 nt, Yersinia pestis
ugcugccuugcugcaa

SEQ ID NO: 2242707 - RNA, 15 nt, Yersinia pestis
ugcugccugccugcu

SEQ ID NO: 2242708 - RNA, 13 nt, Yersinia pestis
ugcugaugucagu

SEQ ID NO: 2242709 - RNA, 17 nt, Yersinia pestis
ugcugcccaaaaucaaa

SEQ ID NO: 2242710 - RNA, 16 nt, Yersinia pestis
uccuuacuccaacagu

SEQ ID NO: 2242711 - RNA, 16 nt, Yersinia pestis
uccuucaauggcauuu

SEQ ID NO: 2242712 - RNA, 16 nt, Yersinia pestis
uccuggcgauccagug

SEQ ID NO: 2242713 - RNA, 13 nt, Yersinia pestis
uccugauuccaaa

SEQ ID NO: 2242714 - RNA, 20 nt, Yersinia pestis
ucgacagucacuaauaccug

SEQ ID NO: 2242715 - RNA, 18 nt, Yersinia pestis
ucgacagaaagcugaucg

SEQ ID NO: 2242716 - RNA, 22 nt, Yersinia pestis
ucccguuuuauuacugauacca

SEQ ID NO: 2242717 - RNA, 16 nt, Yersinia pestis
ucccgucaccagucgu

SEQ ID NO: 2242718 - RNA, 19 nt, Yersinia pestis
uccaugauauaucagucuu

SEQ ID NO: 2242719 - RNA, 19 nt, Yersinia pestis
ucccuugacugaccauaaa

SEQ ID NO: 2242720 - RNA, 15 nt, Yersinia pestis
uccguugguugcacg

SEQ ID NO: 2242721 - RNA, 22 nt, Yersinia pestis
uccuauaucucaguugaaaccc

SEQ ID NO: 2242722 - RNA, 17 nt, Yersinia pestis
uccagcggcguaucaaa

SEQ ID NO: 2242723 - RNA, 18 nt, Yersinia pestis
uccagccccaaacacuua

SEQ ID NO: 2242724 - RNA, 15 nt, Yersinia pestis
uccacuagguccaua

SEQ ID NO: 2242725 - RNA, 19 nt, Yersinia pestis
ucaucaaaggcaauaccgg

SEQ ID NO: 2242726 - RNA, 13 nt, Yersinia pestis
ucaucagcagaga

SEQ ID NO: 2242727 - RNA, 16 nt, Yersinia pestis
ucaucaagccaauggc

SEQ ID NO: 2242728 - RNA, 16 nt, Yersinia pestis
ucaucaacuucugcaa

SEQ ID NO: 2242729 - RNA, 22 nt, Yersinia pestis
ucaucagggaauucaccggcaa

SEQ ID NO: 2242730 - RNA, 11 nt, Yersinia pestis
ucaggucgcaa

SEQ ID NO: 2242731 - RNA, 20 nt, Yersinia pestis
ucagugacugggggugagca

SEQ ID NO: 2242732 - RNA, 23 nt, Yersinia pestis
uccaacaguagcuugaucggaua

SEQ ID NO: 2242733 - RNA, 19 nt, Yersinia pestis
ucauugaggguugucagca

SEQ ID NO: 2242734 - RNA, 21 nt, Yersinia pestis
ucaugagaaguuuuuggcgaa

SEQ ID NO: 2242735 - RNA, 23 nt, Yersinia pestis
ucaugacgaugaccucgcccuuu

SEQ ID NO: 2242736 - RNA, 19 nt, Yersinia pestis
ucaucgggguuugucagcc

SEQ ID NO: 2242737 - RNA, 19 nt, Yersinia pestis
ucaucgcggcgcacaucau

SEQ ID NO: 2242738 - RNA, 21 nt, Yersinia pestis
ucaggccgcgccacaacgcau

SEQ ID NO: 2242739 - RNA, 15 nt, Yersinia pestis
ucagcguugacacca

SEQ ID NO: 2242740 - RNA, 18 nt, Yersinia pestis
ucagcgguggcgggaaca

SEQ ID NO: 2242741 - RNA, 16 nt, Yersinia pestis
ucagcgucacggaaag

SEQ ID NO: 2242742 - RNA, 16 nt, Yersinia pestis
ucagcgggaaagcgua

SEQ ID NO: 2242743 - RNA, 15 nt, Yersinia pestis
ucagccaccauuggc

SEQ ID NO: 2242744 - RNA, 15 nt, Yersinia pestis
ucacgauaauaucga

SEQ ID NO: 2242745 - RNA, 16 nt, Yersinia pestis
ucaccugucaccuguc

SEQ ID NO: 2242746 - RNA, 20 nt, Yersinia pestis
uauuguuucugauaucuaaa

SEQ ID NO: 2242747 - RNA, 22 nt, Yersinia pestis
ucaccgauacuuccagugguuu

SEQ ID NO: 2242748 - RNA, 15 nt, Yersinia pestis
ucacugaccgauuga

SEQ ID NO: 2242749 - RNA, 13 nt, Yersinia pestis
ucacugaauccca

SEQ ID NO: 2242750 - RNA, 19 nt, Yersinia pestis
ucagcaacgcgaugcauua

SEQ ID NO: 2242751 - RNA, 13 nt, Yersinia pestis
uaagauucgccgc

SEQ ID NO: 2242752 - RNA, 23 nt, Yersinia pestis
uaagacaccacaucacgcagcgc

SEQ ID NO: 2242753 - RNA, 17 nt, Yersinia pestis
uaaucacgauacgacuu

SEQ ID NO: 2242754 - RNA, 17 nt, Yersinia pestis
uaaucuauuaauaucga

SEQ ID NO: 2242755 - RNA, 14 nt, Yersinia pestis
uaaucucuccauga

SEQ ID NO: 2242756 - RNA, 14 nt, Yersinia pestis
uaauauuucaaaug

SEQ ID NO: 2242757 - RNA, 21 nt, Yersinia pestis
uaauaugaccggacauaagau

SEQ ID NO: 2242758 - RNA, 11 nt, Yersinia pestis
uaauaccgaua

SEQ ID NO: 2242759 - RNA, 19 nt, Yersinia pestis
uaauacagcaccaccgaug

SEQ ID NO: 2242760 - RNA, 22 nt, Yersinia pestis
uaauaagacguuauuauugauu

SEQ ID NO: 2242761 - RNA, 24 nt, Yersinia pestis
uaaugcgacgacgacaaugaucgu

SEQ ID NO: 2242762 - RNA, 21 nt, Yersinia pestis
uaaugccggcggcccauaucc

SEQ ID NO: 2242763 - RNA, 14 nt, Yersinia pestis
uaauuuaucaguag

SEQ ID NO: 2242764 - RNA, 17 nt, Yersinia pestis
uaauuucacuaucguua

SEQ ID NO: 2242765 - RNA, 19 nt, Yersinia pestis
uacagacgccgacgcggcu

SEQ ID NO: 2242766 - RNA, 15 nt, Yersinia pestis
uacagcuaaagggua

SEQ ID NO: 2242767 - RNA, 17 nt, Yersinia pestis
uacaccguuguuggcga

SEQ ID NO: 2242768 - RNA, 21 nt, Yersinia pestis
uacacgcaguacgugacggca

SEQ ID NO: 2242769 - RNA, 20 nt, Yersinia pestis
uaaaaccggagucaaucauu

SEQ ID NO: 2242770 - RNA, 20 nt, Yersinia pestis
uaaaacgacacuaaccguaa

SEQ ID NO: 2242771 - RNA, 22 nt, Yersinia pestis
uaaaacgcacacugcagauuag

SEQ ID NO: 2242772 - RNA, 19 nt, Yersinia pestis
uaaaacuggcgauagcggc

SEQ ID NO: 2242773 - RNA, 23 nt, Yersinia pestis
uaaaacuggcacgaacaaucgcc

SEQ ID NO: 2242774 - RNA, 14 nt, Yersinia pestis
uaaaaccacugacc

SEQ ID NO: 2242775 - RNA, 22 nt, Yersinia pestis
uaaaaccacugaccuauugaua

SEQ ID NO: 2242776 - RNA, 22 nt, Yersinia pestis
uaaaaaagguggccauuacgcc

SEQ ID NO: 2242777 - RNA, 15 nt, Yersinia pestis
uaaaauuaauuacuu

SEQ ID NO: 2242778 - RNA, 21 nt, Yersinia pestis
uaaacgaccauuucucugaug

SEQ ID NO: 2242779 - RNA, 12 nt, Yersinia pestis
uaaacgccaguc

SEQ ID NO: 2242780 - RNA, 18 nt, Yersinia pestis
uaaacggcgguuaaucgg

SEQ ID NO: 2242781 - RNA, 16 nt, Yersinia pestis
uaaagccauucagcag

SEQ ID NO: 2242782 - RNA, 22 nt, Yersinia pestis
uaaauaucagugacaccauuga

SEQ ID NO: 2242783 - RNA, 19 nt, Yersinia pestis
uaaauauccucggccagug

SEQ ID NO: 2242784 - RNA, 22 nt, Yersinia pestis
uaaccccauauugcucgcgaua

SEQ ID NO: 2242785 - RNA, 16 nt, Yersinia pestis
uaaccccgucgccgca

SEQ ID NO: 2242786 - RNA, 14 nt, Yersinia pestis
uaaccuauacgcuc

SEQ ID NO: 2242787 - RNA, 21 nt, Yersinia pestis
uaaccucaggcccgcuaucac

SEQ ID NO: 2242788 - RNA, 19 nt, Yersinia pestis
uaaccgcuguaaacuggca

SEQ ID NO: 2242789 - RNA, 16 nt, Yersinia pestis
uaaccgcuaaggccaa

SEQ ID NO: 2242790 - RNA, 21 nt, Yersinia pestis
uaacuuaucgaccaacuggca

SEQ ID NO: 2242791 - RNA, 22 nt, Yersinia pestis
uaacguguuuaucgaucaaacc

SEQ ID NO: 2242792 - RNA, 22 nt, Yersinia pestis
uaacuuuucgggcuaaagacac

SEQ ID NO: 2242793 - RNA, 17 nt, Yersinia pestis
uaacuuuccauccagaa

SEQ ID NO: 2242794 - RNA, 15 nt, Yersinia pestis
uaacuuuaucagucu

SEQ ID NO: 2242795 - RNA, 12 nt, Yersinia pestis
uaacgggagauu

SEQ ID NO: 2242796 - RNA, 16 nt, Yersinia pestis
uaaauccaaaugccca

SEQ ID NO: 2242797 - RNA, 23 nt, Yersinia pestis
uaaaucagacgagucuauugaaa

SEQ ID NO: 2242798 - RNA, 18 nt, Yersinia pestis
uaaauucaaauaucauua

SEQ ID NO: 2242799 - RNA, 16 nt, Yersinia pestis
uaaauuccuggcggca

SEQ ID NO: 2242800 - RNA, 11 nt, Yersinia pestis
uaaauuggccg

SEQ ID NO: 2242801 - RNA, 16 nt, Yersinia pestis
uaacacuucagacuga

SEQ ID NO: 2242802 - RNA, 18 nt, Yersinia pestis
uaacacgaggcgcuacug

SEQ ID NO: 2242803 - RNA, 17 nt, Yersinia pestis
guuuccagcccaccagc

SEQ ID NO: 2242804 - RNA, 20 nt, Yersinia pestis
guuuaccuggaguaaugagg

SEQ ID NO: 2242805 - RNA, 14 nt, Yersinia pestis
guugucagcagucu

SEQ ID NO: 2242806 - RNA, 15 nt, Yersinia pestis
guuuucuauuuccac

SEQ ID NO: 2242807 - RNA, 21 nt, Yersinia pestis
guuuucccgacagaacugauu

SEQ ID NO: 2242808 - RNA, 18 nt, Yersinia pestis
guuuugccgggcaauugu

SEQ ID NO: 2242809 - RNA, 17 nt, Yersinia pestis
guuuguuacgggcacug

SEQ ID NO: 2242810 - RNA, 13 nt, Yersinia pestis
guuuuaaauuacg

SEQ ID NO: 2242811 - RNA, 17 nt, Yersinia pestis
guuuuaauaucugccgc

SEQ ID NO: 2242812 - RNA, 15 nt, Yersinia pestis
guuuuaucaauaggu

SEQ ID NO: 2242813 - RNA, 22 nt, Yersinia pestis
guuuuaucaauaggucaguggu

SEQ ID NO: 2242814 - RNA, 19 nt, Yersinia pestis
guuuuagucucgcagccgc

SEQ ID NO: 2242815 - RNA, 22 nt, Yersinia pestis
guuucuucguuugcuaaugcgg

SEQ ID NO: 2242816 - RNA, 12 nt, Yersinia pestis
guuugcagcacu

SEQ ID NO: 2242817 - RNA, 15 nt, Yersinia pestis
guugagguacggcuc

SEQ ID NO: 2242818 - RNA, 15 nt, Yersinia pestis
guugcagcacgccag

SEQ ID NO: 2242819 - RNA, 18 nt, Yersinia pestis
guugccacggaaacguuc

SEQ ID NO: 2242820 - RNA, 15 nt, Yersinia pestis
guugccaauguugcu

SEQ ID NO: 2242821 - RNA, 15 nt, Yersinia pestis
guucuaaaacgucuc

SEQ ID NO: 2242822 - RNA, 20 nt, Yersinia pestis
guugaauaccaagccaaauu

SEQ ID NO: 2242823 - RNA, 19 nt, Yersinia pestis
guugacucgcggcaggcau

SEQ ID NO: 2242824 - RNA, 15 nt, Yersinia pestis
uaguuaaucgcagca

SEQ ID NO: 2242825 - RNA, 17 nt, Yersinia pestis
uaguuaccgggcgaaca

SEQ ID NO: 2242826 - RNA, 20 nt, Yersinia pestis
uaguucaauggucaugcaca

SEQ ID NO: 2242827 - RNA, 16 nt, Yersinia pestis
uaguggugagcgccau

SEQ ID NO: 2242828 - RNA, 13 nt, Yersinia pestis
uagucggcauuaa

SEQ ID NO: 2242829 - RNA, 13 nt, Yersinia pestis
uagugaugcagua

SEQ ID NO: 2242830 - RNA, 16 nt, Yersinia pestis
uagguaauaccaaugc

SEQ ID NO: 2242831 - RNA, 14 nt, Yersinia pestis
uaguaaugacgcua

SEQ ID NO: 2242832 - RNA, 15 nt, Yersinia pestis
uaguauuuaacgcca

SEQ ID NO: 2242833 - RNA, 14 nt, Yersinia pestis
uagucauuaagaau

SEQ ID NO: 2242834 - RNA, 18 nt, Yersinia pestis
uagucaucaugacgauga

SEQ ID NO: 2242835 - RNA, 14 nt, Yersinia pestis
uauauuauuaacga

SEQ ID NO: 2242836 - RNA, 14 nt, Yersinia pestis
uauaggguauaugc

SEQ ID NO: 2242837 - RNA, 22 nt, Yersinia pestis
uauaguuuauuuuauuuaauca

SEQ ID NO: 2242838 - RNA, 17 nt, Yersinia pestis
uauaggcgcauaugaaa

SEQ ID NO: 2242839 - RNA, 20 nt, Yersinia pestis
uauagcgguaaccgacauca

SEQ ID NO: 2242840 - RNA, 15 nt, Yersinia pestis
uauaccgauuaccgg

SEQ ID NO: 2242841 - RNA, 22 nt, Yersinia pestis
uauacaccucaacgugauaugc

SEQ ID NO: 2242842 - RNA, 21 nt, Yersinia pestis
uauacuguuaacucgccaaca

SEQ ID NO: 2242843 - RNA, 18 nt, Yersinia pestis
uauacguaugcgcaccga

SEQ ID NO: 2242844 - RNA, 15 nt, Yersinia pestis
uauaaaccagccagu

SEQ ID NO: 2242845 - RNA, 14 nt, Yersinia pestis
uauacaccccauca

SEQ ID NO: 2242846 - RNA, 16 nt, Yersinia pestis
uauaagcaauaccgac

SEQ ID NO: 2242847 - RNA, 14 nt, Yersinia pestis
uaugggcuucgcca

SEQ ID NO: 2242848 - RNA, 23 nt, Yersinia pestis
uauuaaguuuuucauaaucaccu

SEQ ID NO: 2242849 - RNA, 22 nt, Yersinia pestis
uauuaaagcacuaagauucaaa

SEQ ID NO: 2242850 - RNA, 22 nt, Yersinia pestis
uauugcucagggccacuucggu

SEQ ID NO: 2242851 - RNA, 12 nt, Yersinia pestis
uauuggcgagca

SEQ ID NO: 2242852 - RNA, 24 nt, Yersinia pestis
uauuggcgaucgcaguaugcgaaa

SEQ ID NO: 2242853 - RNA, 18 nt, Yersinia pestis
uauuccuuguggugauga

SEQ ID NO: 2242854 - RNA, 16 nt, Yersinia pestis
uauucaugguuucaaa

SEQ ID NO: 2242855 - RNA, 11 nt, Yersinia pestis
uauucagccaa

SEQ ID NO: 2242856 - RNA, 14 nt, Yersinia pestis
uauuauucaguuua

SEQ ID NO: 2242857 - RNA, 16 nt, Yersinia pestis
uauucaaaaucugaua

SEQ ID NO: 2242858 - RNA, 17 nt, Yersinia pestis
uauccauccccgccuca

SEQ ID NO: 2242859 - RNA, 21 nt, Yersinia pestis
uauccagguuguaccgccaua

SEQ ID NO: 2242860 - RNA, 15 nt, Yersinia pestis
uauccaauaccgaua

SEQ ID NO: 2242861 - RNA, 12 nt, Yersinia pestis
uauccaauggcu

SEQ ID NO: 2242862 - RNA, 15 nt, Yersinia pestis
uauccagcgccauca

SEQ ID NO: 2242863 - RNA, 21 nt, Yersinia pestis
uaucagccguuucuuucaaua

SEQ ID NO: 2242864 - RNA, 18 nt, Yersinia pestis
uaucaccccguuacggcu

SEQ ID NO: 2242865 - RNA, 21 nt, Yersinia pestis
uaucaacaauuuccauaucaa

SEQ ID NO: 2242866 - RNA, 12 nt, Yersinia pestis
uaucaaugggau

SEQ ID NO: 2242867 - RNA, 13 nt, Yersinia pestis
uaucaauaccgaa

SEQ ID NO: 2242868 - RNA, 17 nt, Yersinia pestis
uaucaaagaauuccggc

SEQ ID NO: 2242869 - RNA, 14 nt, Yersinia pestis
uaucuaaaauaucu

SEQ ID NO: 2242870 - RNA, 19 nt, Yersinia pestis
uaucgguauuaccaaucag

SEQ ID NO: 2242871 - RNA, 18 nt, Yersinia pestis
uauccucaccguucaaga

SEQ ID NO: 2242872 - RNA, 19 nt, Yersinia pestis
uauccccugagaaacaucc

SEQ ID NO: 2242873 - RNA, 18 nt, Yersinia pestis
uaucccauuaaugaguaa

SEQ ID NO: 2242874 - RNA, 13 nt, Yersinia pestis
uaucccuccauca

SEQ ID NO: 2242875 - RNA, 19 nt, Yersinia pestis
uaccuauggcgaagagaac

SEQ ID NO: 2242876 - RNA, 19 nt, Yersinia pestis
uaccucaagcugcauguac

SEQ ID NO: 2242877 - RNA, 13 nt, Yersinia pestis
uacaugcuguuca

SEQ ID NO: 2242878 - RNA, 16 nt, Yersinia pestis
uacauuauuauuuaca

SEQ ID NO: 2242879 - RNA, 19 nt, Yersinia pestis
uaccaaaaagcaacuuggc

SEQ ID NO: 2242880 - RNA, 13 nt, Yersinia pestis
uacggauugcaaa

SEQ ID NO: 2242881 - RNA, 13 nt, Yersinia pestis
uacucauugcacc

SEQ ID NO: 2242882 - RNA, 15 nt, Yersinia pestis
uacucccgccaagaa

SEQ ID NO: 2242883 - RNA, 12 nt, Yersinia pestis
uacgugacggca

SEQ ID NO: 2242884 - RNA, 19 nt, Yersinia pestis
uacgugagcaucuggcgca

SEQ ID NO: 2242885 - RNA, 17 nt, Yersinia pestis
uacgugucagacugcug

SEQ ID NO: 2242886 - RNA, 20 nt, Yersinia pestis
uacgguagcgauauccuuac

SEQ ID NO: 2242887 - RNA, 18 nt, Yersinia pestis
uacggcgcaucgccaucc

SEQ ID NO: 2242888 - RNA, 20 nt, Yersinia pestis
uagaauaaguugaugcagua

SEQ ID NO: 2242889 - RNA, 16 nt, Yersinia pestis
uagaaaagcgccauca

SEQ ID NO: 2242890 - RNA, 18 nt, Yersinia pestis
uacuuacccgaaucacuu

SEQ ID NO: 2242891 - RNA, 23 nt, Yersinia pestis
uacugaacgucauaauugccaaa

SEQ ID NO: 2242892 - RNA, 19 nt, Yersinia pestis
uacuccuugaauagccaga

SEQ ID NO: 2242893 - RNA, 14 nt, Yersinia pestis
uagcugacacgcca

SEQ ID NO: 2242894 - RNA, 15 nt, Yersinia pestis
uagcucgcuacgccu

SEQ ID NO: 2242895 - RNA, 18 nt, Yersinia pestis
uagcucaucguauuggcc

SEQ ID NO: 2242896 - RNA, 18 nt, Yersinia pestis
uaggcuauuuuacuugcc

SEQ ID NO: 2242897 - RNA, 23 nt, Yersinia pestis
uaggcggugagggagucagggag

SEQ ID NO: 2242898 - RNA, 18 nt, Yersinia pestis
uagggccguuuaccuugu

SEQ ID NO: 2242899 - RNA, 19 nt, Yersinia pestis
uagggcacuuucaucgccg

SEQ ID NO: 2242900 - RNA, 11 nt, Yersinia pestis
uagauugcgcg

SEQ ID NO: 2242901 - RNA, 17 nt, Yersinia pestis
uagcaaagcgauaucgu

SEQ ID NO: 2242902 - RNA, 20 nt, Yersinia pestis
uagauaugaucgcggcaauc

SEQ ID NO: 2242903 - RNA, 18 nt, Yersinia pestis
uagccugagcaauauguu

SEQ ID NO: 2242904 - RNA, 22 nt, Yersinia pestis
uagccuuuuugcaucaccauca

SEQ ID NO: 2242905 - RNA, 14 nt, Yersinia pestis
uagcgaaccuuagc

SEQ ID NO: 2242906 - RNA, 15 nt, Yersinia pestis
uagcgaaucacauca

SEQ ID NO: 2242907 - RNA, 18 nt, Yersinia pestis
uagcgcuaagcccgugau

SEQ ID NO: 2242908 - RNA, 17 nt, Yersinia pestis
uagcgcugcagcaucaa

SEQ ID NO: 2242909 - RNA, 21 nt, Yersinia pestis
uagcuagccccaaucaagcaa

SEQ ID NO: 2242910 - RNA, 21 nt, Yersinia pestis
ggagucagaugccgcuuuagu

SEQ ID NO: 2242911 - RNA, 22 nt, Yersinia pestis
ggauaaauuaauaacgccgagu

SEQ ID NO: 2242912 - RNA, 23 nt, Yersinia pestis
ggauaccaaucccuacggcaauc

SEQ ID NO: 2242913 - RNA, 16 nt, Yersinia pestis
ggagcaaguuaacgcu

SEQ ID NO: 2242914 - RNA, 20 nt, Yersinia pestis
ggauaugauguuacggguaa

SEQ ID NO: 2242915 - RNA, 19 nt, Yersinia pestis
ggaugccggaaucagccag

SEQ ID NO: 2242916 - RNA, 19 nt, Yersinia pestis
ggaucuauucccugcaauu

SEQ ID NO: 2242917 - RNA, 20 nt, Yersinia pestis
ggacagaaaacaaucuggca

SEQ ID NO: 2242918 - RNA, 17 nt, Yersinia pestis
gcuugcuuugcuucauc

SEQ ID NO: 2242919 - RNA, 19 nt, Yersinia pestis
gcuuggauuccgucgccaa

SEQ ID NO: 2242920 - RNA, 21 nt, Yersinia pestis
gcuugcugccuugcugcaacg

SEQ ID NO: 2242921 - RNA, 17 nt, Yersinia pestis
gcuguuggcuauuacug

SEQ ID NO: 2242922 - RNA, 12 nt, Yersinia pestis
gcuugccaaaua

SEQ ID NO: 2242923 - RNA, 23 nt, Yersinia pestis
gcugauguuucuuugcgccauac

SEQ ID NO: 2242924 - RNA, 14 nt, Yersinia pestis
gcugauuaaugagg

SEQ ID NO: 2242925 - RNA, 17 nt, Yersinia pestis
gcugcccgaguaagcgc

SEQ ID NO: 2242926 - RNA, 17 nt, Yersinia pestis
gcuccagguucauuauu

SEQ ID NO: 2242927 - RNA, 23 nt, Yersinia pestis
gcucggcgggauaucgauggcaa

SEQ ID NO: 2242928 - RNA, 22 nt, Yersinia pestis
gcucuugagguuauugacaaag

SEQ ID NO: 2242929 - RNA, 18 nt, Yersinia pestis
gcucucugagccauccag

SEQ ID NO: 2242930 - RNA, 13 nt, Yersinia pestis
gcucucugagcca

SEQ ID NO: 2242931 - RNA, 22 nt, Yersinia pestis
gcugucacugucaaaaccaaua

SEQ ID NO: 2242932 - RNA, 12 nt, Yersinia pestis
gcuggaaauuca

SEQ ID NO: 2242933 - RNA, 14 nt, Yersinia pestis
gcuggaucagcaga

SEQ ID NO: 2242934 - RNA, 22 nt, Yersinia pestis
gcuggcauuuuuauuuaccgaa

SEQ ID NO: 2242935 - RNA, 17 nt, Yersinia pestis
gcuagugauagcgggcc

SEQ ID NO: 2242936 - RNA, 11 nt, Yersinia pestis
gcuaucacuag

SEQ ID NO: 2242937 - RNA, 17 nt, Yersinia pestis
gcuauaucaucagcaga

SEQ ID NO: 2242938 - RNA, 13 nt, Yersinia pestis
gcuaugcgcaauc

SEQ ID NO: 2242939 - RNA, 15 nt, Yersinia pestis
gcuaugcagcccaga

SEQ ID NO: 2242940 - RNA, 14 nt, Yersinia pestis
gcuauuaggcuuua

SEQ ID NO: 2242941 - RNA, 12 nt, Yersinia pestis
gcucaacugcuc

SEQ ID NO: 2242942 - RNA, 16 nt, Yersinia pestis
gcucaaucucugccug

SEQ ID NO: 2242943 - RNA, 15 nt, Yersinia pestis
gcuacgguucaucau

SEQ ID NO: 2242944 - RNA, 19 nt, Yersinia pestis
gcuaccucguaguaaugac

SEQ ID NO: 2242945 - RNA, 21 nt, Yersinia pestis
gcuaccgcgcugcuugcaaca

SEQ ID NO: 2242946 - RNA, 13 nt, Yersinia pestis
gcucaggcgguca

SEQ ID NO: 2242947 - RNA, 19 nt, Yersinia pestis
gcucagcgccauauccaac

SEQ ID NO: 2242948 - RNA, 17 nt, Yersinia pestis
gcucacgcguaaaugga

SEQ ID NO: 2242949 - RNA, 17 nt, Yersinia pestis
gcucaccuuguggcaca

SEQ ID NO: 2242950 - RNA, 21 nt, Yersinia pestis
gcucacuuuuauauccgccau

SEQ ID NO: 2242951 - RNA, 23 nt, Yersinia pestis
gcucacuuuuauauccgccaucc

SEQ ID NO: 2242952 - RNA, 11 nt, Yersinia pestis
gcucaucgcca

SEQ ID NO: 2242953 - RNA, 22 nt, Yersinia pestis
gcucaucaaccucagccucauu

SEQ ID NO: 2242954 - RNA, 12 nt, Yersinia pestis
gcguaaagcacc

SEQ ID NO: 2242955 - RNA, 18 nt, Yersinia pestis
gcgucgccaccccauuac

SEQ ID NO: 2242956 - RNA, 15 nt, Yersinia pestis
gcguuaaccaguagc

SEQ ID NO: 2242957 - RNA, 18 nt, Yersinia pestis
gcguuccaaucugcgccc

SEQ ID NO: 2242958 - RNA, 15 nt, Yersinia pestis
gcgucugauaaccgu

SEQ ID NO: 2242959 - RNA, 21 nt, Yersinia pestis
gcgguaaccagcaucaguagc

SEQ ID NO: 2242960 - RNA, 20 nt, Yersinia pestis
gcggguuuuuuuacauauaa

SEQ ID NO: 2242961 - RNA, 14 nt, Yersinia pestis
gcgguuacguucac

SEQ ID NO: 2242962 - RNA, 19 nt, Yersinia pestis
gcgguuacguucaccuaaa

SEQ ID NO: 2242963 - RNA, 15 nt, Yersinia pestis
gcgguauugaucacg

SEQ ID NO: 2242964 - RNA, 16 nt, Yersinia pestis
gcgaugaggcucuucu

SEQ ID NO: 2242965 - RNA, 22 nt, Yersinia pestis
gcgaucuauucucuguaauggc

SEQ ID NO: 2242966 - RNA, 15 nt, Yersinia pestis
gcgacuaauggccag

SEQ ID NO: 2242967 - RNA, 14 nt, Yersinia pestis
gcgagcaauaccaa

SEQ ID NO: 2242968 - RNA, 17 nt, Yersinia pestis
gcgaauuaucauccaga

SEQ ID NO: 2242969 - RNA, 14 nt, Yersinia pestis
gccucaucucauga

SEQ ID NO: 2242970 - RNA, 14 nt, Yersinia pestis
gccguuaucaauaa

SEQ ID NO: 2242971 - RNA, 17 nt, Yersinia pestis
gccgugucggaugccgc

SEQ ID NO: 2242972 - RNA, 15 nt, Yersinia pestis
gccgugggcaauaac

SEQ ID NO: 2242973 - RNA, 23 nt, Yersinia pestis
gccuuagcacguuuuucagcuuc

SEQ ID NO: 2242974 - RNA, 14 nt, Yersinia pestis
gccuuaaccaagca

SEQ ID NO: 2242975 - RNA, 13 nt, Yersinia pestis
gccuucugaaacc

SEQ ID NO: 2242976 - RNA, 22 nt, Yersinia pestis
gccugcguaaucguauucucaa

SEQ ID NO: 2242977 - RNA, 22 nt, Yersinia pestis
gccugaugagaaugugacucag

SEQ ID NO: 2242978 - RNA, 19 nt, Yersinia pestis
gcggacagcgcgcagccaa

SEQ ID NO: 2242979 - RNA, 18 nt, Yersinia pestis
gcggauaucgggcggaua

SEQ ID NO: 2242980 - RNA, 22 nt, Yersinia pestis
gcggcaccuucacgcaucacau

SEQ ID NO: 2242981 - RNA, 18 nt, Yersinia pestis
gcggauuuuguugaggua

SEQ ID NO: 2242982 - RNA, 22 nt, Yersinia pestis
gcgcggcuaaauauaaccaaag

SEQ ID NO: 2242983 - RNA, 23 nt, Yersinia pestis
gcgccaucgcuaaucauauccau

SEQ ID NO: 2242984 - RNA, 18 nt, Yersinia pestis
gcgcccggcccacuucgu

SEQ ID NO: 2242985 - RNA, 12 nt, Yersinia pestis
gcgcgauaguca

SEQ ID NO: 2242986 - RNA, 12 nt, Yersinia pestis
gcgccugauugg

SEQ ID NO: 2242987 - RNA, 15 nt, Yersinia pestis
gucugaaacgccagc

SEQ ID NO: 2242988 - RNA, 20 nt, Yersinia pestis
gucuuccaugacaaaauacg

SEQ ID NO: 2242989 - RNA, 15 nt, Yersinia pestis
gucuuagacgucaga

SEQ ID NO: 2242990 - RNA, 17 nt, Yersinia pestis
gucuucaguggcuggaa

SEQ ID NO: 2242991 - RNA, 20 nt, Yersinia pestis
gugaaagcaucccuucgcaa

SEQ ID NO: 2242992 - RNA, 16 nt, Yersinia pestis
gucuuugagcucaccg

SEQ ID NO: 2242993 - RNA, 15 nt, Yersinia pestis
gucgcugaaaugcua

SEQ ID NO: 2242994 - RNA, 19 nt, Yersinia pestis
gucgccaguugcagcaagc

SEQ ID NO: 2242995 - RNA, 20 nt, Yersinia pestis
gucgcacccaaacugucugc

SEQ ID NO: 2242996 - RNA, 21 nt, Yersinia pestis
gucgaugaccugcugcaccuc

SEQ ID NO: 2242997 - RNA, 16 nt, Yersinia pestis
guggauccagcaccac

SEQ ID NO: 2242998 - RNA, 23 nt, Yersinia pestis
gugcuuuauccaauggcucaccu

SEQ ID NO: 2242999 - RNA, 12 nt, Yersinia pestis
guggcacugacg

SEQ ID NO: 2243000 - RNA, 16 nt, Yersinia pestis
guggcauaaucaacgc

SEQ ID NO: 2243001 - RNA, 12 nt, Yersinia pestis
guggccauuacg

SEQ ID NO: 2243002 - RNA, 18 nt, Yersinia pestis
guggcuauuagccgauca

SEQ ID NO: 2243003 - RNA, 15 nt, Yersinia pestis
gugaacaucuggcga

SEQ ID NO: 2243004 - RNA, 18 nt, Yersinia pestis
gugcaucuuccaauucau

SEQ ID NO: 2243005 - RNA, 15 nt, Yersinia pestis
gugcauaaaacgauu

SEQ ID NO: 2243006 - RNA, 19 nt, Yersinia pestis
gugcucauuaaaaccacgc

SEQ ID NO: 2243007 - RNA, 19 nt, Yersinia pestis
gugcgacacgcucauccaa

SEQ ID NO: 2243008 - RNA, 13 nt, Yersinia pestis
gugccugcuggca

SEQ ID NO: 2243009 - RNA, 16 nt, Yersinia pestis
gugcgcaucagccagc

SEQ ID NO: 2243010 - RNA, 17 nt, Yersinia pestis
gugcgcaucagccagcc

SEQ ID NO: 2243011 - RNA, 22 nt, Yersinia pestis
guaaaaucuuucuguucagcau

SEQ ID NO: 2243012 - RNA, 20 nt, Yersinia pestis
guaaacaauaauucgcaugg

SEQ ID NO: 2243013 - RNA, 13 nt, Yersinia pestis
guaaacagccagc

SEQ ID NO: 2243014 - RNA, 17 nt, Yersinia pestis
guaacccuuuggcaacc

SEQ ID NO: 2243015 - RNA, 19 nt, Yersinia pestis
guaacccgccucgcuuacu

SEQ ID NO: 2243016 - RNA, 24 nt, Yersinia pestis
guaacagagccuuauaggcgcaua

SEQ ID NO: 2243017 - RNA, 13 nt, Yersinia pestis
guaacagcggcga

SEQ ID NO: 2243018 - RNA, 18 nt, Yersinia pestis
guaaaaaccaucugaugc

SEQ ID NO: 2243019 - RNA, 18 nt, Yersinia pestis
guaaaagccagucagggc

SEQ ID NO: 2243020 - RNA, 19 nt, Yersinia pestis
gguguguggcaauaaaggc

SEQ ID NO: 2243021 - RNA, 11 nt, Yersinia pestis
gguugaaaguu

SEQ ID NO: 2243022 - RNA, 16 nt, Yersinia pestis
ggucauuguagauggc

SEQ ID NO: 2243023 - RNA, 22 nt, Yersinia pestis
ggucgcgcccugcgcauugaua

SEQ ID NO: 2243024 - RNA, 23 nt, Yersinia pestis
ggugacauccgcuugcagcaaca

SEQ ID NO: 2243025 - RNA, 21 nt, Yersinia pestis
ggugaucgguuagcuacugau

SEQ ID NO: 2243026 - RNA, 16 nt, Yersinia pestis
ggugaucgcugccacc

SEQ ID NO: 2243027 - RNA, 20 nt, Yersinia pestis
guauuggcuaacuggcgcug

SEQ ID NO: 2243028 - RNA, 20 nt, Yersinia pestis
gucaacuaaacagaucaccc

SEQ ID NO: 2243029 - RNA, 21 nt, Yersinia pestis
guauucaaaauagaaaagcgc

SEQ ID NO: 2243030 - RNA, 17 nt, Yersinia pestis
guauuaccaaucagcgc

SEQ ID NO: 2243031 - RNA, 19 nt, Yersinia pestis
guauguuuucggcuugcaa

SEQ ID NO: 2243032 - RNA, 16 nt, Yersinia pestis
guaucggguagcaucc

SEQ ID NO: 2243033 - RNA, 23 nt, Yersinia pestis
gucaccugaaugccauucaagcc

SEQ ID NO: 2243034 - RNA, 21 nt, Yersinia pestis
gucaauaaccucagccucauu

SEQ ID NO: 2243035 - RNA, 13 nt, Yersinia pestis
gucaauaccuuac

SEQ ID NO: 2243036 - RNA, 14 nt, Yersinia pestis
gucaauaccuuacu

SEQ ID NO: 2243037 - RNA, 14 nt, Yersinia pestis
gucacucaauugga

SEQ ID NO: 2243038 - RNA, 17 nt, Yersinia pestis
gucagccauugagcgaa

SEQ ID NO: 2243039 - RNA, 22 nt, Yersinia pestis
gucagcccaacgucauuuccgu

SEQ ID NO: 2243040 - RNA, 15 nt, Yersinia pestis
guaaucuaucaacgc

SEQ ID NO: 2243041 - RNA, 17 nt, Yersinia pestis
guaaucagacugcugac

SEQ ID NO: 2243042 - RNA, 22 nt, Yersinia pestis
guagaggcuuuaaucugcauca

SEQ ID NO: 2243043 - RNA, 15 nt, Yersinia pestis
guagagccuuuacgg

SEQ ID NO: 2243044 - RNA, 15 nt, Yersinia pestis
gucauuugcgcaaua

SEQ ID NO: 2243045 - RNA, 18 nt, Yersinia pestis
gucauugccugcucaccg

SEQ ID NO: 2243046 - RNA, 20 nt, Yersinia pestis
gucauuaccgcacacuacag

SEQ ID NO: 2243047 - RNA, 18 nt, Yersinia pestis
gucaugcaauuacugcau

SEQ ID NO: 2243048 - RNA, 12 nt, Yersinia pestis
gucauaccauuc

SEQ ID NO: 2243049 - RNA, 14 nt, Yersinia pestis
gucaguuuagcgag

SEQ ID NO: 2243050 - RNA, 14 nt, Yersinia pestis
gucaucacccagca

SEQ ID NO: 2243051 - RNA, 15 nt, Yersinia pestis
gucaggguaagcuga

SEQ ID NO: 2243052 - RNA, 14 nt, Yersinia pestis
gucagggugaaagc

SEQ ID NO: 2243053 - RNA, 12 nt, Yersinia pestis
gucagucagggu

SEQ ID NO: 2243054 - RNA, 14 nt, Yersinia pestis
gucagucuugcugc

SEQ ID NO: 2243055 - RNA, 19 nt, Yersinia pestis
gucagguuaauaccugcac

SEQ ID NO: 2243056 - RNA, 16 nt, Yersinia pestis
gucagcugacgcagca

SEQ ID NO: 2243057 - RNA, 23 nt, Yersinia pestis
guccacaacaccacuuugcugug

SEQ ID NO: 2243058 - RNA, 17 nt, Yersinia pestis
guccacagucaguucau

SEQ ID NO: 2243059 - RNA, 19 nt, Yersinia pestis
ggcagaggaguaaagcguc

SEQ ID NO: 2243060 - RNA, 14 nt, Yersinia pestis
ggcagugcgggcaa

SEQ ID NO: 2243061 - RNA, 16 nt, Yersinia pestis
ggccagaguuaugggc

SEQ ID NO: 2243062 - RNA, 20 nt, Yersinia pestis
ggccacccgccaucaggcaa

SEQ ID NO: 2243063 - RNA, 19 nt, Yersinia pestis
ggcauauaaccaugcgaua

SEQ ID NO: 2243064 - RNA, 23 nt, Yersinia pestis
ggccacacaccagucugcauaca

SEQ ID NO: 2243065 - RNA, 22 nt, Yersinia pestis
ggccaguaacgcuucaucaugg

SEQ ID NO: 2243066 - RNA, 18 nt, Yersinia pestis
ggccagccuugagccugc

SEQ ID NO: 2243067 - RNA, 13 nt, Yersinia pestis
ggccauuacgcca

SEQ ID NO: 2243068 - RNA, 16 nt, Yersinia pestis
ggccgaggaauaugcc

SEQ ID NO: 2243069 - RNA, 21 nt, Yersinia pestis
ggcgaguaucgugaccaauaa

SEQ ID NO: 2243070 - RNA, 17 nt, Yersinia pestis
ggccuauugaauaacag

SEQ ID NO: 2243071 - RNA, 18 nt, Yersinia pestis
ggccuugcuucugaacga

SEQ ID NO: 2243072 - RNA, 18 nt, Yersinia pestis
ggccgauacacaugguug

SEQ ID NO: 2243073 - RNA, 13 nt, Yersinia pestis
gggguucacgccu

SEQ ID NO: 2243074 - RNA, 14 nt, Yersinia pestis
ggguaagcugaacg

SEQ ID NO: 2243075 - RNA, 21 nt, Yersinia pestis
ggggcuuguugauaugagcga

SEQ ID NO: 2243076 - RNA, 14 nt, Yersinia pestis
gggucagcucuaca

SEQ ID NO: 2243077 - RNA, 14 nt, Yersinia pestis
gggcuaaaauggca

SEQ ID NO: 2243078 - RNA, 15 nt, Yersinia pestis
ggggauugcugccaa

SEQ ID NO: 2243079 - RNA, 21 nt, Yersinia pestis
ggcuuaucuuccagauagcga

SEQ ID NO: 2243080 - RNA, 20 nt, Yersinia pestis
ggcuuauuugcuaucaccgg

SEQ ID NO: 2243081 - RNA, 17 nt, Yersinia pestis
ggcugucccgaugauug

SEQ ID NO: 2243082 - RNA, 16 nt, Yersinia pestis
ggcucgacucaauaaa

SEQ ID NO: 2243083 - RNA, 16 nt, Yersinia pestis
ggcucgagccgcgcca

SEQ ID NO: 2243084 - RNA, 19 nt, Yersinia pestis
ugcaauccgcugacauugc

SEQ ID NO: 2243085 - RNA, 20 nt, Yersinia pestis
ugcacaaucucguuaucagc

SEQ ID NO: 2243086 - RNA, 11 nt, Yersinia pestis
ugcacaucauu

SEQ ID NO: 2243087 - RNA, 22 nt, Yersinia pestis
ugcaaauuaaccugcuggcgca

SEQ ID NO: 2243088 - RNA, 16 nt, Yersinia pestis
ugcaaauuagcggauu

SEQ ID NO: 2243089 - RNA, 19 nt, Yersinia pestis
ugcaaaugucagaucgcga

SEQ ID NO: 2243090 - RNA, 19 nt, Yersinia pestis
ugcaaacaggcccacugca

SEQ ID NO: 2243091 - RNA, 18 nt, Yersinia pestis
ugcaaccacuuauccagc

SEQ ID NO: 2243092 - RNA, 17 nt, Yersinia pestis
ugaugauauugacgggc

SEQ ID NO: 2243093 - RNA, 17 nt, Yersinia pestis
ugauccgccaaggccag

SEQ ID NO: 2243094 - RNA, 20 nt, Yersinia pestis
ugaugaugacggugaugucc

SEQ ID NO: 2243095 - RNA, 21 nt, Yersinia pestis
ugaucaucgauacaaaccguu

SEQ ID NO: 2243096 - RNA, 19 nt, Yersinia pestis
ugauuaugccacggcgaga

SEQ ID NO: 2243097 - RNA, 16 nt, Yersinia pestis
ugauuaauacacgcuu

SEQ ID NO: 2243098 - RNA, 21 nt, Yersinia pestis
ugauuaaccaagcucgccauc

SEQ ID NO: 2243099 - RNA, 17 nt, Yersinia pestis
ugauuaaaagucaacug

SEQ ID NO: 2243100 - RNA, 21 nt, Yersinia pestis
ugauucauaccuguacuuuga

SEQ ID NO: 2243101 - RNA, 19 nt, Yersinia pestis
ugauucgucugccauugcu

SEQ ID NO: 2243102 - RNA, 18 nt, Yersinia pestis
ugauucgucugccauugc

SEQ ID NO: 2243103 - RNA, 22 nt, Yersinia pestis
ugauuggcacccucuagcagcg

SEQ ID NO: 2243104 - RNA, 16 nt, Yersinia pestis
ugauuggacgauaacg

SEQ ID NO: 2243105 - RNA, 15 nt, Yersinia pestis
ugacuuagcucaucg

SEQ ID NO: 2243106 - RNA, 17 nt, Yersinia pestis
ugacuguuaacauccag

SEQ ID NO: 2243107 - RNA, 17 nt, Yersinia pestis
ugagacguccauaaucu

SEQ ID NO: 2243108 - RNA, 20 nt, Yersinia pestis
ugagacguccauaaucugga

SEQ ID NO: 2243109 - RNA, 13 nt, Yersinia pestis
ugagcaucuggcg

SEQ ID NO: 2243110 - RNA, 18 nt, Yersinia pestis
ugagcaaauuuaucagua

SEQ ID NO: 2243111 - RNA, 19 nt, Yersinia pestis
ugagcaccucuuccggcgu

SEQ ID NO: 2243112 - RNA, 22 nt, Yersinia pestis
ugacgguugcugggaucaccgc

SEQ ID NO: 2243113 - RNA, 13 nt, Yersinia pestis
ugaccauggcgau

SEQ ID NO: 2243114 - RNA, 18 nt, Yersinia pestis
ugaccauggcgaucaaag

SEQ ID NO: 2243115 - RNA, 15 nt, Yersinia pestis
ugagcugaucugcca

SEQ ID NO: 2243116 - RNA, 13 nt, Yersinia pestis
ugaguaucaauau

SEQ ID NO: 2243117 - RNA, 21 nt, Yersinia pestis
ugagucgucgaauccaugaug

SEQ ID NO: 2243118 - RNA, 22 nt, Yersinia pestis
ugagggugaugacaaugcguua

SEQ ID NO: 2243119 - RNA, 18 nt, Yersinia pestis
ugauagcgggcagacguu

SEQ ID NO: 2243120 - RNA, 13 nt, Yersinia pestis
ugcaucagcagug

SEQ ID NO: 2243121 - RNA, 20 nt, Yersinia pestis
ugcaggggaguauugcugag

SEQ ID NO: 2243122 - RNA, 16 nt, Yersinia pestis
ugcauugguugcggau

SEQ ID NO: 2243123 - RNA, 19 nt, Yersinia pestis
ugccaacgugaucgccgcu

SEQ ID NO: 2243124 - RNA, 14 nt, Yersinia pestis
ugccaaccaaucgg

SEQ ID NO: 2243125 - RNA, 15 nt, Yersinia pestis
ugccaauauaccggg

SEQ ID NO: 2243126 - RNA, 19 nt, Yersinia pestis
ugccaauauguuagcagca

SEQ ID NO: 2243127 - RNA, 20 nt, Yersinia pestis
ugccauaaccgcuaaggcca

SEQ ID NO: 2243128 - RNA, 20 nt, Yersinia pestis
ugccauugcucauguucgca

SEQ ID NO: 2243129 - RNA, 18 nt, Yersinia pestis
ugccaucaauaccaauaa

SEQ ID NO: 2243130 - RNA, 17 nt, Yersinia pestis
ugcccuaauaccaauac

SEQ ID NO: 2243131 - RNA, 22 nt, Yersinia pestis
ugccgauaaaaacuauccgccc

SEQ ID NO: 2243132 - RNA, 18 nt, Yersinia pestis
ugacagcaucaauaucgc

SEQ ID NO: 2243133 - RNA, 15 nt, Yersinia pestis
ugacaggcaaagacu

SEQ ID NO: 2243134 - RNA, 18 nt, Yersinia pestis
ugacauccgcuugcagca

SEQ ID NO: 2243135 - RNA, 10 nt, Yersinia pestis
ugacaucauc

SEQ ID NO: 2243136 - RNA, 17 nt, Yersinia pestis
ugaccaauaauaacggu

SEQ ID NO: 2243137 - RNA, 19 nt, Yersinia pestis
ugaauuagguaacuuucca

SEQ ID NO: 2243138 - RNA, 16 nt, Yersinia pestis
ugaauggaucacauca

SEQ ID NO: 2243139 - RNA, 19 nt, Yersinia pestis
ugaauggcaacgcgcagug

SEQ ID NO: 2243140 - RNA, 18 nt, Yersinia pestis
ugacacauauuucaggcu

SEQ ID NO: 2243141 - RNA, 11 nt, Yersinia pestis
ugacaacgugu

SEQ ID NO: 2243142 - RNA, 15 nt, Yersinia pestis
ugacaauaucaacgc

SEQ ID NO: 2243143 - RNA, 20 nt, Yersinia pestis
ugaacugacacacaccagug

SEQ ID NO: 2243144 - RNA, 14 nt, Yersinia pestis
ugaacuaucgccug

SEQ ID NO: 2243145 - RNA, 18 nt, Yersinia pestis
ugaagaugcuucagccac

SEQ ID NO: 2243146 - RNA, 13 nt, Yersinia pestis
ugaauauccgccg

SEQ ID NO: 2243147 - RNA, 13 nt, Yersinia pestis
ugaauaccgcugg

SEQ ID NO: 2243148 - RNA, 19 nt, Yersinia pestis
ugaagguacgcaccauuga

SEQ ID NO: 2243149 - RNA, 11 nt, Yersinia pestis
ugaaacagcag

SEQ ID NO: 2243150 - RNA, 22 nt, Yersinia pestis
ugaaacagcaggggcguuagcu

SEQ ID NO: 2243151 - RNA, 20 nt, Yersinia pestis
ucuuuuucggcaauauuggc

SEQ ID NO: 2243152 - RNA, 18 nt, Yersinia pestis
ucuugcaaggggcgagcc

SEQ ID NO: 2243153 - RNA, 22 nt, Yersinia pestis
ucuucugagauauguagcagca

SEQ ID NO: 2243154 - RNA, 15 nt, Yersinia pestis
ucuuaaaaauaacuu

SEQ ID NO: 2243155 - RNA, 18 nt, Yersinia pestis
ucugggguuucugucauu

SEQ ID NO: 2243156 - RNA, 23 nt, Yersinia pestis
ucugguaccgauaaaaguacaac

SEQ ID NO: 2243157 - RNA, 16 nt, Yersinia pestis
ucuguaaaaaucaccu

SEQ ID NO: 2243158 - RNA, 14 nt, Yersinia pestis
aauacugauagcgg

SEQ ID NO: 2243159 - RNA, 22 nt, Yersinia pestis
aauacuccuugaauagccagaa

SEQ ID NO: 2243160 - RNA, 16 nt, Yersinia pestis
ucuguggauugccaaa

SEQ ID NO: 2243161 - RNA, 12 nt, Yersinia pestis
ucuggcuggcau

SEQ ID NO: 2243162 - RNA, 15 nt, Yersinia pestis
ucugggcuggcaaca

SEQ ID NO: 2243163 - RNA, 18 nt, Yersinia pestis
ucuacuuuauucaauacu

SEQ ID NO: 2243164 - RNA, 16 nt, Yersinia pestis
ucuacgacgcccgauu

SEQ ID NO: 2243165 - RNA, 17 nt, Yersinia pestis
ucuacccuggcggcaaa

SEQ ID NO: 2243166 - RNA, 20 nt, Yersinia pestis
ucuaccgaucaaacagguaa

SEQ ID NO: 2243167 - RNA, 17 nt, Yersinia pestis
ucguuuuaauuugccuu

SEQ ID NO: 2243168 - RNA, 11 nt, Yersinia pestis
ucuaucugcag

SEQ ID NO: 2243169 - RNA, 18 nt, Yersinia pestis
ucuaucucaucuuaauca

SEQ ID NO: 2243170 - RNA, 21 nt, Yersinia pestis
ucuccguugaaaccuacauca

SEQ ID NO: 2243171 - RNA, 19 nt, Yersinia pestis
ucgucggcccggccaggcu

SEQ ID NO: 2243172 - RNA, 11 nt, Yersinia pestis
ucguugccaaa

SEQ ID NO: 2243173 - RNA, 14 nt, Yersinia pestis
ucguuguauuagcc

SEQ ID NO: 2243174 - RNA, 16 nt, Yersinia pestis
ucgcugagacccgauu

SEQ ID NO: 2243175 - RNA, 16 nt, Yersinia pestis
ucggcauacuccauuu

SEQ ID NO: 2243176 - RNA, 16 nt, Yersinia pestis
ucggccauuuacccgu

SEQ ID NO: 2243177 - RNA, 14 nt, Yersinia pestis
ucggcgucgccacc

SEQ ID NO: 2243178 - RNA, 21 nt, Yersinia pestis
ucgccauccgugcggaguuga

SEQ ID NO: 2243179 - RNA, 16 nt, Yersinia pestis
ucgccgguaauaccga

SEQ ID NO: 2243180 - RNA, 15 nt, Yersinia pestis
ucgccgcaaggcaaa

SEQ ID NO: 2243181 - RNA, 15 nt, Yersinia pestis
ucgaaaagcgccuuu

SEQ ID NO: 2243182 - RNA, 15 nt, Yersinia pestis
uccuguugcuggcca

SEQ ID NO: 2243183 - RNA, 15 nt, Yersinia pestis
ucgaacugacgauug

SEQ ID NO: 2243184 - RNA, 16 nt, Yersinia pestis
ucgacaccuucaauca

SEQ ID NO: 2243185 - RNA, 19 nt, Yersinia pestis
ucgacgccagaggcgaucu

SEQ ID NO: 2243186 - RNA, 18 nt, Yersinia pestis
uccucaagaaccugucgc

SEQ ID NO: 2243187 - RNA, 14 nt, Yersinia pestis
uccucaagaccgau

SEQ ID NO: 2243188 - RNA, 11 nt, Yersinia pestis
uccucaccguu

SEQ ID NO: 2243189 - RNA, 14 nt, Yersinia pestis
uccuccgacauagc

SEQ ID NO: 2243190 - RNA, 12 nt, Yersinia pestis
uccguuaaccca

SEQ ID NO: 2243191 - RNA, 23 nt, Yersinia pestis
uccgugcgccugaacagccuaac

SEQ ID NO: 2243192 - RNA, 19 nt, Yersinia pestis
uccgucaucgaacccgcua

SEQ ID NO: 2243193 - RNA, 12 nt, Yersinia pestis
ucccacaugaac

SEQ ID NO: 2243194 - RNA, 23 nt, Yersinia pestis
ucccgauuauugugccgccuucu

SEQ ID NO: 2243195 - RNA, 16 nt, Yersinia pestis
ucccgcaaagccugcc

SEQ ID NO: 2243196 - RNA, 17 nt, Yersinia pestis
ucaacucugaugaaauc

SEQ ID NO: 2243197 - RNA, 17 nt, Yersinia pestis
ucaacgacaacaucaau

SEQ ID NO: 2243198 - RNA, 15 nt, Yersinia pestis
ucaacuucaacgacu

SEQ ID NO: 2243199 - RNA, 22 nt, Yersinia pestis
ucaaauacuucaaaugacauuc

SEQ ID NO: 2243200 - RNA, 22 nt, Yersinia pestis
ucaaccgccagugccaccguaa

SEQ ID NO: 2243201 - RNA, 19 nt, Yersinia pestis
ucaaacucuuuacaggcca

SEQ ID NO: 2243202 - RNA, 15 nt, Yersinia pestis
ucaaacucagcauca

SEQ ID NO: 2243203 - RNA, 15 nt, Yersinia pestis
uauugauccccgcuu

SEQ ID NO: 2243204 - RNA, 20 nt, Yersinia pestis
uauugcguguagcgggagau

SEQ ID NO: 2243205 - RNA, 15 nt, Yersinia pestis
ucaauaucaccagug

SEQ ID NO: 2243206 - RNA, 16 nt, Yersinia pestis
ucaauaggucaguggu

SEQ ID NO: 2243207 - RNA, 16 nt, Yersinia pestis
ucaaucucaucaaucg

SEQ ID NO: 2243208 - RNA, 20 nt, Yersinia pestis
ucaauuguaacucaaugcca

SEQ ID NO: 2243209 - RNA, 19 nt, Yersinia pestis
ucaaugcuuuuguacgaaa

SEQ ID NO: 2243210 - RNA, 18 nt, Yersinia pestis
ucaauaaaaaagucacuu

SEQ ID NO: 2243211 - RNA, 16 nt, Yersinia pestis
ucaauaaaacucacuu

SEQ ID NO: 2243212 - RNA, 18 nt, Yersinia pestis
ucaauaaauucauuagcu

SEQ ID NO: 2243213 - RNA, 19 nt, Yersinia pestis
ucaauaaccucacacgauu

SEQ ID NO: 2243214 - RNA, 15 nt, Yersinia pestis
ucaauaauaugggau

SEQ ID NO: 2243215 - RNA, 14 nt, Yersinia pestis
ucaauacgcugucu

SEQ ID NO: 2243216 - RNA, 21 nt, Yersinia pestis
ucaauacccugccaccuuggc

SEQ ID NO: 2243217 - RNA, 20 nt, Yersinia pestis
ucaauaauuuuuacgauauc

SEQ ID NO: 2243218 - RNA, 21 nt, Yersinia pestis
ucaagcuucucccuuuccagc

SEQ ID NO: 2243219 - RNA, 14 nt, Yersinia pestis
uauauuucaagcua

SEQ ID NO: 2243220 - RNA, 16 nt, Yersinia pestis
uauauucuggcaccug

SEQ ID NO: 2243221 - RNA, 17 nt, Yersinia pestis
uaucagcccaucuuuga

SEQ ID NO: 2243222 - RNA, 21 nt, Yersinia pestis
uaucacgcugguuaucacagc

SEQ ID NO: 2243223 - RNA, 19 nt, Yersinia pestis
uaucacuagcgggccucag

SEQ ID NO: 2243224 - RNA, 19 nt, Yersinia pestis
uauccucaccguucaagau

SEQ ID NO: 2243225 - RNA, 23 nt, Yersinia pestis
uaucaguaacgccguaucaccgg

SEQ ID NO: 2243226 - RNA, 23 nt, Yersinia pestis
uauccaucccaacaauuugcgcc

SEQ ID NO: 2243227 - RNA, 18 nt, Yersinia pestis
uauaucaaggcggcagag

SEQ ID NO: 2243228 - RNA, 21 nt, Yersinia pestis
uauauguugggaaauaaccaa

SEQ ID NO: 2243229 - RNA, 15 nt, Yersinia pestis
uauacauaccacuua

SEQ ID NO: 2243230 - RNA, 23 nt, Yersinia pestis
uauacauacccgucauaccguua

SEQ ID NO: 2243231 - RNA, 15 nt, Yersinia pestis
uauaccaacucugaa

SEQ ID NO: 2243232 - RNA, 16 nt, Yersinia pestis
uauaccggggccauca

SEQ ID NO: 2243233 - RNA, 20 nt, Yersinia pestis
uagguacggguauagcggcg

SEQ ID NO: 2243234 - RNA, 19 nt, Yersinia pestis
uauuaaucaacagauaugc

SEQ ID NO: 2243235 - RNA, 23 nt, Yersinia pestis
uauuacaccuuaaaacagcagcc

SEQ ID NO: 2243236 - RNA, 16 nt, Yersinia pestis
uauuauaaaauucgcu

SEQ ID NO: 2243237 - RNA, 15 nt, Yersinia pestis
uauuaguccguagaa

SEQ ID NO: 2243238 - RNA, 11 nt, Yersinia pestis
uauuauuagcc

SEQ ID NO: 2243239 - RNA, 17 nt, Yersinia pestis
uauuaucgguaucgaua

SEQ ID NO: 2243240 - RNA, 19 nt, Yersinia pestis
uaucugacugcuugccaaa

SEQ ID NO: 2243241 - RNA, 22 nt, Yersinia pestis
uaugacauaucgagacuaccgg

SEQ ID NO: 2243242 - RNA, 22 nt, Yersinia pestis
uaugaaaaaccuccggcuaugc

SEQ ID NO: 2243243 - RNA, 16 nt, Yersinia pestis
uaucuguccgcuuaua

SEQ ID NO: 2243244 - RNA, 22 nt, Yersinia pestis
aauaaagaguccccauaagcgg

SEQ ID NO: 2243245 - RNA, 20 nt, Yersinia pestis
aauaaauacccugcaccaua

SEQ ID NO: 2243246 - RNA, 16 nt, Yersinia pestis
aauaaaauacggcguu

SEQ ID NO: 2243247 - RNA, 12 nt, Yersinia pestis
aauaaaccagca

SEQ ID NO: 2243248 - RNA, 13 nt, Yersinia pestis
aauaaaccagcaa

SEQ ID NO: 2243249 - RNA, 14 nt, Yersinia pestis
aauaaaaaacugac

SEQ ID NO: 2243250 - RNA, 15 nt, Yersinia pestis
uaggacggugccaug

SEQ ID NO: 2243251 - RNA, 16 nt, Yersinia pestis
uaggcuauugacaaag

SEQ ID NO: 2243252 - RNA, 14 nt, Yersinia pestis
uagcuaaccuuaac

SEQ ID NO: 2243253 - RNA, 13 nt, Yersinia pestis
uagcuaugcaguu

SEQ ID NO: 2243254 - RNA, 21 nt, Yersinia pestis
uagcugaauacgguuuugcca

SEQ ID NO: 2243255 - RNA, 16 nt, Yersinia pestis
uagcguuaacgauaua

SEQ ID NO: 2243256 - RNA, 23 nt, Yersinia pestis
uagcaaucucugcaguacagaua

SEQ ID NO: 2243257 - RNA, 13 nt, Yersinia pestis
uagcaagccaaaa

SEQ ID NO: 2243258 - RNA, 13 nt, Yersinia pestis
uacgcaauaccga

SEQ ID NO: 2243259 - RNA, 20 nt, Yersinia pestis
uacggcuuuucgcucagacu

SEQ ID NO: 2243260 - RNA, 19 nt, Yersinia pestis
uacgguauuugaacuucaa

SEQ ID NO: 2243261 - RNA, 22 nt, Yersinia pestis
uagaaaccaauagaccguagaa

SEQ ID NO: 2243262 - RNA, 16 nt, Yersinia pestis
uacuucuuuuuaacga

SEQ ID NO: 2243263 - RNA, 15 nt, Yersinia pestis
uacugcuuaccuugu

SEQ ID NO: 2243264 - RNA, 20 nt, Yersinia pestis
uacuaugauagauuaaucga

SEQ ID NO: 2243265 - RNA, 22 nt, Yersinia pestis
uacuaugauagauuaaucgaaa

SEQ ID NO: 2243266 - RNA, 20 nt, Yersinia pestis
uacguguccuuuuuucugca

SEQ ID NO: 2243267 - RNA, 20 nt, Yersinia pestis
uacgugucagacugcugaca

SEQ ID NO: 2243268 - RNA, 12 nt, Yersinia pestis
uacgugacggcg

SEQ ID NO: 2243269 - RNA, 19 nt, Yersinia pestis
uacggugccagcagcaagu

SEQ ID NO: 2243270 - RNA, 19 nt, Yersinia pestis
uacguaaucccagaaacgg

SEQ ID NO: 2243271 - RNA, 13 nt, Yersinia pestis
uacguacuaucua

SEQ ID NO: 2243272 - RNA, 14 nt, Yersinia pestis
uacguacuucuaca

SEQ ID NO: 2243273 - RNA, 17 nt, Yersinia pestis
uacguaauuucacgcug

SEQ ID NO: 2243274 - RNA, 20 nt, Yersinia pestis
ucauuuccuccgcuuuagcu

SEQ ID NO: 2243275 - RNA, 20 nt, Yersinia pestis
ucauugauauugcgguaaau

SEQ ID NO: 2243276 - RNA, 19 nt, Yersinia pestis
uccaauaggauaagggcca

SEQ ID NO: 2243277 - RNA, 21 nt, Yersinia pestis
uccaaggcggauguggguuca

SEQ ID NO: 2243278 - RNA, 20 nt, Yersinia pestis
ucauuaaggagugccaucau

SEQ ID NO: 2243279 - RNA, 13 nt, Yersinia pestis
ucauuacaucauc

SEQ ID NO: 2243280 - RNA, 23 nt, Yersinia pestis
ucaucugcgggcuaacaucaaug

SEQ ID NO: 2243281 - RNA, 19 nt, Yersinia pestis
ucaucuugggcgggaucuc

SEQ ID NO: 2243282 - RNA, 20 nt, Yersinia pestis
ucaucauuauuguccgcgcg

SEQ ID NO: 2243283 - RNA, 13 nt, Yersinia pestis
ucaucaugacgau

SEQ ID NO: 2243284 - RNA, 22 nt, Yersinia pestis
ucaucucacgguagugacucau

SEQ ID NO: 2243285 - RNA, 21 nt, Yersinia pestis
ucaucgucggcccggccaggc

SEQ ID NO: 2243286 - RNA, 13 nt, Yersinia pestis
uccaucaggucag

SEQ ID NO: 2243287 - RNA, 13 nt, Yersinia pestis
uccauuuaaucgc

SEQ ID NO: 2243288 - RNA, 13 nt, Yersinia pestis
uccaguaacggcc

SEQ ID NO: 2243289 - RNA, 16 nt, Yersinia pestis
uccaguaacggccuuc

SEQ ID NO: 2243290 - RNA, 15 nt, Yersinia pestis
uccacuuuucagaua

SEQ ID NO: 2243291 - RNA, 15 nt, Yersinia pestis
uccacugaccgggaa

SEQ ID NO: 2243292 - RNA, 12 nt, Yersinia pestis
uccacauugauc

SEQ ID NO: 2243293 - RNA, 18 nt, Yersinia pestis
uccacaacagauggcgau

SEQ ID NO: 2243294 - RNA, 21 nt, Yersinia pestis
uccacacccucucuuuccagc

SEQ ID NO: 2243295 - RNA, 15 nt, Yersinia pestis
uccagaucggcaaau

SEQ ID NO: 2243296 - RNA, 16 nt, Yersinia pestis
uccagcaaaagccucu

SEQ ID NO: 2243297 - RNA, 20 nt, Yersinia pestis
uccagcaccacaauggcaga

SEQ ID NO: 2243298 - RNA, 19 nt, Yersinia pestis
ucagccacaucaaaaccgg

SEQ ID NO: 2243299 - RNA, 22 nt, Yersinia pestis
ucagccacaaaaguucacauga

SEQ ID NO: 2243300 - RNA, 23 nt, Yersinia pestis
ucagccacuuguagguuaaauuc

SEQ ID NO: 2243301 - RNA, 22 nt, Yersinia pestis
ucagccccuuugaacugcaccc

SEQ ID NO: 2243302 - RNA, 13 nt, Yersinia pestis
ucagccuucaggg

SEQ ID NO: 2243303 - RNA, 17 nt, Yersinia pestis
ucagcuucaggccaagc

SEQ ID NO: 2243304 - RNA, 13 nt, Yersinia pestis
ucagcgugaauuc

SEQ ID NO: 2243305 - RNA, 14 nt, Yersinia pestis
ucagcgucacgaua

SEQ ID NO: 2243306 - RNA, 15 nt, Yersinia pestis
aauaaggaauaacuu

SEQ ID NO: 2243307 - RNA, 19 nt, Yersinia pestis
aauaaguugauaacgccgg

SEQ ID NO: 2243308 - RNA, 14 nt, Yersinia pestis
aauaauaucaauga

SEQ ID NO: 2243309 - RNA, 16 nt, Yersinia pestis
aauaauaucaaugaug

SEQ ID NO: 2243310 - RNA, 16 nt, Yersinia pestis
ucacuaaaacugaagc

SEQ ID NO: 2243311 - RNA, 18 nt, Yersinia pestis
aauaacggaaaaucaucg

SEQ ID NO: 2243312 - RNA, 19 nt, Yersinia pestis
aauaacgauccgucacaac

SEQ ID NO: 2243313 - RNA, 13 nt, Yersinia pestis
aauaacgccacaa

SEQ ID NO: 2243314 - RNA, 23 nt, Yersinia pestis
aauaacugcccuguuuccgguaa

SEQ ID NO: 2243315 - RNA, 18 nt, Yersinia pestis
aauaaccagagacagcaa

SEQ ID NO: 2243316 - RNA, 19 nt, Yersinia pestis
aauaacagggaggccagca

SEQ ID NO: 2243317 - RNA, 16 nt, Yersinia pestis
ucacacagccagccuu

SEQ ID NO: 2243318 - RNA, 16 nt, Yersinia pestis
ucacaccaguuacuuu

SEQ ID NO: 2243319 - RNA, 15 nt, Yersinia pestis
ucaccgagaucaccu

SEQ ID NO: 2243320 - RNA, 21 nt, Yersinia pestis
ucaccgcuguaggugucacca

SEQ ID NO: 2243321 - RNA, 17 nt, Yersinia pestis
ucaccuuggauggcgaa

SEQ ID NO: 2243322 - RNA, 23 nt, Yersinia pestis
ucacgcaaauaaagggccugcaa

SEQ ID NO: 2243323 - RNA, 19 nt, Yersinia pestis
ucaccggcaaucgcuucca

SEQ ID NO: 2243324 - RNA, 21 nt, Yersinia pestis
ucacgcuaccggaaccaacgg

SEQ ID NO: 2243325 - RNA, 21 nt, Yersinia pestis
uaaaacacagucugucguacu

SEQ ID NO: 2243326 - RNA, 18 nt, Yersinia pestis
uaaaaaucaauacguuga

SEQ ID NO: 2243327 - RNA, 20 nt, Yersinia pestis
uaaaaagaucugcauugauu

SEQ ID NO: 2243328 - RNA, 23 nt, Yersinia pestis
uaaaaacccucuucaaucggaua

SEQ ID NO: 2243329 - RNA, 23 nt, Yersinia pestis
uaaaaaccgcagcagacaacuga

SEQ ID NO: 2243330 - RNA, 17 nt, Yersinia pestis
uaaaaaaucuauugauu

SEQ ID NO: 2243331 - RNA, 13 nt, Yersinia pestis
guuuugaacgcgc

SEQ ID NO: 2243332 - RNA, 19 nt, Yersinia pestis
guuuuuuacgguggcacug

SEQ ID NO: 2243333 - RNA, 18 nt, Yersinia pestis
guuuuucuugccagaugg

SEQ ID NO: 2243334 - RNA, 15 nt, Yersinia pestis
guuuuagacgucaga

SEQ ID NO: 2243335 - RNA, 20 nt, Yersinia pestis
guuguaauaacgcaucaugg

SEQ ID NO: 2243336 - RNA, 15 nt, Yersinia pestis
guugguuagagcacg

SEQ ID NO: 2243337 - RNA, 21 nt, Yersinia pestis
guuucgccaaaucuucggcuu

SEQ ID NO: 2243338 - RNA, 17 nt, Yersinia pestis
uacaucgguuagcguuu

SEQ ID NO: 2243339 - RNA, 16 nt, Yersinia pestis
uacauccauguaggcu

SEQ ID NO: 2243340 - RNA, 18 nt, Yersinia pestis
uacaucccgccauggcau

SEQ ID NO: 2243341 - RNA, 22 nt, Yersinia pestis
uacaucgaguugaugcaauggc

SEQ ID NO: 2243342 - RNA, 18 nt, Yersinia pestis
uaccaauggugcccauca

SEQ ID NO: 2243343 - RNA, 16 nt, Yersinia pestis
uaccaccuacaaccua

SEQ ID NO: 2243344 - RNA, 14 nt, Yersinia pestis
uaccacaucaaacc

SEQ ID NO: 2243345 - RNA, 15 nt, Yersinia pestis
uacauagaaacggug

SEQ ID NO: 2243346 - RNA, 21 nt, Yersinia pestis
uacagguguaccgcuucgcgc

SEQ ID NO: 2243347 - RNA, 21 nt, Yersinia pestis
uacaggccgcuuccgauaacc

SEQ ID NO: 2243348 - RNA, 17 nt, Yersinia pestis
uacaggccccaauccac

SEQ ID NO: 2243349 - RNA, 18 nt, Yersinia pestis
uacacugucgacugcuuu

SEQ ID NO: 2243350 - RNA, 17 nt, Yersinia pestis
uacacugucgcauaaga

SEQ ID NO: 2243351 - RNA, 21 nt, Yersinia pestis
uacagacaaaucacaacguug

SEQ ID NO: 2243352 - RNA, 15 nt, Yersinia pestis
uaauugguuagcgcc

SEQ ID NO: 2243353 - RNA, 13 nt, Yersinia pestis
uaaucagcguggu

SEQ ID NO: 2243354 - RNA, 18 nt, Yersinia pestis
uaauguuucuauccgaaa

SEQ ID NO: 2243355 - RNA, 21 nt, Yersinia pestis
uacacgcaguacgugacggcg

SEQ ID NO: 2243356 - RNA, 18 nt, Yersinia pestis
uacaauuuuuggucguau

SEQ ID NO: 2243357 - RNA, 19 nt, Yersinia pestis
uacaccaacgcaauggugc

SEQ ID NO: 2243358 - RNA, 14 nt, Yersinia pestis
uacacagucccgca

SEQ ID NO: 2243359 - RNA, 22 nt, Yersinia pestis
uacaauagagaauagaccugau

SEQ ID NO: 2243360 - RNA, 16 nt, Yersinia pestis
uacaaccacugaacac

SEQ ID NO: 2243361 - RNA, 17 nt, Yersinia pestis
uacaaccggcuaauacc

SEQ ID NO: 2243362 - RNA, 21 nt, Yersinia pestis
uaagccuaauggugcuauuuc

SEQ ID NO: 2243363 - RNA, 19 nt, Yersinia pestis
uaagccgguguauaacgcc

SEQ ID NO: 2243364 - RNA, 22 nt, Yersinia pestis
uaagccggucuuuuuacaagca

SEQ ID NO: 2243365 - RNA, 18 nt, Yersinia pestis
uaaggcuaacaccuuuac

SEQ ID NO: 2243366 - RNA, 21 nt, Yersinia pestis
uaauagccucugucucuggua

SEQ ID NO: 2243367 - RNA, 23 nt, Yersinia pestis
uaauagugucauaauuaucgcaa

SEQ ID NO: 2243368 - RNA, 21 nt, Yersinia pestis
uaauagguggucccuaacgca

SEQ ID NO: 2243369 - RNA, 21 nt, Yersinia pestis
uaauaucaccauuaacgauga

SEQ ID NO: 2243370 - RNA, 23 nt, Yersinia pestis
uaaguaucagcggcguauaucgu

SEQ ID NO: 2243371 - RNA, 21 nt, Yersinia pestis
uaagucagugcuauucauaaa

SEQ ID NO: 2243372 - RNA, 22 nt, Yersinia pestis
uaagugaacccacgacuauuua

SEQ ID NO: 2243373 - RNA, 13 nt, Yersinia pestis
uaaguacuaucua

SEQ ID NO: 2243374 - RNA, 19 nt, Yersinia pestis
uaaguaauaacucagggcu

SEQ ID NO: 2243375 - RNA, 12 nt, Yersinia pestis
uaaccgccaguu

SEQ ID NO: 2243376 - RNA, 17 nt, Yersinia pestis
uaaccgauuucagcacc

SEQ ID NO: 2243377 - RNA, 21 nt, Yersinia pestis
uaacccuaccuaggccagcac

SEQ ID NO: 2243378 - RNA, 17 nt, Yersinia pestis
uaacgccgcuguagcgc

SEQ ID NO: 2243379 - RNA, 18 nt, Yersinia pestis
uaacgccggaauugcgcu

SEQ ID NO: 2243380 - RNA, 21 nt, Yersinia pestis
uaacgguuuaccggggcgauc

SEQ ID NO: 2243381 - RNA, 21 nt, Yersinia pestis
uaacgcucccuccgccagcaa

SEQ ID NO: 2243382 - RNA, 13 nt, Yersinia pestis
uaacaucauuggu

SEQ ID NO: 2243383 - RNA, 15 nt, Yersinia pestis
uaaccaaacaaauua

SEQ ID NO: 2243384 - RNA, 20 nt, Yersinia pestis
uaacauacaccaucgcgcug

SEQ ID NO: 2243385 - RNA, 15 nt, Yersinia pestis
uaaccaaucacauca

SEQ ID NO: 2243386 - RNA, 23 nt, Yersinia pestis
uaaaccgcuauaucaucagcaga

SEQ ID NO: 2243387 - RNA, 13 nt, Yersinia pestis
gugccaaccgguc

SEQ ID NO: 2243388 - RNA, 20 nt, Yersinia pestis
gugaguaauucgcagacaga

SEQ ID NO: 2243389 - RNA, 13 nt, Yersinia pestis
gugcggcuggcga

SEQ ID NO: 2243390 - RNA, 18 nt, Yersinia pestis
gugcggcauauaaccaug

SEQ ID NO: 2243391 - RNA, 20 nt, Yersinia pestis
guucauaaauuaaaacugaa

SEQ ID NO: 2243392 - RNA, 14 nt, Yersinia pestis
guucaguaguggcu

SEQ ID NO: 2243393 - RNA, 16 nt, Yersinia pestis
guuccgguacgcgaug

SEQ ID NO: 2243394 - RNA, 23 nt, Yersinia pestis
guuauacugugcggacaauugau

SEQ ID NO: 2243395 - RNA, 14 nt, Yersinia pestis
guuaguucagacgu

SEQ ID NO: 2243396 - RNA, 16 nt, Yersinia pestis
guuauaaggcuaacac

SEQ ID NO: 2243397 - RNA, 18 nt, Yersinia pestis
guuauaaaacagccacga

SEQ ID NO: 2243398 - RNA, 17 nt, Yersinia pestis
guuauaacagcuuaccg

SEQ ID NO: 2243399 - RNA, 23 nt, Yersinia pestis
guucacuucgcggacgcuggcac

SEQ ID NO: 2243400 - RNA, 16 nt, Yersinia pestis
guuaucgcuacguacu

SEQ ID NO: 2243401 - RNA, 23 nt, Yersinia pestis
guuaucggugcugacaaacagau

SEQ ID NO: 2243402 - RNA, 22 nt, Yersinia pestis
guucaccagcuugggugaagac

SEQ ID NO: 2243403 - RNA, 18 nt, Yersinia pestis
gugguaucaaacaccggu

SEQ ID NO: 2243404 - RNA, 13 nt, Yersinia pestis
guggucgcuggca

SEQ ID NO: 2243405 - RNA, 15 nt, Yersinia pestis
guggcauguucagca

SEQ ID NO: 2243406 - RNA, 19 nt, Yersinia pestis
gugguuaacagcgugcgcu

SEQ ID NO: 2243407 - RNA, 12 nt, Yersinia pestis
guguccaguuuu

SEQ ID NO: 2243408 - RNA, 23 nt, Yersinia pestis
acugguaauaaugcuguccaguu

SEQ ID NO: 2243409 - RNA, 21 nt, Yersinia pestis
acugguacggcgcaucgccau

SEQ ID NO: 2243410 - RNA, 19 nt, Yersinia pestis
acugguagcaucaucgcac

SEQ ID NO: 2243411 - RNA, 19 nt, Yersinia pestis
acugcauugagacccguua

SEQ ID NO: 2243412 - RNA, 22 nt, Yersinia pestis
acugcgcgaucccagaauggca

SEQ ID NO: 2243413 - RNA, 16 nt, Yersinia pestis
acugcgcgcugaacgu

SEQ ID NO: 2243414 - RNA, 19 nt, Yersinia pestis
acugcucaacugcucaacu

SEQ ID NO: 2243415 - RNA, 20 nt, Yersinia pestis
acucugguccagaucggcaa

SEQ ID NO: 2243416 - RNA, 17 nt, Yersinia pestis
acucuggcacuggcaau

SEQ ID NO: 2243417 - RNA, 17 nt, Yersinia pestis
acugacaaaaacagcac

SEQ ID NO: 2243418 - RNA, 19 nt, Yersinia pestis
acucuguaaaaaucaccuc

SEQ ID NO: 2243419 - RNA, 18 nt, Yersinia pestis
acugacucacgucaguaa

SEQ ID NO: 2243420 - RNA, 16 nt, Yersinia pestis
acugacugauguaagc

SEQ ID NO: 2243421 - RNA, 20 nt, Yersinia pestis
acugacugauguaagcucau

SEQ ID NO: 2243422 - RNA, 21 nt, Yersinia pestis
acucggucgccaaggaugccu

SEQ ID NO: 2243423 - RNA, 18 nt, Yersinia pestis
acugucaaaaagcaccuu

SEQ ID NO: 2243424 - RNA, 21 nt, Yersinia pestis
acuguaucaauaccuuacugc

SEQ ID NO: 2243425 - RNA, 17 nt, Yersinia pestis
acugucaaaauccggau

SEQ ID NO: 2243426 - RNA, 20 nt, Yersinia pestis
acuuaccugaguaagcucau

SEQ ID NO: 2243427 - RNA, 18 nt, Yersinia pestis
acuuaccuugauccgcca

SEQ ID NO: 2243428 - RNA, 14 nt, Yersinia pestis
acuguuugccagug

SEQ ID NO: 2243429 - RNA, 22 nt, Yersinia pestis
acuucaugacuaccuugcuccg

SEQ ID NO: 2243430 - RNA, 16 nt, Yersinia pestis
acuucauuucagguaa

SEQ ID NO: 2243431 - RNA, 22 nt, Yersinia pestis
acuuugauucaaaaugccaguc

SEQ ID NO: 2243432 - RNA, 23 nt, Yersinia pestis
acuuuguuauccaucaaccacgg

SEQ ID NO: 2243433 - RNA, 21 nt, Yersinia pestis
agaaaacaguuacuccuacac

SEQ ID NO: 2243434 - RNA, 17 nt, Yersinia pestis
acuuuuuucacauuacg

SEQ ID NO: 2243435 - RNA, 18 nt, Yersinia pestis
acuugcuggaggcuggca

SEQ ID NO: 2243436 - RNA, 23 nt, Yersinia pestis
acuugccauuuugggcuugagca

SEQ ID NO: 2243437 - RNA, 15 nt, Yersinia pestis
acuaagaguccuuaa

SEQ ID NO: 2243438 - RNA, 17 nt, Yersinia pestis
acuaagauucaaacagu

SEQ ID NO: 2243439 - RNA, 22 nt, Yersinia pestis
acgucagauaaaaaaggguaau

SEQ ID NO: 2243440 - RNA, 17 nt, Yersinia pestis
acgguuucaacuucaac

SEQ ID NO: 2243441 - RNA, 16 nt, Yersinia pestis
acguaauguggugccg

SEQ ID NO: 2243442 - RNA, 16 nt, Yersinia pestis
acguaucaucagugcu

SEQ ID NO: 2243443 - RNA, 20 nt, Yersinia pestis
acgucuuaugccauaacauc

SEQ ID NO: 2243444 - RNA, 17 nt, Yersinia pestis
acgucuucaccaaugau

SEQ ID NO: 2243445 - RNA, 17 nt, Yersinia pestis
acggguaaugaaugccu

SEQ ID NO: 2243446 - RNA, 18 nt, Yersinia pestis
acgguuuaaucaaugugc

SEQ ID NO: 2243447 - RNA, 13 nt, Yersinia pestis
acgguugcccguu

SEQ ID NO: 2243448 - RNA, 14 nt, Yersinia pestis
acggagcguacacg

SEQ ID NO: 2243449 - RNA, 12 nt, Yersinia pestis
acggcucaucac

SEQ ID NO: 2243450 - RNA, 15 nt, Yersinia pestis
acgcacguugaguga

SEQ ID NO: 2243451 - RNA, 16 nt, Yersinia pestis
acgauagccagugaca

SEQ ID NO: 2243452 - RNA, 23 nt, Yersinia pestis
acgaucagcguauagcgccgcca

SEQ ID NO: 2243453 - RNA, 13 nt, Yersinia pestis
acgccauaucaua

SEQ ID NO: 2243454 - RNA, 15 nt, Yersinia pestis
acgccauaucauauc

SEQ ID NO: 2243455 - RNA, 19 nt, Yersinia pestis
acgccaguaaacagccagc

SEQ ID NO: 2243456 - RNA, 21 nt, Yersinia pestis
acgacauguguaguaugcgau

SEQ ID NO: 2243457 - RNA, 19 nt, Yersinia pestis
acgaguuuucccugcgcca

SEQ ID NO: 2243458 - RNA, 23 nt, Yersinia pestis
acgaguuuucccugcgccagcag

SEQ ID NO: 2243459 - RNA, 19 nt, Yersinia pestis
acgauaacgcucuuguagc

SEQ ID NO: 2243460 - RNA, 15 nt, Yersinia pestis
accuaaugcaauggc

SEQ ID NO: 2243461 - RNA, 14 nt, Yersinia pestis
accguuguguauca

SEQ ID NO: 2243462 - RNA, 15 nt, Yersinia pestis
accugucaccuguca

SEQ ID NO: 2243463 - RNA, 17 nt, Yersinia pestis
accugucaccugucacc

SEQ ID NO: 2243464 - RNA, 13 nt, Yersinia pestis
accuucuuaauga

SEQ ID NO: 2243465 - RNA, 20 nt, Yersinia pestis
accuucuuauuuaucacauu

SEQ ID NO: 2243466 - RNA, 15 nt, Yersinia pestis
accuugauccgccaa

SEQ ID NO: 2243467 - RNA, 12 nt, Yersinia pestis
acgcucaucaac

SEQ ID NO: 2243468 - RNA, 16 nt, Yersinia pestis
acgcugaaaaaucuuu

SEQ ID NO: 2243469 - RNA, 17 nt, Yersinia pestis
acgcugaauacacucgu

SEQ ID NO: 2243470 - RNA, 22 nt, Yersinia pestis
acgcugaauacacucgugguga

SEQ ID NO: 2243471 - RNA, 19 nt, Yersinia pestis
acgcucuaacgucagauaa

SEQ ID NO: 2243472 - RNA, 15 nt, Yersinia pestis
acgcucuaacgucag

SEQ ID NO: 2243473 - RNA, 20 nt, Yersinia pestis
acgcgaaacgcccaaaucug

SEQ ID NO: 2243474 - RNA, 16 nt, Yersinia pestis
acgccguaaauacauc

SEQ ID NO: 2243475 - RNA, 14 nt, Yersinia pestis
acaucaaccguuaa

SEQ ID NO: 2243476 - RNA, 19 nt, Yersinia pestis
acaucaaccugaucaucaa

SEQ ID NO: 2243477 - RNA, 12 nt, Yersinia pestis
acauccaauggc

SEQ ID NO: 2243478 - RNA, 12 nt, Yersinia pestis
acaucgccagcg

SEQ ID NO: 2243479 - RNA, 20 nt, Yersinia pestis
acaugugagugguguaagau

SEQ ID NO: 2243480 - RNA, 16 nt, Yersinia pestis
acauggcgcaauggcg

SEQ ID NO: 2243481 - RNA, 16 nt, Yersinia pestis
acaggcgcaucgcgau

SEQ ID NO: 2243482 - RNA, 15 nt, Yersinia pestis
acagguaaaaccgga

SEQ ID NO: 2243483 - RNA, 23 nt, Yersinia pestis
aauuucuugaggugcuugaacaa

SEQ ID NO: 2243484 - RNA, 12 nt, Yersinia pestis
aauuucucaaau

SEQ ID NO: 2243485 - RNA, 15 nt, Yersinia pestis
acaccggcugcaaua

SEQ ID NO: 2243486 - RNA, 22 nt, Yersinia pestis
acagaacaucugccaggcgaca

SEQ ID NO: 2243487 - RNA, 22 nt, Yersinia pestis
acagaacccccgcgaacagcag

SEQ ID NO: 2243488 - RNA, 20 nt, Yersinia pestis
acacgacauguguaguaugc

SEQ ID NO: 2243489 - RNA, 20 nt, Yersinia pestis
acagauauauccaggcacug

SEQ ID NO: 2243490 - RNA, 12 nt, Yersinia pestis
accaauucuuca

SEQ ID NO: 2243491 - RNA, 21 nt, Yersinia pestis
accaauggugcccaucacauc

SEQ ID NO: 2243492 - RNA, 18 nt, Yersinia pestis
acauuauucaugaugccg

SEQ ID NO: 2243493 - RNA, 21 nt, Yersinia pestis
accacgcacgauauucagugc

SEQ ID NO: 2243494 - RNA, 19 nt, Yersinia pestis
accacgccgucuggcuaau

SEQ ID NO: 2243495 - RNA, 20 nt, Yersinia pestis
accauuggggaagauauauu

SEQ ID NO: 2243496 - RNA, 15 nt, Yersinia pestis
accauguugaaucaa

SEQ ID NO: 2243497 - RNA, 16 nt, Yersinia pestis
accaugccuucugaaa

SEQ ID NO: 2243498 - RNA, 20 nt, Yersinia pestis
accaucuugucauuaccaau

SEQ ID NO: 2243499 - RNA, 18 nt, Yersinia pestis
accaugaugacaaugcgu

SEQ ID NO: 2243500 - RNA, 14 nt, Yersinia pestis
accaugaugacaau

SEQ ID NO: 2243501 - RNA, 22 nt, Yersinia pestis
accaucacggucaugcggccuu

SEQ ID NO: 2243502 - RNA, 17 nt, Yersinia pestis
accagucugcauacaga

SEQ ID NO: 2243503 - RNA, 20 nt, Yersinia pestis
accagucugcauacagaucg

SEQ ID NO: 2243504 - RNA, 13 nt, Yersinia pestis
acccuaucgucac

SEQ ID NO: 2243505 - RNA, 16 nt, Yersinia pestis
acccgucaccacaaag

SEQ ID NO: 2243506 - RNA, 15 nt, Yersinia pestis
acccguacugauuau

SEQ ID NO: 2243507 - RNA, 22 nt, Yersinia pestis
acccaaggagaucgcucucacc

SEQ ID NO: 2243508 - RNA, 13 nt, Yersinia pestis
acccacaccgcag

SEQ ID NO: 2243509 - RNA, 21 nt, Yersinia pestis
acccacaauauauacauacgu

SEQ ID NO: 2243510 - RNA, 20 nt, Yersinia pestis
acccaaugccauagcugcug

SEQ ID NO: 2243511 - RNA, 17 nt, Yersinia pestis
acccgagaauaccuggc

SEQ ID NO: 2243512 - RNA, 14 nt, Yersinia pestis
accgacuugcccaa

SEQ ID NO: 2243513 - RNA, 15 nt, Yersinia pestis
accgaguguaaucag

SEQ ID NO: 2243514 - RNA, 19 nt, Yersinia pestis
accgaugcaaucgcauugc

SEQ ID NO: 2243515 - RNA, 22 nt, Yersinia pestis
accgcacacugacagcaacgac

SEQ ID NO: 2243516 - RNA, 16 nt, Yersinia pestis
accguuagcaauguga

SEQ ID NO: 2243517 - RNA, 14 nt, Yersinia pestis
accguguacccgau

SEQ ID NO: 2243518 - RNA, 16 nt, Yersinia pestis
accguacauuaaauga

SEQ ID NO: 2243519 - RNA, 15 nt, Yersinia pestis
accgggauacgggau

SEQ ID NO: 2243520 - RNA, 14 nt, Yersinia pestis
uucuuuuucggcaa

SEQ ID NO: 2243521 - RNA, 23 nt, Yersinia pestis
uugaaaaccgucgacuguaacag

SEQ ID NO: 2243522 - RNA, 20 nt, Yersinia pestis
uugaaauguccacuguacag

SEQ ID NO: 2243523 - RNA, 16 nt, Yersinia pestis
uugaaauaacugccag

SEQ ID NO: 2243524 - RNA, 24 nt, Yersinia pestis
uugaaauacuccuugaauagccag

SEQ ID NO: 2243525 - RNA, 12 nt, Yersinia pestis
uugaaauaccac

SEQ ID NO: 2243526 - RNA, 13 nt, Yersinia pestis
uucuauaaugaug

SEQ ID NO: 2243527 - RNA, 21 nt, Yersinia pestis
uucucagguguuacacaguua

SEQ ID NO: 2243528 - RNA, 17 nt, Yersinia pestis
uucucuacaucauaacg

SEQ ID NO: 2243529 - RNA, 15 nt, Yersinia pestis
uucuccacaccaacg

SEQ ID NO: 2243530 - RNA, 11 nt, Yersinia pestis
aaucagcuuca

SEQ ID NO: 2243531 - RNA, 14 nt, Yersinia pestis
uucgucaccaucaa

SEQ ID NO: 2243532 - RNA, 17 nt, Yersinia pestis
uugagauuaucagccca

SEQ ID NO: 2243533 - RNA, 17 nt, Yersinia pestis
uugagauuuucccagug

SEQ ID NO: 2243534 - RNA, 15 nt, Yersinia pestis
uugauaaaaaucaau

SEQ ID NO: 2243535 - RNA, 13 nt, Yersinia pestis
uugauaauggcau

SEQ ID NO: 2243536 - RNA, 14 nt, Yersinia pestis
uugauauaccgauu

SEQ ID NO: 2243537 - RNA, 19 nt, Yersinia pestis
uugauaucaauauccgcau

SEQ ID NO: 2243538 - RNA, 20 nt, Yersinia pestis
uugauaugcuucacaucaua

SEQ ID NO: 2243539 - RNA, 17 nt, Yersinia pestis
uugaaucagauacggcu

SEQ ID NO: 2243540 - RNA, 20 nt, Yersinia pestis
uugaccuugguaaauaccaa

SEQ ID NO: 2243541 - RNA, 21 nt, Yersinia pestis
uuccgucccaagaaaagcacc

SEQ ID NO: 2243542 - RNA, 15 nt, Yersinia pestis
uucccauagacggcg

SEQ ID NO: 2243543 - RNA, 20 nt, Yersinia pestis
uucauagcggccacgcaaug

SEQ ID NO: 2243544 - RNA, 19 nt, Yersinia pestis
uucaguagucagagcgcaa

SEQ ID NO: 2243545 - RNA, 13 nt, Yersinia pestis
uuccccaucgcca

SEQ ID NO: 2243546 - RNA, 21 nt, Yersinia pestis
uucccgcacaauuccaggguu

SEQ ID NO: 2243547 - RNA, 15 nt, Yersinia pestis
uucgagcaccgcgcu

SEQ ID NO: 2243548 - RNA, 18 nt, Yersinia pestis
uucgacccagaggguuaa

SEQ ID NO: 2243549 - RNA, 12 nt, Yersinia pestis
uucgacggguuu

SEQ ID NO: 2243550 - RNA, 22 nt, Yersinia pestis
uucgcucggcucgaaccugaac

SEQ ID NO: 2243551 - RNA, 15 nt, Yersinia pestis
uucaacgccaauacc

SEQ ID NO: 2243552 - RNA, 22 nt, Yersinia pestis
uucaacgcugcccgucaauauc

SEQ ID NO: 2243553 - RNA, 12 nt, Yersinia pestis
uucaaccugaau

SEQ ID NO: 2243554 - RNA, 18 nt, Yersinia pestis
uucaacaguaucaauacc

SEQ ID NO: 2243555 - RNA, 14 nt, Yersinia pestis
uucaacauccaguu

SEQ ID NO: 2243556 - RNA, 15 nt, Yersinia pestis
uuauuucucugauga

SEQ ID NO: 2243557 - RNA, 16 nt, Yersinia pestis
uucaaauaaguacuuc

SEQ ID NO: 2243558 - RNA, 16 nt, Yersinia pestis
uucaaauaaguauuuc

SEQ ID NO: 2243559 - RNA, 16 nt, Yersinia pestis
uucaaagaagacaucu

SEQ ID NO: 2243560 - RNA, 20 nt, Yersinia pestis
uucaccaguggucaucaccg

SEQ ID NO: 2243561 - RNA, 16 nt, Yersinia pestis
uucacccuuggcuacc

SEQ ID NO: 2243562 - RNA, 18 nt, Yersinia pestis
uucagcccccucaauacc

SEQ ID NO: 2243563 - RNA, 21 nt, Yersinia pestis
uucagcccccucaauaccggu

SEQ ID NO: 2243564 - RNA, 14 nt, Yersinia pestis
uuaucuucaauacg

SEQ ID NO: 2243565 - RNA, 14 nt, Yersinia pestis
uuaucuagcgucca

SEQ ID NO: 2243566 - RNA, 17 nt, Yersinia pestis
uuaucgcuguuuacuga

SEQ ID NO: 2243567 - RNA, 16 nt, Yersinia pestis
uuauguaguuaaucua

SEQ ID NO: 2243568 - RNA, 12 nt, Yersinia pestis
uuauauccgcca

SEQ ID NO: 2243569 - RNA, 15 nt, Yersinia pestis
uuauaucgaucugau

SEQ ID NO: 2243570 - RNA, 23 nt, Yersinia pestis
uuauacccguuauaccucaagcu

SEQ ID NO: 2243571 - RNA, 15 nt, Yersinia pestis
uuacuguaucaauac

SEQ ID NO: 2243572 - RNA, 16 nt, Yersinia pestis
uuacuguaucaauacc

SEQ ID NO: 2243573 - RNA, 14 nt, Yersinia pestis
uuaccuugugcggu

SEQ ID NO: 2243574 - RNA, 19 nt, Yersinia pestis
uuaccuaaccaaacauugu

SEQ ID NO: 2243575 - RNA, 16 nt, Yersinia pestis
uuaccgauggugccgu

SEQ ID NO: 2243576 - RNA, 21 nt, Yersinia pestis
uuacugcaucuauugugucaa

SEQ ID NO: 2243577 - RNA, 22 nt, Yersinia pestis
uuacuggaagcuauucgccaug

SEQ ID NO: 2243578 - RNA, 22 nt, Yersinia pestis
uguguaguugaaguucacaccg

SEQ ID NO: 2243579 - RNA, 15 nt, Yersinia pestis
uguuguugaccucaa

SEQ ID NO: 2243580 - RNA, 15 nt, Yersinia pestis
uguuuaaauugcgcc

SEQ ID NO: 2243581 - RNA, 14 nt, Yersinia pestis
uguugcgccauaau

SEQ ID NO: 2243582 - RNA, 17 nt, Yersinia pestis
uuacccuggucguuacg

SEQ ID NO: 2243583 - RNA, 16 nt, Yersinia pestis
uuaauuauuauuggug

SEQ ID NO: 2243584 - RNA, 21 nt, Yersinia pestis
uuaaggauggucaacauugcu

SEQ ID NO: 2243585 - RNA, 12 nt, Yersinia pestis
uuaaggacucuu

SEQ ID NO: 2243586 - RNA, 15 nt, Yersinia pestis
uguuuggucgccauc

SEQ ID NO: 2243587 - RNA, 21 nt, Yersinia pestis
aauuucuacgccgucaucauc

SEQ ID NO: 2243588 - RNA, 22 nt, Yersinia pestis
aauuggugcuuuauguauucuu

SEQ ID NO: 2243589 - RNA, 13 nt, Yersinia pestis
aauugccuuugcg

SEQ ID NO: 2243590 - RNA, 19 nt, Yersinia pestis
aauuacggcucaguugaug

SEQ ID NO: 2243591 - RNA, 22 nt, Yersinia pestis
aauuacgguuuaccaccuuaaa

SEQ ID NO: 2243592 - RNA, 21 nt, Yersinia pestis
aaugcugcccgaguaagcgcu

SEQ ID NO: 2243593 - RNA, 21 nt, Yersinia pestis
aaugcugcguguggucagcac

SEQ ID NO: 2243594 - RNA, 23 nt, Yersinia pestis
aauucacaacagugcaacauuaa

SEQ ID NO: 2243595 - RNA, 19 nt, Yersinia pestis
aauuaucugaauagcgcug

SEQ ID NO: 2243596 - RNA, 19 nt, Yersinia pestis
aauuccauaauaagugaac

SEQ ID NO: 2243597 - RNA, 23 nt, Yersinia pestis
aauucaguaucaccagaugccgc

SEQ ID NO: 2243598 - RNA, 15 nt, Yersinia pestis
aauucaucagcgcug

SEQ ID NO: 2243599 - RNA, 21 nt, Yersinia pestis
uuuugaaauaacgccacaaua

SEQ ID NO: 2243600 - RNA, 17 nt, Yersinia pestis
uuuuauaccgcagcaua

SEQ ID NO: 2243601 - RNA, 22 nt, Yersinia pestis
uuuuauaccgcagcauaaggcg

SEQ ID NO: 2243602 - RNA, 24 nt, Yersinia pestis
aaugcaaaccaggcaacgacagca

SEQ ID NO: 2243603 - RNA, 22 nt, Yersinia pestis
aaugauuaauaauaguuucugg

SEQ ID NO: 2243604 - RNA, 15 nt, Yersinia pestis
aaugauucagugaua

SEQ ID NO: 2243605 - RNA, 15 nt, Yersinia pestis
aaugauucauugagu

SEQ ID NO: 2243606 - RNA, 20 nt, Yersinia pestis
aaugcagaugccaaugaucg

SEQ ID NO: 2243607 - RNA, 14 nt, Yersinia pestis
aaucugaauagggg

SEQ ID NO: 2243608 - RNA, 20 nt, Yersinia pestis
aaucucuugauuaccaauaa

SEQ ID NO: 2243609 - RNA, 22 nt, Yersinia pestis
aaucugcaaugucauuaauugg

SEQ ID NO: 2243610 - RNA, 13 nt, Yersinia pestis
uuuuuuaucagcc

SEQ ID NO: 2243611 - RNA, 19 nt, Yersinia pestis
uuggcuagccugacaggcu

SEQ ID NO: 2243612 - RNA, 16 nt, Yersinia pestis
uuggcguagcuugauu

SEQ ID NO: 2243613 - RNA, 18 nt, Yersinia pestis
uuggcuaaaccacggcgu

SEQ ID NO: 2243614 - RNA, 15 nt, Yersinia pestis
uugcuuuuugccagu

SEQ ID NO: 2243615 - RNA, 14 nt, Yersinia pestis
uuggaaagggcaua

SEQ ID NO: 2243616 - RNA, 14 nt, Yersinia pestis
uugcuuaucgucaa

SEQ ID NO: 2243617 - RNA, 14 nt, Yersinia pestis
uugcuucugaacga

SEQ ID NO: 2243618 - RNA, 20 nt, Yersinia pestis
uugcggcguuucucagacug

SEQ ID NO: 2243619 - RNA, 15 nt, Yersinia pestis
uugcuggcgcugauc

SEQ ID NO: 2243620 - RNA, 22 nt, Yersinia pestis
uugcuccgacaauaacgcugaa

SEQ ID NO: 2243621 - RNA, 17 nt, Yersinia pestis
uugaucgauaacgcuaa

SEQ ID NO: 2243622 - RNA, 16 nt, Yersinia pestis
uugcgcugauaacuuc

SEQ ID NO: 2243623 - RNA, 20 nt, Yersinia pestis
uugcggaagguauccaauac

SEQ ID NO: 2243624 - RNA, 14 nt, Yersinia pestis
uugcggcaauggcu

SEQ ID NO: 2243625 - RNA, 19 nt, Yersinia pestis
uuucaucccauauuccggu

SEQ ID NO: 2243626 - RNA, 18 nt, Yersinia pestis
uuucagacugcugacaac

SEQ ID NO: 2243627 - RNA, 14 nt, Yersinia pestis
uuuauuacagagua

SEQ ID NO: 2243628 - RNA, 20 nt, Yersinia pestis
uuucaagauagcugucagcg

SEQ ID NO: 2243629 - RNA, 20 nt, Yersinia pestis
uuuaguugcuauuuccccgc

SEQ ID NO: 2243630 - RNA, 18 nt, Yersinia pestis
uuuauaaaaccacugacc

SEQ ID NO: 2243631 - RNA, 18 nt, Yersinia pestis
uuuagucaucaugacgau

SEQ ID NO: 2243632 - RNA, 15 nt, Yersinia pestis
uuuaggccuauaacc

SEQ ID NO: 2243633 - RNA, 17 nt, Yersinia pestis
uuuagaggcugauaacc

SEQ ID NO: 2243634 - RNA, 23 nt, Yersinia pestis
uuuagacaagcgcaguagcggcu

SEQ ID NO: 2243635 - RNA, 11 nt, Yersinia pestis
uuuaaugcccc

SEQ ID NO: 2243636 - RNA, 16 nt, Yersinia pestis
uuuaauaugugacaau

SEQ ID NO: 2243637 - RNA, 21 nt, Yersinia pestis
uuuacgggcugaacccugacg

SEQ ID NO: 2243638 - RNA, 14 nt, Yersinia pestis
uuguucgugaaagc

SEQ ID NO: 2243639 - RNA, 19 nt, Yersinia pestis
uuguuacugcuuaccuugu

SEQ ID NO: 2243640 - RNA, 15 nt, Yersinia pestis
uguaucaauaccuua

SEQ ID NO: 2243641 - RNA, 19 nt, Yersinia pestis
uguauuguugcucaacaua

SEQ ID NO: 2243642 - RNA, 14 nt, Yersinia pestis
uguauuaccucacg

SEQ ID NO: 2243643 - RNA, 19 nt, Yersinia pestis
uguaaauuaauacaccggg

SEQ ID NO: 2243644 - RNA, 18 nt, Yersinia pestis
uguaaauguacagucauu

SEQ ID NO: 2243645 - RNA, 16 nt, Yersinia pestis
ugguucgagacaacgu

SEQ ID NO: 2243646 - RNA, 22 nt, Yersinia pestis
uggugaugcugcuggcguuauu

SEQ ID NO: 2243647 - RNA, 18 nt, Yersinia pestis
uggugauaacugccauac

SEQ ID NO: 2243648 - RNA, 20 nt, Yersinia pestis
uggugaugaugacggugaug

SEQ ID NO: 2243649 - RNA, 15 nt, Yersinia pestis
aaucaaucaauugcc

SEQ ID NO: 2243650 - RNA, 21 nt, Yersinia pestis
aaucaacgcucaaucacgaca

SEQ ID NO: 2243651 - RNA, 19 nt, Yersinia pestis
uggucuaucauuuacggcu

SEQ ID NO: 2243652 - RNA, 18 nt, Yersinia pestis
uggugagcgccaugcgcu

SEQ ID NO: 2243653 - RNA, 20 nt, Yersinia pestis
ugguaauuucggguaacggu

SEQ ID NO: 2243654 - RNA, 21 nt, Yersinia pestis
ugguaaucgucccacaugaac

SEQ ID NO: 2243655 - RNA, 21 nt, Yersinia pestis
ugguaacguucgcguggcaga

SEQ ID NO: 2243656 - RNA, 17 nt, Yersinia pestis
ugguaacgcagaaauau

SEQ ID NO: 2243657 - RNA, 20 nt, Yersinia pestis
ugggucauugcgugcaauaa

SEQ ID NO: 2243658 - RNA, 13 nt, Yersinia pestis
uggguauccagug

SEQ ID NO: 2243659 - RNA, 17 nt, Yersinia pestis
uggguaauaucaccauu

SEQ ID NO: 2243660 - RNA, 18 nt, Yersinia pestis
uggguaaaccuugcugau

SEQ ID NO: 2243661 - RNA, 21 nt, Yersinia pestis
uggguaaaccaaucaagcaua

SEQ ID NO: 2243662 - RNA, 22 nt, Yersinia pestis
ugggccaccggucugaauaccg

SEQ ID NO: 2243663 - RNA, 23 nt, Yersinia pestis
uggcuagccugcaccucaucaac

SEQ ID NO: 2243664 - RNA, 22 nt, Yersinia pestis
uggcuacguaaucuuuaccgcu

SEQ ID NO: 2243665 - RNA, 16 nt, Yersinia pestis
uggcugagauuuagau

SEQ ID NO: 2243666 - RNA, 15 nt, Yersinia pestis
uggcggccagugaug

SEQ ID NO: 2243667 - RNA, 14 nt, Yersinia pestis
ugggauaugccgua

SEQ ID NO: 2243668 - RNA, 20 nt, Yersinia pestis
ugggaauuaagaagccucau

SEQ ID NO: 2243669 - RNA, 20 nt, Yersinia pestis
uggcuugcuugauggcauca

SEQ ID NO: 2243670 - RNA, 15 nt, Yersinia pestis
uggccugugaugaug

SEQ ID NO: 2243671 - RNA, 15 nt, Yersinia pestis
uggcauacagcucau

SEQ ID NO: 2243672 - RNA, 15 nt, Yersinia pestis
uggcauaaccaauca

SEQ ID NO: 2243673 - RNA, 14 nt, Yersinia pestis
uggagaucugggcg

SEQ ID NO: 2243674 - RNA, 21 nt, Yersinia pestis
uggauacugcauuucaacaaa

SEQ ID NO: 2243675 - RNA, 23 nt, Yersinia pestis
uggauaagugaauaacgcugaau

SEQ ID NO: 2243676 - RNA, 17 nt, Yersinia pestis
uggauaaggugaugaau

SEQ ID NO: 2243677 - RNA, 22 nt, Yersinia pestis
uggcaacgacuggguaacggau

SEQ ID NO: 2243678 - RNA, 17 nt, Yersinia pestis
uggcaagguaaacgggu

SEQ ID NO: 2243679 - RNA, 17 nt, Yersinia pestis
uggcagaaaucagccau

SEQ ID NO: 2243680 - RNA, 16 nt, Yersinia pestis
aauaucaaugauguca

SEQ ID NO: 2243681 - RNA, 13 nt, Yersinia pestis
ugcuaccagcaau

SEQ ID NO: 2243682 - RNA, 18 nt, Yersinia pestis
ugcuaacuuguucagaaa

SEQ ID NO: 2243683 - RNA, 19 nt, Yersinia pestis
ugcguuuccgggcaauaau

SEQ ID NO: 2243684 - RNA, 17 nt, Yersinia pestis
ugcucugucaacgcuuc

SEQ ID NO: 2243685 - RNA, 17 nt, Yersinia pestis
ugcugaaaaucaugaaa

SEQ ID NO: 2243686 - RNA, 13 nt, Yersinia pestis
ugcugaacuugcu

SEQ ID NO: 2243687 - RNA, 15 nt, Yersinia pestis
ugcucggugaguuua

SEQ ID NO: 2243688 - RNA, 15 nt, Yersinia pestis
ugcucacuacccuua

SEQ ID NO: 2243689 - RNA, 13 nt, Yersinia pestis
ugcucaacugcuc

SEQ ID NO: 2243690 - RNA, 16 nt, Yersinia pestis
ugcucaacugcucaac

SEQ ID NO: 2243691 - RNA, 16 nt, Yersinia pestis
ugcugcccaaccgcau

SEQ ID NO: 2243692 - RNA, 13 nt, Yersinia pestis
ugcuggccaguuu

SEQ ID NO: 2243693 - RNA, 22 nt, Yersinia pestis
ugcuggcggauaacggcggcaa

SEQ ID NO: 2243694 - RNA, 13 nt, Yersinia pestis
ugcgcgcugggac

SEQ ID NO: 2243695 - RNA, 20 nt, Yersinia pestis
ugcgcuccacgccccaacgg

SEQ ID NO: 2243696 - RNA, 16 nt, Yersinia pestis
ugcgcugcgccaauac

SEQ ID NO: 2243697 - RNA, 15 nt, Yersinia pestis
ugccugacagccugu

SEQ ID NO: 2243698 - RNA, 20 nt, Yersinia pestis
ugccuaagccuaauggugcu

SEQ ID NO: 2243699 - RNA, 15 nt, Yersinia pestis
aauagaucccauacc

SEQ ID NO: 2243700 - RNA, 13 nt, Yersinia pestis
aauagagccucua

SEQ ID NO: 2243701 - RNA, 12 nt, Yersinia pestis
aauagauaacaa

SEQ ID NO: 2243702 - RNA, 15 nt, Yersinia pestis
ugccguuaaaggccc

SEQ ID NO: 2243703 - RNA, 14 nt, Yersinia pestis
ugccguuacccccg

SEQ ID NO: 2243704 - RNA, 14 nt, Yersinia pestis
ugccguacaacaau

SEQ ID NO: 2243705 - RNA, 19 nt, Yersinia pestis
ugccgcgcccccagccauu

SEQ ID NO: 2243706 - RNA, 17 nt, Yersinia pestis
aauaguacuugccacaa

SEQ ID NO: 2243707 - RNA, 12 nt, Yersinia pestis
ugcgauccuggc

SEQ ID NO: 2243708 - RNA, 20 nt, Yersinia pestis
ugcgacaaugcccccagcgg

SEQ ID NO: 2243709 - RNA, 13 nt, Yersinia pestis
caauaaaacucac

SEQ ID NO: 2243710 - RNA, 15 nt, Yersinia pestis
caauaaaaacgccuc

SEQ ID NO: 2243711 - RNA, 13 nt, Yersinia pestis
caauaaacucaua

SEQ ID NO: 2243712 - RNA, 18 nt, Yersinia pestis
caauaaaggcaagauuuc

SEQ ID NO: 2243713 - RNA, 16 nt, Yersinia pestis
caauaacaaacacauc

SEQ ID NO: 2243714 - RNA, 17 nt, Yersinia pestis
caauaauaucuggcguu

SEQ ID NO: 2243715 - RNA, 13 nt, Yersinia pestis
caauaauaagccg

SEQ ID NO: 2243716 - RNA, 13 nt, Yersinia pestis
caauaauucagau

SEQ ID NO: 2243717 - RNA, 15 nt, Yersinia pestis
caauagguaaaucca

SEQ ID NO: 2243718 - RNA, 21 nt, Yersinia pestis
caauaggcuauuuuacuugcc

SEQ ID NO: 2243719 - RNA, 22 nt, Yersinia pestis
caauauugcauaaaugacgagc

SEQ ID NO: 2243720 - RNA, 16 nt, Yersinia pestis
caauaucaaaacucca

SEQ ID NO: 2243721 - RNA, 19 nt, Yersinia pestis
caauacuggccaugugugu

SEQ ID NO: 2243722 - RNA, 18 nt, Yersinia pestis
caauaccuuacugcauca

SEQ ID NO: 2243723 - RNA, 18 nt, Yersinia pestis
caauaccuuacuguauca

SEQ ID NO: 2243724 - RNA, 15 nt, Yersinia pestis
caaguaaaagucagc

SEQ ID NO: 2243725 - RNA, 16 nt, Yersinia pestis
caagucagggaucacc

SEQ ID NO: 2243726 - RNA, 17 nt, Yersinia pestis
caagccucgcugagucu

SEQ ID NO: 2243727 - RNA, 22 nt, Yersinia pestis
caagcgacccggcugcacgcca

SEQ ID NO: 2243728 - RNA, 14 nt, Yersinia pestis
caaucaugggccaa

SEQ ID NO: 2243729 - RNA, 13 nt, Yersinia pestis
caaucaaugaacc

SEQ ID NO: 2243730 - RNA, 20 nt, Yersinia pestis
caaucacauccccugccguu

SEQ ID NO: 2243731 - RNA, 15 nt, Yersinia pestis
caauccauccgguuu

SEQ ID NO: 2243732 - RNA, 12 nt, Yersinia pestis
caaucucaucaa

SEQ ID NO: 2243733 - RNA, 14 nt, Yersinia pestis
caaucuccacuuua

SEQ ID NO: 2243734 - RNA, 15 nt, Yersinia pestis
caaucggauaaccgc

SEQ ID NO: 2243735 - RNA, 20 nt, Yersinia pestis
caaucuggggguaacgccgc

SEQ ID NO: 2243736 - RNA, 21 nt, Yersinia pestis
cacaaugccuaaaauggccgu

SEQ ID NO: 2243737 - RNA, 12 nt, Yersinia pestis
cacacaauacau

SEQ ID NO: 2243738 - RNA, 20 nt, Yersinia pestis
cacaacggaaggcccagccg

SEQ ID NO: 2243739 - RNA, 18 nt, Yersinia pestis
cacaaugcacagugccgu

SEQ ID NO: 2243740 - RNA, 15 nt, Yersinia pestis
cacaauauauacaua

SEQ ID NO: 2243741 - RNA, 16 nt, Yersinia pestis
cacaauagaugcagua

SEQ ID NO: 2243742 - RNA, 15 nt, Yersinia pestis
cacaauacagcaaau

SEQ ID NO: 2243743 - RNA, 18 nt, Yersinia pestis
cacaacccgcugaugccg

SEQ ID NO: 2243744 - RNA, 18 nt, Yersinia pestis
cacaacgcaucaguaaug

SEQ ID NO: 2243745 - RNA, 14 nt, Yersinia pestis
cacaacgacagcca

SEQ ID NO: 2243746 - RNA, 21 nt, Yersinia pestis
caauuuaucagacaaucugug

SEQ ID NO: 2243747 - RNA, 18 nt, Yersinia pestis
caauguguugaauaucca

SEQ ID NO: 2243748 - RNA, 23 nt, Yersinia pestis
caauguguugaauauccaauggu

SEQ ID NO: 2243749 - RNA, 14 nt, Yersinia pestis
caaugugagaaucu

SEQ ID NO: 2243750 - RNA, 21 nt, Yersinia pestis
caauggcgaugagaaugccga

SEQ ID NO: 2243751 - RNA, 19 nt, Yersinia pestis
caaccauccgcccaauacg

SEQ ID NO: 2243752 - RNA, 16 nt, Yersinia pestis
caaccccaucagcaua

SEQ ID NO: 2243753 - RNA, 20 nt, Yersinia pestis
caacccgccccccaucaacg

SEQ ID NO: 2243754 - RNA, 12 nt, Yersinia pestis
caaccucagccu

SEQ ID NO: 2243755 - RNA, 18 nt, Yersinia pestis
caaccguuacgauaaucu

SEQ ID NO: 2243756 - RNA, 21 nt, Yersinia pestis
caaccgcuugcauacgcuuaa

SEQ ID NO: 2243757 - RNA, 17 nt, Yersinia pestis
caacuaucguccgcgcc

SEQ ID NO: 2243758 - RNA, 19 nt, Yersinia pestis
caacuaaacagggcagaaa

SEQ ID NO: 2243759 - RNA, 21 nt, Yersinia pestis
caacgcguacgggacggguug

SEQ ID NO: 2243760 - RNA, 13 nt, Yersinia pestis
caacaaaguaagg

SEQ ID NO: 2243761 - RNA, 18 nt, Yersinia pestis
caaauucuuucaacgcau

SEQ ID NO: 2243762 - RNA, 21 nt, Yersinia pestis
caaauuuuuaccuucuacaaa

SEQ ID NO: 2243763 - RNA, 22 nt, Yersinia pestis
caaauuguggaaauaacgcggc

SEQ ID NO: 2243764 - RNA, 18 nt, Yersinia pestis
caacaauaaagcgguaaa

SEQ ID NO: 2243765 - RNA, 14 nt, Yersinia pestis
caacaccacacuga

SEQ ID NO: 2243766 - RNA, 15 nt, Yersinia pestis
caacacccaacucaa

SEQ ID NO: 2243767 - RNA, 20 nt, Yersinia pestis
caaauauuaccguuaucaaa

SEQ ID NO: 2243768 - RNA, 17 nt, Yersinia pestis
caaauuaaguaagccgc

SEQ ID NO: 2243769 - RNA, 14 nt, Yersinia pestis
auuguggcuaaacc

SEQ ID NO: 2243770 - RNA, 18 nt, Yersinia pestis
auuuaaauaagauccaga

SEQ ID NO: 2243771 - RNA, 15 nt, Yersinia pestis
caaaggcccaaguau

SEQ ID NO: 2243772 - RNA, 12 nt, Yersinia pestis
caaacugauaaa

SEQ ID NO: 2243773 - RNA, 16 nt, Yersinia pestis
caaacccggugcauug

SEQ ID NO: 2243774 - RNA, 23 nt, Yersinia pestis
caccagagaugauagcaauguca

SEQ ID NO: 2243775 - RNA, 16 nt, Yersinia pestis
caccuaaccaaacauu

SEQ ID NO: 2243776 - RNA, 23 nt, Yersinia pestis
caccguuuccagaaucaauggga

SEQ ID NO: 2243777 - RNA, 19 nt, Yersinia pestis
caccgccuaucgugaacag

SEQ ID NO: 2243778 - RNA, 16 nt, Yersinia pestis
auugaccagauagcug

SEQ ID NO: 2243779 - RNA, 19 nt, Yersinia pestis
auugagcauauucaguaac

SEQ ID NO: 2243780 - RNA, 13 nt, Yersinia pestis
auugagguaaacc

SEQ ID NO: 2243781 - RNA, 15 nt, Yersinia pestis
auugagguugccggu

SEQ ID NO: 2243782 - RNA, 19 nt, Yersinia pestis
auugauaaaaucaccgccg

SEQ ID NO: 2243783 - RNA, 20 nt, Yersinia pestis
auugaagggcaaaacgugaa

SEQ ID NO: 2243784 - RNA, 23 nt, Yersinia pestis
auucuucguugccccaucagcac

SEQ ID NO: 2243785 - RNA, 21 nt, Yersinia pestis
auugcaggauaauagugucau

SEQ ID NO: 2243786 - RNA, 14 nt, Yersinia pestis
auugcaggauagcc

SEQ ID NO: 2243787 - RNA, 21 nt, Yersinia pestis
auugcaacaacgccagauaac

SEQ ID NO: 2243788 - RNA, 13 nt, Yersinia pestis
auugcuggcuauc

SEQ ID NO: 2243789 - RNA, 23 nt, Yersinia pestis
auugcuaaauuuuguacaacuuc

SEQ ID NO: 2243790 - RNA, 20 nt, Yersinia pestis
auugcguuaguccacccagc

SEQ ID NO: 2243791 - RNA, 14 nt, Yersinia pestis
auugccucggcaag

SEQ ID NO: 2243792 - RNA, 12 nt, Yersinia pestis
auugcgaauauu

SEQ ID NO: 2243793 - RNA, 22 nt, Yersinia pestis
auuggcuucuaccguaucagcc

SEQ ID NO: 2243794 - RNA, 22 nt, Yersinia pestis
auuggccuuccaucgucagaac

SEQ ID NO: 2243795 - RNA, 22 nt, Yersinia pestis
auugguguuacagcaaggcagc

SEQ ID NO: 2243796 - RNA, 13 nt, Yersinia pestis
auucaccaccauu

SEQ ID NO: 2243797 - RNA, 13 nt, Yersinia pestis
auuauucaugaug

SEQ ID NO: 2243798 - RNA, 20 nt, Yersinia pestis
auuaugauuggcugaugcgc

SEQ ID NO: 2243799 - RNA, 21 nt, Yersinia pestis
auuaaagccauucagcagcaa

SEQ ID NO: 2243800 - RNA, 15 nt, Yersinia pestis
auuaaagauuaagac

SEQ ID NO: 2243801 - RNA, 13 nt, Yersinia pestis
auuaaaugcauua

SEQ ID NO: 2243802 - RNA, 14 nt, Yersinia pestis
auuaacaaagcuau

SEQ ID NO: 2243803 - RNA, 17 nt, Yersinia pestis
auucauaugcgcgucaa

SEQ ID NO: 2243804 - RNA, 21 nt, Yersinia pestis
auucagcgucagucaaugagc

SEQ ID NO: 2243805 - RNA, 14 nt, Yersinia pestis
augcuuaaagccuu

SEQ ID NO: 2243806 - RNA, 16 nt, Yersinia pestis
auggacgauuaccguu

SEQ ID NO: 2243807 - RNA, 22 nt, Yersinia pestis
auggaccgcgacacaagccauu

SEQ ID NO: 2243808 - RNA, 19 nt, Yersinia pestis
auggauaaauucagccgcu

SEQ ID NO: 2243809 - RNA, 16 nt, Yersinia pestis
auggauuugugcaaau

SEQ ID NO: 2243810 - RNA, 19 nt, Yersinia pestis
auggcaaagcacagucgcc

SEQ ID NO: 2243811 - RNA, 18 nt, Yersinia pestis
auggauguauuuacggcg

SEQ ID NO: 2243812 - RNA, 23 nt, Yersinia pestis
auggauucuugcugcaaccguga

SEQ ID NO: 2243813 - RNA, 20 nt, Yersinia pestis
auggcauuuaggcgggcagu

SEQ ID NO: 2243814 - RNA, 20 nt, Yersinia pestis
augcauuggaaaaaaucuuc

SEQ ID NO: 2243815 - RNA, 21 nt, Yersinia pestis
augcugcacaucaacggacag

SEQ ID NO: 2243816 - RNA, 15 nt, Yersinia pestis
augcugaccacugcu

SEQ ID NO: 2243817 - RNA, 22 nt, Yersinia pestis
augucagacagcacgggcuauc

SEQ ID NO: 2243818 - RNA, 20 nt, Yersinia pestis
augggcagugcacagucacu

SEQ ID NO: 2243819 - RNA, 19 nt, Yersinia pestis
auggggccaccuaauccaa

SEQ ID NO: 2243820 - RNA, 15 nt, Yersinia pestis
augguguagcugaac

SEQ ID NO: 2243821 - RNA, 19 nt, Yersinia pestis
auggucaacucgagcauuu

SEQ ID NO: 2243822 - RNA, 20 nt, Yersinia pestis
augguauucgauauggaugg

SEQ ID NO: 2243823 - RNA, 14 nt, Yersinia pestis
augggucguugaua

SEQ ID NO: 2243824 - RNA, 20 nt, Yersinia pestis
augggguaaucccgaaucaa

SEQ ID NO: 2243825 - RNA, 19 nt, Yersinia pestis
aucuuuaccccauugcacc

SEQ ID NO: 2243826 - RNA, 21 nt, Yersinia pestis
augaccuacacacucaguaca

SEQ ID NO: 2243827 - RNA, 14 nt, Yersinia pestis
augacccaacguca

SEQ ID NO: 2243828 - RNA, 15 nt, Yersinia pestis
augacauucagcguu

SEQ ID NO: 2243829 - RNA, 17 nt, Yersinia pestis
augaaugacuggcuauu

SEQ ID NO: 2243830 - RNA, 13 nt, Yersinia pestis
augaaucaacaga

SEQ ID NO: 2243831 - RNA, 14 nt, Yersinia pestis
augagucgcuggua

SEQ ID NO: 2243832 - RNA, 14 nt, Yersinia pestis
augaguaaaccgua

SEQ ID NO: 2243833 - RNA, 18 nt, Yersinia pestis
augaucaaacggauaauc

SEQ ID NO: 2243834 - RNA, 16 nt, Yersinia pestis
augaucaagauagcgu

SEQ ID NO: 2243835 - RNA, 19 nt, Yersinia pestis
augauuaacggauacccuu

SEQ ID NO: 2243836 - RNA, 13 nt, Yersinia pestis
augcacugaacaa

SEQ ID NO: 2243837 - RNA, 19 nt, Yersinia pestis
augcagaugccaaugaucg

SEQ ID NO: 2243838 - RNA, 15 nt, Yersinia pestis
augcagcauuucagg

SEQ ID NO: 2243839 - RNA, 13 nt, Yersinia pestis
augcauaacugcu

SEQ ID NO: 2243840 - RNA, 16 nt, Yersinia pestis
augcauaagcacgaau

SEQ ID NO: 2243841 - RNA, 23 nt, Yersinia pestis
augcaguaacgggucucaaugca

SEQ ID NO: 2243842 - RNA, 18 nt, Yersinia pestis
augcagguuuugccagau

SEQ ID NO: 2243843 - RNA, 12 nt, Yersinia pestis
aucuaacugcac

SEQ ID NO: 2243844 - RNA, 22 nt, Yersinia pestis
aucggcgucaagguacccauua

SEQ ID NO: 2243845 - RNA, 21 nt, Yersinia pestis
aucuaaucggcuggcaagaua

SEQ ID NO: 2243846 - RNA, 16 nt, Yersinia pestis
aucuaucgauacccuu

SEQ ID NO: 2243847 - RNA, 16 nt, Yersinia pestis
aucuccaguugcacac

SEQ ID NO: 2243848 - RNA, 19 nt, Yersinia pestis
aucuuccagauagcgaauc

SEQ ID NO: 2243849 - RNA, 20 nt, Yersinia pestis
aucuucauccgcuccagccu

SEQ ID NO: 2243850 - RNA, 16 nt, Yersinia pestis
aucuugaacggugagg

SEQ ID NO: 2243851 - RNA, 15 nt, Yersinia pestis
aucugcugaccauua

SEQ ID NO: 2243852 - RNA, 22 nt, Yersinia pestis
aucgcucuugagggugaccauc

SEQ ID NO: 2243853 - RNA, 19 nt, Yersinia pestis
aucgcugugguuaucacgg

SEQ ID NO: 2243854 - RNA, 17 nt, Yersinia pestis
aucgcugugguaucaaa

SEQ ID NO: 2243855 - RNA, 18 nt, Yersinia pestis
aucgcgcuucaggucagg

SEQ ID NO: 2243856 - RNA, 18 nt, Yersinia pestis
aucgcuagggauccgcuu

SEQ ID NO: 2243857 - RNA, 21 nt, Yersinia pestis
aucggcggccaugucaggcca

SEQ ID NO: 2243858 - RNA, 21 nt, Yersinia pestis
aucgccguuacccccuucacc

SEQ ID NO: 2243859 - RNA, 17 nt, Yersinia pestis
auccuucaagaugcagg

SEQ ID NO: 2243860 - RNA, 13 nt, Yersinia pestis
auccucauugagc

SEQ ID NO: 2243861 - RNA, 18 nt, Yersinia pestis
auccucaccguucaagau

SEQ ID NO: 2243862 - RNA, 15 nt, Yersinia pestis
auccuacauucagua

SEQ ID NO: 2243863 - RNA, 21 nt, Yersinia pestis
auccggcgggcaauauaggcg

SEQ ID NO: 2243864 - RNA, 16 nt, Yersinia pestis
aucagcgguaucuaga

SEQ ID NO: 2243865 - RNA, 13 nt, Yersinia pestis
agauuacagccua

SEQ ID NO: 2243866 - RNA, 16 nt, Yersinia pestis
agcaaauuuaucagua

SEQ ID NO: 2243867 - RNA, 13 nt, Yersinia pestis
agcaaaucacauu

SEQ ID NO: 2243868 - RNA, 16 nt, Yersinia pestis
agauucgcaaagcggg

SEQ ID NO: 2243869 - RNA, 21 nt, Yersinia pestis
agcaacucacugaauauccgu

SEQ ID NO: 2243870 - RNA, 19 nt, Yersinia pestis
agcaaugaccucccuguua

SEQ ID NO: 2243871 - RNA, 14 nt, Yersinia pestis
agcaauauauugcu

SEQ ID NO: 2243872 - RNA, 23 nt, Yersinia pestis
agcaccagaaaguuguucaacgc

SEQ ID NO: 2243873 - RNA, 18 nt, Yersinia pestis
agcaccagcaccaacaau

SEQ ID NO: 2243874 - RNA, 15 nt, Yersinia pestis
agcacucaguacagu

SEQ ID NO: 2243875 - RNA, 19 nt, Yersinia pestis
agcacucgguggcauaaac

SEQ ID NO: 2243876 - RNA, 23 nt, Yersinia pestis
agcacuacguguuuuucaucugu

SEQ ID NO: 2243877 - RNA, 20 nt, Yersinia pestis
agcacuaagauucaaacagu

SEQ ID NO: 2243878 - RNA, 14 nt, Yersinia pestis
agcacuaucacauc

SEQ ID NO: 2243879 - RNA, 16 nt, Yersinia pestis
agcacguaaaucgguu

SEQ ID NO: 2243880 - RNA, 15 nt, Yersinia pestis
agauauuugcugccu

SEQ ID NO: 2243881 - RNA, 14 nt, Yersinia pestis
agauauuauuagcc

SEQ ID NO: 2243882 - RNA, 16 nt, Yersinia pestis
agaguccagcacuggu

SEQ ID NO: 2243883 - RNA, 15 nt, Yersinia pestis
agaucgcgucaucgg

SEQ ID NO: 2243884 - RNA, 22 nt, Yersinia pestis
agaugauuuuuaacgucagaua

SEQ ID NO: 2243885 - RNA, 21 nt, Yersinia pestis
agaugacaucgacgcgccaua

SEQ ID NO: 2243886 - RNA, 22 nt, Yersinia pestis
agaugacaucgacgcgccauaa

SEQ ID NO: 2243887 - RNA, 20 nt, Yersinia pestis
agauggucaacuaaacagau

SEQ ID NO: 2243888 - RNA, 19 nt, Yersinia pestis
agacuaaccucugcaaugc

SEQ ID NO: 2243889 - RNA, 20 nt, Yersinia pestis
agaaaaucguuguauuagcc

SEQ ID NO: 2243890 - RNA, 17 nt, Yersinia pestis
agaggacucugcgcuca

SEQ ID NO: 2243891 - RNA, 18 nt, Yersinia pestis
agagaucccgugccagau

SEQ ID NO: 2243892 - RNA, 20 nt, Yersinia pestis
agcagucugagggccacuuc

SEQ ID NO: 2243893 - RNA, 21 nt, Yersinia pestis
agcagucugaggggcguuuaa

SEQ ID NO: 2243894 - RNA, 17 nt, Yersinia pestis
agccagugcgggagagu

SEQ ID NO: 2243895 - RNA, 16 nt, Yersinia pestis
agccaucaguucacug

SEQ ID NO: 2243896 - RNA, 12 nt, Yersinia pestis
agccaucgccau

SEQ ID NO: 2243897 - RNA, 20 nt, Yersinia pestis
agccaaaugagauugaucag

SEQ ID NO: 2243898 - RNA, 14 nt, Yersinia pestis
agccagaaugaacu

SEQ ID NO: 2243899 - RNA, 18 nt, Yersinia pestis
agccgauaauccaccuga

SEQ ID NO: 2243900 - RNA, 17 nt, Yersinia pestis
agcccuguugcccagca

SEQ ID NO: 2243901 - RNA, 18 nt, Yersinia pestis
agcccaacugacugaagu

SEQ ID NO: 2243902 - RNA, 20 nt, Yersinia pestis
agcccacugacacugauaga

SEQ ID NO: 2243903 - RNA, 15 nt, Yersinia pestis
agcgccccugagguu

SEQ ID NO: 2243904 - RNA, 18 nt, Yersinia pestis
agcgcccggcugaccugu

SEQ ID NO: 2243905 - RNA, 20 nt, Yersinia pestis
agcgcuuggugaugcugcug

SEQ ID NO: 2243906 - RNA, 17 nt, Yersinia pestis
agccuucauucaauuga

SEQ ID NO: 2243907 - RNA, 19 nt, Yersinia pestis
agcgauagauccacuccag

SEQ ID NO: 2243908 - RNA, 14 nt, Yersinia pestis
agcguucaucgccc

SEQ ID NO: 2243909 - RNA, 21 nt, Yersinia pestis
agcguggaauuaauaucccac

SEQ ID NO: 2243910 - RNA, 15 nt, Yersinia pestis
agcggguuaccagua

SEQ ID NO: 2243911 - RNA, 17 nt, Yersinia pestis
agcgugaauucacucag

SEQ ID NO: 2243912 - RNA, 18 nt, Yersinia pestis
agcguuucuacaauggcc

SEQ ID NO: 2243913 - RNA, 23 nt, Yersinia pestis
agcguuucuacaauggccuuagc

SEQ ID NO: 2243914 - RNA, 22 nt, Yersinia pestis
agcuaccggaaugaguugcccu

SEQ ID NO: 2243915 - RNA, 16 nt, Yersinia pestis
agcuaaccuuaacugc

SEQ ID NO: 2243916 - RNA, 16 nt, Yersinia pestis
agcucacgccaauuca

SEQ ID NO: 2243917 - RNA, 13 nt, Yersinia pestis
aggcauuaucuga

SEQ ID NO: 2243918 - RNA, 18 nt, Yersinia pestis
aggauggcccaagccauc

SEQ ID NO: 2243919 - RNA, 16 nt, Yersinia pestis
aggauggcccaagcca

SEQ ID NO: 2243920 - RNA, 20 nt, Yersinia pestis
aggccuagcccaguaccgcu

SEQ ID NO: 2243921 - RNA, 14 nt, Yersinia pestis
aggcggugaacagu

SEQ ID NO: 2243922 - RNA, 13 nt, Yersinia pestis
aggcgggucagaa

SEQ ID NO: 2243923 - RNA, 19 nt, Yersinia pestis
aggcuaaaccggcacaggc

SEQ ID NO: 2243924 - RNA, 20 nt, Yersinia pestis
aggcuaauacaugcuggcgg

SEQ ID NO: 2243925 - RNA, 22 nt, Yersinia pestis
aggcgugucauuugcgcaauac

SEQ ID NO: 2243926 - RNA, 16 nt, Yersinia pestis
agggaguuauucugau

SEQ ID NO: 2243927 - RNA, 17 nt, Yersinia pestis
aggcuaauuuaggugaa

SEQ ID NO: 2243928 - RNA, 16 nt, Yersinia pestis
aggcuauuuuacuugc

SEQ ID NO: 2243929 - RNA, 20 nt, Yersinia pestis
aggcuauuuuacuugccguu

SEQ ID NO: 2243930 - RNA, 16 nt, Yersinia pestis
aguaaugccgcugccg

SEQ ID NO: 2243931 - RNA, 18 nt, Yersinia pestis
aguacagcacucaguaca

SEQ ID NO: 2243932 - RNA, 21 nt, Yersinia pestis
aguccuggccaaagccgguau

SEQ ID NO: 2243933 - RNA, 23 nt, Yersinia pestis
aguccaacgcacugguugcuuca

SEQ ID NO: 2243934 - RNA, 15 nt, Yersinia pestis
aguaugguuaaucua

SEQ ID NO: 2243935 - RNA, 15 nt, Yersinia pestis
agucaguucauuaca

SEQ ID NO: 2243936 - RNA, 14 nt, Yersinia pestis
agguuacugcccug

SEQ ID NO: 2243937 - RNA, 13 nt, Yersinia pestis
aggugucaucaag

SEQ ID NO: 2243938 - RNA, 14 nt, Yersinia pestis
agguggccauuacg

SEQ ID NO: 2243939 - RNA, 21 nt, Yersinia pestis
aguaaaaaaucuauugauugc

SEQ ID NO: 2243940 - RNA, 17 nt, Yersinia pestis
aguaaacgccaaucacc

SEQ ID NO: 2243941 - RNA, 14 nt, Yersinia pestis
aguaaacugcgcuu

SEQ ID NO: 2243942 - RNA, 21 nt, Yersinia pestis
agguaccccauaaaucccgag

SEQ ID NO: 2243943 - RNA, 14 nt, Yersinia pestis
aggucaauugcggc

SEQ ID NO: 2243944 - RNA, 23 nt, Yersinia pestis
agggguugcaggcugucaggaac

SEQ ID NO: 2243945 - RNA, 23 nt, Yersinia pestis
aggguauuggcuaacuggcgcug

SEQ ID NO: 2243946 - RNA, 21 nt, Yersinia pestis
aggguacagucuagugcgcug

SEQ ID NO: 2243947 - RNA, 15 nt, Yersinia pestis
agggggaugccuugu

SEQ ID NO: 2243948 - RNA, 18 nt, Yersinia pestis
agggccaccagacugaca

SEQ ID NO: 2243949 - RNA, 21 nt, Yersinia pestis
aggucaucgucacgaucaacc

SEQ ID NO: 2243950 - RNA, 20 nt, Yersinia pestis
aggucaucaaggugccauaa

SEQ ID NO: 2243951 - RNA, 11 nt, Yersinia pestis
aggucaggaag

SEQ ID NO: 2243952 - RNA, 18 nt, Yersinia pestis
aggucgggcgcugagcgg

SEQ ID NO: 2243953 - RNA, 14 nt, Yersinia pestis
aguguaaaaagcga

SEQ ID NO: 2243954 - RNA, 23 nt, Yersinia pestis
agugucgauuuaauggguaaacc

SEQ ID NO: 2243955 - RNA, 20 nt, Yersinia pestis
aguuccagccccaaacacuu

SEQ ID NO: 2243956 - RNA, 16 nt, Yersinia pestis
aguugauaaagcugga

SEQ ID NO: 2243957 - RNA, 15 nt, Yersinia pestis
auaaacccuacagca

SEQ ID NO: 2243958 - RNA, 13 nt, Yersinia pestis
auaaaauccacua

SEQ ID NO: 2243959 - RNA, 14 nt, Yersinia pestis
auaaaauucagcca

SEQ ID NO: 2243960 - RNA, 19 nt, Yersinia pestis
auaaagaugaaggucacca

SEQ ID NO: 2243961 - RNA, 20 nt, Yersinia pestis
auaaagcgguaaauggcgaa

SEQ ID NO: 2243962 - RNA, 18 nt, Yersinia pestis
auaaauaggccgccaaau

SEQ ID NO: 2243963 - RNA, 11 nt, Yersinia pestis
auaaauauccu

SEQ ID NO: 2243964 - RNA, 20 nt, Yersinia pestis
auaaaugagauugaugggau

SEQ ID NO: 2243965 - RNA, 14 nt, Yersinia pestis
auaaaacuggcgau

SEQ ID NO: 2243966 - RNA, 21 nt, Yersinia pestis
auaaaacagaacccccgcgaa

SEQ ID NO: 2243967 - RNA, 20 nt, Yersinia pestis
auaaaacagcuugauagggc

SEQ ID NO: 2243968 - RNA, 21 nt, Yersinia pestis
auaaaaaagcccggucacuca

SEQ ID NO: 2243969 - RNA, 19 nt, Yersinia pestis
aguuuuaaacgucagauua

SEQ ID NO: 2243970 - RNA, 19 nt, Yersinia pestis
aguuuuagaugucagauua

SEQ ID NO: 2243971 - RNA, 18 nt, Yersinia pestis
auaaucucagcaucggca

SEQ ID NO: 2243972 - RNA, 12 nt, Yersinia pestis
auaaauuccugg

SEQ ID NO: 2243973 - RNA, 19 nt, Yersinia pestis
auaaauuccuggcggcaac

SEQ ID NO: 2243974 - RNA, 12 nt, Yersinia pestis
auaacaauggcc

SEQ ID NO: 2243975 - RNA, 17 nt, Yersinia pestis
auacacuggcagugcca

SEQ ID NO: 2243976 - RNA, 21 nt, Yersinia pestis
auaauuaauuauucaacguga

SEQ ID NO: 2243977 - RNA, 13 nt, Yersinia pestis
auaauucagauaa

SEQ ID NO: 2243978 - RNA, 12 nt, Yersinia pestis
auaauucagacg

SEQ ID NO: 2243979 - RNA, 21 nt, Yersinia pestis
auaaucuccauugauucacga

SEQ ID NO: 2243980 - RNA, 22 nt, Yersinia pestis
auaccgccacacaauacauaga

SEQ ID NO: 2243981 - RNA, 20 nt, Yersinia pestis
auacaugccucugcuaacaa

SEQ ID NO: 2243982 - RNA, 15 nt, Yersinia pestis
auaccaugccaucaa

SEQ ID NO: 2243983 - RNA, 13 nt, Yersinia pestis
auacaggugucau

SEQ ID NO: 2243984 - RNA, 21 nt, Yersinia pestis
auacccguuauaccucaagcu

SEQ ID NO: 2243985 - RNA, 15 nt, Yersinia pestis
auaccgacaucaaca

SEQ ID NO: 2243986 - RNA, 18 nt, Yersinia pestis
auacucuguuaccaaugg

SEQ ID NO: 2243987 - RNA, 22 nt, Yersinia pestis
auacugagaccuuccauaacuc

SEQ ID NO: 2243988 - RNA, 20 nt, Yersinia pestis
auacuguuaacucgccaaca

SEQ ID NO: 2243989 - RNA, 20 nt, Yersinia pestis
auacugccgaccauaucuuc

SEQ ID NO: 2243990 - RNA, 18 nt, Yersinia pestis
auacuguuaacucgccaa

SEQ ID NO: 2243991 - RNA, 16 nt, Yersinia pestis
auacuugaaacagcag

SEQ ID NO: 2243992 - RNA, 21 nt, Yersinia pestis
auagacuuuuaucaacuucau

SEQ ID NO: 2243993 - RNA, 20 nt, Yersinia pestis
auagcaccgagcaugcuaac

SEQ ID NO: 2243994 - RNA, 15 nt, Yersinia pestis
auagcaacaucgacc

SEQ ID NO: 2243995 - RNA, 21 nt, Yersinia pestis
auagcaaaauugagauaacgc

SEQ ID NO: 2243996 - RNA, 15 nt, Yersinia pestis
aucaacaugggcaag

SEQ ID NO: 2243997 - RNA, 16 nt, Yersinia pestis
aucaaaugucagcguu

SEQ ID NO: 2243998 - RNA, 20 nt, Yersinia pestis
aucaaauacgaccgucacca

SEQ ID NO: 2243999 - RNA, 21 nt, Yersinia pestis
aucaaauuugcaguauucagg

SEQ ID NO: 2244000 - RNA, 21 nt, Yersinia pestis
aucaacacauaaaaucagcau

SEQ ID NO: 2244001 - RNA, 20 nt, Yersinia pestis
aucaaaggcgaccaaugggg

SEQ ID NO: 2244002 - RNA, 19 nt, Yersinia pestis
aucaaacagcacaucgcca

SEQ ID NO: 2244003 - RNA, 19 nt, Yersinia pestis
aucaaguuagcaggcagca

SEQ ID NO: 2244004 - RNA, 20 nt, Yersinia pestis
aucaauaaaauuacccagca

SEQ ID NO: 2244005 - RNA, 12 nt, Yersinia pestis
aucaagggcgau

SEQ ID NO: 2244006 - RNA, 16 nt, Yersinia pestis
aucaaucagcggagcu

SEQ ID NO: 2244007 - RNA, 14 nt, Yersinia pestis
aucaauauaacgcc

SEQ ID NO: 2244008 - RNA, 18 nt, Yersinia pestis
aucaauaggucagugguu

SEQ ID NO: 2244009 - RNA, 13 nt, Yersinia pestis
aucaauaccuuac

SEQ ID NO: 2244010 - RNA, 17 nt, Yersinia pestis
aucaauacacuggcagu

SEQ ID NO: 2244011 - RNA, 13 nt, Yersinia pestis
aucaauaccaaua

SEQ ID NO: 2244012 - RNA, 16 nt, Yersinia pestis
auagcgaucagcaacg

SEQ ID NO: 2244013 - RNA, 16 nt, Yersinia pestis
auauccaaaauaauuc

SEQ ID NO: 2244014 - RNA, 14 nt, Yersinia pestis
auagcgaucagcaa

SEQ ID NO: 2244015 - RNA, 17 nt, Yersinia pestis
auagcccaaauaaccuc

SEQ ID NO: 2244016 - RNA, 12 nt, Yersinia pestis
auagccacuaac

SEQ ID NO: 2244017 - RNA, 18 nt, Yersinia pestis
auauuucaaaugccagua

SEQ ID NO: 2244018 - RNA, 12 nt, Yersinia pestis
auauuaccgcug

SEQ ID NO: 2244019 - RNA, 14 nt, Yersinia pestis
auauuacgcagcca

SEQ ID NO: 2244020 - RNA, 16 nt, Yersinia pestis
auauuagcaauuggcc

SEQ ID NO: 2244021 - RNA, 13 nt, Yersinia pestis
auauuaacugcag

SEQ ID NO: 2244022 - RNA, 15 nt, Yersinia pestis
auauuaauaucagcg

SEQ ID NO: 2244023 - RNA, 20 nt, Yersinia pestis
auauggguaaauacauggcg

SEQ ID NO: 2244024 - RNA, 23 nt, Yersinia pestis
auauguagcagcaccauacagca

SEQ ID NO: 2244025 - RNA, 14 nt, Yersinia pestis
aucacgauccauac

SEQ ID NO: 2244026 - RNA, 17 nt, Yersinia pestis
aucacgcauguucagcc

SEQ ID NO: 2244027 - RNA, 20 nt, Yersinia pestis
aucaccuuggaaaacagcaa

SEQ ID NO: 2244028 - RNA, 17 nt, Yersinia pestis
aucaccuuuuuucaggc

SEQ ID NO: 2244029 - RNA, 22 nt, Yersinia pestis
aucaccaaacagcuucgccacc

SEQ ID NO: 2244030 - RNA, 21 nt, Yersinia pestis
aucaccgccggauuucaaucc

SEQ ID NO: 2244031 - RNA, 15 nt, Yersinia pestis
aucaccauucaagau

SEQ ID NO: 2244032 - RNA, 18 nt, Yersinia pestis
aucacccauaaaugggau

SEQ ID NO: 2244033 - RNA, 16 nt, Yersinia pestis
aucagacggcagcaac

SEQ ID NO: 2244034 - RNA, 22 nt, Yersinia pestis
aucacuugcuggcggcuuuuau

SEQ ID NO: 2244035 - RNA, 23 nt, Yersinia pestis
aucacuucacuugcaugccuggc

SEQ ID NO: 2244036 - RNA, 14 nt, Yersinia pestis
aucacuauuucagg

SEQ ID NO: 2244037 - RNA, 15 nt, Yersinia pestis
aucacugauaucggu

SEQ ID NO: 2244038 - RNA, 13 nt, Yersinia pestis
aucacugaaagug

SEQ ID NO: 2244039 - RNA, 14 nt, Yersinia pestis
aucagccauaucaa

SEQ ID NO: 2244040 - RNA, 13 nt, Yersinia pestis
ccaauauugaucc

SEQ ID NO: 2244041 - RNA, 17 nt, Yersinia pestis
ccaauagcgaucagcaa

SEQ ID NO: 2244042 - RNA, 18 nt, Yersinia pestis
ccaaucauucugucauca

SEQ ID NO: 2244043 - RNA, 21 nt, Yersinia pestis
ccaauccgccuuuaauaccgc

SEQ ID NO: 2244044 - RNA, 18 nt, Yersinia pestis
ccaaccaucaccaucggc

SEQ ID NO: 2244045 - RNA, 17 nt, Yersinia pestis
ccaauggccaccauuaa

SEQ ID NO: 2244046 - RNA, 22 nt, Yersinia pestis
ccaauucuuaggucaucgucac

SEQ ID NO: 2244047 - RNA, 17 nt, Yersinia pestis
ccaauucagcaacgguu

SEQ ID NO: 2244048 - RNA, 19 nt, Yersinia pestis
cauuuaucgccaagccagu

SEQ ID NO: 2244049 - RNA, 17 nt, Yersinia pestis
cauugagacccguuacu

SEQ ID NO: 2244050 - RNA, 12 nt, Yersinia pestis
cauugaccagcg

SEQ ID NO: 2244051 - RNA, 23 nt, Yersinia pestis
cauuguuuggucgguaagcuggc

SEQ ID NO: 2244052 - RNA, 19 nt, Yersinia pestis
cauuuuuaaguggcaucag

SEQ ID NO: 2244053 - RNA, 13 nt, Yersinia pestis
ccaacaccaccau

SEQ ID NO: 2244054 - RNA, 18 nt, Yersinia pestis
ccaacagagugaaucgcc

SEQ ID NO: 2244055 - RNA, 16 nt, Yersinia pestis
ccaacauaaucaaucc

SEQ ID NO: 2244056 - RNA, 22 nt, Yersinia pestis
cauguugugugugaagugugca

SEQ ID NO: 2244057 - RNA, 19 nt, Yersinia pestis
cauuaccccggcggcgggu

SEQ ID NO: 2244058 - RNA, 16 nt, Yersinia pestis
cauuagcccaacggcu

SEQ ID NO: 2244059 - RNA, 14 nt, Yersinia pestis
cauuacauccuuag

SEQ ID NO: 2244060 - RNA, 17 nt, Yersinia pestis
cauuaauuaauaagccc

SEQ ID NO: 2244061 - RNA, 16 nt, Yersinia pestis
cauuauugauugcauc

SEQ ID NO: 2244062 - RNA, 17 nt, Yersinia pestis
cauuauuuauagguaua

SEQ ID NO: 2244063 - RNA, 12 nt, Yersinia pestis
cauucaauuccu

SEQ ID NO: 2244064 - RNA, 18 nt, Yersinia pestis
cauuauaaggaauauacu

SEQ ID NO: 2244065 - RNA, 22 nt, Yersinia pestis
cauuauauuauuuaucaaucag

SEQ ID NO: 2244066 - RNA, 18 nt, Yersinia pestis
cauucgcgccccaaauaa

SEQ ID NO: 2244067 - RNA, 22 nt, Yersinia pestis
cauggcgaucaaaggcgaccaa

SEQ ID NO: 2244068 - RNA, 18 nt, Yersinia pestis
caugcucuucauaagcca

SEQ ID NO: 2244069 - RNA, 14 nt, Yersinia pestis
ccagcuuacgguua

SEQ ID NO: 2244070 - RNA, 15 nt, Yersinia pestis
ccagcaaacgcauuu

SEQ ID NO: 2244071 - RNA, 14 nt, Yersinia pestis
ccagcacaaugacu

SEQ ID NO: 2244072 - RNA, 19 nt, Yersinia pestis
ccagcaauuggccuuccau

SEQ ID NO: 2244073 - RNA, 19 nt, Yersinia pestis
ccacuuuuugaauaauccg

SEQ ID NO: 2244074 - RNA, 18 nt, Yersinia pestis
ccacuucuuucacuaaug

SEQ ID NO: 2244075 - RNA, 17 nt, Yersinia pestis
ccacuuuaccgauuuca

SEQ ID NO: 2244076 - RNA, 19 nt, Yersinia pestis
ccacuugcuuggauuccgu

SEQ ID NO: 2244077 - RNA, 24 nt, Yersinia pestis
ccacugauaggucauauacaccgc

SEQ ID NO: 2244078 - RNA, 16 nt, Yersinia pestis
ccagacaaccaauaca

SEQ ID NO: 2244079 - RNA, 18 nt, Yersinia pestis
ccacgcugaaacuuuuca

SEQ ID NO: 2244080 - RNA, 17 nt, Yersinia pestis
ccacggauauccaacgg

SEQ ID NO: 2244081 - RNA, 13 nt, Yersinia pestis
cccauuuauuaca

SEQ ID NO: 2244082 - RNA, 19 nt, Yersinia pestis
ccccauauaaaaaacuaau

SEQ ID NO: 2244083 - RNA, 14 nt, Yersinia pestis
ccccgccucaaugc

SEQ ID NO: 2244084 - RNA, 20 nt, Yersinia pestis
cccccuguaaccgcaaggau

SEQ ID NO: 2244085 - RNA, 16 nt, Yersinia pestis
cccccuguaacgcuaa

SEQ ID NO: 2244086 - RNA, 17 nt, Yersinia pestis
cccagcacaaugcauuc

SEQ ID NO: 2244087 - RNA, 16 nt, Yersinia pestis
cccacggcgacguuca

SEQ ID NO: 2244088 - RNA, 16 nt, Yersinia pestis
ccaucaguacgguuca

SEQ ID NO: 2244089 - RNA, 17 nt, Yersinia pestis
ccauaccaggccacggc

SEQ ID NO: 2244090 - RNA, 17 nt, Yersinia pestis
ccaucgcuaaucauauc

SEQ ID NO: 2244091 - RNA, 16 nt, Yersinia pestis
ccaugagaaccaguuc

SEQ ID NO: 2244092 - RNA, 19 nt, Yersinia pestis
ccagucgucuucagcuucc

SEQ ID NO: 2244093 - RNA, 22 nt, Yersinia pestis
ccgaacgcacgacugcggugau

SEQ ID NO: 2244094 - RNA, 16 nt, Yersinia pestis
cccugauccacuacuu

SEQ ID NO: 2244095 - RNA, 22 nt, Yersinia pestis
cccugaguuaaguaauaacuca

SEQ ID NO: 2244096 - RNA, 16 nt, Yersinia pestis
cccuaaaaucauugac

SEQ ID NO: 2244097 - RNA, 17 nt, Yersinia pestis
cccuaaagccaucgcca

SEQ ID NO: 2244098 - RNA, 18 nt, Yersinia pestis
cccuaccguaucaacgua

SEQ ID NO: 2244099 - RNA, 12 nt, Yersinia pestis
cccuagcgcaaa

SEQ ID NO: 2244100 - RNA, 20 nt, Yersinia pestis
cccuaacaggcgcaucgcga

SEQ ID NO: 2244101 - RNA, 18 nt, Yersinia pestis
cccuaucauucaacacuc

SEQ ID NO: 2244102 - RNA, 17 nt, Yersinia pestis
ccgaagcucaagcuggc

SEQ ID NO: 2244103 - RNA, 16 nt, Yersinia pestis
cccggcugaccuguug

SEQ ID NO: 2244104 - RNA, 18 nt, Yersinia pestis
cccggauuaaaacuguug

SEQ ID NO: 2244105 - RNA, 19 nt, Yersinia pestis
cccggcaucccaccuucag

SEQ ID NO: 2244106 - RNA, 21 nt, Yersinia pestis
cccgccuugcggaagguaucc

SEQ ID NO: 2244107 - RNA, 12 nt, Yersinia pestis
cagccaauggcc

SEQ ID NO: 2244108 - RNA, 14 nt, Yersinia pestis
cagccaccauuggc

SEQ ID NO: 2244109 - RNA, 19 nt, Yersinia pestis
cagcccuuauucaaagaau

SEQ ID NO: 2244110 - RNA, 12 nt, Yersinia pestis
cagcaagccaau

SEQ ID NO: 2244111 - RNA, 17 nt, Yersinia pestis
cagcaagaacaauccau

SEQ ID NO: 2244112 - RNA, 20 nt, Yersinia pestis
cagcaauaaaccacugguua

SEQ ID NO: 2244113 - RNA, 12 nt, Yersinia pestis
cagcaauacgcc

SEQ ID NO: 2244114 - RNA, 18 nt, Yersinia pestis
cagcgauucauugagcaa

SEQ ID NO: 2244115 - RNA, 15 nt, Yersinia pestis
cagccuuaacugcau

SEQ ID NO: 2244116 - RNA, 14 nt, Yersinia pestis
cagacucaagcauu

SEQ ID NO: 2244117 - RNA, 19 nt, Yersinia pestis
cagacucuuauauaaaucc

SEQ ID NO: 2244118 - RNA, 14 nt, Yersinia pestis
cagacggaauacca

SEQ ID NO: 2244119 - RNA, 18 nt, Yersinia pestis
cagauuugguauuacgcu

SEQ ID NO: 2244120 - RNA, 21 nt, Yersinia pestis
cagcaaacaucgguaaaucgc

SEQ ID NO: 2244121 - RNA, 16 nt, Yersinia pestis
cagcaaaagaaccggu

SEQ ID NO: 2244122 - RNA, 24 nt, Yersinia pestis
cagcaaacucagccaauccagcaa

SEQ ID NO: 2244123 - RNA, 14 nt, Yersinia pestis
cagcaaaucacauu

SEQ ID NO: 2244124 - RNA, 21 nt, Yersinia pestis
cagcaacaacaaaggcgccaa

SEQ ID NO: 2244125 - RNA, 18 nt, Yersinia pestis
cagaugaauccagccaug

SEQ ID NO: 2244126 - RNA, 13 nt, Yersinia pestis
cagaugagaaucu

SEQ ID NO: 2244127 - RNA, 16 nt, Yersinia pestis
cagauaacucagggcg

SEQ ID NO: 2244128 - RNA, 16 nt, Yersinia pestis
cagaaaguaaucuuug

SEQ ID NO: 2244129 - RNA, 15 nt, Yersinia pestis
cagacaagaaugccu

SEQ ID NO: 2244130 - RNA, 12 nt, Yersinia pestis
cagacaaccauu

SEQ ID NO: 2244131 - RNA, 16 nt, Yersinia pestis
cagacaaccaauacac

SEQ ID NO: 2244132 - RNA, 23 nt, Yersinia pestis
cacucauugccuggcccaucuau

SEQ ID NO: 2244133 - RNA, 14 nt, Yersinia pestis
cacucauaauuuug

SEQ ID NO: 2244134 - RNA, 19 nt, Yersinia pestis
cacuccauucgucacuguc

SEQ ID NO: 2244135 - RNA, 18 nt, Yersinia pestis
cagacgccccgaaccauu

SEQ ID NO: 2244136 - RNA, 22 nt, Yersinia pestis
cacuauuucaggcauaucacua

SEQ ID NO: 2244137 - RNA, 14 nt, Yersinia pestis
cacuauuucaggca

SEQ ID NO: 2244138 - RNA, 21 nt, Yersinia pestis
cacuauucuccaacaacugcc

SEQ ID NO: 2244139 - RNA, 23 nt, Yersinia pestis
cacuagagcguuacacaucaggc

SEQ ID NO: 2244140 - RNA, 18 nt, Yersinia pestis
cacuaaaccauucagcca

SEQ ID NO: 2244141 - RNA, 19 nt, Yersinia pestis
cacguuuaauuucacuucc

SEQ ID NO: 2244142 - RNA, 18 nt, Yersinia pestis
cacguaauuauuguucaa

SEQ ID NO: 2244143 - RNA, 20 nt, Yersinia pestis
cacguaaacaaugaccaucu

SEQ ID NO: 2244144 - RNA, 21 nt, Yersinia pestis
cacggcgaguaggucucgccg

SEQ ID NO: 2244145 - RNA, 21 nt, Yersinia pestis
cacggcgagaccuacucgccg

SEQ ID NO: 2244146 - RNA, 21 nt, Yersinia pestis
caccucaucccaaaauagcca

SEQ ID NO: 2244147 - RNA, 16 nt, Yersinia pestis
cagcucauuaaacugu

SEQ ID NO: 2244148 - RNA, 19 nt, Yersinia pestis
cagcucauuaaacuguucu

SEQ ID NO: 2244149 - RNA, 22 nt, Yersinia pestis
cagcuugauagggcugaagacc

SEQ ID NO: 2244150 - RNA, 14 nt, Yersinia pestis
cagcuugcaacaaa

SEQ ID NO: 2244151 - RNA, 13 nt, Yersinia pestis
cagcuucgccacc

SEQ ID NO: 2244152 - RNA, 21 nt, Yersinia pestis
caggauaaagcugaauaucca

SEQ ID NO: 2244153 - RNA, 17 nt, Yersinia pestis
caggaagcguauaagca

SEQ ID NO: 2244154 - RNA, 17 nt, Yersinia pestis
caggcggucaaacuccc

SEQ ID NO: 2244155 - RNA, 15 nt, Yersinia pestis
caggcucagcacaaa

SEQ ID NO: 2244156 - RNA, 18 nt, Yersinia pestis
caggccgguauucagcca

SEQ ID NO: 2244157 - RNA, 14 nt, Yersinia pestis
caggcgcuacgcaa

SEQ ID NO: 2244158 - RNA, 19 nt, Yersinia pestis
cagucugacaccggggauc

SEQ ID NO: 2244159 - RNA, 17 nt, Yersinia pestis
cagucugaaacgccagc

SEQ ID NO: 2244160 - RNA, 16 nt, Yersinia pestis
caguaacggccuucac

SEQ ID NO: 2244161 - RNA, 22 nt, Yersinia pestis
caguaaagauuauguagauccc

SEQ ID NO: 2244162 - RNA, 19 nt, Yersinia pestis
caguaagguauugacacaa

SEQ ID NO: 2244163 - RNA, 15 nt, Yersinia pestis
cagucaauugagaau

SEQ ID NO: 2244164 - RNA, 17 nt, Yersinia pestis
cagguuaaaguugauaa

SEQ ID NO: 2244165 - RNA, 16 nt, Yersinia pestis
cagguucggcgcaauc

SEQ ID NO: 2244166 - RNA, 17 nt, Yersinia pestis
cauaaacggaacucauc

SEQ ID NO: 2244167 - RNA, 13 nt, Yersinia pestis
cauaaguccuuaa

SEQ ID NO: 2244168 - RNA, 14 nt, Yersinia pestis
cauaaaaauacaua

SEQ ID NO: 2244169 - RNA, 18 nt, Yersinia pestis
cauaaugagguuauccaa

SEQ ID NO: 2244170 - RNA, 19 nt, Yersinia pestis
cauaaucgauuacuggcua

SEQ ID NO: 2244171 - RNA, 20 nt, Yersinia pestis
cauaaucaacgcucaaucac

SEQ ID NO: 2244172 - RNA, 14 nt, Yersinia pestis
cauacgaucagcaa

SEQ ID NO: 2244173 - RNA, 13 nt, Yersinia pestis
cauaccuggauca

SEQ ID NO: 2244174 - RNA, 22 nt, Yersinia pestis
cauaccugaauguuuggcucau

SEQ ID NO: 2244175 - RNA, 17 nt, Yersinia pestis
cauaccuguacuuugau

SEQ ID NO: 2244176 - RNA, 16 nt, Yersinia pestis
caguguaucaauagga

SEQ ID NO: 2244177 - RNA, 23 nt, Yersinia pestis
caguggaacauuuucguggaaau

SEQ ID NO: 2244178 - RNA, 22 nt, Yersinia pestis
caguuaaacgguaaccauccau

SEQ ID NO: 2244179 - RNA, 22 nt, Yersinia pestis
cagugcgcggcgccgucacgua

SEQ ID NO: 2244180 - RNA, 21 nt, Yersinia pestis
caucaauggauucuugcugca

SEQ ID NO: 2244181 - RNA, 18 nt, Yersinia pestis
caucagcccauugcugua

SEQ ID NO: 2244182 - RNA, 18 nt, Yersinia pestis
caucagcaagugauagau

SEQ ID NO: 2244183 - RNA, 21 nt, Yersinia pestis
caucagcagagagcgacucac

SEQ ID NO: 2244184 - RNA, 16 nt, Yersinia pestis
caucaagccaccgcug

SEQ ID NO: 2244185 - RNA, 19 nt, Yersinia pestis
cauagagagaacagcgaau

SEQ ID NO: 2244186 - RNA, 17 nt, Yersinia pestis
cauagcgaauaauggca

SEQ ID NO: 2244187 - RNA, 13 nt, Yersinia pestis
cauccagugccaa

SEQ ID NO: 2244188 - RNA, 14 nt, Yersinia pestis
caucgacaauggcu

SEQ ID NO: 2244189 - RNA, 19 nt, Yersinia pestis
caucgaacgcgucacuggc

SEQ ID NO: 2244190 - RNA, 16 nt, Yersinia pestis
cauccuugaucgccaa

SEQ ID NO: 2244191 - RNA, 16 nt, Yersinia pestis
caucgcucaucgccaa

SEQ ID NO: 2244192 - RNA, 23 nt, Yersinia pestis
caucgcggaugccuuuaauggca

SEQ ID NO: 2244193 - RNA, 15 nt, Yersinia pestis
caucgccugaucacg

SEQ ID NO: 2244194 - RNA, 21 nt, Yersinia pestis
ccuuuuaaaugaagcaguuca

SEQ ID NO: 2244195 - RNA, 13 nt, Yersinia pestis
ccuuguaacuuua

SEQ ID NO: 2244196 - RNA, 14 nt, Yersinia pestis
ccuuggcuuugcgc

SEQ ID NO: 2244197 - RNA, 22 nt, Yersinia pestis
ccuucuucuccuauccacugug

SEQ ID NO: 2244198 - RNA, 23 nt, Yersinia pestis
ccuuauaggcgcauaugaaaaac

SEQ ID NO: 2244199 - RNA, 18 nt, Yersinia pestis
ccuguuuuuguuguucuu

SEQ ID NO: 2244200 - RNA, 18 nt, Yersinia pestis
ccuucaacuguggauuau

SEQ ID NO: 2244201 - RNA, 18 nt, Yersinia pestis
ccugugcgcuuugcagua

SEQ ID NO: 2244202 - RNA, 16 nt, Yersinia pestis
ccuggcaccggacaaa

SEQ ID NO: 2244203 - RNA, 13 nt, Yersinia pestis
cgaaggggauaaa

SEQ ID NO: 2244204 - RNA, 15 nt, Yersinia pestis
cgacaccugcuauca

SEQ ID NO: 2244205 - RNA, 17 nt, Yersinia pestis
cgacaccuucaaucauu

SEQ ID NO: 2244206 - RNA, 22 nt, Yersinia pestis
cgacauucauuacugcggauca

SEQ ID NO: 2244207 - RNA, 12 nt, Yersinia pestis
cgacauggaugg

SEQ ID NO: 2244208 - RNA, 20 nt, Yersinia pestis
cgacauaaagcaaacgccgc

SEQ ID NO: 2244209 - RNA, 22 nt, Yersinia pestis
cgacugagaagcggaauuugcu

SEQ ID NO: 2244210 - RNA, 19 nt, Yersinia pestis
cgacucugcaugauagcuu

SEQ ID NO: 2244211 - RNA, 13 nt, Yersinia pestis
cgacgcgccauaa

SEQ ID NO: 2244212 - RNA, 17 nt, Yersinia pestis
cgauuguuugggauaaa

SEQ ID NO: 2244213 - RNA, 13 nt, Yersinia pestis
cgcaaaaucagua

SEQ ID NO: 2244214 - RNA, 16 nt, Yersinia pestis
cgcaauggcgcgucau

SEQ ID NO: 2244215 - RNA, 15 nt, Yersinia pestis
cgcaauggugauaaa

SEQ ID NO: 2244216 - RNA, 15 nt, Yersinia pestis
cgcaaugucaccuga

SEQ ID NO: 2244217 - RNA, 14 nt, Yersinia pestis
cgcaaugucaucag

SEQ ID NO: 2244218 - RNA, 18 nt, Yersinia pestis
cgcaauuugcccaucuuu

SEQ ID NO: 2244219 - RNA, 19 nt, Yersinia pestis
cgcaauaguuaacagcguc

SEQ ID NO: 2244220 - RNA, 22 nt, Yersinia pestis
cgcacaugccgucaccucauca

SEQ ID NO: 2244221 - RNA, 17 nt, Yersinia pestis
cgcaccgagccacuuua

SEQ ID NO: 2244222 - RNA, 19 nt, Yersinia pestis
cgauauagucuugaugaaa

SEQ ID NO: 2244223 - RNA, 17 nt, Yersinia pestis
cgauauccagugccaaa

SEQ ID NO: 2244224 - RNA, 12 nt, Yersinia pestis
cgaucaauacac

SEQ ID NO: 2244225 - RNA, 17 nt, Yersinia pestis
cgauagauuuucagcgc

SEQ ID NO: 2244226 - RNA, 15 nt, Yersinia pestis
cgauagucagcuuca

SEQ ID NO: 2244227 - RNA, 22 nt, Yersinia pestis
cgauaaauacucccgccaagaa

SEQ ID NO: 2244228 - RNA, 20 nt, Yersinia pestis
cgauaagccgcuaucacauc

SEQ ID NO: 2244229 - RNA, 16 nt, Yersinia pestis
cgauaaaauucagcca

SEQ ID NO: 2244230 - RNA, 19 nt, Yersinia pestis
cgaugagcuucuucaaaag

SEQ ID NO: 2244231 - RNA, 19 nt, Yersinia pestis
cgaugaauaugcuucauca

SEQ ID NO: 2244232 - RNA, 17 nt, Yersinia pestis
cgaucuugaacggugag

SEQ ID NO: 2244233 - RNA, 18 nt, Yersinia pestis
cgccaguaaacagccagc

SEQ ID NO: 2244234 - RNA, 13 nt, Yersinia pestis
cgcaggcggccaa

SEQ ID NO: 2244235 - RNA, 14 nt, Yersinia pestis
cgcagauaaaucug

SEQ ID NO: 2244236 - RNA, 12 nt, Yersinia pestis
cgcaucacaucu

SEQ ID NO: 2244237 - RNA, 17 nt, Yersinia pestis
cgcauaaaaugagccug

SEQ ID NO: 2244238 - RNA, 15 nt, Yersinia pestis
cgccaacaggccuaa

SEQ ID NO: 2244239 - RNA, 22 nt, Yersinia pestis
cgccaacagagugaaucgccgu

SEQ ID NO: 2244240 - RNA, 16 nt, Yersinia pestis
cgcauguucagccgcu

SEQ ID NO: 2244241 - RNA, 16 nt, Yersinia pestis
cgcauucaucagggca

SEQ ID NO: 2244242 - RNA, 18 nt, Yersinia pestis
cgcauuuuuuucacacca

SEQ ID NO: 2244243 - RNA, 14 nt, Yersinia pestis
ccggcucauccgcc

SEQ ID NO: 2244244 - RNA, 12 nt, Yersinia pestis
ccggucugcugg

SEQ ID NO: 2244245 - RNA, 14 nt, Yersinia pestis
ccgguaauaccgau

SEQ ID NO: 2244246 - RNA, 20 nt, Yersinia pestis
ccggucaacgucaucgccac

SEQ ID NO: 2244247 - RNA, 16 nt, Yersinia pestis
ccugagauuaaccgcg

SEQ ID NO: 2244248 - RNA, 22 nt, Yersinia pestis
ccugacggccagcaaccuggcg

SEQ ID NO: 2244249 - RNA, 18 nt, Yersinia pestis
ccugaccuagcaaugaga

SEQ ID NO: 2244250 - RNA, 14 nt, Yersinia pestis
ccugcaaacggcuc

SEQ ID NO: 2244251 - RNA, 17 nt, Yersinia pestis
ccuggaaccaagcccgc

SEQ ID NO: 2244252 - RNA, 17 nt, Yersinia pestis
ccugcugcuguggcacu

SEQ ID NO: 2244253 - RNA, 21 nt, Yersinia pestis
ccugcucaacugcucaacugc

SEQ ID NO: 2244254 - RNA, 18 nt, Yersinia pestis
ccucaaugacgcgaucug

SEQ ID NO: 2244255 - RNA, 17 nt, Yersinia pestis
ccuaaaccuuucagaca

SEQ ID NO: 2244256 - RNA, 14 nt, Yersinia pestis
ccguuugcagcuca

SEQ ID NO: 2244257 - RNA, 19 nt, Yersinia pestis
ccguuuaggauugcgucaa

SEQ ID NO: 2244258 - RNA, 22 nt, Yersinia pestis
ccgcagacugaaauaaugguuu

SEQ ID NO: 2244259 - RNA, 18 nt, Yersinia pestis
ccgcagacugcugacaaa

SEQ ID NO: 2244260 - RNA, 19 nt, Yersinia pestis
ccgccccccaucaacgaca

SEQ ID NO: 2244261 - RNA, 15 nt, Yersinia pestis
ccgccacacaauaca

SEQ ID NO: 2244262 - RNA, 17 nt, Yersinia pestis
ccgccuuccucaaugca

SEQ ID NO: 2244263 - RNA, 15 nt, Yersinia pestis
ccgcuuuaucgccaa

SEQ ID NO: 2244264 - RNA, 15 nt, Yersinia pestis
ccgcuuuuuagcgau

SEQ ID NO: 2244265 - RNA, 15 nt, Yersinia pestis
ccgcuguagcgccaa

SEQ ID NO: 2244266 - RNA, 13 nt, Yersinia pestis
ccgcugugauuaa

SEQ ID NO: 2244267 - RNA, 16 nt, Yersinia pestis
ccgcuaucucgcaaua

SEQ ID NO: 2244268 - RNA, 14 nt, Yersinia pestis
ccgcugcgauacca

SEQ ID NO: 2244269 - RNA, 23 nt, Yersinia pestis
cgggagauuaauacaucaucaaa

SEQ ID NO: 2244270 - RNA, 23 nt, Yersinia pestis
cgggacgcguuugcuugcugccu

SEQ ID NO: 2244271 - RNA, 23 nt, Yersinia pestis
cgggaugcgcucgcuugcugccu

SEQ ID NO: 2244272 - RNA, 22 nt, Yersinia pestis
cgggcacgaauagucuguuuca

SEQ ID NO: 2244273 - RNA, 15 nt, Yersinia pestis
cggcgucuugaucaa

SEQ ID NO: 2244274 - RNA, 21 nt, Yersinia pestis
cggcucgacucaauaaaucca

SEQ ID NO: 2244275 - RNA, 21 nt, Yersinia pestis
cggcucaccugcgggauagca

SEQ ID NO: 2244276 - RNA, 23 nt, Yersinia pestis
cgguaacgcagauaaaucagugg

SEQ ID NO: 2244277 - RNA, 22 nt, Yersinia pestis
cgguaaugacauauucaaccgc

SEQ ID NO: 2244278 - RNA, 22 nt, Yersinia pestis
cgggcuggggcaagcucguugg

SEQ ID NO: 2244279 - RNA, 13 nt, Yersinia pestis
cggucuguuaauc

SEQ ID NO: 2244280 - RNA, 19 nt, Yersinia pestis
cggucuguuaauccuaaug

SEQ ID NO: 2244281 - RNA, 23 nt, Yersinia pestis
cggucugaagagaaauaacccau

SEQ ID NO: 2244282 - RNA, 19 nt, Yersinia pestis
cggaugccggaaucagcca

SEQ ID NO: 2244283 - RNA, 19 nt, Yersinia pestis
cggauagggggcaaccaua

SEQ ID NO: 2244284 - RNA, 18 nt, Yersinia pestis
cggaucauaaucgauuac

SEQ ID NO: 2244285 - RNA, 22 nt, Yersinia pestis
cggagucuaucugcaguauuug

SEQ ID NO: 2244286 - RNA, 20 nt, Yersinia pestis
cggcagacguggucaagaau

SEQ ID NO: 2244287 - RNA, 13 nt, Yersinia pestis
cggccaauagcaa

SEQ ID NO: 2244288 - RNA, 17 nt, Yersinia pestis
cggcaugcaacuuggca

SEQ ID NO: 2244289 - RNA, 23 nt, Yersinia pestis
cggcauuaaugcagguucauuac

SEQ ID NO: 2244290 - RNA, 19 nt, Yersinia pestis
cggccacucgcaucgccug

SEQ ID NO: 2244291 - RNA, 16 nt, Yersinia pestis
cggccagccuugagcc

SEQ ID NO: 2244292 - RNA, 22 nt, Yersinia pestis
cggccgguuucaccgcuuagca

SEQ ID NO: 2244293 - RNA, 12 nt, Yersinia pestis
cgcuaucacauc

SEQ ID NO: 2244294 - RNA, 22 nt, Yersinia pestis
cgcucacgcugggcgaucauuu

SEQ ID NO: 2244295 - RNA, 16 nt, Yersinia pestis
cgcuauuucuucauac

SEQ ID NO: 2244296 - RNA, 22 nt, Yersinia pestis
cgcuauugcccaucaugccagc

SEQ ID NO: 2244297 - RNA, 14 nt, Yersinia pestis
cgcuaaaucaucaa

SEQ ID NO: 2244298 - RNA, 17 nt, Yersinia pestis
cgcugaccauggcgauc

SEQ ID NO: 2244299 - RNA, 17 nt, Yersinia pestis
cgcuuuuuagcgaucag

SEQ ID NO: 2244300 - RNA, 14 nt, Yersinia pestis
cgcuuucuguucau

SEQ ID NO: 2244301 - RNA, 15 nt, Yersinia pestis
cgcuuggucacuggu

SEQ ID NO: 2244302 - RNA, 24 nt, Yersinia pestis
cgcuugauggccacacugucauca

SEQ ID NO: 2244303 - RNA, 12 nt, Yersinia pestis
cgcuugauugau

SEQ ID NO: 2244304 - RNA, 13 nt, Yersinia pestis
cggaaaucgguga

SEQ ID NO: 2244305 - RNA, 14 nt, Yersinia pestis
cggaagucaaucgg

SEQ ID NO: 2244306 - RNA, 16 nt, Yersinia pestis
cgcuguugaucgccgc

SEQ ID NO: 2244307 - RNA, 19 nt, Yersinia pestis
cgcugcgcaagcgcugcuu

SEQ ID NO: 2244308 - RNA, 11 nt, Yersinia pestis
cgcuggcucua

SEQ ID NO: 2244309 - RNA, 19 nt, Yersinia pestis
cgcgguaacgaaucugcac

SEQ ID NO: 2244310 - RNA, 13 nt, Yersinia pestis
cgcggcgccguca

SEQ ID NO: 2244311 - RNA, 17 nt, Yersinia pestis
cgccugaucgauaaccc

SEQ ID NO: 2244312 - RNA, 16 nt, Yersinia pestis
cgccguaaacugccgu

SEQ ID NO: 2244313 - RNA, 13 nt, Yersinia pestis
cgccguaaacugc

SEQ ID NO: 2244314 - RNA, 17 nt, Yersinia pestis
cgcgaauaacagacguu

SEQ ID NO: 2244315 - RNA, 15 nt, Yersinia pestis
cgcgauagucacauc

SEQ ID NO: 2244316 - RNA, 20 nt, Yersinia pestis
cgcgauaucugcauaacugg

SEQ ID NO: 2244317 - RNA, 20 nt, Yersinia pestis
cgcgauaacgguaucaguca

SEQ ID NO: 2244318 - RNA, 14 nt, Yersinia pestis
cugaucgugccauu

SEQ ID NO: 2244319 - RNA, 16 nt, Yersinia pestis
cugcacucauugccug

SEQ ID NO: 2244320 - RNA, 20 nt, Yersinia pestis
cugcagaaugaaguuauccu

SEQ ID NO: 2244321 - RNA, 19 nt, Yersinia pestis
cugcagauguauuagcgcu

SEQ ID NO: 2244322 - RNA, 14 nt, Yersinia pestis
cugauccacuacuu

SEQ ID NO: 2244323 - RNA, 14 nt, Yersinia pestis
cugauccaguuuca

SEQ ID NO: 2244324 - RNA, 22 nt, Yersinia pestis
cugauaucuucacucagcgcug

SEQ ID NO: 2244325 - RNA, 16 nt, Yersinia pestis
cugaucacuggcauug

SEQ ID NO: 2244326 - RNA, 19 nt, Yersinia pestis
cugagcguccgucauccaa

SEQ ID NO: 2244327 - RNA, 18 nt, Yersinia pestis
cugauagccaauaaccgg

SEQ ID NO: 2244328 - RNA, 17 nt, Yersinia pestis
cugagcguagcugucac

SEQ ID NO: 2244329 - RNA, 22 nt, Yersinia pestis
cugacgggcgcggguaauggcg

SEQ ID NO: 2244330 - RNA, 21 nt, Yersinia pestis
cugaccacgauuuaaugguuu

SEQ ID NO: 2244331 - RNA, 19 nt, Yersinia pestis
cucuugcacuuuuacuggu

SEQ ID NO: 2244332 - RNA, 18 nt, Yersinia pestis
cucugaacccugcgauuu

SEQ ID NO: 2244333 - RNA, 15 nt, Yersinia pestis
cucuauugcucauca

SEQ ID NO: 2244334 - RNA, 16 nt, Yersinia pestis
cucuugcucuucgggu

SEQ ID NO: 2244335 - RNA, 16 nt, Yersinia pestis
cucuuucccuucaggu

SEQ ID NO: 2244336 - RNA, 18 nt, Yersinia pestis
cucuuuuugugcuucaua

SEQ ID NO: 2244337 - RNA, 23 nt, Yersinia pestis
cugaauacacucguggugauuaa

SEQ ID NO: 2244338 - RNA, 23 nt, Yersinia pestis
cugaauaagagagacgggauaau

SEQ ID NO: 2244339 - RNA, 21 nt, Yersinia pestis
cugaauaaacggcaagcggug

SEQ ID NO: 2244340 - RNA, 23 nt, Yersinia pestis
cugaacuuuaccggugcacaggu

SEQ ID NO: 2244341 - RNA, 22 nt, Yersinia pestis
cugaacuucugggaucaucgcu

SEQ ID NO: 2244342 - RNA, 22 nt, Yersinia pestis
cugacauuugcaucuauggauu

SEQ ID NO: 2244343 - RNA, 15 nt, Yersinia pestis
cugacauuaucgcca

SEQ ID NO: 2244344 - RNA, 16 nt, Yersinia pestis
cucuacucgcucacca

SEQ ID NO: 2244345 - RNA, 15 nt, Yersinia pestis
cugcauacagaucga

SEQ ID NO: 2244346 - RNA, 18 nt, Yersinia pestis
cugccagccauauccaaa

SEQ ID NO: 2244347 - RNA, 13 nt, Yersinia pestis
cugccauaaucca

SEQ ID NO: 2244348 - RNA, 22 nt, Yersinia pestis
cugccauaauccagaagccauu

SEQ ID NO: 2244349 - RNA, 15 nt, Yersinia pestis
cugccgcaacggcac

SEQ ID NO: 2244350 - RNA, 17 nt, Yersinia pestis
cugccugcagcaacaau

SEQ ID NO: 2244351 - RNA, 13 nt, Yersinia pestis
cugccugcugcuc

SEQ ID NO: 2244352 - RNA, 21 nt, Yersinia pestis
cugccuauucuuaccguuuca

SEQ ID NO: 2244353 - RNA, 18 nt, Yersinia pestis
cugccuauuuaucguuac

SEQ ID NO: 2244354 - RNA, 18 nt, Yersinia pestis
cucacaagccacgccauu

SEQ ID NO: 2244355 - RNA, 22 nt, Yersinia pestis
cucaccaagaggaaaugccgcg

SEQ ID NO: 2244356 - RNA, 16 nt, Yersinia pestis
cucaugaaugaggcug

SEQ ID NO: 2244357 - RNA, 15 nt, Yersinia pestis
cucaucgggauuaau

SEQ ID NO: 2244358 - RNA, 16 nt, Yersinia pestis
cucagugaggaucacc

SEQ ID NO: 2244359 - RNA, 20 nt, Yersinia pestis
cucauuaaucagcauuaacc

SEQ ID NO: 2244360 - RNA, 17 nt, Yersinia pestis
cuccagccugcgauagc

SEQ ID NO: 2244361 - RNA, 14 nt, Yersinia pestis
cuaucaucaccauu

SEQ ID NO: 2244362 - RNA, 15 nt, Yersinia pestis
cuagcgccgcaucaa

SEQ ID NO: 2244363 - RNA, 16 nt, Yersinia pestis
cuaugccuacuggcca

SEQ ID NO: 2244364 - RNA, 14 nt, Yersinia pestis
cucaaugcuuaaca

SEQ ID NO: 2244365 - RNA, 19 nt, Yersinia pestis
cucaacugcucaacugcuc

SEQ ID NO: 2244366 - RNA, 20 nt, Yersinia pestis
cuacaucauaacgaaugagc

SEQ ID NO: 2244367 - RNA, 21 nt, Yersinia pestis
cuaccgacgauaaucaggcua

SEQ ID NO: 2244368 - RNA, 13 nt, Yersinia pestis
cuacguucaggcc

SEQ ID NO: 2244369 - RNA, 16 nt, Yersinia pestis
cuacucguaacgacga

SEQ ID NO: 2244370 - RNA, 17 nt, Yersinia pestis
cucgcccaugaccacuu

SEQ ID NO: 2244371 - RNA, 16 nt, Yersinia pestis
cuccuugaauagccag

SEQ ID NO: 2244372 - RNA, 22 nt, Yersinia pestis
cucgagccgcgcccucccuggc

SEQ ID NO: 2244373 - RNA, 22 nt, Yersinia pestis
cguauuggccgacugacacaaa

SEQ ID NO: 2244374 - RNA, 19 nt, Yersinia pestis
cgucaaacgggugcgccaa

SEQ ID NO: 2244375 - RNA, 13 nt, Yersinia pestis
cguauuaucagua

SEQ ID NO: 2244376 - RNA, 21 nt, Yersinia pestis
cguauuaucaguaacgccgua

SEQ ID NO: 2244377 - RNA, 22 nt, Yersinia pestis
cguauuaaaccagugcgccgua

SEQ ID NO: 2244378 - RNA, 19 nt, Yersinia pestis
cgucaccagaucuggguua

SEQ ID NO: 2244379 - RNA, 18 nt, Yersinia pestis
cguagcgguuucgcauca

SEQ ID NO: 2244380 - RNA, 17 nt, Yersinia pestis
cguaauaucugccaccg

SEQ ID NO: 2244381 - RNA, 21 nt, Yersinia pestis
cguccagaacaauaccgccaa

SEQ ID NO: 2244382 - RNA, 14 nt, Yersinia pestis
cguccagaugccaa

SEQ ID NO: 2244383 - RNA, 15 nt, Yersinia pestis
cgucaucgaacccgc

SEQ ID NO: 2244384 - RNA, 20 nt, Yersinia pestis
cgucaugauagacagcaaac

SEQ ID NO: 2244385 - RNA, 22 nt, Yersinia pestis
cgucuaacaguuguuucaauaa

SEQ ID NO: 2244386 - RNA, 18 nt, Yersinia pestis
cgugaugguaucaaucgc

SEQ ID NO: 2244387 - RNA, 24 nt, Yersinia pestis
cgugccagaaacagcccagauggc

SEQ ID NO: 2244388 - RNA, 19 nt, Yersinia pestis
cgugucagacugcugacaa

SEQ ID NO: 2244389 - RNA, 19 nt, Yersinia pestis
cguguaguuauugauuaau

SEQ ID NO: 2244390 - RNA, 21 nt, Yersinia pestis
cgugggcguagaagaauaucu

SEQ ID NO: 2244391 - RNA, 12 nt, Yersinia pestis
cguggugaugau

SEQ ID NO: 2244392 - RNA, 17 nt, Yersinia pestis
cguggcauaaucaacgc

SEQ ID NO: 2244393 - RNA, 16 nt, Yersinia pestis
cguggcauugagguug

SEQ ID NO: 2244394 - RNA, 17 nt, Yersinia pestis
cguucaaccaacugauu

SEQ ID NO: 2244395 - RNA, 13 nt, Yersinia pestis
cguuagguucaau

SEQ ID NO: 2244396 - RNA, 21 nt, Yersinia pestis
cguuacacaucaggcuguuga

SEQ ID NO: 2244397 - RNA, 16 nt, Yersinia pestis
cguuacccacauuaaa

SEQ ID NO: 2244398 - RNA, 20 nt, Yersinia pestis
cguguugcaucauuggcuuc

SEQ ID NO: 2244399 - RNA, 21 nt, Yersinia pestis
cguucacugaccgauugaauc

SEQ ID NO: 2244400 - RNA, 15 nt, Yersinia pestis
cuuaaaaaacgauua

SEQ ID NO: 2244401 - RNA, 21 nt, Yersinia pestis
cugugcgauuucacggauauc

SEQ ID NO: 2244402 - RNA, 15 nt, Yersinia pestis
cuguuaguucagacg

SEQ ID NO: 2244403 - RNA, 13 nt, Yersinia pestis
cuguucaccgauu

SEQ ID NO: 2244404 - RNA, 19 nt, Yersinia pestis
cuguaauggcgcacauuac

SEQ ID NO: 2244405 - RNA, 12 nt, Yersinia pestis
cuguaagacuca

SEQ ID NO: 2244406 - RNA, 20 nt, Yersinia pestis
cugguuagagcacagcacuc

SEQ ID NO: 2244407 - RNA, 14 nt, Yersinia pestis
cugguuauuggccc

SEQ ID NO: 2244408 - RNA, 16 nt, Yersinia pestis
cugguugcagcacgcc

SEQ ID NO: 2244409 - RNA, 20 nt, Yersinia pestis
cuguacugcugcaacucauu

SEQ ID NO: 2244410 - RNA, 13 nt, Yersinia pestis
cuguacuuugauu

SEQ ID NO: 2244411 - RNA, 23 nt, Yersinia pestis
cuguacugcugcaacucauuaac

SEQ ID NO: 2244412 - RNA, 18 nt, Yersinia pestis
cuguaggugucaccaacg

SEQ ID NO: 2244413 - RNA, 15 nt, Yersinia pestis
cuguagcucauacuc

SEQ ID NO: 2244414 - RNA, 22 nt, Yersinia pestis
cuuaucaaagugcuuaacccac

SEQ ID NO: 2244415 - RNA, 14 nt, Yersinia pestis
cuuauccagcgcca

SEQ ID NO: 2244416 - RNA, 22 nt, Yersinia pestis
cuuccaguggcucgacggccaa

SEQ ID NO: 2244417 - RNA, 17 nt, Yersinia pestis
cuucgcacgcccaucaa

SEQ ID NO: 2244418 - RNA, 19 nt, Yersinia pestis
cuggcgguuucaccuaucg

SEQ ID NO: 2244419 - RNA, 15 nt, Yersinia pestis
cugguaacagagccu

SEQ ID NO: 2244420 - RNA, 14 nt, Yersinia pestis
cugcgagcguuuaa

SEQ ID NO: 2244421 - RNA, 16 nt, Yersinia pestis
cuuuuggcagcaccag

SEQ ID NO: 2244422 - RNA, 17 nt, Yersinia pestis
cuuuauugcuccuuacu

SEQ ID NO: 2244423 - RNA, 18 nt, Yersinia pestis
cuuuuaauuuucagccgu

SEQ ID NO: 2244424 - RNA, 12 nt, Yersinia pestis
gaaauaguuacu

SEQ ID NO: 2244425 - RNA, 19 nt, Yersinia pestis
gaaauauacacaagucauu

SEQ ID NO: 2244426 - RNA, 14 nt, Yersinia pestis
gaaagaagacauau

SEQ ID NO: 2244427 - RNA, 13 nt, Yersinia pestis
cuuuaaauccauc

SEQ ID NO: 2244428 - RNA, 15 nt, Yersinia pestis
cuuuaaagccaaauu

SEQ ID NO: 2244429 - RNA, 20 nt, Yersinia pestis
cuuguuguaugucaaugugu

SEQ ID NO: 2244430 - RNA, 19 nt, Yersinia pestis
cuuuaaucaguuucaggcg

SEQ ID NO: 2244431 - RNA, 13 nt, Yersinia pestis
cuuuauauucaau

SEQ ID NO: 2244432 - RNA, 15 nt, Yersinia pestis
cuuuauccacuuggc

SEQ ID NO: 2244433 - RNA, 15 nt, Yersinia pestis
cuugguggagccugu

SEQ ID NO: 2244434 - RNA, 14 nt, Yersinia pestis
cuuguucaccaauu

SEQ ID NO: 2244435 - RNA, 22 nt, Yersinia pestis
cuugcuuaucaccccuucacuc

SEQ ID NO: 2244436 - RNA, 22 nt, Yersinia pestis
cuugccauuuugggcuugagca

SEQ ID NO: 2244437 - RNA, 22 nt, Yersinia pestis
cuugccguuuugggcuugagca

SEQ ID NO: 2244438 - RNA, 22 nt, Yersinia pestis
gaacaaaccccacuaacgcuga

SEQ ID NO: 2244439 - RNA, 19 nt, Yersinia pestis
gaacauaacuuugccagug

SEQ ID NO: 2244440 - RNA, 15 nt, Yersinia pestis
gaacaggcagaucgu

SEQ ID NO: 2244441 - RNA, 15 nt, Yersinia pestis
gaacucauauguggu

SEQ ID NO: 2244442 - RNA, 18 nt, Yersinia pestis
gaacccgcuaacaugcca

SEQ ID NO: 2244443 - RNA, 19 nt, Yersinia pestis
gacuaucccuucaaucagc

SEQ ID NO: 2244444 - RNA, 21 nt, Yersinia pestis
gacuauucugccuauccucac

SEQ ID NO: 2244445 - RNA, 21 nt, Yersinia pestis
gacucaucaaaacaaucacug

SEQ ID NO: 2244446 - RNA, 17 nt, Yersinia pestis
gacucccugacucccuc

SEQ ID NO: 2244447 - RNA, 18 nt, Yersinia pestis
gacugcagaaaaucacgu

SEQ ID NO: 2244448 - RNA, 16 nt, Yersinia pestis
gacucgaucuugaacg

SEQ ID NO: 2244449 - RNA, 18 nt, Yersinia pestis
gagaaagguuuaccgaug

SEQ ID NO: 2244450 - RNA, 22 nt, Yersinia pestis
gagaaaaaguauugcacugaga

SEQ ID NO: 2244451 - RNA, 19 nt, Yersinia pestis
gacuuuccccagaugaaug

SEQ ID NO: 2244452 - RNA, 11 nt, Yersinia pestis
gacuuucaauc

SEQ ID NO: 2244453 - RNA, 18 nt, Yersinia pestis
gacuugcccaauggcaaa

SEQ ID NO: 2244454 - RNA, 13 nt, Yersinia pestis
gagaucgauagca

SEQ ID NO: 2244455 - RNA, 21 nt, Yersinia pestis
gagauuauuggcgauuuaaug

SEQ ID NO: 2244456 - RNA, 19 nt, Yersinia pestis
gagcacgcagagaugaaua

SEQ ID NO: 2244457 - RNA, 14 nt, Yersinia pestis
gagagaaaauuucu

SEQ ID NO: 2244458 - RNA, 16 nt, Yersinia pestis
gagagaccagggcacc

SEQ ID NO: 2244459 - RNA, 12 nt, Yersinia pestis
gagagugaagau

SEQ ID NO: 2244460 - RNA, 19 nt, Yersinia pestis
gagaauagacagaagcgua

SEQ ID NO: 2244461 - RNA, 16 nt, Yersinia pestis
gagaauaaaaaugaua

SEQ ID NO: 2244462 - RNA, 15 nt, Yersinia pestis
gagacccguuacugc

SEQ ID NO: 2244463 - RNA, 23 nt, Yersinia pestis
gacgugcagcgcgcagccaacgg

SEQ ID NO: 2244464 - RNA, 12 nt, Yersinia pestis
gacggaacacgu

SEQ ID NO: 2244465 - RNA, 16 nt, Yersinia pestis
gacaaaaauaagcgua

SEQ ID NO: 2244466 - RNA, 12 nt, Yersinia pestis
gaauuugcuagc

SEQ ID NO: 2244467 - RNA, 13 nt, Yersinia pestis
gaauggcgcgacc

SEQ ID NO: 2244468 - RNA, 15 nt, Yersinia pestis
gaaugagaugaacac

SEQ ID NO: 2244469 - RNA, 21 nt, Yersinia pestis
gaaugucaugguuaaacugac

SEQ ID NO: 2244470 - RNA, 15 nt, Yersinia pestis
gacaaugaugaccgg

SEQ ID NO: 2244471 - RNA, 20 nt, Yersinia pestis
gacaacuuagguucaaucgg

SEQ ID NO: 2244472 - RNA, 20 nt, Yersinia pestis
gaaucacuggugugugucag

SEQ ID NO: 2244473 - RNA, 13 nt, Yersinia pestis
gaaucacaucauu

SEQ ID NO: 2244474 - RNA, 17 nt, Yersinia pestis
gacaucagcgccacagu

SEQ ID NO: 2244475 - RNA, 16 nt, Yersinia pestis
gaccagauaaucgcca

SEQ ID NO: 2244476 - RNA, 14 nt, Yersinia pestis
gacaccaauaccga

SEQ ID NO: 2244477 - RNA, 18 nt, Yersinia pestis
gacacccgcuucauucgc

SEQ ID NO: 2244478 - RNA, 14 nt, Yersinia pestis
gaccguacaucugg

SEQ ID NO: 2244479 - RNA, 15 nt, Yersinia pestis
gaccgauugaaucaa

SEQ ID NO: 2244480 - RNA, 19 nt, Yersinia pestis
gaccgauaaacgccaguca

SEQ ID NO: 2244481 - RNA, 14 nt, Yersinia pestis
gaccagugaauaag

SEQ ID NO: 2244482 - RNA, 19 nt, Yersinia pestis
gcaacugagucgcuugauu

SEQ ID NO: 2244483 - RNA, 15 nt, Yersinia pestis
gcaaucaugaugguc

SEQ ID NO: 2244484 - RNA, 14 nt, Yersinia pestis
gcaauccgcugaca

SEQ ID NO: 2244485 - RNA, 17 nt, Yersinia pestis
gcaauuauaagcacaac

SEQ ID NO: 2244486 - RNA, 19 nt, Yersinia pestis
gcacaaugccuaaaauggc

SEQ ID NO: 2244487 - RNA, 24 nt, Yersinia pestis
gcacaaucucguuaucagccacau

SEQ ID NO: 2244488 - RNA, 16 nt, Yersinia pestis
gcaacaauaaagcggu

SEQ ID NO: 2244489 - RNA, 16 nt, Yersinia pestis
gcaaccacuuauccag

SEQ ID NO: 2244490 - RNA, 21 nt, Yersinia pestis
gcaaccacuuauccagcucau

SEQ ID NO: 2244491 - RNA, 19 nt, Yersinia pestis
gcaaauaccgggacuacca

SEQ ID NO: 2244492 - RNA, 22 nt, Yersinia pestis
gcaaaucauuuaauuuauccaa

SEQ ID NO: 2244493 - RNA, 18 nt, Yersinia pestis
gcaacaaacagccgauca

SEQ ID NO: 2244494 - RNA, 15 nt, Yersinia pestis
gcaaauucccaccau

SEQ ID NO: 2244495 - RNA, 21 nt, Yersinia pestis
gcaaaggcccgcuaucacuag

SEQ ID NO: 2244496 - RNA, 20 nt, Yersinia pestis
gcaaacaggcccacugcaac

SEQ ID NO: 2244497 - RNA, 23 nt, Yersinia pestis
gcaaaccaggcaacgacagcaac

SEQ ID NO: 2244498 - RNA, 24 nt, Yersinia pestis
gcaaaccgaauaccauaacgcugc

SEQ ID NO: 2244499 - RNA, 15 nt, Yersinia pestis
gauuuagacaagcgc

SEQ ID NO: 2244500 - RNA, 18 nt, Yersinia pestis
gauuauguagaucccgug

SEQ ID NO: 2244501 - RNA, 22 nt, Yersinia pestis
gauuaugugcggcauauaacca

SEQ ID NO: 2244502 - RNA, 20 nt, Yersinia pestis
gauuagccugaccgguaaua

SEQ ID NO: 2244503 - RNA, 19 nt, Yersinia pestis
gauuacucaggaacaagac

SEQ ID NO: 2244504 - RNA, 15 nt, Yersinia pestis
gauuuaaaaucccuc

SEQ ID NO: 2244505 - RNA, 13 nt, Yersinia pestis
gauggucaacauu

SEQ ID NO: 2244506 - RNA, 21 nt, Yersinia pestis
gauccugugcgcuuugcagua

SEQ ID NO: 2244507 - RNA, 12 nt, Yersinia pestis
gaucgaugccgg

SEQ ID NO: 2244508 - RNA, 13 nt, Yersinia pestis
gaucaugaugauc

SEQ ID NO: 2244509 - RNA, 15 nt, Yersinia pestis
gaucagugccaguaa

SEQ ID NO: 2244510 - RNA, 14 nt, Yersinia pestis
gaucaucaucaaug

SEQ ID NO: 2244511 - RNA, 20 nt, Yersinia pestis
gaucagcuaacaaaaccggg

SEQ ID NO: 2244512 - RNA, 13 nt, Yersinia pestis
gaugaauccagcc

SEQ ID NO: 2244513 - RNA, 14 nt, Yersinia pestis
gaugacacgaucuu

SEQ ID NO: 2244514 - RNA, 22 nt, Yersinia pestis
gaucugcccccccuuucaccaa

SEQ ID NO: 2244515 - RNA, 23 nt, Yersinia pestis
gaucugccccuggcucaguagca

SEQ ID NO: 2244516 - RNA, 13 nt, Yersinia pestis
gaucucugcgaca

SEQ ID NO: 2244517 - RNA, 21 nt, Yersinia pestis
gagugcggccaucuaacugca

SEQ ID NO: 2244518 - RNA, 18 nt, Yersinia pestis
gauaaaaauaaucaauga

SEQ ID NO: 2244519 - RNA, 15 nt, Yersinia pestis
gagguggccauuacg

SEQ ID NO: 2244520 - RNA, 21 nt, Yersinia pestis
gaguaaaccguacauuaaaug

SEQ ID NO: 2244521 - RNA, 17 nt, Yersinia pestis
gagggaguuauucugau

SEQ ID NO: 2244522 - RNA, 16 nt, Yersinia pestis
gauagcaucauccagc

SEQ ID NO: 2244523 - RNA, 19 nt, Yersinia pestis
gauagccaauaaccgggua

SEQ ID NO: 2244524 - RNA, 19 nt, Yersinia pestis
gauagaguacucggcuacg

SEQ ID NO: 2244525 - RNA, 15 nt, Yersinia pestis
gauagcgcuucagug

SEQ ID NO: 2244526 - RNA, 20 nt, Yersinia pestis
gauaaauacaaaauuaacgg

SEQ ID NO: 2244527 - RNA, 21 nt, Yersinia pestis
gauaaauacggucaacgauug

SEQ ID NO: 2244528 - RNA, 21 nt, Yersinia pestis
gauaaaccaacugaaacugga

SEQ ID NO: 2244529 - RNA, 18 nt, Yersinia pestis
gauaccacaucaaaccgg

SEQ ID NO: 2244530 - RNA, 17 nt, Yersinia pestis
gauaccgccaaucucuc

SEQ ID NO: 2244531 - RNA, 16 nt, Yersinia pestis
gauauugaugacgcua

SEQ ID NO: 2244532 - RNA, 13 nt, Yersinia pestis
gauauugcgguaa

SEQ ID NO: 2244533 - RNA, 17 nt, Yersinia pestis
gauaugacuaaacugau

SEQ ID NO: 2244534 - RNA, 19 nt, Yersinia pestis
gauaugacuaaacugauca

SEQ ID NO: 2244535 - RNA, 23 nt, Yersinia pestis
gcauuuuaguuuuauacccguua

SEQ ID NO: 2244536 - RNA, 12 nt, Yersinia pestis
gccaaacugcuc

SEQ ID NO: 2244537 - RNA, 15 nt, Yersinia pestis
gccaaaacagccuaa

SEQ ID NO: 2244538 - RNA, 19 nt, Yersinia pestis
gccaacacucaugacaaaa

SEQ ID NO: 2244539 - RNA, 15 nt, Yersinia pestis
gcaucgucgcuguua

SEQ ID NO: 2244540 - RNA, 12 nt, Yersinia pestis
gcaucgcugagg

SEQ ID NO: 2244541 - RNA, 20 nt, Yersinia pestis
gcaucgcgguuuuuccgccg

SEQ ID NO: 2244542 - RNA, 17 nt, Yersinia pestis
gcaucaauaauaacgaa

SEQ ID NO: 2244543 - RNA, 18 nt, Yersinia pestis
gcaucagacggcagcaac

SEQ ID NO: 2244544 - RNA, 16 nt, Yersinia pestis
gcaucacgauagccag

SEQ ID NO: 2244545 - RNA, 14 nt, Yersinia pestis
gcauaaaacgauuu

SEQ ID NO: 2244546 - RNA, 22 nt, Yersinia pestis
gcauaaguuaucgucacuggca

SEQ ID NO: 2244547 - RNA, 21 nt, Yersinia pestis
gcauagaaauucaacuugccu

SEQ ID NO: 2244548 - RNA, 24 nt, Yersinia pestis
gcauagccggagguuuuucauaug

SEQ ID NO: 2244549 - RNA, 17 nt, Yersinia pestis
gcauagacgaaggcacg

SEQ ID NO: 2244550 - RNA, 19 nt, Yersinia pestis
gcagugcgcggcgccguca

SEQ ID NO: 2244551 - RNA, 20 nt, Yersinia pestis
gcagagagcgacucacgacg

SEQ ID NO: 2244552 - RNA, 16 nt, Yersinia pestis
gcagacuuacgcgaug

SEQ ID NO: 2244553 - RNA, 14 nt, Yersinia pestis
gcacuuuuauacau

SEQ ID NO: 2244554 - RNA, 13 nt, Yersinia pestis
gcagaaaagcgaa

SEQ ID NO: 2244555 - RNA, 21 nt, Yersinia pestis
gcagaaagugacccaagauga

SEQ ID NO: 2244556 - RNA, 23 nt, Yersinia pestis
gcagaccaaucaauacacuggca

SEQ ID NO: 2244557 - RNA, 19 nt, Yersinia pestis
gcagccgggaugaucaaca

SEQ ID NO: 2244558 - RNA, 12 nt, Yersinia pestis
gcacugccacca

SEQ ID NO: 2244559 - RNA, 21 nt, Yersinia pestis
gcacugcgcguugccauucag

SEQ ID NO: 2244560 - RNA, 13 nt, Yersinia pestis
gccccaaaugcca

SEQ ID NO: 2244561 - RNA, 14 nt, Yersinia pestis
gccccaaaugccag

SEQ ID NO: 2244562 - RNA, 16 nt, Yersinia pestis
gcccauuaguaauggg

SEQ ID NO: 2244563 - RNA, 20 nt, Yersinia pestis
gcccauuaguaaugggauca

SEQ ID NO: 2244564 - RNA, 13 nt, Yersinia pestis
gcccccaaugaca

SEQ ID NO: 2244565 - RNA, 14 nt, Yersinia pestis
gcccccaaugacac

SEQ ID NO: 2244566 - RNA, 18 nt, Yersinia pestis
gccauuacaucccgccau

SEQ ID NO: 2244567 - RNA, 17 nt, Yersinia pestis
gccauuuauauaacgac

SEQ ID NO: 2244568 - RNA, 18 nt, Yersinia pestis
gcccaaaugagcagcaau

SEQ ID NO: 2244569 - RNA, 22 nt, Yersinia pestis
gcccaaccccccauugccaaau

SEQ ID NO: 2244570 - RNA, 17 nt, Yersinia pestis
gccaucaauaaagcugg

SEQ ID NO: 2244571 - RNA, 17 nt, Yersinia pestis
gccaucgccaacaggcc

SEQ ID NO: 2244572 - RNA, 23 nt, Yersinia pestis
gccagggguaagauccaccacau

SEQ ID NO: 2244573 - RNA, 17 nt, Yersinia pestis
gccagaucaaugugguu

SEQ ID NO: 2244574 - RNA, 14 nt, Yersinia pestis
gccagauaucacuc

SEQ ID NO: 2244575 - RNA, 22 nt, Yersinia pestis
gccacgaguuuucccugcgcca

SEQ ID NO: 2244576 - RNA, 13 nt, Yersinia pestis
gccagcgucauca

SEQ ID NO: 2244577 - RNA, 18 nt, Yersinia pestis
gccgaaugauucauugag

SEQ ID NO: 2244578 - RNA, 20 nt, Yersinia pestis
gccgacaaacccacacccuu

SEQ ID NO: 2244579 - RNA, 19 nt, Yersinia pestis
gccgauaaucccugccaga

SEQ ID NO: 2244580 - RNA, 14 nt, Yersinia pestis
gccgauacgaucau

SEQ ID NO: 2244581 - RNA, 14 nt, Yersinia pestis
gccgauguuugagc

SEQ ID NO: 2244582 - RNA, 14 nt, Yersinia pestis
gccgcuccagcacu

SEQ ID NO: 2244583 - RNA, 18 nt, Yersinia pestis
gccggaaaagagauagca

SEQ ID NO: 2244584 - RNA, 12 nt, Yersinia pestis
aaaagcaccgca

SEQ ID NO: 2244585 - RNA, 18 nt, Yersinia pestis
aaaagcccggucacucaa

SEQ ID NO: 2244586 - RNA, 18 nt, Yersinia pestis
aaaaguggcuaucugaaa

SEQ ID NO: 2244587 - RNA, 19 nt, Yersinia pestis
aaaaucaucgcucaucgcc

SEQ ID NO: 2244588 - RNA, 14 nt, Yersinia pestis
aaaaucauugacgu

SEQ ID NO: 2244589 - RNA, 15 nt, Yersinia pestis
aaaaucgcacugagu

SEQ ID NO: 2244590 - RNA, 17 nt, Yersinia pestis
aaaauauggcagguauc

SEQ ID NO: 2244591 - RNA, 15 nt, Yersinia pestis
aaaauaaggcgaaua

SEQ ID NO: 2244592 - RNA, 14 nt, Yersinia pestis
aaaauacuacucaa

SEQ ID NO: 2244593 - RNA, 20 nt, Yersinia pestis
aaaauuagcauuaccgguaa

SEQ ID NO: 2244594 - RNA, 17 nt, Yersinia pestis
aaaaacacgguugaaaa

SEQ ID NO: 2244595 - RNA, 21 nt, Yersinia pestis
aaaaagcccccuuuuucauau

SEQ ID NO: 2244596 - RNA, 22 nt, Yersinia pestis
aaaaacccucucauccugcuau

SEQ ID NO: 2244597 - RNA, 13 nt, Yersinia pestis
aaaacgccgguaa

SEQ ID NO: 2244598 - RNA, 19 nt, Yersinia pestis
aaaacgcgacggucagcca

SEQ ID NO: 2244599 - RNA, 12 nt, Yersinia pestis
aaaacggcaaaa

SEQ ID NO: 2244600 - RNA, 13 nt, Yersinia pestis
aaaacugaagcau

SEQ ID NO: 2244601 - RNA, 22 nt, Yersinia pestis
aaaagaaauuuuuagaaaacau

SEQ ID NO: 2244602 - RNA, 24 nt, Yersinia pestis
aacaaauucggcuuguugaaucaa

SEQ ID NO: 2244603 - RNA, 19 nt, Yersinia pestis
aacacaccugcaacguuaa

SEQ ID NO: 2244604 - RNA, 16 nt, Yersinia pestis
aacacauuacugcguu

SEQ ID NO: 2244605 - RNA, 17 nt, Yersinia pestis
aaaacugacugccauaa

SEQ ID NO: 2244606 - RNA, 21 nt, Yersinia pestis
aaauaaccgagcgugaagagc

SEQ ID NO: 2244607 - RNA, 15 nt, Yersinia pestis
aaauaaaccaauauc

SEQ ID NO: 2244608 - RNA, 18 nt, Yersinia pestis
aaauaauaauucugcuau

SEQ ID NO: 2244609 - RNA, 19 nt, Yersinia pestis
aaauaaucggcaaaccgaa

SEQ ID NO: 2244610 - RNA, 19 nt, Yersinia pestis
aaaaccggagucaaucauu

SEQ ID NO: 2244611 - RNA, 21 nt, Yersinia pestis
aaaacagccuaaggccaucaa

SEQ ID NO: 2244612 - RNA, 20 nt, Yersinia pestis
aaaacacgcgcuacgaugca

SEQ ID NO: 2244613 - RNA, 16 nt, Yersinia pestis
aaaacacuggcagcca

SEQ ID NO: 2244614 - RNA, 18 nt, Yersinia pestis
aaaugacaaaucagcguu

SEQ ID NO: 2244615 - RNA, 20 nt, Yersinia pestis
aaaugcccgucgggauaucu

SEQ ID NO: 2244616 - RNA, 19 nt, Yersinia pestis
aaagcaucagacugcucuu

SEQ ID NO: 2244617 - RNA, 23 nt, Yersinia pestis
aaagacggccaacugcuggccaa

SEQ ID NO: 2244618 - RNA, 17 nt, Yersinia pestis
aaaccuuuauguaacac

SEQ ID NO: 2244619 - RNA, 22 nt, Yersinia pestis
aaagccagucagggcgauagcc

SEQ ID NO: 2244620 - RNA, 22 nt, Yersinia pestis
aaagccauuucaguaacuuacc

SEQ ID NO: 2244621 - RNA, 16 nt, Yersinia pestis
aaacagcuuaucagcg

SEQ ID NO: 2244622 - RNA, 21 nt, Yersinia pestis
aaacacuuauuugaaauacuu

SEQ ID NO: 2244623 - RNA, 15 nt, Yersinia pestis
aaaccuuuaccagcg

SEQ ID NO: 2244624 - RNA, 20 nt, Yersinia pestis
aaacccaaccccaucagcau

SEQ ID NO: 2244625 - RNA, 18 nt, Yersinia pestis
aaacccccaacccaagga

SEQ ID NO: 2244626 - RNA, 12 nt, Yersinia pestis
aaaccgcuuauc

SEQ ID NO: 2244627 - RNA, 22 nt, Yersinia pestis
aaaccggacauaaugcauccac

SEQ ID NO: 2244628 - RNA, 21 nt, Yersinia pestis
aauuuccgguaacugacgcag

SEQ ID NO: 2244629 - RNA, 21 nt, Yersinia pestis
acaaauagaucggguaaacca

SEQ ID NO: 2244630 - RNA, 15 nt, Yersinia pestis
acaaccgugcaccau

SEQ ID NO: 2244631 - RNA, 16 nt, Yersinia pestis
acaacacgcuauccgc

SEQ ID NO: 2244632 - RNA, 15 nt, Yersinia pestis
acaaauugcggcaac

SEQ ID NO: 2244633 - RNA, 17 nt, Yersinia pestis
acaacaacggugaacag

SEQ ID NO: 2244634 - RNA, 15 nt, Yersinia pestis
acaacaaaggcgcca

SEQ ID NO: 2244635 - RNA, 24 nt, Yersinia pestis
acaacgacagccaaaucaguacca

SEQ ID NO: 2244636 - RNA, 14 nt, Yersinia pestis
acaacgccgcaccg

SEQ ID NO: 2244637 - RNA, 22 nt, Yersinia pestis
acaauaggcuauuuuacuugcc

SEQ ID NO: 2244638 - RNA, 15 nt, Yersinia pestis
acaauuauuuuuaca

SEQ ID NO: 2244639 - RNA, 18 nt, Yersinia pestis
acaauuacgcacugccug

SEQ ID NO: 2244640 - RNA, 13 nt, Yersinia pestis
acaauucacccau

SEQ ID NO: 2244641 - RNA, 13 nt, Yersinia pestis
acacagcacggca

SEQ ID NO: 2244642 - RNA, 16 nt, Yersinia pestis
aaugccagucaaugac

SEQ ID NO: 2244643 - RNA, 21 nt, Yersinia pestis
aaugcccgucgggauaucuuc

SEQ ID NO: 2244644 - RNA, 18 nt, Yersinia pestis
aaugcacugaacaaugcc

SEQ ID NO: 2244645 - RNA, 20 nt, Yersinia pestis
aaugcucggcgucagccgcg

SEQ ID NO: 2244646 - RNA, 17 nt, Yersinia pestis
aaucacgcagcaggcca

SEQ ID NO: 2244647 - RNA, 19 nt, Yersinia pestis
aaugacagcaucaauaucg

SEQ ID NO: 2244648 - RNA, 19 nt, Yersinia pestis
aaucuuuuuaaaucaugca

SEQ ID NO: 2244649 - RNA, 15 nt, Yersinia pestis
aaugaauucauugau

SEQ ID NO: 2244650 - RNA, 12 nt, Yersinia pestis
aauuccgcuucu

SEQ ID NO: 2244651 - RNA, 17 nt, Yersinia pestis
aaugggaugauagcuuc

SEQ ID NO: 2244652 - RNA, 21 nt, Yersinia pestis
aauggcguuauguaaaacgac

SEQ ID NO: 2244653 - RNA, 15 nt, Yersinia pestis
aauugugucaucgcg

SEQ ID NO: 2244654 - RNA, 17 nt, Yersinia pestis
aauugcggucagcauac

SEQ ID NO: 2244655 - RNA, 17 nt, Yersinia pestis
acaccuaacuuccuaac

SEQ ID NO: 2244656 - RNA, 20 nt, Yersinia pestis
acaccggggauccauaggau

SEQ ID NO: 2244657 - RNA, 17 nt, Yersinia pestis
acaccuucaaucauuga

SEQ ID NO: 2244658 - RNA, 13 nt, Yersinia pestis
acaccauaaucgc

SEQ ID NO: 2244659 - RNA, 14 nt, Yersinia pestis
acaccauaaucgca

SEQ ID NO: 2244660 - RNA, 16 nt, Yersinia pestis
acaccgcuaaccuuaa

SEQ ID NO: 2244661 - RNA, 20 nt, Yersinia pestis
acaccgcuacaggcgcaacu

SEQ ID NO: 2244662 - RNA, 19 nt, Yersinia pestis
acagagguagacguaucau

SEQ ID NO: 2244663 - RNA, 14 nt, Yersinia pestis
acagacacagcaac

SEQ ID NO: 2244664 - RNA, 13 nt, Yersinia pestis
acagacccuguuc

SEQ ID NO: 2244665 - RNA, 13 nt, Yersinia pestis
acagcaacgacgc

SEQ ID NO: 2244666 - RNA, 17 nt, Yersinia pestis
acagcacggcaacaggc

SEQ ID NO: 2244667 - RNA, 22 nt, Yersinia pestis
acacuugcucuaccacguuuau

SEQ ID NO: 2244668 - RNA, 13 nt, Yersinia pestis
acacugguugaaa

SEQ ID NO: 2244669 - RNA, 16 nt, Yersinia pestis
acacugucgcauaaga

SEQ ID NO: 2244670 - RNA, 19 nt, Yersinia pestis
acagaaaucaaugugccgu

SEQ ID NO: 2244671 - RNA, 15 nt, Yersinia pestis
acagaaaauguccau

SEQ ID NO: 2244672 - RNA, 13 nt, Yersinia pestis
acagaaucgccgu

SEQ ID NO: 2244673 - RNA, 16 nt, Yersinia pestis
acagcguaauaccacu

SEQ ID NO: 2244674 - RNA, 13 nt, Yersinia pestis
aauauccaauggu

SEQ ID NO: 2244675 - RNA, 14 nt, Yersinia pestis
aauaucaacgccgu

SEQ ID NO: 2244676 - RNA, 19 nt, Yersinia pestis
aauaucagcaaaguaccgc

SEQ ID NO: 2244677 - RNA, 15 nt, Yersinia pestis
aauaucacugauauc

SEQ ID NO: 2244678 - RNA, 19 nt, Yersinia pestis
aauaucacugauaucggua

SEQ ID NO: 2244679 - RNA, 13 nt, Yersinia pestis
aauauaguugauc

SEQ ID NO: 2244680 - RNA, 12 nt, Yersinia pestis
aauacgccaguu

SEQ ID NO: 2244681 - RNA, 14 nt, Yersinia pestis
aauacuucaggcca

SEQ ID NO: 2244682 - RNA, 12 nt, Yersinia pestis
aauauaaugcug

SEQ ID NO: 2244683 - RNA, 14 nt, Yersinia pestis
aaucaagcccgcaa

SEQ ID NO: 2244684 - RNA, 15 nt, Yersinia pestis
aaucaaaaaaccggc

SEQ ID NO: 2244685 - RNA, 16 nt, Yersinia pestis
aauaugauucgguuau

SEQ ID NO: 2244686 - RNA, 18 nt, Yersinia pestis
aauauuaccaauaugaaa

SEQ ID NO: 2244687 - RNA, 19 nt, Yersinia pestis
aauauuccccaccauugca

SEQ ID NO: 2244688 - RNA, 18 nt, Yersinia pestis
aauauucgcagccaaaau

SEQ ID NO: 2244689 - RNA, 13 nt, Yersinia pestis
aauauuguugcca

SEQ ID NO: 2244690 - RNA, 16 nt, Yersinia pestis
aauaaagggccugcaa

SEQ ID NO: 2244691 - RNA, 20 nt, Yersinia pestis
aauaacaggcuggccgugga

SEQ ID NO: 2244692 - RNA, 23 nt, Yersinia pestis
aauaaccucagggcgucucuacg

SEQ ID NO: 2244693 - RNA, 12 nt, Yersinia pestis
aauaaucaauga

SEQ ID NO: 2244694 - RNA, 14 nt, Yersinia pestis
aagugcaaacuuaa

SEQ ID NO: 2244695 - RNA, 13 nt, Yersinia pestis
aagccaaaacagc

SEQ ID NO: 2244696 - RNA, 18 nt, Yersinia pestis
aagacuuuuccaacggcu

SEQ ID NO: 2244697 - RNA, 19 nt, Yersinia pestis
aagcauucaagccaccggc

SEQ ID NO: 2244698 - RNA, 16 nt, Yersinia pestis
aagagauaaccguuaa

SEQ ID NO: 2244699 - RNA, 13 nt, Yersinia pestis
aagcgauccugcu

SEQ ID NO: 2244700 - RNA, 16 nt, Yersinia pestis
aagccauucagcagca

SEQ ID NO: 2244701 - RNA, 18 nt, Yersinia pestis
aaggcuaaaccggcacag

SEQ ID NO: 2244702 - RNA, 15 nt, Yersinia pestis
aaccuaauaacgcuc

SEQ ID NO: 2244703 - RNA, 12 nt, Yersinia pestis
aaccuaacacgu

SEQ ID NO: 2244704 - RNA, 17 nt, Yersinia pestis
aaccucugcaaugccca

SEQ ID NO: 2244705 - RNA, 21 nt, Yersinia pestis
aaccgugacguuuuuaacguc

SEQ ID NO: 2244706 - RNA, 14 nt, Yersinia pestis
aacacgauccgcuu

SEQ ID NO: 2244707 - RNA, 15 nt, Yersinia pestis
aacacgaugccagua

SEQ ID NO: 2244708 - RNA, 18 nt, Yersinia pestis
aaccgcuugcauacgcuu

SEQ ID NO: 2244709 - RNA, 17 nt, Yersinia pestis
aacgccugauucaucgc

SEQ ID NO: 2244710 - RNA, 22 nt, Yersinia pestis
aacgcccagcuuuuuacgcaac

SEQ ID NO: 2244711 - RNA, 22 nt, Yersinia pestis
aacgcccugccgggcaaugugu

SEQ ID NO: 2244712 - RNA, 18 nt, Yersinia pestis
aacgcucuguugacucgc

SEQ ID NO: 2244713 - RNA, 19 nt, Yersinia pestis
aacgcugaauaaguugaua

SEQ ID NO: 2244714 - RNA, 23 nt, Yersinia pestis
aacgcucauaccaugccaucaau

SEQ ID NO: 2244715 - RNA, 22 nt, Yersinia pestis
aacgcucaucaaccgggauauc

SEQ ID NO: 2244716 - RNA, 20 nt, Yersinia pestis
aacgcggagccaaacgugcu

SEQ ID NO: 2244717 - RNA, 18 nt, Yersinia pestis
aacggcagugaucgcacu

SEQ ID NO: 2244718 - RNA, 20 nt, Yersinia pestis
aacucagccauugcuuugcg

SEQ ID NO: 2244719 - RNA, 19 nt, Yersinia pestis
aacucaccuaaaucauaca

SEQ ID NO: 2244720 - RNA, 20 nt, Yersinia pestis
aacuccuuuguuauuucugg

SEQ ID NO: 2244721 - RNA, 23 nt, Yersinia pestis
aacucuucagccauaacuucugg

SEQ ID NO: 2244722 - RNA, 16 nt, Yersinia pestis
aacucuggcacuggca

SEQ ID NO: 2244723 - RNA, 16 nt, Yersinia pestis
aacucgccaacagagu

SEQ ID NO: 2244724 - RNA, 16 nt, Yersinia pestis
aacugauaaaccgcua

SEQ ID NO: 2244725 - RNA, 13 nt, Yersinia pestis
aacugagugagcg

SEQ ID NO: 2244726 - RNA, 20 nt, Yersinia pestis
aacugcauagcuaaccuuaa

SEQ ID NO: 2244727 - RNA, 17 nt, Yersinia pestis
aacuuuuuuaccacauu

SEQ ID NO: 2244728 - RNA, 22 nt, Yersinia pestis
aacuuggacaucugcuuuacug

SEQ ID NO: 2244729 - RNA, 16 nt, Yersinia pestis
aacuggcgcaauguca

SEQ ID NO: 2244730 - RNA, 16 nt, Yersinia pestis
agaauuccggcgcauu

SEQ ID NO: 2244731 - RNA, 18 nt, Yersinia pestis
agaauuaaggaaacucau

SEQ ID NO: 2244732 - RNA, 21 nt, Yersinia pestis
agaauguuguuuaugaaaucu

SEQ ID NO: 2244733 - RNA, 21 nt, Yersinia pestis
agaaugaaaggcggugaacag

SEQ ID NO: 2244734 - RNA, 21 nt, Yersinia pestis
agaaucccgguugauaucggc

SEQ ID NO: 2244735 - RNA, 19 nt, Yersinia pestis
agaauagagaaaucaaagu

SEQ ID NO: 2244736 - RNA, 14 nt, Yersinia pestis
agaacguucaacca

SEQ ID NO: 2244737 - RNA, 20 nt, Yersinia pestis
agaacccccgcgaacagcag

SEQ ID NO: 2244738 - RNA, 14 nt, Yersinia pestis
agaacaggcagcaa

SEQ ID NO: 2244739 - RNA, 22 nt, Yersinia pestis
agaacaccagagaugauagcaa

SEQ ID NO: 2244740 - RNA, 13 nt, Yersinia pestis
agaacaacgcugc

SEQ ID NO: 2244741 - RNA, 16 nt, Yersinia pestis
agaaaucaaugugccg

SEQ ID NO: 2244742 - RNA, 19 nt, Yersinia pestis
agaaaaugcccgccaguaa

SEQ ID NO: 2244743 - RNA, 12 nt, Yersinia pestis
agaaacaucgcc

SEQ ID NO: 2244744 - RNA, 12 nt, Yersinia pestis
agaaagccggaa

SEQ ID NO: 2244745 - RNA, 15 nt, Yersinia pestis
agaaacgaucuuggu

SEQ ID NO: 2244746 - RNA, 22 nt, Yersinia pestis
acuuccuaacaauauuaccaau

SEQ ID NO: 2244747 - RNA, 13 nt, Yersinia pestis
acuuuucagauag

SEQ ID NO: 2244748 - RNA, 17 nt, Yersinia pestis
acugaaccgccauugca

SEQ ID NO: 2244749 - RNA, 20 nt, Yersinia pestis
acugaaguuuaccgcaugaa

SEQ ID NO: 2244750 - RNA, 18 nt, Yersinia pestis
acucuuguuaucaccugu

SEQ ID NO: 2244751 - RNA, 14 nt, Yersinia pestis
acugaccuauugau

SEQ ID NO: 2244752 - RNA, 17 nt, Yersinia pestis
acugaguucugcugcca

SEQ ID NO: 2244753 - RNA, 22 nt, Yersinia pestis
acugagcgugguaucggugagu

SEQ ID NO: 2244754 - RNA, 21 nt, Yersinia pestis
acugacgauuguccaggcuau

SEQ ID NO: 2244755 - RNA, 12 nt, Yersinia pestis
acugacgcagcg

SEQ ID NO: 2244756 - RNA, 16 nt, Yersinia pestis
acugaaugugaagagc

SEQ ID NO: 2244757 - RNA, 20 nt, Yersinia pestis
acugaaucccagaaccucaa

SEQ ID NO: 2244758 - RNA, 18 nt, Yersinia pestis
acugaugguuuccugaau

SEQ ID NO: 2244759 - RNA, 17 nt, Yersinia pestis
acugauucucuucaccu

SEQ ID NO: 2244760 - RNA, 19 nt, Yersinia pestis
acugauaugggaacgucug

SEQ ID NO: 2244761 - RNA, 14 nt, Yersinia pestis
acugaugcgguagu

SEQ ID NO: 2244762 - RNA, 20 nt, Yersinia pestis
acugcccucgcaauggugau

SEQ ID NO: 2244763 - RNA, 18 nt, Yersinia pestis
acugcagaaucacuggca

SEQ ID NO: 2244764 - RNA, 14 nt, Yersinia pestis
acuuacugccaaag

SEQ ID NO: 2244765 - RNA, 15 nt, Yersinia pestis
acuuaacuacugcaa

SEQ ID NO: 2244766 - RNA, 18 nt, Yersinia pestis
acuuaacaaucagugcaa

SEQ ID NO: 2244767 - RNA, 18 nt, Yersinia pestis
acuuaaagcccagguuac

SEQ ID NO: 2244768 - RNA, 20 nt, Yersinia pestis
acuguuggcaauuucacgcu

SEQ ID NO: 2244769 - RNA, 13 nt, Yersinia pestis
acugccgggauca

SEQ ID NO: 2244770 - RNA, 18 nt, Yersinia pestis
acugguaauaaugcuguc

SEQ ID NO: 2244771 - RNA, 16 nt, Yersinia pestis
acuggcccgcguggca

SEQ ID NO: 2244772 - RNA, 15 nt, Yersinia pestis
agauaccgcaaccau

SEQ ID NO: 2244773 - RNA, 16 nt, Yersinia pestis
agauaccgcaaccauu

SEQ ID NO: 2244774 - RNA, 14 nt, Yersinia pestis
agauaucuuugagu

SEQ ID NO: 2244775 - RNA, 16 nt, Yersinia pestis
agaucagugccaguaa

SEQ ID NO: 2244776 - RNA, 11 nt, Yersinia pestis
agaucagugcc

SEQ ID NO: 2244777 - RNA, 15 nt, Yersinia pestis
agaucccuaacgccg

SEQ ID NO: 2244778 - RNA, 14 nt, Yersinia pestis
agaggaguaaagcg

SEQ ID NO: 2244779 - RNA, 21 nt, Yersinia pestis
agagcuaccggaaugaguugc

SEQ ID NO: 2244780 - RNA, 13 nt, Yersinia pestis
agagucgcuuugg

SEQ ID NO: 2244781 - RNA, 23 nt, Yersinia pestis
agaucuuuuucauucugagcgua

SEQ ID NO: 2244782 - RNA, 16 nt, Yersinia pestis
agaucguuaaacccgg

SEQ ID NO: 2244783 - RNA, 13 nt, Yersinia pestis
agacccgauuuca

SEQ ID NO: 2244784 - RNA, 16 nt, Yersinia pestis
agacugaaauaauggu

SEQ ID NO: 2244785 - RNA, 22 nt, Yersinia pestis
agacuucagcccauggcugaaa

SEQ ID NO: 2244786 - RNA, 20 nt, Yersinia pestis
agagcaaagucccggcuagg

SEQ ID NO: 2244787 - RNA, 20 nt, Yersinia pestis
agagcauagacgaaggcacg

SEQ ID NO: 2244788 - RNA, 22 nt, Yersinia pestis
acuacggcgacuugccguggcu

SEQ ID NO: 2244789 - RNA, 15 nt, Yersinia pestis
acuaacaucagcgau

SEQ ID NO: 2244790 - RNA, 14 nt, Yersinia pestis
acuaacaucagcga

SEQ ID NO: 2244791 - RNA, 17 nt, Yersinia pestis
acuaagagucacagcau

SEQ ID NO: 2244792 - RNA, 18 nt, Yersinia pestis
acuaacacgacuuuuggc

SEQ ID NO: 2244793 - RNA, 21 nt, Yersinia pestis
acgucuacuggcugagagccg

SEQ ID NO: 2244794 - RNA, 22 nt, Yersinia pestis
acgugcuuacuggccuggcauu

SEQ ID NO: 2244795 - RNA, 19 nt, Yersinia pestis
acguggccugccagccaua

SEQ ID NO: 2244796 - RNA, 16 nt, Yersinia pestis
acgguuucaacuucaa

SEQ ID NO: 2244797 - RNA, 23 nt, Yersinia pestis
acgguucagugcucccugaacgc

SEQ ID NO: 2244798 - RNA, 17 nt, Yersinia pestis
acgggcugcugcagccg

SEQ ID NO: 2244799 - RNA, 13 nt, Yersinia pestis
acgguagcaauac

SEQ ID NO: 2244800 - RNA, 18 nt, Yersinia pestis
acggucauucacuguggc

SEQ ID NO: 2244801 - RNA, 20 nt, Yersinia pestis
acggcccaauauugauccac

SEQ ID NO: 2244802 - RNA, 20 nt, Yersinia pestis
acgcuugauggccacacugu

SEQ ID NO: 2244803 - RNA, 20 nt, Yersinia pestis
acgcugcuugccgcacgacg

SEQ ID NO: 2244804 - RNA, 14 nt, Yersinia pestis
acggaugagucgcu

SEQ ID NO: 2244805 - RNA, 15 nt, Yersinia pestis
acggaugauauccac

SEQ ID NO: 2244806 - RNA, 20 nt, Yersinia pestis
acggauacccagcacaauga

SEQ ID NO: 2244807 - RNA, 12 nt, Yersinia pestis
acggauaucaac

SEQ ID NO: 2244808 - RNA, 23 nt, Yersinia pestis
acggcaugauaauuugucaguaa

SEQ ID NO: 2244809 - RNA, 16 nt, Yersinia pestis
acggccaauuucagua

SEQ ID NO: 2244810 - RNA, 14 nt, Yersinia pestis
aaacagagcaccgg

SEQ ID NO: 2244811 - RNA, 13 nt, Yersinia pestis
aaacagccagcau

SEQ ID NO: 2244812 - RNA, 22 nt, Yersinia pestis
aaacaccuucacugaauaccgu

SEQ ID NO: 2244813 - RNA, 17 nt, Yersinia pestis
acgcucaaacaauguga

SEQ ID NO: 2244814 - RNA, 21 nt, Yersinia pestis
acgcuccagugcaucgcugag

SEQ ID NO: 2244815 - RNA, 19 nt, Yersinia pestis
acgcucauccaacguaaac

SEQ ID NO: 2244816 - RNA, 20 nt, Yersinia pestis
accaucaaggacuucaucac

SEQ ID NO: 2244817 - RNA, 21 nt, Yersinia pestis
aaaauacugccaaucgcucug

SEQ ID NO: 2244818 - RNA, 15 nt, Yersinia pestis
accauaacaauggcc

SEQ ID NO: 2244819 - RNA, 21 nt, Yersinia pestis
aaaaugcacugaacaaugcca

SEQ ID NO: 2244820 - RNA, 19 nt, Yersinia pestis
aaaaugagagcgaauggca

SEQ ID NO: 2244821 - RNA, 22 nt, Yersinia pestis
aaaaugagccgaccgucguaau

SEQ ID NO: 2244822 - RNA, 17 nt, Yersinia pestis
acaguaaauuauuuucc

SEQ ID NO: 2244823 - RNA, 14 nt, Yersinia pestis
acaguuacgucagg

SEQ ID NO: 2244824 - RNA, 18 nt, Yersinia pestis
accaguaaacgccaauca

SEQ ID NO: 2244825 - RNA, 19 nt, Yersinia pestis
accagggcuaaaauggcac

SEQ ID NO: 2244826 - RNA, 17 nt, Yersinia pestis
acccgcuauauguaaug

SEQ ID NO: 2244827 - RNA, 18 nt, Yersinia pestis
aaaauuccaccauucuca

SEQ ID NO: 2244828 - RNA, 15 nt, Yersinia pestis
accauugaccagcgu

SEQ ID NO: 2244829 - RNA, 14 nt, Yersinia pestis
accccccauugcca

SEQ ID NO: 2244830 - RNA, 19 nt, Yersinia pestis
accgauuucaggucgcaag

SEQ ID NO: 2244831 - RNA, 20 nt, Yersinia pestis
accgcacuugcggcaauggc

SEQ ID NO: 2244832 - RNA, 18 nt, Yersinia pestis
accgauggugccgucaac

SEQ ID NO: 2244833 - RNA, 21 nt, Yersinia pestis
accgaugcaaucgcauugcgu

SEQ ID NO: 2244834 - RNA, 15 nt, Yersinia pestis
accgaguucucacca

SEQ ID NO: 2244835 - RNA, 15 nt, Yersinia pestis
acccgcuucauucgc

SEQ ID NO: 2244836 - RNA, 22 nt, Yersinia pestis
accgcuggucgggugcaggcca

SEQ ID NO: 2244837 - RNA, 22 nt, Yersinia pestis
accgcuuacugaugucaucaag

SEQ ID NO: 2244838 - RNA, 20 nt, Yersinia pestis
accgcugauaaccagccaac

SEQ ID NO: 2244839 - RNA, 15 nt, Yersinia pestis
acgauaacuuuuggc

SEQ ID NO: 2244840 - RNA, 19 nt, Yersinia pestis
acgauauaccucaguuauc

SEQ ID NO: 2244841 - RNA, 20 nt, Yersinia pestis
acgauauaggguauaugccu

SEQ ID NO: 2244842 - RNA, 23 nt, Yersinia pestis
acgaucgauaguaacaccagcau

SEQ ID NO: 2244843 - RNA, 12 nt, Yersinia pestis
acgcaaggccag

SEQ ID NO: 2244844 - RNA, 22 nt, Yersinia pestis
acgcaauuagguugcagcuaaa

SEQ ID NO: 2244845 - RNA, 16 nt, Yersinia pestis
acgcacguugagugau

SEQ ID NO: 2244846 - RNA, 15 nt, Yersinia pestis
aaaauuuuaccgaug

SEQ ID NO: 2244847 - RNA, 16 nt, Yersinia pestis
acgacgugcagcgcgc

SEQ ID NO: 2244848 - RNA, 18 nt, Yersinia pestis
acgacuucgucaucguaa

SEQ ID NO: 2244849 - RNA, 18 nt, Yersinia pestis
acgacugcggugaucgac

SEQ ID NO: 2244850 - RNA, 17 nt, Yersinia pestis
acgagggcucaaucucu

SEQ ID NO: 2244851 - RNA, 19 nt, Yersinia pestis
acgaaaagcagcaguuaca

SEQ ID NO: 2244852 - RNA, 14 nt, Yersinia pestis
accuuguucccgca

SEQ ID NO: 2244853 - RNA, 17 nt, Yersinia pestis
accuuggaaaacagcaa

SEQ ID NO: 2244854 - RNA, 15 nt, Yersinia pestis
accugcaccaaugac

SEQ ID NO: 2244855 - RNA, 12 nt, Yersinia pestis
acgaccgucacc

SEQ ID NO: 2244856 - RNA, 14 nt, Yersinia pestis
accuccguaggcca

SEQ ID NO: 2244857 - RNA, 19 nt, Yersinia pestis
accuaccaccuaccaccua

SEQ ID NO: 2244858 - RNA, 16 nt, Yersinia pestis
accuaacgccaaaaug

SEQ ID NO: 2244859 - RNA, 16 nt, Yersinia pestis
accguuuauuuacugg

SEQ ID NO: 2244860 - RNA, 19 nt, Yersinia pestis
accguauacgcugaaugau

SEQ ID NO: 2244861 - RNA, 14 nt, Yersinia pestis
accguaucaacgua

SEQ ID NO: 2244862 - RNA, 22 nt, Yersinia pestis
accgugaacgauaacggcggua

SEQ ID NO: 2244863 - RNA, 18 nt, Yersinia pestis
accgggguucgcaaugaa

SEQ ID NO: 2244864 - RNA, 21 nt, Yersinia pestis
accgggggcguauuaucggau

SEQ ID NO: 2244865 - RNA, 21 nt, Yersinia pestis
accggggauccauaggauccc

SEQ ID NO: 2244866 - RNA, 15 nt, Yersinia pestis
cuuucgauagucagc

SEQ ID NO: 2244867 - RNA, 22 nt, Yersinia pestis
gaaaaagggccaugccuguuga

SEQ ID NO: 2244868 - RNA, 21 nt, Yersinia pestis
cuuuuugcaucaccaucauua

SEQ ID NO: 2244869 - RNA, 15 nt, Yersinia pestis
cuuuuugccaguggu

SEQ ID NO: 2244870 - RNA, 22 nt, Yersinia pestis
cuuuuuuaaagccuuucagcgc

SEQ ID NO: 2244871 - RNA, 14 nt, Yersinia pestis
gaaaaaacguuacu

SEQ ID NO: 2244872 - RNA, 13 nt, Yersinia pestis
gaaaaacacuggc

SEQ ID NO: 2244873 - RNA, 19 nt, Yersinia pestis
gaaaaacugugcaaauggc

SEQ ID NO: 2244874 - RNA, 19 nt, Yersinia pestis
cuuuuaugacggcaucgag

SEQ ID NO: 2244875 - RNA, 21 nt, Yersinia pestis
cuuuuuauguuaaaucaguga

SEQ ID NO: 2244876 - RNA, 16 nt, Yersinia pestis
cuuuacgcgcaccgga

SEQ ID NO: 2244877 - RNA, 12 nt, Yersinia pestis
cuuuacggcaag

SEQ ID NO: 2244878 - RNA, 14 nt, Yersinia pestis
cuuuaccuguuuca

SEQ ID NO: 2244879 - RNA, 13 nt, Yersinia pestis
cuuuaaaaucuug

SEQ ID NO: 2244880 - RNA, 14 nt, Yersinia pestis
cuuuauucaauacu

SEQ ID NO: 2244881 - RNA, 12 nt, Yersinia pestis
aaccgucaugcu

SEQ ID NO: 2244882 - RNA, 19 nt, Yersinia pestis
cuuucaggccacgcaauuc

SEQ ID NO: 2244883 - RNA, 18 nt, Yersinia pestis
cuuucagcacgcuuucca

SEQ ID NO: 2244884 - RNA, 13 nt, Yersinia pestis
cuucguagccauu

SEQ ID NO: 2244885 - RNA, 22 nt, Yersinia pestis
cuucguugccccaucagcacuc

SEQ ID NO: 2244886 - RNA, 17 nt, Yersinia pestis
cuugcuugauggcauca

SEQ ID NO: 2244887 - RNA, 22 nt, Yersinia pestis
cuugcugguauucaucagcaau

SEQ ID NO: 2244888 - RNA, 22 nt, Yersinia pestis
cuugggcuucacauccaauggc

SEQ ID NO: 2244889 - RNA, 12 nt, Yersinia pestis
aaccguuugccg

SEQ ID NO: 2244890 - RNA, 16 nt, Yersinia pestis
gaaaagguaaacagac

SEQ ID NO: 2244891 - RNA, 17 nt, Yersinia pestis
aaccugcccguuaucuu

SEQ ID NO: 2244892 - RNA, 22 nt, Yersinia pestis
aaccuaaucucuacauuuaguc

SEQ ID NO: 2244893 - RNA, 14 nt, Yersinia pestis
aaccugguuaucgg

SEQ ID NO: 2244894 - RNA, 19 nt, Yersinia pestis
aaccuuaacuacaccgcua

SEQ ID NO: 2244895 - RNA, 20 nt, Yersinia pestis
aacgaaacacacuucgccgg

SEQ ID NO: 2244896 - RNA, 13 nt, Yersinia pestis
gaaacuaacgcgu

SEQ ID NO: 2244897 - RNA, 22 nt, Yersinia pestis
gaaauaccgauuagaaaucgcu

SEQ ID NO: 2244898 - RNA, 22 nt, Yersinia pestis
gaaauuuuccaucacugcauua

SEQ ID NO: 2244899 - RNA, 16 nt, Yersinia pestis
gaacaauccauccggu

SEQ ID NO: 2244900 - RNA, 19 nt, Yersinia pestis
gaacagccuaacgggugac

SEQ ID NO: 2244901 - RNA, 14 nt, Yersinia pestis
gaacgcucuguuga

SEQ ID NO: 2244902 - RNA, 15 nt, Yersinia pestis
cuggauauauuuaca

SEQ ID NO: 2244903 - RNA, 12 nt, Yersinia pestis
cuggcacuggca

SEQ ID NO: 2244904 - RNA, 17 nt, Yersinia pestis
cuggcuuuuucacacgc

SEQ ID NO: 2244905 - RNA, 13 nt, Yersinia pestis
cugggcgauccaa

SEQ ID NO: 2244906 - RNA, 16 nt, Yersinia pestis
cuucaguggcuggaaa

SEQ ID NO: 2244907 - RNA, 12 nt, Yersinia pestis
cuucauccgcuc

SEQ ID NO: 2244908 - RNA, 18 nt, Yersinia pestis
cuuauggucgguuuccgc

SEQ ID NO: 2244909 - RNA, 24 nt, Yersinia pestis
cuucaacuaauauuaagucuaucg

SEQ ID NO: 2244910 - RNA, 22 nt, Yersinia pestis
cuucaaucauugagaucaguuc

SEQ ID NO: 2244911 - RNA, 9 nt, Yersinia pestis
cuucaggca

SEQ ID NO: 2244912 - RNA, 19 nt, Yersinia pestis
cuucaggccaauagcccaa

SEQ ID NO: 2244913 - RNA, 20 nt, Yersinia pestis
cuucgauggcuuuacgcaac

SEQ ID NO: 2244914 - RNA, 13 nt, Yersinia pestis
cuuccgccagcag

SEQ ID NO: 2244915 - RNA, 12 nt, Yersinia pestis
cugugauaacca

SEQ ID NO: 2244916 - RNA, 22 nt, Yersinia pestis
cuguguuuugagcaucacuuca

SEQ ID NO: 2244917 - RNA, 13 nt, Yersinia pestis
cuuaauaccuaaa

SEQ ID NO: 2244918 - RNA, 18 nt, Yersinia pestis
cuuaaccaacaugagcca

SEQ ID NO: 2244919 - RNA, 11 nt, Yersinia pestis
cuuaacugcac

SEQ ID NO: 2244920 - RNA, 16 nt, Yersinia pestis
cuuaacugcauagcua

SEQ ID NO: 2244921 - RNA, 17 nt, Yersinia pestis
cuguuuuugaauaggua

SEQ ID NO: 2244922 - RNA, 14 nt, Yersinia pestis
aacgcuccagugca

SEQ ID NO: 2244923 - RNA, 17 nt, Yersinia pestis
aacgcgucacuggccac

SEQ ID NO: 2244924 - RNA, 15 nt, Yersinia pestis
gacaucugcuuuacu

SEQ ID NO: 2244925 - RNA, 16 nt, Yersinia pestis
aacgaugaccgugaca

SEQ ID NO: 2244926 - RNA, 22 nt, Yersinia pestis
gaccacuugguuggcaccacgg

SEQ ID NO: 2244927 - RNA, 21 nt, Yersinia pestis
gacccaagggcuauugcugug

SEQ ID NO: 2244928 - RNA, 23 nt, Yersinia pestis
gacccaucgccguuuugccauua

SEQ ID NO: 2244929 - RNA, 19 nt, Yersinia pestis
gacagaauauccagcaaau

SEQ ID NO: 2244930 - RNA, 24 nt, Yersinia pestis
gacacucagaucccccugcugcca

SEQ ID NO: 2244931 - RNA, 20 nt, Yersinia pestis
gacagauuauuguuauccac

SEQ ID NO: 2244932 - RNA, 12 nt, Yersinia pestis
gacaaugcguua

SEQ ID NO: 2244933 - RNA, 21 nt, Yersinia pestis
gaauaaugguauuugaaauau

SEQ ID NO: 2244934 - RNA, 19 nt, Yersinia pestis
gaauauucaacgccaauac

SEQ ID NO: 2244935 - RNA, 14 nt, Yersinia pestis
gaauauccguucag

SEQ ID NO: 2244936 - RNA, 12 nt, Yersinia pestis
gaauaacgcuga

SEQ ID NO: 2244937 - RNA, 22 nt, Yersinia pestis
gaaugcgcccuuuuccgucagc

SEQ ID NO: 2244938 - RNA, 21 nt, Yersinia pestis
gacaaacggcgcgucgccaua

SEQ ID NO: 2244939 - RNA, 17 nt, Yersinia pestis
gaauuuggaucgccagu

SEQ ID NO: 2244940 - RNA, 16 nt, Yersinia pestis
gacaacaucaauggca

SEQ ID NO: 2244941 - RNA, 18 nt, Yersinia pestis
gacaacgccggaucauca

SEQ ID NO: 2244942 - RNA, 16 nt, Yersinia pestis
gacaagauugccaccu

SEQ ID NO: 2244943 - RNA, 15 nt, Yersinia pestis
gacaaugaucgucaa

SEQ ID NO: 2244944 - RNA, 18 nt, Yersinia pestis
aacggcaguuaacgacgc

SEQ ID NO: 2244945 - RNA, 22 nt, Yersinia pestis
gaccuucccucuuuuaucugug

SEQ ID NO: 2244946 - RNA, 24 nt, Yersinia pestis
gacgcacauuacccggccaaccgu

SEQ ID NO: 2244947 - RNA, 18 nt, Yersinia pestis
aacgucuuaugccauaac

SEQ ID NO: 2244948 - RNA, 16 nt, Yersinia pestis
gacggucagccaacga

SEQ ID NO: 2244949 - RNA, 21 nt, Yersinia pestis
gacgcggugacaaugaauccg

SEQ ID NO: 2244950 - RNA, 17 nt, Yersinia pestis
gacgcgaucuugaacgg

SEQ ID NO: 2244951 - RNA, 23 nt, Yersinia pestis
gacgcuguauacggacaaugcca

SEQ ID NO: 2244952 - RNA, 13 nt, Yersinia pestis
cucuuacucauuc

SEQ ID NO: 2244953 - RNA, 23 nt, Yersinia pestis
cucuucaccaaaggaagccgagc

SEQ ID NO: 2244954 - RNA, 18 nt, Yersinia pestis
cucugucaacgcuucagu

SEQ ID NO: 2244955 - RNA, 14 nt, Yersinia pestis
cucuguauuuucaa

SEQ ID NO: 2244956 - RNA, 20 nt, Yersinia pestis
cucuggccagcgucuucagu

SEQ ID NO: 2244957 - RNA, 16 nt, Yersinia pestis
cucuuucuucucuuca

SEQ ID NO: 2244958 - RNA, 18 nt, Yersinia pestis
cucuuguuaucaccuguc

SEQ ID NO: 2244959 - RNA, 20 nt, Yersinia pestis
cugaacaucgcggaugcgcg

SEQ ID NO: 2244960 - RNA, 18 nt, Yersinia pestis
cucucaucugaacuauug

SEQ ID NO: 2244961 - RNA, 12 nt, Yersinia pestis
cucuaugccgcu

SEQ ID NO: 2244962 - RNA, 20 nt, Yersinia pestis
cucuaugcguguugccaccu

SEQ ID NO: 2244963 - RNA, 17 nt, Yersinia pestis
cucuggagcucuccacu

SEQ ID NO: 2244964 - RNA, 14 nt, Yersinia pestis
cugaauuucaauaa

SEQ ID NO: 2244965 - RNA, 13 nt, Yersinia pestis
cugaauucuguag

SEQ ID NO: 2244966 - RNA, 15 nt, Yersinia pestis
cugaauuggaagagc

SEQ ID NO: 2244967 - RNA, 17 nt, Yersinia pestis
cugaaucgccgaaaucu

SEQ ID NO: 2244968 - RNA, 21 nt, Yersinia pestis
cugaauaccguuuaggaugaa

SEQ ID NO: 2244969 - RNA, 16 nt, Yersinia pestis
cugaauauccguucag

SEQ ID NO: 2244970 - RNA, 18 nt, Yersinia pestis
cugaacguauauuggccu

SEQ ID NO: 2244971 - RNA, 14 nt, Yersinia pestis
cugaacggauaccc

SEQ ID NO: 2244972 - RNA, 14 nt, Yersinia pestis
cugaauaacugaac

SEQ ID NO: 2244973 - RNA, 21 nt, Yersinia pestis
cugaaggguauugaagauacc

SEQ ID NO: 2244974 - RNA, 16 nt, Yersinia pestis
cugaagccagcaccgg

SEQ ID NO: 2244975 - RNA, 16 nt, Yersinia pestis
cugauagcagaaaccc

SEQ ID NO: 2244976 - RNA, 22 nt, Yersinia pestis
cugauacccuccgacuuugaua

SEQ ID NO: 2244977 - RNA, 14 nt, Yersinia pestis
cugaucaucaucaa

SEQ ID NO: 2244978 - RNA, 18 nt, Yersinia pestis
cugaucaucaucaaugga

SEQ ID NO: 2244979 - RNA, 15 nt, Yersinia pestis
cugaguuguaaugaa

SEQ ID NO: 2244980 - RNA, 12 nt, Yersinia pestis
cugauaaagcaa

SEQ ID NO: 2244981 - RNA, 19 nt, Yersinia pestis
cugagugugccuuggucuc

SEQ ID NO: 2244982 - RNA, 19 nt, Yersinia pestis
cugauaagccgucagcuua

SEQ ID NO: 2244983 - RNA, 15 nt, Yersinia pestis
cugauacauuuccau

SEQ ID NO: 2244984 - RNA, 15 nt, Yersinia pestis
cugaggcguggcaca

SEQ ID NO: 2244985 - RNA, 21 nt, Yersinia pestis
cugacuaacucuucuggcaaa

SEQ ID NO: 2244986 - RNA, 13 nt, Yersinia pestis
cugacugcuggca

SEQ ID NO: 2244987 - RNA, 21 nt, Yersinia pestis
cugacguaguguauucaaacg

SEQ ID NO: 2244988 - RNA, 22 nt, Yersinia pestis
cugacguaauaccggcaccaau

SEQ ID NO: 2244989 - RNA, 13 nt, Yersinia pestis
cugacgucagauc

SEQ ID NO: 2244990 - RNA, 14 nt, Yersinia pestis
cugaccuauugaua

SEQ ID NO: 2244991 - RNA, 18 nt, Yersinia pestis
cugcauaagcaucaguaa

SEQ ID NO: 2244992 - RNA, 17 nt, Yersinia pestis
cugcaucaucacauuca

SEQ ID NO: 2244993 - RNA, 16 nt, Yersinia pestis
cugccagaaucgccug

SEQ ID NO: 2244994 - RNA, 14 nt, Yersinia pestis
cugcaauagcucau

SEQ ID NO: 2244995 - RNA, 21 nt, Yersinia pestis
cugcaccccaaauguuggaua

SEQ ID NO: 2244996 - RNA, 16 nt, Yersinia pestis
cugauuuuuauggcag

SEQ ID NO: 2244997 - RNA, 19 nt, Yersinia pestis
cugauuguaacaauccgaa

SEQ ID NO: 2244998 - RNA, 23 nt, Yersinia pestis
cugcaaccacuuauccagcucau

SEQ ID NO: 2244999 - RNA, 19 nt, Yersinia pestis
cugaugcgguagugaugca

SEQ ID NO: 2245000 - RNA, 16 nt, Yersinia pestis
cugaugacgcgccaua

SEQ ID NO: 2245001 - RNA, 16 nt, Yersinia pestis
cucaauugucuuugga

SEQ ID NO: 2245002 - RNA, 18 nt, Yersinia pestis
cucacaacccgcugaugc

SEQ ID NO: 2245003 - RNA, 21 nt, Yersinia pestis
cucacccugcgugguauaccc

SEQ ID NO: 2245004 - RNA, 20 nt, Yersinia pestis
cucauuacucagcuugguaa

SEQ ID NO: 2245005 - RNA, 18 nt, Yersinia pestis
cuccauccccaacucuuu

SEQ ID NO: 2245006 - RNA, 15 nt, Yersinia pestis
cuauuguuccgguuc

SEQ ID NO: 2245007 - RNA, 15 nt, Yersinia pestis
cuauuuacugcauuc

SEQ ID NO: 2245008 - RNA, 14 nt, Yersinia pestis
cuauuuauuaaucu

SEQ ID NO: 2245009 - RNA, 16 nt, Yersinia pestis
cuauugugucaauacc

SEQ ID NO: 2245010 - RNA, 14 nt, Yersinia pestis
cuauugcgacgguu

SEQ ID NO: 2245011 - RNA, 22 nt, Yersinia pestis
cucaaagaccacaucaaccuga

SEQ ID NO: 2245012 - RNA, 20 nt, Yersinia pestis
cucaacauauugcucugccg

SEQ ID NO: 2245013 - RNA, 20 nt, Yersinia pestis
cucaacauucuuuagcggcg

SEQ ID NO: 2245014 - RNA, 21 nt, Yersinia pestis
cuauuuuuauuucuccuuacu

SEQ ID NO: 2245015 - RNA, 22 nt, Yersinia pestis
cuauuuuaucccaaaagaagac

SEQ ID NO: 2245016 - RNA, 14 nt, Yersinia pestis
cucaauacgguaau

SEQ ID NO: 2245017 - RNA, 11 nt, Yersinia pestis
cucaacggcac

SEQ ID NO: 2245018 - RNA, 18 nt, Yersinia pestis
cucaacugcucaacugcu

SEQ ID NO: 2245019 - RNA, 14 nt, Yersinia pestis
cuauuaugccagcc

SEQ ID NO: 2245020 - RNA, 16 nt, Yersinia pestis
cuauuaucccaguuuu

SEQ ID NO: 2245021 - RNA, 19 nt, Yersinia pestis
cuauggaagaacuggcaca

SEQ ID NO: 2245022 - RNA, 14 nt, Yersinia pestis
cuaucgacuucacg

SEQ ID NO: 2245023 - RNA, 24 nt, Yersinia pestis
cuaucgaguugauauaccgauuac

SEQ ID NO: 2245024 - RNA, 15 nt, Yersinia pestis
cuauaaaaugccgcu

SEQ ID NO: 2245025 - RNA, 24 nt, Yersinia pestis
cuagcaucgccgggucuugcagca

SEQ ID NO: 2245026 - RNA, 15 nt, Yersinia pestis
cuauaucucaguuga

SEQ ID NO: 2245027 - RNA, 19 nt, Yersinia pestis
cuauaucucaguugaaacc

SEQ ID NO: 2245028 - RNA, 21 nt, Yersinia pestis
cuaucaccccguuacggcugg

SEQ ID NO: 2245029 - RNA, 13 nt, Yersinia pestis
cuccuauaucuca

SEQ ID NO: 2245030 - RNA, 18 nt, Yersinia pestis
cguuaugaauaaaccagc

SEQ ID NO: 2245031 - RNA, 13 nt, Yersinia pestis
cguuauugagaag

SEQ ID NO: 2245032 - RNA, 16 nt, Yersinia pestis
cguuacacaucaggcu

SEQ ID NO: 2245033 - RNA, 16 nt, Yersinia pestis
cguucaccgcaucgcc

SEQ ID NO: 2245034 - RNA, 23 nt, Yersinia pestis
cguguuucgcuauuucaauggga

SEQ ID NO: 2245035 - RNA, 14 nt, Yersinia pestis
cguguugccaccug

SEQ ID NO: 2245036 - RNA, 21 nt, Yersinia pestis
cguggugggcgguaguauuug

SEQ ID NO: 2245037 - RNA, 19 nt, Yersinia pestis
cgugguuauugcgccauca

SEQ ID NO: 2245038 - RNA, 17 nt, Yersinia pestis
cguugcccugagaauca

SEQ ID NO: 2245039 - RNA, 16 nt, Yersinia pestis
cguugauuaugccacg

SEQ ID NO: 2245040 - RNA, 21 nt, Yersinia pestis
cguucguagccacgaucgaug

SEQ ID NO: 2245041 - RNA, 12 nt, Yersinia pestis
cguucccuguau

SEQ ID NO: 2245042 - RNA, 24 nt, Yersinia pestis
aacccguucgcgguuuacggcaau

SEQ ID NO: 2245043 - RNA, 13 nt, Yersinia pestis
cgucuugaucaac

SEQ ID NO: 2245044 - RNA, 20 nt, Yersinia pestis
cgugcauuagagguuguuga

SEQ ID NO: 2245045 - RNA, 14 nt, Yersinia pestis
cguagccguuaaau

SEQ ID NO: 2245046 - RNA, 21 nt, Yersinia pestis
cguagaguugcaguucaucaa

SEQ ID NO: 2245047 - RNA, 23 nt, Yersinia pestis
aaccccaugaccgccagugccgc

SEQ ID NO: 2245048 - RNA, 21 nt, Yersinia pestis
aacccccgaagggauaugaca

SEQ ID NO: 2245049 - RNA, 17 nt, Yersinia pestis
aacccauucaucaaacu

SEQ ID NO: 2245050 - RNA, 22 nt, Yersinia pestis
cguauaucuuaccuucaguuua

SEQ ID NO: 2245051 - RNA, 18 nt, Yersinia pestis
cguaacaugcagcccgac

SEQ ID NO: 2245052 - RNA, 17 nt, Yersinia pestis
cguaacccccagccaga

SEQ ID NO: 2245053 - RNA, 16 nt, Yersinia pestis
cguaauuuuaagccgc

SEQ ID NO: 2245054 - RNA, 18 nt, Yersinia pestis
cguaauucccaccacuug

SEQ ID NO: 2245055 - RNA, 18 nt, Yersinia pestis
cguacuggcgcgcuuugg

SEQ ID NO: 2245056 - RNA, 23 nt, Yersinia pestis
cgguuuccugcggggaucgggcu

SEQ ID NO: 2245057 - RNA, 14 nt, Yersinia pestis
cgguuaucacauca

SEQ ID NO: 2245058 - RNA, 20 nt, Yersinia pestis
cgguuauucguggugaugau

SEQ ID NO: 2245059 - RNA, 15 nt, Yersinia pestis
cgguucgcagcuucc

SEQ ID NO: 2245060 - RNA, 13 nt, Yersinia pestis
cgucaugauugag

SEQ ID NO: 2245061 - RNA, 16 nt, Yersinia pestis
gcacugagagaaccau

SEQ ID NO: 2245062 - RNA, 16 nt, Yersinia pestis
gcacugcgcgauccca

SEQ ID NO: 2245063 - RNA, 24 nt, Yersinia pestis
gcacucaaauagauagcaaucaau

SEQ ID NO: 2245064 - RNA, 17 nt, Yersinia pestis
gcacuucauuggcuugg

SEQ ID NO: 2245065 - RNA, 13 nt, Yersinia pestis
gcacuucaccugg

SEQ ID NO: 2245066 - RNA, 15 nt, Yersinia pestis
gcagaaaucagccau

SEQ ID NO: 2245067 - RNA, 23 nt, Yersinia pestis
aacuuugcuuugacuaauacugc

SEQ ID NO: 2245068 - RNA, 14 nt, Yersinia pestis
aacuuuaacuucca

SEQ ID NO: 2245069 - RNA, 18 nt, Yersinia pestis
aacuuuucuucauugcug

SEQ ID NO: 2245070 - RNA, 14 nt, Yersinia pestis
gcagaguauccagc

SEQ ID NO: 2245071 - RNA, 16 nt, Yersinia pestis
gcaauuuuuagccaaa

SEQ ID NO: 2245072 - RNA, 19 nt, Yersinia pestis
gcaauucggccauauacgc

SEQ ID NO: 2245073 - RNA, 17 nt, Yersinia pestis
gcacaauuccaggguug

SEQ ID NO: 2245074 - RNA, 14 nt, Yersinia pestis
gcacaccgugcacc

SEQ ID NO: 2245075 - RNA, 14 nt, Yersinia pestis
gcacacgauuaccu

SEQ ID NO: 2245076 - RNA, 22 nt, Yersinia pestis
gcaccaaucauuacaucaucuu

SEQ ID NO: 2245077 - RNA, 14 nt, Yersinia pestis
gcacaucgccauua

SEQ ID NO: 2245078 - RNA, 23 nt, Yersinia pestis
gcacauuacaagugccaaaugga

SEQ ID NO: 2245079 - RNA, 19 nt, Yersinia pestis
gcagcuaauguuggcaacu

SEQ ID NO: 2245080 - RNA, 16 nt, Yersinia pestis
gcagcgacaaccugua

SEQ ID NO: 2245081 - RNA, 19 nt, Yersinia pestis
gcagcccccuuauggcaca

SEQ ID NO: 2245082 - RNA, 20 nt, Yersinia pestis
gcaguacaaauuguggaaau

SEQ ID NO: 2245083 - RNA, 14 nt, Yersinia pestis
gcaguaacgccaua

SEQ ID NO: 2245084 - RNA, 12 nt, Yersinia pestis
gcaggcuuucac

SEQ ID NO: 2245085 - RNA, 22 nt, Yersinia pestis
gcaggccaugucgaucauggca

SEQ ID NO: 2245086 - RNA, 14 nt, Yersinia pestis
gauauacaccccau

SEQ ID NO: 2245087 - RNA, 18 nt, Yersinia pestis
gauagcgaaucacaucau

SEQ ID NO: 2245088 - RNA, 16 nt, Yersinia pestis
gauauuacgcagccau

SEQ ID NO: 2245089 - RNA, 22 nt, Yersinia pestis
gauauugcguguagcgggagau

SEQ ID NO: 2245090 - RNA, 20 nt, Yersinia pestis
gauauugagaaucagugguc

SEQ ID NO: 2245091 - RNA, 22 nt, Yersinia pestis
gaucaaaacaauaaaaagaucu

SEQ ID NO: 2245092 - RNA, 20 nt, Yersinia pestis
gaucaaaccagagaaagguu

SEQ ID NO: 2245093 - RNA, 18 nt, Yersinia pestis
gaucaaacggauaaucgc

SEQ ID NO: 2245094 - RNA, 22 nt, Yersinia pestis
gaucaauaaacgcuuuugcugc

SEQ ID NO: 2245095 - RNA, 15 nt, Yersinia pestis
gaucacaaugcaaau

SEQ ID NO: 2245096 - RNA, 21 nt, Yersinia pestis
gaucaauauguuuguugaugu

SEQ ID NO: 2245097 - RNA, 14 nt, Yersinia pestis
gaucaccagaucau

SEQ ID NO: 2245098 - RNA, 22 nt, Yersinia pestis
gagucgcaaaacuucacuuucu

SEQ ID NO: 2245099 - RNA, 12 nt, Yersinia pestis
gaguaaucagag

SEQ ID NO: 2245100 - RNA, 23 nt, Yersinia pestis
gauaaccaaaucaccugacacca

SEQ ID NO: 2245101 - RNA, 16 nt, Yersinia pestis
gauaaccguucaagag

SEQ ID NO: 2245102 - RNA, 15 nt, Yersinia pestis
gauacaucucggcuu

SEQ ID NO: 2245103 - RNA, 14 nt, Yersinia pestis
gauacgguccagca

SEQ ID NO: 2245104 - RNA, 15 nt, Yersinia pestis
gauacugacccacau

SEQ ID NO: 2245105 - RNA, 14 nt, Yersinia pestis
gaucaguucaguau

SEQ ID NO: 2245106 - RNA, 17 nt, Yersinia pestis
gauccacuuauaucucc

SEQ ID NO: 2245107 - RNA, 19 nt, Yersinia pestis
gaucagcuuaaucgcauca

SEQ ID NO: 2245108 - RNA, 17 nt, Yersinia pestis
gauccaguucaguccag

SEQ ID NO: 2245109 - RNA, 14 nt, Yersinia pestis
gaucgaaugaucag

SEQ ID NO: 2245110 - RNA, 17 nt, Yersinia pestis
gagguagacguaucaug

SEQ ID NO: 2245111 - RNA, 16 nt, Yersinia pestis
gaguaaacagagcacc

SEQ ID NO: 2245112 - RNA, 22 nt, Yersinia pestis
gaggguaaccgccgcaggccau

SEQ ID NO: 2245113 - RNA, 19 nt, Yersinia pestis
aacugcauagcuaaccuua

SEQ ID NO: 2245114 - RNA, 15 nt, Yersinia pestis
aacucgcgccugaaa

SEQ ID NO: 2245115 - RNA, 23 nt, Yersinia pestis
gagcggcauccaguaagcuguug

SEQ ID NO: 2245116 - RNA, 18 nt, Yersinia pestis
gagccgcgccauccuugg

SEQ ID NO: 2245117 - RNA, 16 nt, Yersinia pestis
gagccucaugaaugag

SEQ ID NO: 2245118 - RNA, 15 nt, Yersinia pestis
gcaacacgaugccag

SEQ ID NO: 2245119 - RNA, 14 nt, Yersinia pestis
gcaaauuaaugucg

SEQ ID NO: 2245120 - RNA, 18 nt, Yersinia pestis
gauuaaauucuaccuggc

SEQ ID NO: 2245121 - RNA, 19 nt, Yersinia pestis
gauuaauaucaaaacugau

SEQ ID NO: 2245122 - RNA, 22 nt, Yersinia pestis
gauuaacggugcgacaaugccc

SEQ ID NO: 2245123 - RNA, 12 nt, Yersinia pestis
gauuaccaauaa

SEQ ID NO: 2245124 - RNA, 18 nt, Yersinia pestis
gauguuuugcugccauuu

SEQ ID NO: 2245125 - RNA, 15 nt, Yersinia pestis
gauucauuagccagc

SEQ ID NO: 2245126 - RNA, 15 nt, Yersinia pestis
gauuuaaauaacagc

SEQ ID NO: 2245127 - RNA, 21 nt, Yersinia pestis
gauugcagaccaaucaauaca

SEQ ID NO: 2245128 - RNA, 18 nt, Yersinia pestis
aacuucuucauaacgcuu

SEQ ID NO: 2245129 - RNA, 18 nt, Yersinia pestis
gaugcugcacaucaacgg

SEQ ID NO: 2245130 - RNA, 15 nt, Yersinia pestis
aacuuccuuugcccu

SEQ ID NO: 2245131 - RNA, 19 nt, Yersinia pestis
gauggcuuuggugaucaug

SEQ ID NO: 2245132 - RNA, 19 nt, Yersinia pestis
gaugagaaugugacucagc

SEQ ID NO: 2245133 - RNA, 21 nt, Yersinia pestis
gaugaacugacacacaccagu

SEQ ID NO: 2245134 - RNA, 24 nt, Yersinia pestis
gaugaaauuuuauucgcguuucau

SEQ ID NO: 2245135 - RNA, 15 nt, Yersinia pestis
gaucuuguucaccaa

SEQ ID NO: 2245136 - RNA, 16 nt, Yersinia pestis
gaugaucaaugugguu

SEQ ID NO: 2245137 - RNA, 20 nt, Yersinia pestis
gaugaucugaugaucaucug

SEQ ID NO: 2245138 - RNA, 18 nt, Yersinia pestis
aacuuacaggcugccugc

SEQ ID NO: 2245139 - RNA, 20 nt, Yersinia pestis
gaugccaaucaaaaaaccgg

SEQ ID NO: 2245140 - RNA, 15 nt, Yersinia pestis
gaugcgacaauuucc

SEQ ID NO: 2245141 - RNA, 21 nt, Yersinia pestis
gcagugaaaagguuaacugca

SEQ ID NO: 2245142 - RNA, 21 nt, Yersinia pestis
gcagucugagggccacuucgg

SEQ ID NO: 2245143 - RNA, 16 nt, Yersinia pestis
gcagucuccaucacuc

SEQ ID NO: 2245144 - RNA, 22 nt, Yersinia pestis
gcagucgauaaacaucaugaca

SEQ ID NO: 2245145 - RNA, 14 nt, Yersinia pestis
gccaaguuugcagu

SEQ ID NO: 2245146 - RNA, 22 nt, Yersinia pestis
gccaaguuugcagucgcuucau

SEQ ID NO: 2245147 - RNA, 16 nt, Yersinia pestis
gccaccggcaguucau

SEQ ID NO: 2245148 - RNA, 23 nt, Yersinia pestis
gccagcauucaggcuuuuuucua

SEQ ID NO: 2245149 - RNA, 23 nt, Yersinia pestis
gccagcgaaagucggugacucgg

SEQ ID NO: 2245150 - RNA, 17 nt, Yersinia pestis
gccagccuuaacugcau

SEQ ID NO: 2245151 - RNA, 22 nt, Yersinia pestis
gccacuucuuucacuaaugagg

SEQ ID NO: 2245152 - RNA, 10 nt, Yersinia pestis
gccacuucgc

SEQ ID NO: 2245153 - RNA, 14 nt, Yersinia pestis
gccagauuauccag

SEQ ID NO: 2245154 - RNA, 21 nt, Yersinia pestis
gccagauucgcaaagcgggcc

SEQ ID NO: 2245155 - RNA, 21 nt, Yersinia pestis
gccagcagcaaguuagcgaua

SEQ ID NO: 2245156 - RNA, 14 nt, Yersinia pestis
aagagagccauaau

SEQ ID NO: 2245157 - RNA, 19 nt, Yersinia pestis
gcccauauagcggcguuca

SEQ ID NO: 2245158 - RNA, 21 nt, Yersinia pestis
gcccgaucaggugaugucagc

SEQ ID NO: 2245159 - RNA, 16 nt, Yersinia pestis
gcccgccccaauagau

SEQ ID NO: 2245160 - RNA, 21 nt, Yersinia pestis
aagacaccacaucacgcagcg

SEQ ID NO: 2245161 - RNA, 15 nt, Yersinia pestis
gccaugucgaucaug

SEQ ID NO: 2245162 - RNA, 22 nt, Yersinia pestis
gccauuaaggccacugacggua

SEQ ID NO: 2245163 - RNA, 22 nt, Yersinia pestis
gccauugagugcggccacacgg

SEQ ID NO: 2245164 - RNA, 16 nt, Yersinia pestis
gccauugauuggcucc

SEQ ID NO: 2245165 - RNA, 17 nt, Yersinia pestis
gcccacaccaaucagcu

SEQ ID NO: 2245166 - RNA, 15 nt, Yersinia pestis
gcccaagccauccuu

SEQ ID NO: 2245167 - RNA, 15 nt, Yersinia pestis
gcccaaaaucaaaua

SEQ ID NO: 2245168 - RNA, 23 nt, Yersinia pestis
gcccaacgucauuuccguuaacc

SEQ ID NO: 2245169 - RNA, 20 nt, Yersinia pestis
gcccacauaaagauagccac

SEQ ID NO: 2245170 - RNA, 20 nt, Yersinia pestis
gcccagagcgcggcuucagc

SEQ ID NO: 2245171 - RNA, 12 nt, Yersinia pestis
aagcacgauaaa

SEQ ID NO: 2245172 - RNA, 21 nt, Yersinia pestis
gccgcacgaaccguggcgcgg

SEQ ID NO: 2245173 - RNA, 20 nt, Yersinia pestis
gccgauggugugcagcaaga

SEQ ID NO: 2245174 - RNA, 20 nt, Yersinia pestis
aagauuaggggaugacaccu

SEQ ID NO: 2245175 - RNA, 21 nt, Yersinia pestis
aagauugagggcgucucuacg

SEQ ID NO: 2245176 - RNA, 18 nt, Yersinia pestis
gcccuuuuugguuuucua

SEQ ID NO: 2245177 - RNA, 12 nt, Yersinia pestis
gcccgcuaucac

SEQ ID NO: 2245178 - RNA, 21 nt, Yersinia pestis
gccgcuauuggcgagcaugac

SEQ ID NO: 2245179 - RNA, 18 nt, Yersinia pestis
gccgcuaucacaucgccc

SEQ ID NO: 2245180 - RNA, 14 nt, Yersinia pestis
gccgcucgcggaca

SEQ ID NO: 2245181 - RNA, 14 nt, Yersinia pestis
gcuugugcgccaac

SEQ ID NO: 2245182 - RNA, 14 nt, Yersinia pestis
gcuuucaucgauug

SEQ ID NO: 2245183 - RNA, 11 nt, Yersinia pestis
gcuugcugccu

SEQ ID NO: 2245184 - RNA, 16 nt, Yersinia pestis
gcuuggcucaaugugc

SEQ ID NO: 2245185 - RNA, 17 nt, Yersinia pestis
gcuuucucuugccauug

SEQ ID NO: 2245186 - RNA, 13 nt, Yersinia pestis
ggaaaaaucagua

SEQ ID NO: 2245187 - RNA, 16 nt, Yersinia pestis
gcuuccaauauugagc

SEQ ID NO: 2245188 - RNA, 15 nt, Yersinia pestis
gcuuccaucaggaag

SEQ ID NO: 2245189 - RNA, 16 nt, Yersinia pestis
gcuuaacugcacgacg

SEQ ID NO: 2245190 - RNA, 22 nt, Yersinia pestis
gcuguuguaguuagaugacauc

SEQ ID NO: 2245191 - RNA, 13 nt, Yersinia pestis
gcuguuacccaug

SEQ ID NO: 2245192 - RNA, 16 nt, Yersinia pestis
gcuuauuaugacaacu

SEQ ID NO: 2245193 - RNA, 18 nt, Yersinia pestis
gcuucaaaaucaccuggc

SEQ ID NO: 2245194 - RNA, 17 nt, Yersinia pestis
gcuucacccuggcucug

SEQ ID NO: 2245195 - RNA, 19 nt, Yersinia pestis
gcuuaguauccgcgccaga

SEQ ID NO: 2245196 - RNA, 16 nt, Yersinia pestis
gcuuacuuacccgaau

SEQ ID NO: 2245197 - RNA, 20 nt, Yersinia pestis
gcuuauccccugagaaacau

SEQ ID NO: 2245198 - RNA, 22 nt, Yersinia pestis
gcuuaucccuccaucaagccac

SEQ ID NO: 2245199 - RNA, 15 nt, Yersinia pestis
gcuuauccugcaacc

SEQ ID NO: 2245200 - RNA, 15 nt, Yersinia pestis
gcugauaugaaaaau

SEQ ID NO: 2245201 - RNA, 16 nt, Yersinia pestis
gcugauaaccagccaa

SEQ ID NO: 2245202 - RNA, 19 nt, Yersinia pestis
gcugaucaucaucaaugga

SEQ ID NO: 2245203 - RNA, 15 nt, Yersinia pestis
gcugaucugccccug

SEQ ID NO: 2245204 - RNA, 17 nt, Yersinia pestis
gcucguuggccggaugc

SEQ ID NO: 2245205 - RNA, 16 nt, Yersinia pestis
gcugcaacgcagacau

SEQ ID NO: 2245206 - RNA, 15 nt, Yersinia pestis
gcugcaauaagccag

SEQ ID NO: 2245207 - RNA, 17 nt, Yersinia pestis
gcucagggccacuucgg

SEQ ID NO: 2245208 - RNA, 18 nt, Yersinia pestis
gcucaguucgguugccaa

SEQ ID NO: 2245209 - RNA, 20 nt, Yersinia pestis
gcucaguucgguugccaaaa

SEQ ID NO: 2245210 - RNA, 23 nt, Yersinia pestis
gcuccaaauuaauagguuggcau

SEQ ID NO: 2245211 - RNA, 15 nt, Yersinia pestis
gcucccuccgccagc

SEQ ID NO: 2245212 - RNA, 20 nt, Yersinia pestis
aagcgcgacgguacugauca

SEQ ID NO: 2245213 - RNA, 23 nt, Yersinia pestis
aagcgccguaaaaagcagcaaac

SEQ ID NO: 2245214 - RNA, 21 nt, Yersinia pestis
gcggcauaaauucuagcaaca

SEQ ID NO: 2245215 - RNA, 21 nt, Yersinia pestis
aagcggaucggguugaugaug

SEQ ID NO: 2245216 - RNA, 20 nt, Yersinia pestis
aagcguaggggacauugagg

SEQ ID NO: 2245217 - RNA, 13 nt, Yersinia pestis
gcggcugguaaca

SEQ ID NO: 2245218 - RNA, 16 nt, Yersinia pestis
gcgguuuuaucaauag

SEQ ID NO: 2245219 - RNA, 21 nt, Yersinia pestis
gcgugauauccccaccguggc

SEQ ID NO: 2245220 - RNA, 20 nt, Yersinia pestis
gcgucuuuacgaucugccug

SEQ ID NO: 2245221 - RNA, 22 nt, Yersinia pestis
gcgugauuccgguacugugcug

SEQ ID NO: 2245222 - RNA, 21 nt, Yersinia pestis
gcguacuguuaguucagacgu

SEQ ID NO: 2245223 - RNA, 24 nt, Yersinia pestis
gcgaaggugugcucacaaucuucu

SEQ ID NO: 2245224 - RNA, 18 nt, Yersinia pestis
gcgaauccccccauucac

SEQ ID NO: 2245225 - RNA, 19 nt, Yersinia pestis
gccuuucagcgcugcgccc

SEQ ID NO: 2245226 - RNA, 19 nt, Yersinia pestis
gccuuuucuuccgccagca

SEQ ID NO: 2245227 - RNA, 23 nt, Yersinia pestis
gccuguuagggcgcggcugguaa

SEQ ID NO: 2245228 - RNA, 18 nt, Yersinia pestis
gccuucauguugcaacau

SEQ ID NO: 2245229 - RNA, 16 nt, Yersinia pestis
aagcccccguaucaug

SEQ ID NO: 2245230 - RNA, 15 nt, Yersinia pestis
gccuagcccaguacc

SEQ ID NO: 2245231 - RNA, 20 nt, Yersinia pestis
gccuaaaaugaauaacgccg

SEQ ID NO: 2245232 - RNA, 20 nt, Yersinia pestis
gccguuuugcucgggcucuc

SEQ ID NO: 2245233 - RNA, 19 nt, Yersinia pestis
gccguguugcaucauuggc

SEQ ID NO: 2245234 - RNA, 17 nt, Yersinia pestis
gccuauaccugcgaaca

SEQ ID NO: 2245235 - RNA, 17 nt, Yersinia pestis
gccguaaauacauccau

SEQ ID NO: 2245236 - RNA, 22 nt, Yersinia pestis
gccguaaugacucgauaaccca

SEQ ID NO: 2245237 - RNA, 13 nt, Yersinia pestis
gcgcagccaacgg

SEQ ID NO: 2245238 - RNA, 21 nt, Yersinia pestis
gcgcauuucacccucugcagc

SEQ ID NO: 2245239 - RNA, 15 nt, Yersinia pestis
gcgcccgccagguau

SEQ ID NO: 2245240 - RNA, 18 nt, Yersinia pestis
gcgccccgcaacgccgau

SEQ ID NO: 2245241 - RNA, 12 nt, Yersinia pestis
gcgcguuggcag

SEQ ID NO: 2245242 - RNA, 18 nt, Yersinia pestis
guccaacaucuccgccaa

SEQ ID NO: 2245243 - RNA, 15 nt, Yersinia pestis
gucauuaccaauggu

SEQ ID NO: 2245244 - RNA, 20 nt, Yersinia pestis
gucauugguuaacuuauagc

SEQ ID NO: 2245245 - RNA, 17 nt, Yersinia pestis
gucauuuuauuagacau

SEQ ID NO: 2245246 - RNA, 14 nt, Yersinia pestis
guccagaucggcaa

SEQ ID NO: 2245247 - RNA, 19 nt, Yersinia pestis
gucaucgucggcccggcca

SEQ ID NO: 2245248 - RNA, 21 nt, Yersinia pestis
gucccuaaagccaucgccauc

SEQ ID NO: 2245249 - RNA, 22 nt, Yersinia pestis
gugagagaagaucacgcuaccg

SEQ ID NO: 2245250 - RNA, 17 nt, Yersinia pestis
gugacccaagaugacca

SEQ ID NO: 2245251 - RNA, 17 nt, Yersinia pestis
gugaagacaucgccaga

SEQ ID NO: 2245252 - RNA, 15 nt, Yersinia pestis
gucuucaguggcugg

SEQ ID NO: 2245253 - RNA, 17 nt, Yersinia pestis
gucuugaucaacucacg

SEQ ID NO: 2245254 - RNA, 15 nt, Yersinia pestis
gucuggugcugguaa

SEQ ID NO: 2245255 - RNA, 16 nt, Yersinia pestis
gucuauagugccuaau

SEQ ID NO: 2245256 - RNA, 14 nt, Yersinia pestis
gucuauugcccguu

SEQ ID NO: 2245257 - RNA, 18 nt, Yersinia pestis
gucucuacgacgcccgca

SEQ ID NO: 2245258 - RNA, 15 nt, Yersinia pestis
aagucucuagaauuc

SEQ ID NO: 2245259 - RNA, 13 nt, Yersinia pestis
guauagcaugaau

SEQ ID NO: 2245260 - RNA, 19 nt, Yersinia pestis
guaucccggugaucaucgc

SEQ ID NO: 2245261 - RNA, 13 nt, Yersinia pestis
guacuuggucacu

SEQ ID NO: 2245262 - RNA, 19 nt, Yersinia pestis
guagaccaccaacuccugc

SEQ ID NO: 2245263 - RNA, 15 nt, Yersinia pestis
guagacauggcaacg

SEQ ID NO: 2245264 - RNA, 22 nt, Yersinia pestis
guagaucccgugugauuuccau

SEQ ID NO: 2245265 - RNA, 14 nt, Yersinia pestis
guagaguugcaguu

SEQ ID NO: 2245266 - RNA, 19 nt, Yersinia pestis
guacagcguuggucagcaa

SEQ ID NO: 2245267 - RNA, 18 nt, Yersinia pestis
guaccgcauaagacacca

SEQ ID NO: 2245268 - RNA, 23 nt, Yersinia pestis
guaccggcuccugccgcauccca

SEQ ID NO: 2245269 - RNA, 22 nt, Yersinia pestis
guacgugacggcggcgagcacu

SEQ ID NO: 2245270 - RNA, 17 nt, Yersinia pestis
guacgcugauagccaau

SEQ ID NO: 2245271 - RNA, 17 nt, Yersinia pestis
gguuucagcuugcaaca

SEQ ID NO: 2245272 - RNA, 23 nt, Yersinia pestis
guaaugucacugccaucucaugu

SEQ ID NO: 2245273 - RNA, 18 nt, Yersinia pestis
guaaucuuugagcaccgc

SEQ ID NO: 2245274 - RNA, 19 nt, Yersinia pestis
guaacgcagauaaaucagu

SEQ ID NO: 2245275 - RNA, 16 nt, Yersinia pestis
guaacgaauucagcag

SEQ ID NO: 2245276 - RNA, 18 nt, Yersinia pestis
guaaccgcaaggauacca

SEQ ID NO: 2245277 - RNA, 22 nt, Yersinia pestis
gguuaacagccccgucucaaca

SEQ ID NO: 2245278 - RNA, 19 nt, Yersinia pestis
gguuagagcggaugauucg

SEQ ID NO: 2245279 - RNA, 17 nt, Yersinia pestis
gguuagauuacagccua

SEQ ID NO: 2245280 - RNA, 21 nt, Yersinia pestis
gguuacgggcuugcugcaacc

SEQ ID NO: 2245281 - RNA, 13 nt, Yersinia pestis
gguuauugacaaa

SEQ ID NO: 2245282 - RNA, 18 nt, Yersinia pestis
gguucuaaauccugcaaa

SEQ ID NO: 2245283 - RNA, 19 nt, Yersinia pestis
gguugccaaagcugcgcca

SEQ ID NO: 2245284 - RNA, 15 nt, Yersinia pestis
gguuuaucaggugaa

SEQ ID NO: 2245285 - RNA, 22 nt, Yersinia pestis
gguuucaccuaucgguaucucc

SEQ ID NO: 2245286 - RNA, 16 nt, Yersinia pestis
gguacguugucaauaa

SEQ ID NO: 2245287 - RNA, 24 nt, Yersinia pestis
gguagaccaccaacuccugccuac

SEQ ID NO: 2245288 - RNA, 14 nt, Yersinia pestis
ggguaacgccauag

SEQ ID NO: 2245289 - RNA, 11 nt, Yersinia pestis
gggucaggaag

SEQ ID NO: 2245290 - RNA, 17 nt, Yersinia pestis
ggugaacauuuaucuau

SEQ ID NO: 2245291 - RNA, 13 nt, Yersinia pestis
ggucagcggagca

SEQ ID NO: 2245292 - RNA, 17 nt, Yersinia pestis
ggcuuucugccuguggg

SEQ ID NO: 2245293 - RNA, 17 nt, Yersinia pestis
ggcuuuugggucagggu

SEQ ID NO: 2245294 - RNA, 12 nt, Yersinia pestis
ggcuugcugcaa

SEQ ID NO: 2245295 - RNA, 12 nt, Yersinia pestis
ggcuugcggcaa

SEQ ID NO: 2245296 - RNA, 19 nt, Yersinia pestis
ggcuugcucaauaccauug

SEQ ID NO: 2245297 - RNA, 22 nt, Yersinia pestis
ggcuggcaccgguggucgcgau

SEQ ID NO: 2245298 - RNA, 21 nt, Yersinia pestis
ggcuggaaaaaauaauggcca

SEQ ID NO: 2245299 - RNA, 17 nt, Yersinia pestis
ggcugcaauaagccaga

SEQ ID NO: 2245300 - RNA, 17 nt, Yersinia pestis
ggcugcugcagccggga

SEQ ID NO: 2245301 - RNA, 14 nt, Yersinia pestis
ggcugccuuccugc

SEQ ID NO: 2245302 - RNA, 22 nt, Yersinia pestis
ggcucuggguuaccugccuuca

SEQ ID NO: 2245303 - RNA, 17 nt, Yersinia pestis
ggcucuggcaauggcua

SEQ ID NO: 2245304 - RNA, 18 nt, Yersinia pestis
ggcucgcccacggcacau

SEQ ID NO: 2245305 - RNA, 16 nt, Yersinia pestis
ggcucgcgauaucugc

SEQ ID NO: 2245306 - RNA, 24 nt, Yersinia pestis
ggcuaaauccacacgcgagcauaa

SEQ ID NO: 2245307 - RNA, 20 nt, Yersinia pestis
ggcuaaccagugucuggcaa

SEQ ID NO: 2245308 - RNA, 22 nt, Yersinia pestis
ggcuaaccagugucuggcaauc

SEQ ID NO: 2245309 - RNA, 21 nt, Yersinia pestis
ggcuaagccgcaauaaauggc

SEQ ID NO: 2245310 - RNA, 16 nt, Yersinia pestis
ggcguggcacaccgcu

SEQ ID NO: 2245311 - RNA, 17 nt, Yersinia pestis
ggcgucuuuacgaucug

SEQ ID NO: 2245312 - RNA, 17 nt, Yersinia pestis
ggaugaugcacagcugg

SEQ ID NO: 2245313 - RNA, 20 nt, Yersinia pestis
ggaugcccacacugccgaca

SEQ ID NO: 2245314 - RNA, 20 nt, Yersinia pestis
ggaugaucggcauaaauggc

SEQ ID NO: 2245315 - RNA, 15 nt, Yersinia pestis
ggaugaauaaaugac

SEQ ID NO: 2245316 - RNA, 18 nt, Yersinia pestis
ggcaauguugagaaauau

SEQ ID NO: 2245317 - RNA, 16 nt, Yersinia pestis
ggcacauacuaauaga

SEQ ID NO: 2245318 - RNA, 18 nt, Yersinia pestis
ggcaacugccgcuucagu

SEQ ID NO: 2245319 - RNA, 19 nt, Yersinia pestis
ggcaaaacucaggugagua

SEQ ID NO: 2245320 - RNA, 19 nt, Yersinia pestis
ggcaaacucagccaucagu

SEQ ID NO: 2245321 - RNA, 15 nt, Yersinia pestis
ggcaaagucaucaaa

SEQ ID NO: 2245322 - RNA, 16 nt, Yersinia pestis
ggcaaccaguuauagc

SEQ ID NO: 2245323 - RNA, 14 nt, Yersinia pestis
ggcauaaauggcua

SEQ ID NO: 2245324 - RNA, 19 nt, Yersinia pestis
ggcauaaauucuagcaaca

SEQ ID NO: 2245325 - RNA, 22 nt, Yersinia pestis
ggcaucuaccuguguugcgcca

SEQ ID NO: 2245326 - RNA, 21 nt, Yersinia pestis
ggcauugaccaaagcggaucg

SEQ ID NO: 2245327 - RNA, 19 nt, Yersinia pestis
ggcauuaaguggcgguuca

SEQ ID NO: 2245328 - RNA, 17 nt, Yersinia pestis
ggcccgcuagugauagc

SEQ ID NO: 2245329 - RNA, 19 nt, Yersinia pestis
ggccgacucugcaugauag

SEQ ID NO: 2245330 - RNA, 18 nt, Yersinia pestis
ggccgagacaccauguug

SEQ ID NO: 2245331 - RNA, 14 nt, Yersinia pestis
ggccgguuaauuga

SEQ ID NO: 2245332 - RNA, 20 nt, Yersinia pestis
ggccgccuucuuuuuacugc

SEQ ID NO: 2245333 - RNA, 21 nt, Yersinia pestis
ggccgcgaauaacagacguua

SEQ ID NO: 2245334 - RNA, 17 nt, Yersinia pestis
auggauugaaaccgcug

SEQ ID NO: 2245335 - RNA, 19 nt, Yersinia pestis
auggauuaucgccuggcuu

SEQ ID NO: 2245336 - RNA, 15 nt, Yersinia pestis
auggaugugauccac

SEQ ID NO: 2245337 - RNA, 18 nt, Yersinia pestis
augcugaccccaaauuug

SEQ ID NO: 2245338 - RNA, 18 nt, Yersinia pestis
augcucuuuuuaugcagg

SEQ ID NO: 2245339 - RNA, 22 nt, Yersinia pestis
auggcaggucucgcaaugaaag

SEQ ID NO: 2245340 - RNA, 22 nt, Yersinia pestis
auggcggucgcacugugagcgg

SEQ ID NO: 2245341 - RNA, 20 nt, Yersinia pestis
auggcgguauagaccaauuc

SEQ ID NO: 2245342 - RNA, 21 nt, Yersinia pestis
augguuaaaacucaaacugau

SEQ ID NO: 2245343 - RNA, 15 nt, Yersinia pestis
auguaacacacagca

SEQ ID NO: 2245344 - RNA, 19 nt, Yersinia pestis
augucaugcaauuacugca

SEQ ID NO: 2245345 - RNA, 17 nt, Yersinia pestis
augcgcccgcgcaggca

SEQ ID NO: 2245346 - RNA, 17 nt, Yersinia pestis
augccacccccagugcu

SEQ ID NO: 2245347 - RNA, 16 nt, Yersinia pestis
augccacuucgcuacg

SEQ ID NO: 2245348 - RNA, 17 nt, Yersinia pestis
augccaguaauucacug

SEQ ID NO: 2245349 - RNA, 16 nt, Yersinia pestis
augcccagcguuggca

SEQ ID NO: 2245350 - RNA, 13 nt, Yersinia pestis
aucgacaauggcu

SEQ ID NO: 2245351 - RNA, 19 nt, Yersinia pestis
aucgggcguuggaggcuuu

SEQ ID NO: 2245352 - RNA, 21 nt, Yersinia pestis
aucguaacccccagccagaau

SEQ ID NO: 2245353 - RNA, 13 nt, Yersinia pestis
aucgguuucaguu

SEQ ID NO: 2245354 - RNA, 19 nt, Yersinia pestis
aucucuggcaacggcacau

SEQ ID NO: 2245355 - RNA, 16 nt, Yersinia pestis
aucugaaacggugagg

SEQ ID NO: 2245356 - RNA, 18 nt, Yersinia pestis
aucucuucgccuuugaug

SEQ ID NO: 2245357 - RNA, 12 nt, Yersinia pestis
aucugagccuuc

SEQ ID NO: 2245358 - RNA, 15 nt, Yersinia pestis
aucugcauaccugga

SEQ ID NO: 2245359 - RNA, 22 nt, Yersinia pestis
aucugcacuguaauugcgucag

SEQ ID NO: 2245360 - RNA, 21 nt, Yersinia pestis
aucugccgggaggauaaguuc

SEQ ID NO: 2245361 - RNA, 20 nt, Yersinia pestis
aucucacucaggcgugucau

SEQ ID NO: 2245362 - RNA, 21 nt, Yersinia pestis
aucguggagacgccuucacgg

SEQ ID NO: 2245363 - RNA, 22 nt, Yersinia pestis
augagagcgaauggcaauggcc

SEQ ID NO: 2245364 - RNA, 16 nt, Yersinia pestis
augagaaccaguucug

SEQ ID NO: 2245365 - RNA, 14 nt, Yersinia pestis
augagcaugccuga

SEQ ID NO: 2245366 - RNA, 15 nt, Yersinia pestis
augagccuuaccccu

SEQ ID NO: 2245367 - RNA, 13 nt, Yersinia pestis
augauuaaauggu

SEQ ID NO: 2245368 - RNA, 20 nt, Yersinia pestis
augcaaaaaaagacacuaac

SEQ ID NO: 2245369 - RNA, 22 nt, Yersinia pestis
augaauaacgccggcgccauug

SEQ ID NO: 2245370 - RNA, 18 nt, Yersinia pestis
augaacggauacccagca

SEQ ID NO: 2245371 - RNA, 13 nt, Yersinia pestis
augacaguauuug

SEQ ID NO: 2245372 - RNA, 22 nt, Yersinia pestis
augacagacgcgguuaacgacg

SEQ ID NO: 2245373 - RNA, 20 nt, Yersinia pestis
aucugggugagagguugcaa

SEQ ID NO: 2245374 - RNA, 20 nt, Yersinia pestis
augaaaaacagauauacggc

SEQ ID NO: 2245375 - RNA, 15 nt, Yersinia pestis
augaaaaccggcauu

SEQ ID NO: 2245376 - RNA, 22 nt, Yersinia pestis
augaaaucuaacgugaucgccg

SEQ ID NO: 2245377 - RNA, 17 nt, Yersinia pestis
aaacuaccgaucaucag

SEQ ID NO: 2245378 - RNA, 21 nt, Yersinia pestis
auucauugccgaugucaauaa

SEQ ID NO: 2245379 - RNA, 18 nt, Yersinia pestis
auucauuggcgguugagu

SEQ ID NO: 2245380 - RNA, 16 nt, Yersinia pestis
auucagguugagcauc

SEQ ID NO: 2245381 - RNA, 15 nt, Yersinia pestis
auucacgcaaggcca

SEQ ID NO: 2245382 - RNA, 19 nt, Yersinia pestis
auucagacgacgugcagcg

SEQ ID NO: 2245383 - RNA, 20 nt, Yersinia pestis
aaacugaucaucaacgcgcc

SEQ ID NO: 2245384 - RNA, 22 nt, Yersinia pestis
aaacucuuguguugggcaguaa

SEQ ID NO: 2245385 - RNA, 21 nt, Yersinia pestis
auucaccguguuucagcauca

SEQ ID NO: 2245386 - RNA, 15 nt, Yersinia pestis
auucacgagcuaacg

SEQ ID NO: 2245387 - RNA, 19 nt, Yersinia pestis
auuaucuuauccacagcau

SEQ ID NO: 2245388 - RNA, 20 nt, Yersinia pestis
auuagagguuauugacaaag

SEQ ID NO: 2245389 - RNA, 21 nt, Yersinia pestis
auuagagguuauugacaaaga

SEQ ID NO: 2245390 - RNA, 17 nt, Yersinia pestis
auuagcaguaacgucca

SEQ ID NO: 2245391 - RNA, 21 nt, Yersinia pestis
auuaaugucgccauaacgcac

SEQ ID NO: 2245392 - RNA, 18 nt, Yersinia pestis
auuaaucuauuaauaucg

SEQ ID NO: 2245393 - RNA, 13 nt, Yersinia pestis
auuaccgcacacu

SEQ ID NO: 2245394 - RNA, 20 nt, Yersinia pestis
auuacacacccucaacucaa

SEQ ID NO: 2245395 - RNA, 15 nt, Yersinia pestis
auuaauaucagcgau

SEQ ID NO: 2245396 - RNA, 20 nt, Yersinia pestis
augucgcccccucuggcaua

SEQ ID NO: 2245397 - RNA, 21 nt, Yersinia pestis
auugugucaauaccuuacugu

SEQ ID NO: 2245398 - RNA, 19 nt, Yersinia pestis
auuuaaucgcucauccaua

SEQ ID NO: 2245399 - RNA, 23 nt, Yersinia pestis
auuucacuggccuauuaagauaa

SEQ ID NO: 2245400 - RNA, 16 nt, Yersinia pestis
auuuauauaaggucaa

SEQ ID NO: 2245401 - RNA, 18 nt, Yersinia pestis
auuuaucccgagcuaacg

SEQ ID NO: 2245402 - RNA, 19 nt, Yersinia pestis
auuuaucgccaagccagua

SEQ ID NO: 2245403 - RNA, 16 nt, Yersinia pestis
auuuauuggucaauaa

SEQ ID NO: 2245404 - RNA, 16 nt, Yersinia pestis
auuucuccauugcggu

SEQ ID NO: 2245405 - RNA, 17 nt, Yersinia pestis
auuucgccuuucauaca

SEQ ID NO: 2245406 - RNA, 14 nt, Yersinia pestis
auuucauaccgcug

SEQ ID NO: 2245407 - RNA, 14 nt, Yersinia pestis
auuucagucaauaa

SEQ ID NO: 2245408 - RNA, 22 nt, Yersinia pestis
auuucccccaccugauaagccg

SEQ ID NO: 2245409 - RNA, 16 nt, Yersinia pestis
auuucccguugauauc

SEQ ID NO: 2245410 - RNA, 21 nt, Yersinia pestis
auugcguaauuacccaagauc

SEQ ID NO: 2245411 - RNA, 15 nt, Yersinia pestis
auugcguuaccuaaa

SEQ ID NO: 2245412 - RNA, 16 nt, Yersinia pestis
auugcgcuaacagcgu

SEQ ID NO: 2245413 - RNA, 16 nt, Yersinia pestis
auugcccgguaacaua

SEQ ID NO: 2245414 - RNA, 16 nt, Yersinia pestis
caaaucccgcuggaag

SEQ ID NO: 2245415 - RNA, 23 nt, Yersinia pestis
caaauuagcgucuuuaacgcugc

SEQ ID NO: 2245416 - RNA, 19 nt, Yersinia pestis
caacaccacacugagcacc

SEQ ID NO: 2245417 - RNA, 20 nt, Yersinia pestis
caaaauugagauaacgcuga

SEQ ID NO: 2245418 - RNA, 14 nt, Yersinia pestis
caaacaucgguaaa

SEQ ID NO: 2245419 - RNA, 21 nt, Yersinia pestis
caaaaugcgguggcacugacg

SEQ ID NO: 2245420 - RNA, 16 nt, Yersinia pestis
caaaaugccuaccguu

SEQ ID NO: 2245421 - RNA, 16 nt, Yersinia pestis
caaaccaucgcucucc

SEQ ID NO: 2245422 - RNA, 14 nt, Yersinia pestis
caaaccgaauacca

SEQ ID NO: 2245423 - RNA, 20 nt, Yersinia pestis
caaaccgcuggugacggcuu

SEQ ID NO: 2245424 - RNA, 17 nt, Yersinia pestis
caaaccgggguucgcaa

SEQ ID NO: 2245425 - RNA, 21 nt, Yersinia pestis
caaacucaugcucuucauaag

SEQ ID NO: 2245426 - RNA, 16 nt, Yersinia pestis
caaacguauugguaac

SEQ ID NO: 2245427 - RNA, 20 nt, Yersinia pestis
caaacgcugauuaaccugua

SEQ ID NO: 2245428 - RNA, 14 nt, Yersinia pestis
caaacgcuugagcu

SEQ ID NO: 2245429 - RNA, 16 nt, Yersinia pestis
caaacgcucaguuaaa

SEQ ID NO: 2245430 - RNA, 17 nt, Yersinia pestis
auuugaaaugcauuggu

SEQ ID NO: 2245431 - RNA, 20 nt, Yersinia pestis
auuucuugaugucggguggu

SEQ ID NO: 2245432 - RNA, 18 nt, Yersinia pestis
auuucugcuucuacccug

SEQ ID NO: 2245433 - RNA, 22 nt, Yersinia pestis
auuuuacuguucugggggugau

SEQ ID NO: 2245434 - RNA, 16 nt, Yersinia pestis
auuuucucgcggggau

SEQ ID NO: 2245435 - RNA, 22 nt, Yersinia pestis
auuuucguggaaaucgggugau

SEQ ID NO: 2245436 - RNA, 12 nt, Yersinia pestis
auuuucggguau

SEQ ID NO: 2245437 - RNA, 16 nt, Yersinia pestis
auuuucggguaucugu

SEQ ID NO: 2245438 - RNA, 12 nt, Yersinia pestis
caaaacagccua

SEQ ID NO: 2245439 - RNA, 17 nt, Yersinia pestis
caaaaaacugcggcaau

SEQ ID NO: 2245440 - RNA, 15 nt, Yersinia pestis
caaaaaaccggcucc

SEQ ID NO: 2245441 - RNA, 16 nt, Yersinia pestis
caaaacgaacacugca

SEQ ID NO: 2245442 - RNA, 11 nt, Yersinia pestis
caaaacucaug

SEQ ID NO: 2245443 - RNA, 17 nt, Yersinia pestis
caaaacucccuguuacg

SEQ ID NO: 2245444 - RNA, 20 nt, Yersinia pestis
auuuuggguauauacucugu

SEQ ID NO: 2245445 - RNA, 15 nt, Yersinia pestis
auuuugccggggagu

SEQ ID NO: 2245446 - RNA, 20 nt, Yersinia pestis
caaaaaaacugacugccaua

SEQ ID NO: 2245447 - RNA, 14 nt, Yersinia pestis
caauaauaagccgc

SEQ ID NO: 2245448 - RNA, 17 nt, Yersinia pestis
caaggguauaacucauc

SEQ ID NO: 2245449 - RNA, 23 nt, Yersinia pestis
caagcggcuggcccccaaugaca

SEQ ID NO: 2245450 - RNA, 21 nt, Yersinia pestis
caagcgggccaaggggagcca

SEQ ID NO: 2245451 - RNA, 18 nt, Yersinia pestis
caacuuuuauuggcauua

SEQ ID NO: 2245452 - RNA, 19 nt, Yersinia pestis
caacuuuuuucauccuaaa

SEQ ID NO: 2245453 - RNA, 15 nt, Yersinia pestis
caacuuggcaccuaa

SEQ ID NO: 2245454 - RNA, 14 nt, Yersinia pestis
caagccaaugaauc

SEQ ID NO: 2245455 - RNA, 15 nt, Yersinia pestis
caacuuagccuacuc

SEQ ID NO: 2245456 - RNA, 21 nt, Yersinia pestis
caacucggccgcuaagucacg

SEQ ID NO: 2245457 - RNA, 13 nt, Yersinia pestis
caacucuacauug

SEQ ID NO: 2245458 - RNA, 16 nt, Yersinia pestis
caaugagacaagagca

SEQ ID NO: 2245459 - RNA, 23 nt, Yersinia pestis
caaugaccuuacagugauaauca

SEQ ID NO: 2245460 - RNA, 13 nt, Yersinia pestis
caaugaauaccca

SEQ ID NO: 2245461 - RNA, 19 nt, Yersinia pestis
caaugacacaagauugaug

SEQ ID NO: 2245462 - RNA, 21 nt, Yersinia pestis
caaugaaauauggugauaacu

SEQ ID NO: 2245463 - RNA, 17 nt, Yersinia pestis
caaugagugauauccgc

SEQ ID NO: 2245464 - RNA, 13 nt, Yersinia pestis
caaugccuuggca

SEQ ID NO: 2245465 - RNA, 16 nt, Yersinia pestis
caauggucaugcacag

SEQ ID NO: 2245466 - RNA, 22 nt, Yersinia pestis
caauaccuuacuguaucaauac

SEQ ID NO: 2245467 - RNA, 15 nt, Yersinia pestis
caauaauuucacuau

SEQ ID NO: 2245468 - RNA, 18 nt, Yersinia pestis
caaucauucugucaucaa

SEQ ID NO: 2245469 - RNA, 21 nt, Yersinia pestis
caaucauagccaucccaauaa

SEQ ID NO: 2245470 - RNA, 16 nt, Yersinia pestis
caauuucucggccaac

SEQ ID NO: 2245471 - RNA, 15 nt, Yersinia pestis
cacaaaugcugugcc

SEQ ID NO: 2245472 - RNA, 20 nt, Yersinia pestis
caauugcagacgacggaacc

SEQ ID NO: 2245473 - RNA, 20 nt, Yersinia pestis
caauggugcccaucacaucg

SEQ ID NO: 2245474 - RNA, 19 nt, Yersinia pestis
cacaauccaauuuaccacu

SEQ ID NO: 2245475 - RNA, 21 nt, Yersinia pestis
cacaaucagcccgauggcaaa

SEQ ID NO: 2245476 - RNA, 23 nt, Yersinia pestis
cacaauagcuaccccuucaguca

SEQ ID NO: 2245477 - RNA, 19 nt, Yersinia pestis
cacaauagaugcaguaacg

SEQ ID NO: 2245478 - RNA, 12 nt, Yersinia pestis
cacaauaagccc

SEQ ID NO: 2245479 - RNA, 15 nt, Yersinia pestis
caccacuuugcugug

SEQ ID NO: 2245480 - RNA, 21 nt, Yersinia pestis
caccagagaccacagauaaau

SEQ ID NO: 2245481 - RNA, 18 nt, Yersinia pestis
caccagagaugauagcaa

SEQ ID NO: 2245482 - RNA, 18 nt, Yersinia pestis
caccacgaaaaaauggca

SEQ ID NO: 2245483 - RNA, 15 nt, Yersinia pestis
caccacugucagggc

SEQ ID NO: 2245484 - RNA, 20 nt, Yersinia pestis
cacccaccuuuugcgcgaua

SEQ ID NO: 2245485 - RNA, 17 nt, Yersinia pestis
cacccaacucaacggca

SEQ ID NO: 2245486 - RNA, 19 nt, Yersinia pestis
caccaagaggaaaugccgc

SEQ ID NO: 2245487 - RNA, 15 nt, Yersinia pestis
caccaagacugaagu

SEQ ID NO: 2245488 - RNA, 19 nt, Yersinia pestis
caccaaucauuacaucauc

SEQ ID NO: 2245489 - RNA, 18 nt, Yersinia pestis
caccaauagcgaucagca

SEQ ID NO: 2245490 - RNA, 12 nt, Yersinia pestis
caccaaugccgg

SEQ ID NO: 2245491 - RNA, 17 nt, Yersinia pestis
cacagcggcggauaaau

SEQ ID NO: 2245492 - RNA, 12 nt, Yersinia pestis
caccaaccgguu

SEQ ID NO: 2245493 - RNA, 20 nt, Yersinia pestis
cacacguguacucauauugu

SEQ ID NO: 2245494 - RNA, 18 nt, Yersinia pestis
cacagagcgggaacgcca

SEQ ID NO: 2245495 - RNA, 12 nt, Yersinia pestis
cacagcgcgaca

SEQ ID NO: 2245496 - RNA, 12 nt, Yersinia pestis
cacgaucagcuc

SEQ ID NO: 2245497 - RNA, 19 nt, Yersinia pestis
cacgaucaucaacucgcca

SEQ ID NO: 2245498 - RNA, 17 nt, Yersinia pestis
caccugcgguugcugug

SEQ ID NO: 2245499 - RNA, 12 nt, Yersinia pestis
cacgaugccagu

SEQ ID NO: 2245500 - RNA, 15 nt, Yersinia pestis
cacgcagagaugaau

SEQ ID NO: 2245501 - RNA, 18 nt, Yersinia pestis
caccugacgaaaugccgc

SEQ ID NO: 2245502 - RNA, 13 nt, Yersinia pestis
caccuccgcaucc

SEQ ID NO: 2245503 - RNA, 22 nt, Yersinia pestis
caccgagcaccaauauugcgga

SEQ ID NO: 2245504 - RNA, 22 nt, Yersinia pestis
agcuugggcgauagucggcauu

SEQ ID NO: 2245505 - RNA, 13 nt, Yersinia pestis
agcuugcaacaaa

SEQ ID NO: 2245506 - RNA, 21 nt, Yersinia pestis
aggaaggcgguuaucuggaau

SEQ ID NO: 2245507 - RNA, 22 nt, Yersinia pestis
aggaaauacaggcuauauugcu

SEQ ID NO: 2245508 - RNA, 15 nt, Yersinia pestis
aggcaaggccguuua

SEQ ID NO: 2245509 - RNA, 20 nt, Yersinia pestis
aggcacccgagcacugcgcg

SEQ ID NO: 2245510 - RNA, 23 nt, Yersinia pestis
aggagagauuggcgguaucuuau

SEQ ID NO: 2245511 - RNA, 14 nt, Yersinia pestis
aaacggcgguuaau

SEQ ID NO: 2245512 - RNA, 21 nt, Yersinia pestis
aggauaggguuuuuugaacaa

SEQ ID NO: 2245513 - RNA, 17 nt, Yersinia pestis
agcuaaugcucgcucau

SEQ ID NO: 2245514 - RNA, 14 nt, Yersinia pestis
agcuaacagugacc

SEQ ID NO: 2245515 - RNA, 20 nt, Yersinia pestis
agcgugguauaaauggcacu

SEQ ID NO: 2245516 - RNA, 18 nt, Yersinia pestis
agcguaggggacauugag

SEQ ID NO: 2245517 - RNA, 19 nt, Yersinia pestis
agcguauguuccugaaugg

SEQ ID NO: 2245518 - RNA, 18 nt, Yersinia pestis
agcguauuuugucaugaa

SEQ ID NO: 2245519 - RNA, 14 nt, Yersinia pestis
agcggcuagcagca

SEQ ID NO: 2245520 - RNA, 21 nt, Yersinia pestis
agcggaugauaaauaucauua

SEQ ID NO: 2245521 - RNA, 18 nt, Yersinia pestis
agcgccgugcauaaugga

SEQ ID NO: 2245522 - RNA, 22 nt, Yersinia pestis
agcaugcuaacuuguucagaaa

SEQ ID NO: 2245523 - RNA, 14 nt, Yersinia pestis
agcauauucaguaa

SEQ ID NO: 2245524 - RNA, 17 nt, Yersinia pestis
agcaucaauaucgccac

SEQ ID NO: 2245525 - RNA, 18 nt, Yersinia pestis
agcauuuucagcaacuga

SEQ ID NO: 2245526 - RNA, 24 nt, Yersinia pestis
agccacgcguaaucauagccauca

SEQ ID NO: 2245527 - RNA, 16 nt, Yersinia pestis
agccacgaucaacagu

SEQ ID NO: 2245528 - RNA, 14 nt, Yersinia pestis
agccacuacugaac

SEQ ID NO: 2245529 - RNA, 16 nt, Yersinia pestis
agccagccuuaacugc

SEQ ID NO: 2245530 - RNA, 12 nt, Yersinia pestis
agccauaacuuc

SEQ ID NO: 2245531 - RNA, 14 nt, Yersinia pestis
agccauaacuucug

SEQ ID NO: 2245532 - RNA, 16 nt, Yersinia pestis
agauucaucaccaguc

SEQ ID NO: 2245533 - RNA, 16 nt, Yersinia pestis
agcaguugcugcucug

SEQ ID NO: 2245534 - RNA, 11 nt, Yersinia pestis
agccaucgcca

SEQ ID NO: 2245535 - RNA, 15 nt, Yersinia pestis
agccauggcuuuagg

SEQ ID NO: 2245536 - RNA, 14 nt, Yersinia pestis
agccauugauuggc

SEQ ID NO: 2245537 - RNA, 18 nt, Yersinia pestis
agcccuacuggcugaagu

SEQ ID NO: 2245538 - RNA, 17 nt, Yersinia pestis
agccgcaggcaaacaau

SEQ ID NO: 2245539 - RNA, 23 nt, Yersinia pestis
agccgcgaugccaucgcuuuggc

SEQ ID NO: 2245540 - RNA, 13 nt, Yersinia pestis
agccgcgccaucc

SEQ ID NO: 2245541 - RNA, 20 nt, Yersinia pestis
agccugaauuuccugcgcuu

SEQ ID NO: 2245542 - RNA, 22 nt, Yersinia pestis
agccucuguaaaacgauaguaa

SEQ ID NO: 2245543 - RNA, 14 nt, Yersinia pestis
agccucaugaauga

SEQ ID NO: 2245544 - RNA, 18 nt, Yersinia pestis
agccuccaagaugauaaa

SEQ ID NO: 2245545 - RNA, 16 nt, Yersinia pestis
agccucaauuuugccu

SEQ ID NO: 2245546 - RNA, 18 nt, Yersinia pestis
agccuaacuggcgguuau

SEQ ID NO: 2245547 - RNA, 15 nt, Yersinia pestis
agccuacgagagauc

SEQ ID NO: 2245548 - RNA, 21 nt, Yersinia pestis
agcgaucaccucuugcauacu

SEQ ID NO: 2245549 - RNA, 12 nt, Yersinia pestis
agcgcagacguu

SEQ ID NO: 2245550 - RNA, 15 nt, Yersinia pestis
agcgaccaucaugaa

SEQ ID NO: 2245551 - RNA, 15 nt, Yersinia pestis
agcgccacagucgcc

SEQ ID NO: 2245552 - RNA, 15 nt, Yersinia pestis
aucaaccaagacaua

SEQ ID NO: 2245553 - RNA, 14 nt, Yersinia pestis
aucaacggcaccac

SEQ ID NO: 2245554 - RNA, 19 nt, Yersinia pestis
aucaaaaaaggacacgauu

SEQ ID NO: 2245555 - RNA, 23 nt, Yersinia pestis
auauuugaacgugccccaaugau

SEQ ID NO: 2245556 - RNA, 18 nt, Yersinia pestis
auauuccccaccauugca

SEQ ID NO: 2245557 - RNA, 13 nt, Yersinia pestis
auaugauuaauca

SEQ ID NO: 2245558 - RNA, 20 nt, Yersinia pestis
auaugcagcauccagcucau

SEQ ID NO: 2245559 - RNA, 21 nt, Yersinia pestis
auaugacagaaaaaucacaug

SEQ ID NO: 2245560 - RNA, 14 nt, Yersinia pestis
auaucuucacucag

SEQ ID NO: 2245561 - RNA, 13 nt, Yersinia pestis
auaccauuuuagc

SEQ ID NO: 2245562 - RNA, 21 nt, Yersinia pestis
auagcuguuagccagauaggc

SEQ ID NO: 2245563 - RNA, 19 nt, Yersinia pestis
auaucaaugcaacuggcau

SEQ ID NO: 2245564 - RNA, 23 nt, Yersinia pestis
auaucagaaacaauaaauauccu

SEQ ID NO: 2245565 - RNA, 14 nt, Yersinia pestis
auaguaacgcuaau

SEQ ID NO: 2245566 - RNA, 21 nt, Yersinia pestis
auagucaucuuuccagcgaac

SEQ ID NO: 2245567 - RNA, 22 nt, Yersinia pestis
auagugaaaacguuaacugcag

SEQ ID NO: 2245568 - RNA, 16 nt, Yersinia pestis
aucagugcacggcagu

SEQ ID NO: 2245569 - RNA, 13 nt, Yersinia pestis
aucaugccagcaa

SEQ ID NO: 2245570 - RNA, 18 nt, Yersinia pestis
aucaucuuuaauaauaga

SEQ ID NO: 2245571 - RNA, 14 nt, Yersinia pestis
aucaucguaguaau

SEQ ID NO: 2245572 - RNA, 17 nt, Yersinia pestis
aucaucuacaacaucau

SEQ ID NO: 2245573 - RNA, 17 nt, Yersinia pestis
aucaucgggaacaggau

SEQ ID NO: 2245574 - RNA, 18 nt, Yersinia pestis
aucaucgcucaucgccaa

SEQ ID NO: 2245575 - RNA, 15 nt, Yersinia pestis
aucaucaccauucaa

SEQ ID NO: 2245576 - RNA, 16 nt, Yersinia pestis
aucaaguacacugcac

SEQ ID NO: 2245577 - RNA, 16 nt, Yersinia pestis
aucaauaaagccauuu

SEQ ID NO: 2245578 - RNA, 19 nt, Yersinia pestis
aucaauacccugccaccuu

SEQ ID NO: 2245579 - RNA, 16 nt, Yersinia pestis
aucaaucucuucaugg

SEQ ID NO: 2245580 - RNA, 14 nt, Yersinia pestis
aucaauaccuuacu

SEQ ID NO: 2245581 - RNA, 18 nt, Yersinia pestis
aucaauaccuuacugcau

SEQ ID NO: 2245582 - RNA, 16 nt, Yersinia pestis
aucacuggcauugcau

SEQ ID NO: 2245583 - RNA, 17 nt, Yersinia pestis
aucagaccuuuacagga

SEQ ID NO: 2245584 - RNA, 23 nt, Yersinia pestis
aucagccagccacugggcuaccc

SEQ ID NO: 2245585 - RNA, 16 nt, Yersinia pestis
aucagccgcaucacug

SEQ ID NO: 2245586 - RNA, 14 nt, Yersinia pestis
auccaucggccagu

SEQ ID NO: 2245587 - RNA, 14 nt, Yersinia pestis
auccagugccaaaa

SEQ ID NO: 2245588 - RNA, 18 nt, Yersinia pestis
auccccacuuguaccugu

SEQ ID NO: 2245589 - RNA, 15 nt, Yersinia pestis
aucccuaacgccgug

SEQ ID NO: 2245590 - RNA, 22 nt, Yersinia pestis
aucccgaaucaagcuacgccaa

SEQ ID NO: 2245591 - RNA, 13 nt, Yersinia pestis
auccccugccguu

SEQ ID NO: 2245592 - RNA, 16 nt, Yersinia pestis
aucauucgacggguuu

SEQ ID NO: 2245593 - RNA, 19 nt, Yersinia pestis
aucauggaagaccagauaa

SEQ ID NO: 2245594 - RNA, 18 nt, Yersinia pestis
auccaaaugcccauuagu

SEQ ID NO: 2245595 - RNA, 20 nt, Yersinia pestis
auccaaucauucugucauca

SEQ ID NO: 2245596 - RNA, 21 nt, Yersinia pestis
auccuugauggaaauacgcuu

SEQ ID NO: 2245597 - RNA, 15 nt, Yersinia pestis
auccuucauuucagg

SEQ ID NO: 2245598 - RNA, 19 nt, Yersinia pestis
auccucgagauguauccaa

SEQ ID NO: 2245599 - RNA, 16 nt, Yersinia pestis
auccucaccguucaag

SEQ ID NO: 2245600 - RNA, 23 nt, Yersinia pestis
auccggauuaaauucuaccuggc

SEQ ID NO: 2245601 - RNA, 14 nt, Yersinia pestis
auccgcugacauug

SEQ ID NO: 2245602 - RNA, 18 nt, Yersinia pestis
auccgcugacauugcccg

SEQ ID NO: 2245603 - RNA, 17 nt, Yersinia pestis
auccgcuacguucacug

SEQ ID NO: 2245604 - RNA, 22 nt, Yersinia pestis
auccggccauuuuuuaccauua

SEQ ID NO: 2245605 - RNA, 16 nt, Yersinia pestis
auccgaccacugacaa

SEQ ID NO: 2245606 - RNA, 15 nt, Yersinia pestis
auccgaucagccagc

SEQ ID NO: 2245607 - RNA, 14 nt, Yersinia pestis
auaauuaacagcau

SEQ ID NO: 2245608 - RNA, 19 nt, Yersinia pestis
auaauuauaaauuccuggc

SEQ ID NO: 2245609 - RNA, 15 nt, Yersinia pestis
auacaccgccaguau

SEQ ID NO: 2245610 - RNA, 18 nt, Yersinia pestis
auacaccuucgagagcua

SEQ ID NO: 2245611 - RNA, 23 nt, Yersinia pestis
auaaugauuauugaccagauagc

SEQ ID NO: 2245612 - RNA, 14 nt, Yersinia pestis
auaaugcaccaauc

SEQ ID NO: 2245613 - RNA, 13 nt, Yersinia pestis
auaauggcagccc

SEQ ID NO: 2245614 - RNA, 16 nt, Yersinia pestis
auaaucaacggcacca

SEQ ID NO: 2245615 - RNA, 15 nt, Yersinia pestis
auaaucagccugcug

SEQ ID NO: 2245616 - RNA, 22 nt, Yersinia pestis
auaaucacguucaacuuccuga

SEQ ID NO: 2245617 - RNA, 20 nt, Yersinia pestis
auaagccgcuaucacaucgc

SEQ ID NO: 2245618 - RNA, 22 nt, Yersinia pestis
auaaauggcuagauucaucggc
